United States Patent 7,630,836 (POLYNUCLEOTIDES) - sequence listing, part 8

SEQ ID NO: 6094 - DNA, 1518 bp, Streptomyces avermitilis
  CDS (1)..(1518)
gtgacatatccagggccgccccgaccggctcatgtctccgccacacccctcgcggaactggccggtcagatgggtgccgccacgccggagcgcgacgccgaggtcacggggatcacccacgactcgcgcgccgtccgccccggcgacctgtacgccgccctgcccggcgcccgcctgcacggcgccgacttcgtgacccaggcggccggcctgggcgccgtggccgtgctcaccgacccgacgggcgccgatcgtgccgccgccaccggtctgcccgtgctggtcgtcgacgacccgcgtggccggatgggcgagctggcggccacgatctacggccacccggggcgcgacctgctccagatcggcatcaccggcacctccggcaagaccacgaccgcctacctcatcgagggcggtctgaggacggtccgcagcaccgggctgatcggcaccgtcgagatgcgcatcggcgacgagcgcatcaagtccgagcgcaccacccccgaagccaccgacctccaggccctgttcgcggtcatgcgtgagcgcggggtcgacgcggtcgccatggaggtctccagccacgcgctggtcctcggccgggtcgacggctgcgtcttcgacatcgccgtcttcaacaacctcagcccggaacacatggagttccactccgacatggaggactacttccgggccaaggcgcagctgttcaccccgcaacgcagcaaactcggtgtggtcaacttcgacgacgagtacggccgcaggctggtcgaggaagccggcgtcccgatcgtcaccttctccgccgagggccatcccgacgccgactggcgcgcccaggacgtcgaagtcggccccatggactcgacgttcaccgtgatcggccccaaggaggagcggatcacggccaggtcgccgctcgccgggcccttcaacgtggcgaacaccctcgccgcgatcgtcgccctcgccgcggccgggctcgacccgcaggccgccgccgacggcatcgccgcggtgccgggcgtgccgggccgcctggagcgcgtggacgtgggccagccgtacctcgcggtcgtcgactacgcccacaagaccgacgccgtcgaatcggtgctgcgcgccctgcgcaaggtcaccgagggcaaactgcacatcgtgctcggctgcggcggcgaccgggacagaacgaagcggatgccgatgggcgccgccgcggcccggctcgccgacaccgccgtactgacatcggacaacccccgctcggaggaccccctcgcgatcctcgccacgatgctggcgggcgccgccgaggtgccctcgcacgagcgcggcgaggtccaggtcttcgagaaccgggcggccgccatcgcggccgtcgtcgcccgcgcacggccgggcgacaccgtgctggtcgcgggcaaggggcatgagcagggccaggacatcgccggtgtggtgcgtcccttcgacgaccgcctggtgctacgcgaagctatccagcagacccaggga

SEQ ID NO: 6095 - DNA, 1413 bp, Streptomyces avermitilis
  CDS (1)..(1413)
gtgatcgccctctctctcgccgagatcgcagcagtcgtcggcgggcagacgtacgacataccggatccggcggtacaggtcaccggaccggtcgtccgggactcccgtgaggtggagtccggcagcctcttcgtcgccttcgccggtgagcgcgtggacggccacgacttcgcggcagcggtcgtggaagcgggcgccgtcgccgttctggcgtcccgccccgtcggggtgcccgcgatcgtcgtggacgacgtccagacggcgctcggggccctcgcgcgccatgtcgtggagcgcctcggcgcgaccctcgtggcgctcaccggctccgcgggcaagaccagcaccaaggacctgatcgcccaggtgctgagaagcaaggcgccgacggtcttcacgcccggctcgctcaacaacgagatcgggctgccgctcaccgccctcagcgccaccgaggagacgaagttcctcgtgctggagatgggcgcccgcggcatcggtcacatccgctacctcgcggatctcacgcctccgaaggtcggtctcgtcctcaacgtcggcaccgcccacatcggcgagttcggcggccgcgagcagatcgcgcaggccaagggcgagctcgtcgagggtcttccgccggcggaggacggcggcgccgcgatcctgaacgccgacgatccgctcgtccgcgccatggcgtcccgcacgaaggcgcgcgtgatcctcttcggagagtccgacgaagcggacgtacgcgccgagaacgtccgtctcacggccggcggacagccctcgttcagccttcacacaccctccgggtgcagcgatgtgaccatgcgcctgtacggtgagcaccacgtgtcgaacgcgctcgccgcggccgccgtcgcccatgagctgggcatgtccgcagacgagatcgcccgtgcgctctccgaggcgggctccctctcccgttggcggatggaggtcaccgagcgcccggacggcgtgacggtcgtcaacgacgcctacaacgcgaaccccgagtccatgcgagccgccctgcgcgcgctcgcggcaatgggcaaggggcggcggacctgggcggtgctcggcaagatggccgagctcggggacgaggcgctcgccgagcacgacgcggtcggacggctcgccgtccggctcaatgtcggcaagctcgtcgcggtcgggggcagggaagcgtcctggctgcaactgggcgcatataacgagggttcgtggggtgaggagtcggtgcacgtgtccgacgcacaggcggctgtcgacctgttgcgcagcgagctgcgcccgggggacgtcgttctcgtgaaggcgtcccggtcggtcgggctggagagcgttgcacaggcgctgctcgagaccggtgccgagggtgaggttgtcgcccga

SEQ ID NO: 6096 - DNA, 1071 bp, Streptomyces avermitilis
  CDS (1)..(1071)
atgatgaagcagatcctgttctcaggagtcattggtctcttcctgaccctggtcggcactccgctgctgatcaagctgctcgcccgcaagggctacgggcagtacatccgtgacgacggcccgcgcgagcatcacagcaagcgcggtacgccgaccatgggtggtatcgccttcatcctggcgacgatcatcgcgtacttcatgtccaaggtgatcacgggctacacgccgaccttctcgggtctgctggtgctcggcctgatggccggcatgggcctggtcggcttcctggacgactacatcaagatcgtcaagcggcgctcgctcggtctgcgggccaaggcgaagatggccggtcagctgatcgtcggtatcgccttcgcggtcctcgcgctgcagttcgcggacaaccacggcaacaccccggcctccaccaggctctccttcgtggaggacttcggctggaccatcggcccggtgctgttcgtgatctgggccctgttcatgattctcgccatgtcgaacggcgtgaacctgacggacggtctggacggtctcgccaccggcgccgcgaccatggtcttcggcgcgtacacgttcatcggcgtctggcagttccaggagtcctgcgccaacgcgcagaccctcaccaacccggccgcctgctacgaggtacgcgacccactcgacctcgcggtcgtcgcctccgccctcatgggcgcctgcttcggcttcctgtggtggaacacgtcgcccgccaagatcttcatgggtgacaccggatccctcgcgctcggcggcgcgctcgccggtctcgcgatctgctcccgcaccgaactgctggtcgcgctcctcggcggcctcttcgtcctgatcaccatgtcggtcgtcatccaggtcggctccttccggctcaccggcaagcgggtcttccgaatggcgccactccagcaccacttcgaactcaaggggtggtccgaagtccttgtggtggtccgcttctggatcatccagggcatgtgcgtgatcgtcggtctcggcctcttctacgcaggatgggcagccaagaag

SEQ ID NO: 6097 - DNA, 1401 bp, Streptomyces avermitilis
  CDS (1)..(1401)
gtgaccaactggcagggcaagaacgtcaccgtcgccgggctcggcgtctccggtatcccggcggcccgcgtgctgcacggcctcggcgcggtcgtcacggtcgtcaacgacggcgacgacgagcgctcccgggcccaggccgcggatctggaggcgctcggcatcaccgtgcgcctcggtgacggcgcgaccctgcccgagggcaccgagctcatcgtcaccacacccggctggcagccggacaagccgctgttcgccgcggccgccgaggcgggcgtcccggtctggggcgacgtcgaactcgcctggcggctgcgcggccccggatccgcgccctggctcgccgtcacgggcaccaacggcaagaccacgaccgtgcagatgctcgcctcgatcctgacggccgcgggcctgcgcacggccgcggtcggcaacatcggcgtctcgctcctcgacgcggtcctcggcgaggagacgtacgacgtcctcgcggtcgaactctccagctaccagctgcactgggcgccctccctgcgcgcccactccgccaccgtcctgaacatcgcgcccgaccacctcgactggcacggctccatggaggcgtacaccgccgacaagggccgtatctacgagggcaatcgggtcgcctgcgtctacaacgtggccgacaaggccaccgaggacctggtgcgcgcggcggacgtcgaggagggctgccgggccgtcggcttcacgctgggcacgcccggaccgtcccaactcggcgtcgtggagggcattctggtcgaccgcgccttcgtcgaggaccggcagaagaacgcccaggagctggccgaggtggcggacgtgcatccgcccgcgccgcacaacatcgccaacgcccttgcggcagcggccctggcgcgcgccttcggggtgcccgcctcggcggtacgggacggactgcgggccttccgcccggacgcccaccgcatcgcgcacgtcgccgacgtggacggggtcacctacatcgacgactccaaggccaccaacacgcacgccgcggaagcctctttggcggcgtacgggtccatcgtctggatcgccggcgggctcgccaagggcgcctccttcgacgagctggtggccaagtcggcacagcggctccggggtgtggtgctcatcggtgcggatcgtgcgctgatccgtgaagcccttgcgcgacacgccccggaggtacccgtcgtcgacctcgaccggaccgacactggggcgatgcccgcggctgtccaggaggcgcggcggctcgccgtcgccggcgacacggtactgctggccccggcctgtgcctcgatggacatgttcgccaactacaacaagcgcggtgacgcgttcgcggaggcggttcgcggactcggagcc

SEQ ID NO: 6098 - DNA, 1347 bp, Streptomyces avermitilis
  CDS (1)..(1347)
atgcccactagccgtaccggccggccccccgtccagcgtgccaccaggcggcccgccgcgtcccgctcccggcgcgagaaccccgtacagagcctctaccaccgcgccaggcgcgcctgggaccggccgctgaccgcctactacctgatcctcggcagcagcctcctgatcaccgtgctcggtctggtgatggtctactcggcctcgcagatcaccgcgttgcagatgtcgctgcccggttcgtacttcttccgcaagcagttcctggcggcctcgatcggcaccgtactgctgctgaccgcctcgcggatgccggtgaggctgcaccgggcgctggcgtacccgctgctggccggcgccgtcttcctgatgatcctggtgcaggtgccggggataggcgtggcggtcaacggcaaccagaactggatctccgtcggcggcccgttccagcttcagccgagcgagttcggcaagctcgccctcgtgctgtggggcgccgatctgctcgcccgcaagcaggacaagcggctgctgacccagtggaagcacatgctggtgccgctcgtcccggcggccttcatgctgctcgggctgatcatgctcggcggcgacatgggcacggccatcatcctgaccgcgatcctcttcgggctgctgtggctggcgggggcgccgaccaggctgttcggcggtgtgctggccatcgccacgaccatcgggatcatcctcatcaagaccagcccgaaccgcatggcccgcctcgcctgcatcggcgccaccgatcccgggccgggcgaccactgctggcaggccgtgcacggcatctacgcgctcgcctcgggcggaatcttcggttccgggctcggcgccagtgtggagaaatggggccaactccccgaagcgcacaccgacttcatcttcgccatcaccggggaggaactcggtctggcggggacgctgtcggtgctcgccctcttcgcggctctaggctatgcgggtatccgcgtggccggacgcacggaggaccccttcgtgaggtacgccgcgggaggtgtgaccacctggatcacggctcaggccatgatcaacgtaggtgcggtgctcggtctgctgccgatcgccggtgtcccgctcccgctgttctcctacgggggttccgccctgctgccgaccatgttcgccatcgggttgctgatcgccttcgcgcgcgacgagcccgctgcgcgggccgcgcttgcgatgcggcaacctcgctttggtagaaagcgggctggaggtcctgcggggcctcggagatggaaaacgatgagacggcgtgcctcggcggcgcgttcgtccggagagcgg

SEQ ID NO: 6099 - DNA, 1089 bp, Streptomyces avermitilis
  CDS (1)..(1089)
gtgcatgtcgtactcgccggtggggggaccgccggccacatcgagcccgcgctcgccctcgcggacgccctgcgcaggcaggacccgaccgtggggatcacggccctgggaacggagcgcggcctcgagacccgtctcgtacccgagcgcggttacgacctcgcgctgatccccgccgtcccgctgccacgcaagcccacgcccgagctgatcaccgtccccgggcggctgcgcggcacgatcaaggcggccgagcagatcctggagcgcaccaaggcggacgccgtggtcggcttcggcggctatgtcgccctgcccggctacctggccgccaagcggctcggtgtgccgatcgtcatccacgaggccaacgcccgccccggcctggccaacaagatcggctcgcggtacgcggcccaggtcgccgtgtccaccccggacagcaagctgcgcggcgcccgctacatcggcatcccgctgcgccgctccatcgccaccctcgaccgggccgccgtacgccccgaggcgcgcgccgcgttcggactcgacccgaacctgccgacgctgctggtctccggcggctcgcagggcgcccgccggctcaacgaggtggtccagcaggtcgcgccgtacctccagcaggccggcatccagatcctgcacgcggtcggcccgaagaacgaaatgccgcaggtccaccagatgccggggatgcccccgtacatcccggtaccgtacgtggaccggatggacctcgcctacgccgctgccgacatgatgctctgccgcgcgggcgcgatgaccgtcgccgaactctccgccgtcggactcccggccgcctacgtcccgctgcccatcggcaacggcgaacagcggctgaacgcccagccggtggtcaaggccggcggcggcctcctcgtcgacgacgcggaactgacacccgagtgggtccagggcaacgtcctgcccgtcctcgccgacccgcaccggctgtacgagatgtcccgcgccgccagcgagttcggccgtcgggacgccgacgacctgctcgtcggcatggtgtacgaggcaatcgccgcacgccaccgc

SEQ ID NO: 6100 - DNA, 789 bp, Streptomyces avermitilis
  CDS (1)..(789)
gtggccggaccgacgaccgccgagcgcggcgaacggcagaagctggagtccggcccgccccggctgccccgcctgcggccccggccccgtacgttcatcatccttttgtgtgcggtggtgttggcgggcgccggatccgtgtgggtcctctacggttccccgtggctgcgcgtggagcgtgtgtccgtctccgggacacgggtcctgacggagggtcaggtgcgcgaagcggccgatgtgtcgctcggatcgcccctgatttccgtcggtatcgacgagattgaggcgcgattgcgccagaaattgccccgaattgactcggttgatgtcgtccgttcctggcctcatggaatcgggctgaaagtgaccgagcgcactccggtcctgattgtcgaaaactccggaaacgggggaaagtacgtcgaagtggacgccaagggagtgcgattcgcgacggtttcggacgctccgaagggcgtgcccgtgctggaattggccgtctcccggtcggcggcggccctgcggcgcttccccgaggcccggctggtgcgggaggcggtccgggtcgccggggacctcccggccgccgtcgcccgcgacaccggcaccgtcaaggtccgctcgtacgactccatctcgctggagttgagcggcggtcgcaccgtgatgtgggggagcggcgagaagggcagcgcgaaagccaggacgctcaccgctctcctgaaagcctctcccggggcgcggcacttcgacgtgagcgtgcccactgcccctgcgtcatcagggagt

SEQ ID NO: 6101 - DNA, 1188 bp, Streptomyces avermitilis
  CDS (1)..(1188)
gtggcagcaccgcagaactacctcgcagtcatcaaagtcatcggtgtcggcggcggtggtgtcaatgccatcaaccggatgatcgaggtcggtctcaagggcgtcgagttcatcgccatcaacacggacgcgcaagctctgttgatgagcgacgccgacgtcaaactcgacgtcggtcgcgaactcacccgcggactcggcgccggagccaacccggctgtcggccgcaaggcagccgaggaccaccgcgaggagatcgaggaggtcctcaagggggccgacatggtcttcgtgacggccggggaaggcggcggcaccggcaccggcggcgcgcccgtcgtggccaacatcgcccgctcgctcggcgccctcaccatcggcgtggtcacgcgcccgttcactttcgagggacggcgccgcgccaaccaggcggaggacggcatcgccgaactccgcgaagaggtcgacaccctcatcgtcatcccgaacgaccggctgctgtccatctcggaccgccaggtctcggtcctcgacgccttcaagtcggcggaccaggtcctgctctccggtgttcagggcatcaccgacctcatcaccacgcccggtctgatcaacctcgacttcgccgacgtgaagtccgtgatgtccgaggccggttcggcgctcatgggcatcggctcggcccgcggcgacgaccgcgcggtggcggcggccgagatggcgatctcctcgccactcctggaagcctccatcgacggcgcccgtggcgtcctgctctccatctccggcggctccgacctcggcctgttcgagatcaacgaggcggcccagctggtgagcgaggccgcgcaccccgaggccaacatcatcttcggcgcggtcatcgacgacgccctcggcgacgaggtgcgcgtcaccgtcatcgccgccgggttcgacggcggccagccgccttcgaagcgggacaccgtcctcggctcgtcctccgccaagcgcgacgagcccacgccggcccggcccgccgagagccgcccgtccttcggctcgctcggcagcgtcacgccgaaggaggccccggagcccgcgccggagccggtgaacgaactcccggtctcgccgccggtcccgccgtcccggacctactcggacagcgcggccgaagagctggacgtgccggacttcctgaag

SEQ ID NO: 6102 - DNA, 726 bp, Streptomyces avermitilis
  CDS (1)..(726)
gtgataggacagcgcgacaccgtgagcggcgcgcacttcgccttcaccgaccggtggggcggggtgagcgccgttccgtacgaggagctcaacctcggcggagcggtcggcgacgactccgacgccgtacgtaccaatcgtgaactggccgccaagtccatggggctcgacccggcccgggtggtctggatgaaccaggtgcacgggccggacgtggccgtggtcgacgagccgtggggggcgcggcccgtggccgaggtcgacgcgatcgtcacccggcgccgcggactcgccctcgccgtactcaccgccgactgcacgccggttctgctcgccgaccccgtcgccggggtcgcggccgccgcccacgccgggcggcccggcatgatcgccggagtcgtgccggccgccgtcgaggcgatggtggagctgggtgccgacccgtcccggatcgtcgcccgtaccggccccgccgtctgcggccgctgctacgaagtgccggacgcgatgcgcgccgaggtcgcggccgtcgaacccgcggcgtacgccgagaccagttggggcacgcccgcggtggatgtgagcgccggcgtgcacgcgcagctcgaacggctcggggtgtgcgaccgggagcagtcgccggtgtgcaccctcgaatccggtgaccacttctcgtaccgccgcgaccgcaccaccggtcggctcgcgggctatgtctggctggac

SEQ ID NO: 6103 - DNA, 717 bp, Streptomyces avermitilis
  CDS (1)..(717)
atgacggaccgtaaggatcaactcgccgcaaacctggcgaaagtggaggaccgcatcgcggccgcgtgtgcggccgccgggcgtgggcgggaggaggtgaccctcatcgtggtcaccaagacctaccctgcgatcgatgtgcggatcctgtcggaactcggtgtgcgcgatgtcgccgagaacaaggaccaggacgcggcgcccaaggccgccgagtgctcggatctgccgctcaagtggcactttgtcggtcagttgcagaccaataaggtgcgctctgtggtgggttatgccgatgtcgtgcaatccgtcgatcgtcccaagcttgtcacggctctgtcgaaggaagccgtgcgcgccgggcgcgaagtgggctgcctgatccaggtcgcgctggatgctcaggagtacggacggggagagcgcggcggtgtgggacccggcggactcgaagagttgggcgacctcgtcgccgaggctccgggcctgaggctggacgggctgatgaccgtcgcgccgctcaccggggagtacgcgggtcgccaacgggcggcgttcgaccggttgatggatttgtcgactgacctgcgccgagcccatccggctgcgaacatggtttccgcagggatgagtgcggacctcgaggaggccgtggcggccggggcgacacatgtgcgcgtcggcactgcggtactcggcgtccgccccaggctcggg

SEQ ID NO: 6104 - DNA, 639 bp, Streptomyces avermitilis
  CDS (1)..(639)
atggccggcgcgatgcgcaagatggcggtctacctcggcctcgtggaggacgatgggtatgacggcaggggattcgatcccgacgacgacttcgagccagagctcgacccggagcccgagcgggaccgcaggcggcatgaaccgccacaccagtcacaccaggcacttcaccctcaacgggacgaatcggtacgagtggtacagccgccgatgcagcgggatcctgtgccgcattccgcttcgctccccgcggaatccgtacggcctgcacgaatcgcccccgtggcatccatcacacaagaacgtcaaagcctggagaagaacgcaccggtgatcatgcccaaggtcgtgtcggaacgggagccttaccggatcaccacgctccatccgcggacctacaacgaggcccgtaccatcggggaacacttccgcgaaggcaccccggtgatcatgaatctgaccgagatggatgacactgatgcgaagcgacttgtcgactttgcggccggtttggtgtttggtcttcacggcagcatcgagcgggtgacgcagaaggtgttcctgttgtcgcctgctaacgtcgatgtcacggcggaggacaaggcccgcatcgcagagggcgggttcttcaaccagagc

SEQ ID NO: 6105 - DNA, 282 bp, Streptomyces avermitilis
  CDS (1)..(282)
atgagcgtggtcttcgatgtcatctacatcgcgctgatgtgtttcctcatcgtgctgatcttccggttggtcatggactacgtcttccagttcgcccgctcatggcaacccggcaaggcgatggtggtcgttctggaggccacctacactgtcactgatccaccgctcaagcttctgcggcggttcattccgccgctgcgtctcgggggcgtggcgctagacctgtccttcttcgtactgatgatcatcgtctacatcctgatctccgtcgtgagccggctg

SEQ ID NO: 6106 - DNA, 1224 bp, Streptomyces avermitilis
  CDS (1)..(1224)
atgccgttgacccccgaggacgtgcggaacaagcagttcacgaccgtccgcctccgagaaggctatgacgaggacgaggtcgatgccttcctcgacgaggtcgaagccgaactgacccgcctgctccgcgagaacgaggacctgcgcgccaagctggccgcggccacgcgtgccgctgcgcagaaccagcagcagggcatgcgcaagccacccgagcagcaacaggaccagcagcagggcatgcgaggtcccggttctccggtgcccgccgggatatcgggcccgccgcagcagcagcagatgggtggccccatgggcggcccgccgcagctgccgagcggcgccccgcagctgcctgccggtcccggtggcggccagggtggcccgcagggccccggcccgatgggtcagggtcagatgggtcagggcccgatgggccagggtcagatgggccagggaccgatgggccagggccagatgggccagggccagatgggtcagggtccgatgggccagggccccggccagatgcagggccagatgcagcagatgggcggtcccatgggcggtcccatgggtggccccatgggcggtcatggcccgcagatgtcgcagcccggtcagggccccggcggcgacagcgccgcgcgtgtgctctcgctggcccagcagaccgccgaccaggcgatcgccgaggctcgttccgaggccaacaagatcgtcggcgaggcccgtagccgcgccgagggtctggagcgcgacgcccgtgccaaggcggacgctctcgagcgggacgcgcaggagaagcaccgcgtagcgatgggctccctggagtccgctcgcgccacgctggagcgcaaggtcgaggacctgcgcggcttcgagcgcgagtaccgcacgcggctgaagtcctacctggagtcgcagctgcgtcagctggaaacccaggccgacgactcgctggctccgccgcggactccggcgaccgcgtccctgccgtcgtcctcgccgtccatggctccggcgggcgcgagcgccccgtcgtacggcggcaaccagacgatgggtggccctccggctccggccgcgccttcctatggcggccagcagcagatgtccccggccatgacccagccgatggccccggtccggccgcagggcccgtcgcccatgcagcaggcgccttcgccgatgcgcggtttcctcatcgacgaggacgacaac

SEQ ID NO: 6107 - DNA, 3141 bp, Streptomyces avermitilis
  CDS (1)..(3141)
atgaaaccgccgcagtaccgccaggtgcccgcccaggtcgacctgcccgccctcgagcacgccgtgctcgacttctggcgcgagcagaagatcttcgccaagagcctcgagcagtccgagggccgccccgaatgggtgttctatgagggcccgcccacggccaacggcatgccgggcgcccaccacatcgaggcccgcgtcttcaaggacgtcttcccccgcttccgcaccatgcgcggctaccacgtggcccgcaaggccggctgggactgccacggcctcccggtggagctggcggtggagaaggagctcggcttcagcggcaagcaggacatcgaggcgtacggcatcgccgagttcaacgccaagtgccgcgagtccgtgacccgccacaccgacgccttcgaagagctcacgtcccgcatgggctactggaccgacctgaacgacccgtaccgcacgatggaccccgagtacatcgagtccgtgtggtggtcgctcaaggagatcttcaacaaggggctgctggtccaggactaccgcgtcgccccgtggtgcccgcaggacgagaccggcctgtcggaccacgagctggcacagggctacgagacgatcgtcgacccctccgtctacgtccgtttcccactcacctccggtccgctggccggccgggccgcgctcctggtgtggacgacgaccccgtggacgctggtctccaacaccgccgtcgccgcgcaccccgacgtcacctacgtggtcgcgacgaacggcgaggagaagctcgtcgtcgccgagccgctcgtcgagaaggccctcggtgagggctgggagaccaccggcgagaccttcaccggcgccgagatggagcgctggacgtatcaacgtccgttcgaactggtcgagttcccggcacccgcccactacgtggtgaacgccgagtacgtcaccaccgaggacggtacgggtctggtccaccagtcccccgccttcggtgaggacgacctcaaggtctgccgtgagtacggcctgccggtggtgaaccccgtccgcacgaacgggaccttcgaggaggacgttcccctcgtgggcggtgtcttcttcaagaaggcggacgaaaagctcaccgaggacctccagaaccgcggtctgctcttcaagcacatcccgtacgagcacagctacccgcactgctggcgctgccacaccgcgctcctctactacgcgcagccgtcctggtacatccgcaccacggccgtcaaggaccgcctcctccaggagaacgagaagaccaactggttcccggagtccgtcaagcacggccgcttcggtgactggctgaacaacaacgtcgactgggcgctgtcccgcagccgcttctggggcaccccgctcccgctgtggacctgcgaggagggccacctcacctgcgtcggctcccgcgcggagctctccgagctgacaggcaccgaccagtcgaacctggacccgcaccgcccgttcatcgacgcggtcaccttcgcctgcccccaggacggctgcgggcggacggcgacccgcgtcccggaggtcatcgacgcctggtacgactcgggttcgatgccgttcgcgcagtggggctacccgtacaagaacaaggagctcttcgagagccgctaccccgcgcagttcatcagcgaggccatcgaccagacgcgaggctggttctacacgctgatggcggtcggcacgctcgtcttcgacaagtcctcgtacgagaacgtggtgtgcctcggccacatcctcgccgaggacggccgcaagatgtccaagcacctgggcaacatccttcagccgatcccgctgatggaccagcacggagcggacgcggtgcgctggttcatggcggcgggcggctccccgtgggcggcgcgccgcgtgggccacggcaccatccaggaggtcgtccgcaagacgctcctcacgtactggaacacggtcgccttccaggccctgtacgcgcgcacgtcgggctgggcgcccagcgaggccgacccggccccggcggaccgcccggtcctcgaccgctggctcctgtccgaactccacgcgctcaccgaccaggtgacgcaggccctggagtcgtacgacacccagcgcgccggcaagctcctgtccgcgttcgtcgacgacctgtccaactggtacgtacgccgctcccgtcgccgcttctggcagggcgacaaggcggcgctgcgcaccctgcacgaggtcgtcgagacggtcacgcgcctgatggccccgctgaccccgttcatcaccgagcgggtctggcaggacctggtgttcccggtgacgccgggcgcccccgagtccgtacacctggcgtcgtggccggaggcggacctgtccgccatcgacccggagctgtcgaagcagatggtgctcgtccggcggctcgtcgagctcggccgtgccacgcgcgcggagtcgggcgtcaagacccggcagccgctgtcgcgtgcgctggtcgcggtggccggcttcgaaacgctcgaccgtgagctgcacgcgcagatcacggaagagctgaacgtcacatccctggccgcactgagcgaggtcggcggctcgctggtcgacaccaccgccaaggcgaacttccgcgcgctcggcaagcggttcggcaagggcgtccaggccgtcgcgaaggctgtcgcgggcgccgacgcggccgcgctgtcgctggccctgcgcgagggcacggcgtcggtcgaggtcgacggcgagacggtgacgctcgccccggacgaggtgatcatcaccgagactccgcgcgagggctggtcggtcgcgtccgactccggtgcgacggtcgccctcgacctggagatcacggaggaactgcggcaggcgggcctcgcccgtgacgcgatccgtctgatccaggaggcccgcaagaacagcggcctcgacgtggcggaccggatcgcgctccgctggacctcgacggacccggaggtgatcgcggcgctgtccgagcactccgagctcatcgccgacgaggtcctcgccacggacttcgcccagggtgaggcggacgacacatacggggagccgttcaccgacgagtccctgtcgctgacgttccgcctgcgcaaggcg

SEQ ID NO: 6108 - DNA, 1068 bp, Streptomyces avermitilis
  CDS (1)..(1068)
atggacgccggaggatcgggaacggagggcacggcggaggccgcgggtgcttcctcggctgcgggtgctgcgggtgctgcgggtgcttcgggggcgaggaagaccgggggaacgaagtccgccgcgaagaagaccacggtcgccgcgtcggccggggccgccacaaaagccgcggcgaagaagatcacggcgaagagaaccgcggtgaagaagaccacggtgaagaagagcacggcgaagaagtccacggtgaaggaaaccggcgtgcggaagaccgtcgcccagaaggaggcggcggcctcgaaggtggctccttcgaagaggccggacgaggaggaaggccccgagaggccggcggcgaagaatgcggccgggacgaaggcggccgggaagaagacagcggagaaggccgccgtcgcgaggaagaccgttgccaggaagagtgccgcagcgaagggcggtaccacggaggccacctccccgaagagcacctccacgaagagcacctccacgaagagtgcggccaagaagagcactgccaagaacgcgggcgcggccgcggccgcgaagcagacgggagccacgacagtggttgcgaagaagactcctggcacggccacggcggcgcagaaccccaccgcggtccccaaggcgcggatcgccgcggtggagcccggcgagctggccgtgcgccccggcgaggacccgtggacccccgaggaggtcgcggaggcacgcgccgaacttcagggcgaggcgatccggctgagcaccgagatctcctcgtcggaggcggcgctcgtcggtctgatgcgggactccggggacggtgcgggcgacgaccaggcggacaccggcaccaagaacatcacgcgcgagcacgagatggctctcgccgccaacgcgcgcgagatgctcgaacagaccgagcgggcgctggagcggctcgatgccggtacgtacggcctctgcgagaactgcggcaaccccatcggcaaggcgcgtatgcaggccttcccgcgggccacgctgtgcgtcgagtgcaagcagaagcaggaacgccgttac

SEQ ID NO: 6109 - DNA, 600 bp, Streptomyces avermitilis
  CDS (1)..(600)
gtggcagaggcggagcgcatcatcggtacgccggatatcccagaggcggcgggagccgaaccggagcaggccgacggtgagagtggcggtgccggtgccggcaccgagcggcccaagggcaggcgccggatcgccgtcctgttcgccgtcgccgcgctcgcgtacgccttcgacctcgtcagcaagctgatcgtggtcgcgaagctggagcaccacgcgccgatcgagatcatcggggactggctgaggttcgaggcgatccgcaacgcgggtgcggccttcggcttcggcgaggccttcaccgtcatcttcacggtgatcgcggcggccgtgatcgtggtgatcgcccgcctcgcgcgcaagctctacagcctgccctgggcgatcgcgctcgggctgctgctcggcggtgcgctgggcaacctcaccgaccggatcttccgctcgcccggtgtcttcgagggcgcggtcgtcgacttcatcgcgcccaagcacttcgcggtgttcaacctggcggactcggcgatcgtctgcggcggcatcctgatcgtgctgctgtccttccgcgggctcgacccggacgggacggtccacaaggac

SEQ ID NO: 6110 - DNA, 942 bp, Streptomyces avermitilis
  CDS (1)..(942)
gtgagcacgattcccgagatccgtaccctgcccgtgccggacggcctggagggcgagcgcgtcgacgccgccatttcccgcatgttcggcttttcccgcacgaaggcggccgagctggccgcggcaggcaaggtgctggtcgacggcacggtggtcggcaaatccgagcgcgtgcacggcggcgcctggctcgaggtggagatgccgcaggcccccgcgcccgtgcagatcgtcgccgagccggtcgagggcatggagatcgtgcacgacgacgacgacgtgctcgtgatcgtcaagccggtcggcgtggccgcgcacccgtcgcccggctggtcgggcacgaccgtcatcggcggcctcgccgccgccgggtaccggatctccacctcgggcgccgccgagcgccagggcatcgtgcaccgcctcgacgtgggcacgtcgggcctgatggtggtcgccaagtcggagtacgcgtacacgtcgctgaagcgccagttcaaggagcgcacggtcgacaagcgctaccacgcgctggtgcagggccaccccgacccgaccagcggcacgatcgacgcgcccatcgggcgtcatccgaaccacgactacaagtgggcggtcacggccgagggcaagccctccgtcacgcactacgacctgatcgaggcgttccgcgcggcctccctgctcgacatcaagctggagaccgggcgcacccaccagatccgcgtccacatgtcggcgcaccgccacccgtgcgtgggcgacctgacgtacggcgccgacccgacgctcggcaagcgactcggcctcacccgccagtggctgcacgcggtgcgcctcggcttcgagcaccccggagacggcgagtgggtcgagttcgcctgcgactatcccgccgacctccagcaggctctggacaaggtgcgggaggaaagctacgca

SEQ ID NO: 6111 - DNA, 489 bp, Streptomyces avermitilis
  CDS (1)..(489)
gtgccacgggcggtttccttacagcgtgcgccgcatcgcccgatgcggtatccccgcctcgaggaactccggtccgtacaccacgtaccccagccgctcgtagaaaccgagggcgtgggtctgggcgtgcaggtcgaccgccgcgaggccacgcgcgcgtgccgcgtcctcgatggcgcggaccagcgccgcgccgacacccaggccgcgcgcgtcctgcgtcacggcgagccgcccgagggagcccacggtgaggtcgccgtcggtcttggcggcggccgcctccccgtgcagcagccgcccggtgccgagcggcaccccgtcgtcccggaccgccagcacatgcacggctccggcgtcgtacgcgtcgtactcgatgtcctgcgggacgcgctgctcgacgacgaagacctccttgcggaccgcgaagcacgcctcacggtcggcagtaccctccgcgacccgcacctcgtacgccgcgctcatgcg

SEQ ID NO: 6112 - DNA, 1593 bp, Streptomyces avermitilis
  CDS (1)..(1593)
gtgctgaccgtggatcagttggccctgttgttcgtgcttctcctcggggccgtggtgagtgtcccggtgggagaccggttcgggctgcccgcgccggtgctgatgacgctgctcgggatcggcctcgccgtggcggacttcgtgccgaacgtggacatcccgcccgatctgatccttcccgcgctgctgccgccgctgctctacgccgcggtgcggcggacgtcgtggagacagttcaccgccaacaagcgcccgatcttcctgctggctgtggcgctggtgttcgtcaccacggcggtcgtggcgctcgtcgccggcgcgatcgtgccggggctgccgatcgcggccgccgtggcgctcggtgcgctggtcgcgccgcccgacccggtcgcggcgaccgccgtcgcggggcagctggggctgccgcggcgactggtgtcgatcctggagggcgaggggctcttcaacgacgtcacggcgatcgttctctaccacgtcgcgatcgccgccgccgtcagcggaacgttctccctgccgaacgccgtgctcgacctggtgctgtccgccgtggtcgcggtcgccgtcgggctcgcgctcggctgggccgcgaacaggctgatggacctgctcgacgacgtcacgctgcagatcggtctgacgctgctggtgccgtacgcgtcgtacgtcctggccgaggaactgcacgggtccggggtgctcgcggtgctcaccaccgcgctgttcctcgcggagtacgccaccgacgcggacgacgtgatgacacggctcgccgggcacacgttctggaacgtggtggacaccctcgtcaccggtgtcgcgttcgggctgatcgggctcgaactgcacaacgccctcaggacggcgtccgggcggtggggcgagatgctgggctgggcggcggcgatcgtggccgtggtggtgctcgtacggctggcgtatctgctgccggcgacctggctgaccaaacggctgcacgcgaaacgggactacgacgaggagatcccgacctcgtggcgcgagaccgtcgtgatgtggtgggccgggatgcggggggtggcgtccgcggccctggcgctggccattccgctgaagatggacgacgggtcgccgtttccggaccgggacgagatcgtcttcatcgcgttcggagtgatcatggggacactggtgttgcaggggctgacgctgccgtggctggtgaagaggctgggggtgcgggccgacacggggagcgagaaggcgttcgagaaggcgttggccattcgggcggcgaaggcggcgaagcggcggctgcgggagatcgaggacgtggaggagttgccggaggagctgtccgagcagttgttgcggcgggcgttcgacatcggggcgcggatcagtcctgatctgggggacgaggagcggcgggaggcgcacgagcagcgggtccggcggatgaagagggtgcggcggattcagggggagatgatgagtgcggcgcggcatgaggtgctggccgcgcggagcgagccgggggcggatccggagattgtggaccgggtgttgcggcatctggatgtgcggagtttgcgt

SEQ ID NO: 6113 - DNA, 738 bp, Streptomyces avermitilis
  CDS (1)..(738)
atgactcgcaacgtggtgatcagcggtggtggtacggggatcgggctcgcggcggcccgggcttttgccggggacggggaccaggtgctgctgctcgggcggcgggcggacgtgttggagaaggcggaggtgccgggcgcgctcacctacgcggccgacctgagtgatccgcacggcgtgcgcggggtcgcggagttcgtcgcggccgagttcggcaccgtcgatgtgctcgtccacagtgccggaggggccgggaatctggagcccaggacggagaccgacgacccgctcgaagccgtcgcccacaactggaccgtgaacttccggctcaacgtgctgaccgccgcgctgctcacggaggcgttgcgggagcggctcgcctcgccgggcgggcggctgctgttcctcagctccatcgccgcctaccgggggtccgggagcggggcgtacgcggcggccaaggccgcgctgcatccgtacgccttcgatctggcgcgggagttggggccgcggggcgtcaccgtgaacgtggtggcgcccgggtatgtcgaggacaccgggttcttcggcggggagatcgagcaggcgcggcgtgagcggctcgtcgccgagacctcgaccggccgcgcgggtacgcccggcgacatcgccgcgacactgcactggctggcgtcaccgggcgccgcgcacatcaccgcacaggtgatccaggtcaacggaggagcggaacgcgggcat

SEQ ID NO: 6114 - DNA, 1101 bp, Streptomyces avermitilis
  CDS (1)..(1101)
atggagaacgtactgcgaccgctgatcgtcgtcggcggctcgctcgtactcacgctggtcgtcggctgggccgtcgaccagctgttgcgacgggccgacggccgacaccatgagactcccctgtggggcctgctgcgccgcggcggcgtgccgttccagctcgtgctgtgctcggccctgttcagagggtcgtacgaccaggcgaagctgctggaggaccaccggatcggcataggccgggctctgacgctcgtcctcatcggctcgacggcctggctggtggtccgcatcgctgcggcgatcgtcgagacctcgtactggcgctacgcggccgcccaccgcgatcccgcccgggtccgccgcgtgcgcacccaggtgtcgctgatccagcgggtggtctccgccatcgtgggcgtggtggccgtcgccgcgatgctgctcaccttcccggcgatgcgggcggccggcgcctcgctgctggcctcggccggcatcctgggcatcgtcgccggtgtcgccgcccagtccacgctcgccaatctcttcgccggactgcagatcgcgttcggcgacatggtgcggctcggtgacacggtcgtggtggacggcgagtggggcacggtcgacgagatcacgctgacattcctgaccgtacggacgtgggacgagcgccggatcacgatgccggtctcgtacttcaccgcccagcccttcgagaactggtcgcggggcagcgcccagatgaccggcaccgtcttcttccacgtcgaccactccacgcccgtcgaggagatgcgcaagaagctccaggacatcgtgcgcgagtgcccggcctgggacggccgcgactacggcctggcggtcacggacacgacacccaccaccattcaggtgcgcgccctggtgaccgcgaaggacgcggacgacatctggacggtgcgcgtcacggtccgtgaacagatggtccgttggctgacggagcagcacccctacgcgctgccgcgcgtcaacacggcggacgcggtcgtgccgccgggcaggaccgcgtcccgggacggcgtggcccaccgggccttcgagccgccgagaacgggccggggc

SEQ ID NO: 6115 - DNA, 567 bp, Streptomyces avermitilis
  CDS (1)..(567)
atgaacatcatgctctttcactcgacctacgggttgcggcccgcggtgcgcgccgcggcggaccggttgcgcgccgcgggacacgaggtgtggacgcccgacctcctcgaggggcgcaccttcgagaccgtggaggagggcatggctttctgcgacgggatcggcaaggacgagctgctcaagcgcgcggtcctggccgccgcgccctactcggagcgtggcctggtgtacgcgggcttctcgctgggcgcctccatcgcccagaccctggcgctcggcgacgagaaggcccgcgggctgctgctcctgcacggcacgtcggacatcgccgagagcgcgtcggtggacgagctgccggtccagctgcatgtcgccgagcccgacgcgttcgagacggacgactggctgggcgcctggtacctgcagctgcggagagccggggccgacgtggaggtctatcggtacgcgggtgccgggcacctctacaccgaccccgacctgcccgactacgacgcggaggcggccgaggccacctggaaggtggcgctcggcttcctcgacagcctc

SEQ ID NO: 6116 - DNA, 1659 bp, Streptomyces avermitilis
  CDS (1)..(1659)
gtgaccagtcgacacagatcatccgacaccgcccatacgttctcgccgcgccgccgtacggtcgtcaaggccgcggccgccaccgccgtcctggccgggccgctcgccgccgcactgcccgcccgcgcggccaccgagacccccgccttcctgcacggcgtggcctccggcgacccgctccccgacggcatcctgctgtggacccgggtgacgcccaccgccgaggcgatacccggctccgggctcggccccgacaccgaggtgagctggacggtggccaaggacaagacgttcaccgcgatcgtcgccaagggctccaccaccgcgaccgccgcctccgaccacaccgtcaaggcggacatccgcggcctccagccggccacggactacttcttccgcttctcggccggcggcaccgactcgcccgtcgcccgcacccgcaccgccccggccgccgacgcgggcgtggccggtctgcgcttcggcgtggtctcgtgcgccaactgggaggccggctacttctccccgtaccgccacctggccgcgcgcggcgacctggacgcctggctgcatctgggcgactacatctacgagtacaagtccggcgagtacgcggcccgcggcaaggtcgtacgcccgcacgcccccgccaacgagatcctcaccctcgccgactaccgcacccggcacggccgttacaagacggacccggacctccaggccctgcatcacaaggcgccggtcgtcgcgatctgggacgaccacgagttcgccgacaacgcgtggtcgggcggcgcggggaaccacaccgagggcgccgagggcacctggacggcacgtcaggccgccgcgaaacaggcctacttcgagtggatgccggtccgcccggcgatcgaggggaccacctaccggcggctgcgcttcggcaagctcgccgacctctcgctgctcgacctgcggtccttccgctcgcagcaggcgtccacgggcagcggcacggtcgacgacccggagcgtacgctcacgggccgggtccagctcgactggctgaaggcggggctcaaggcgtccgacaccacctggcggctggtcggcaactcggtgatgatctcgccgttcgccatcggtgagctctccgccgacctcttcaagccgctcgccaagctgctcgggctgccgcaggagggcatcgccctcaacaccgaccagtgggacggctacacggacgaccgccgtgaactcctcgcccacctgcggaacaacgcgatccgcaacacggtcttcctgaccggcgacatccacatggcgtgggccaacgacgtgccgttcgacgccggtacgtacccgctgtccgcgtcggccggcaccgagttcgtggtcacgtcggtcacctccgacaacctcgacgacatcgtcaaggtccccgagggcaccgtctcggccgtggccgcgccgctcatccgcgccgccaaccggcacgtccactgggtcgacaccgaccggcacggctacggcgtcctggacatcaccgccgaccgcgcgcagatggactactacgtgctctccgaccgcacggacccgaacgcgacctcgtcctgggcccgctcgtaccgcacgcgcagcggcacgcagaaggtggagcggacgtacgatccggtg

SEQ ID NO: 6117 - DNA, 837 bp, Streptomyces avermitilis
  CDS (1)..(837)
atgagcaagcggaacagccaggcggcgaagacggcggcccgtgagcggctgcgcgtcgagcgcgagcgccaggccaagcgcgacaaagtcaagcgccaggccaagcgcgacaaagtcaagcggcagggcatggtcgccggctccctcgtcgccgtcctggccgtcgccggcggcatcggctacttcgtcgtccagaacaacaagcccggttactgggaggccgccaagaacgacaagctcgtcaagccggccaacaccacgggcacgaacggcaccacggtcgtcttcggcaaggccgacgccaagaagacgctggagctgtacgaggactcgcgctgcccggtctgcgcccagttcgagcagaccgtcggctcgaccgtggacaaggccatcgcggacggcacgtacaaggtccagtacatcggtgccacgttcatcgacaacagcgaccagggcgagggctccaagaacgcgctcagcgctctgggcgccgcgctgaacgtgagccccgaggcgttcctcgagtacaagaccgccctgtactcgacgaagtggcacccggacgagaccgacgacaagttcaagagcgacgactacctgatcaaggtcgcgaacacggtggacgccctgaagaacaacaaggcgttccagaaggccgtgacgggcggcacctacgacaagtgggcgctggtcatgtcgcagaagttcgacaagagcggcgtgaccggcacaccgaccctgaagatggacggcaagaagctcaccggctccgacggccagaacgcgccgatgtcggtggccgagtacacgacggcgatcgacaaggcgctcaaggcc

SEQ ID NO: 6118 - DNA, 684 bp, Streptomyces avermitilis
  CDS (1)..(684)
atggacatatccgggacccacctcagagcccttcgcgcggctctgttcaccgcagtcgtcgtgacgctctccaccacgtcgcacgtactgctgtcccgggtgccgctgccgctgtccaccgtggccgcgatcgcgggcaccgtcttcgtcgtcgcgtacgcgctggcgggccgcgagcgcggcttcggaaagatcgccgcgctgctggtccctctcgagctggccgccgacacggtcttcaccatggggcagcacgtctgctacgggaaggtgggcggcccggtcgcgggcccgctgcgctcggtcggcctcgacgtgctgtgcggcggcaacggcgtcggcgccccgctcgcccgggtgaccggcggcggcagcgaccgcgccgccgtcctgctcgcacacgccgacccggccgccgcctggctgctgctcgccgcgcacgtcggcaccgggctgctggcggccgcctggctgcgccgcggcgagcgcgccctggcccagttgctgcgcgcggcggcggtgagcgcgttccggccgctgctgctcgcggtcagcgcggtgaccgtacgactcactccggtacgccggccggcgcgccccgcgcgccggatctccaccgtccgtacgcgcctgttcgtgcactccctgggacggcgtggaccgcctcgctcggccgtattcgcc

SEQ ID NO: 6119 - DNA, 1323 bp, Streptomyces avermitilis
  CDS (1)..(1323)
atgtcggttccgcagctcagcgccgagcaacgcggcgagcagatcctcgccgtcttcgacaccgcgttcggcgagctgctcgccgccgacccggccgcgttccgcgtgaagttccgcaagatggcggcctccgcgttcgcgttctaccggggcacggcgtgcctcttctaccacgacctggacgccgacaagcggggcggcccgtacctggacgagcggacctcccgggtgtggatccacggcgatctgcacgccgagaacttcggcacgtacatggactccaccggccgcctgatcttcaacgtcaacgatttcgacgaggcctacgtggggtcgttcacctgggacctcaagcgcttctcggcctccgtggcactgatcggttacgcgaaggcgctcagcgacgagcagatcaccgagctcgtccaggtctacgcggcggcctaccgggagcggatccacgccctggcgaccggcgccaagagcgacgaggtgcctcccttcacgctggacaccgccgagggccccctcctggacgcgctgcgcgacgcccgctcactgacccgcttcgggctgctggactcgatgaccgagatccgtgacttcgagcgccgtttcgcgccgggcggcggctccatcgagctggacgcggccacccgctacaaggtgctggccgccttcgacggctacctggagacgctgccggagtcgtcgctggcccgcccggactcgtaccgggtgaaggacgtggtcggccgccggggcatcggcatcggttcggcgggcctgccgtcgtacaacattctcctggagggccacagcgacgccctggagaacgatgtggtgatctacatcaagcaggcccagacaccggccgtctcccggcacatcacggactcctcgatccgcgactacttccagcacgagggccaccgcacggtgatctcgcagcgcgcgctccaggcgcacgccgacccctggctgggctggaccgagctggacggcgcgggtcagctggtcgccgagatctcgccgtacgccgtggacctggactggggcgacatcgacgacccgaaggagatcgcggcggtcgtcgccgacctcggccgggccacggccgccatgcacgcggcggcggacgacctgtccgggcagtccctcgtgccgttctcgacggagcgtgccatcgacgccgccgtcgcggccgacgaggacggcttcgcgggcctcctggtggacttcgcgcacgagtacggcgcacgcgcgcgtgcggaccaccagatcttcgtggacctgttccgcaacggccggattccgggcctg

SEQ ID NO: 6120 - DNA, 3537 bp, Streptomyces avermitilis
  CDS (1)..(3537)
gtgtcaaagccgccgttcacgcacctgcacgtccacacccagtactcgctgctggacggtgccgcgcggctcaaggacatgttcaatgcctgcaatgagatgggcatgacacacatcgccatgagcgaccacggcaacctccacggggcgtacgacttcttccacacggccaagaaggcgggcgtcacgccgatcatcggcatcgaggcgtacgtcgcccccgagtcccggcgcaacaagcgcaagatccagtggggccagccgcaccagaagcgcgacgacgtgtccggttcgggtggttacacgcacaagacgatctgggcggcgaaccggacgggcctgcacaacctcttcaagctctcctcggacgcgtacgccgagggctggctccagaagtggccccggatggacaaggagaccatctcccagtggtccgaaggtctcatcgcctccaccggctgcccctccggcgagctccagacccggctgcgcctgggccagttcgacgaggccctgaagtcggccgccgagtaccaggagatcttcggcaaggaccggtacttcctggagctgatggaccacggcatcgagatcgagcgccgggtccgtgacggtctcctggagatcggcaagaagctcggcatcccgcccctggtgacgaacgactcgcactacacctacgcgaacgaggcgaccgcgcacgacgccctgctgtgcatccagaccggcaagaacctctccgacccggaccgcttccgcttcgacggcacgggctactacctgaagtccacggacgagatgtacgccatcgactcctcggacgcctggcaggagggctgcgccaacacgctcctggtcgccgagcagatcgacacctccggcatgttcgaggcgaagaacctcatgccgaagttcgacatccccgagggcttcaccgaggtcacctggttccaggaggaggtgcgccgcggcatggagcgccgcttccccggcggcgtccccgacgaccgtcagaagcaggccgagtacgagatggacgtcatcatccagatggggttcccggggtacttcctcgtggtcgccgacttcatcatgtgggccaagaagcagggcatcgcggtgggcccgggccgtggttcggcggccggctcgatcgtcgcgtacgccatgggcatcaccgacctcgacccgatcccgcacggtctgatcttcgagcggttcctcaaccccgagcgcgtctccatgcccgacgtcgacatcgacttcgacgagcgtcggcgcgtcgaggtgatcaggtacgtgaccgagaagtacggcgccgacaaggtcgccatgatcggcacgtacggcaagatcaaggcgaagaacgccatcaaggactccgcgcgcgtgctgggctacccgtacgcgatgggcgaccgcctcaccaaggcgatgcccgccgacgtcctcggcaagggcatcgacctcaacggcatcaccgacccctcgcacccccgctacagcgaggccggcgagatccgggcgatgtacgagaacgagccggacgtgaagaaggtcatcgacaccgccaagggcgtcgagggcctggtccggcagatgggcgtgcacgccgccggcgtcatcatgtccagcgagcccatcgtcgaccacgcccccatctgggtgcggcacacggacggcgtgaccatcacgcagtgggactacccgcagtgcgagtcgctcggcctgctgaagatggacttcctcggcctgcgcaacctgacgatcatggacgacgccgtcaagatggtgaagtccaacaagggcatcgacctcgacctgctgagcctcccgctcgacgacccgaagaccttcgaactgctccagcgcggcgagaccctcggcgtcttccagttcgacggcggccccatgcgctcgctgctgcgcctgatgaagcccgacaacttcgaagacatctccgccgtctcggcgctctaccgtcccggcccgatgggcatggactcgcacacgaactacgcgctccgcaagaacggccttcaggagatcacgccgatccacaaggagctggaggagcccctccaggaggtcctggccgtcacctacggcctgatcgtctaccaggagcaggtgcagaaggccgcccagatcatcgccgggtactcgctcggcgaggccgacatcctgcgccgcgtgatgggcaagaagaagcccgacgagctggcgaagaacttcgtcctcttccaggagggcgcccagaagaagggctacagcgacgaggccatccaggccctgtgggacgtcctggtgcccttcgccggatacgcgttcaacaaggcgcactcggccgcgtacggcctggtctcgtactggaccgcgtatctgaaggcgaactacccggccgagtacatggccggcctgctcacctcggtcaaggacgacaaggacaagtcggccgtctatctgaacgagtgccggcgcatgggcatcaaggtgctcccgccggacgtcaacgagtcgatgtcgaacttcgccgcgcagggcgacgacgtgatcctcttcggcctgtccgccgtccgtaacgtcggtacgaacgtcgtcgagtcgatcatcaagagccgcaaggccaagggcaagtacgcctccttccccgactatctcgacaaggtcgaggcggtcgcctgcaacaagcgcaccaccgaatcgctgatcaaggcgggcgcgttcgacacgatggggcacacccgcaagggcctcaccgcgcagttcgagccgatgatcgacaacgtggtgcaggtcaagcgcaaggaggccgagggccagttcgacctcttcggcggcatgggcgaggaggagagcgacgagcccggcttcggactcgacgtcgtcttcaccgacgacgagtgggagaagacctatctgctcgcccaggagcgggagatgctcggtctgtacgtctccgaccacccgctcttcggcttggagcacgtgctgtccgacaaggccgacgcgggcatcgcccagctcaccggaggcgagcacgcggacggcgcggtcgtcaccatcggcggcatcatctcgggcctccagcgcaagatgaccaagcagggcaacgcgtgggcaatcgccaccgtggaggacctggcgggctccctggagtgcatgttcttcccggccacgtaccagctggtgtcgacccaactcgtcgaggacgcggtcgtgttcgtcaagggacgcctcgacaagcgcgaggacgtgccccggctcgtcgccatggagctccaggtccccgacctgtcgaacgcgggcaccaacgcgcccgtgatcctcaccattccggcgctgaaggtcaccccgccgatggtgagccggctcggtgagatcctcagccaccacaagggcgagagcgaggtgcggatcagactccagggtccgcgcaagacgaccgtgctgcggctcgaccggcaccgggtgaagccggatccggccctgttcggcgatctgaaggtgctgctcggcccgtcctgcctggcgggc

SEQ ID NO: 6121 - DNA, 177 bp, Streptomyces avermitilis
  CDS (1)..(177)
atggccaagaacaagaaccgcaagcagggcagccagcagcagcgcagctcccaggccgagcaggcacaggagcacgcgcagaggtctgcgacggaggcacagcagtcgccgatgccgcacacccagggcagccccgcggatgttgcccgtaagcagcagaagcgcttcggccacaac

SEQ ID NO: 6122 - DNA, 1224 bp, Streptomyces avermitilis
  CDS (1)..(1224)
gtggaccgcgtggaccgctgcatcgtcctggtggacgccgggtatctgctcggggccgccgccagtctgctcgccggagagccttcgcgctcccggatcaccgtcgaccatgccgccctcatccagggactgcgcgagcgcgccgagttcgacacggaacggccgctgctgcgcatctactggttcgacggcgcccccgaccgcgtgccacagccggagcaccgcagactccgggtgatgccgcgcgtgaccgtccggctgggcgcgctgacccgcagtgacgggcggtgggcgcagaagggcgtcgacgcggcgatgcacgcggagctgaccgagttggcgcgcaaccgggcctgttccgacgtggtcctggtgaccggcgacggggatctgctgccgggcatgatggccgccaaggagcacggggtcgccgtacacctgtgggccgttcaggccgcggacggcgactacaaccagtccgaggacctggtcgccgaggccgacgagcggcgtgtgctcgaccgggcctggatcaccaaggccgtacgcgccaaggaggtgggcggggtctgcgcgccgcagcccgtcccgcggccggagatcgccgcgatcctgtccgcgccgctgcccgagtcctcgctcgcgggcgccgccgagcggaccgccgaggagccggagcaccggtcggcggcggacgcgcagaacggggcgcaggagcgggtgtcggccccgaagggcgtgccgacaccgaaggacctggccgctctccgcgcgcccggcacccagtcccctcagcatccggccagtgcgacgctgcggtggtcctccgacaaggggtgggtggaccggcccggtgcggcggccgagtccgcggacgccgcgtcgctgccgacgctggcgcaactcacctcggcggagcagcggtgggccgaccgcgaggaggacatcaccacggtcggcggggacccgtacgaggtcggacaggtgttcgcccggcggtggatggagcgactgaccgaccagacgcatctgcagaagctgtcggccatgtatccacgggttccgcaccgggtcgacggggagctgctgcggtacgccgcccggttcgggctgctcgcgcacaaggacgaccagatcgacgagcacgaccggtacgcgatcagggcggggttctggcgggagatcgatgtacggacggcggcggagcacgcgccggcgggagat

SEQ ID NO: 6123 - DNA, 1137 bp, Streptomyces avermitilis
  CDS (1)..(1137)
atgtacggacggcggcggagcacgcgccggcgggagattagccggggctgccgcgccggagttctatttcaggacgggggttggatttcgggcggactccaccaccccgtactctcgtcccttgtgagtacgcgcacggcacaggcatgtcgacagggtggcgatgtcgtgtgcgccgtgcgggggctgaccaagacctacccggccgtgcgcggacggcgtggcgccccgggaacgcccgaggtgcgggccaccgacggggtacggctcgacatccggcgcggcgaggtcttcgggctgctcgggccgaacggcgccgggaagtccaccctcgtccgccagctgaccgggctgatgcggcccgaccggggcagcgtcgacatcctcgggcacgacatcgtgcgccatcccgagcgggccgcgcggatcctcgcctacctcgggcaggagtccaccgccctcgacgagctgacggtgtcgctcgccgccgagacgaccgggcggctgcgcggtctcgacgtccggcaggcgcggggcgagcgggacgccgtactcgacgaactgggtctcgcggcggtcgccgggcgcccgctgaagaagctgtccggcgggcagcgcaggctcgcctgcttcgccaccgtcctggtgggggagcggccgctgctcgtgctcgacgagccgaccaccgggatggaccccgtggcgcggcgggccgtgtgggccgccgtcgaccggcggcgcgccgagcgcggcaccaccgtcctgctggtcacccacaacgtcatcgaggcggagaccgtgctcgaccgggtcgccgtgctcgacagcggacgcgtcatcgcctgcgacacaccgggcgggctcaaggagcgggtcgcgggggaggtgcgcgtcgaactcgtctggcgcgagcgggcgccgctggacgttcccgaggtcgccgcgctgcgggcccgtgccgtcgagtccgggcgccgctggtcgctgcggctcgcgcccgacgaggcccgcgccgcggtcgccacggtcaccggaggagccgccttcgccgccctggacgacttcaccctggccacgccgagcctggaggacgtctatctggcgctcggcggcaacgcgcaggggctggtgaaggcg

SEQ ID NO: 6124 - DNA, 852 bp, Streptomyces avermitilis
  CDS (1)..(852)
atggaacggggccggagcgaagaggagcagctcgacgtgagtgtcgtacccgctgaggttctgcccggcgtcacggccctggacgacggcgctcgaaccgaggcgccgctcgggccgcgggcgcggctgtggccgtcgctcgccgccgtctaccgggcgcagctgtcccgggcgcgggtcgcgcggatcccgctgctgttcgtggcgaccttccagtccgtcgggatcatgatcatgatgcgcggagtcgtcgacgacgcggacgaggcgcgggccgtggtcgccggggcgaccgtcctcgtcgtcgcgttcgtcgcgctgaacctgctcgcgcagtacttcgggcagctgcgcgccagcggcgggctcgaccactacgcgacgctgcccgtgccgcccgcggcggtggtgctcggcgcggccggcgcgtacgcctccttcaccgtgcccgggaccgtcgtcaccgccgtcttcgggtgtgtgctcttcgggctgccgctgacccacctgtgggtccttgccgcggtgatcccgctcgcgggggccgcgctcgccgggctcggggccgccttcgggctgctcgctcctcggcccgaactggccacgctgctggggcagttggggatgtccgcggcgctgctgctcggtgtgctgccggccgaccggatgccgggggtcgtgcagtgcgcgcgggatctgctgccgtccacgtacggggtcgaggcgctcgcgcggaccttcggcgggcacccggactgggcgttcgtcctgggtgacctggccgtgtgcgccgccgtcggggtcgcctcgctggccgtcgcgacctgggcctatcgccgagcggccgtccgg

SEQ ID NO: 6125 - DNA, 663 bp, Streptomyces avermitilis
  CDS (1)..(663)
gtgaccgctccgctgactccgcctccgccgccgcacgaccagccctcccaggacccctggcaggcgccgcccgccggtggtgccgtgggcgtggccgggtacgaagaggacggccccgggatgaagaccgaagtccgcgaggccgccgtgatcacggtcggtcttgcgctctgcggagtgctgctcggggtgctgtggtggtggctggcgccgcatgtgccgctcatgggcggcgtggtcggcaaggagtgggtcgtctacctcaaggacaccgagggcgagcaggctgtcggggtcgatggaaccttcaccctgctcgcgctggccttcggcgcggtcagtgcgctcgccgtgttcctgtggcgccggcggggcggggtgccgctggccgtgtcgctcgccgtgggcggggtgctcgggtcgttgctcgcgtggcgggtgggggtctggctgggacccacgcagaacgtgctcgcgcatgccaaggccgtgggcaagggcgtcaccttctccgcgccgctgaagctgggcgcgaagggggcgctgctggcgtggtcgctggcggcgctgctggtgcacctcggactcacggcgctgttcgggccacgggatccggatccgtacgcgagcccgtacgacgcgcctccggctccgcccgccggg

SEQ ID NO: 6126 - DNA, 498 bp, Streptomyces avermitilis
  CDS (1)..(498)
gtggcgaagaagtcgaagaagcagcagccgggcggcacgcccgcgacggtggccctgacggcggcgggcgtgccgtacacggtccacgcgtacgagcacgaccccgcgcacccctcgtacggcgaggaggcggccgaggcgatgggcgtctcgcccgaccgcgtcttcaagacgctggtggcggacgtggacggcgcgctggtcgtcgccgtggtcccggtcgcgggctcgctggacctgaaggcgctggcgacggcggtgggcggcaagcgcgcggcgatggcggatcccgtgctggcggagcgcacgacgggctatgtccgcggtggcatctcaccgctgggccagcgcaagaagctccgcacggtcctggacgcgtcggccgccgcccacgacacggtctgtgtctcggcgggccgccggggcctcgaagtggagctgtccccggacgacttggcgaagctcacggaagcggtccccgccccgatcgcccgtgcc

SEQ ID NO: 6127 - DNA, 738 bp, Streptomyces avermitilis
  CDS (1)..(738)
gtgaccaccgtccggctcccgctcttcccgctgaactcggtgctgttccccgggctcgtcctcccgctgaacgtgttcgaggagcgctatcgcgccctcatgcgcgatctgctgaagacccccgaggacgaaccgcgccggttcgccgtcgtcgccatccgcgacggctacgaggtcgcgccgagcgcgcccggcatgccggacccgacggccgtgcccgagcgcgggcccgcggccggcttcggcgacgacccggtcaaggccttccactccgtgggctgcatcgcggacgcggcgaccgtgcgggagcgcgccgacggcggcttcgaggtgctggcgaccggcacgacacgcgtcaagctgctctccgtggacgcgtcgggcccgtatctgacggccgagctggaggaactgcccgaggacccgggcgacggggcgggtgcgctcgccgagggcgtgctgcgcgcgttccggcagtaccagaagcgcctggccggcgcccgcgagcgctccatctccacgagcgccgacctgccggacgagccgtccgtcgtctcgtacctcgtcgcggcggccgtgatgctcgacaccccggcgaaacagcggctgctccaggccccggacacggcctcacggctgcgcgaggagctgaaactgctgcgcacggagacggcgatcatccgtaatctgccgtcgttgccagcgtccgagctgacgcgcggcccgaccagtctcaac

SEQ ID NO: 6128 - DNA, 1086 bp, Streptomyces avermitilis
  CDS (1)..(1086)
atggcttccaccatggcactgctgcgcgcgatcctccgtacggcccggatggccaggaactccccgcgcctcgcggtcgggctgcccgccgacgacgaggtgctcctcgacgcgcccgacgaacacctcgcccccgcgctggtcgcggcgggacgcggcgagtacgagcccgcggccgagctgctcgccggctcccgcgaggccgccgagtgggagaaccgcgaccggtacacgacccgcctcgcggccttcgcgcgctcccggcccgagtggctcgaggagtggcggcgcgcccgcccgcacgacccggacgcgctgctcgtccgggccgagctggcggtgcgccgcggctgggagtcgcccgcccgcgccgaactcctgcgccaggtcgccccgctgatcaccgccgccgcggagggcgccccgcgcgacccggtgccctggcggatcgccctcgaccacgcgcgcggcaccaacgccgggcacgccgagttcgaacggctgtggggcgaggcggtgcgccgctcctcgcaccactacggctgccatgtcgccgccctccagtacttgtccgccgcctgctgtgctcagcggggggacacccctcacaccccccggcgctcgcaccgcgagtgcttcgacttcgccgagacggccgcgcaggacgccctgcccggctccctggtccagatgctgcccgtgcgcgccgccttcgcctatctgaccgagggcggcggggcggccgtggggcgcgagcgcctggacgcggcggccgaccgggccatcgcgctctcgaacgagtacgcggccgccgacccgtggcccgcggaggtccgcaacctcctcacctatgtcctggtgcggctccagcgctgggaggacgcgttgcagcaactgcgcatgatcggcccgtacgccacctcgttcccctgggaccggatctccgacgacccgctcgggcagttcctggaactgcgcgacggagtccgcctcgaggtcgcctccggcctccccctcggaccgccgggtgagcgcccgcgggatccacggagtgggcacgacggacgctcccgctccggcgaccat

SEQ ID NO: 6129 - DNA, 1578 bp, Streptomyces avermitilis
  CDS (1)..(1578)
gtgaccgagggtgccggtatccacgccggggacctgccggacgacctgaccgccgccgaggccggcatgtggcaggccttccgcaacggcactgtgtacgacctgcgcgccgggaacgcgaccgtggacgatccgcacggcggccacccctggggccccgagcgcaccgtacgggcccgcatcgtgtgctggctgctcctggacgggccgccggccctggcggggcgggtggcgtccctgaagctcgtcggcgtacagatcaaggactcgctcgatctctccggcggcaccgtcgtgccgtacctcgaactgaagggctgccggttcgagaaggaggtcctgctgccggaggcccacttcacgaccgtacggttcgtggactgctcggtgccgcgcctggaggcggcacgggtgcacaccgagggcgacctgcatctgccgcgctgccggttccacaacggcgtacggctcacggacgcgcacatcggcacggatctgctgctgaaccaggcggtggtctaccgggaccggcgcgggcgttcgctcaccggcgacggcatgaccgtcgggcaggacctccaggccgagatgatggagtcgcacggcgagctgagtctgcgcagcgccaagatcggcgtctcgctgagcctgcgcggcgccctgctgaccaacagctacacgcccctggccctgaacgcgcctcagctgaccgtcgggcgcacgctgtacctgacccccgccggcctcggcaatccgccgctgaccagcggcgccactccggcgcggggcacccgggtgcagcggttcgcgtgccggggcgggatccggctcgacgacgggcggttcggggacgcggtggacctggagcgggcccgcttcgtcttcgaggacgaccaggagttgtcactgcgccgggtccagacgcccgagctgcgctttttgagcgagcaccccgagcgcggccgggtcgtcctgtcgggcgcgcggatcgtcaacctggtcgacagggcggagagctggccgggcccgggccggctgcagatgggcggcttcggctacgagaacctcgtgccgcacggccggttcccgctgaccgagcgcctggagtgggtggccgcggcgaccgccgagtacaacccggagccgtacgagcgcctggcggccgtgctgcgcaactccggcgaggacgaggacgcgcgggaggtgctgctcgccaagcagcgccgccgccgggagaccctgccggtcgcgggcaagctgtgggggtacgtacaggactgggcggtcgcctacgggtaccggccggggcgcgccgccctgtggatggcggtcctgtgggcggtgacgtcggtcgccttctcgcacgccgggcaccccccggtcaacggcgacgggcatccgtcgtggaacgcctcgctgttcgcgctggatctgctgctgccggtcatcgacctcggccaggccggccagtggcagctgcgcggcggctggcagtggctggccgcgacggtgatcctgctcggctggatcctggcgacgaccgtggcggcgggggccacccgactgctgcgccgcagc

SEQ ID NO: 6130 - DNA, 1323 bp, Streptomyces avermitilis
  CDS (1)..(1323)
gtgatctcccgaatcgatctgcgcggcgacgccctccccgagggctccgccctgcgcgacctgctgccccgagccgacttcgacgtctcggccgccctggagaaggtgcgtccgatctgcgaggccgtgcatcatcggggcgacgcggcgctgatcgacttcgccgagaagttcgacggcgtacgcctcgagtccgtacgggtcccggcgcgggccctcgccgacgcgctggagcagctcgacccggcggtgcgcgcggccctggaggagtcgatccgccgcgcccggctcgtccaccgcgagcagcgccgtacgacgcacacgacccaggtcgtgccgggcggctcggtcaccgagaagtgggtgccggtcgaccgcgtcggtctgtacgcgcccggcggtcggtcggtctacccgtcctccgtggtcatgaacgtcgtcccggcccaggaggccggcgtcgagtcgatcgccctcgcctcgccggcgcaggccgagttcggcggactcccgcacccgacgatcctcgcggcgtgcgcgctgctcggcgtcgacgaggtgtacgcggccggcggcgcgaccgccgtcgcgatgttcgcgtacggcaccgagtcctgcgcgcccgccgacatggtcaccggccccggcaacatctgggtcgccgcggccaagcgctacttcacgggcaagatcggcatcgacgccgaggccggccccaccgagatcgcggtcctcgcggactccacggccgaccccgtccacgtcgcctccgacctgatcagccaggccgagcacgacccgctggccgccgccgtcctggtcaccgactccgtcgagctggcggacgcggtcgagaaggagctggaaccgcaggtcgcggccaccaagcacatcgacgaccgcatcgtcccggcgctgaagggccggcagtccgcgatcgtgctcgtcgacggcgtcgacgagggcctgcgggtggtcgacgcgtacggcgccgagcacctggagatccagacggccgacgcggccgccgtggccgaccgggtgcgcaacgcgggcgcgatcttcatcgggccctgggcgccggtctccctcggcgactacgcggccggctccaaccacgtgctgcccaccggcggctgcgcctgccactcctcgggcctgtccgtccagtccttcctgcgcggcatccacatcgtcgactacacgaaggacgcgctggccgacgtggcgcaccacgtggtgacgctcgcggaggcggaggacctgcccgcgcacggcgcggcgatcaaggcaaggttcggttggaaggtgcctgagagcaag

SEQ ID NO: 6131 - DNA, 1107 bp, Streptomyces avermitilis
  CDS (1)..(1107)
gtgagcttcggaatcgacgatctccccgtacgggacgagctgcgcggcaagtccccctacggcgcgccccagctcgacgtccccgtacggctgaacaccaacgagaatccgtacccgctgcccgagccgctcgtcgagcggatcgccgagcgggtgcgggaggccgcccgtcacctcaaccgctaccccgaccgggacgcggtggagctgcgcacggagctggccacgtacctgacgaacaccggcaagcaccccgtcggcatcgagaacgtctgggcggccaacggctccaacgaggtcatccagcagctgctccagaccttcggcggacccggccgcacggcgatcggcttcgagccgtcgtactcgatgcacgccctcatcgcgcgcggcacgggcaccgcctggatctccggtccccggggcgaggacttcacgatcgacctcgccgccgcccggcaggccatcgccgagagccggccggacgtcgtcttcatcacgacccccaacaaccccacgggcaccgcggtcccgcccgagacggtcctcgcgctgtacgaggccgcgcaggcggtgaagccgtcgatggtggtggtcgacgaggcgtacatcgagttcagccacggcgactccctgctgccgctgctcgaaggccggccgcatctcgtcgtctcgcgcaccatgtccaaggcgttcggcgcggccgggctgcgcctcggctatctcgccgcgcacccggcggtggtcgacgccgtccagctcgtacggctgccgtaccacctgtcggccatcacgcaggcgaccgcgctggccgccctggagcacaccgacaccctgctcggttacgtggagcagttgaaggccgagcgggaccggctggtcgccgagctgcgcgcgatcggctacgacgtgaccgagtccgacgcgaacttcgtgcagttcgggcggttcgccgacgcgcacgaggtctggcagcagatcctcgaccggggcgtcctggtccgggacaacggcgtaccgggatggctgcgggtcagcgccggtacccccgaagagaacgacgcgttcctcgacgcggtccgtgagctgaagaaggagcagaacgca

SEQ ID NO: 6132 - DNA, 591 bp, Streptomyces avermitilis
  CDS (1)..(591)
atgagccgcgtaggccgcgttgagcgcaccaccaaggagacctcggtgctcgtcgagatcgatctcgacgggtccggaaaggtcgatgtgtcgaccggggtcggcttctacgaccacatgctcgaccagctcggccgccacggtctgttcgacctgacggtgaagaccgagggcgacctgcacatcgactcgcaccacaccatcgaggacaccgccctcgccctcggtgccgccttcaagcaggcgctcggcgacaaggtgggcatctaccgcttcggcaactgcacggtcccgctggacgagtccctcgcccaggtgaccgtcgacctgtcgggccgcccgtacctcgtgcacaccgagcccgagaacatggcgccgatgatcggcgagtacgacaccacgatgacccggcacatactggagtccttcgtcgcccaggcgcagatcgccctgcacgtgcacgtgccgtacgggcgcaacgcgcaccacatcgtggagtgccagttcaaggcgctggcgcgggcgctgcggtacgcgagcgaacgcgacccgcgtgccgccggcatcctcccctccacgaagggcgcactg

SEQ ID NO: 6133 - DNA, 162 bp, Streptomyces avermitilis
  CDS (1)..(162)
gtgagcgggctgtccaccgtcctgatcgtcctcgggctcttcctcctcggcggggtctactccttcgtcaagcagaagatgccgacgagcctcatcgtggtgctgtcgatcggcgcggtgatgtgcctggccgcgggcgtcgtgcgactggaggtgtggaat

SEQ ID NO: 6134 - DNA, 645 bp, Streptomyces avermitilis
  CDS (1)..(645)
gtggaattgagtaccgcgaagaaagtcgtggtgttcgactacggcttcggcaatgtgcgctccgccgagcgcgcgctcgcccgtgccggcgccgaggtcgagataacgcgtgacttcgacacggccatgaacgccgacggactgctggtgcccggtgtcggcgccttcgccgcctgcatgaaggggctgaaggaggcgcgcggcgactggatcgtcggccgccggctggccggcggccgccccgtgatgggcatctgcgtcggcatgcagatcctcttcgagcgcggcatcgagcacggtgtggagaccgagggcctcgacgagtggcccggcacggtcgggccgctcgaggccgagatcgtgccgcacatgggctggaacacggtcgaggcgcccgggggatcgcagctcttcgcggggctcgacgccgacgcgcgcttctacttcgtccactcgtacgccgtccacgactggtccctggacgtcgcgaacccggcgatgcgcgcacccctggtgacctggtcgacgcacggcaagccgttcgtggcggccgtcgagaacggcgccctgtgggccacgcagttccaccccgagaagtccggcgacgccggagcgcagctgctgaacaactggatcggaaccctc

SEQ ID NO: 6135 - DNA, 726 bp, Streptomyces avermitilis
  CDS (1)..(726)
atggcttcgaagctcgaactcctccccgccgtcgacgtccgtgacggccaggccgtccgcctcgtgcacggcgagtccggtacggagacgtcctacggctctccgctcgaggccgccctcgcctggcagcggtcgggcgccgagtggctgcacctcgtcgacctggacgccgcgttcggcaccggcgacaaccgcgcgctgatcgccgaggtcgcgggggcgatggacatcaaggtcgagctgtccggcggcatccgcgacgacgacacgctcgccgccgccctcgccaccggctgcacccgggtgaacctgggcaccgccgccctggagacccccgagtgggtcgccaaggtcatcgccgagcacggcgacaagatcgcggtcggtctcgacgtacgcggcacgacgctgcgcggccgtggctggacccgcgacggcggcgacctctacgagaccctggagcgcctcaactccgagggctgcgcccgctacgtggtcaccgacatcgcgaaggacggcacgctccagggcccgaacctggagctgctgaggaacgtctgcgcggcgaccgaccgcccggtggtcgcctccggcggcgtgtcctcgctggacgacctgcgggccatcgccgcgctggtgccgctcggtgtcgagggctcgatcgtcgggaaggccctgtacgcgaaggcgttcaccctggaagaggccctggaggcggtagccaag

SEQ ID NO: 6136 - DNA, 330 bp, Streptomyces avermitilis
  CDS (1)..(330)
gtgcagctgccgaacggtctggtgctggtctccggctgcacctccgtgatcgacggatcgatcgtcgacgacggcccgtacgagcaggcgctcaactccttcaatgtcgcgttcgcggcgctgaaggagctcggcctcggccgcgacgacgtcgtccgtacgcgcatgtacctcacccatgcccgggacgtggaggagatcggacgcgcccacaagcagctgttcgactccgtccgccccgccgcgtccatgatcatcgtctccggtttcgtggacccgcgcctggtcgtcgaggtcgaggtggaggcgtaccgagaggccccgcagtca

SEQ ID NO: 6137 - DNA, 753 bp, Streptomyces avermitilis
  CDS (1)..(753)
atgaccctggccgtacgagtcatcccctgcctggacgtggacaacggccgggtggtcaagggtgtcaacttccagaacctgcgcgacgcgggcgaccccgtcgagatggcgaaggtgtacgacgccgagggcgccgacgagctgacgttcctggacatcaccgcgtcctccggcaaccgcgagaccacgtacgacgtcgtgcgccgcacggccgagcaggtgttcatcccgctgacggtgggcgggggcgtgcggacgcccgacgacgtggacaagctgctgcgggcgggcgcggacaaggtgggcgtgaacacggccgccatcgcccggcccgagctgatccgtgagatcgccgagcggttcggccggcaggtcctggtcctgtcggtggacgcgcgccggaccgagagcggcagcttcgaggtcaccacccacggcggccgcaagggcaccggcatcgacgccgtggagtgggcgcaccgggccgccgagctgggcgcgggagagatcctgctcaactcgatggacgcggacggcaccaaggacggctacgacctggagatgatcgcggcggtgcgggcgcacgtgaccgtgcccgtcatcgcctccggcggcgccggcaagctcgaccacttcccgccggccatcgcggcgggcgccgacgcggtgctggccgcgtccgtcttccacttcggtgatctgcggatcggcgaggtgaaggagacgctgcgggcggcggggcatcccgtgcgg

SEQ ID NO: 6138 - DNA, 585 bp, Streptomyces avermitilis
  CDS (1)..(585)
gtgaccgccaaggagaaccgccccatcaccgacatcggcacgctcaaggcgctcgcccatccgctgcggatgaagctctaccgggccctgtgcgtgacccgcaccgcgaccgcctcgcagctcgccgagcaggtcgacgaaggcgtctcgctggtcagttaccacctgcgcaagctcgccgaccacgggctgatcgaggcggcccggccgcagagcggggacggccgcgagcgctggtggcagccctcctcacagggcgtgagcatcaaggacaaggacttccgggacgcacccgagaaggcggccgcgcacgcggcggccacccgtctcttccacgagcagcgcgccgacctgtaccgccgctatctcgacgagcgccccacctggggccccgagtggaactccgccgcgcccgaccaggagtccctgctgcgcctgacccccgccgagctggccgagctgggcgcggagttgctcgccctcgccaggaagtacgacgagaagggccgtgccgccgaggccgccggcgacaccgaagggcgcgagaacgtcgcgctgcatgtgtacggcttcccgttccgcccc

SEQ ID NO: 6139 - DNA, 1230 bp, Streptomyces avermitilis
  CDS (1)..(1230)
atggtgggcgacaacgtctactacctcgcgctgtcctgggccgcggtccaggccggtacgccctcgcaggccggcctcgtgatggccgtcagcgccgtgccgcgggccctgctcatgctgggcgggggagtggtggccgaccggttcgggccgcgcagggtcgtcatcggcagcgacgcggtgcgctgcgctgccgtcctcgcggtggccgcgctgctgttcgcggcgagccccgggctgtggccgctcgccctgctcgccgttctcttcggcaccgtggacgccgtgttcatgcccgccgtgggcgcccttccggcccgcgtcaccggccgcgaccagctcgcccgcgtccagggcatgcgcggcctcgcgatccgcttcgccaacgtggtgggcgcgccgctcggcggcctgggcgtggcgctcggcggagcggcggccgcgttcggactggccggactcctgatcgccgtctcggtgccgttgctgatctccgtacggatgcgggacctgccggcggacggggaggggggcggggaagcggaccgggaggcgggcgggaaggcggaccaggaggcggggccccaccgcatgggggccgcgcaggacaccgtcccccgcaccaccccctggcaggacctccgcgacggtctgcgctacatccgtggccaccgtgtgctcgccccgctcctggtcgccatcgccctcggcgacctcggcttcgtcggaccgctcaacgtcgggctgaccctgctcgccgagcagcggggctggggcgcctccggtatgggctgggtgctctccggattcgggaccggggccggggtggccgccctgctgctgaccgtacggggtcggctgccgcacgccggacgtgtcgtcgcggcggcgatcctgccgggctccgtcgcgatcggcgcgctcgcgtacgcaccgagtctcgtcgtcgccgtcggcacggctctgctggtcgggctgctcgccgggctcagcggcgccctgtgcggcgcgctgctccagacccaggccgaccccgcgtacctgggccgggtcagctccgtggccggcatcgtcagcctcggcttcgccccgctcagcatgccgctgagcgcggccgccatcggctggtggggcaccggccccgtcttcgtcaccagcgccgcggtctgcggcctcggcggcgtcgtcgtgctgtgctccggcccactgcgccgcgcccagctgcctcgc

SEQ ID NO: 6140 - DNA, 1254 bp, Streptomyces avermitilis
  CDS (1)..(1254)
atgccgaacgccgtacgagcccgtgtccgggcggtgcccgggctgccgcccgcctcgccgcccgtccgttccctcgtcgacgcggaggccgtcgccgtgctgcgccgcgcggccgccgtcctgatggacgacctccccgaaatcaccgaacggctgctcgccgtgctccaggagcaggagccggcctaccgggcggccttcgaaacggacccctcggggctgtggcaggaggtgcaccgctccctgcggcacaacgtcggctccctgctgcgccccagggagtgcagggacgccgcccggcgctgctcatggcggatcggcgccgaacgggcggaacaggggatgccgttggacgcgctgctgcacgcctttcggctcggcggcgccctggtgtggcggaggctcgtcgaggaggccgcacggcgcgaccccgacgacgtacgcctgctggtgcatgtggcgtcggacgtgtggaacttcgtcgacgagcactgcaccctggtcgccgacgcctaccggcatgtggaacggcagctcgcctggcggcgcgagaaccggttgcggctgatgaccaccgccctcctcgacggcacgacccgcatagccgacctgccggacgtggccaccgcgctggaccttcccgagcagggcaggtacgcggtggtgagcgtggccgtcgcccacccggccggccacgtgggcacacaactgctgtccgtgccacccggtatgcgggcgctctggcacaccggcacggacgtcgagcacggcatcgtccacctcggcgagcgcgagccgaaggatctggtcgaccgcgtgaccgtaccgatcggggcccgggtcggtatcagccgcgcggtcgacggtctcgcggcggtcggtgacgcacgccggctcgccgagaccgctctgcgcgcctgcccggagagcggcggcaccgtcctgctcgacgagcatctgcccgcggccctgctggtgtccgcgccggccctgggcacggcgctcgtcaaccgggtcctgggaccgctgctcagcctcgacccgagcgaccgggacctgctcctggacaccgtcagcgcctggctcgacaacgacgggtccgcccagcgcgcggcgagccggctgtactgccaccgcaacacggtcctcaaccggctgcgccgtttcgaacagctcaccggccgctgtctcacccggcccgcggacgtcgtcgacacctcgctcgcgctgaccgcccggcggctcctcggggac

SEQ ID NO: 6141 - DNA, 1089 bp, Streptomyces avermitilis
  CDS (1)..(1089)
atgccctctttgtcatcggacggcgcccggcaggacatacccctgccgggcggaccgcccccgaaggacccgcccccgaacgggccgtcggtgctgcacgtgcgcgacctcgacgtggcctacgggcgcgccctgaccgcgttgcgaggtgtctgcctggaggtgcccgcgggcggggccgtggccctgctcggcgccaacggcgcgggcaagagcaccttgctgcgctccctctccggcaccctgcgcctgcatcgcggagcgatcaccgcgggcagcgtccactacggcgacgtgcgcctgaccggacaggacccggtggccgcggtgcgcgccggtgtcgtacaggtccccgaaggccgccgggtgttcgccggactcaccgtggacgagaacctgcgggccggcggactgggcctcggccgccgtgccccggcggtcgtcaaagccgcccgcgaacaggtcttcggactgttcccccggctcgcggaacgccgcgcgcagcgcgccggactgctgtcgggcggcgagcagcagatgctcgccatcgggcgggccctgatggccgcaccccggctgctgctcctcgacgaaccgtcactcggcctggccccgctgatggtcgagcgcatcgccgaggtgatccgggagatcaacgagcagggcacctcgatcctgctcgtggaacagaacgccgcgatggcactggcactgtccgaccacgcgtacgtcctcgaagtcggcgaggtgcggctcgccggcccggccgccgaactggccaggaccgacgcggtacggcgcctgtacctgggggaggaggccggacccgaggcgatggggcccggcgaggccaccgcggctccggacactccgggcccgcaccccgcgccgcccggcccgccccctggtccggaggccggtacggacggtgcggtcggttcgtctcctggtccggaggccggtacggacggtgccgccgggccgccccccgatcccgacaccggcacggaaggcgccgccggcccgcccggcgggcagcgcaccacgaccgagggccagcgcaccacggccgaagggcagggcgtcgca

SEQ ID NO: 6142 - DNA, 792 bp, Streptomyces avermitilis
  CDS (1)..(792)
atgagcgtgtcacccccgcccctgcgggtcgacgacgtcacggtcaaattcgccggactcaccgcgctggactccatcggcttcaccgtggcgcccggcagcgtccacgcgctgatcgggcccaacggagcgggcaagtccacctgcttcaacgtcgtgtccgggctgtgccggcccacgcacggcagcgtcagcctcggcgacacggaactcacccggctgcccccgcaccggatcgccctgctcggcatcgcccgtaccttccagaacatcgtcaccacggcgggcaccgtgggcgacaacctgatgctcggccggcacgccctgtcccgcgcggggttcaccgcgaccgccctgcgactgccgggcaccgtgcgcgagcagcgcagccaccgggcccgcgcccgcgagatcgccgaactcaccggcctcggcacgctgttcgacacgccggtcgccctgctgtcgtacggcgaccgcaagcgcgtcgaactcgcccgcgccctgtgcctggagccgcgggtgctgctgctcgacgaaccggtggccggcatgaactccggcgaacgcgcccgcaccgtcgaggtcgtgcgcacggtccgcgcggaactgggcctgtccgtgctgctggtggagcacgacatgggcctcgtcatgcggctggccgacgaggtcaccgtcctcgacttcggccgccgtatcgccgcgggcaccccggaccaggtccgccaggaccccgaggtccgccgcgcctacctcggcaccccgaccactccccaggagcacatcgca

SEQ ID NO: 6143 - DNA, 888 bp, Streptomyces avermitilis
  CDS (1)..(888)
atgagcaccgccctggacaccgtactgaacgggctcgccctcggttcggtctacgccctggtcgccctcggcttcgtcatcatcttcaaggcctcggcagtgatgaacttcgcgcacggctccctgctgctcctcggcggctatctgaccgcggtgctgcacgaccggctcggcttcgcgggcgccctcgccctcgcggtcctcgccaccgcggccgccgccgggctgatcgactggctgctgctgcgccgcctcgacccgcacgccgcgcacgtactgaccatcctcaccatcggcgtcgacatcctgctgatgacggacctcacccgccgcatcggcggggacctcctcaccctgggcgacccctggggctccgacgtgaccgagctcggcccgatcaccgtcgccgacagccggatcgcctcgatcctggtgtcactggtcgtcatcgccgccgtcttcgccgtcttccggttcacttcgtggggcctgtccctgcgagccgccgccgaggaccacgaggccgccgcgctgatgggcatcaggctcgcccggatccggaccctcgcctggtgcctggccggcgcgctcgccgcgctcgccgccgtcttcctggccgccttcccggcccccggcctggagcgcaccaccggacagatcgcgctgaaggccttccccgccgcgatcctcggcggcatggcctcgccgccgggcgcgctcgccggaagcctgctgatcggcgtcaccgaggcgctggcggccggctaccagtccgaactctccgcgctcggcgagggcttcggcgacgtggtgccgtacgccgtgatggtgctggtgctcctcgtccggcccgccggtctcttcgggacgagggaggcggcccgtgtc

SEQ ID NO: 6144 - DNA, 1179 bp, Streptomyces avermitilis
  CDS (1)..(1179)
gtgtctaggcgcctcgtcatggcgggcgctgccgtcctcctgtgcgtactgcccttctatctgggcgcgttctggctccaggtcggactgttctcgatggccgccgcgctcggagccgtcggactcaccctcctcaccggcaccgccggccagctctccctcggccacgcgttcttcctcgcggtcggcgcctacggatacgtgtggctggcgggcgaccccgggccggggctgccgccgctgctcgccctggtgctggcggtctgtctgagcggtctggtgggcggcctgttcagtccggtcgccggccgggtgcgcggcgtctacctcggggtggcgacgctcgccctggtcttcctcggccaccacgtgatgctcaacgccgactccatcaccggcggcttcaacgggcggtccgtgccgcccatgtccctcggcggcttcaccttcaccgcgagcgatccccaactgaccgtgctgggcgtcccgttcggcgccgaggagcgcctgtggtacctggcgctgatcctgctcgcggtgggctggttcgccgcccgcaacctgctgaacggccgcccgggactggccctgaccgcgctgcgcgacagcgagaccgcggcggccgtgatgggcgtcccggtcgcccgccggcgctcggccgccttcgtggtctcctccatgtacgcgggcctggccggggtcctgctcgcgctcgtcttccgccggatcgtgccggactacttcggcctcgcactgtccatcgactacctcgcgatgatcgtcatcggcggcctcggctcggtggcgggcgccgccgcgggcgccgtcttcgtcaccgcgctgccgttgctcatggcccgctacgccgaccagttgccgctggtcgccgcgcccggcgccgcgggccacgcggtgggccccaccgaggcctcccgctatctgtacggcgccgccatcgtcctcgtcctgctcttcgcccccgacgggctgagcggcgtcgcccggcgcgccggcgccgcggtccgccgacgccggaccgcgcccccgcgcacggcgtccgccgatgtcgcatcaccggcctccgcatcaccggcctccgaatcaccggcctccgcatccccggccgcctccaccccggccgcgtccgcatcagatcaacgacccaaggagcgcacctcg

SEQ ID NO: 6145 - DNA, 1260 bp, Streptomyces avermitilis
  CDS (1)..(1260)
gtgaacacgacgggacgcacagcactcgccacgacccttgccgcctttctgctggccggcgtcggatgcagcaccaaagccggtgactccggcggcgacaccgccgcggacggcgtgaagaccggccccggcgtcaccgccgacaagatcgggctgggcgcgctcacggatctgagcggcccctacgccaccctcggcaagagcatcgtccaggcccagcagatgtgggccgacgagaccaacaagaagggcgggatctgcgggcgcaaggtcgagatcgtcgtcaaggaccacggctacgacgtccagaaggccgtggccgcctacaccgagatctccccggacgtcctggcgctgccccaggtcatcggctcgcccgtggtctccgccctgctcgacgacgtggagaaggaccacctcctcaccttcccgcaggcctgggccgcctccctgctcggcaaggacgccgtgcaggtgctcggcaccacgtacgacatcgacatggtgcgcgccgtcgacttcctcacccgcaagcagggcgtgaagaagggcgacaagatcggccacgtgtacttcgagggcgactacggcagcaacgcgctggaaggctcctcgtgggcggcgaagaaggcgggcctcacggtcgtcggacagaagatcaaggccaccgacaccgatctgtcggcgcaggtcaccgccctgcgcaaggccggggtcaaggcgatcctgatcagcgcgggccccagccagaccgcttccctggtgggtgtcgcggcttcacgcgggctgaaggtcccggtcgtcaccagcgcccccggctacgcgccgcagctcctcaagacaccggcggcgcccgcactgctcgccatgctgcacgtcgtcagctccgccccgccggtcagttccgaccttccggccgtcaagaggatggtcacctcgtaccagaagaagtaccccggtgagctcgtggacgcgggcaccttgtcgggctacaacgcggccgaactcatgggccgcgacctgaaggccgcctgcaaggccaaggacctcacccgggagggcctggtgaaggcgcaccgctcgcagaaggcggtggacaacggcctcggcaccccgcaggacttctccgacgcctcgcgcccggcggccatggccgcctacgtgaccaagccggacaagaaggccacgggcggcaccgtgctggtcgaggacgcccgcgcactgcccgcggaacagaagttcctggactcccgcaagaag

SEQ ID NO: 6146 - DNA, 633 bp, Streptomyces avermitilis
  CDS (1)..(633)
atgtcgacccatgcgaagcgtgaacgacttctcctcgccgatctgttggaggcggagggaccggacgcccccaccctgtgcgagggctggaacacacgggatctcgccgcgcacgtggtggtgcgcgagcgccgggccgatgcggccggcgggctgctgatcaagcagctcgcgccccggctcgagcgggtgatggcggagttcgccgcgaagccgtacgaggagctcatccagctgatccgtaccggcccgccgcgcttctccccgttcgccctgaagcagatcgacgaggcgtcgaacacggtcgagttctacgtccacaccgaggacgtacgccgggcgcggccggactggacgccacgcgcgctggacccggtcttccaggacaccctgtggtcccgcctggagcgcacggcccgtctggtgggccgcggcgcgccgaccggcctcgtgctgcgccggccggacgggcagacggtggtcgcgcacaagggcacaccggtggtgacggtgaccggcgagccctcggagctgctgatcttcgcgtgcgggcggcagaacgtggcggccgtcgagctggacggggacaaggaagcgatcgcgagactgcacgagacgaagcaactcggcctc

SEQ ID NO: 6147 - DNA, 399 bp, Streptomyces avermitilis
  CDS (1)..(399)
atgaccagcacgccccagcccagcaggcccagcagcctggacgccgagatcgccgcgcgcctcaagcgcagcgccgacgggctcgtccccgccatcgcccagcagtacgacaccggtgaggtgctgatgctcggctggatggatgacgaggcgctgcaccgcacgctcaccacgggccgctgcacctactggtcgcgcagccgcggggagtactgggtgaagggcgacacctccggccacgtccagtacgtgaagtccgtagccctcgactgcgacgccgacaccgtgctcgtcaaggtcgaccaggtgggcgccgcctgccacacgggcgcgcacacgtgcttcgacgccgacgtgctgctcaaggacggcgattccggcgtacccgcagcggatcag

SEQ ID NO: 6148 - DNA, 1479 bp, Streptomyces avermitilis
  CDS (1)..(1479)
atggacctcgagacgttccgcaagctggccaccgaccgccgtgtcattcccgtcagccgcaaactcctcgccgacggcgacaccccggtcgggctctaccgcaagctcgccgccgagcgccccggcaccttcctcctggagtccgcggagaacggccgctcggcgttcaaatggtcccgctactccttcgtgggcgtccgctccgccgccaccctcaccgagcgtgacgggcaggcgcactggctcggcaccccgcccgtgggcgtccccacggacggcgacccgctcgccgccctgcgcgccaccatcgaggcgctgcacacgccccacgaggagggcctgccgcccttcaccggcggcatggtcggctatctcggctacgacatcgtgcgccgcctggagaagatcggccccggcgagcgcgacgatctgaaacttcccgagctgaccatgctcctcaccagcgatctggccgtcatggaccactgggagggctccgtcctgctgatcgccaacgcgatcaaccacaacgacctcgacacgggcgtcgacgaggcctacgcggacgcggtcgcccgcctcgacgccatggaggcggacctgtcgcgcgcggtcgcgcagccccccgccgccctcccgccctccgaactcccggagtacaccgccctctggggcggccccgacttccaggacgccgtcgaggacatcaaggagcgcatccgggcgggcgaggcgttccaggtcgtcccctcccagcgcttcgaaacgccgtgcacggcaagcgcgttggacgtctaccgggtactgcgggcgaccaacccctcaccgtacatgtacctcttccgcttcgagggcttcgacgtggtcggctcgtcccccgaggccctcgtcaaggtcgaggacgggcaggcgatggtccaccccatcgcgggcacccggccgcgcggcgcgaccccgcaggaggaccaggccctcgcggacgagctgctggccgaccccaaggagcgcgccgagcacctgatgctcgtcgacctggggcgcaacgatctggggcgggtctgcgagcccggttccgtcgaggtcgtcgacttcatgaccatcgagcgctactcgcacgtgatgcacatcgtgtcgaccgtgaccgggcgggtcgcgcgggggcgtacggccttcgacgtgctgacggcctgcttcccggccggcaccctctccggcgcgcccaagccccgcgccctgcagatcatcgacgaactggagccgtcccggcgggggctgtacggcggctgcgtcggctacctcgacttcgcgggcgactccgacaccgccatcgccatccgcacggcgctgctgcgcgacggcacggcgtacgtgcaggcgggcgccggcatcgtcgcggactcggacccggtcgccgaggacgacgagtgccgcaacaaggcggcggcggtcctgcgcgcggtccacacggcgaaccggctg

SEQ ID NO: 6149 - DNA, 642 bp, Streptomyces avermitilis
  CDS (1)..(642)
gtggagtacgtgactgccgtaccaaccccccgatccgaagccgcgggacccgcccggtccggccgccggagccttgccgtggccctgctgtgcggtgcgctcggcgccgccgtggcgctgctgtcctcccggcagggctgggcggcggggaccgtggcggtggccggcggcgacttcccgctgaccgccaagggcagcgacgtcacgggcgtgcccgcggccctcgccatagtgggcctcgccgcgctcgtcgccgtcttcgccgtccgcagcgccgggcgcctgctggtcgccgcgctgctcgcgctgtccggcgcgggcacgatcgccgccgcgctcctcggcgtctcggacagcgcggccctcgacgagaaggcggcccaggcgtccggcgacacctccgcgaccgccgaggcactgacccacaccgcctggccgtacgtcgccgtcgcaggcggcgccctgctcctcctcgccgggctgctcgccctgcgctacggacggctgtggcccgcgatgtccggccggtacgagcgcgacggcacgccccggccgcgccaggcccgggtggaccccgaccggcccgaggacctgtggaaggcgctggaccgcggcgaggacccgacgggcccggacccggcg

SEQ ID NO: 6150 - DNA, 237 bp, Streptomyces avermitilis
  CDS (1)..(237)
atggcgggcagcagccacggtcacaccccggccgcctggaccggtgtcatcatcgccttcatcggtttctgtgtatcgggtgccttcatggtgttggccaacccgctgggcttctgggccggcatggtcatcgtcgtcctcggcggtgtcgtcggcggcatcatgcgcgcgatgggcctcggccagcagaagaccacgcacccggtgcaccacgtcgcgagcgccggcgcggagagc

SEQ ID NO: 6151 - DNA, 486 bp, Streptomyces avermitilis
  CDS (1)..(486)
atgcgtggggtgaacgcacaatcccagtgggtgacgcggccgggcgcggatcagccgggcgcggatcagccggacgcgggcgcggggcccacggccgtgctgcggcggctcgctgtccccggcggggtgctcgcggccgtcgtcggggccttcgcgtacgtcggggcggtcgatcccaaccagccggggcactacccggtctgtccgctgctccgcttcaccggcgtctactgccccggctgcggcggactgcgcagcgcgcacgccttcgtgcacggggacctctcggccgcgctcacggacaacgcggtggccgtggccggctacttcgtgttcgccgtggtgtggactttctgggtggtacgggcggcgcgcggacggccggtgcggatcgacctggggccggtgcatctgtggagcgtgggcgcgttgctgctggtcttcaccgttgtccggaacctgccgttcggtggctggctgcatcct

SEQ ID NO: 6152 - DNA, 807 bp, Streptomyces avermitilis
  CDS (1)..(807)
gtgagtgtgctcgacgagatcatcgacggagtccgtgccgacctcgcggagcggcaggcgcgggtcagcctcgacgagctcaaggagcgcgtggcgaaggcacccgcggccaaggacggcgtggccgccctgcgcggcgacggcgtcaaggtgatctgcgaggtcaagcggtccagcccgtccaagggcgcgctcgccgcgatcgccgaccccgcggctctggcggcggactacgaggcgggcggcgcgtccgtcatctccgtcctgaccgagcagcgccgcttcggcggctccctcgccgacctggaggccgtccgcgccaaggtcgacatccccgttctgcgcaaggacttcatcgtcacgtcgtaccagctgtgggaggcccgggcgtacggcgccgacctcgcgctgctgatcgtggccgccctggagcagcccgccctggagtcgctgatcgagcgcgccgtgtccatcgggctcacgccgatcgtcgaggtgcacgacgaggacgaggccgagcgggcggtggacgcgggcgcgaaggtgatcggcgtcaacgcgcgcaacctgaagacgctcaaggtcgaccgcaccacgttcgagcgggtcgccccggagatccccgaggggatcgtgaagatcgccgagtccggcgtccgcggcccgcacgacctcatcgcgtacgccaatgccggcgccgacgccgtcctggtgggcgagtccctcgtcaccgggcgcgacccgaaggcggcggtcgccgacctggtggcggccggtacgcatcccgccctgcggcacggccggggc

SEQ ID NO: 6153 - DNA, 306 bp, Streptomyces avermitilis
  CDS (1)..(306)
atgaccaccgccgaccgggctctcgccgccgtcaccgtccgtccgggctccggcctcgacggtggtggcgccgtggcgtgcgtgcggtcggtcgtaccggtgccggtggtggccgctcaggcgcccctctccgcggcccgggacccctatgcccggctggcccgcggctgccgtccgcgcggctgccgggcaccggcccgacgggtgcacgggcgacgggtgcggtacgtgatcggcgacgagccgggccaggtcaacggcatgcgatggcgccggggtgcgcgcgtgcgcaccctgcgggccggc

SEQ ID NO: 6154 - DNA, 1284 bp, Streptomyces avermitilis
  CDS (1)..(1284)
atgtccagcgagttcttcattcccgaccccgagggtcaagtccccaccgccgagggctacttcggcgctttcggcggcaagttcatcccggaggccctggtcgccgccgtggacgaggtcgccgtcgagtacgacaaggccaaggccgaccccgagttcgcccgtgaactggacgacctgctcgtccactacaccggccgcccgagcgccctcaccgaggtctcccgcttcgccgagcacgccggtggcgcccgcgtcttcctgaagcgggaggacctcaaccacaccggctcccacaagatcaacaacgtgctcgggcaggccctgctcacccggcgcatgggcaagacccgcgtcatcgcggagaccggcgcgggacagcacggcgtcgccaccgccaccgcctgtgcgctcttcggcctcgactgcaccatctacatgggcgagatcgacacccagcgccaggccctcaacgtcgcgcggatgcgcatgctcggcgccgaggtcatcgccgtgaagtccggcagccgcaccctcaaggacgccatcaacgaggcgttccgggactgggtcgccaacgtcgaccgcacccactacctcttcgggaccgtcgccggcccccaccccttccccgccatggtgcgcgacttccaccgcgtcatcggggtcgaggcgcgccggcagatcctggagcgcgccggacgtctgcccgacgcggccgtcgcctgcgtcggcggcggctccaacgcgatcgggctgttccacgccttcatccccgacaccggcgtccgcctcatcggctgcgagcccgcgggccacggcctggagacgggtgagcacgcggccaccctcaccgccggcgagcccggcatcctgcacggatcgcgctcgtacgtcctccaggacgacgaagggcagatcaccgagccctactcgatctcggccgggctcgactacccgggcatcggacccgagcacgcctacctcaaggacagcggtcgcggcgagtaccgcgcggtcaccgacgacgcggccatgcaggccctgcgcctgctctcccgcaccgagggcatcatcccggccatcgagagcgcccacgcgctcgccggtgccctggagatcggcaaggaactgggcaaggacgggctgatcctcgtcaacctgtccgggcgcggcgacaaggacatggacacggccgcccgctacttcggcctgtacgacaccgacgcgtccgtcgccgcggacgccgacagcgacatcgccgagatcgagggggacgccaag

SEQ ID NO: 6155 - DNA, 831 bp, Streptomyces avermitilis
  CDS (1)..(831)
gtgagcggcgccgcattttcccgtcagaggggccaactgctgagcgacaccctcgccgccgcgaaggcggaggggcggtccgccctcatcgcctatctgccggccgggttcccgaccgtcgacgggggcatcgccgccatcaaggccgtcttcgacggcggcgccgatgtcgtcgaggtcggactcccgcacagcgaccccgtcctcgacggccccgtcatccagaccgccgacgacatcgccctgcggggcggcgtcaggatcgccgacgtcatgcggacggtccgggaggcgcacgaggcgacgggcaagccggtcctcgtgatgacgtactggaaccccatcgaccgctacggcgtcgagcggttcaccgccgagctcgcggaagcgggcggagcgggctgcatcctgcccgacctcccggtgcaggagtcggcgctgtggcgggagcacgccgagaagcacggcctcgcgacggtcttcgtggtcgcgcccagcagcaaggacgcccggctcgccgagatcaccgcggcgggctccggcttcgtgtacgcggcctcgctgatgggcgtcaccggtacccgcgcgtccgtgggcgagcaggcgcaggacctggtgcggcgcaccagggccaccaccgacctgcccgtctgcgtcggcctcggcgtctccaacgccacgcaggccgcggaggtcgccggcttcgccgacggcgtgatcgtcgggtcggcgttcgtgaagctgatgctggacgccgaggacgaggcggcgggtcttgaggccgtacgggcgctggccggcgaactggccaagggcgtgcgcggcggcgac

SEQ ID NO: 6156 - DNA, 828 bp, Streptomyces avermitilis
  CDS (1)..(828)
gtggacctgggaccggggaggcgcgctgtgcctccccggttcgttctgccggatgtgagcgagaagaaccgtgagggaaagcgcaccgcccgtgagcggctggtggtcgagcgtgagaagcaaaaggccgccgagaggcgccgccgggcgctgatcgtcggggcgtcggtggtgtgtgtcctggctctcgcggccgtggtgggcgtgctggccgcgaactccggcaaggacaagaagagcgcctcggacggcccggccgtggcgccctcgggcgcgacgggcaaggacggcctggcgatcccggtcggcaaggacaccgccaagtcgtcgctcacggtgtgggaggacttccgctgcccggcctgcaagatcttcgagaccacataccggcccacgctgcacgaactggtcggcgccggaaagctgaagatcgactaccacctggtcacgatcatcgacgacggcaggggcggcagcggctcccgccaggccgccaatgccgcggcctgcgcccaggacgccggaaagttcaccgcgtaccacgacgtcctgtacgacaaccagccggacgagaccgtggactcgttcgcggacgacagcaagctcatcgaactcgccggcaaggtcgacggcctggacaccccggcgttccggaagtgcgtcaaggacggcacgcacaacagctgggtcgtgaagtcgaacgccgccttcgacagcggcggcttcaaaggcacgccgaccgtgctgttcggcggcaagaacctcgccgcggacccgacgatgaccccggcgaagctgaagcagatggtggaggcggcgaacaagggc

SEQ ID NO: 6157 - DNA, 1020 bp, Streptomyces avermitilis
  CDS (1)..(1020)
atggaacttgcctacattcccagcccggcgcgtggggtgctgtacctcggccccattccactgcgcggctacgcgttctgcatcatcatcggcgtcttcgtggccgtctggctcggcaacaaacgctgggtcgcccgcggtgggcgccccggcacggtggccgacatcgcggtctgggccgtgccgttcggtcttgtcggcgggcggctgtaccacgtcatcacggactacgagctgtacttcagcgagggccgtgactgggtggacgccttcaagatctgggagggcggcctcggcatctggggcgcgatcgcgctgggtgcggtgggggcgtggatcggctgccggcgccgcggcatcccgctgccggcctgggccgacgccgtcgcccccggcatcgccttcgcgcaggccttcggccgctggggcaactggttcaaccaggagctgtacgggcgcgagacgcacgttccctgggcgctgcacatcacgtcctcgacggacggacgggtgccggggtactaccacccgacgttcctgtacgagtcgttgtggtgcgtcggcgtcggcttcctggtcatctgggccgaccgccgcttcaagctgggccacggccgggcgttcgcgctgtacgtcgccgcgtactgcgtgggccgcgcgtggatcgagtacatgcgcgtcgacgacgcccaccacatcctgggtgtgcgcctcaacgactggaccgcgatcgctgtgttcctcctcgcggtgctctacatcgtgctgtcgtcgcggaagcggccggggcgtgaggagatcgtcgagccgggtgcctccgacaccggaaccggtgcggacgacccggtggacctcggcaaggacgaggataaggccaccacggacaaggccacggccacggacacgtccacaaccacggacaagtccacggaccggggcaagaacgaggacgagaacgagggcgaggacgccgagccgtcggagaagacggagagcgcggccgagtcggccaagaaggtc

SEQ ID NO: 6158 - DNA, 855 bp, Streptomyces avermitilis
  CDS (1)..(855)
gtgaccgcggagtccttcccgctcacctggctgtacgcgcccggcgaccgacccgaggtggtgggcaaggccctcgcctgcggggcggacgtcgtcctgatcgacctggaggacgcggtccccccggaccgcaaggactacgcccgcgccgcgacggcggaacggctcacgcagcggcagccggtcccggtccacgtacgcgtgaacgccctggacggtccctggctggaggccgatctcaaggcactcacggcgctcccgggcctctccggcctgcgcctgcccaaggtgacctcgcccgcggacgtggtccgcgtcgcggaacgcgccgcccccacggagggcggcacacgcgcggagggcggcgcgatcccgctccacgccctcctggaaacggccctgggcgtggaacaggcgttcgcgatcgcgtcggcgcatccggacgtgcggggcgtctcgctgggcgagacggatctacgggcggatctgggggtacgggaggacgcgggcctggactggtcgcgggcgcgggtggtggtggccgcacgggcggcgcggctgccgccgccgacgcagtcgatccacccggacatccgggacctggagggcctggccgcgtcctgcgcccgcggccgggccctgggtttcctgggccgcgcggcgatccatccgcgccagctgccggtcatcgagcgggcctatctcccgactccgcaggagatcgccacggctgaggagatcgtcaaggccgcggcgagggacccgggcgcccaggccctcccggacggccgcttcatcgacacggcggtggtgacgggggcccagcgcacactggcgctcgcgcgccgcctgaac

SEQ ID NO: 6159 - DNA, 1206 bp, Streptomyces avermitilis
  CDS (1)..(1206)
atgagtacgccgcccgacaccgccgccccgctcaccggtctgcgcgtcgtcgacctcgcgaccctcttcgccggaccgatcgccgccaccatgctcggcgacttcggcgccgaggtgatcaaggtcgagcacccggcgaaaccggatccctcccgcggccacggcccgtcgaaggacggcgtgggcctgtggtggaagctcctcggccgcaacaagcgcacgatgaccctggacctgtcccggcccggcggccgcacgaccctgctgcgcctcgccgcgacgaccgacgtgatcatcgagaacttccgccccggcacgctggagaagtgggacctgggatgggaggagctgtcggccgcgaacccccggctcgtcctcgcccgggtcaccggcttcggccagttcggcccgtacgcgcgccgccccggcttcggcacgctcgcggaggcgatgagcggcttcgcggcgatcacgggcgagccggacgcgcccccggtgctcccgcccttcggcctggccgactcgatcgcgggcctcgcgaccgcctacgcggtgatgacggccctcgccgcccgcgaccgcaccggtgcgggccaggtgatcgacatggcgatcatcgagccgatcctcacggtcctcggcccgcagccgatctggtacgaccagctcggccacgtgcagccgcgcaccggcaaccgttccgcgaacaacgcgccccgcaacacgtaccgcacggcggacggttcgtgggtcgcggtctccacgtccgcgcagtcgatcgcggaacggttgatgatcctggtgggccgcccggagctgatcgccgagccgtggttcgcgacgggcgcggaccgggcccgccacacggacgtcctggacgaggcggtgggtgcctggatcgcccgccacacccgcaccgaggtcctggaggcgttcgagaaggcggaggcggcggtggcccccatccaggatgtgcgggacgtgatgacggatccgcagtacgccgcgctggacacggtcaccacgatccccgacgaccccgaactgggcccgctccggatgcagaacatcctcttccggctctcctccacccccggcgcgatccgctgggcgggccgtccgcacggcgcggacacggaggcggtactgaccgaactgggcctggcggaagccgagatcaccgcgctgagatcggaaggcgccctg

SEQ ID NO: 6160 - DNA, 1371 bp, Streptomyces avermitilis
  CDS (1)..(1371)
gtgagcgcgctccggctgacctgggtccagcccgaggacctgctcggccacgaactccaccaggcggcccaggacggccgcgaaccgtacgcgatcgcggcccgctggcgggcggcgggcggccaaaaggccccggaacgggcgggcgcgtcgcggggaccggtctcgccgtacctgcggatactggccgaggacctgctggccgaactggcggacctgccgagccggctggcggaccaggagccgacggacctggcgaacatcagggcccgctgcccgaagtggccgtcgcggccccagccctcccccgccacgccaccggcccacgaccgtctggaagccgcctggctgggcagagcggccggctgcctcctgggcaagccggtggagaagctccccctcgacggcatccgccggctcgcccgggccaccggcaactggcccctgcacacctggttcacggcccgcggcctccccccggaactcgccgcggcccacccctggaaccgccgctcggcaaccacctccctcgccgagaacatcgacggcatgccggaggacgacgacctcaactaccccctcctgaacatcctgttgctccagcgccacggcaagggcttcagcaccgccgaagtcgcccgcctctggctcgacgaactccccgccggccgcacgttcaccgcggagcgcatcgcgtaccgcaacctcctcgacggcatcgagcccccgcgcacggcccgccaccgcaacccgttccgcgagtggatcggcgccctgatccgcgcggacgtgcacggctggaccaacccgggagacccggcggccgccgcggcccaggcccaccgcgacgccaccctcacccacaccgcgaacggcgtctacgcggcgatgttcacggccgccaccatcgccgaggccgccaccggccaccacggcatccaccactgcctgcgcaccggcctcaccgtcgtcccgccgcactcccggctggccagggccgtccgtcacgcggtccacctggccgccaccacagaggacttcgacacggtcgtcgacgaactgcacgccacccaccgcggctaccactgggtccacgccgtccccaacaccgccctgatcgccgccgccctcacccacgcggacggcgacttcagcggctccgtctgccgcgccgtggcgggcggctgggacaccgactcgaacggcgcgacggcaggcggcatcgccggtctgctggccggccgcccgaccgccctccccgaccgctggaccacccccctcaagaaccgactcgccacctccgtggccgacttcaacggcgtcggcttcgacaccctcgcccacctcacacaccgggaggcccaccgccca

SEQ ID NO: 6161 - DNA, 1194 bp, Streptomyces avermitilis
  CDS (1)..(1194)
atgacgcccaaatcacccctctgcgagacgtctccgccgcccctcgacgagacgtccaccccgcccctcgacgcacggatcaccggcgccctcgtcggggccgcggtcggcgacgccctcggcggtcccgtcgagggctacacgcccgagcagatcctcgaacgccacggcgggcgcgtccacggcgtcgtcggcccctggaacggcgacgcctggcgcacggcccgccccatcgccccgtaccacaagggcgacgggcacgtcaccgacgacaccttgctgacgcacgcgctggtacgtgtgtacgccacggtccgcgatcacctcgacgcgtacgcgatcgccgagcacctcgtccccgacctgatgacctccccccgctggatcccggaactggaggccgaggccctccccctccaacggatcttcctcgccgagaagtggctggtggcccgcctgcactacggccacgtcgatccccgtgaggccggcgccggcaacatcgtcaactgcggcgccgcgatgtacatggccccggtcggcctggtcaacgcggccaacccggcgggcgcgtacgccgaggcgctggacatcgcgggcgcgcaccagtcgtcgtacggcagggaggcggccggtgtcctcgcggcggcggtcgcggcggcctgcgcaccgggcgcgacggcggactcggtggtcaccgcgtgcctggcgctggcgaaggacggcacccgctcggcgatcgaggcggtctgcgaagcggcgtcccggcacacggacttcgagtcggccctcgggccgctgcgcgcggcggtggctccgttcgacaccgtgggcccggactaccgcaccccttccctcggcgcccgccgcccctcccgcctccacgcgatcgaggaactcccggtggccctcggcatgttggtggtggccggcggcgactaccggcacgccgtgctcggcgcggtcaactacggccgggactgcgactccatcgccacgatggccggcgcggtcgcgggcgcgctgggcgcggccgtcccgcacgactgggcgaagacggtggcgcgggcgagccgcctcgacctgcacgccccggcgcggaccctcacggaggtcacccgcgagatcttcgaacgggacgtccgccgccgccgggcccacgagtcggcgtacgcgacgctggcggaccggcgg

SEQ ID NO: 6162 - DNA, 507 bp, Streptomyces avermitilis
  CDS (1)..(507)
gtgcacggcgcccgcgccatggccgccgcgctcgcgctcgccctcgccggggcggacgtcgacgcctgcgcggacgcggccctcgccgaactccccgagtcgacggagatcggccgcaacgcccggcacgcgctccggctggcccgttcgggcgacggcacgttcgccatcgtgcccctccttgagcaccagatcgtggaccacgtctacagctacggcatcgccgcggcggagaccgtaccggtcgccctcgcgctcgccaccgccgcccgcggccggatcgccgaggccgtgcccgccgccgcctgcctgtcgcgggtcgcggactcggccccggcgctggcgggcgcgctgaccggcgcgctcggcggcggcgcggagatcccggccgcctggcgcgacgcctgccgcaccctctccggctgcgcgctgccccgcctgaccggcaccgacctggtagaactcgccgaactcctgggagccacggaactgaccacaccgggggga

SEQ ID NO: 6163 - DNA, 915 bp, Streptomyces avermitilis
  CDS (1)..(915)
atgaggcccggcctggtgggagacgagccgggtgagagctcgggggcctcggcggcggaggcgcacgatccgccccccgcgcccgcggccgaccgcgccctcgacatccgcgccgtcggcgcaccgcacccccgtcgtatcgaaggcctcctcctgggcctcgccgcgggggacgccgccggctggcccgccgcccggcaccgggccgcacgcatgcccgagtggacccggcggctcacccgtgagctggacaccttcgccgagcagaacgcgaccaccaccctccccgtgccgatcgcgctcaatcagccgccggagccactgcggctcggcccgtccgacgacgccgagtgggcggcgttcgcggcggaggcggtactgcgggccggcgacgggaacgtgctcggggacctgagccacgagcggcggatgcgcgcggccatcgacctgtcctggaacgccgtcgccagcgaggtcgccgccgcggccgaacgcgcccccgaggtcgagtccgcgctgctcccgctgcgcgcccggatctccgtgcgggcaggcctcggcaacctcgccaccggggctgcgcccgcccgccaccggccacgacaacccccactacttcgacgacgcggcctgcgtacgggcctgcgtcctggccgtcgcgcaccccggagaaccccggctcgccgccgagctggccgagttcgacgcccgctacacccaggacggcgacggagtgcacggcgcccgcgccatggccgccgcgctcgcgctcgccctcgccggggcggacgtcgacgcctgcgcggacgcggccctcgccgaactccccgagtcgacggagatcggccgcaacgcccggcacgcgctccggctggcccgttcgggcgacggcacgttcgccatcgtgcccctcct

SEQ ID NO: 6164 - DNA, 1284 bp, Streptomyces avermitilis
  CDS (1)..(1284)
atggcttccatcgcctgcattccctcggtcccggcgcccggagacgccgccgatctccgtgaacgggcgcgcggcgcgctgctcggcctcgccgtcggggacgcgctgggcgcgcccgccgagaacatgaagccgtccgagatccgggcgcgctggggtcgcatcacggggtacgtggccgacaacccggcgggcaccgacgacacggagtacgcgatcttctccggcctcctcctggcccggcacggctcggcgctcacggtcgcgcatgtggaggcggcctggcaccagtggatcgccgaccgggacgaggggccgttcaaaggggcgggattcagcgagcggggcacgctggagaacctgcgccggggccttgccgcaccgatctcggcccagcaccggcacgcgtggagcgacgggctcgcgatgcgcgcggcccccttcggcgtcttcgcggcgggccgccccgccgaagcggcccggctggtggcgatcgacggctcggtgagccacgacggcgagggaatctacggcggccaggcggtggccgcgggcgtggcggcggcgatggccggcgcgccgacgatcgcggtggtggcctcggccctggcggtcgtccccgaagactcctggacggcccgctcgctgcgccgggcggtcgcggtcgcccatcgcggcgaacgcgcggtccgctccgcggtcgtgatcggcggctacccgtggacggacctcgcccccgaggcggtcgccctcgcgttcggcgcgtacgcggcggccgacggcgacttcacggagtcggtgctcaccgcggtcaacatggggcgggacgccgacacgacggcggcggtggcgggcgccctggcgggtgcgacgcggggcgcctcgtcgatcccggcggcgtgggcggcggcgatcggcccggcgcgcggcagttgcctgccgtccatggagggccaccacgtcctggacatcgcggagttgctgacaccgggcgcggaggacgaggggaagtggggggcgggggtactggcccccggctggaacggactggacgggccggccggactcgccggactgggcggactcgccggcctcgccggactggacggactgggcgggctgggcggcctgggggggcggggcaaggaggcggacgggctcgtacgggggccgggcggactcgtacgagagctgccccgccggtggcccggccccgatccgggcgtcttcgtgctcgcctcggacgcgttcgtaccggccggcgacgacgacgaggtggagcga

SEQ ID NO: 6165 - DNA, 729 bp, Streptomyces avermitilis
  CDS (1)..(729)
atggccatcatcgagaccgaggcgacgctgcacgaggcgcaccgcgacaaccacacccaccgcgatgtcaacggtggctggctgcgccccgccgtcttcggcgcgatggacggcctcgtctccaacctggccctgatgaccggcgtcgccggcggctcggtcggccagcagaccatagtcatcaccgggctcgcgggcctggccgccggcgccttctccatggcggccggcgagtacacctccgtcgcctcgcagcgcgagctggtcgaggccgaactcgacgtcgagcggcgggagttgcggaagcacccgaaggacgaggaagcggagctggccgcgctctacgcggcgcgtggcgtcgagcccgagctggcccgggaggtcgcccggcagctgtcccgggatccggagcaggcgctcgagatccacgcgcgcgaagagctgggcatcgacccgggcgaccttccctcaccggccgtcgccgccgtgtcgagcttcggctccttcgcgctcggcgccctcctgcccgtactgccgtatctgctcggcgcgagcgccctgtggcccgcgctgctgctcgccctcatcgggctcttcgcgtgcggcgcggtcgtggccagggtgacggcgcgatcctggtggtacagcgggctgcgccagctcgccctgggaggagccgcggcgggtgtgacgtacgtcctgggcagtctcatcggcgcggccgtagga

SEQ ID NO: 6166 - DNA, 4548 bp, Streptomyces avermitilis
  CDS (1)..(4548)
atggatgctcgccctgctgcgcagggtatgtacgacccccgcaacgagcacgacgcctgtggcgtcggtttcgtggccaccctcaccggcgaggcgagccacgcgctggtcgagcaggcgctcacggtgctgcgcaacctggagcaccgcggtgcgaccggctccgaacccgactccggcgacggcgcgggcatcctgtcccaggttcccgacgccttcctccgggaggtggccggttttgaactgcccgccgccggtgcgtacgcggtcggcatcgccttcctgcccgaggacggcacggacgaggccgtctcacagatcgagacgatcgccggcgacgagggcctgacggtcctcggctggcgcgaggtcccggtcgcccccgagctcctcggcgccaccgcccgctccacgatgcccgccttccgccagatcttcgtgagcgacggacagtcgcagggcatcgacctggaccgcagggcgttcgtgctgcgcaagcgcgccgagcgcgaggccggcgtctacttcccgtcgctgtccgcccgcaccatcgtctacaagggcatgctgaccaccggccagctggagcccttcttcccggacctgtccgaccgccgcttcgcctccgcgatcgcgctcgtgcactcccggttctccacgaacaccttcccgagctggccgctcgcccacccgtaccgcttcgtcgcgcacaacggcgagatcaacacggtcaagggcaaccgcaactggatggcggcccgcgagtcccagctcgtctccgagaagttcggctccgccggcagcggggccaagggactggagcggatcttcccggtctgcacgcccgacgcctccgactcggcgtccttcgacgaggtccttgagctgctgcacctcggcggccggtccctcccgcactccgtgctgatgatgatcccggaggcgtgggagaaccacgactccatggacgcggcccgccgcgccttctaccagttccacgccacgatgatggagccctgggacggcccggcctgcgtcaccttcaccgacggcacccaggtcggcgcggtcctcgaccgcaacggtctgcgccccggccgctactgggtcaccgacgagggcctggtcgtcctcggctccgaggtcggcgtcctcgacatcgaccccgccagggtcgtccgcaagggccggcttcagccgggccggatgttcctcgtcgacaccgccgagcaccgcatcatcgaggacgacgagatcaaggccggcctcgccgccgagaagccctacgccgactggctggaggccggcgagatcgagctggaggacctccccgagcgtgagcacatcgtgcacacccacgcctcggtcacccgccgccagcagaccttcggctacaccgaggaggagctgcgcgtcatcctcgcgccgatggccaaggccggtgccgagccgatcggctcgatgggcacggactcgccgatcgccgcgctgtcggagcgcccgcgtctgctcttcgactacttcacccagctgttcgcgcaggtcaccaacccgccgctggacgcgatccgcgaggaactcgtcacgtccctgcgctcctccctcggcccgcagggcaacctgctggagccgacggccgcgtcctgtcgtagcgtcaccctgcctttcccggtgatcgacaacgacgagctggccaagctcatccacatcaacgccgacggcgacatgcccggcatgaaggccgcgaccctgtccggcctgtaccgggtctccggcggcggcgagtccctcgccgcgcgcatcgaggagatctgctccgaggccgacgccgccatcgagaacggcgcccggctgatcgtcctgtcggaccgccactccgacgccgagcacgcgccgatcccgtcgctgctgctcaccgcggccgtccaccaccacctcatccgcaccaagcagcgcacccaggtgggtctgctcgtcgaggccggtgacgtccgcgaggtccaccacgtcgccctgctcatcggcttcggcgccgcggccgtcaacccgtacctcgcgatggagtccgtggaggacctcgtccgcgccggtacgttcctgtcggacatcgaggccgagcaggccatccgcaacctgatctacgcgctgggcaagggcgtcctcaaggtcatgtccaagatgggcatctccaccgtcgcctcctaccgcggcgcgcaggtcttcgaagcggtcggtctggacgaggagttcgtcaacaagtacttcagcggcacggcgacgaagatcggcggcgccggtctcgacgtcatcgccaaggaggtcgccgcccgccacgccaaggcctacccggcctccggcatcgcgcccgcgcaccgcgccctcgacataggcggcgagtaccagtggcgccgcgagggcgagccgcacctgttcgacccggagacggtcttccgcctccagcactccacgcgctcgggcaagtacgacatcttcaagaagtacacggaccgggtgaacgagcagtccgagcgcctgatgacgctgcgcggcctgttcggcttcaagtcgggccgcgagccgatctccctcgacgaggtcgagccggtcagcgagatcgtcaagcggttctcgaccggcgccatgtcgtacggctcgatctcccgcgaggcgcacgagaccctcgccatcgccatgaaccagctgggcggcaagtccaacaccggtgagggcggcgaggacgcggaccgcctgtacgacccggcgcgccgctcggccatcaagcaggtcgcctccggccgcttcggtgtgacctccgagtacctggtcaacgcggacgacatccagatcaagatggcccagggcgccaagcccggcgagggcggtcagctgcccggccacaaggtgtacccctggatcgccagcacccgtcactcgaccccgggtgtcggcctgatctccccgccgccgcaccacgacatctactccatcgaggacctggcccagctgatccacgacctgaagaacgcgaacccgcaggcgcggattcacgtgaagctggtctccgaggtcggcgtcggcacggtcgccgcgggtgtctccaaggcccacgcggacgtcgtactgatctccggtcacgacggtggtacgggcgcgtcgccgctgacgtcgctcaagcacgccggcggtccctgggagctgggcctcgccgagacccagcagacgctgctgctcaacggcctgcgcgaccgcatcgtcgtccagaccgacggccagctgaagaccggccgtgacgtcgtcatcgccgcgctgctcggcgccgaggagttcggtttcgcgaccgcgccgctcgtcgtctccgggtgcgtcatgatgcgcgtctgccacctggacacctgcccggtcggcatcgccacccagaacccggtgctccgcgaccggttcaccggcaaggccgagtacgtcgtgaacttcttcaagttcatcgccgaagaggtccgcgagatcctcgccgagctgggcttccgctccatcgaggaggccgtcggccacgccgaggcgctcgacgtggcccgcgcgatcgagcactggaaggcgcagggcctggacctggctccgctcttctacgtgcccgagctgcccgagggcgcggcgctccaccaggtcatccagcaggaccacggcctggagaaggcgctcgacaacgagctgatcaagctcgccgccgacgccctggccgcgaacagcgtgaccgacgcccagccggtccgcgcccaggtcgcgatccgcaacatcaaccgcacggtcggcaccatgctcggccacgaggtgacgaagaagttcggcggcgcgggtctgcccgacgacaccatcgacatcaccttcaccggctcggcgggccagtcgttcggcgcgttcctgccgcgcggtgtcacgctgcgcctggagggcgacgccaacgactacgtgggcaagggcctctccggcggccgcgtgatcgtccgtcccgaccggggcgccgaccacctcgccgagtactcgacgatcgcgggcaacaccatcgcgtacggcgcgaccggcggcgagctgttcctgcgcggtcgtacgggtgagcggttctgcgtccgcaactccggcgcgacggtcgtgtccgagggcgtgggcgaccacggctgcgagtacatgaccggtggccgcgcggtggtcctcggcgagacgggccgtaacttcgcggccggcatgtccggcggcgtcgcgtacgtcatcgacctcgaccgcgacaacgtcaacgtcggcaacgccggcgccgtcgaggagctgaccgaggacgacaagcagtggctgcacgacgtggtgcgccgccacgccgaggagaccggctccacggtcgccgagaagctcctcgccgagtggtccgtctccgcgcagcgcttcagcaagatcatccccagcacgtacaaggcagtgctcgccgccaaggacgccgccgagcgagccggtctcaccgagaccgagatcaccgagaagatgatggaggcggcgaccaatggc

SEQ ID NO: 6167 - DNA, 1458 bp, Streptomyces avermitilis
  CDS (1)..(1458)
atggctgatcccaagggcttccttacgcacggccgcgaggtcgccaggacccgtccggtcgaggagcgggtcaaggactggaacgaggtctacgtccccggctcgctgctgccgatcatctcgaagcaggccggccgctgcatggactgcggcatcccgttctgccacaacggctgtccgctcgggaacctgatccccgagtggaacgactacgcctaccgcgaggactggacctccgcgtccgagcggctgcacgccacgaacaacttcccggagttcacgggccgcctgtgccccgctccgtgcgagtcggcgtgcgtgctgggcatcaaccagcccgcggtgaccatcaagaacgtcgaggtctccatcatcgacaaggcgtgggacaccggcgacgtcaagccgcaggcccccgagcgcctgtcgggcaagacggtcgcggtcgtcgggtccggccccgccggtctcgccgccgcccagcagctgacccgggccggtcacacggtcgcggtgtacgagcgcgcggaccgcatcggcggcctcctgcgctacggcatccccgagttcaagatggagaagcggcacatcaaccgccgtatcgagcagatgcgcgcggagggcaccaagttccgcacgggtgtcgagatcggccgcgacatcgacgccgcgaagctgcgcaggcgctacgacgcggtggtcgtcgccgcggggtccacgaccgcccgtgacctcccggtccccggccgtgagctcaagggcgtctaccaggcgatggagtacctgcccctggccaacaaggtgcaggagggcgacttcgtggccccgccgatcaccgccgagggcaagcacgtcgtcgtgatcggcggcggtgacacgggcgcggactgcgtgggcaccgcccaccgtcagggcgcggcctcggtcacgcagctggagatcctggcgaagccgggcgaggagcgcgccgcgcaccagccctggccgacgttcccgatgctctacaaggtcacctccgcgcacgaggagggcggcgagcgggtctactccgtcagcaccacccacttcgagggcgacgaggacggcaacgtccagtggctgcacctggtcgaggtcgagttcgtcgacggcaagctgacccagaagccgggcacggagcgcaggatcccggcgcagctggtgacgctggcgatgggcttcacgggcacggaccaggacaacggactggtcacccagttcggcctgggcctcgacgagcgcggcaacatcgcgcgcgacgcggacttccagaccaacgtccccggtgtcttcgtcgcgggcgacgcgggccgcggccagtccctgatcgtctgggccatcgcggagggccgctcggccgccaagggcgtcgaccgcttcctcaccggcgcgagcgaactgccggcgccgatccgtcccacggaccgctcgctgatggtc

SEQ ID NO: 6168 - DNA, 852 bp, Streptomyces avermitilis
  CDS (1)..(852)
atgaaacgtgccgctctcctgctgctcacggccgtccccgccgccgtcgccgcggcgacggcggtctacctcttcggcctcgcgccctcggacccggacaggaccgagagccccaagcccccgtcgcggcagtcctccgcgagcgcgcagggcctgaacgcccccgccaagaaggagctggcgcaggagatcgtggcgagcgcggagaactccaccctggactggcgcagcgcctacggctacgtcgaggacatcggtgacggccggggctacacggcgggcgtcatcggcttctgcaccggcacgcacgatctgctcaccctggtcgagcgctacacgaaggaccaccccggcaacggcctggcccgcttccttcccgcgctgcgcgcggtggacggcacggactcccacgcgggcctgggccgggcgttcacggcggcgtggcgggcggaggccggcgtcgcggccttccgcgcggcccaggacgcggaacgcgaccgcgtctacttcgacccggccgtccgtctcgcccggcacgacggcctgggcgcgctcggccagttcatctactacgacgcgatggtcgtccacggcccgggcaccgacccgcacagtctccagggcatccgcgcccgggccctgcgggaggcggacacccccgcggagggcggctccgagacgaggtacctggacgccttcctggacgtgcgccgcacggtgatgaagtccgagaagtcccaccacgacacgacccgcatcgacacggcccagcggcggttcctgtacgacggcaacctggacctgcgcacgccgctggagtggcgggtgtacggggagcggtaccgggtgccg

SEQ ID NO: 6169 - DNA, 963 bp, Streptomyces avermitilis
  CDS (1)..(963)
gtggaacccaagtccccggagtcacccgagaccccggactcccccgagtcacctgagtccgccgactccgctgtcaccacctgctaccgccatcccaaggtggagtcgcacgtccgctgcatccggtgcgaccggtacatctgcccggactgcatgcgggaggcgtccgtcggtcatcaatgcgtggagtgcgtgaaggaaggcgcgcggtcggtacggcaggcccgcacggccttcggcgggcggatcacgacggcccccctggtgacgtacgtactgatcggcctcaatgtgctggcctacctgggcgaggtgctgcggccggcgctcgtggaccggttccagatgctgggcgcgggtcttgccgggccggacggcgggcactacctgtggcaggacccgtacccctcgtccttccacgcggagggtgtcgtgggcggggagtgggagcggctgctgaccggcgcgttcctgcatctgccgcccaccgagggcacgttcgggatcctgcacatcgtgatgaacatggtgtcgctgtggaacctgggccgggtggtggaggcccagctcggccgtgtccgcttcctcgccctctatctgctgtcggcgctcggcggctcggtgctggtgctgctgatcgcgcccgacacccccacggtcggcgcctcgggggcgatcttcggtctgggcgccgcgtactacgtgatggcccgccgcctgggcgccgacatgcgcgccgtcaaccgcttcatcgcgggtctgctgctgtggctgctgatctcggcgggcctcacgtcctggcagggccacctcggcggactgctggcgggcggcctggtcacgctggcgtacgcgtacgtaccgcgcggcccccggcgcggtctgctccaggcggccgcgtgcgtgggcctgctggcgctcctgctggtcctgacggtggggaaggtgtccgggctgacgggc

SEQ ID NO: 6170 - DNA, 717 bp, Streptomyces avermitilis
  CDS (1)..(717)
atggccgcgatcagcctcgccaaggtggaggagaccgcgcccgcgctggtcagcctgtacaagagcgccggggtgtccctgcacaagcacggccttgacggtcagcgggccgccgtctatctcgtggtcgactactcggggtcgatgaggccgtattacaaggacggcagtgtgcaggcgctcaccgaccgggtgctcggtctgtcggcgcacctcgacgacgacgggaccgtgccggtcgtcttcttctccacggacatcgatgccgtcacggacatcgcgctcgccgaccaccagggccacatcgagctgatcgtggccggactcggacacatgggcaagaccagctatcacctggccatggacgccgtcatcgaccactacctcgacagcggttccaaggaccccgccttcgtcgtcttccagacggacggtgggcccaccagcaagccggccgccgaacggtacttgtgcaaggccgccgagctgcccctgttctggcagttcatcgggttcggggacccgggaagccgacagttcgaattcctgcgcaagctggacgagttggcggttccgcacaagcgggtggtggacaacgccgggttcttccacgccggtacggatccgcggaaggtgtccgacggcgagctgtacgaccgactggtgggcgagttcccccagtggctggcggccgcccgcacccacgggatcgtccgg

SEQ ID NO: 6171 - DNA, 612 bp, Streptomyces avermitilis
  CDS (1)..(612)
gtggctggcggccgcccgcacccacgggatcgtccggtgaccgtcctgcttcccgccgccgaacgcgtggccgtggcctggaagaacggcggcggggtgacccgcgagatcgccgccgcgccgcccggtgcggacatggccgccttcgcctggcgcgtcagcctcgccgaggtcgccgcggacgggccgttctccgcgtttcccgaggtggagcggaccctcaccctcgtcgagggcgccggcatggacctgacggtgggcgggcggcggcggctcgtcgacacgcggtacgtgccccaggacttccccggtgacgtgcccaccgactgccggctgctcggcggccccgtcgtgaacctcaacgtgatgtggcgcaggggcggcgcggccccgaccgtcgccgtcgtacgcggccggctgcgcctgcccgcggcgcccgccctggtggtcgccctcgacgggggcgcggacctggccggggtgcggctcggccgctacgacgccctgttgctgaccggcgaggacaccgtgctgcacgcacacgggccgacggcggtcgtcggactcacccccgcccgggggctcgcggccctcacgcacgacgagcggcac

SEQ ID NO: 6172 - DNA, 957 bp, Streptomyces avermitilis
  CDS (1)..(957)
atgcgttttctgctgtcgccgcagcagcgggacttcgcccgctccctggacgcgatgctgacggccgccgacaccccctcggtcatccgcggcgaccacacggcccggcgcgccctgtggtcccggatcgcggaggcgggcgtcttcgcgccggcggtgcccgaggcgtacgagggcatgggtccgctgccggtggacctggccgtggcgttcgtggagctggggcggcatgcggtgccgggtccggtggtggagacggtgctggcggcggcgctgctggccgcgctgcccgagccgggtccggccaagcggctgcttccggggctggcggcgggcgagaccgtggccacggtgggcgctccgtacgcgctggacggggacgccgcggacgtcgtgctcgccgtgcggggcggggagttgtggctcgcgccgggcgtcgcggacgtacggccgtcgctcgatccaggccgccggatcaccacgcccctgcccggcggcgaacggatctcctcgcgggtgccggggcacgcgttcgactgggcccgcctcgccaccgccgcccaggccctcggcgtcggtctcgccctcctcgaccgcacggtcacccatgtcacgcggcgcgtccagttcggtgttcccaccggttcgttccaggcggtcaagcaccgactggccgacgcgaagaccgccctggagttcgcgcgcccgctgctcttcggagccgcggtgacactggctccccgggacgtggccgccgccaaggccgcggcctgcgaggcggcgtacgcgaccgcccgcaccgcgctccagctgcacggcgcgatcggctacaccgccgagtacgacctctccctgtggctgaccaaggcccgtgcgctgcgcacggcgtggggctcgccggccgagtgccgggccgacgtcctcagtgccgatgtcctcagtgccgctcgtcgtgcg

SEQ ID NO: 6173 - DNA, 1137 bp, Streptomyces avermitilis
  CDS (1)..(1137)
gtggacctgacgcactcccccgccgacgaggcgttccgtaccgaggcccgggcctggctcgccgcgcacgttccggccgtcccgctgccctccctggagaccgaggagggcttcggggcgcaccgcgcgtgggaggcggagctggccgcggaccgctggtcggtggtgtcgtggccggccgcgtacggcgggcgggacgccgggctcctgcggtggctggtgttcgaggaggagtactacgcggcgggcgcgccgggccgcgtcggccagaacggcatcagcctcctcgcccccacgctcttcgaccacggcaccgaggagcaacgcgcgcgtgtgctgccgccgatggccaccggcgaggtgatctgggcgcaggcgtggtccgagcccggggcgggctcggatctcgcctcgctcacctcgaaggccgtgcgcaccgagggcggctggctggtgaacgggcagaagacgtggtcgtcgcgggcggcgttcgcggatcgcgcgttcggcctcttccgcagcgagccgcgcaccccgaagccccatcagggcctcacgtatctgatgttcgacctgcgtgccccgggcgtcacggtccgcccgatcgggcgcctggacggcaaaccggccttcgccgacatcttcctggacgacgtgttcgtccccgacgaggacgtgatcggcgagccggggcagggctggcggatcgcgatgtccgcggcgggcaacgaacggggcctcaccctccgctcccccggccgcttcctcgccgccgccgaccggctggtggagctctggcgcgggcggggcagcccgtcgcaggagcgtgagcgggtggcggacgcggtgatcggcgcccgcgcctaccagctgttcgcctacgcggccgcggcccggttcctggacggcgagcccatcggcccggagtccagcctgaacaaggtcttctggtccgagtacgacatcgcgctgcacgagacggccctcgatctcctcggccgggacggggagctcgcggacaccgactgggcggagggctatgtcttcgccctggcaggccccatctacgcgggcacgaacgaaatccagcgcgacatcgtcgccgagcgtctgctcggcctgccgaaggggcgccgc

SEQ ID NO: 6174 - DNA, 789 bp, Streptomyces avermitilis
  CDS (1)..(789)
atgacagacgtcgaggccccggtgtacgtgtccgggcacggcctgctccaggggcgcacggccgtcgtcacggcggcggcgggcgcggggatcggcggggcgaccgcccgccggttcctggaggagggcgcgcgcgtactgatcagcgacgcgcacacccggcgcctcaaggagtacgaggcggagctggcccgggagttcgagggcgcggccgtcgccgcgctgccgtgcgacgtgacggacgaggaccaggtgcgggccctcttcgacacagccgtccgactgcacggcggactcgacatagtcgtcaacaacgccggtctgggcggcacttcggacctggtcgacatgacggacgagcagtggtcgaacgtactcgacgtcacgctgaacgggacgttccggtgcacccgcgcggccctgcgcctcctcagggagcagcccggcggcggagtgatcgtcaacaacgcgtccgtcgtcggctggcgcgcccaggcggggcaggcccactacgcggcggcgaaggcgggcgtgatggccctgacccggtgcgcggccatggaggcggccgggtacggggtccgggtgaacgccgtggcgccgagcctcgccatgcacccgcacctggtgaaggtgacgacccccgaactgctggaggaactgaccgggcgggaggccttcgggcggtacgccgagccctgggaggtggccaacgtgatcgtgttcctggcgtccggctattcctcgtacctgacgggcgaggtcgtctccgtcagcagccggcatgcc

SEQ ID NO: 6175 - DNA, 612 bp, Streptomyces avermitilis
  CDS (1)..(612)
gtgaccgccgcaccggagcgccgccgcgaactcctcgacaccgcagccgaggtcttcgccgagcagggctacaacgccaccaccgtacgcaagatcgcggaccatgccggcatgctcgcgggcagcctctactaccacttcgactccaaggaatcgatgctggaggagatcctgcggaccttcctcgacgagctctgggacggctacgacaccgtcctggacgccgaactcgggccgcgcgaaaccctggaggcgctggtcaccgagtccttccgggagatcgaccggcaccgtgcggccgtcgcgatctaccagaaggagtcgaggcaactcgtggcgcaggagcggttcgcgttcctcgccgagtcgcagcgcaggttcgagaaggcgtggctggccacgctggagcgcggggtcgccgccgaggtgttccgggccgacctcgacatccggctcacctaccggttcgtacgcgacacggtgtgggtcgccgcgtcctggtaccggcccggtggacagcaccgcccggaggagatcgcccggcagtacctgtcgatggtcctcgacgggatcgccgtccgtacgtcgcccctcacgttgcccgtccgtaca

SEQ ID NO: 6176 - DNA, 1155 bp, Streptomyces avermitilis
  CDS (1)..(1155)
atggccgaggcctacatcgtcgaagcggtccgtacgcccgtcgggcggcgccggggagggctggccggggtgcacccggcggacctgggcgcgcacgcgctgacggcgctggtcgcacgctccggcatcgatcccgccgccgtcgaggacgtggtcttcggctgcctggacacggtcggaccgcaggccggcgacatcgcccgcacgtgctggctggccgccggactgcccgaggaggtgccgggcgtgacggtcgaccggcagtgcggatcctcccagcaggccgtgcacttcgcggcacaggccgtgctgtccggcacgcaggacctggtggtggcgggcggggtgcagaacatgtcgcagatacccatcgccttcgcctcccggcaggccgccgagccgctcgggctgacccaggggcccttcgcgggcagcgagggatggcgggcgcgctacggggacctgcccgtcaaccagttccacggcgccgaactgatcgccgcgaaatgggggatcacccggcgtgaccaggaggagttcgcgctgcgctcgcaccggcgggccgtccgcgcgagcgacgagggacgcttcgaccgggagaccgtggcgtacgggaaggtcacggccgacgaagggccgcgccgggacacctcgctggagaagatggccgcgctggcgcccgtgatcgagggcggcaccatcaccgccgcctgttcctcgcaggtctccgacggcgcggccgcgatgctgctggcctcggagcgggcgctgcgcgagcacgggctgaccccgcgtgcccgcgtccaccatctgtccgtgcggggcgaggacccgatccgtatgctgtcggcgccgattccggcgaccgcgcacgccctgaagaagaccgcgctggccatcgacgacatcgacctcgtcgagatcaacgaggccttcgcgccggtcgtgctggcctggctcaaggagacgggcgccgacccggagaaggtcaacgtcaacggcggcgcgatcgccctcggacatccgctcggcgccacgggcgtgcggctgatgaccacgctgctgcacgaactggagcgcaccggcggccggttcggcctccagacgatgtgcgagggcggcggccaggcgaacgtgacgatcatcgagcggctc

SEQ ID NO: 6177 - DNA, 1056 bp, Streptomyces avermitilis
  CDS (1)..(1056)
atggacaccgcgctcacccgtctggtcggggtccgccatcccgtcgtacagaccggcatgggatgggtggcgggtccccgtctggtctcggccacggcgaacgcgggtgcgctgggcattctggcctccgcgaccatgacccccggccggctgcgggacgcggtacgggaggtgcggtcccgtacggacgcgccgttcggggtgaatctacgcgcggacgccggggacgcgggcgagcgggtgcggatcatcgtggaggaaggggtgcgggtggcatcgttcgccctcgccccctcccgtgagctgatcgccgagctgaaggacgcgggtgtcgtcgtcatcccgtccatcggtgcccggcggcacgccgagaaggtggccgcctggggtgcggacgcggtgatcgtgcagggcggggagggcggcgggcacacgggcgaggtggcgacgagcgtactgctgccgcaggtggtggacgccgtcgacctgcccgtggtggcggcgggcggcttccacgacgggcgggggctggtcgccgcgctggcgtacggcgcggcgggcgtcgccatgggcacccggttcctgctgacctcggactcgacggtcccggacgcggtgaaggcggcgtatctggcggcgaccgtcaaggacgtcacggtgacgacggccgtggacggcctgccgcaccgcatgctgcgcacgccgttcgtcggctccctggagaccgctggccgtacgagggcgctggtccgggcggtgcgcggggcggcgggcttccggaagctgtcgggcctgacgtggtcccggatgatccgcgacgggctcgccatgaagcacggcaaggaactgacctggagccaggtcctgctcgccgcgaacacgccgatgctgctcaggtcctcaatggtggacgggcggacggatctgggggtgatggcctcggggcaggtcgccggggtgatcgacgacctgccgtcgtgcgcggaactggtggagcggatcatggccgaggcggaacggacactcaaaggcctggagcgtctcagggccgctcgg

SEQ ID NO: 6178 - DNA, 738 bp, Streptomyces avermitilis
  CDS (1)..(738)
atgaccctctccaggaccgccacccgcgccgagcactgcgtgatcgcctgcgccgaggcctggcgggacgccggggagatcctcgccgcccccatgggcccggtcccgtccgtcggcgcgcggctcgcccggcgcaccttctcgccggacctgctgctgaccgacggcgaggcgctgctcgtcggcccggacggcacaccggagggctggctgccgtaccggcagcatctggccctcgtcacgaccggccggcggcacgtgatgatgggcgcgagccagatcgaccgcttcggcaaccagaacatctcctgcatcggcgactgggccgcccccgcgcgacagctgctcggggtgcgcggcgcaccggtcaacaccctgaacaatccgaccagttactggatcccgaggcactcgaagcgcgtgttcgtcgagcgggtcgacatggtgtgcggcgtcggctacgaccgtgcggccgagcaccccggcacggcccgtttccaccacatcccccgggtggtgtccgacctcggggtcttcgatttcgcgacccccgaccactcgatgcggctggcctcgctgcatccgggggtcacggtggagcaggtgcgggcggcgaccggattcgagctgacggtccctgacggtgtgccgttcacccgtgaaccgacgccggcggagctgcggttgatccgggaggtcatcgacccgggcaacagccgcgaccgtgaggtgcggacc

SEQ ID NO: 6179 - DNA, 846 bp, Streptomyces avermitilis
  CDS (1)..(846)
gtgagtgacaagaccatgaccgccgacgaggccgtctcccgcctgcggagcggtatgaccctcggcatcggcggctggggttcgcgccgcaagccgatggccctggtgcgagcactgctccgctccgggatcaccgatctcaccgtcgtctcgtgcggcggcccggacgtcggcatgctcgcggccgccgggcggatacggaaactggtcgccgccttcgtgaccctcgactcgatcccgctcgaaccgcactaccgcgcggcacgcgagcgcggggcgctggagctgatggagatcgacgaggcgatgttcctgtggggactgcgcgcggcggccggtcggctcccctttctgccggtgcgggcgggcatcggctccgacgtgatgcgggtcaaccccggcctgcggacgatcacttcgccgtacgttgacggggagaccttcgtcgcgatgcccgccctgcggctggacgcggcgctggtgcatctgaaccgcgcggaccgcctcggcaacggccagtacctgggcccggacccgtacttcgacgacctgttctgcgaggcggccgacacggcgtacgtctcctgcgagcgggtcgtcgacacggcggagctgacgaaggaggcggcaccgcagacgctcctggtgaagcggcacacggtgacgggcgtcgtggaggcgccgaacggcgcggacttcacctcctgcgtacccgactacggccgggacgaggccctccagaggtactacgcgaccacgccgtggccggagttcgccgagcggttcctcggcggcggcgaaccggcctaccggtccgcggtccaggactggcgcaaggagcggata

SEQ ID NO: 6180 - DNA, 756 bp, Streptomyces avermitilis
  CDS (1)..(756)
atgactgtctccacctcgttcccggaaaaggggatcgccgtcgtcacggtcgacttcccgccggtgaacgcactgccggtgaccggctggcaggacctggccgacgccgtacgggcggcgggccgcgacccccgggtccgctgtgtcgtactggccgccgaggggcgggggttcaacgcgggcgtggacatcaaggagctacaggcgaacggccacagcgccctgatcggcgccaaccgcggctgcttcgaggcgttcgcggcggtgtacgagtgcgaggtgcccgtcgtcgcggcggtgcaggggttctgtctgggcggcggcataggcctggcggggaacgcggacgcgatcgtggcgagcgacgacgcctcgttcgggctccccgagctggaccgcggggcgctgggtgcggccacgcatctcgcgcggctggtcccccagcacctgatgcgcgccctctactacacgtcgcggacggcgacggcggccgaactgcgggcgcacggctcggtctggaaggtcgtaccgcgcgcggaactccacggagcggcgctggagctggcccgcgagatcgccgccaaggacggccggctgctgcggctcgcgaaggccgccatcaacgggatcgacccggtggacgtgcgccgcagctaccgcttcgagcagggcttcaccttcgaggccggcctcgacggggtcgccgaccgcgtccgcgacacgttcgggaagccttcggaagggcaggtgcccagg

SEQ ID NO: 6181 - DNA, 828 bp, Streptomyces avermitilis
  CDS (1)..(828)
atggagctgaacgggaaggtcgccgtcgtcaccgggggcacccgaggcgtcggcgccgggatcgcgcgggccttcgccgcggcgggcgccgaggtggtcgtctgtgcgcgcagaccgcccgaagtgctcctgaaaggagccgagttcgcgcgcctggacctgcgggacccggatgccgtaggggccttcttcggtgcgctgccccggctcgacgtcctggtcaacaacgcgggcggcaccccgtaccggaggctggccgacgtggacgcggcccgtcacgcgcgcgtggtcgagctgaacctcgtcgccccgctgaccgcctccctcgccgcgtacgagcacctcaagcgggccgggggcgccgtcgtgatggtcggcagcgtgagcggcggccgtccgtcacccgggtcggcggcgtacggcgcggccaaggcggggctggagagcctcgcccgttccatggccgtggagtgggcaccggagatccgggtcaacacgctcgttctcggcatggtccgcaccgagctgtcccacctccactacggcggtgccgagggcgtcgccgccgtctcccgcaccgtgccgctcgggcggctcgccgaaccgtccgacgtcggtgccgccgccgtcttcctggcctcggacgccgccgcgtacatcagcggcgcgagcctgctcgtgcacggcggcggggagccgccggcgttcctcggcgcggcaacggccaacagggggacgcgacacgagatgccacgggagaagcgacgggagaagcgacaggaggaggagtgggcccgacaggaggaggagcaggaggaggagtgggga

SEQ ID NO: 6182 - DNA, 945 bp, Streptomyces avermitilis
  CDS (1)..(945)
gtgggcccgacaggaggaggagcaggaggaggagtggggatgaccggtatcgccgaggggcgggtcgtgatcgtcaccggcgcgggccgggggctcggccgcgcgcacgccctcgcgtacgccgcggagggcgcgaaggtcgtcgtcaacgacctcggggtcggactcgacggcgcgccgggcccggacagcccggccgggcgggtcgtggacgagatccgcgcggcgggcggcgcggcggtcgcccacggcggcgacatcgcgacgagtgcgggggccgcgtccctggtggccgccgcgctggagacgtacgggcggctcgacaccctcgtcaacaacgcgggcttcctgcgcgaccggatgctcgtcaacctcgaagaggacgactgggacgccgtgctgcgcgtccatctgacagggcacttcctgccgctgaggcatgcggcggcgcactggcgggcggagacgaaggcggggcggacaccgcgggccagaatcgtcaacaccagcagtggggccgggctgttggggtctgtggggcagggcaactacagcgcggcgaaggccgggatcgtcggactgacgctggtcgcggcggccgagctcgcgcggtacggcgtccaggtgaacgcgatcgcgcccgccgcccgcacccggatgacggagcgtgccttcgccgggacgatggcggcgcccgacgccggcttcgacgccatggcccccgagaacgtgtcgccgctggtggtctggctcggctccgccgcgagcgccggggtcacgggacgcgtcttcgaggcggagggcggccggatcaccgtcatggagggctggcgtccgggcccgaccgccgacaagggagcacgccggacgccggcggaggcggggaagacggcccggaaactgctcgcggaggcggaggtgccgggggtggtgtacggggcgggg

SEQ ID NO: 6183 - DNA, 924 bp, Streptomyces avermitilis
  CDS (1)..(924)
atgaacacgcaagaaccggcgggtcttttcacggcggtgtacgaaggggacgaaaacacggtcgtgcggctgctgcgcgcgggcacggccgccgatgcgcgggacgaggacggtcagacggccctgtatctggcggcggtgagcaacgagcccggcatcgtacggctgctgctggcggccggagccgaccccgaccggctgagcgcggacgcggactccccgttgtgcggcgcggcctgcgggggccacgcggaggtcgtccgcgccctgctggcggccggggcgacggccgacctggaggaggagttcggcttccgggcgctgacgtgggcggtgcagcgcgggcaggtggagatcctcacggaactcctggccgccggtgcgcatccggaccgccccggccccaccggcgaggccccgctggtcgccgcggcgcggcggggctccccgggttgtgtgcgcgcgctgctggcgcacggggccggcgcacgctccccggcgctggacgaggcgcggcgctggccggcactcgacgtcgaggccgaactgcgcgcgggtcttgagcagatgtacggctccggccacgagatggtgacccaccggattccggaggacggcggcatcaccgtcgaggtccaactccgcaccggggaacgcacgatggcgggcaacgaccagcagacgggccacgcggccatcatcacgctcctggaggccgcgctggggatcgccaccccggtcccggaactcgccgaccgcgccctgcgctgcggcgatcccgccaacgacgactggacggaggcggtgtcggtgctcgtccgccgggcgggcggggagaccttcaccgcggcgaccgcttggtcccgctccccggacccactgcggcgggccctcgggacggagatcctgcggaagctgggcagg

SEQ ID NO: 6184 - DNA, 894 bp, Streptomyces avermitilis
  CDS (1)..(894)
gtggcgaacggcggtcccgtcgagcacggctacccgcatctggacacggtgcgggcggccatcaccgcgctgtacaaacggctctcctacgacaccatccacaccttcgcggccagcgtggcccccgccgacgtggccttcgccgaccacgacgacctgcacctgggcgcacagcgcgtggcacacgagatggtgcggcactaccggctgccggacgcccggatgatcgtcggcttccgcgagatgacccatgcggcgaacgtcgaactcgccgcggggccggagtacttcatcgagctgaacgaccgcttccgcacccaccgccgggacatcggcgcggccctggcgcacgaggtgatgcacgtgtacctgcaccgcctggacctgtccttcccgggcacccgcgacaacgagatcctcacggacacggcggcgacctatctgggcgcgggctggctgcttctcgacgcgttccgcgaggacgcggcctcgtcccagaagctcgggtatctgacgccggaggagttcggctacgtcctcgccaagcgggccctggtcttcggtgaggacccctcgatctggttcaccagcccgcaggcgtacacggcgtacacgaagggcatggcgcaggcccgccgggacgagcagcagcccccgctgacggcggcgggctgggcgggccgccaccgttacgcgaaggaccgccgccacgcccaggaccaccgctcccccggcccgcagccgggcgtcccctacgccttcgcccccggcgaccgcggcctcctgcgggtgtcgttcccctgccccacctgtcaccagcgcatcaggatcccggtgcgcggccgggtccgggcacgctgcacgctgtgccggacggtgctggagtgcgacacg

SEQ ID NO: 6185 - DNA, 873 bp, Streptomyces avermitilis
  CDS (1)..(873)
gtgcatgccattcaggctgtgcggcatgccgtgcggtgctccgcggtgcccccgccaggcgtgcaaccccccacgagaggaaccacgttgaacatcccgaagatcctgaagagattcggcggcctcaagagagccctggccgtcggcgccgtcacgctcgccgcggtctcgctccagccgctctccgcgcaggccgcgccgcagcccgtcgtcggcggcacccgggccgcacagggcgagttcccgttcatggtgcggctctccatgggctgcggcggcgccctgtacaccaagcagatcgtcctgaccgccgcgcactgcgtgagcggctcgggcaacaacacctccatcaccgccaccgccggcgtcgtcgacctccagagcggcagcgcggtcaaggtcaagtcgaccaaggtgctccaggcccccggctacaacggcaagggcaaggactgggccctgatcaagctcgccgccccgatcgagcagcccaccctgaacatcgccaccaccaccgcgtacaacaacgggaacttcaccgtcgccggctggggcgccgcccgcgagaacggcgcccagcagcgctatctcctcaaggccacggttcccttcgtcagcgacgcctcctgtcagcagtcgtacggcagcgacctcgtacccggcgaggagatctgcgccgggttcccgcagggcggcgtcgacacctgccagggcgactccggtggccccatgttccgcaaggacgactccggcgcgtacgtccaggtcggcatcgtcagctggggcgagggctgcgcgcgggccggataccccggggtgtacaccgaggtgtcgacgttcgcggccgacatagccagggcggcggccggactc

SEQ ID NO: 6186 - DNA, 453 bp, Streptomyces avermitilis
  CDS (1)..(453)
atgaccatggaccaacagccttccatcaccgcgtcgttgcaggtgggcgagaaggacagcccactggaacggcggctcgacagggaactcaccgccttcaacgcggacgccaccggcgccggcgaacccgccccgctctccgtccgcgtcaccgactccgcgggcgacctggtcggcggcctgaccgcctgggtctggggcagctgctgcgcggtcgacatgctgtgggtgcgcgaggaccagcggcacgcgggctggggcggaaaactgctgcgggcggccgaggaggagagcgcacggcgcggctgcaccgagatgatcgtctcgtccttcaccttccaggcccccgacttctaccgcggccacggctaccgcgagacaggccgcaccgaaggcatcccgggcggccatcaggacgtccacttccacaaagtcctggagcccaccgcccgt

SEQ ID NO: 6187 - DNA, 387 bp, Streptomyces avermitilis
  CDS (1)..(387)
atgaccaacagcaacacccgcaccggcaccggtgacgtcgaccccgccgtccgcgccgaactcgcccggctgcgcgacagcatcgacaacatcgacgccgccgtcgtccacatgctcgccgaacgcttcaagtgcacccagcaggtcggccacctcaaagccgtacaccagctgccgcccgccgacccggcccgcgaggccagccagatcgcccgactgcgccggctcgccgagaacgccaaactcgacccggcgttcgccgagaagctgctgggcttcatcatcgccgaggtcatccgccaccacgagcgcatcgcggacaacaccgcgaacggctcggtgagcgcaccgccggccaccgaggacgacaccaccggccccgcggag

SEQ ID NO: 6188 - DNA, 555 bp, Streptomyces avermitilis
  CDS (1)..(555)
atgccgtcggatgccaggatcctcatcgtcgacgaccatgaggacacgctgtacgcgctggagagcacgctggccccgctcggctatctgctgtcccgcgcgaccagcggcgacgacgcgctcaaggaagtcctgcgcggccaggtcggactcctgctgctcgacgtacgcatgcccggcgtcagcggactggacgtcgtgcgctacatgcggcgcctggaacagacccagcacatccccatcatcctgctcaccggcttcggcctggacgccgaactcaccaccaccgccttcgcactcggcgtcgccgacctggtcacgaaacccgtcgacccctggtccctgcgcaccaaggtccgctacctgtacgacgcccaccagcgcagccaggccctggaacgagaagtgcgcgaactgcgcgccctcgccaagaacgagcacccccagccccgctcccaggcccagccccacccgtccccagcccaaccccagccacacgcccacgtccccgtcccacgcgagccccccgcccagaagccggcgcaggaccgcacc

SEQ ID NO: 6189 - DNA, 2538 bp, Streptomyces avermitilis
  CDS (1)..(2538)
atgtccctcatgtccgtactgacgcgcgacgaagcgcagacccgtgccagtctcctcgacgtccaccactacgcgatcgccctcgatctgaccgtgggggacgagaccttcgactcccgcaccgtcatcaccttcacggtacggggggaccacgacgtcgcggacaccttcgtcgagctgaagcccgccgagctgcgctccgccaccctggacgggcagcccctggacaccgcgaccctggtcgagaaccgactgccgctgacgggcctgacccagggcgagcacgagctgcgcatcgacaccgccatgggctactcccgcaccggcgaaggcatgcaccgcttcaccgaccccaccgacggcgagacatacgcctacacccagctgttcatggacgacgtgcagcgcgtcttcgccgccttcgaccagcccgacctcaaggccgtcttcgaactcgagatcaaggcccccgaaggctggaccgtcctcgccaacggcgtcaccaccgacgtgggcgacggcacctggaaggccaccgccacccccctcatctccacctacctcgtcgccgtcgccgccggcccctggcactccgtacacaccgaacaccgaggcctgcccttcggccttcactgccgccgctccctcgccccccacctcgacgcggacgccgacgaactcctcgacatcacccgcgcctgctacgaccgctaccacgagaagttcgaggagccctaccccttcgactcctacgaccaggcgttcgtccccgagttcaacgccggcgccatggagaaccccggcctcgtcaccttccgcgacgagttcgtctaccgctccgccgtcaccgacaccgagcgccagacccgcgccatggtcatcgcccacgagatggcccacatgtggttcggcgacctcgtcaccctgcgctggtgggacgacatctggctgaacgagtccttcgccgagtacatgggctaccagaccctcaccgaagccagcctcggggggtccggggggactccccccagaaagtggggcaccgacacctggaccgacttcggcgtcacccgcaaaccctggggctacgacgccgaccagcgcccctccacccaccccgtcgccccggaagccgtcgacgacaccgcctccgccctcctcaacttcgacggcatctcctacgccaagggcgcctccgccctgcgccaactcgtcgcctggctgggcgagaaggacttcctcgccggcatcaacacccacttcacccgccacaagttcggcaacgccaccctcgccgacttcatcgactccctcgccgccgccaccgaacgcgacgtccacgcctgggccgactcctggctgcgcacgaccggcgtcgacaccctgaccccggacatcaccacggcccccgacggcacctgcgccctgaccgtcgagcgcgacggcagccgcccgcaccgcatcaccgtcggcctctacgaccgcgacctcaacgacgaggcccgcctcaccctgcgccgccgcctcgaactcgacatcccccaggaccccgccgaaccacagcccctcggcaagcgccccgccctgctcctcctcaacgacggcgacctcacctacgccaaggtccgcttcgaccccgaatccttcaccaccgtccgcgccgccctgtccggcctgcccgaccccctcacccgcgccgtcgtctggaacgccctgcgcaacgccgtacgcgacggccatctcccgcccaccgcctacctgcagaccgcccgcgcccacctcccgcacgagacggacctcgccctcgtccagggcgtcctggccttcgccaccacccacgtggcgggccgctacctgtcggccgccgaccgacccgccgccctcgccaccctcaccgacctgtgccgcgacctgatccgccgcaccgaggacggctcccagcccggcctgcgcctgaccgccgtacgccacctcatcgacgtcgccgcccaccccgacaccctcagcagctggctctccgaaggcaccgtccccggcggccccgaactcgaccccgaactgcgctggcgcatcctcggccgcctcgccgtcctcggcgccatcgacgacgacgtcatcgaggccgaactcgtccaggaccccagcgccagcggccaggaaggcgccgcccgctgccgggccgccctgcccgaccccgagtccaagcgacgggcctgggaagagatgttcaccaccgaccacctctccaactacctgttcaccgccaccgcccagggcttctggcaacccgaacaggccgacctcgtacgcgcctacgtcgagcggtactggaccgacgcggtcgccgtcgccgcccgccgcggccccgccatcgccgccgccgcgggccgctgggccttccccgcccacgccgtcagcccggacaccctccgccgcggcgaacagtgcctgcgcgaggccgaccccatcccggccctgcgccgcaaactcgtcgacgaactcgacgacctggcacgggccctgcgggtccgggaggca

SEQ ID NO: 6190 - DNA, 1440 bp, Streptomyces avermitilis
  CDS (1)..(1440)
atgagctcgccgcccctcgcctcaggtcccgaaggcccccacgcgctgcggccgctgctcgagaccgtgctcgacgcactcacggaaggccgccaggcacgcggcggaccactgcccgcaggcggaccccaggccgtcgccgcgcgggtgcgggccacggtcggcgacgccctgccacagaagggcgacccggacgccgtacgccacctcgtccgcatgctcgccgaaggcgccgccgaccccgccgaccccctgtgcgccgcccacctgcactgcccgcccctcgccgtcgccaccgccgccgacctcgccgcctccgccctcaacccctcactcgactcctgggaccaggcccccgccgcctcggagctggaggcgctggtgaccgacgctctcgccgcggagatctacgccggcacaaggacgagtgaccgagcacggccgaccgtcgacaccagcaccagcgccccggaggcgaacgagccacacacgagcacagccctcgtcaccaccggcggcaccgagtccaaccaactcgccctcctcctcgcccgcgaagcccacagcggcgcccggctcgtctgcggagccaacgcccaccactcactcacccgcgccgcctggctcctcggcctgcccgaacccgtcgtcgtccccgcccccgccggcaccctcgaccccgccgccctcgacgaagccctcaccgaactaccgggcccacgcggctccctcgtcgtagccgccaccgcgggcaccaccgacgccggcctcatcgacccgctcaccgacatcgccgacctgtgcgccgcccacggcgcccgcctccacatcgacgccgcctacggcggaggactgctgttcagcgcacgccaccgccaccgactccacggcatcgaacgcgcccacaccgtcaccctcgacctgcacaaactcggctggcaacccgccgccgccggcctcctcgccgtacgcgacccccacgacctgcacgcactccaccaccacgccgactacctcaacgccgacgacgacacccaagccggactccccgacctcctcggccgctccctgcgcaccacccgacgccccgacatcctcaaaatcgccgtcaccctcaaaaccctcggccgcgacggactcggcaccctcgtcgaccaggtctgcgcccacgcccaggaactcgcccgcctcatccaggcacaccccggcttcgagctctacgacccacccaccatcagcaccgtcctgttccggcccgccgaagcctccgacgacaccgtcgccgcggtacgccgcaccctcctcaccgaaggccgcgccgtcctcggccgcgccgtcctcgacggacagctctggctcaaagccacccttctcaacccccacacccggccgggcgacctggccgcgctcctgaaactggtggaaggacacaccccccga

SEQ ID NO: 6191 - DNA, 1416 bp, Streptomyces avermitilis
  CDS (1)..(1416)
atgagcccgacgccccaccccccacgccacgaacccgaagcaccccgcgacctggcgggcatcggcatcggccccttcaacctctccctcgccgccctcgcccaccccctcaccgaactcgacaccgtcttctacgaacagcgccccagcttcgactggcaccccggcctcctcatcgacggcgccaccctccaagtccccttcctcgccgacctcgtgaccctcgccgaccccaccagcccctggtccttcctcaaccacctcaagacccgcgaccgcctcttccccttctacttcgccgagcgcttccacatccagcgcgccgaatacgacgcctactgccgctgggtcgccgacagcctccccggcctccacttcggccaccaggtcgacgccgtccgctggaaccccgaacgcgacgtcttcgaagtcgacttcacccaactcgacaccgacggcgaagccgaagccctcggacgcacctacagcaagaacatcgtcctcggcgtcggcaccgccccctacgtccccgaacccctcaagcccctcgtcgaagcccccggcgtgcccgtcatccacgccgcggactacctccagcaccgcgaccgcttcctgaccgccgaacacatcaccgtcatcggctcaggacagtccggcgccgaagtcttcctcgacctgctccgcaaccgccccgccggacacgagaggatccactggctcgcccgcacggaggccttcgcaccgatggagtactccaaactcggcctcgaacacttcacccccgactacacccgctacttccacgccctcaccgaacccgtccgcgaccggctcgtcgccgcccaatggcaactccacaaaggcatcgacgccgacaccatcgccgccatccaccacgagctctaccggcgcaccctgcacggcggctggcccgacgccgtcctcacgcccggcgtcaccgtccgcaccgccggtcgcctcgccaccaccaaagtcgaactccacctggaacacgcccagcagggcacccgctcccgcctcaccaccaacgccgtcgtcctcgccaccggctaccgcgaacgccccctcggccgcatcctcgccggcctcgacccctacctgcgccgcgacagcgccgaacgcccccgcatcgacaaccagttccgcctcgacctcgacccctcggtcaccggcaccgcctacgtccagaacgccgaactccacacccacggcatcggcacccccgacctcggcctcgccgcctggcgcagcgccaccatcctcaactccctcaccggcaaggacctctaccccctcccacaccgcaccgccttcaccaccttcggactccagcagcaaccacacatcccacccgcccgccaggtccacgccctcacgcccctcatcgacggacgc

SEQ ID NO: 6192 - DNA, 1818 bp, Streptomyces avermitilis
  CDS (1)..(1818)
atgccgttgaaccgtcggaagttcttgaagaagtcggccgtgaccggggcgggggtcgcgctgaccggcgcggtcgcggctccggcggcgcaggccgcggaggtgaagggcggggcggcgaagggtgccgggaagcgtccgaagcggtattcgctgacggtgatgggcacgacggacctgcatgggcatgtcttcaactgggactacttcaaggacgcggagtactccgacaaggcggggaacgcgcaggggttggcccggatttcgactctggtggaccaggtgcgcaaggagaagggccgctgcaacaccctgctgctcgacgcgggtgacacgatccagggcacgccgctgacgtactactacgcgaaggtggacccgatcaccgcgaagggtggtccggttcatccgatggcgcaggcgatgaacgcgatcgggtatgacgcggtggcgctcggcaaccatgagttcaactacggcatcgagacgctgcggaagttcgagtcgcagtgccgtttcccgctgctgggtgcgaacgcgctggacgcgaagacgctgaagccggcgttccctccgtacttcatcaagaagttccatgtgccgggtgcgccgccggtgaaggtggctgtgctggggctgacgaacccgggtatcgcgatctgggacaaggcgtatgtgcagggcaagttgacgttcccggggcttgaggagcaggcggcgaagtgggtgccgaagctgcggtcgatgggtgcggatgtcgtcgtcgtgtcggcgcactcggggtcgtccgggacgtcgtcgtacggtgatcagttgccgtacatcgagaattcggcggcgctggtggcgcagcaggtgccggggatcgacgcgattctggtcggtcacgcgcatgtggagattcccgagctgaaggtgacgaacgcgaagaccgggaagacggtcgtgctgtcggagccgttgtgttacgcggagcggttgtctctcttcgacttcgagttggtgttcgagaaggggaagtgggaggtggagtcggtggtcgcgtcgctgcggaacacgaacgcggtcgcggacgacccgcggatcaccaagctgctgtcggacgagcatgcgacggtcgtgaagtatgtgaaccaggtggtcggtacggcgacggagacgctgacgacggtcgaggcgcgctacaaggacgccccgatcatcgatctgatcaccaaggttcaggaggatgtcgtcagggcggcgctggtgggcacgcagtacgcgtcgttgccggtgatcgcgcaggcgtcgccgttctcgcggacgtcggagatcccggccgggaaggtgacgatccgggatctgtcgagtctgtatgtgtatgacaacacgctggtcgcgaagttgctgacgggtgcgcagctgcgggcgtacctggagtactcggcggagtatttcgtgcagacggcggcgggcacggtggtcgacacggagaagctgacgaacgcgaacaaccggccggactacaactacgactatgtgtcgggtctggggtacgagatcgacatcgcgcaggcggcgggttcgcggatcaagaacctgacgtacaacggtgcggcgctggatgatgcgcagcagttcgtgttcgcggtgaacaactaccgtgcgaacgggggcggtgccttcccgtatgtggcgtcggccgctgagttgtggtcggagtcgacggagatccggacccggatcgcggagtgggtgaccgcgaagggtgtgctggatccgaaggacttcgcgtcggtggactggaagctgacgcgggacggttcgccggtgttc

SEQ ID NO: 6193 - DNA, 759 bp, Streptomyces avermitilis
  CDS (1)..(759)
atgaccagtagccaccccaccgcaccccccagtgacagagtgggacgtatgacccccaccgcggaggaaccccgccccacaggcccctacggcacccccgaagccccccgcatcgccgtccgcggcgaagcccacctcgaagtcgaccccgagatcgcccgcataggcatcaccgtcagcgcccgcggcaccgacagacgcgacgcactcaccgacctcacccgccgcaacaccaccgccctcgacctcgtcaaaacctacggggaagccgtcgagcgactggaaaccggcgccttctccatcacccctgaactcaccaaacacggccgcggcgaacgcatccgcgcctaccacggccgcgtccacatcaccgccgaactcaccgacttcaccgcactgggcgaactcacgacccgactggccgacctcgacctcacccgcgtcgacggcccctggtgggccctgcgccccgactcacccgcccaccgccaagcccgccggcaagcagtgcgcgaagccgtccagcgcgcccgcgaatacgccgacgccctcggcaccaccctcgccgccctcgtcgaactcgccgacatcggcgccgacaacctcccgccctaccctccggcccccggccgcgccatgcgctccatggcctacggcgccgccgcccccgaggaaaccgcccccctcgacctcgaacctcaacgccagaacgtctacgcccaggtcaacgctcggttcaccatggtcccgccgcggctg

SEQ ID NO: 6194 - DNA, 1434 bp, Streptomyces avermitilis
  CDS (1)..(1434)
atgcgccgagcaaagatcgtctgtactctgggccccgccaccgactcgtacgaccagatcaaggcactggtcgaggccggaatggacgtagcccgcttcaacctcagccacggcacctacgccgagcacgaggagcgttaccagcacgtccgcaaggcctccgacgagaccgggcgcagcgtcggagtcctcggcgaccttcaaggtccgaagatccgcctcggccgcttcaacgaaggacccgtactccttgaacgcggcgacaccttcaccatcaccgtcgaggaaggcgtcgaaggcgaccgccagacctgcggcaccacctacgccggcctcgccgccgacgtcactcccggtgagcgcatcctcgtcgacgacggcaaggtctgcctcgaagtcacctccgtcgacggcccccgcgtccacaccaccgtcgtcgaaggcggcatggtctccgaccacaagggcctgaacctgcccggcgtggccgtctcggtccccgccctctccgacaaggacgaggccgacctccgctgggccctccgtcagggcttcgacgtcatcgcgctgtccttcgtacgcagcggcaaggacatcaaggacgtccaccggatcatggacgaagaaggccgccggctccccgtcatcgccaaggtggaaaagccccaggccgtcgagaacatcgacgacatcgtcgccgccttcgacggaatcatggtcgcccgcggagacctcggcgtggaaatgccgctcgaacaggtcccgatcgtccagaagcgcgccatcaaactcgccaggcgcaacgcgaagccggtcatcgtcgcgacgcagatgctggactccatgatcgacaactcccgcccgacccgcgcggaggcctcggacgtcgccaacgccgtcatcgacggcaccgacgcggtgatgctgtccggcgagacgagcgtgggcaagtaccccgtcgaaacggtccgcaccatgtcccgcatcgtggaagcggcggaagaggacatcctggccacgggcctgccgccgctgaccgaacgcaacaagccccgcacccagggcggcgcggtggcccgcgcggcggccgagatgggcgacttcctcggcgccaagttcctggtggcgttcacgcagtccggagacacggtccgccgcctctcgcgctaccgttccccgatcccgctcctggccttcaccccgatgccggcgacgcgctcccagctcaacctgacatggggcgtggagacgttcctgggcccgcacgtggattcgacggacgcgatggtggaccaggtcgacgagctgctgctcaagtacggccgctgcgagaagggcgacgtggtggtcatcacggcgggctcaccccccggcgtctcgggctcgacgaacctggtccgagtccaccacatcggcgaggacgacagccccaag

SEQ ID NO: 6195 - DNA, 810 bp, Streptomyces avermitilis
  CDS (1)..(810)
atgaggtcacgaccggtgacgcagagtggccgcatggaacagcacagcccttcgattcgcgctcacgctgtcgcactcatgcgccaaggcatccccaaccgcatagtcgcggagcgcctcaacgttccacgagggacggtcggctggtggcgtagcgaggatcgcagagcacgcggcgaagcctatgagcagccaaccgactgcccccactgcacgggccgcgagttcgaccatgctgcgtacgcctacctactaggcctctatctcggtgatggacacatcatctcgaagcgcaagcagcaccacctgtctgtcttctgcaacgcaatgcagacggggctgattacagccgccgaagaggccatgcgcaaggtgatgccgctgccgagtgtcaagcagcgctacaagccgggctgcgtcgaggtgaagtcctacaccaagcactggacctgcatgttcccgcagcatggccccggcaagaagcacgagcgccccatcgtcctcgaagcctggcagcaggagatcgtcgacgcccacccgtgggagttcatccgcggactcatccactccgacgggtgccgcatcaccaactggacgacccggctcgtcggcggtgagcgcaaacgctacgagtacccgcggtacttcttcaccaatgtgtccgacgacatccgccagctctacaccgacaccctcgaccagctcggcatccagtggacgcactgcacccgcaacggaaacccgtacaacatctccgtcgcccgcaaagcctccgtcgccctcatggacgcccacgtaggccccaagtac

SEQ ID NO: 6196 - DNA, 654 bp, Streptomyces avermitilis
  CDS (1)..(654)
gtgaccgcccccgagtcgccccagcccgtagacgcgcccgacgacgacaagtcgcacgtgcctccgctgacgacccgtgtcgtcatcgccgaggacgaggcgctcattcgtctcgacctcaaagagatgctcgaggaagagggctacaccgtcgtgggggaggcgggtgacggcgagcaggccgtggagctcgcccgcgagcaccgccccgacctcgtcatcctcgatgtgaagatgcccaagctcgacggcatctcggccgccgagaagatcgccgaggagagcatcgcgcccgtcctcatgctcaccgcgttctcccagcgcgacctggtcgagcgggcgcgtgacgccggcgcgatggcgtatctggtgaagccgttcagcaagagcgacgtcgtgccggcgatcgagatggccgtgtcgcgcttcgcggaactgaaggcgctggagcaggagatcgtcgatctcacgcagcgtctggagacccggaagctggtggaccgtgcgaagtccgttctgcagacgcagtacgggctgaccgagcccgccgccttccgctggattcagaagacctccatggaccgtcgtatgtccatgcagcaggtcgccgaggcggtcatcgaggacgccgaggagaagaagtccgcgaagggc

SEQ ID NO: 6197 - DNA, 714 bp, Streptomyces avermitilis
  CDS (1)..(714)
gtgaccgcactgctcgaggtcgaggacctcagggtctcctacggcaagatcgaagccgtcaagggcatctccttcagcgtcgaagcgggccaggtcgtcaccctcatcggcaccaacggcgctggcaagacgaccaccctgcgcaccctctccggcctgctcaagccgaccggcggccgcatcgtcttcgacggccaaccgctcaccagcgtccccgcccacaagatcgtcgccctgggcctggcccactcccccgagggccggcacatcttcccgcgcctgaccatcgccgagaacctccagctcggagcgttcctccgcaaggacaagcccggcatcgagaaggacatccagcgcgcctacgacctcttccccatcctcggggaacgcaggaagcaggccgccggaaccctctcgggcggcgaacagcagatgctggccatgggccgggccctgatgtcccagcccaaactgctcatgctcgacgagccctccatgggactctcgcccatcatgatgcagaagatcatggccaccatcgccgagctcaagtcccagggcacgacgatcctcctcgtcgaacagaacgcccaggcggcgctctcactcgccgaccagggccacgtcatggagatcggcaacatcgtcctctccggcaccggacaggacctgctgcacgacgagtccgtgcgcaaggcgtacctgggcgaggac

SEQ ID NO: 6198 - DNA, 942 bp, Streptomyces avermitilis
  CDS (1)..(942)
gtgaccgacatgaccaccaccacggccacctccaccgtcctcgaagcctccggcgtcaccatgcgcttcggcggactcaccgccgtacgctccgtcgacctcaccgtcaacagcggcgaaatcgtcggcctcatcggccccaacggcgccggcaagaccaccttcttcaactgcctcaccggcctctacgtccccaccgagggcaaggtctcctacaagggcaaggtcctgccgccgaagccccacctggtgacaagcgcgggcatcgcccgcacgttccagaacatccggctcttcgccaacatgaccgtcctcgaaaacgtcctcgtaggacgccacaccaggaccaaggaaggcctctggtcggccctcctgcgcggccccggcttccgcaaggccgaaaccgcctcccgcgaacgcgccatggaactgctggagttcatcggcctcgcccacaaggccgaccacctctcccgcaacctcccctacggcgaacagcgcaagctcgagatcgcccgcgcactcgccagcgaaccgggcctgctgctcctcgacgagccgacggccggcatgaacccgcaggagacgcgagcgaccgaggaactggtcttcgccatccgcgacatgggcatcgccgtcctcgtcatcgagcacgacatgcgcttcatcttcaacctctgcgaccgcgtcgccgtcctcgtccagggcgagaagctcatcgaaggcacctcggaggtcgtacaggccgacgagcgcgtcatcgccgcctacctcggcgaacccttcgaaggcgcccccggcgacgccgaggccgccgaggtcgaagccgccgaagcccacgccgaagccgcggaggccgaagcggccgaagcggccgacagcaccagcgagaccagcaccaccggcacgaccagcaccaccggcaccaagggagacgcccag

SEQ ID NO: 6199 - DNA, 1773 bp, Streptomyces avermitilis
  CDS (1)..(1773)
atgaccacccccgccaccagcaccgagaagaccgcggccggcctcatcccgctcccccaggccgccgcccgcctcctcatcgtcatcggcgccctcgccaccatcgccagcgccttcatgtcctggacctggaccgccgccttccccggtgacctcaccgtctacggctaccccgcgggcctccagaccctcgccatcgtcggcgccgtcatcaccctcctcctcggcctcacccgctgggacatccccgccctgcgctgggccaaccccgcgaacgccgcctcccccatcgccctcgccgcggcctccgccttcaccgtctgctggtacaccggcatcgccatcgcggtcgacctcggcggcctcgccaacctcgaccccggcgcctacgtcgccatggccgcctccctcatcgccctcctcggcgccctcgccctccccaccccgggcggcacctggcgcgactacctcgccaaggcggagaacatcccgcccgccggcgaactcgccccctgggtccagcgcctcgtcatcaccctcgccaccctcctcgccctgatcgtcttcacctacggcatcggcgtgaacgacgacgagagcgaaaccttcatcggcttcctcttcctcgtcgtcttcggcgcctgggcactcttcgccgccggcctcctcgaccggttctccacgatcaacgcccagcacaaaggattcgccaccaccctggccttcctcgccgccgcgatcttccccttcacccagagcgacgaccacaacgccaacctcggcgtgaacatcctgatcgtcggaaccgtcgccctcggcctcaacatcgtcgtcggcctcaccggactcctcgacctcggatacgtcgccttcctcggcgtcggcgcctacgccgccgccctcgtctccggctccgagttctcccgcttcgccggcgtccagttccccttctgggcagcggcactgaccggcatgggagcctcactcgtcttcggcgtcctcatcggcgccccgacgctccggctgcgcggcgactacctcgccatcgtcaccctcggcttcggtgagatcttccgcatcgccgtcaacagcctcgacggctcctccggacccaacctcaccaacggccccaacggcatctcccggatccccgacctcgaaatcttcggattcaacctcgggatctcccacgacgtcggctccttcaccgtgggccgcttcgcgaactacttcttcctgatgctgatcatcaccgcactcgtggtgctggtcttcaccagggcctcggactcccgcatcggccgctcctggatcgccatccgcgaggacgagaccgccgccaccgccatgggcatcaacggcttccgcgtcaaactcatcgccttcgccctcggcgcctccctcgccggcctcgccggtacggtcagcgcccacgtcggctacagcgtcaacccggcgccgtaccagttcgccggctccgtgcccccgaactccgccttcctgctcgccgcggtcgtcctcggcggcatgggcaccgtcaacggccccatcctcggcgccaccctgctctacctcatccccgagaagctctccttcctgaaggagtaccagctcctcgccttcggcatcgcgctcgtcctcctcatgcgcttccgccccgaaggcatcatcgccaaccgccgccgccagctcgaattccacgagaccgaccagatcgacgtaccggaacaacgcctgaccgaacccaccgtcggcgtcacgaaggcaggggcg

SEQ ID NO: 6200 - DNA, 930 bp, Streptomyces avermitilis
  CDS (1)..(930)
gtgcacaccctgccgcagcagctggccaacgggctgttcctcggctcgatgtacgggctgatcgccatcggttacacgatggtgtacggcatcgtccagctcatcaacttcgcccacggcgagatcttcatgaccggaggcttcggcgcactcacggtctacttctacgtcctgccagacggcacatccatgtggatagccctcccggcgatgctcatcggaggcggcctcatcgccgtactcatcgccgtcggggcggaacgcttcgcctaccggcccctgcgcggcgcaccacgcctcgcccccctcatcaccgccatcggcctctccctcggcctccagcaggtggtcttcaacttctacccggacgccaagaccgacaggaccttcccccagctgggcaccgagtccttcaacatcggctccgtccacatccagagcggccagctcttcatcatcatcgccgcccccatctgtatggccgctctcggcttcttcgtccgcctctcccgcaccggccgcgccatgcaggccaccgcccaggacccggacaccgcccagctcatgggcatcgacaccaaccgcatcatcgtcatcgccttcgccatcggcggactcttcgccgcggtcgccgccgtcgcctacggcctgcgctacggccagatcaagtacgacatgggcttccagatgggcctcaaggccttcaccgcggccgtcctcggcggcatcggcaacatctacggcgccatgctcggcggagtcgtcctcggcgtcgccgaaaccctcgccaccgcctacatcgacggcatccccggcatgcagcagctcggcggcggcagctgggcccccgtctgggccttcgtcctcctcatcctcgtactgctgctgcggccacaaggcctcctcggcgaacgcgtcgcggacagggcg

SEQ ID NO: 6201 - DNA, 1227 bp, Streptomyces avermitilis
  CDS (1)..(1227)
ttgatcgtgcgacaccgttccttgctgatactcaccaccgtgctcaccaccggagcactcacgctcaccgcttgcggatcgcgcgacgacgacaagggcagcgacagcggcagcaagacgaccgtggtcatcggcgtcgacgcgcccctcaccggccagaactccgccaccggcctcggcatccagtacggcgtccagatcgccgtcgacgacgccaacaagaagaacctcgtgcccggcgtcacgttcaaggtcaaggccctcgacgacaaggccgtcccggccagcggccagcagaacgccaccgccctcgtcgccaacaaggacgtcctcggcgtcgtcggcccgctgaactccggtgtcgccacccagatgcagcaggtcttcgacacggccggcctcgtccagatctccccgtcgaacaccgcccccgagctgacccagggcaagaactggcagagcaagaaggaacgtccttacaagacgtacttccgcaccgccaccaccgacgccctccagggcggcttcgcggccgactacgcctacaacaccctgaagaagcgcaaggtcttcatcgtcgacgacaagcagacctacggcgccggcctcgccaagctcttcaagcagaacttcaaaaaggcgggcggcaaggtcaccgccgaggaccacatcagcgtcggcgacaccgacttctcctcgctcgtcaccaaggtcaagaactccggcgccgacctgttctactacggcggccagtacgacgagtccgagaagatcaccaagcagctcaaggacggcggcgtcgacatcccgctgttcggcggcgacggcatgttctccgacacctacatcgagaccgccggcaagccctccgaaggcgacctcgtcacctccgtcggcgtccccgtcaccaccctgcccgccgccaaggagttcatcgccacctacaaggcgaagaagtaccccggcgactacggcacctacggtggctactcctacgacgccgccaccgccatcatcaaggccatcggcaacgtcgtgaaggacggcaaggtcccctccgacgcccgcaccaagatcgtcgacgaggtccagaagaccaagttcgacggcatcgccggccccgtcgccttcgacgagtacggcgacaccaccaacaagcagctcaccgtctaccaggtcgtcaagggcaagtggaaggccgtcaagagcggcacctacaacgccggc

SEQ ID NO: 6202 - DNA, 459 bp, Streptomyces avermitilis
  CDS (1)..(459)
atgggcgagcagcacaccccgacgttcccgcaagaggtcatcgacgagtacgcggcactcggcgtcgacctgcccgccctcttctccgccggacacctcggcacacgcatgggcgtccggatcctcgaggcctccgcggagcgggtcgtcggcaccatgcccgtcgagggcaacacccagccgtacgggctgctgcacggcggcgcctccgccgtcctcgccgagaccctcggctccgtcggctccatgctccacggcggcagctccaagctcgccgtgggcgtcgacctgaactgcacgcaccaccggggcgtacggtccgggctggtcaccggagtggccacacccgtgcaccgggggcgctccacggcgacgtacgagatcgtgatcagcgacgaggagggcaagcgcgtgtgcaccgcccgcctgacctgcctgctgcgcgaactccccgcgaaa

SEQ ID NO: 6203 - DNA, 2280 bp, Streptomyces avermitilis
  CDS (1)..(2280)
atggccacgaagccgcccaagggcgatccggttcaggacgcgccgcaggtcagcgagccgaagcaggcggcagcggggctgccggccatcaagcacaccctgcgcatcgcccagcagcagatgggggtgcgccgcaccgcgctgacactgctgcgcgtcaaccagaaggacggcttcgactgccccggctgcgcctggcccgagccggagcaccggcacacggcggagttctgtgagaacggcgcgaaggccgtcgccgaggaggccaccctgcgccgggtcaccccggacttcttcgccgcccacagcgtggccgacctcgccacccgcagcggctactggctgggccagcagggccgcctgacccaccccatgtatctggcggagggcgccgaccactacgaggcggtgccctgggagcgggccttcgacatcgtcgccgaggagctcgccgcactcggctcccccgacgaggccctcttctacacctccggccgcacgagcaacgaggccgcgttcctgtaccagctgttcgcccgcgaactcggcacgaacaacctgcccgactgttccaacatgtgccacgagtcgtcgggttcggcgctgaccgagacgatcggcatcggcaagggcagcgtcctgctggaggacctctacaaggcggacctgatcatcgtcgccggacagaaccccggcacgaaccacccccggatgctctccgccctggagaaggccaaggcgggcggcgcgaagatcatcacggtcaatccactgcccgaggcgggcatggggcgcttcaagaacccgcagaccccccagggcatgttcaagggcgccgccctcaccgacctgttcctgcagatccgcctcggcggcgaccaggccctcttccgcctcctcaacaaactgatcctcgagacgaacggcgccaccgaccaggcgttcatcgacgaacacacccacggatacgaggagttcgccgaggccgcccgcaccgccgactgggccgggacgctcgccgcgacgggcctcacccagcagcagatcgaggaagccctccgcatggtgctcgcctccgagcgcaccatcgtgtgctgggcgatgggcctgacccagcacaagcacgcggtgccgacgatccgcgaagtcgtcaacttcctgctgctgcgcggcaacatcggccgcccgggcgcgggcgtgtgccccgtgcgcggccactccaacgtgcagggcgaccgcacgatgggcatcttcgaacggcccgccccggccttcctggacgccctggagaaggagttcggcttcgccccgccacgcgagcacggctacgacgtcgtacgggccatccgcgccctgcgcgacggcgaggcgaaggtcttcttcgcgatgggcggcaacttcgtgtccgcctcgcccgacaccgaggtgaccgaggcggccatgcgccgcgcccgcctcacggtgcatgtgtcgaccaagctcaaccgctcgcacgctgtcacgggcgcgcgcgccctgatcctgccgaccctgggccgtacggaacgcgacctccaggccggtggcgagcagttcgtgaccgtcgaggactccatgggcatggtgcacgcctcacacggccgtctggagcccgcgagcgggcacctgctgtccgagacggccatcgtgtgccggctcgcccgccgcgtgctcggcgacaaatcccgcaccccctgggaggagttcgagaatgactacgcgacgatccgcgaccgcatcgcgcgcgtgatccccggcttcgacgacttcaacgcgcgcgtgaccggttccgccggcggcttcgcgctcccccacgcgccccgcgacgagcgccgcttcccgacagccaccggcaaggccaacttcacggcggcaccggtcgagtacccggcgctccccgaaggccggctgctgctccagaccctgcgctcgcacgaccagtacaacaccacgatctacggcctcgacgaccgctaccgaggcatcaagaacggccgccgggtcgtcctcgtcaaccccgaggacgccaaggcgctgggcgccgcggacggctcgtacgtcgacctggtcagcgagtggcaggacggcgtggagcgccgcgcccccggcttccgcgtcgtgcactaccccaccgcccggggctgcgccgccgcctactaccccgagaccaacgtcctcgtaccgctcgacgccaccgccgacaccagcaacaccccggccagcaagtccgtcgtcgtccgtctggaacaatcgacaaccgac

SEQ ID NO: 6204 - DNA, 2721 bp, Streptomyces avermitilis
  CDS (1)..(2721)
gtggcagaaacagcatcgaagaagaccgagaagacctccggcggcgcgcgtccgcggctgatgctcatggacgggcactcgctggcgtaccgcgcgttcttcgcgctgcccgcggagaacttcacgaccgcgaccggccagccgacgaacgcgatctacggcttcgcgtcgatgctggcgaacacgctgcgcgacgaggcgcccacgcacttcgcggtggcgttcgacgtctcgcgcaagacgtggcgctccgaggagttcacggagtacaaggcgaaccgctccaagaccccggacgagttcaaggggcaggtcgagctgatcggtgagctgctcgacgcgatgcacgcgcagcggttcgcggtcgacggcttcgaggcggacgacatcatcgccacgctcgccacgcaggccgaggccgagggcttcgaggtcctcatcgtcaccggtgaccgggactccttccagctggtcagcgatcacacgacggtgctgtatccgacgaagggcgtctcggagctgacccggttcaccccggagaaggtcttcgagaagtacgggttgacgcccgcgcagtacccggacttcgcggcgctgcgcggcgacccgtccgacaacctgccgggcatcccgggcgtcggcgagaagaccgcggccaagtggatcaaccagttcggttcgttcgcggagctggtcgagcgcgtcgacgaggtcaagggcaaggtcggccagaacctccgcgaccacctggagtcggtgaagctgaaccgccggctcacggagatggtgcgggacgtcgagctgccgaagtcggtcgccgccctggagcgcgctccgtacgaccgcacggccgtcgcgatggtcctggacaccctggagatccgcaacccgtccctgcgcgagcggctgctggccgtcgacccgggcggggaggaggccgaggaggcgccggtcgccgcgggcgtcgcggtggacggcgcggtgctgggcgcgggcgagctgaagccgtggctcgccgagcacggcacgacggtcctggggctggccacggtcgactcctgggcgctcggcgcgggtgcggtggccgaggtcgcgctcgccgcggccgacggggcggccgcctggttcgacccgtcccagctggacgaggccgacgagaacgcgttcgcgacgtggctcgccgaccccgcgaagcccaaggtgctgcacaacgccaagggtgtgatgcgggtcttcgccgagcacggctggaccgtcgagggcgtgtccatggacaccgcgctcgccgcctacctggtcaagccgggccgccgctccttcgcgctggacgcgctgtccctggagtacctcggccgtgagctggagcccgccgcgacggccgacgggcagctggccttcggcgcggacgagggggccgaggccgacgcgctgatggtgcaggcgcgcgcgatcctcgacctgggcgaggcgttcggcgagcggttgaaggaggtcggctcggccgacctgctccgcgacatggagctgccgacgtccgccctgctggcccggctggagcggcacggcatcgcggcggacaaggcccacctggaggccatggagcagatgttcgcgggcgccgtgcagcaggcggtgaaggaggcgcacgcggccgcgggacacgagttcaacctgggctcgcccaagcagctccaggaagtcctcttcggtgaactgggcctgcccaagacgaagaagacgaagacgggctacacgacggacgcggacgcgctggcgtggctggccgcccagacggacaacgaactgccggtgatcatgctccgtcaccgtgagcaggcgaagctgcgggtgacggtcgagggcctgatcaagacgatcgcggcggacggccgcatccacaccacgttcaaccagacggtggcggcgaccggtcggctgtcgtcgaccgacccgaaccttcagaacatcccggtgcgcaccgacgagggccgcgcgatccgccgcggcttcgtggtcggcgagggcttcgagtcgctgatgaccgcggactacagccagatcgagctgcgtgtgatggcccacctgtccgaggacgagggcctgatcgaggcgttcacctccggagaggacctgcacacgacggtcgcctcccaggtgttcggggtggagcgctcagcggtggacgcggagatgcgccgcaagatcaaggcgatgtcgtacggcctcgcgtacggcctgtcggccttcggtctctcgcagcagctgaacatcgatgcgggcgaggcgcgggcgctgatggacacgtacttcgagcgcttcggaggagtacgcgactatctgcgccgcgcggtcgacgaggcgcgggcgacgggctacacggagacgctgttcggccgccgccgctacctcccggacctgaacagcgacaaccgccagcgccgcgagacggcggagcgcatggcgttgaacgcgccgatccagggcaccgcggcggacatcgtcaagatcgccatgctgaacgtggaccgcgcgctccaggaggcgaacctcaagtcccgcatgctcctccaggtccacgacgaaatcgtcctggagatcgcgccgggcgagcgggcgaagacggaggaactggtccgccgggagatggcgtccgccgtgcagctgagggctccgctggatgtctcggtgggcgacggcggggactgggagtcggcggcgcac

SEQ ID NO: 6205 - DNA, 1239 bp, Streptomyces avermitilis
  CDS (1)..(1239)
atgccggtgttacgtgctggtgctgcgtgcccgtgtcgctggtgtcaccggcgttcgaccgtgctccccggcacggtgacccaggtgaccctacgacaacttgtgtcgcccgggcacccgttggtgcccgattgccggtggccggccgactgcggcgctggtcggatgcgggagccgggtggctcgccgcacgattttcatgcgcccctcatactggacgactgtgatcgccggacggttgtgtccggccgacgacagccacggagggccgacttgccgttcactctcagtcatgcggcggccgtgctgcccggcgtgcgcggggacgggaccggacgcgggcgactggtgcccacggtcctcgtcgccggctcgttcgctcccgatatgacctactacgcggcgagtgtgctgtccggagcgatggaattcggcgatttcacgcactcgttcaccggtgtcctcaccttcgacgtgctcgtcgcctgggcgttggccggtgcctggctggtgctgcgcgaaccgctggtcgcgctgctgccgcgggcccggcaggggcgggtggcggcgctgctgcgctgcggggtgccgcgggcgcggatgcgggcctcggcggtgctgtggtggtacgtgtccgcggcgctgggcgcgctgacccatgtcgtgtgggacgcgttcacgcatcacgaccggtgggggattcggctgtttccggtgctggggcaggaggccgggggctttccgctgtactggttcctccagtacggcagttcggcggtggcggcggtcgtgatcgcggtgttcgtggtggtcgcgctgcggcgggtgccgttgcccacgccttcaccttcaccttcaccttcaccttcgggatcgggttcgggttcgggttttggcgggccggcgggggtgccggtgctgtccggttcggaccggtgggtcgcgggtgcggtgatcggcgggtgtgccgtggtggcggcgatgcagcgggcgtcgcggtggtgggagtactggggcgcgacggcgaagccgtgggaactcatcccgaccctgtgcttcggggcgggcgccgggctggtcctcgggacgctgctgtacgcggtggggatcagggtgcgccgtccggccgcggccggtggagcgggcgccgggacggaggccggcgtcggggacgaggccggtgccggtgcgcgtaccgggaacggggccggcaaggagccgagccgcccggccgcctcc

SEQ ID NO: 6206 - DNA, 1707 bp, Streptomyces avermitilis
  CDS (1)..(1707)
atggcggcgcatttcggcagcaggctgcgcaggggggcgacaaccaccgccgtggcggcggccgcggtcgcggccctggccgcgtcccaggctcctggagtgaccaccgacgaccagggcagacagaccaccggctccgaggccacacccgacgggaacggcgacggctccgccacgggcaacggccgctactacaccgacctcccgccgctcgacagccccaccgcctcgcccagcccgggcaccggctccacgacccccgccggcaccgcggaggcgggcatacccgccaccgtcctcgacgcctacaagaaggccgagacggcactgcgctcgtccaagccgggctgcaacctgccgtggcagctcctcgccgccatcggcaaggtcgagtccgggcaggcccgcggcggccgcgtcgacgcgaacggtacgacgtactcgaagatcctgggccccaagctcgacggcaacggcttcgccctgatcgccgacaccgacaacggcgcgtacgacggcgacagcgcgtacgaccgcgcggtcggccccatgcagttcatcccctccacctgggagtgggcgggccgcgacggcaacggcgacggcgcgaagaaccccaacaacatctacgacgcggccctcgccgccggtcactacctctgccgcttcgaccgtgacctctccgtccagtccgagctgaacaaggccatcctcggctacaacaactcgcaggagtacctgaacaccgtcctgtcgtggctggagtactaccgcaagggcacgcacgaggtgccggacggcacgggcacgctgccctcgcacagcaacgacgacggccagggagcgagccccgcgcccagtccgtcgccgccgaagacgccgaagccgccgaagacgacgaagccgacgaagccgggcacgcccggcgacggcggttccacgagccccagcccgtcgccgccgccgcccagcacccccaagccgccgagccccacgcctcccacccccaccgacacggtggaccacctggaggacgcgggcaccgccaagctcaccgcgacggcgggcgacacgttcgaccagaaggtcgccgtgcgcaccgagaccaaggccggcaaggccgtcgcgaaggtgcgggtgcgattcaccatcgtcggcgacacggacgccacgttcaccggcggcgagaccgtggccacgatcgtcaccaacagcgccggcaaggccaccgcgcccgcgctggtggcaggacagaagaccggcgacttcacggtccgcgccaccgtcgtgggccgctccgtcgcgggcctcgactacacggcgaccgtcaccgaaccccaggccgacgccctcgcccgcaccagcgccaccgagctgacctgtgtgcccggcggcgagttcgcggaccaggtcgaggtgaaggccacgtacaagaacgccgtcgcggacggtgtcgccgccaccgcgacgatcgtcaagtcggccgacgacgcgaccgagaacgacaagggcccgtccttcaaggacgcggacggcaagaccgtacgcaccctcaaggacctcaagacggacgcgaacggcctgctgaagcttccgaagctgtacgcggacgacaccgtcggcacgttcctgctccgcatcgacaccacgggcggcgcgaccctcacggtcgagctgaaggtggccgcggccaccaccacgacgccc

SEQ ID NO: 6207 - DNA, 990 bp, Streptomyces avermitilis
  CDS (1)..(990)
atgcgccgcaaggccagcctgatcctgctcgccctggccgtgttctgcacggctctgtccccgctggtgcgctggtacgccttcccgcgcctggccaagatccccgcgaaccagtaccaggacatggtcctggaggcgaagaacgccaccctcctcgactacggcaccatgaaggcgaagacggtccccaaggtcaccgtcgtgcagaccctcaggggcaacgtggaggcctcacagaagatcgagaagaccgccggcaaggacgtggtcgtctgggacggcctctcctacgtccagggaccggacggcaaaatggtctcccggatccccgagcgctacatcttcgacgcacacacccaggaacccgtccacgccaccggcgagatggtcgacggcgacccggtcacccgcgcgggcctcgagttcaagtggccgttcctcacggagaggcgggactacgagtacttcgacgcccaggcgcgcaccacggcccccatccactacaagggcacgcaggacttccgcggtgtgcgggtctactacttcgagcagaccgtcccctggaccaaggtccccttccccaaggccatgcccgtcaagggcgtcaccccccggtcgctcgcgaagacgggcacgacgcgctggtacaccacggtccggaagttctgggtcgaaccggtgaccggagcaccggtctacggcgaggagatccacaaggaggagctgcgcggcggcacgctcctcggcggccgcgacaaggtcacggccttcgccggccacgtcaagatgcgcgaggactacatcaggtcgacggtcgccctggtcaagtccaaccgcaccgtggtcctgctgatgacctcgtacctgccatggggcctcctgctgctgggcctgctcctgctgaccctgtccctgtggctggaggcccgcggccgccggccggcggacccggcccccaccgaggcctcggcgccggaaccggtcagcgcc

SEQ ID NO: 6208 - DNA, 2631 bp, Streptomyces avermitilis
  CDS (1)..(2631)
gtgatccgctacgacgccctggacctgccggtacgcagcgcgctgcccggcctgaacgacgccctggacgcgggaggcgccgcggtcctcgtggcgccgcccgggacgggcaagaccacgctcgtgccgctggccctggccggtctgctcggggagggggccgcgaaggggccggtacgccgtgtcgtcgtcgcggagccgcggcgcatcgccgcccgggccgcggcgcgccggatggcgtggctgctcggcgagaaggccggcgacagcgtcggctacaccgtgcgcggggagcgcgtggtggggcgccacacgcgcgtggaggtcgtcacgaccggtgtgctgctgcaacgacttcagcgggatcaggagttggcgggcgtcgacgtggtggtgctcgacgagtgccacgagcgtcatctggacgcggacacggcggcggccttcctcctggacgtgcgggaggcgctgcggcccgagctgcggctggtggcggcctcggcgacgaccgacgccgcggggtgggcccggctgctcggcggggcgccggtggtcgaggcggcgggtgtgtcgtacccggtggaggtcgtgtggacgcctccggtgcggcccgtccggccgccgcacgggatgcgggtggaccccgtactgctgacgcatgtggcatcggtggtgcggcgggcgctcgcggaacgcgagggggatgtcctctgcttccttcccggggtcggggagatcgcgcgcgtggcggggcagctgggggacctggacggggtcgaggtgctccaggtgcacgggcgggcgccggcggcggtacaggacgcggtgctgtctcccggtgcggggcgccgggtggtcctcgcgacgtccgtggccgagtcctcgctgacggtgccgggtgtgcgggtcgtcgtggactgcggactggcgcgggagccacgtgtggatcacgcgcgcgggctgagcgccctgacgacggtacgggcctcgcaggcggcggggcggcagcgggcgggccgggccgggcgcgaggcgccggggacggtgtaccgctgctgggcggaggcggaggacgcccgtctgccgcgcttcccctcccccgagatcaaggtggccgacctgacggcgttcgcgttgcaggcggcgtgctggggcgatccggaggcgtccgggctcgccctgctggacgcgccgccgggcggggcgatggcggcggcgcggtccgttctcgccgcgatcggtgcggtggattccgcggggcgggccacggagcgaggggtgcgcatgtcccggctcggcctgcacccgcgactggcgcgggctctgctggacgcggcgccggaggtcggcgcggaccgggccgcggaggtggtcgcgctgctgagcgaggagccgccgcgggagtacggcgacgacctggcggcggcctggcgggctgcccggcgtgggggcgacgcgtacgcggggcgctggcgtgcggaggcgcggcggctgcgggccggggcgacagatcgtgcgcgcccgcccgcccgtgaccgtgactccgctccgcgagagcgggacgccggggctccggccgggacgggtgggcagggctcggcgcccggccccaccgggtccgagcccaccggatccggggcggccgggcgagcgggctcgggggacgatcggatcgccgggctcgtggccgccctcgccttcccggagcggctcgcgcgggcacagggcggctcctgcctcatggtcagcgggacccgcgccgacatcggcgacggctccgcgctgcgcggcgccccctggctcgccgtggcggtcgccgaccgtcccgtcggcgcggggcacgcgcgcgtgcggctcgccgccgtggtcgacgaggacacggcgcggcgggccgcggcgcccctgcgttccgcgggcgccgaggtccactgggccgacggggatgtcgtcgcgcggcgggtcgagcgactgggggccgtggagttggcggtgcggccgctgcgtgacgccgaccccggtctcgtacgggacgcgctcctcgaagggctgcgggaggaagggctcggcctggtgcggtggtccgctgacgccgaggtgctgcggcggcggctcgcctttctgcacctgcacgtcggcgccccctggcccgacgtgtccgacgacgcgctccacgcgcgcgtggacgagtggctggagccggagctgagccgtgcccggcggcgggccgatctggcgcggatcgacgccgggcaggcactggcccggctgctgccgtgggcgaccggggacgcggcccggctcgacgaactcgctcccgagcggatcgaggtgcccagcgggtccaggatccggatcgactacggcaacccggagcagcccgtgctcgccgtgaagctccaggagatgttcggccgccacgagtccccgagggtcgccggagtaccggtgctcgtccatctgctgtcgcccgccggccggccggccgccgtcacggccgacctcgcctcgttctggcgggacggctacaaggcggtacgggccgagctgcgcggccgctaccccaagcacccgtggcccgaggacccggccacggccgagccgacccggtacacgaacgcgcggctcaggcgc

SEQ ID NO: 6209 - DNA, 867 bp, Streptomyces avermitilis
  CDS (1)..(867)
gtgacaccaccggaacgggttcgacggaagtgcccgcagactaatacgagggagccgatcatccaagagcccgatacgttcgaacccgaagccacccgacgtgacgccggcgccacggagagttcccgcgccaaccgtggctggtgggaccggaacgcggacgactaccaggtcgagcacggcacgttcctcggcgacgaccggttcgtgtggtgccccgaggggctcgacgaagtggaggccgagctgctcggcccggcggaggacctcaagggcaaggacgtcctggagatcggcgccggcgcggcccagtgctcgcgctggctggccggccagggcgcgcgcccggtggccctggacctctcccaccgccagctccagcacgcgctgcgcatcggcggggacgtgcctctggtggaggccgacgcgggcgccctgccgttcgcggacgcttccttcgacctcgcctgctcggcgtacggcgcgctgcccttcgtcgccgacccggtgcgcgtcctgcgcgaggtccaccgggtgctgcgcccgggcggccgcttcgtcttctccgtgacgcacccgatccgctgggccttccccgacgagcccgggcccgagggcctgtcggtctccgcctcctacttcgaccgcacgccgtacgtggagcaggacgaggagggcggggcggtctacgtcgagcaccaccggacgatcggcgaccgggtgcgcgacgtggtggcgggcggcttccggctgctcgatgtggtcgagccggagtggcccgcctggaacacccaggagtggggcggctggtccccgctgcgcgggaacctgatcccgggcacggcgatcttcgtgtgcgtacgagac

SEQ ID NO: 6210 - DNA, 1503 bp, Streptomyces avermitilis
  CDS (1)..(1503)
atgacgagcagcaccgagaccacctctaccactccgcaggtagcggtcaacgatatcggtaacgaggaagccttcctcgccgcgatcgacgagacgatcaagtacttcaacgacggcgacatcgtcgacggcgtcatcgtgaaggtcgaccgggacgaggtcctgctcgacatcggttacaagaccgaaggtgtcatcccgagccgcgagctctcgatcaagcacgacgtcgacccgaacgaggtcgtcaaggtcggcgacgagatcgaagcccttgttctccagaaggaggacaaggaaggccgcctgatcctctcgaagaagcgcgcccagtacgagcgcgcctggggcaccatcgagaagatcaaggaagaggacggcatcgtcaccggcaccgtcatcgaggtggtcaagggtggtctcatcctcgacatcggcctccgtggcttcctgccggcttccctcgtcgagatgcgccgcgtccgcgacctccagccctacgtgggcaaggagctcgaggcgaagatcatcgagctggacaagaaccgcaacaacgtggtcctgtcccgccgcgcctggctcgagcagacccagtccgaggttcgccagacgttcctcacgaccctccagaagggtcaggtccgctccggcgtcgtctcctcgatcgtcaacttcggtgccttcgtggacctgggtggcgtcgacggtctggtccacgtctccgagctttcctggaagcacatcgaccacccgtccgaggttgtcgaggtcggccaggaagtcaccgtcgaggtcctcgacgtcgacatggaccgcgagcgtgtctccctgtcgctgaaggcgacgcaggaagacccgtggcagcagttcgcccgcacgcaccagatcggtcaggtcgtgcccggcaaggtcacgaagctggttccgttcggtgcgttcgtccgcgtggacgagggcatcgagggtctggtccacatctccgagctggccgagcgccacgtggagatcccggagcaggtcgtccaggtcaacgacgagatcttcgtcaaggtcatcgacatcgacctcgagcgccgtcgcatcagcctctcgctgaagcaggccaacgaggccttcggtggcgacccggcttcggtcgagttcgacccgaccctgtacggcatggccgcgtcgtacgacgaccagggcaactacatctaccccgagggcttcgaccccgagaccaacgactggctcgagggcttcgagtcccagcgtgaggtgtgggagacccagtacgccgaggcgcagcagcgcttcgagcagcaccaggcgcaggtcatcaagtcccgcgaggccgacgctcaggccgaggccgagggtgctgccgctcccgccgccggcggttccggcgcgggtgtctcgggtggttcgtactcctcggagtcggacgacaactccggcgccctggcgtcggacgaggccctggctgccctccgcgagaagctcgccggcggccagagc

SEQ ID NO: 6211 - DNA, 936 bp, Streptomyces avermitilis
  CDS (1)..(936)
gtgcttgatccgcagggtttgtacgcctgggagccgaagggcctggcagtcgtcgacatggcgctggcccaggagtcggccggtcttgtcatgctctaccacttcgacggatacatcgacgcgggcgagaccggcgaccagatcgtcgaccggcttctcgactcgctgccccaccaggtcgtggcccgtttcgaccacgaccggctggtggactaccgtgcccggcgtccgctgctcaccttcaagcgtgaccgctggaccgaatacgaggagcccacgctcgacgtacggctggtccaggacaccaccggtgcccccttcctgctgctgtccggtcccgagccggatgtcgagtgggagcgcttcgcggcggccgtccagcagatcgtggagcggctcggcgtccgcctgtccgtgaacttccacggcattccgatgggcgtcccgcacacccgccccgtcggcctcaccccgcacggcaaccgcaacgacctggtgcccggccaccgcagccccttcgaggaggcgcaggtccccggcagcgccgagtccctcgtcgagtaccgcctcatggaggccggacacgacgtcctgggagtcgccgcgcacgtgccgcactacatcgcccgttctccgtatccggacgccgcgctgaccgtcctggaggccatcacggccgctacgggactggtcctgccgggcctcgcgcactccctgcgcacggaggcgcaccgcacgcagacggagatcgaccggcagatccaggagggcgacgaggaactggtcgccctcgtgcagggtctcgagcaccagtacgacgcggcggcgggcgccgagacccgggggaacatgctggccgagcccgtcgagatcccgtccgcggacgagatcgggcaggagttcgagcggttcctggcggagcgggaaggcgagggc

SEQ ID NO: 6212 - DNA, 639 bp, Streptomyces avermitilis
  CDS (1)..(639)
gtggcaagccctaggctggtgggcatgctgaaggtgggcctgaccggcggtatcggcgccggcaagagcgaggtgtcgcggctgctcgtcgagcacggagccgtgctgatcgacgcggaccgcatcgcgcgtgaggtcgtcgcgcccggaactcccgggctcgccgcggtcgtcgaggccttcgggacggacgtactcgcgccggacggcagtctggaccgcccgaagctgggctccatcgtcttcgccgacccggacaagctcgccgtgctgaacgcgatcgtgcaccccttggtgggcgcccgctcccgcgaactggaaacggccgccgccgcggatgccgtagtgatccacgacgtcccgctcctcgccgagaacggcctcgcgccgctgtacgacctcgtggtcgtcgtcgacgcgagccccgagacccagctcgaccggctcgtccggctgcgcggcatgaccgagcaggacgcacgcgcgcgcatggccgcccaggcgacgcgcgagaagcgcctggccatcgccgacatcgtcatggacaacgacgtacccctggaggagctggagcggcgcgtgggggacgtatgggcagatctcgtgcacagggcgcaccagccaggggagtcacaggaa

SEQ ID NO: 6213 - DNA, 378 bp, Streptomyces avermitilis
  CDS (1)..(378)
gtgcccgagaccagcggttggaccggacgtactccggagacgcatgtcatcgacttccgcgccgccgagcagttgctcgccgcgcgcgacccgcggggcgcggtgaagctgctcgatccggtgatagccgcgcaccccgagaacacggccgcacggctgctgcgcgcgcgtgccttcttcgccgccgcgcaactgcgtcccgccgagctcgagttcaccatcgtgctggagcgcgagccggacaacgcgttcgcgcacttcgcgctcgcccgcacctatgagcgccagctgcggccggatcaggccaagaggcacttccgcctcgcggcggcgctcgacccgaacccgcagtacttgaaggcggcacgcttcgactcg

SEQ ID NO: 6214 - DNA, 273 bp, Streptomyces avermitilis
  CDS (1)..(273)
gtggtcccgatgcgtacaggcagtgaaccgacgacagcgcgcagtgccctgcggctgcgcttctggctgagcgtgtggggcctgatctgggcgatcgccggaacggccgcgttcgccctcgccgggaggcccggatgggcggccgcctgcggtgtcctgtggctgatcgtcaccgcggacatgaccatgatcctgcggcacatccaccaggggccgcactggcagccgggccgcgacgtcccaccgtaccgaccgccggaacaccgccacccc

SEQ ID NO: 6215 - DNA, 1035 bp, Streptomyces avermitilis
  CDS (1)..(1035)
gtggtgcacgttcaccatgggacggtggacggatccacgggggaggcgacgatgctgctggatgcgctgcgggcggacgcgaggctcgccgagtggctgcgggacctggagagcgagggcgatccgcgggtggaggtcgcgctgcccggcgcggacgaactcccggacgtactgctggacctgtccgtgccgcacgaggacatcaacgagttcgtcgcgctgcgcgcccggctggcggacgacgcggaggcgatgaccctcctcgcccggtgtgtcgcccgcttcgtacgggacatgggggagatcgggaagggctgggagccgccgccgttcccgacgtcgacgggggacctcggacgctgcttccctctgtacgtcttcgtcggcgcgctgccgcacgtacgcgcgtaccaccaccggcgcggggtcccggccgaggtgtcccggcgcacgctcgccgatctggggcggcatgtggcggtgcaccgtcggcggctcggcacgggcgggctgctgttcccgtggtggatcgcgctccccttccacggggagttgttccagctgggccggctgcagttccagcgcgcgcggctggggcagcgcacggggcgggccgtcgcgggggccggcctgggcctggggccgggcgacccctgtctgagcctgcacatacccgacttccgcggaccgctgtcgccgtccgcctgtgagcggtcgctggcgctggcacgggagttcttcgcccgccactatcccgacgagcggtacgaggtggccgtgtgccactcctggctcctcgacccgcagctgaagcggtacctgtcggcggagtccaacatcgtccgcttccaggagcgcttcgagatcgcgtacgcgcagacggcgccggaggacggggtgccggtcgggttcgtcttcggcgatccggagctgccggtggcggacctgccgcggcggaacagcgtggagcgggcgatcggggaccacttgcgggcgggcggccactggtacggcgggcatgggtgggctccgctg

SEQ ID NO: 6216 - DNA, 681 bp, Streptomyces avermitilis
  CDS (1)..(681)
atgcgtgagggatacgagggaacgggacccggggcgatcaccccggacggctgcgcggtcgagctctactcgcggctgcccgtcggggaggaaccggacatcatcgccgcggcagtgcccacgggggcccgcattctggaactgggcagcggggtgggccgcatgacccatccgctcctggatcgcgggttcgaggtcacggccgtggacgagtcgtcggagatgctggcgcgcgtccgtggggcgcgcacgatatgcagcccgatcgagggactcgacctgggtgagacgttcgacgtggtgatgctcgcgtcgttcctcgtccacgcgggcgacgtcgaggtgcggcgggggatgctgcgggcgtgcgcgcggcatgtcgcggagggcgggtgcgtgctgatccagcgcgaaggggaggactatcactcgaatgtgccccgtgagcgggtcgatcccagcggcttcacgctacggatcctgtcggcggagccggcgggtgacggggtcaactcggtcagcgcggagtacgtgttcccggacgcgacgtggacccatacgttcctggcgcggccgctgaccaaggagcagttcgaggaggcgctcgccgaggcggggctgagggtggaccggtatctgacggaggacggcgtgtgggtgagggcggtgccggctgaggag

SEQ ID NO: 6217 - DNA, 540 bp, Streptomyces avermitilis
  CDS (1)..(540)
gtgcgcggcgatgagttgcgggcgtcggcccggtctacctctgtgacagcgatacggaactgcttcacagaggagacccccatgtcccagaccaccgctcccgtcacccgcgccgcctcggctgcctccgcctccggtggcacccgcagtcgtcgtgccgagatttccctgcgtgcgcttcagatcgtgctcgcgctcttctacggggtggcgagcgcgctgccgaagctgatcgcgcacccctcggccgtcgagtccttcgacaagatcggctggggcagcgcggggatgtacaccatcggcgcgctcgaactggccggagctgtcgcactgttgataccggcgctcatgtcggtggcggcggtggcactcagtgcgctgatggtgggtgcgttcatcacgcagctcaccgtcttcgacgggcagtacgcagcgacaccgctgatcctgatcgtgccgctcgccctgatcgcgtgggcgcgccggaaggggacggcggacgggctggggcggctggtgcggctggtgcgacgaggggcg

SEQ ID NO: 6218 - DNA, 636 bp, Streptomyces avermitilis
  CDS (1)..(636)
atggcttccgagagtgcggatgaggagacggtgggcgcggacgcggtggacacgggcgcggcggccacggacgagttggacacggacgcaacggtggccgccgacgcggccgggccggcgaacggcgagaccgtgcgcatcgacagttggatctggtccgtccgtctcgtcaagacccgctcgatgggcgccaccgcctgccggggcgggcacgtccgggtgaacggcgaacgcgtcaagcccgcgtacgcggtacgggtcggcgacgaggtacggctgcggcacgcgggccgggagcggatcctcgtcgtgaagcgcgtgatccgcaaacgggtcggcgcgccggtcgcggtcgagtgctacgtcgacaacagcccgccgcccccgccccgcgaggccgtcgccccgatcggcatccgcgaccgcggcacgggccgccccaccaaacgggaccgccgcgaactggaacgcctcaggggcttcggcgacccgccggacggggaacacggcgggaccgcggccccggacgatcccggaaagcagaacaggcccggaaagcagagcagctccgaaaagcagagcagctctggaaagcggagcagctccggaaagcagagcggacccaggacacgaggc

SEQ ID NO: 6219 - DNA, 792 bp, Streptomyces avermitilis
  CDS (1)..(792)
atggagggcacggagggcagggacagcagcttggcggagggcggccgcctggcggagggcagcagcctgagtgacctggacgagcacatcacggggtgccgtgcctgcccgcggctggtcgagtggcgcgaagaggtggcccgtaccaagcgcgccgctttcgccgactggacgtactggggacgtccggtcccgggtttcgggcccgtggacgcctcgctcctcgtcgtcgggctcgcacccgccgcgcacggggccaaccggaccgggcggatgttcaccggggacaggtcgggggacgttctgtacgcggcactgcacgacgtgggtctcgcctcgcgggccaccgccgtgtccgccgatgacggccttgagctgtacggggtgcggatcacctcgcccgtgcactgcgcgccgcccgccaacaagccgacgccggaggagcgggacacctgtcggccctggctggtgcgtgaactcgagctgctgcggccgacgttgcgggccgtcgtggtgctcggcgccttcggctggcaggccgcgctgcccgccctcgccgaggcggggtgggcggtgccacggccccggccggccttcgcgcacggggtgcgggtgacgctccggccctcagcagggccgcccgccaagtcgctcgacgtcctcgggtgtttccacgtcagccagcgcaacaccttcaccggacggctgacgcccgccatgctgcgggacgtgctgcgtacggcggcggaggcggcggggctgccgacactgccggatgcggggcagtacgcc

SEQ ID NO: 6220 - DNA, 405 bp, Streptomyces avermitilis
  CDS (1)..(405)
gtgaccacccgtacggcaatcggcgccgcccggacccgtccctgcacgctcgtcgtctgccgcggctgctgctgcggtgacccgcgcaagtaccccggctacgaccacgactggcaactggagcgcctgcgggcggcggccgcggcctccggcgggcggatcacggtccgcacgacggactgcctcgggccctgcgaccaggcgaacatcatcgtcgtacagccctccggggagggccgcagacgcggcggccgggcaacctggatcggctggtcgatgggcgacgactgcacggacgagatagtgcgctgggccgaggcggggggcccgggcatcgcccctcccccagccacgctggaactccagttcgtatcgtcggcgggagaacggtcccgggcccgccgt

SEQ ID NO: 6221 - DNA, 585 bp, Streptomyces avermitilis
  CDS (1)..(585)
gtggtggcacttcgctccgcaaattcgaatgcgcccgcctccccacgtcgcgcatgctcggcaggttgtccctccgccggcaggttgtccctcaaccgtcggcccgcccgaatccctggagaccccgtgatcaaccgcgtcaccgtccccaccctctgcccgccccccgtctactcccacgcctccgtcgtcgaggcggggacccgcctggccttcctcgccgggtccgtgccgctcgacgccgacggcaagatcgtcggcgagggcgaccccgtacgccaggccgcgcaggtgctcgccaacctcgccgagcaactgcgcgcggtcggcagcgacctggcgcatgtcgtttcgacggacgtgtatgtcgtcagcggcgagcctgccgtgctctccgcggtctgggacgtcgtcgaggcatcggggctcagtatcgggccgcactcctcgaccctgatcggcgtggcctgtcttgggtacacgggccagctcgtggagatcacggcgaccgcggtggttccggagcccggagcagagtccgcgtctgcctccgagcccggacccggacccggacccgagtcggcg

SEQ ID NO: 6222 - DNA, 375 bp, Streptomyces avermitilis
  CDS (1)..(375)
atgtcacgcaccgtccatcacgtccccacgagacaccgcacccgccccgcctactggcccaccggtacggcgggcccgtgcaccgcgcacgccctcaccgaccaccgctacagccgccaggagctggcccgagcccgccgcgcgggccgtcgccccgtaccgacgcgtgtcgaccgttccttcgccgcctacgtgtttccgcgtgccctgggtgcccacttctggagcccgtacgagtccgccgcccgtgctgacctgcgcactttccgcacggccgcctgcaagctcctccgtgccgcaccgccgggcgccctcctcgcggcggccgaggacctggaccatccgccgacccgccaccgccaccgcgacctgtgg

SEQ ID NO: 6223 - DNA, 1188 bp, Streptomyces avermitilis
  CDS (1)..(1188)
atgcgcatcgcgcaccacagatacgtcgtcgtcgcggccacagccgcggcgattctcgcactcgccgacataccggccgaggcccagaccggtccggccgccgctgccctgccgtcctcggtgagtgccgacaccacgggacttgccgggctcgccgagagctacctgcagcagcgggccgacatgctgacgacatctcctcccacggcgaaagccgccatcgcccatgtccgggccacgcgttccatggccgcccagacgcaggacgaccttgccgcgctcgcggagaagggcaagcggtacaaggaggtcgacggcggctatacgcgggcgcaggtcgacgtgaaagtcgacgacacgaccgtcgacggcgggacggcgacgcttcagctgaccgaacacacccgcctccggctgccgttcacgccgcaggaggtcgaggaaggcgcgccggagttcgaggaactctcgctcccgcacaccgtgaagttcacccagggatccgacagcgcgtggctgctgtcgtcggacaaggccgacaccgcgggcgggccgaccccgacgacacaggtgtccgacacggacgccgaggccaccaccgacgatgggggcggcgcaccggacgaggacgagggcggcaaggacgacgcggccgacaccaccccgctgcccgacagcggcgcgtccgacaccgtcaagccgggggtctcggccgcctacagctacaacaagatggtggcctacgccgacaggtactgggaccaccacaacggcgcgtaccggacctacggcaacgactgcaccaacttcatctcccaggcgatgctggccggcggttggggtcccaagggcggcgccctcatccagcggaccagcaacaagtactggttctacgggccgacgaagtggaccacgagctacacctgggcgggcgccgagaactggtactggttcgcgaagaagcacgcgaagaggaccaagatcctgggcaacgtgtggcaactggccaagtcggacgtgctccaggcggactggacccgcaacaacaacatcgaccactcgatgatcgtcacgaagaagtaccggggcacgccatacctgacctaccacaccggcgacacccacaacaaaagcctcagcaagctcctgtccgaccaccctcgtgcctggtggtacgcgcaccgcacc

SEQ ID NO: 6224 - DNA, 471 bp, Streptomyces avermitilis
  CDS (1)..(471)
atgaacaaggagcgcgctgtggaacgtcgacgtctcttggccgtgctggccgccctggccgtcgccaccggctgctcgacccatgatgacaaggccgagccctcccgttcggcatcctccgacggggcacgccacgccgtcgaggcctacgtggacgccctcaactcccgcagtgccaccggcctgatcaaggtcggcggcgtcaaggacgagagctggtcgcgacaggaggccgcgcggatgctggcggacaggggcgggcgggagtggaagatcaaggatgtccggatcgaccacgacatgggtcctgacaccggatcggcccgcctcctcgccaaggacaaggcgggcaagtccctgcgtgacaccttcaccgtgacacgcgagaagggggtgtggcatctggccgtcttcacccaccagccggacgggaaggggaaggagtcctcctcgaccgacaagcccgcttcc

SEQ ID NO: 6225 - DNA, 1860 bp, Streptomyces avermitilis
  CDS (1)..(1860)
gtgacccgcctcagtgccgccgtaccgccctggctcgctcatgccctgcgtgcccagcgggggccgatcccctggagtgcggtcctgcgtggggcgctggccggcgggcccctcctgctcgcggccgtgctgagcgggcgcagctccataggtgtcgtcgcagcgctcggcgccatgctcgccgggatcaacgaccgccccggcagccggcggacctccgtcaaacggctcggtgtgcccgccctcgcaggtgccgccggactgctcgtcggctcgtacgccggtcagcacgcctcggccgccccgctgaccctcctcctcacctgcctcgggttcttcgccggcgccgtcagcgccatcgggcccgtcgcctccggggccgggacgcagctcctcgtcgcctccgccatcggggccggcatgccgctgcccgagcccggctggcagcgcgccctcttcttcctcgccggggccgggtggctgctcgccctgcggctcgtgctgcccacgcccggggccacctccggcgactaccgcttcgacggggaacggaccgccgtcgccgccgtctacgacgctgtcgcacagttgctcgacgccgtgggcgcggtcgacgcgggcacccgtcgcgccgggctcaccgccgccctcgaccacgcggaggacgccctcgccgggccccggctgcgccgccgcgccggctccgcgaccgagcggcgcctgcacgcccagtacgccgtcgcactgcccctcgccgaagccgcgaccgcgctcgcctgggcgggggacgcggtgcccgcgcgggccgccgaagggccgcgccggctcgccgccgccgtgcgcgacagcacccacaccggaccgctgccggcacccgcccgctccgcacccgcgctgcgcgccctcgacgacgccctcctgcacgccgccgaggccttcgaccggggcgccggaggcaacctgcacacccggcgccgtaccgccgcatccctggtccgcaccgcactcgactccggcgggcgcgagtacggcctccgggtcgccctctccttcggcgccggcgtcgccgtcgcgcaggccctgaaccacgcgcgctggtacgggctccacacccactggtactggctgcccgccaccgccgtcttcctggtcaagcccgacctgggaccgctcgcgtcgcgcgtactgtgccgggcggcggggaccgtcctgggcgccgtcctcttcgccggactggccgccctgctgccgcggcccgagggcctggtcgccctggtggtgatcagcggtgcgctcatccccgtggccacccggcacttcgccgcgcagaccgccgtcgtcaccgttctcgtcctcgccctcgtcatggtgggcggggagccgcaggcctcctggaaccggatcggtgagaccgcgctggcctgcgcgatcgtgctgctcgtggggcatctgcccacgccggggcagcgtggcggtggcgtacgggcccggctcgcgcgcgcccacgacgccgcgcacgcgtacctcgcccacgtcctgagcggctccggcgaccgcaccggccgctgggtgctgcgccgcgaggcctatcgggcgctcgccgaggcccgcgccgccatcgacctcgccgcggccgaactcccggccctggcgcggcacacggagggcacggaggaggtcgcggccgtcctcgaacggctggtggacacgacgaccgcctgcgccgtgcacctcgacgacgcggggcggctgcccgcccggcaccgtgagcggatcgccgagttgctcgccgaactcacggacgcccacgaacacgcgggcctagacacacccgaggcgccccgcctgcccgtcgccgtc

SEQ ID NO: 6226 - DNA, 1164 bp, Streptomyces avermitilis
  CDS (1)..(1164)
atggatcccgccgaaggcctcctcgccgacccctacgccgtctacgaccggctgcgcgacaccgcccccgtacaccgcatcgccggcaccgacggcaagcccgcctggctggtcacgcggtacgacgacgtacgtgaaggactcgcgaacccgctgctctcgctcgacaagaagcacgcgctgcccgggaattaccgcggactcgcgctcccgcccgccctggacgcgaacctgctcaacatggacgcgccggaccacacccgcatccggcgcctggtcggccgggccttcaccctgcgtcgcgtcgaacaactccgcgagcccgtacgggagaccgcccaccggcttctcgacgcactcgggacgcacggcagcaccgacctcatcgcctcgtacgccgcgcccctgccgatcaccgtcatctgcgacctgctcggcgtgccggacgaacaccggcgggacttccgggcctggaccgacccgctcgtcaccccggacccggcccgcccggacgtcgccagggaatccgtcgtctcgttgctcggcttcttcaccgggctcctcgccgacaagcgcaagaaccccgcggacgacctgctctccgacctcatcgccgtgcaggaagagggggaccggctcaccgaggacgagctgatgtccctcgccttcctcatcctcttcgccggctacgagaacaccgtgcacctcatcgggaacgccgtactggcgctgctgcgccatccggagcagctcgccgcgctccgcgaggacccggcacggctgccggacgccgtcggggagttcgcccgctacgaagggcccgccctgctcgccatccgccgcttcccggtgcgggacgtgacgatcggcggggtcaccgtgcccgcgggggagaccgtgctgctgtcgctgtccgccgccaaccgtgacccgagccggttccccgaccccgaccgcctcgatctcggccgcgacgccgcaggccacctcgcgctcggccacggcgtccactactgcctgggcgcgccgctggcccggctggagacggaggtcgccctcgccgcgctcctcgaacggttcccggacctcgccctcgcggaaaccgaaccgcgccgacggccctcgctgcgcgcccgcggcctgctcgcgcttccggtgacgtac

SEQ ID NO: 6227 - DNA, 171 bp, Streptomyces avermitilis
  CDS (1)..(171)
gtgaacgggcgaacggtgctggagcgctttcccgccggtggaccccgcgggtcgtggcccgcggaggagttcgcacaggcgtgccgcctggagggccaggccgcggaggtcgtcatggacctctccacggacgcgtttctggtgatcgtcaggggcgcggaccgcatcgag

SEQ ID NO: 6228 - DNA, 453 bp, Streptomyces avermitilis
  CDS (1)..(453)
atgggtgtgagggacacgtcggcgagtgggtcaggggccgcccaggtcctgaacctggacaccttggtccgcctcaggcgcggacagcagggccccgcgtcgtccggtcgactccccatacccgagggcatgacgctgccgctgggctgcgacgcggtggccgtgcccgcgcacctgggaccgctgctgatgccgcgcctgccgcgggtgggctgtgtgtacgccgacagcgcgtactggtggtggatcgtgcccgccgactccgacgtcgcgctggaatggccggcgcccgcgcactacgccaccggtgcggtggtcccggtcacgccttgcgtccccgcgctcgtccaccggccggacggcatccttccttacaccccgccgatccccctctacctggccttgtgccgggtcatggacacgattccggcgtggtcgcggccgatcagcgcg

SEQ ID NO: 6229 - DNA, 702 bp, Streptomyces avermitilis
  CDS (1)..(702)
gtggcaagcgtgactccgtccgcgccgttaggaacagacgccgccgaagaccgatccggtctccgcgacgccgctggggtgcgcccccacgcggccgccgagcgccggttccgcttcgagctggccgcacacccgggatccgtggcccaggcccggcgtctgacgcgtgctcggctgacccgctggcaagtctgcgaggacacctgtgactcggccgccctggtcgtctccgagctggtcaccaacgcgatcgtccacaccgcgagcgaacacgtcgtgtgcgagctgcacgacggtgacgagctcgtgcgcatagccgtacgcgacgaggggtgtgcgccgggggagccgcatccctcgccacagcgacccgaggaggagcacgggagggggttgctcctcatcgcgtctctgtgcagggcatggggtgccctggagacggggccggggctgctggtctgggcggatctgccccgccgggcggcacccccggctccacgggacctgtcgcgttccggcgacaggtcccgctctacgacggccgcttcgtactgtctcgcggccgattccgacgacgcctcccgctccccggcggagaacaccgaggccaggtcggacctggggtggagtgcgaagaagacgccggccgaaagccggggaaccggggcggaggcgtcctggggagcggaggccggatgggtg

SEQ ID NO: 6230 - DNA, 858 bp, Streptomyces avermitilis
  CDS (1)..(858)
gtgagcgaaccgcggtccgcgccgacggtcggccaggtcgtcctcggccggcgcctgctggacctgcgggaacgcgcgggtctcaagcgcgaggaggccgcgcgcatcctgcgtgtcgcgcccgccaccgtccgccggatggagatggccgaggtctccctcaagatcccgtacctccaactgctcctgaaggcgtacggagtgggcgaggaggaggccgaggccttcgtactgctggccgaagaggccaacaaacccggctggtggcagcggttccacgacatcctgcccggctggttctcgatgcacgtcagcctggagggcgcggcggccctgatccgctcgtacgaaccccacttcgtgcccggactgatgcagaccgaggaatacgcccgtgtcgttctgaaatcgggggccatcggccagaccaggcccgaggacgtcgaccgctatgtggcgctgcgcatgcagcgccaggagctgctgacacgtgaggacgcgccccggatctgggccgtgatggacgagaccgccctgcgtcgccccgtcggcggccccgaggtgatgcgggcccagatcgacaagctgctcgaggtcacgaagctggcccatgtgacgctccaggtgatcccgttctcctcgggaccgcaccccggcacgtacgggcccttcgtactgttccgatttgccatgccggaactgccggacatggtctacagcgagtacctgaccggtgccgtctacctggacgcgcgagccgaggtggcaacccacctcgaggtcatggaccgcatggcggcgcaggccgctacggcacatcgcacgaaggagatcctgatggatctccgcaaggagctg

SEQ ID NO: 6231 - DNA, 291 bp, Streptomyces avermitilis
  CDS (1)..(291)
atggaacgcgccaagccgcgcatacgcaacgagcgcccgtacagcgagcgcatctccagcgagcggatctacaacggcatgcccgcccgtgagctgggaagcgagggctggcacaagccgtggagcggaggcaacggcggcaactgcctggaggcgatgaagctcgccgacggccggatcgccgtacgccagtccaccgacccggacgggcccgccctgatctacaccccggacgagatgacggcgttcatccagggggcgaaggcgggtgaggcggacttccttctctcg

SEQ ID NO: 6232 - DNA, 813 bp, Streptomyces avermitilis
  CDS (1)..(813)
atgaccgggcagaaccccgcaccggacgagatcgtcatcgacaccggcaatccgcaccccgcacgcatgtacgactggttcctcggcggcaaggacaactaccccgtcgacgaggagatgggccgacaactgctcgccctggacccccgggtcccggtgatggcaaaggtcaaccgcgcgttcatgcaccgcgccacgcgctggctggccatgaacggcgtacgccagttcctggacatcggcaccgggatacccaccgagcccaacctccaccagatcgcgcagcaggtcgcgcccgagtcgcgcgtcgtctactgcgacaacgacccgatcgtgctggcacacgcggcagccctgctgcgcagcacgcccgagggggtgaccgagtacgtacaggccgacgtgcgggaccccgacaccatcgtcgagcaggccggcaaggtcctggacttcagcaagccggtggcactctcgctcgtcgcgctgctgcacttcgtctccgacgaggacggcgcgtacgaactcgtcgaccgcctgctggccgaggtgccctccggcagctacctgatgctgtcccacgcgacggcggacttcaccccgaagaagtccgaggaggcgggggagctgtacaaggcccgcagtctgacgctggcactgcgcagccgcgacgaggtggcccgcttcttccgcgacctcgaactcgtcgagcccggtgtcgaggtgcccgacaagtggcgtcccgaactgggcgaaccggtgcccggccaggacgacgagccgatccccggctacgcggcggtggggcgtaagccg

SEQ ID NO: 6233 - DNA, 1410 bp, Streptomyces avermitilis
  CDS (1)..(1410)
atggcggaatcatgggtcaattcggcggagcgcatcggcgccgacctgcatcttgagctgtcggcggcgggcgggcgccgggcttcgctgattcgggcgctgcgtgaggcggtgcgcagcgggaggctcgcgccgggcactcgcctgccgccctaccgttcgctcgccgccgacctgggcgtggcccgcaacacggtcgccgacgcgtacgccgaactcgtcgccgagggctggctgaccgcacgtcagggctcgggcacgcgtgtcgccgaccgcgccgcgccgctcggcggtgcccacgcgcgcgtaccgaaaaagctgccgccgcgcgcgcgtgggccacggcacgatctgcggcagggcacgccggacgcgtcgtcgttcccgcgcgcggcgtggctcgcgtcgtaccggcgggcgctccagcaggcccccaacgaggtcttcgggccgggcgatcccgcgggccggatcgagctgcggcaggcgctcgccgcgtacctggcacgcgcgcgtggggtgcggacggagcctgaccggatcgtgatctgctccggcttcgcgcacgcactgcggctgctcttccccggcgtgctcaagggcccgctggcggtcgagtcgtacggcctcggcttccaccgtgagctgctggccgccgcgtccgtacggaccgtgccgctgccgttggacgaagacggcgcgcgggtgggcgggttgggccgggaacgggccgtactgctcacgcccgcacaccagttcccgaccggcggaccgctgcatccggcgcggcgggccgcggtcgtcgactgggcacgcgcgcgtggcggggtgattctggaggacgactacgacggtgagttccgttacgaccgcaagccggtcggcgccgttcaggggctcgaccccgaacgggtgatccacatcggctcggtcagcaagagcctgtcgcccgcgctgcggctggggtggatggtccttccggagcggtacgtcgacgcggtgctcgcggtcaagggcgagcgggaggcgtgggtgagcgtcctggaccagctggcgctcgcggacttcgtcgtctccgggtcgtacgaccgtcatgtgcggcgtatgcggcagcggtaccgggggcggcgcgaccggctcgtcgccgcgctcgccgagcgggcgccgcacatcgaggtgacggggatcgcggcggggctgcacgcggtgctgcggctgccgccggggacggagcggtccgcggtgaaggcggcgacatggcagggcgtcgcgctggacgggctcgcggagttccggcacccggaggcgacgatggcggtgacggacgggctggtcgtggggtacgcgacaccggcggagcatgcgtacggggcggcggtcgaggcgttgtgcggggcgctgccgccgggg

SEQ ID NO: 6234 - DNA, 513 bp, Streptomyces avermitilis
  CDS (1)..(513)
atggtcatgacgacgaacacgacccacacgacccacacgacgaacacgaccgacacggtggacacgaccggctctcgcctcaacttcgcgaaggccgccccgaaggtcttccgcgcgctcatcggcttcgacgcggcggcccgcgagggaatcgacccggccctcgtcgaactcatccagatccgcgcctcgcacctcaaccactgcgcgtactgcctccacatgcacaccaacgacgcacgcaaggccggggagagcgaggatcggctgcacatggtggcggtgtggcgcgaggcccgccacttcttcaccccgaaggagcaggcggccctcgccctgacggaggcggtgaccctggtcgccgacgcgggcgtccccgccgacgtctacgccgaagccgccgcccacttccccgaggaggaactggcccacgtcctcgccctgatcctcacgatcaacacatggaaccgggtcgccctgtcgacgggaaaggtggccggcacggacgaacgc

SEQ ID NO: 6235 - DNA, 1488 bp, Streptomyces avermitilis
  CDS (1)..(1488)
atggccgatcccaagggttttctcaccacaccgcgcgaggaatggccccgccggcccgtcgaggaacgggtgcgggactgggacgaggtgtacgtccccggcgcgctgctgccgatcatcagtcggcaggccgaccgctgcatggactgcggggtccccttctgtcatgaggcctgtccgctgggcaatctgattcccgagtggaacgacctggtctcgcgggaggactggcgtgccgcgagcgaccggctgcatgccacgaacaactttcccgagttcaccgggcggttgtgtcccgcgccgtgcgaggcggggtgtgtgctggccatcaaccagcccgcggtcaccatcaagaacgtcgaggtcgccatcgcggatcgggcgtgggcggacgggttcacgccgccgtgtccgccggagcggctgtccgggaggacggtcgcggtcgtcggctcgggccccactggccttgccgcggcgcagcagttgacgcgggccgggcacacggtcgcggtgttcgagcgggccgaccggatcggcgggctgctgcggtacgggataccggccttcaagatggagaagcggcatctgaaccaacggctcgaacaaatgcgggacgagggaacgaagttccgcacgtcgacggcgatcgggcgggacatcggggcggaggagctgcgggcgcggtacgacgccgtggtccttgccgtgggcgcgacggcctggagggaactggacgtacccggacgggagttggccggcattcatcaggcgatggagtatctgccgctggccgaccgggtgtgcgagggggatctggaggtctcgccgctgtctgcggccggcaagcacgtcatcatcgtgggcggaggcgacaccggcgcggactgcctgggaaccgcggtgcgcgagggcgcggcgtccgtgacccagctcgacatctatccgctgcccgaggcggagcgggacgaggacatcgagccgtggccggtgtatccgaagatctaccggatgtcgcccgcgcacgaggaagcccgtgacctgaagacggcgcccgcggcggacgcggacgcacgactgttcgcggcgtccacgctccgcttcgccggggacgcggcggggcatgtgcgggccttgcacctggtcgaggtcgacgcgcggcgtcggccgctgcccggctccgggcgtacgctgcccgccgacctcgttctgctcgctctcggtttctccggtcccgaccgggacgacgggctggtcgaccagctcggtctcgcactcgacccgcgcggcacgatcactcgggacgcggacttcgcgaccaatgtccccggggtgttcgcggccggggacgcggcgcgcggacagtcgctgatcgtgtgggcgatcgcggaggggcgagcggtggcggcggcggtggaccgccggctgacgggcgccgcgtcgaagctgccggcgccgatagggccgtacgaccggccgatgagggcg

SEQ ID NO: 6236 - DNA, 477 bp, Streptomyces avermitilis
  CDS (1)..(477)
atgatcgacgggccgtacttcgtactgacggtgctcggggtgctcgggaccgggctggtggccggggtgttctgcgggttctcgacgttcgtgatgaaggggcttgcctcgctgccgcccgcgcagggcgtcgccgcgatgaacgcgatcaacgtcgccgcgctgacccccgccttcatgatcgtgttcgtcggctcggcggtgctgtgtgccgtgctcgccgtggtcacgttcgtgctgtggcccgacgcgggcacggtggaactgctggtgggcagcgggctgtatctgttcggtacgttcggagtgacggccgtcgcgaatgtgccccgcaatgacgcgctcctcaagatggatccgggcgccccggagaccgccacgtactggcgttcgtacgtgcgcgagtggacgatctggaaccacatccgtgcggtcgcgtcggccggcgccgccgtgtcgtacgtcctcgcgctcacc

SEQ ID NO: 6237 - DNA, 816 bp, Streptomyces avermitilis
  CDS (1)..(816)
gtgggcggggggagcggcccggtcgcgggtatgacggtccggtccggttgcggacatgacggcccggccgcgggcatgacggccgacgagacgaggggacagagggcgggggcggggtggggggcggaggggtggggggacggcgggctgcgccgttccgcgccggtacttctggtcattcagccgatcacgcgacgcctctgtgccgagtgtcggagcgggccgcgttcgctgttggtgtgggaggagggcgcacctcggtgtctggactgtgccgacctcgggcatctggtgtttctgccgcgggggcactccgcgctgactcggcggtcgcgggaggagagtgggctgtcggcggtggtggttcggttcaaccggcgaaagagtcggtacgagcggcagggggtgctagtcgaggaggcggcgctggcgctggccgaggagcggtgtctggccgacgcggaggcgcggcggcggcgccgggtgcgggacgctcggcggcgggcagcggaggacgtacggttcacggacgccttcgcgcgggagatccggcggctgtatccccgctgtccggccgagcgggcgttggcgatcgccgcgcatgcgtcactgcggggaagtgggcgggtcgggcgcagcgctgcggggcgtgcgttgtcggggacggcggtggcctcggcggtgcgggcgtccgtgcggcacaaggagacgccgtacgaccggctgctgatgagcggggtgccgcggcatgaggcgcggcgacggatcgcgggggtggtggaggcgacgttacgggagtggggcggggcgccacct

SEQ ID NO: 6238 - DNA, 642 bp, Streptomyces avermitilis
  CDS (1)..(642)
atgatgggcggtgtgcgactcgaagcgatcacctgggaacggctcggcgacctcctcgccgaccgtctgctcgacctgaaaccggacgacggcagcccctggccgcgcatcgccttcgacggagccccggccgcccgccccggcgacctcgctcagcgggtgtccgaggcgctgcgcatacgcggccgtccttcgctcgtcgtcggcgcggccgacttcctgcgccccgcctcgctgcggttcgagtacggccaccgggacatcgaggcctactacgacggctggctcgacaccggcgccctgtggcgtgaggtgttcggtcccctggaagccggcggcagcggccgcgtcctgcccgacctctgggacccgctcaccgaccgcgccacccgcagcccctacgcccaactaccgcccggcggtgccctgttgctgcacggccccctccttctccggcactggttccccttcgatctgaccgtccacctactcctttccccgggtgccctgcgccgccgtacccccgaatccgagcactggaccctccccgcctacgagcgctacgaggccgaggtggacccggtcgccgcggtcgacatcctggtacgcgcggacgacccccggcacccggcgtggcgcggc

SEQ ID NO: 6239 - DNA, 486 bp, Streptomyces avermitilis
  CDS (1)..(486)
gtggcgcggctgaccgagcggatatggcgtggtcggccgagcctgtacccccaagaccttttgcatgcatgtgcatgtagttactctggtcccatgacactctccttcgacgactcggtccgcaccctcctcgacggcaagaacttcgccggcgtcgccaccctcggtcccgacggcgctccccagaactcggtggtctggatcaagcgcgagggcgacaccgtcctcttctcctcgaccgcaggccgccagaaagtgcgcaacctgcgacgggatccccgcatcagcctctcggtcttcgacctcgccaacccctatacctcggtcgagatccgcggcaccgccgagatccttcccgacgagaacaagcgcctcccgtacgagctctcgcacaaatacctcggcatcgatccgccggcggagaaggacgacgaggtgcgtgtgatcatccgcgtcgtcccgcagaagatcgtgggcttctcggcg

SEQ ID NO: 6240 - DNA, 471 bp, Streptomyces avermitilis
  CDS (1)..(471)
gtgtgtcccgcgccgcgccggccgtccggcaccgggaggtacttcatgaccaccgccggagaaatcatgcaccgtggtgcccagtggattcccgcccacgaaaccctggaccgcgccgcccagctgatgcgcgagctcaacgtcggagccctgcccatcagcgacgagaacgaacggctctgcggcatcctcaccgaccgcgacatcgtcgtcggctgcgtggccatggggcgcgacccggcacgggtgaccgcgggcgagatggcccagggcaccccgcgctggatcgatgcgagtgccgacgtcactgaagtgctcgacgagatgcaggggcaccagatccgccggcttcccgtcatcgaggacaagcgcctcgtcggcatgatcagcgaggccgacctggcccagcatctgacggacgaccagatcgccgtgtgggtcgagagcgtctacgcgaggagcgtgacgcac

SEQ ID NO: 6241 - DNA, 1062 bp, Streptomyces avermitilis
  CDS (1)..(1062)
gtggcacggctggcgcaacgccgtgcgcgggtcgacctgagtcaccccgccaggtcgcccctgggctccgcggtggtgaactgcgtgatgtatcaggacggcgtacggatgccgggcggtcacgatctggtcgaggccgtggagcgggtccgcaagaaggacgacggcttcgtctggctcgggctgcacgagccgacggaccaggagttcgcgggcatcgccgagctgttcgacctgcatccgctggcggtcgaggacgcggtggaggctcatcagcgcccgaagctggagcggtacggggagacgctgttcgcggtcttcaagacggtctgctacgtcgagcacacggagctgaccgcgacgagtgaggtggtgaacacgggcgagatcatggtgttcatcggccccgccttcgtgatcacggtgcggcacggccggcatggttctctcggccccctgcgcgaggagctggaggccacaccgcagcagctcgccaaggggccggccgcggtgctgcatgcgatcgcggaccatgtcgtcgacgactatctgagcgtcacggacgcggtgcaggaggacatcgaccaggtcgagacggatgtgttcgcggcgagcggtgcgcgggtcgacgcgggacgcatctaccagctcaagcgcgaactcctggaactgaagcgagcggtgatgccactcagccgccccgtacaggagctggccacccggccgatccgagtgatcgaccaggagatacaggcgtacttccgggacgtctccgaccacctgctgcgggtgtccgagcagatcgccgcgttcgacgaactgctcaactcgatcctgcaagcgcatctcgcgcaggtcagcgtcgcgcagaacgaggacatgcggaagatcaccgcgtgggcctcgctcatcgcggtgccgacgatggtgtgcggtgtgtacggcatgaacttcgagttcatgcccgagctgcactggaggttcggctacccgatggtcatggccgtcatagccgtgggctgcgtcactctgtaccggggcttcaagcgcaacgactggctg

SEQ ID NO: 6242 - DNA, 792 bp, Streptomyces avermitilis
  CDS (1)..(792)
atgacgcgaaccgacgggtatctcctcgacaaccggcagcccgaggcggggcagagttacgacgccgtcgccgccgtcttcgaccccacgacgttccggcacatcgagggcttcggcatcgggtccggctggcgctgctgggaagtcggcgcaagcggcacgtccgtgatctcctggctggccaagaaggtcggaccgacggggaaggttgtcgcgacggacaccgacacctcgtgcgcggcgtcggccgcgcgccatccggtcgaggtgcgcacgcacgacgtgggggtggaggagccgccgggggagggcttcgacctcgtgcacgcccgcctcgtactggtccatgttccggaccaggagcgggcgttgcggtcgatggtcaaggcgctccggccgggcggacggctgctgctcgaggacgccgacccggcgctccagccgctgctgtgccccgacgagcacggccccgagcagcagctggcgaaccgcctgcgcgacggattccgcttgctgctggccgagcgcggcgtcgacctctcgtacggtcgtaagctccctcgcctgctccgtgcggcaggtctgcgccgagtggaggccgacgcgcacttccccgtcacctcgcccgcctgcgccaccctcgaggccgcgacgatccgtcagatccgggaccagctggtctcctcaggccatgccacgaacgcggacatcgacctccacctggccaatgtggcggccggcgccatggacctggccacggccccgatgatctcggcgtggggccgcaaggcg

SEQ ID NO: 6243 - DNA, 942 bp, Streptomyces avermitilis
  CDS (1)..(942)
atgaacgctcccggcgccggggcgctgctcgtcgtcggtgacgtcgtcactgatgtcgtcgcgcggcaccgggggccgctcgcgtcgggcaccgacacggccgccgccatccggacggtgccgggtggcgcgggcgccaacgttgcctgctgggcggctcattggggctgggcggacgtacggctgctcgggcgggtgggggccgacggggccgcctggcacgagcgggagctgacggcttcgggggtacgtcctcgtctggtcgtcgatcccgacgtgccgacaggaacggtgatctgtctggtggacacgggcgcttcggccgagcgcaccttcctgacggacagcggggcctcgctgcggctggcgcccggggactggtcgaacgcgctgctcgacggtgtcgtacgactgcatctgtcgggttatctgctgttctcggagcagagtcgggcgctggtggcggcggcgttggaatcggcacgcgcgcgtggggtgccggtgagtcttgatccggcgtcggcggggttcctggcggagcttggagtggaccgcttcctggccctcatcgagggggtggacgtcctgctgcccagccgcgacgaggcctgtctgctgaccgggttgcccgatccggcggacgcggcggccaagttgagccgccacgttcccctggtggtcgccaagcagggcgcggagggagcgctggtggcagaggcgggcgccgtccgggcgcgggtaccggcaacgcccgcgacgcctcgggacacgacaggcgcgggcgacgccttcacgggcgccttcctcgcggccctcctggtcggcgtggaacccgcccaggccgcggcggaagggtgccgggcgggtgctgccgcggtggcaggggtgggcgggagaccgccgagcggcacgcgccagaacaggggtgcggtcaaactcgat

SEQ ID NO: 6244 - DNA, 903 bp, Streptomyces avermitilis
  CDS (1)..(903)
gtgctggtggtgtccgaagaggtacgggaggcgctcgccgcgcaccggccggtggtggctctggagtccacgatcatcgcgcacgggctgccgcgtccgcgcaatctccaggtcgctctggagctggaggacgtcgtacggcaggagggtgccgtgcccgcgacgatcgccgtgctcgacgggcatccccgtgtcggcctggacaaggaacagctggagcgggtcgccaacgaggacgggatccgcaagctggggcatcgcgatctgccgctcgcggtggcggcgggcgcgagcggcgcgaccacggtgtcggcgactgctctgctggcggccctcgcgggcgtacgggtgttcgcgacgggcggtctcggcggggtgcaccgcgagtggacggtgacgcaggacgagtcggccgacctgggactgctggcacgcacccggatcacggtggtgtgcgcgggcgtgaagtccatcctggacgtgcccgcgacgctgcagcggctggagaccctgggagtcgcggtggccgggtacggcacggcgcgctttcccggcttctatctgtccgactccgggtatccggtggactggacgcttcggtcgccgcggcaggtcgcggatgtcatgcgcgcgcaggacgcgctcgacggcccggagtcggcgctcatcgtcgcccatcccgtccccgaggacgaacagctcgatcccgagctccacgcgcgcgtactcgccgacgcgctgcacgcgtgcgaggcggagggcgtcacgggccaggcggtcaccccgttcctcctcgactacctggtacgccacaccgagggtgcctcgctgagcgccaacctggcggcggtacggggcaacgtacgcctcgcggggcggatcgcggcggcctgggccggggca

SEQ ID NO: 6245 - DNA, 462 bp, Streptomyces avermitilis
  CDS (1)..(462)
ttgcgagctgtgggggacggcaccagcctgaggggtatgacggacaactcgccacgtctcgaccatgtcgtcctctgggtacgggacccggtggccgcggccgacttctacgagaagacggtcggcctcgaaccccttcgggtccccggtttcgccgcggggaaggacccgttcccctcggtgcgcctcaacgaggagacgatcttcgacctcgccccgctctccctggtggagcacatgaacatgctccctggggccgccgacagcgccgggcaccccgtcaaccatgtgtgcctgtcccttcagagggacgatttcgacgccctacgggcgcgcctggaggatcggacggtcccggtctcggacttctcgtacgactccttcggcgcccggggaaaggccaagcgcagcttctacttccgtgacccggacggcaacgtcttcgaggcacgacactacgag

SEQ ID NO: 6246 - DNA, 360 bp, Streptomyces avermitilis
  CDS (1)..(360)
atgaccacgaacgcccagtccaccccgtccttcgccgtccacatccccgacgcggaactcgaagcggagccgctcgacccggcccagatcgtctccggcgccccggtcgtgacgggcaaggtgctgtgggaatccgccgacggcaagcaggtgcggggcatctggcagatcacgccgggcgtggtgaccgacaccgaggcgaacgaactcttcgtggtcgtgagcggccgcgccacgatcgaggtcgagggcggcgccgtcatcgaggtcggaccgggcgacgcggcggtcctgcgcgagggtgaccggacgacctggaccgtgcacgagacgctccgcaaggcgtaccacatcagcctc

SEQ ID NO: 6247 - DNA, 552 bp, Streptomyces avermitilis
  CDS (1)..(552)
atgaagagtgttgagcgcagcgagcagcaggtcgtgtgggccgtcgtcggcacggacatcggtccgctgctgctcgccgcgaccggcgacggcctggtgaacgtggtgttccacgcgacggacgcggtgcgcgacaaggcgctggagcggctcgcgtcccggctcggttcagagcccgtcgaggatcccggctccccgttcctggccgaggcgatacgccaggtgacggcgtacttcgcgggtgagcggcgcgacttcgagctgcccttggactggtccctgatctccggcttcaaccgccaggtgctgcgcgagctggcgtccggcgtgccgtacggcgcggtcgtggggtacggcgacctggcccggcgggtcggtcagccgggcgcggcgcaggcagtgggcatggccatgggctcgaatccgctgccggtggtcgtcccgtgtcaccgggtggtcgagagcgacggtggcatcggggggttcggcggcgggctggaggccaagcggaagctgctggcgctcgaaggggtgctgccggaaccgctgttc

SEQ ID NO: 6248 - DNA, 870 bp, Streptomyces avermitilis
  CDS (1)..(870)
atgcacgcgcgcgttgccgccgccacgaccaccgcgcttatcggggccaccgtcgccatactccccacgcctcacgccggggccgcggccggcgacggcccggtgatcgtctcccaccgcggggcctccgcgtacgcgcccgagaacaccctggcctcgatcgacaaagcggccgccatgggcttcagctgggtcgagaacgacgtacagcgcaccagggacggtgaactcgtcgtcatccacgacgacactcttgcgcgcacaaccgacgtcgaacaggtgtatccgaaccgggcaccctggaaggtgaaggacttcaccgccgaggagatctcgcgtctcgatgcgggcagttggttcggctcccggtacaagggcacacgcgtgccgacgctgaagcagtacatgaaccgcgtctcgcgcaaccatcaaaaactcgttttggagatcaagaacccggagctctatccgggcatcgagcgtcagaccctcaggctgctcggcaacgaggggtggctcaagcccggtcgcctcaagaggcggctgatcgtgcagagcttcagcatcgggagcctgcgcacggtccaccggctgcgccccggcatcaagaccggttacctgggcacgccgtcgatcgcggccctgcccgcgtacgcggagttcgccgaccagatcaacgcctcgtacacctcgatctcggccggttacgtctccgcgctccactcgttcgacggaccgcacggcaagccgctggagatcctcacctggaccgtgaacagcggtgacacggcgcgccgtgtcacccgctacggcgtggacggcatcatcacgaacactcccgacgtggtccggcgggcggtgaccgcgtac

SEQ ID NO: 6249 - DNA, 864 bp, Streptomyces avermitilis
  CDS (1)..(864)
atgcagggcaccgtcgacggcttcagctacggactcgtcacaccgctggtggcgtacctcatggccttcctgggcggtgcgctcgggctgcgctgcaccacccggtcgatgctggtcgcccggtcctggcgggccggctggctcgccctagggtcggccgcgatcggctccggcatatggacgatgcacttcatcgcgatgatggggttcagcgtcaaggaaacccccatccactacgaccaggcgaccacgttcgcgagcctgggcgtcgccatcctcatggtcggcgtagggatcttcatagtcggataccggggggcttccggagcggctcttttcaccgggggcacgatcaccggtctgggagtcgcctcgatgcactacctgggcatggccgggatgcgcctcaacggaaagctcgagtacaacaccctcaccgtctccgcctccgtggtgatagcggtcgtggccgcgatcgccgcgctctgggcggccggacaggtgcgcggcttcatgtggagtgtgggcgccagtctcgtcatggggctcgccgtcagcggtatgcactacaccggcatggccgccctcagcgtccatctgcacggctcggccggcgcaccggcgggcgactcgcccgccgccctgctcgccccattgatgatcggtccgctcgtcttcctgtgtctggccggcgtcgtcgtactgttcgacccgatgatggtcatgggcaagcccgactggacccccaccgagaacaggccgggcgtccccgcccaccccaccgtcacccacaccggccggcgccccgcgtcccgccccggcgagcgccatggacaccgcggcccccgcaccccgcagcgctgg

SEQ ID NO: 6250 - DNA, 2139 bp, Streptomyces avermitilis
  CDS (1)..(2139)
atgcggcccgtttccaagatcgaacgcacggtggcgcccttcgaggtcgtcagtccctaccagcccagcggcgaccagccggcggccatcgctgagctcgaccgacgtatccgtgcaggtgagaaggacgtcgtcctgctcggcgcgaccggcaccggcaagtccgccaccaccgcgtggatgatcgagaagctccagcgccccaccctcgtgatggcgccgaacaagacactggccgcccagctggccaacgagttccgcgagctgctgccgaacaacgccgtcgaatacttcgtctcgtactacgactactaccagcccgaggcgtacgtcccgcagtcggacacctacatcgagaaggactcctcgatcaacgaggaggtcgagcgcctgcgccactccgcgaccaactcgctgctcacccgccgcgatgtcgtcgtggtcgcctcggtctcctgcatctacggcctgggtactccgcaggagtacgtggaccggatggtcccgctcagggtcggcgacgaggtcgaccgcgacgacctgctgcgccgcttcgtcgacatccagtacacgcgcaacgacctggccttcacccggggcaccttccgggtccgcggcgacaccatcgagatcttcccggtctacgaggagctggccgtccgcatcgagatgttcggcgacgagatcgaggcgctctccaccctgcacccgctcaccggcgagatcatcagcgacgaccagcatctgtacgtcttcccggcctcccactacgtcgcgggccccgaacgcctggagcgggccgccaacgacatcgagaaggagctgggggagcgcctcaccgagctggagaagcagggcaagctcctggaggcccagcgcttgaggatgcggacgacgtacgacctcgagatgctccgccagatcgggtcctgctccggcgtcgagaactactcgatgcacttcgacggccgcgagcccggctccccgccgaacacgctgctcgactacttcccggacgacttcctgctcgtcatcgacgagtcgcacgtcaccgtgccgcagatcggcgccatgtacgaaggagacgcctcccgcaagcgcaccctcgtcgaccacggcttccgcctgccttccgccctggacaaccgccccctgaagtgggaggagttccaggagcgcatcggccaggccgtctatctgtcggcgacgccgggcaagtacgagctctcgcgcggggacggtttcgtcgagcagatcatccgccccaccggcctcatcgaccccgaggtcgtggtcaagcccaccgagggccagatcgacgatctggtgcacgagatccgcaagcgcaccgagaaggacgagcgcgtcctggtcaccacgctcaccaagaagatggccgaggacctcaccgactacttcctcgaactgggcattcaggtccgctacctgcacagcgacgtcgacaccctgcgccgcgtcgagctgctgcgcgaactgcgcgccggtgagtacgacgtactggtcggcatcaacctgctgcgtgagggcctcgacctgcccgaggtctccctggtggcgatcctcgacgccgacaaggagggcttcctgcgctccggaacgtcgctgatccagaccatcggccgcgcggcgcgcaatgtgtccggccaggtccacatgtacgccgacaagatcaccccggcgatggagaaggcgatcgacgagaccaatcgccgccgggagaagcaggtcgcgtacaacaaggagaagggcatcgacccgcagccactccgcaagaagatcaacgacatcgtggcgcagatcgcccgcgaggacatcgacacggagcaactgctcggctcgggctatcgccaggcgaaggacggcaagggcgcgaaggcaccggtgccgtcactcggcggaaaggcggcggccaagggcgccaagtccgccaagggcaaggccaaggagacggtgccgaccgaccgtccggcggcgaaactcgccgaggagatcgaggaactgaccaaccgcatgcgcgccgccgcggccgaccttcagttcgagatcgcggcccggctgcgtgacgaggtctccgagatgaagaaggagctgcggcagatgaaggaggcgggcctggcc

SEQ ID NO: 6251 - DNA, 576 bp, Streptomyces avermitilis
  CDS (1)..(576)
gtgacggtcaacatgaccaagggtcaggccatcagtctgcagaagaatgacgggggcaccctgaccgcggtgcgcatggggctcggctggcaggcggccccccggcgcggcctgttcggctcgcgcacccgggagatcgacctcgacgcgtccgccgtgctgttcgcggacaagcagccggtcgacgtggtgttcttccgccacctcgtcagcgacgacggctccgtgcgacacaccggcgacaacctggtcggtggtgtcggccagggcggcgacgacgaggcgatcctcgtcgacctgcagcgcctcccggtccacatcgaccagatcgtcttcaccgtgaactcgttcaccggccagaccttccaggaggtgcagaacgcgttctgccgtctggtcgacgaaaccaacggcgaggagctcgcgcggtacacgctggcgggcggcggccagtacacggcccagatcatggcgaaggtgcaccgggcgggtgcgggctggcagatgaccgccctgggcacgcccagcaacggccgtactttccaggacctgatgccggcgatcctgccgcacctg

SEQ ID NO: 6252 - DNA, 2085 bp, Streptomyces avermitilis
  CDS (1)..(2085)
atgacggccgagctggtccgggggcagaaccatccgctcccccaggcccgacttgaggtccgggtatctgccggcacaccgatcgtggccggggccacgctcggcgacgagcagggcaaggtccgcggcgtcgagtgggtggcccatccgggtgcgcccacgctgcccggcctcgaggtctccaagcaggcggcggccgaccaccgcctcgccttcgacctggacgccctgccagggaccgtgcaccgcgtgcatgtactgctcgccctgccgacgggaggcggtggcccggcccggttcggcgccgtcgcggcccccttcgtcgcggtcaccggactcgacggcgccgagatcgccagctacacgatcaccggactgaatgccgagtcggcggtggtggctctggagctctaccgcagacaggacgcctggaaggtgcgcgcggtcggtcagggatacgcgggcggtctcgccgagctcttcgccgaccagggactgccgcaggcacagcagctcgcggccggcatcaacgaagcagtggcccaaggtctggcgcgttcggtggcggcaccgccacgcctgccggacggggagcgcacgccccccgccgcctccgccccgggctcggaccagacgcacgcccgaccggtatcgcagggcgcagcgcaggtcgccgccgaccacgtacagccgcaccaggggacccccggcaggccccagcccggctcgccgtacgacggcgcgggcccgcagagcggtgcggcaccgcagccagatcacgccgccggccgttcggtgccgcaggaagggcaccccggcgctcccgtccggccggactccgccgccgcccggcccgcaacgcccggcgcgggcggcccgatcgactacagccaccccgcccggcagaacgtcgcgcccccgccgcccccgccgccggccgcgccggggcattccgcacagcccgtcgcgggagacgcgaccggctggaccatggaggagcggctctacaaccaggtgtggggcatgttcgaggacctggcgcgcgccacggccgcgtaccgcagcgccgtcgacttcgcggactcccgcagggaacaggagctcgacaaggccctgtcggatccgcgcagccgcatcggcgggcagggcgacgccgtgcgggaggcggcccaggccaagcacgcccaactcgtcgaccaggcccgcgcggcactcgaccgcgacctcgcccagctcatggccgagtcggacgtcgtcgagcccgcgctgcccccggcttacgcgcgctgggacaatccggtctggcacggctaccgggtgccgatggagacccccatggccgtgcgcctgggcgatctccacctcccggagagcgaaggactgcgcatccccatgctggtcaggctgccgttggagcgcggtctgtggatcgacagcggccgcgccggatcccgtgacggctcgctcgccgacgccgacgagctgcgccgcctcgccatggacacggcggtggcgcatgccgcgcggctgctcgccgtccatccggcgggcgagttcaccgtgcacgtcatcgacccggccggctcgggcgcctccgcgctcgcgcccctgacacagtccggggtgctcgccgacccgcccgctgtcggtgccgcgggcgtggcggacatgctggcccggctcatccagcgcgtcgacctggtgcagatggcggtgcgcggcggcgcggccgactcgctgccccccgacctggacacggccgaacagctactgatcgtcaacgactttccgcacggcttcgacgaccgtgccgtgacccagctgcgctatctcgcggacgagggcccggccgtcggcgtccatctgatgatggtcgccgaccgggaggacgccgccgcctacgggccgctgctcgacccgctctggcgctcgctgctacgcctcactcccgtccccgacgaacacctcgccgacccgtgggtgggccatgcctggacgtacgagcctgtgacggtgccgccgggcagccaggtactgcaccaggtgctcgcgcacatcgcggcggctcgccgcgcatggaaccgc

SEQ ID NO: 6253 - DNA, 987 bp, Streptomyces avermitilis
  CDS (1)..(987)
gtggatgtttccctgaccctgtgggtcctgacaatcgtgggccttggcgccctcatcgcggtcgacttcttcatcggccgtaaaccgcacgacgtgtcgatcaaggaagccggcacctggaccatcgtctggatcgtcctcgccggactcttcggcctgggactgctcgtcttctccggcggtcagccggccggagagttcttcgccggcttcatcaccgagaagtctctgagcgtcgacaacctcttcgtcttcgtcctgatcatggcgaagttcgcggtgccctcgcagtaccagcagcgagtgcttctcatcggtgtcctcatagccctcgtcctgcgggcgatcttcatcgccgcgggtgccgcgatcatctccagcttcgcgtgggtcttctacatattcggcgcgttcctgatctacaccgcctggaagctcatccaggaggccagggctgacgagccggaggaggagttcgaggagaacaggctgctcaaggccgcggagaagcgcttcggcgtggccgaccgctatcacggcacgaagctgtggatcgagcagaacggcaagcgggtcatgacaccgatgctggtcgtcgtgctcgcgatcggcaccacggacgtgctcttcgcgctcgactcgatccccgcgatcttcggcctgacgcaggatccgtacatcgtgttcaccgccaacgcgttcgcgctgatgggcctgaggcagctgtacttcctgatcggcgggctgctcaggaagctggtccacctctcctacggtctgtccgtcatcctcggcttcatcggcatcaaactggtgctgcacgcgctgcacgagtccggcgtccacgtacccgagatctccgtcccggcctccctcggtgtgatctgctcggtcctcgtcatcaccacgatcaccagcctgatcgcctccaggaagcaggcggcgcagaagcagaccgaaggcgctccgaaggacagcatcgacgtc

SEQ ID NO: 6254 - DNA, 1098 bp, Streptomyces avermitilis
  CDS (1)..(1098)
atgatcgttcggctccggtcccttgtgatgcagtggacggccgtcgtgcccgtggccgcgatcgtcctgcttgccctcacctggggccgcgacctgcccggcgcggtcgtcgcactggtgacgctggtactggccggagccgtgctggccgccgtgcatcacgccgaggtcgtcgcgcaccgggtcggtgaacccttcggctcactcgtcctcgccgtcgccgtgacgatcatcgaggtcgcgctgatcgtcaccctgatggcggacggcggcggcaagagcgcgaccctggcgcgcgacacggtgttcgccgccgtgatgatcacctgcaacggcatcgtggggatctgcctgctggtcgcctcgctgcgccacgggctcgcggtcttcaacgcggagggcaccggagccgccctggcgacggtcgcgacgctggccacgctcagcctggtgttcccgaccttcacgaccagcaagccgggcccggagttctccacgacccagctcaccttcgccgcgctcgcctcactgatcctgtacggactgttcgtgacgacgcagaccgtgcgccaccgcgactacttcctgccgatcacccggcacggcgaggtgatcgacgcggagacccacgccgacgcgcccaccgcccgaaccgcaggcatcagcctcggactgctcggcctcgccctggtaggtgtcgtcggcctcgccaagggggtgtcgcccaccatcgaatccggcgtggaggcggccggaatgccgcagtccgtggtcggcgtgatcatcgcgctgctcgtgctgctccccgagaccatcgctgcgctgaggtccgcccgccgcgaccgggtacagaccagcctgaacctcgccctcggctcggcgatggccagcatcggcctgacgatccccgccgtcgccctcgcatccgtctggctctccggccccctggtgctcggcctcggctccacgcacatggtgctgctcctgctgaccgtggtagtgagctccctgaccgtggtaccgggccgcgccacaccgctccagggcggtgtgcacctggtggtgttcgccgcgtacttggagctggcggtcaatccg

SEQ ID NO: 6255 - DNA, 1302 bp, Streptomyces avermitilis
  CDS (1)..(1302)
atgcacgacgtacgcaccgtgaaggcgccctccatgctccggctcgcggccgcctcgctcgccgggacggccatcgagttctacgacttcttcgtctacgggaccgctgccgccctggtactggggccgctgttcttcccgacgttctcaccggtggcggggacgctcgcggcgttcgtcacgttcggggccggcttcgtggcacggccgctcggttcggtgctgttcgggcacatcggggaccggcgcgggcggcggccggtcctcgtcggctccctgctgctgaccggcgcggccaccgtcgctgtcggctgcgtaccgacgtacgacaggatcggtacggcagctcccgtgctcctcctcgtgctgcgtttcctccagggcctcgggctcggcggggagtggggcggggcggtgctgctgaccgcggagcacgcgcccgcggggcggcgtgggctgtggtcgagcttccctcagatcgggccgtccctggggttcgtgctggccaacggcggtctgctgatcctgtcggcgacgctgtccgaggaccagttcgcggcatgggggtggcgggtgccgttctgggcggcgggggtgctcgcggcggccgggctgtggctgcgcggttcgctggtggagagtcctcgattcctcgaaatcgacgaccacgcgcgcgtgccgttcgccgaggtcgtccgtggacactggcggctggtgctgctgacggccggcgcgctggcagtcgggtacgcggtgttctacgcggtgacgacctggtccctctcctacgcgaccgagcatctgggggtgagtcgtaccgtcatgctggcctgcatcatggccgcggtcgtggtgaagggctccctgacgccgctggccgcccacctgagcgaccgttacgggcggcggccgttgtgcctcgcgggttgtgcgggcgccgtgctgtggatgttcccgatggtcgcgctgctgtcgaccggcgagcctgtgctgatgttcctcggcatcctgggggcgttgatcgccttcatcacgatgttcgccgtgatcgccgcgtatctgccggagttgtacgagccccgggtgcgctgcacgggcgccgccgtgggctacaacctgggcggagtgctcggcggcgcgctcacgccgatcgtcgccacggcgctggcgcaacacgaggggcgggtgccctggggcgtcggcgcctatctgacggccatcgcgctgctcagcctgggctgcttcgcgctgcttccggagacgcggccggtgccgcgcatgacggcggtgcaggcgacggag

SEQ ID NO: 6256 - DNA, 1113 bp, Streptomyces avermitilis
  CDS (1)..(1113)
ttgaggaccgctgctcggtcccggtttatcacggtgcgtcaaacagctgaccgcccgtaccctccccccatgaccgcaccgtcgtaccctcccaagcccgtacggggcgaccgcatagccgtgatctcgccgtcctcggggctgccggggcttctcccgctcccccacgaactgggcctgaagcggctgcgcgaggagttcgggctggtgcccgtcgagtatccggcgacccgcaggatgggctccaccccgcgggagagggcggacgacatccacgcggcgttcgccgacccgaccgtcaaggcggtcatcgcgtcgatcggcggcgaggaccagatcaccgtgctgccgctgttggaccgggagttgatccgcgcgaacccgaagccgttcttcgggtacagcgacaacaccaacctgcacgcgttcctgtggaacacggggatcgtgagctatcacggcggcacggtgatggtcgagttcggccggcccggcgcgatggcctcgatctccgccgactccctgcgggccgccctcttcacctccggcgagtacgagctgaagcccgcccctcggtggggcgacgtcagccgggactgggcggatccggcgaccttcgagtcggagccggagacccggcccgggtacggctggtcctgggtgaacgccgaccgtgtggtcgagggacgcagttggggcggctgtctggagatcgtctcctggctgctgatggccgaccgtgagatctcgcgggacctcgctgtgtacgacggcggagtgctcttcctggagacctcggaggacatgcccagcggggaggaggtcttcatcatcctccggaacatgggcgagcgcggactgctgcgacgcttcccggcgttgctgatgggccgcgccaggacgtggtccttcgaacgccccaacagcccggaggaaggcgcacgttacgccgccgagcagcgcgagagcgtactgcgcgccctgaagatatatgcccccgacaccatggccgtcttcgatgtggatctcggacacacggatccccaggtggtcatcccgtacggcggtgtcgtacgggtcgacgggcccgcccggcgcatcaccgtgacgtac

SEQ ID NO: 6257 - DNA, 477 bp, Streptomyces avermitilis
  CDS (1)..(477)
gtgccccgcacccgaaccctcgccaacgccccgatcatgatcctcaacgggcccaacctgaacctcctcgggcagcgccagccggagatctacggctccgacacgctggccgacgtggaggccctgtgcgccaaggcggcggccgcgcacggcggtacggtggacttccggcagtccaaccacgagggcgagctggtggactggatccacgaggcacggctgcaccacgtcgggatcgtgatcaacccggccgcctactcgcacacctccgtggcgatcctggatgcgctcaacacctgtgacgggctgccggtggtggaggtccacatctccaacatccaccagcgcgaggagttccggcaccactcgtacgtctccctgcgcgccgacggggtgatcgcgggctgcggggtgcagggctacgcgttcgccgtggagcgggtcgcggcgctggcggagacgggccgggcggacgcc

SEQ ID NO: 6258 - DNA, 774 bp, Streptomyces avermitilis
  CDS (1)..(774)
atgagcaccacgtccacggacgggtccccggtcctgcgcatggagtccgtccgcaagaccttcggcggttccgtcgtgctgcgggacgtcgatctggaggtcgccccgcacacggtgaccgctctgatcggcgcgtcggggtccggcaagtcgacgctgctgcgctgcgccaatctgctggaggagatcgacgacggcgcgatctggctggacgacgaggagatcaccgatccgcgtgccgaccaggacgcggtgcgccgccggatcggcgtggtcttccaggcgtacaacctctttccgcacatgaccgtgctggagaacatcaccctcgcgccgcgccgggtgcacggcgtggggcgcgcggcggccgaggagcacgcgcgcgagctgctcgaccggctcgggctgggcgccaaggcgaccgagtacccggaccggctcagcggcggccagcagcagcgcgccgcgatcgtccgggccctggccgtacgaccccggctgctgctcctcgacgagatcaccgccgcgctcgacccggagctcgtgggagaggtcctggccgtcgtccgggacctgaaggacgacgggatgaccatggtgctggccacgcacgagatgggcttcgcccgcgaggtcgccgaccaggtgtgcttcctggacggcggtgtggtgctggagcgcggcacggccgagcaggtgttcggcgacccgcagcaggagcgcacgcggcgctttctgcaccggatcgtggaggcggggcggcttcaggagggc

SEQ ID NO: 6259 - DNA, 951 bp, Streptomyces avermitilis
  CDS (1)..(951)
gtggctctccgaggccgtcgacgccccggtgctcaagtgaccgtcaccaaggaggagtccggccaggaggacgcggacgacaggggtgacatgtccggcgggggcgacgcgtacgtcccctcgccacggcgcatcgaacgcgagcgctacaagcgcacccgcgcccgccgcgccaccgcgatcgccgcgctctcgaccctgatcaccggcgtcgtcctctacttcgtcgttgtcggcgcacccggctggccacgcaccaaggaaaccttcttcgacgcgcagtacgcgcgcgaggcgctccccaaggtcctcgaagggctgtggctcaacgtccggctgctgctggtgtgcggcgccgccgtgctcgtcctgggcatgctcatcgccatcgcccgcaccctgcgcggcccggtgttcttcccgctgcgggcgctcgccgccgcgtacaccgacttcttccgcgggctcccactgatcatcaacctgatgatcgtggtcctgggcgtccccgcactgcggctgcaaggggtcaccgtggacccggtgctcctcggcggtacggcgctcacgctgacgtactcggcgtacgtcgccgaggtgttccgcgccggcatcgagtccgtccacccctcgcagcgcgccgcggcccgctcgctcgggctcaccaaccggcaggcgctgcgccacgtggtgctcccccaggccgtacgccgccaggtgccgccgctgctcaacgacctggtgtccctccagaaggacaccgggctcgtctcgatcggtggcgcggtggacgcggtgcgggccgccgacatcatcgtgggccgcagcctcaactacacgccgtacatcgtcgcgggactgctcttcgtcgcgctgaccattccgatgacccgcttcacggactgggtcacggcccggatggaccggcagcgggcgcagggaggaacccta

SEQ ID NO: 6260 - DNA, 936 bp, Streptomyces avermitilis
  CDS (1)..(936)
atgcggacagttgcccccgtgacctcgacaaacaggacgccgcactgccactctcccgccatgcatctcgcccaacgcgccctgcgtcgcaccgcgtccgccgccactgtcgccctgctcgccgtcgccgtgggctgtgccccgcagccggaggacaaagccacggcctccggaacgagcgcggagagctgcgcgaagagcacgttgcagaccaagacctccggcaagctgacgatcgcgaccgacgagcccgcgtacgagccctggttcaaggacgacaagcccgccagcggcaagggcttcgagtctgcggtcgcgtacgccgtggcgaagcagctcggctacgccaaggggaacgtggtgtggcagagcgtccccttcaacaaggccttcgcacccggtgagaagacgttcgacttcgacatcaaccaggtctcgatcagcaccgagcgcaagaaggccgtggacttctcctccggctactacgacgtgcgccaggccgtcatcgcactgaagagctccaaggccgccaaggcgaagagcgtcgcggacctgaagggcctgaagctgggcgctcaggtcggcaccacgagcctcgactacatcaacgacgtcgtgaagccgacccaggagccggccgcgtacgccaagaacgaccaggccaagtccgcgctgaagaacggtcaggtcgacgccatcgtggtcgacctgccgacggcgttctacatcaccgccgccgaggtgaccgacgcgaagatcgtcgggcagttcgagaaccagggcggcacgcccgagcagttcggactcgtcctcgacaagggcagcgccctcacctcgtgcgtgacctccgcggtggacgccctgcgcaaggacggcacgctggcgaagatcgagaagcagtggctctccgaggccgtcgacgccccggtgctcaag

SEQ ID NO: 6261 - DNA, 654 bp, Streptomyces avermitilis
  CDS (1)..(654)
atgacgtacagcggagcggtgaaggtcggcggccctgccgatgtgcacgagctgcaggacctgatgatcacgaagatcgcggtgggtccgatggacaacaacgcctatctgctgcgctgccgggccaccgacgagcagttgctgatcgacgcggccaacgaggccgggacgctgctcgggatgatcggtgacgacggcatcgcgtccgtcgtcaccacccatcagcacggcgaccactggcaggcgctcgccgaggtcgtggcggtcacgcgcgcgcgtacgtacgcgggccgggacgacgccgaaggcatccccgtcccgacggacgtcccggtcgacgacggcgacaccatccgagtggggcgcgtggagctgaccgcacgccatctggtgggccacacaccgggctcgatcgccctcgtctacgacgacccgcacgggcaccctcatgtgttcaccggggactgtctcttcccgggcggtgtgggcaacacacgtaaggacccgaaggccttcgccagcctcatccgcgacgtcgagacgaagatcttcgacgtgctcccggacgagtcgtgggtctaccccggccacggcaacgacaccacgctgggcgcggagcggccgcacctgccggagtggcacgcgcggggctgg

SEQ ID NO: 6262 - DNA, 783 bp, Streptomyces avermitilis
  CDS (1)..(783)
atgcccgacgccactctcgaccatatagcacgcgcattcgatttacgggtccgctcagccaccttcacccaaacgtgtggcgccgctatcgtcggccccatgaacgatcatgtgcgcgacctggcgtctgtacgtgacgcgaccgaacggctgctcaccgcagccaccaaactggacaacgcccgtgtgaccgagccgtcacggctgcccggctggagccgcggtcacgtcctcgcccatctcgcccgcaacgcggacgcgctcacgaacgtcctcgccggacgtccgatgtacgcctccgccgatgtccgggacgccgacatcgagcgggacgcaccgcgccccctggacgtccaggtcaccgatgtacgcgagagcggggcccgcttccaggacgaggcggccgtacccgcggactggtcccgcacggtggagctgcggaacggggtcaccgattccgcgtcccgggtgccgttccggcggtgggtggaggtcgagctgcaccatgtggacctgggcatcgggtacgagctcgaagatcttccggaggggttcacccagcgcgagatcaacttcctcgccgaacggttccgggggcaccccgacgtacccgccctcctggtcaagcaggacgacggccgcatgatctcctccggccgccgcgagggagaaccgctcgtcgtcaccggccgtcaggccgatctgctcggctggctcgccggtcgtcgcgacggatcggcactgaccgtcgacggcggaccactccccgccctccccccgcta

SEQ ID NO: 6263 - DNA, 3027 bp, Streptomyces avermitilis
  CDS (1)..(3027)
gtggccgaccgtctcatcgtccgtggcgcgcgcgagcacaacctcaagaatgtctcgctcgacctgccacgcgactcgctcatcgtcttcacgggcctgtctgggtcgggcaagtcctcgctggccttcgacacgatcttcgccgaggggcagcgccgctacgtcgagtcgctctcgtcgtacgcccggcagttcctcggccagatggacaagccggacgtggacttcatcgagggcctctccccggcggtctccatcgaccagaagtcgacctcgcgcaacccgcgctcgacggtcggcaccatcacagaggtttacgactatctgcgtctgctgttcgcgcgcatcggcaagccgcactgccccgagtgcggccgcccgatctcgcgccagtcgccgcaggccatcgtcgacaaggtcctggagctgccggagggcagccgcttccaggtcctgtcgcccctggtgcgcgaacgcaagggagagttcgtcgacctgttcgccgatctccagaccaagggatacagccgtgcccgggtcgacggccagacgatccagctcagcgacccgcccacgctgaagaagcaggagaagcacaccatcgaggtggtcatcgaccgcctcacggtgaaggaaggcgccaagcgccgcctcacggactccgtggagaccgccctcggcctggccggtggcatggtcgtgctcgacttcgtcgacctccccgaggacgaccccgagcgcgagcgcatgtactcggagcacctgtactgcccgtacgacgacctgtccttcgaggagctggagccccgctccttctccttcaactcgccgttcggcgcctgccccgactgctccggcatcggtacgcgcatggaggtcgacgccgagctgatcgtcccggacgaggagaagtccctcgacgagggcgccatccacccctggtcgcacggacacaccaaggactacttcggccggctgatcggggccctcgcggacgcgttgggattccggaccgacatccccttcgccggtctcccgcagcgcgccaagaaggcactgctttacggccacaagacccagatcgaggtccgctaccgcaaccggtacgggcgcgagcgtgtgtacaccacgcccttcgaaggggccgtccccttcgtcaagcggcggcacagcgaggccgagagcgacgcgagccgcgagcgcttcgagggctatatgcgcgaggtcccctgtcccacctgccagggcacgcgtctgaagccgctcgtcctcgcggtcacggtcatggagaagtcgatcgccgaggtcgcggcgatgtccatcagcgactgcgcggacttcctgggcaagctgaagctcaacgcccgcgacaagaagatcgccgaacgcgtcctgaaggaggtcaacgagcggctgcgcttcctggtcgacgtcggcctcgactacctgtcgctgaaccgcgcggccggcaccctgtccggcggcgaggcccagcgcatccgcctggccacgcagatcggctccggcctcgtcggcgtcctgtacgtcctcgacgagccgtccatcggtctgcaccagcgcgacaaccaccggctgatcgagaccctggtccggctgcgcgacatgggcaacacgctcatcgtcgtggagcacgacgaggacaccatcaaggtcgccgactggatcgtcgacatcggccccggtgcgggcgagcacggcggcaaggtcgtgcacagtggctccctgaaggagctgctggccaacgccgagtcgcagaccggccagtacctgtccggcaagaagtccatccccctgcccgacatccgacgcccgcgcgacccgtcccggcagctcacggtgcacggcgcccgtgagaacaacctccaggacatcgacgtgtcgttcccgctgggcgtcctcactgccgtcacgggcgtgtccggctccggcaagtcgacgctggtcaacgacatcctgtacacacacctggcccgcgagctgaacggcgcgaggagcgtccccggccgacacacgcgcgtggacggcgacgacctcgtcgacaaggtggtgcacgtcgaccagtcgcccatcggccgcaccccccggtccaacccggccacgtacaccggagtcttcgaccacgtccgcaagctgttcgcggagacgaccgaggcgaaggtgcgcggctatctgcccggacgcttctccttcaacgtcaagggcggtcgctgtgagaactgctccggtgacggcaccatcaagatcgagatgaacttcctgccggacgtgtacgtcccgtgcgaggtctgccacggagcgcgctacaaccgggagaccctggaggtccactacaagggcaagtccatcgccgacgtcctgaacatgccgatcgaggaggccatgcacttcttcgaggccgtcccggcgatcgcccgccatctgaacacgctgaacgacgtcggcctcggctacgtccgcctcggccagtccgcgacgaccctgtccggcggcgaggcgcagcgcgtgaagctggccagcgagctccagcggaggtccaccggaagaacggtgtacgtcctcgacgagccgaccaccggtctccacttcgaggacatcagcaagctcctcgtcgtgctctccgggctggtcgacaagggcaacacggtcatcgtcatcgagcacaacctcgacgtcatcaagaccgcggactgggtcgtcgacatgggccccgagggcggcgccggcggcggtctcgtcgtcgccgagggcacgccggaggaggtcgccggggtgccgacgagccacaccggcaagttcctgcgcgagattctcgacgccgatcgcatcagcgacgcggcgtccgtgaaggccccgcgcaagacggccgccaggaagacggcagcggccaagtcgacgacgaagaagacggcgacggtcaggaccaccaacaacacggccaccaagaaggcggccgccgtgacgaagaagaccgcccccgcgaagaagaccacgcgggcgcgcaaggcc

SEQ ID NO: 6264 - DNA, 909 bp, Streptomyces avermitilis
  CDS (1)..(909)
gtgatcgtcgtcgccggtgaggccctgatcgacctggtaccgcagggcgcgggcgcgctcgccggcctcaagccggcactcggcggcggcccctacaacacggccgtcgccctcggccggctcggctcccccacggccttctgctcccgcacctcgcgggacgccttcggtgaggccctgctcgacgggctgcgcacagcgggcgtcgatgtgtcggcggtgcagcgcggggccgagccgaccaccctcgcggtcgccacgatcgacgagcacggctcggccgcgtactccttctacgtcgacggcacggcggaccggcagttcgcggcaccggaccggctgccgggcgccacgcgggcggtgtccttcggtacctgctcactggtcctggagccgggcgcgagcgcctacgaggaactgctgcggagcgccgccgcgcagggcctgttcaccacgctcgatccgaacatccgggcgggactgatccccgacccggacgcctatcgggcgcgtttcaagagctggctggcgtcggtgacgctgctcaagctctccgaggacgacgccacgtggctgggcggcagcccgcgcgagtggctggcctcgggcccctcggccgtggtgctcacccggggcggcgacggactgaccgtcttcacccgggacggcgcggagcactccgtgccgggtgaaccggtcgacgtggtggacacgatcggtgccggcgacaccgtcaacgcggccctgctgcacggcctggccgcccgcgacgccctgtctccggaagggctcgcgggcttggacgcggagggctggaccgaactgctccggttcgccgcccgggcggcggcgatcacctgctcacgggcgggtgcggaacctccgtacgcctctgaactgggcgcgttc

SEQ ID NO: 6265 - DNA, 1047 bp, Streptomyces avermitilis
  CDS (1)..(1047)
atggcgaccatggccgacgtggcgcgaagcgcgggggtgtccgtggccaccgtctcgcacgtgctgaacgacacccgcccggtactgccccacacccggcaggcggtcctggacgccgtcgacgaactgggctacacgccgaacaccctcgcccgctccctcgtcacctcgcgcaccaggtcgatcggactcgcggtgtcggcgatcagcaacccgtacttcacggagatcctccagggcgtcgaggcaggtgcgctggagcacgggtacagcctgctcatcgccgatccgcacgacgacccgaagcacgagcagcgggtcgtccggctcctgcacgaacgacgcgtggacggcatgatcgtcgcgccgtcggcggacccgggcgacctcgtcgcctacctcgggcggcacgacgtaccgaccgtgttcctcgaccggctggtcgacgtcccctcggacggcaccgcccgcttcgaccaggtcggcgccgagaacgccgagccgatggcccggctggtcacgcatctcgccgacctcggccaccggcgcatcggtctggtcgccgggctgcccgggctgagcaccacgaacgagcggctctccggttaccggcacggcctggcggccgccgggctcccccacgacgagcggctcgtggcgcggggcgactccgaggcggcgggcgccgagcgcgccaccaccgccctgctgtcgctcgcggctccccccacggcgctcgtcaccgccaacaacgcgatgaccatcggcgccctgcgcgcgctgcgcgggcgcggcctgtcggtgccggacgatctggcgctgtgctgcttcgacgacttcgcctgggcggacctgttcgcaccccggctcaccgtgatctcccagcccagcaaggagatcggggcacaggccgtacgcctgctcctggaccggctggccgcgccggaccggccctcccgcaccctgcggttgcccagcacgttcgtccaccgcacctcgtgcggctgccccgaccacccccacagctccgagaagggacccgtctcg

SEQ ID NO: 6266 - DNA, 423 bp, Streptomyces avermitilis
  CDS (1)..(423)
atgcccggccgtcccgccgcgagccgtcgtaccgtccttcgaggagcggcgctcaccccggtcgccgggctcggcctcgcggcctgttcgtcgggagcggacggcggttggccggccacgcccaccgcgccggtcgagctgggcgcggagagcgagatccccaagggcgccgcgaagctgtaccgggacgcgaacgtcgtggtgagccgggccggggacgggtccctgaaggcgtacagcacgatctgcacgcacgcggggtgcgccatcaacaagctggcggggacgaccctcacctgcccctgtcacggcagcgagttcgatgccacgaacggcaaggtgctgcaggccccggcgaccgagccgctgcacgagctgtccgtcgaggccaggaacggcaagatcgtcgcgggctcgggcgcc

SEQ ID NO: 6267 - DNA, 945 bp, Streptomyces avermitilis
  CDS (1)..(945)
atgcggcacggcacacagcacgcggacctcgccacggacgagttggagacggcgctgcgcggcggacccttccatgtggcgctgcgcaccgcgatcgccgcccgcgggctgcccttgcagcgcgtgcagcaccatctgtcgcggtacggggtcaaggtcggcgtgacgagcctgagctactggcagcagggcgcccggcggccgcagcgccccgagtcgctgcgggccgtacgcgcgctggaggagatcctccagctgccggacgagtcgctgatccggctgctcgccacggccgacgagcaacccggcgccgaccgtcccgggagccgttcgtaccgctccctggtggaggcttcgggggtgctggagcgactgttcgccgagttggggtcgccgctcgacggcggactgcacaccctcggccaccacgaacgcgtacggatcggggcccaccgcgagctgctgggccgcgattcgcaccacatagtgcgtgcgcacaaggatggcgtggaccgctatgtggccgtccaccacggtgacccggggtgcgctccggagcggatggcggtgcgcgcgctggagaactgccgtacggggcgggtgcgccggcaccccgagacgggggtgctggtggccgagctgctcttcgacacccggctgcgctcaggagatacgttcctcttccgctacggcttcgacgacggcacggccggcccgtccagcgagtacgttcgcgggttcggcttccccggcgggcagtacgcgcttcaggtgcggttcgacgaagcggcgctgccggtgcgctgccaccggttcacccagcactcggccgccgccccgcgcagcggccgccaggagctgtcgctgagcggacaacaccgctcggtccacctggtcgagccgagggtgcggtcggggatcgtggggatcgggtgggactgggag

SEQ ID NO: 6268 - DNA, 2043 bp, Streptomyces avermitilis
  CDS (1)..(2043)
atggccgacccctccagctaccgccccaagccgggagagatcccggactcacccggggtctacaaattccgcgacgagcaccaccgggtgatctacgtcgggaaggcgaagagcctgcgccagcgcctggcgagctacttccaggacctggcgggcctccacccgcgcacccgcaccatggtcaccacagcggcgtccgtggagtggacggtggtgtccacggaggtcgaggcgctgcagctggagtactcctggatcaaggagtacgacccccggttcaacgtcaagtaccgcgacgacaagagctacccgtacctcgccgtgacgatgaacgaggagttcccgcgggtgcaggtgatgcgcggccacaagcgcaagggcgtgcggtacttcgggccgtacgggcacgcgtgggcgatccgcgacaccgtcgacctgctgctgcgcgtcttccccgtccgtacctgctcggccggcgtcttcaagaacgccgcccgcaccggccgcccctgcctcctcggctacatcggcaagtgctcggcgccctgcgtggagcgcgtctccgccgaggagcaccgtgaactcgccgaggagttctgcgacttcatggcaggccgcacgggtacgtacatccgccgcctggagcggcagatgacggacgcggccgaggagatggagtacgagaaggccgctcggctgcgcgacgacatcggggccctgaagaaggccatggagaagaacgcggtcgtgctcgccgacgcgaccgacgcggacctgatagcggtcgccgaggacgagctggaagcggccgtgcagatcttccacgtacgcggcggacgcgtacgcggccagcgcggctgggtcaccgacaaggtcgaggccgtcaccaccgcggatctcgtcgagcacgccctccagcagctctacggcgaggagaccggcgactccgtgcccaaggaggttctcgtccccgcgctgcccgaccccgtggagcccgtccaggaatggctcaccgggcgccgcggatcgatcgtgtcgctgcgcattccgcagcgcggcgacaagaagtccctgatggagaccgtgcagcgcaacgcccagcagtcgctcgcgctgcacaagaccaagcgcgcctccgacctgaccacccgctcgcgcgccctggaggagatcgccgaggcgctcgacctggacagcgcgcccctcaggatcgagtgctacgacatctcgcatctccagggcgacgacgtcgtggcctccatggtggtcttcgaggacggactccagcgcaagagcgagtaccggcgcttccagatcaagagcttcgaaggccaggacgacgtccgctccatgcacgaggtgatcacccgccgcttcaggcgctacctctccgagaaggagaggaccggcgagtgggccgacggtgacctgaaggacggtgagctgaaggacgacgagggccgccccaagcgcttcgcctacccgccgcagctggtcgtcgtcgacggcggccagccccaggtcgcggccgccaagagggcgctcgacgagctcggcatcgacgacatcgccgtctgcggcctcgccaagcgtctggaggaggtctggctgccggacgacggcgacccggtcgtcctgccccgcaccagcgagggcctctacctgctccagcgcgtccgtgacgaggcgcaccgcttcgcgatcacctaccagcgcaccaaacgcgccaagcgtttccgggcgagccccctggatgacgtggcgggtctcggcgagactcgcaaacaggcgctgatcaagcatttcggctcagtgaagaagctgcgatccgcgaccatcgaccagatctgtgaggttccgggcatcggccgcaagacggccgagacgatcgccgtggccttcgcccaggcggccccggccgtccccgccgtgaacacggcgactggagagatcatggaagacgaggaacccgggacgacggcgggttcctcccaggagcccgtgtccgcgggcacctcggacgagcgacgggggcaggagaca

SEQ ID NO: 6269 - DNA, 1011 bp, Streptomyces avermitilis
  CDS (1)..(1011)
atgaccgagcacgaagagcgccaagaagaacgctcagcgcagggccaggaagcgcacaaggaatcaggcgaggatcaggccccgcagcaagcggcacaggaaaacggagcacaggtgagtacgggcatcgaaacagccggggtccccgacgcggtcatccccgagctggtgatcatctccggcatgtccggagccggccggtcgacggccgccaagtgtctcgaggacctcggctggttcgtcgtcgacaacctcccgcccgcgctgatccccaccatggtggagctcggcgcccgctcccagggcaacgtggccaggatcgcggtcgtcgtcgacgtacgcggccgacgcttcttcgacaacctccgcgagtccctcgccgacctggagtcgaagaacgtcacccggcggatcgtcttcctggagtcctccgacgaggccctggtccgccgcttcgagtccgtgcgccgcccgcacccccttcagggcgacggccgcatcgtcgacggcatcgacgccgagcgcgagctcctgcgcgagctgcgcggcgacgccgacctggtgatcgacacctccagcctgaacgtgcacgagctgcgcgccaagatggacgcccagttcgcgggagacgaggagcccgagctgcgggccaccgtcatgtccttcggcttcaagtacggcctcccggtcgacgccgacctggtcgtggacatgcggttcctgcccaacccgcactgggtcccggagctgcgccccttcaccggcctcaacgaggaggtctcggcgtacgtcttcaaccagcccggcgccaaggagttcctcgaccgctacgccgagctgctccggctcatcgccgccggctaccggcgcgagggcaagcgctatgtgaccatcgccgtcggctgcaccggtggcaagcaccgctcggtcgccacgtccgagaagctcgccgcccggctggccgccgagggagtggagacggtcgtcgtccaccgggacatgggccgagaa

SEQ ID NO: 6270 - DNA, 1065 bp, Streptomyces avermitilis
  CDS (1)..(1065)
atgaccggacgtgctctgcggctgagcaggctgcgccgcatggcccccgaggagcgcggcggcaaggcccccgaggcgcgcggcggcaagccgcgccgccggggcgcccagcccaaggtcgtcgccctcggcggcggcatgggcctgtccgcctcgctcgccgccctgcgccggatcaccggcgacctcaccgccgtcgtcacggtggccgacgacggcggctccagcgggcgcctgcgcgacgagctgggcgtgctcccgcccggcgacctgcgcaaggccctcgcggcgctgtgcggcgacgacgactggggccagacctgggcccgcgtcatccagcaccgcttccagtcccagggagacctgcacgagcacgccgtcggcaatctgctgatcgtcgccctgtgggagcagctcggggatcacgtccaggccctcgacctggtcggcaagctgctgggcgcgcacggccgggtgctgcccatgtccgccgtgcccctggagctccaggcgctggtcaagggacatgacccggaccggcccgaggacatcgacaccgtccggggccaggcgaccgtcgcgctcacgcccggcgaggtgcagtccgtgcacgtcgtgccgcacgacccgccggccgtgcccgaggccgtcgcggcggtcctcgacgcggactgggtggtgctcggacccggctcctggttctcctcggtgatcccgcacctcctggtgcccgaactcctggacgccctctcgcagacgaaggcgcgccgggtactctcgctgaacctcgccccgcagcccggagaaaccgatggcttctccccgcagcgtcatttggaggttttgggacgacacgcccctaaactcgccctggacgtggtgctggccgacgaggccgccgtgcccgaccgagagtcgctcaccgatgccgccaagcggttcggggcagcggtcgagctggcgccggtggcccggaccgacggttctcctcggcacgacccggagctgttggccgccgcgtacgaccgtatttttcggatgcatggaaggatcggcccatggcga

SEQ ID NO: 6271 - DNA, 987 bp, Streptomyces avermitilis
  CDS (1)..(987)
atggcgatgacggcagcggtgaaggacgagatttcccggcttcccgtcacccggacctgctgcagaaaggcagaggtctcggcgatcctgcggtttgcgggcggcctgcacctggtgagcggccggatcgtgatcgaggcggagctggacaccgcgatggcggcccgccgcctcaaacgggacatcctggagatcttcggccacagctccgaactgatcgtgatggcgcccggcggactgcgccgcggctcccgctatgtcgtccgcgtggtcgcgggcggcgaccagctggcccgccagaccggcctcgtcgacggccgtggccgtccgatccgcgggctgcccccgcaggtggtctcgggggccacctgcgacgccgaggcggcctggcgcggcgcgttcctggcccacggctcgctgaccgagcccggccgctcctcctccctggaggtgacctgcccgggcccggaggccgccctcgccctcgtcggcgccgcccgccgcctgtcgatcgcggcgaaggcccgcgaggtgcggggcgtggaccgcgtggtcgtacgggacggtgacgccatcggcgccctcctcacccgcctcggcgcgcacgagtccgtgctggcctgggaggagcggcggatgcgccgcgaggtccgcgccacggcgaaccgtctcgccaacttcgacgacgccaacctgcgccgctcggcccgcgccgccgtcgccgccggtgcccgggtgcagcgcgcgctggagatcctcgccgacgaggtgccggagcacctcgcggccgcagggcggctgcgcatggagcacaaacaggcctccctggaggagctgggcgcgctcgccgacccgccgttgaccaaggacgccgtcgccggccgtatccgccgtctgctggccatggccgacaagcgcgcgcaggacctcggcatcccgggcacggagtccaacctcaccgaggagatggcagacaacctcgcaggc

SEQ ID NO: 6272 - DNA, 2952 bp, Streptomyces avermitilis
  CDS (1)..(2952)
atgagacgaagagcgagatcgatcctcgctgccggcgcgctgctgctcgggggagcgggcatggcgcccatcgcccaggcggacagcggcagttcgcccaagccggatgcggacgccgtgaaggtgttccgcgccgaggtcacgaagcagcaggtacccctgctgctcgcggccgggcaggacggccatgaactcggtgcacaggcgccggagaagggcacggccacggtcgaggtctacctcaccgacaagcaggcccggaagctggagaagcagggtgtggagctcaccgagcacacactttcggccaaggccgaggcgcgtgtcgaggacgcggcgcagggcgtgttccgcccgtacagcggaaagggcggtctcgaggaggagatcgtcaggacgggcgcggcccaccccgacctcaccaaggtcgtctccatcggcaagaccctgaacggccaggacatcctcgcgctcaaactgaccaagggcgcgaagaagaccaaggacggcgccaagccctccgcgctgtacatgtccaaccagcacgcgcgcgagtggatcacgcccgagatgacccggcggctgatgcactactacttggacaactactccaaggacaagcgcatcaagaagatcgtcgactcgacggaactgtggttcgtcctctcggccaaccccgacggctacgactacacgttccagaactccgacacgcgtctgtggcgcaagaacctgcgggacgtcaacggcgacggcacgatcagcaccggcgacggcgtcgacctcaaccgcaacttctcctacaagtggggctacgacgacgagggttcgtcccccaaccccaccagccagacctaccgcggcgcgagccccggctccgagcccgagaccaaggccctggacgccttcgagaagcgcatcggcttcacgtacggcatcaactaccactccgccgccgaactgctcctctacggagtggactggcaggtggcgacgccgagcccggacgacatcgcctacaagtccctcgccggtacgccggacaactccgcggtcccgggctaccgcccgcaggtttcctcggagctgtacaccaccaacggcgaggcggacggccacgcctcgaacgtcaacggcatggcgatgttcacgcccgagatgtcgacgtgccagaccgcgtcggacatcgacccgaacgacacctggaacgcggccgactgccagtcggtcttcaacttcccggacgacgagaagctgatcaagcaggagttcgagaagaacatcccgttcgcgctctccgtcgccgagaccgccgcccatcccgacaagccgtcctccacggtgggcatcgacgcgcccgacttcaccccggcgacgttctccacgtcgtactcccgcggcgccgaccaggaggtctccgtcgtcgtacgcaagtccgtgcgcgacaaggagctcaagtaccgcgtcaacgccggccgcaccgaggacatggcgctcaaggcctggaagggcggcgagacgtacgggggcgacgacaacctgtacttcgacgagtaccgcaccaaggtccaggacggcgagccgggcgacaaggtcgaggtctggttcaccggcgagaccaggagcggcaagaagacgtccagtgcgcacttcacgtacaccgtggccgagcggccgaaggcggacaccctcgtggtcgccgaggagggcgcgaccgccacacaggcccagaagtacgtcgacgccctgaaggccaacggccacaaggcgctcgtctgggacgtcgccacccagggcgcgcccgacgcgctcggcgtgctcgaccacttcaagaccgtcgtccactacacgggcgcggcccggccgggcaaccccacccagctccagctgcgcgccttcctcaacgagggcggcaagctgatcgaggcgggcgagctggcgggcggcagcgtcgacctcggcgacggcaccctgtcgaacgacttcagccagtactacctgggcgcctattcgcgtacgtcgactccgggggccaacggcttcaccggctccggcaagctcgacgggtccacgggcgccctgggcgacgcgccgggcaacccgctgaacgcggcgggcacctacggcgtcacctcggacgagctgtccgtcgccacgtatccgcagttcgcgagcgccggtgcgggccagttcgccgggaccgtcaacccgtacggaccgcacgggggctcctccatggcggccgccgtccacaccgacgacgcctacaagcgactcacccgcaccatcgatctcaccggggtgggcgcggccgacaagccgaccctgcgcacccagctcctgtgggacacggagcccggctacgaccacgcggtgctggagatccacaccaccggcgccgacgactggacgaccctccccgaggcgggcggcgccaccggagccaccgtcccggcggactgtgaggcagggttcctcgtcgccgagcacccctggctcaagcactacctgaccgtggcggccggcggctgcaccgcgaccggcaccagcggctcctggaacagcttcaccggcgcctccaccggatggcagcaggtcggcttcgacctgagcgcgtacgccggcaagtcggtcgaggtctcgctgagctacatcaccgacccgagctccggcggtcacggtgtcctcgccgacgacgcctccctcgtcgtcggtggcaccgccacccaggcggagggcttcgagacctcgctcggggcctggagcgtgcccggaccgcccgcgggcagcccggccgtcctcaaggactgggcgcgctccggagcgctcttcaagacctacggagcggtcaccacgcgtgacaccgtgctgttcggcttcggcctggagcacgtcaccgcggcggccgaccgtacggcgctgatcgggaaggcgctgacggcgctgggtggc

SEQ ID NO: 6273 - DNA, 1005 bp, Streptomyces avermitilis
  CDS (1)..(1005)
gtgacgatccgcgtaggcatcaacggctttggccgcatcggtcgtaactacttccgcgcgctgctggagcagggtgcagacatcgagatcgtggctgtcaacgacctgggtgacaccgcgaccaccgctcacctgctgaagtacgacacgattctgggccgtctcaaggccgaggtgacgcacaccgccgacacgatcaccgtggacggcaagaccatcaaggtgttctccgagcgcaaccccgccgacatcccgtggggcgagctgaacgtcgacatcgtcatcgagtcgaccggcatcttcaccaagaaggccgacgccgagaagcacatcgccggcggcgccaagaaggtcctcatctcggctccggcctccgacgaggacatcaccatcgtcctcggcgtcaacgaggacaagtacgacccggcgaagcacaacgtcatctcgaacgcgtcctgcaccaccaactgtgtggcgccgatggccaaggttctcgacgagaacttcggcatcgtcaagggcctgatgaccaccatccacgcgtacacgaacgaccagcgcatccttgacttcccgcacaaggacctgcgccgcgcccgtgccgccgccgagaacatcatcccgaccaccacgggtgccgccaaggccaccgcgctggtcctcccgcagctcaagggcaagatggacggcatctccatgcgcgtcccggtccccacgggctcggccaccgacctggtcgtcgaggtctcccgtgaggtcaccaaggacgaggtcaacgccgcgttcaagaaggccgccgagggcgagctgcagggctacctgtcgtacaccgaggacccgatcgtctcctcggacatcgtcggcgacccgtcgtcctgcaccttcgactcggccatgaccatggtcatggagggcacctcggtgaagatcctcggctggtacgacaacgagtggggctactccaaccgcctcgtcgacctcacggtcttcgtcggcaaccagctc

SEQ ID NO: 6274 - DNA, 1209 bp, Streptomyces avermitilis
  CDS (1)..(1209)
atgaagacgatcgacgaacttctcgccgaaggcgtggacggcaagcgggtcttcgtccgcgccgacctgaacgtgccgctggccgacggcctcatcaccgacgacggccgcatccgcgccgtcctgccgacggtcaaggcgctggccgaggccggtgccaaggtggtcgtcgcctcgcacctgggccgccccaagggcgccccggacccggccttctccctgctgcccgcggcggagcggctcggtgaactcctcggcgcgcccgtcgcgttcgcccaggacaccgtgggccccgccgcccacgacgccgtgaacggcctccagcccggccaggtagcggtcatcgagaacctgcgcttcaacgcgggcgagacgtccaaggacgacgccgagcgcggcgcgttcgccgaccggctggcggccctggccgacatctacgtgggcgacggtttcggcgccgtgcaccgcaagcacgcctccgtgtacgacctcccggcacgcctgccgcactacgcgggctacctcatcgccaccgaggtcaacgtcctgaagaagctcaccgaggacgtcaagcgcccctacgtggtcgcactcggcggcgccaaggtctccgacaagctcgccgtcatcgaccagctgctcggcaaggccgaccgcctgctgatcggcggcggcatggcctacaccttcctcaaggccaagggctacgaggtcggcatctccctcctccaggaggaccagatcccgaccgtcaaggagtacatggagcgcgcggagaagaacggcgtcgagctggtcctccccgtcgacgtgctggtctccacggagttcccggacctcaagacgaaggccccggccaaccccaccaccgtcgccgcggacgccatcccggccgaccaggagggtctcgacatcggtcctgagacccgcaagctgtacgcatcgaagctcgccgacgcggccaccgtcttctggaacggccccatgggcgtcttcgagcaccccgactacgccgagggcaccaaggcggtcgcccaggccctcgtcgactcccaggccttcacggtcgtcggcggtggcgactccgccgcggccgtccgcatcctgggcttcgacgagacggcattcggccacatctcgaccggcggcggcgcctccctcgaatacctcgagggcaagacgctccccggccttgccgcactggaggac

SEQ ID NO: 6275 - DNA, 774 bp, Streptomyces avermitilis
  CDS (1)..(774)
gtgacttcgcgcatgccgctgatggcgggcaactggaagatgaacctcaaccacctcgaggccatcgcccacgtccagaagctcgccttcgccctggccgacaaggactacgaggcctgcgaggtcgccgtcctgccgccctacaccgacctgcgctccgtgcagaccctggtcgacggcgacaagctcaagatcaagtacggcgcccaggacgtctcggcgcacgactccggcgcctacaccggcgagatctccggctcgatgctggccaagctcaagtgcacgtacgtggcggtcggccactccgagcgccggcagtaccaccacgagaccgacgagatcgtcaacgccaaggtcaaggcctccttcaggcacggcctgatcccgatcctgtgcgtcggcgaggagctggaggtgcgcgaggcgggcaaccacgtcacgcacacgctcacccaggtcgagggcggcctcaaggacgtcccggccgagcaggccgagaccatcgtgatcgcgtacgagcccgtctgggccatcggcaccggcaaggtctgcggcgccgacgacgcccaggaagtctgcgcggccatccgcgccaagctcgccgagctgtactcccaggagctggccgaccaggtccgcatccagtacggcggctccgtgaagtccgggaacgtcgcggagatcatggcgaagcccgacatcgacggcgccctggtcggcggtgcctcgctcgacgccgacgagttcgtcaagatcgcgcgcttccgcgaccag

SEQ ID NO: 6276 - DNA, 336 bp, Streptomyces avermitilis
  CDS (1)..(336)
ttgcgggggccgagggctctgaaagtgagcacgcacagagctcaccggaaaagcttcggcccccgttgtcgtccatccagttccgaggaagttggtccagccgtggttttggggttctcgatcgccctgatcgtcttcagcctgctgctgatgctgctggtgctgatgcacaaggggaagggcggcggcctctccgacatgttcggtggcggcatgcagtcgtccgtcggcggctcctcggtcgccgagcgcaacctcgaccggatcaccgtggtgatcggtctgttgtggttcgcgtccattgtcgtgctcggcatcctgatgaaggtcaacagg

SEQ ID NO: 6277 - DNA, 333 bp, Streptomyces avermitilis
  CDS (1)..(333)
gtggcaagtggcaacgcgatccgaggaagccgggtcggggcggggccgatgggcgaggccgagcgcggcgagtccgcgccgcggctgcgcatctccttctggtgctccaacgggcacgagacgcagcccagcttcgccagcgacgcgcaggttcccgatacctgggactgcccgcgctgcggctttcccgccggacaggaccaggacaacccgccggacccgccgcgcaccgagccgtacaagacgcacctcgcgtatgtacgggagcggcgcagtgacgcggacggcgaggcgatcctcgccgaggcgctcgccaaactgcggggcgaaatc

SEQ ID NO: 6278 - DNA, 1368 bp, Streptomyces avermitilis
  CDS (1)..(1368)
gtgcctggccggacgtgtttcgcacggcctcgccgctcgctgcgcggtcgactgtcagtggtgcccgttacggttcgcaggagtggaccgggagggggcgctgtgacgacggccgaggcgagtggtgtggcagcacccgcatggcgcgggggcttcgggcggctgtggagcgcggcagtggtgtcgcggttcggagacgcgctgcggaccgccgcgttacccctgattgccgtgcggctcaccgacgatcccctcgtcatcgcctccgtgaccgcctgcggctacgttccgtggctgctcttcggtctgctcggcggcgccgtcgcggaccgggtggaccagcgccgggccatgtgggccgtggacacggtacgcggggcactggtggcgtccttcgcgctcgccgtcgggctcggacacgcgtcgatcccgctgctgttcgtgctcgccttctcgctgaccaccctccagacgctcttcgacaacgcctccacggccctgctgccgtccctcgtggatcccgaggccctgggcagcgccaacgcgaggctgatgacgggccagcagctcgcgggcggcctgctcgcgagccccttcgtgccgctgttgctggccgccggggccgccgtgccgttcgccgcggacgcggtcacctatctgctggccgccgccctcgtggccttcctgcggatccgggcgcccgagcgggcgccacgcccggccggcagcaccctgcgggcggagatggccgacggcctgcgcgcactccggcgtgaccggccgctgcgcgcgatctgcgcggccaccctgctgtgcaacatcggcatgggcgccctgatcgccaccgtggtgctgcacgtgacgcgctggctgcacacggggaacgcgggatacgcggccgtgatgacggcgtactcggccggaagcctcgccggtggcttcgtcgcccagcggatcgcgaaccgcgtggggagagtccgcgccctgctcctgtgcgtcggcgtccagacctcgtccttggtgctcatcggcaccgtccgccagctcgccgccctgatcgtcggcatggcgctgctcggcgccatgggcatggtgtggaacgtcaaccaggtcacgctgatgcagcagcgcagcgagccgtccatggtcggccgcatcgccgcggccttccgcacggcctcgacgtccggcgccccgctcggcgccctgctgggcggcgccgtggcacaggtgtacgggctgaacgggcccgcgctgttcgcggccgtcctgttcgcgctggccggcaccgcgttgatacccgcgctcacgccggacgtacctgttgtcgagccggacgacggcgcgacgacagctcacgtcacgccc

SEQ ID NO: 6279 - DNA, 1650 bp, Streptomyces avermitilis
  CDS (1)..(1650)
atgaacgcagacagccgtaccaggctcaaccagaggcctgagtggaccgctctggccaagcaccgcgaagaactcgcgggcacccatctgcgggacctgttcgcggccgaccccgggcgcggtgccggatacaccctcgaggtcggcgatctgcacgtcgactactccaagcacctcgtcaccgacgagacgctgcggctgctgcgcgagctggccgccgcgaccgatgtgttcgggctgcgggacgccatgttccgcggcgagaagatcaacgtcaccgaggaccgcgccgtcctgcacacggcgctgcgcgccccgcgggacgcggtcgtcgaggtcgacggcgagaacgtggtgccggccgtgcacgccgtgctcgacaagatgagcaccttcgcggagcgcgtccgtacgggggagtggaccgggcacaccggaaagcccatcaagaacatcgtcaacgtcggcatcggcggctcggacctcggcccggccatggcgtacgaggtgctgcgctccttcaccgaccgttcgctgaccgtccggttcgtgtcgaacgtggacggtgccgacctgcacgaggccgtccgcgacctggacccggccgagacgctgttcgtgatcgcctcgaagacgttcaccacgatcgagacgatcaccaatgccacctcggcccgcgactggctgctgaccgagctgaaggccggtcaggaagccgtcgccaagcacttcgtggcgctgtcgacgaatgccgagaaggtgtcggagttcggcatcgacacggcgaacatgttcgagttctgggactgggtcggcggccgctactcgttcgactcggcgatcggcctgtcgctgatgatcgcgatcgggccggagcggttccgcgagatgctcgacgggttcaggatcgtcgacgagcacttcgagagcgcccccgccgaggacaatgtgccgctgctgctgggcctgttgggcatctggtacggcaacttccacgatgcccagtcgcacgcggtgctgccctacagccactacctgtccaagttcaccgcctacttgcagcagctcgacatggagtcgaacggcaagtcggtacagcgggacggcaacccggtggagtgggagaccgggcccgtcgtgtggggcactccgggcaccaacgggcagcacgcctactaccagctcatccaccagggcacgaagctgatcccggccgacttcatcggcttcgccgagccggtcgccgatctgctgcccggcctggtcgcccagcacgacctgctgatggccaacttcttcgcccagacgcaggcgctggccttcggcaagacgccggacgaggtgcgggccgagggcgtgcccgagcagctggtgccgcacaagacgttcaagggcaaccacccgacgaccacgatcctcgcgaaggaactgactccgtcggtgctcggccagctgatcgcgctctacgagcacaaggtgttcgtccagggcgcggtctggaacatcgactccttcgaccagtggggcgtcgaactcggcaaggtcctcgccaagcgcgtcgaaccggcactgaccgagggcgcggacgtgccgggtctggacgagtcgacgaaggcgctggtcgccaagtaccggcagctgcggggccgg

SEQ ID NO: 6280 - DNA, 2304 bp, Streptomyces avermitilis
  CDS (1)..(2304)
gtgcgggccactctgcgctgggcgcaagccgatctgcgcacgcatcgcggcgaggcgctgttcatcgtgctcgccaccgccggcatcgtcgcctcgctgctgcttgccgcggcgctgttcggctacgccaccaacccctggcagcgggtgttcacgcagtcgcacggtgcccatgtgtggatccacaccggcccgtcggccgacgccgcgcggctcgccgagctggacggcgtcgcggcggtgtcgggcccgtatcccaccgccgccacgaccgtcgagtcgcgcggtacccgcgccaccgtcgagctgcggggcacggtcgagccgcccggcagcggccgcccgctgctcaccgccggccgctggctggaccccgccgagccggacggcgtcgtcctggagagcagcctcgcccggtcgctgtgggccgagccgggagacatcctcacgctgccgggcaccgtccgcacgctgaccgtgctgggcgtcgccgacagcgccgagcctcgttaccgccccggggagcagccgggcctcgtatggtcgctgccgtccaccgtgcggcgcgccgacgggcgcggcggccaggtcatcggcctgcgcctggacgatcccgaggacacggactacgccgtccagcgggccgtcaccgtcctcggttccggagccgtcagcgaggtgtccgactggcgccaggcacgcgccgcggcccagggcgacaaccggctgctcgggcaggtgctcggcctgttcgggctcggcgcgctggtcgccgccgccctggccgtccacggcgcgatcggtacccgtatccgcggtcatctgcgcgacatctccgtgctgaaggcgatcggtttcacgccgggccaggtggtgcgcatcttcctgctccagcacctggcgttcgcgttgctcggcgcggtggtcgccgcggcactcacccaggcgctgggccggctgatcccgggccggctcggagacgccgtgggcgtgtggcaggggctgccgggacataccgcggcgctcttcgcggtgcccgtggcggcggtcctcttcatcggtgcgacgaccggcctcgcggcatggcgggccggccgggtccctccggtgccggtactgcgggccgcggctccgctcggcgggcgcctgtcgggtgtcgcgcgcggggcgctcgggctccgggtgctggggctgcggctgccgcccgcgctggtcctgggctggcacaaggcgttcacgcggcggccgcgttcgctggcgaccgtctcccggctcgccctgccgctgctgctgatcgtggtggcgctgagcgcgtggaccaccatcgaccgcttccacagcaggcccgaacagatcggtctcgccgccgcgctcaccgtccgggcggacgagagtctgagcgacccggacgcgcggaccctgctggcccagaacccgcgggtcgccgccgtccatccgggcgtcgaggtcgcggccctggtcccggggcagaccggcacgatcgcgctgcgcgggctcggcacgcgccgggacccgtacccgttctcactggccgagggccgccccgcccgcggccccgacgaggcggtggccggtcaggggctgctcgacctgctggacgtgcgcatcggggactgggtccggatgaccgtgggggcgcagccgcagatcctgcacatcgtgggacgcagcatcgagccggagaacggcggacgggtcatctccacctcgctcgacacgctccgcgagaacgacccggggctccggccgaccctctaccagctccagctgcgcccccacgccgacccgcaccgggtcgccgccgagctgaccgcgtccgcgcacgggcgcttcgacgtccaccccgtgacgaatccggccgacgggctctctcccctgcgcggcgtcgtggtcgggctgatcgccgtactggccctgatcgggctcatcgaactgctcaccgcgatcggcggcaccatacgcgagggcgagcgggatctgctggcgttgaaggcgatcgggctgtccccgcggcagatcaccgcggtcaccgtcaccgccacaggctgcaccgccttggccgcggtcctcgtcggcagcacgctcggaatgcccctcgcgcactggctgatcgatgtccaggggaggtcgagcggcatcggcgccggggtcgcccaggggccgtccccggtgctcctgctgctcttcggcacggccgcggtgctgggtgccgccgcgctcgccgcactgcccgcggcacggtcgggccgccgcaggctggcggacacgttgagcgcggtggcc

SEQ ID NO: 6281 - DNA, 744 bp, Streptomyces avermitilis
  CDS (1)..(744)
gtgagccacaccgctcctttggtgcgcgccgagggtctggtcaagacccacttcggcgagggtgcgcccgcgtacgccgtgcgcggggtggacctcgccgtgcggcagggcgagttcgtggccgtcaccggcccgtccggtgccgggaagtcgaccttgctgcatctgctcggcgggctccagcggccggacagcggctccctctggctggacggcgagtgcaccgacgcgtacggcgaggcccgctgggcggtggagcgcaggcgccgtatcggcatcgtcttccagttcttcaacctggtgtcgaacctgtcggtcgccgacaacgtcgagctgccggccctgctcgccggggtctctcccaagcgggcgcgcgccgagcgcgagcagctcctcgccgagctgggcctcgagggcaaggagcgcagcatgccgggcgagctgtccggtggcgagcagcagcgggtggcgctggcccgggccctggtcaaccacccgcccctgctgctggccgacgagccggcgggcagcctcgacagcaagggcacgcgcgaggtcatgcggctgctgacccgcttccaccagcgcggccagaccatcgtgctcgtcacccatgacgcccggctcgcgagcgccgcggaccgggtgatcagcttcttcgacgggcgcatcgccgacgacgcggaactcgacggcaccccgtcgcgcggcgccgggatatccggcgtgctggaactgagggac

SEQ ID NO: 6282 - DNA, 513 bp, Streptomyces avermitilis
  CDS (1)..(513)
gtgcggctgcccctcctggcgctgcttgcgcgtggcccggcccatggctacgagctcaagcaggaccttgagcagatgctgggtgccgcgtaccctcagccgaacgtcggccagatatatgtgacgctcggccgcctggagaagtccgggctgatcgagggcgaggaagtcgagcagtcgagccggcccaacaagaagatctaccacctcaccgatgccgggcgggaggcgctgcgcgcctggtacgaggagacggcggacgagccgcgggtgcgggacgagttcttcatgaaactcgcgctcgccccgacgaccggtctcgccgaccggatcgccctgatcaacaaacagcggcgccaatacctgaacaccatgcgcagtctgtcgaagctcgccgcggccgagaaccgggacaaccgcatcgcccagttgctcgtcgagggcgccatgctgcatctccaggccgacctcgactggctggagcgctgccaggaggagttggaggagctggag

SEQ ID NO: 6283 - DNA, 1326 bp, Streptomyces avermitilis
  CDS (1)..(1326)
atggcctctgactccgggcgacggtgcccggcgccggtgtacagggaggaacctatgcggtggatacacgccgccggtaggggcctcctggtcgcggcggtgatcctgaccggttacgtggcctcgggcacgcagtccgacgggccccgcgaaggcggtcgcggcccgctcacactggccaccgcgggcgacctcaccaactatctgggacccctgctcgacggctggaaccgcacccaccccggcgagcgggtcaccctcgtcgaactgccggactccgccgacgagacccacgcgcagatgacgaccgacctgcgcggcggcgaccggagccgcttcgacgtcctcaacatcgacgtcgcctggacctcggagttcgccgccgccggctggatcgcgccgctggagcggtcgcgtttcccgctcgggagtttcctgccgccggtcgtggacacggcgacgtacgacggaaggctgtacgccgtcccgtacgtcaccaacgccgggctcctcctgtaccgcaaggacgtcctcgccaaggagggtgtcccgccgccgcgcacctgggccgagctggagcggcaggccagggacatcgcccccaagtacgggctcgacggctacgccggccagttcctgccgtacgaggggctcaccgtgaacgccgccgaggcggtctactcggcgggcggcacgatcctcggtgacgagggcgaacgcgtcaccgtgaactccgccgcggcccgtgagggcatcgggttcctcgcccgcggcgtgcgcgacggctggatcccgaagacggcgctcgcgtacaaggaagaagagtccaagcaggccttccaggacggacatctgctcttcctgcgcaactggccgtacgcctacgtcggcgcgtcgggcaagggctccgcggtcgccgggaagatcggtgcggtgccgctgcccggacccgacggcccgggcgcgagtgtgctcggcggctccaatctcgcggtcaacgcgcatgcccggcatcccgggtcggccgcccgcctgatcgcgtacctcaccagcgagccggtgcagcggcaggtcctcaccaggggtgcgctgccgcccgtacgggcggcgctctaccgggacccggcgctgatccggaagttcccctatctgccgacgctgcgcgcgagcgtgctcgccgccgccccgcgtcccaagagtccccgttacgaccaggtcagcctggccgtgcaggccgtggtgcgcgacgcgatgacggggcacgagacgccgacaacggcggtacggcgactggcgcgggagctggcggacatctcgcaccgcggc

SEQ ID NO: 6284 - DNA, 1704 bp, Streptomyces avermitilis
  CDS (1)..(1704)
ttgacacctcttcgacatgcctacttaacatgcatgcataaccgctggcacgaacagacaggtcgacgggtgtccctcaacacgcaccactggtggcgcgacgcagtgatctaccaggtgtacgtccgcagcttcctggacagcaccggggacgggatcggcgatctcgccggggtccgggccggactgccgtacctgaagaagctcggcgtcgacggcatctggctgagccccttctacccctccccgcagcacgaccacggctacgacgtggccgactactgcgacgtggacccgctcttcggcgatctcgcggagttcgacctgctgatgacggacgcccggcggctcggcatcaaggtgctcctcgacatcgtccccaaccactgctccagcgagcacccgtggttctcccaggcgctggactcggcgcccggcagcgcggcccgcgcccgcttccacatcgccgacggccgcggcccggacggggccgagccgcccaacaactggcacgccatgttcggcggccccgcatggtcccgcatcaccgagccggacggcacgcccggccagtggtacctgcacatgttcacgcccgagcagcccgatctgaactggcgcaaccccgaggtcggcgcccacttcgaccacgcgctgcgcttctggctggaccggggcgtcgacggcttccgcatcgatgtcgcggccggcctcttcaagcaccccgacctgcccgactcgcccgaccccgaggccgacgcccgcacccgcgactcggtcaacccgctggcctggaaccagcccgaggtgcacgacgtctggcggcactggcgcacggtctgcgaggagtacaccgcccgcgacggccgcgagcggctgctcgtcggcgaggtctccgtgcccaccgcgcgcgaacacgcccagtacgtacgccacgacgaactccaccaggcattcttcttcgacctgctgagcgcgccctggaacgacgacgccttccgcaaggtcatctccgaggccatgcaggacatcgccggcaccggctccaccgtcacctgggtgctcaacaaccacgaccaggtccgcacggtcacccgctacggcgaactcggcaccgagggcagcggtctgggcgccgcccgggcccgcgccgccgcactgctgatgctggcgctgcccggagccgcgtacatctaccagggcgaggagctcggccttcccgaggtcgtcgacctgcccgatgacgtgctgaccgacccgatcttccaccggaccggcagccgtgcccggatccgcgacggctgccgggtgccgctgccgtggtcggggcacgcctcgccgttcggcttcacccccggcgtcgagagcgccaagccgtggctgccgcagcccgcctacttcgccgagtacgccaccgaccgcgccctcgccgacacccgctccttctggcacctctaccgcgacgggctccacctgcgcgccggactgccccagctgggcgaagggacgctgcgctggctggacaccccgcccggcgtcctcggcttcgtccgcggcgacggcctggtgtgcgccgtcaacttcggtacggcccccacgcccgcgcccgtctccggcacccccctgctgtccagcggcccctgcgcgcccggcgtcctgcccggctcgacggccgcctggtggatcagcgactccaccaacccc

SEQ ID NO: 6285 - DNA, 1320 bp, Streptomyces avermitilis
  CDS (1)..(1320)
atgcgacgacgtacgaccctgctcgccagctgcaccgccctcgccctggccctgggcgccaccgcctgcggaggcggccccgtcgccgcgggtggcggcggcaagtcgctcagcgggcagacgatcaccgtggccggtgtctggtccgggagcgagcagaagaacttccagaaggtcctggacgccttcaccgagaagaccggcgcgtcggcccggttcacctctaccggcgacaacgtctccacggtcgtcggcagcaagatcgagggcggcaacgctcccgacgtggtgatggtcccgcaggtcggcgtgctccagcagttcgcgaagaagggctggctcaagccgctctcccggaccgcccagcagtccgtcgacgccaactacgcgagtgtctggaagaagtacggcagcgtcgacggcaccctgtacggcctgtacttcaaggccgcccacaagtcgaccgtctggtacagccccgacgccctcgaccaggcgggcgtcaagccgccgaagacgtacgacgcgatgctgaaggccgggcacaccgtgtccgactccggcctcgcggccttctccgtcgccggacaggacggctggaccctcaccgactggttcgagaacatctacctctcccaggccggacccgagaagtacgacgccctggccgcccacaagatcaagtggaccgacccgagcgtggtcgaggccctcaccaccctcggcaggctcttcaaggacaagcagctgatagccggcggccagaagggcgccctgaacaccgacttccccggctccgtcgagaaggtcttcggacccgaggcacaggcgggcatggtctacgagggcgacttcgtcgccggcgtcgccaaggaccagttcgacaagaagatcggccaggacgccgacttcttccccttccccgcggtggacggcggcaaggcacccgtggtcagcggcggcgacgcggcggtcgtcctgaaggacggcaagaaccagaaggccgccacccggttcctggagtacctcgccacccccgaggcgtccgccgtctgggccggggccggcggcttcctctccccgaacaagaaggtcgacctcgcctcctacggcgacgacgtcacccgcgagacggccaagtccctgatcgccgccggggactcggtccgcttcgacatgtccgaccaggccccggccgcgttcggcggcaccaagggcaccggcgagtggaagctcctccaggacttcctgcgcgacccgtccgaccccaaggcgaccgccgccgagctggagcgcgcggcggccaaggcctaccaggac

SEQ ID NO: 6286 - DNA, 1356 bp, Streptomyces avermitilis
  CDS (1)..(1356)
atgaccgccaccctcgtgaaagagacgagccccccggccgccccccgggccgacggcaggcgccgggccaggcgccgcggccggatcatcgccctcgtcttcgtcttccccgccctgctcctgctcggcgcgctcgtcgtctatcccgtgctgttcaccgtcgggcgcagcttcttcgacgcctccggcacccggttcgtgggcggcgacaactacgccgagatgttccgcgaccccgccacgctcaaggccatccgcaacaccaccatctgggtggtcgtcgccccgaccctgctcaccgggctcggcctggtcctcgccgtgctcgtcgagaagatccgctgggcgacggcgttcaagctgctgctgttcatgccgatggcggtctccttcctcgccgcgggcatcatcttccggctcgcctacgacgaggaccccgacaagggcgtgctgaacgccgccgtggtcggcgtccacgacgccttcgcgggcacgtcctcctacccgaccgcccgtgcccgcgacggccagggcctgaccagggcaggcgacggctcgtacggtacggccgacggcgtgtcccccggccgcaccgtcagcctcggactggtcggtgtacgccccgacgacctgcccaaggacgcgaggccggcgtacacggccgccgggcgcacgtccgccccggacgaactgcgcggtgtcgtctacctggacttcacccccggcgggggaggccggcagggcaaggccgacaaggcggagagcgggctgccggggatgcgggtcgaggcggtgcgcgacgggaagacggccgcgcgcgccacgaccgccgccgacggctccttccgcttcggggacctgggctccggctcgtacacgctccggctgcccgcgtcgaacttcgcgccgccctacgaaggcgtctcctggctcggcccggcgctcgtcacgccggccgtcatcggggcgtacctgtggatctggaccggcttcgccatggtcctgatcggtgccggactggccgcgctgccccgggacgcgctggaggcggcccggatggacggggcgggggagtggcagatcttccgccggatcaccgtgccgctgctgggacccgtactcacggtggtcttcgtgaccctggtgatcaacgtgatgaaggtcttcgacctcgtctacatcatcgcgccgggaccggtgcaggaggacgccaccgtgctcgccacccagatgtggctcgtgtccttcggcggcggcaacaaccagggcctgggcagcgcgctcggagtgctgctcctgctgctggtcatcccggccatggtcttcaacgtccgccgtttccgagggagtcagcga

SEQ ID NO: 6287 - DNA, 837 bp, Streptomyces avermitilis
  CDS (1)..(837)
atgaacgcgctcaggcgagggctcggcaacagcctgatacaggccttcctcgtgctggtcgggctgatctggctcaccccgctcgccggactgttcctgtcgtcgttgcggtccgcgcaggaccaggcgcgcggcggctggtggacggctctgaccagtcccgcacagctgtccttcgacaactactcggcgctgctgggcaatgcggggatgacgcaggcgttctggaacaccgtgctgatctccgtcccggcgaccacactcgtcgtcgtcatcgcggcgctcgccggatacgcgttcgcctggctggagttccccggccgggaggcgctcttcctgctcgtcgtggccctgttggtggtgcccgtccagatcgggctgctgccggtggccaaactcttcggccagctgggcctgttcggcacgatcccgggcgtcgtgctcttccacgtctcctacgggctgcccttcgcgatcttcctgctgcgcaactacttcgccgagatgccgcgggagatgctggaggccgcccgcatggacggcggcagcgagtggcgcatcttcacccggctcgtccttccggtcggccgcccggccatcgcgagcctcgcgatcttccagttcctctgggtctggaacgacatgctcgtcgccctgctcttcgccgacagctccgcacagccgctgacggtggaactccagtcgcagatacggcagttcggcagcaacatcgacgtactcgcgccgggggcgttcctgtccctggtggtgccggtggtcgtcttcttcgccttccagcggcactttgtgcagggggtgatggcgggctccgtcaag

SEQ ID NO: 6288 - DNA, 780 bp, Streptomyces avermitilis
  CDS (1)..(780)
gtgagtactccccaactggtcgtgcatcgcgacaaggagctgatggcgcaggccgccgcggcccggctgatcacgaagatcgtggacgcgcaggcctcccgcggctacgcctcggtcgtgctcacgggcggccgcaacggcaacggcctgctggccgcgctggccgccgagcccgcccgggacgccatcgactggggccggctcgacctgtggtggggcgacgagcggttcctgcccgagggcgacccggaacgcaatgacacccaggcccgtgaggcgctgctgaacgcggtgccgctggaccccaagcgggtgcacgccatgcccgcgtcggacggcccgcacggctccgacgcggacgcggcggcggccgcgtacgcggaggagctggccagggcggccgggcccgagaaccatggcgcggtcccgaccttcgacgtcctgatgctgggcgtcggcccggacacgcatgtcgcgtcgctcttcccggagcacccggcggtgcgggagacggagcggacggtggtcggtgtgcacggagcgccgaagcccccgccgacccggatcacgctcacgctgccggcgatccgggccgcgcgtgaggtgtggctgctggcggcgggcgaggacaaggcggaggcggcggccatcgccctgtcgggcgcgggcgagctccaggccccggcggccggcgcccacggccgctcccgcaccctgtggctgctggacgcggcggcggcctcgcagctgccgcgctcgctgtatccgccggctctggcc

SEQ ID NO: 6289 - DNA, 1119 bp, Streptomyces avermitilis
  CDS (1)..(1119)
atgaagatcgacctcacggacaccactgccagcaagatcaacaaggggctcgtgcaggcccgccgcgccatcggcacgcccgccgtcggcatggtgctcaccctggtcatcgtcaccgacgaggagaacgcctacgacgccctgaaggccgccaacgacgcctcgcgcgcgcacccctcgcgcacgctcgtggtcgtcaagcgggtctcgcgctcgccccgggaccgcacgaagtcgcgtctggacgccgaggtacgggtcggcgcggacgccggcaccggcgagacggtcgtccttcgcctgtacggcgaggtcgcgaaccacgcccagtccgtcgtcctgccgctgctgctgccggacgcgcccgtggtggtctggtggtcggtggacgccccgcgtgacccggccagcgaccccctcggcgccctgggccagcgccgggtcaccgacagctacgcggcggagaagcccgtcgacgagctgcgggcccgcgccgagagctacgagccgggggacaccgacctggcgtgggcccggatcaccccgtggcgctcgatgctggccgccgccctcgaccagatcaactgcgaggtcatctccgccgaggtggcgggcgaggagttcaacccgagcgtcgaactgctggccatgtggctcgccgaccggctccatgtgcacgtccggcgcgtgatctccgccggtcccggcctgacccaggtccggatggaaacgaccggtggccccatcacgctgcaccggtcggacggaacgatggccacgctggcgctgccggggcagccggaccgcgcggtggcgctcaagcgccgcgaaacgtccgggttgctcgcggaggagctgcgcaggctcgatccggacgacacctacgcgtcggcgctccggttcggggtggaccggctcggcgggacccactcggcctcgcgaaggtccgaggctcccgcacaggccacgacgccactcccggtccggccggtgcaggaatcggctgagcccagccggacggccgcgtcggctcccgcgccggcctccccggcgggcgacagcgaggtcggccgtccgtctccggcccagatgcccccggtcaagaaggcagacccgcag

SEQ ID NO: 6290 - DNA, 1521 bp, Streptomyces avermitilis
  CDS (1)..(1521)
ttgtcgagcagcaacccgctgcgtgaccccgcagaccgacggctcccgcgtatcgcggggccgtcgggcctggtcatcttcggcgtcacgggcgatttgtcacgtaaaaagctgatgccagccgtgtacgatctcgccaaccgcgggctgctgccgccgggcttctcgctcgtcggcttcgcccgccgcgactgggagcacgaggacttcgcccaggtcgtccacgacgccgtcaaggaacacgcccgtacggagttccgcgaggaggtctggcagcagctcatccaggggatgcgcttcgtccagggcaccttcgacgacgacgacgccttcgagcggctgcgcgacaccatcggggaactggacaaggcacagggcacgggcggcaacttcgccttctacctgtccgtgccgccgtccgccttcccggtggtcatccagcagctcaagaagcacggcctggccgaccagtcggacggctcctggcgccgcgcggtcatcgagaagcccttcggacacgacctcaagtcggccgaggagctcaacgcgatcgtccacgaggtcttcggctcggaccaggtcttccgcatcgaccactacctgggcaaggagaccgtccagaacatcctggcgctgcgcttcgccaacacgatgttcgagccgatctggaaccggtccttcgtggaccatgtgcagatcaccatggccgaggacatcggtatcggcggccgcgccggctactacgacggcatcggcgccgcccgtgacgtcatccagaaccacctgctccagctgatggcactgaccgccatggaggagcccgcctccttcgacgcggacgcgctcgccgccgagaagaccaaggtgctcggcgccgccaagctgccgaaggacctgagcaagaacaccgtccgcggacagtacgcggccggctggcagggcggcgagaaggtcgtcggctatctccaggaagacggcatcgaccccaagtcgaagaccgacacctacgcggccgtcaagctcgaggtggacaaccgccgctgggcgggcgtccccttctatctccgtaccggcaagcgcctgggccgccgcgtcaccgagatcgcggtcgtcttccagcgcgccccgcactcccccttcgaccacacggcgacggaggagctcggccagaacgcgatcgtcatccgcgtccagcccgacgagggcatcaccgtccgcttcggctccaaggtgcccggcacctcgatggagatccgggacgtctcgatggacttcgcgtacggcgagtcgttcaccgagtccagcccggaggcgtacgagcggctgattctggacgtgctgctcggcgactcgaacctcttcccgcgcaccgaggaggtcgagctgtcctggaagatcctcgacccgatcgaggagcactgggacaagcacggcaagcccgcgcagtaccccgcgggcacgtggggtcccgtcgaggcggacgaaatgctcgaacgagacggacggagctggcgtcgccca

SEQ ID NO: 6291 - DNA, 1116 bp, Streptomyces avermitilis
  CDS (1)..(1116)
atgacagacgcactcaagcgcctctccaaggaaggcgtcgcgatctggctggacgacctgtcgcgcaagcggatcacgtccggcaacctcgccgaactgatcgaccagcagcacgtcgtgggcgtcaccaccaacccgtcgatcttccagaaggccatctctcagggcgacggttacgaccagcaggtctccgacctcgccgcccgccgggtcaccgtcgaagaagccatccgcatgatcaccacggcggacgtccgcgacgccgccgacatcctgcgcccggtcttcgacgccaccgacggccaggacggccgggtctcgatcgaggtcgacccgcgcctggcccacaacaccaaggcgacggtcgccgaggccaagcagctggcctggctggtcgaccgccccaacacgctcatcaagatcccggccaccaaggcgggcatcccggcgatcacggaggtcatcggcctcggcatcagcgtcaacgtgacgctgatcttctcgctcgagcgctaccgcatggtcatggacgcctacctcgccggcctggagaaggccaaggagcgcggcctggacctgtcgaagatccactcggtggcgtccttcttcgtgtcccgcgtggacaccgagatcgacaagcggatcgacgccctcggcacgccggaggccaaggccgcgcgcggcaaggcgggcctcgccaacgcccggctcgcctacgaggcgtacgaggcggtcttctccaccgaccgctggctcgccctcgacaaggcgcaggccaacaagcagcgcccgctgtgggcctccaccggcgtcaaggacccggcgtacaaggacaccatgtacgtcgaggaactggtcgcgccgaacaccgtgaacaccatgccggaggccactttggaggccaccgcggaccacggcgagatccggggcaacaccatcgccggcacgtacgagcaggcccgcgccgacctcgacgccgtcgagaagctcgggatcgcgtacgacgacgtggtccagctcctggaggaagagggcgtcgacaagttcgaggcgtcctggaacgacctgctcaagtcgaccgaggcggagctccagcgcctcgccccctcggagggc

SEQ ID NO: 6292 - DNA, 2085 bp, Streptomyces avermitilis
  CDS (1)..(2085)
gtgagcaccaagccgaccaccacagacctcgagtggaccgagttggaccagcgggccgtggacaccgcccgcgtcctggccgccgatgccgtacagaaggtcggcaacggccatcccggtacggcgatgagcctcgcgcctgccgcgtacaccctcttccagaaggtgatgcggcacgacccggcggatcccgactgggtcgggcgcgatcgtttcgtcctttccgcgggccactcgtccctgaccctctacaccgagctctacctggccgggttcggcctggagctggacgacctcaagtccttcaggacctggggcagccggactcccggccaccccgagtacgggcacacgcccggcgtggagacgacgaccggcccgctgggccagggtgtcgccaacgcggtgggcatggccatggcctcccgctacgagcgcggtctgttcgacccggacgccgcacccggcacctccccgttcgaccacttcatctacgcgatcgccggtgacggctgcctccaggagggcatctcccacgaggcgtcctcgctggccggccaccagaagctcggcaacctggtcctgctgtgggacgacaaccacatctcgatcgagggcgacaccgagacggccgtctccgaagacacggtgaagcgctacgaggcgtacggctggcatgtgcagcgcgtggccccgaagccggacggcgacctcgacccgcacgccctctacgacgcgatccaggccgccaaggcggtcacggacaagccgtcgttcatcgcgatgcgctcgatcatcgcctggcccgcgccgcacgcgcagaacaccgaggccgcgcacggctcggcgctcggcgaggacgaggtcgcggccaccaagcgcgtcctcggcttcgacccggagaagagcttcgaggtcgccgaggaggtcctcgcccacacccgtgaggccctcgaccgcggccgcgaggccaaggccgagtgggagaagggcttcgccgcctggcgcaccgcccagccggagcgcgccgccgagtacgagcgcatcgccgcgaccgagctgccggccggctgggaggagaagctcccggtcttcgaggtgggcaagggcatcgcgacgcgtgccgcgtccggcaaggtcctccaggcactcggcgcggtcatccccgagctgtggggcggctccgccgacctggccggctcgaacaacaccacgatcgacaagaactcctcgttcctgccggcggacaacccgctgccggaggccgacccgtacggccgcacgatccacttcggcatccgcgagcactccatggccgcggagatgaacggcatcgcgctgcacggcaacacccgtatctacggcggcaccttcctggtgttctccgactacatgcgcaacgccgtccgcctctccgcgctgatgcacctgccggtgacgtacgtgtggacccacgactccatcggtctcggcgaggacggccccacccaccagcccgtcgagcacctcgcctcgctgcgcgccatccccggcctcaacgtcgtgcgtcccgcggacgccaacgagacggcgatcgcctggcgcgagatcctcaagcgctacaccaaggtgttcggcaagggcgccccgcacggcctcgcgctgacccgtcagggcgtaccgacgtacgagcccaacgaggacgcggccaagggcggttacgtgctcttcgaggccgagggcggcgctcccgaggtcattctcatcggcaccggctccgaggtgcacgtcgccgtcgaggcgcgcgagcagctccaggccgcgggcgtgccgacccgggtggtgtccatgccgtccgtggagtggttcgaggagcaggaccaggggtaccgggacagcgtcctgccgccgtcggtgagggcgcgggtcgcggtcgaggcaggtatcggtcttacctggcaccggttcgtcggagacgccggacgcattgtttcgctggagcacttcggtgcttcggccgatggcaaggtgctcttccgggagttcggtttcactcccgagaacgtcgccgacgccgcccgggaatcgatcgccgcagcccagcgc

SEQ ID NO: 6293 - DNA, 855 bp, Streptomyces avermitilis
  CDS (1)..(855)
gtggcgctgaccaagccgcggatcatcgagctgttgctgatcaccaccgttccggtgatgttcctggcggagcaaggggttccgagcctgcgcctcgtcctgctgacctgcctcggcggctacctctccgcgggcggcgccaacgcgctgaacatgtacatcgaccgtgacatcgacgccctcatggagcgcacctcgcagcggccgctggtgaccggcatggtcagcccgcgtgagtgcctggccttcggcatcacgctggcggtcgtctccacgctgctgttcggtctgaccgtcaactggctgtccgcctggctgtcgctcggagcgctcctcttctacgtcgtcgtctacacgatgatcctcaaacggcgtacgtcgcagaacatcgtgtggggcggcatcgcgggctgcctcccggtgctcatcggctggtcctcggtcaccgactcgatgtcctgggcgccggtcatcctcttcctcgtcatgttcttctggacgccgccgcactactggccgctgtccatgaaggtgaaggacgactacgcgcgcgtgggcgtgccgatgctgccggtcgtcgcctccaacaaggtggtcgcccgccagatcgtgatctacagctgggtgatggtcggcgtctcgctgctgctcaccccgctcggctacacgggctggttctacaccctggtcgccctgctggccggcggtttctggctgtgggaggcgcacgggctgcagaaccgcgccaaggccgaggtgacgggcggcaagctcaaggagatgcgcctgttccactggtccatcacctatgtgtcgatcctcttcgtcgccgtcgcggtggaccccttcctccgc

SEQ ID NO: 6294 - DNA, 354 bp, Streptomyces avermitilis
  CDS (1)..(354)
atggcagacacgcagcaggttgacgagggcaccgacgccaagcaggccgccagggccgagcgcaaggcggccaagctcgccaaggagatcaacgccttcgccaagacgcacggcggggccgaggcgcatgtggcgtacatcgggcaggccggcacccggatcgtgctcgtcggcgaggacgacgcctggggcgacctcgtcgcacccacgtacgccgtcgccgagcaggcggtggagaaggccggcgtcacggttcacgaggcgttcgacggcgaattcgcggccaaggtgaagaccgggccgtacgagtggacgcgcatggcggggatccaggtgggcggcccgagcaacggc

SEQ ID NO: 6295 - DNA, 1104 bp, Streptomyces avermitilis
  CDS (1)..(1104)
atgatcgaaacgccgtccctggtggaccagtactgccacggcgtactgcgtacggagctgggtctcggcaccttcgaggcccacctcgcccgtaccgagggcccgcccgcccccggcaccaccctgttcgacacccagacgggtttcgcggtacgccgctggtgtccgccgctgctcggtctggagccgcactgcccgccggcccgctatctggcccgacgccgtgaactcggcgttctggaatcgggccgcaggctgctgcgcggcagcggcatcaccacgtatctcgtcgacaccgggctgcccggcgatctcaccggacccggcgagatggcctcggccggggccgccgacgcgcacgagatcgtccgcctcgaactgctcgccgaacaggtcgccgacacctccggcaccgtcgagtcgtttctcgccaatctcgccgagtccgtccacgggaccgccgccgacgccgtggcgttcacctcggtcgcgggcgtacggcacggactggcgctcgcgcccgagccgccggggccgggggaggtgcggggcgcggcggggcgctggctcgcgggccggagggtcggcggcccgctgtcggacccggtcctgctgaggcatctgctgtggatcgcggtggcctcgggccggcccctgcaactgcactccgggctcggcgaaccagggctgcgcatcgaccgcaccgacccggtcctgctcaccgacttcgtccgggccaccgccgggctcggcacggacctcgtcctgctgcacggctatccgtaccaccggcacgcggcacatctggccggcgtcttcccgcatgtgtacgcggacctgggcgcggcgctggtgcggacgggggcgggggcggcggccgtgctctcggagatcctggagctggcgcccttcggcaagattctcttctccagcggggcacatggtctgccggaactccatgtggtgggcgcacatctcttccgtgcggcgctcgcacgggtgctcggcgcctgggtcgccgagggggcctggtcgctggcggacgcacagcgggtggcagggctcatcgcggcgggaaacgcgcggcgggtctacggggtggag

SEQ ID NO: 6296 - DNA, 768 bp, Streptomyces avermitilis
  CDS (1)..(768)
gtgcggatgaccgatgacgccacggctcgtctcctcgaccgcttcctcgccgatctgcgcgccctcgccccggtcgccgtgtgggcgcacggttcgctcgccggcggcgactaccaggagggccgcagcgacctcgacctgatcgcagtcctggagggtccggtcccgctcggcaccgtgcgcgaggtggcgcggctgcaccggcggctgcgcgccgacgaggcgctcgccgagaagctgcactgcagctatctgacgccggacaccgtggccggcgcggagcggtcgcatctcacctgggcgcacgaccgcctgatgaagcgcccggtcactccggtcacccgccgggaactgcacgccttcggcctggtcctgcacggcgaaccgccgaaggacctgctcccgcccaccccggaccgcgaactcgacgccttcgtcgtacgggaccagaaggagttctggcggcccgcggtgcgcaaggcccggctgtggaagcagtccgtctgggtcgacctggggatggtcaccttcgcccgtgcgaccgtcaccctgcgggagggccgcctgatctccaagaaggaggccttggcggcacttcccggactgggggcgcccgccgacgtggtcgaggacatcgggcggcggagatacgcggaccccgcgccgcccacggaggagtggacggcacgccgggccgagctcacgagggcctacctgggccccgccatcgacggccttgtcgccacctacgaaccgctcacgcgcgcg

SEQ ID NO: 6297 - DNA, 1053 bp, Streptomyces avermitilis
  CDS (1)..(1053)
gtggcggagcggaccctcgtgaaaccgtgcacaagcgtcccgcctacgatggtgcgcgtgccaaacgtgacccgtgccgatgccctcgccgccgcgcgcaaccccctcgccctcatcgccgaacgctggactccggccccccggacggttcggcgcgcggccctcgccgcgctcgtcatggcggtggtcatcgtggtcaccggcggtgccgtgcggctgaccgggtccgggctcggctgcccgacctggcccaagtgcaccgacgactcgctgaccaccaccagcgcgatgggcttccacggcgtcatcgagttcggcaaccgcatgctgacgtacgtgctgtgcgcggcggtcggctgggcgatcatcgcggcgcgctcgcagaagccgtggcggcgctctctcacccggcttggctgggcgcagttctggatcgtcatgagcaacgcgatcctcggcggcatcgtggtcctggtcggcctcaacccctacacggtcgcggcccacttcctgctctccacggcgctcatcgccgtcgccacgctcatgtggcagcgcgcctgcgagggcgacggggcaccgcgcccgctggtcggcaaggccgtccagcagctggtgtggttcctggtcaccgcctccgtgctgctgatcgcggtcggcacggtggtcaccggtgcgggtccgcacgcgggtgactcgagcgacgtcgagcgcatgccgctggactgggagaccgtcagcaagctgcacgccgtcctggcctggatcgtggtgacgctgaccttcgccctgtggttcgtgctcaaggcggtcgacgcccccaagggcccgctgcaccgcacccgcgacctgttcctgatcctcctcgcgcagggcgtcatcggttacgtccagtacttcacggacctccccgaggccctggtcgccctgcacatgctcggctcctgcctggtctggatcggcgtgctccgggtgctgctgtcgctgcgcgaacgtcccgaggccgtggcggacctgccgggtccttcgacggagtcggcgctcacgcgcgcg

SEQ ID NO: 6298 - DNA, 768 bp, Streptomyces avermitilis
  CDS (1)..(768)
gtgaccatcgccggtacgtacacgccgaagcccggcgccgccccgctgccccgcatgatcgcggcgcaggcggcgctggagacgaagatgctgctgcgcaacggcgagcagctgctgctgacggtggtcatcccgacgctgctgctggtcctcttcagctcggtggacatcgtcgacaccggcaagggcaggtccgtcgacttcctcgcccctggcatcctcgccctcgccgtgatgtcgacggcgttcacgggccaggcgatcgcgacgggcttcgagcgccgctacggggtcctcaagcgcctcgccgcctcccccctcccccgctggggcctgatggccgcgaagacggcgtcggtgctcgtcacagagctcctccaggtgatcctgctgacggcgatcgccttctccctgggctggtcaccgcacggcaacccgctggccgtcctgctgctgctgatcctcggcacagccgccttctcgggcctcggtctgctgatggcgggcacgctgaaggcggaggcgacactcgcggcggcgaacctggtctttctgctccttctggtgggcggcggtgtgatcgtcccgctggacaagttcccggacgcggcgcaggacgtcctcggcctgctgccgatctcggccctttcggacgggctgcgggacgtgctgcaacacggggcggggatgccgtggggggatctggggatcctcgccgtgtggggagtcgtggggctggcggcggccgggaagttcttccgctgggag

SEQ ID NO: 6299 - DNA, 930 bp, Streptomyces avermitilis
  CDS (1)..(930)
ttggcgctcatgcagagtgaccccgtcgtccaggtccaggccctggtgaagcggtacggcgacaagaccgcggtgaacagcctcgacctggtggccggggccggtgtcaccgccgtgctcggccccaacggtgcgggcaagaccaccacggtcgagacctgcgaggggtaccggaggccggactccggcacggtgcgcgtcctgggcctggacccggtgcgcgaagcctccgcgctgcggccgcgcatcggggtgatgctccagtccggcggggtctactccggcgcgcgggcggacgagatgctgcgccatgtcgccaagctgcacgcccgccccctggacgtggacgcgctgatcgagcgtctcggcctcggcagctgcggccggacggcgtaccggcgtctgtcgggcggccagcagcagcggctcgcgctggcgatggccgtggtggggcgtccggaactggtcttcctggacgagccgacggcgggcctggacccgcaggcgcgccgggcgacctgggacctcgtacgcgacctgcgtgcggacggcgtctcggtcgtcctcacgacccaccacatggacgaggcggagcagctcgccgacgacgtggcgatcatcgacgggggccgggtcgtcgcccagggctctcccgaggagctgtgccgcggtggcgccgagaacacgctgcgcttcatgggccgccccgggctcgacgtcggctcgctgctcaaggcgctcccggcggactgcacggccgcggagctgacaccgggcgcgtaccgggtgggcggcaaggtcgacccccagctcctggctaccgtcacctcctggtgcgcgcagcacggggtgatgccggagaagatctcggtggagcggcacactctcgaagacgtcttcctcgaactgaccggcaaggagctgcgttcg

SEQ ID NO: 6300 - DNA, 189 bp, Streptomyces avermitilis
  CDS (1)..(189)
atgtccgcaccccctccgaccggcccactcgtcactcggaacacggtcgccacccagctcgacggccacgcgcccgactgccggctcggcgagcgcagcccgtcggccggactggcgaagttgggggcccgggtgctgctcctcggcgcgggctacgacacgtgcgcgagcttccatctggctgggcca

SEQ ID NO: 6301 - DNA, 747 bp, Streptomyces avermitilis
  CDS (1)..(747)
gtgaaaaacgtcggcgaggcacgggagacccccacgggggcccctcaggaggaactcgcgaccggtgagcgctccacgcgcaaccgtgtcgtgcgctccatcctggaccacgggccgtcgaccgtcgccgagctggccggacgtctcggtctcacccaggccgccgtccgccgccatctcgacgcactggtcaccgacgacatcgtgcagccgcgcgagcagcgggtctacggggcgcgtacgcgcggccgtccggccaaggtcttcgccctgaccgactgcggccgggacgccttcgaccagtcctacgacaagctcgccgcggacgccctgcgctggatcgccgagcgcgagggcggggaggaggcggtcgccgccttcgcccgcgcccggatcgccgcccaggccgccgcgtaccgcgcggccgtcgaggccgccgcgcccgaggagcgcaccgaagcgctggccaaggccttgagcgcggacgggtacgctgctacggcgcgcagcgcaccggtcggtgagcagctctgccagcaccactgcccggtcgcgcatgtggccgagcagttcccgcagctgtgcgaggcggagaccgagatcttctcccagctgctcggtacacatgtccagcggctggcgaccatcgcgcacggtgacggcgtctgcacgacgttcatccccaagatttccaagaccgatcacggccacaacgcatccgcaagcaccgccgggaggaaccccgca

SEQ ID NO: 6302 - DNA, 1422 bp, Streptomyces avermitilis
  CDS (1)..(1422)
atgacgctccccatcgaggagaccgcccaccccgagctcgagggtctgggcacgtacgaatacggctgggccgactccgacgtggccggtgcctctgccaagcgcggcatcaacgaggacgtcgtccgcgacatctccgcgaagaagaacgagccggagtggatgaccaagctccgcctcaagggcctgcgcctgttcgagaagaagcccatgccgaactggggctcggacctctcgggcatcgacttcgacaacatcaagtacttcgtgcgttccacggagaagcaggcggagtcctgggaggacctgcccgaggacatcaagaacacgtacgacaagctcggcatcccggaggcggagaagcagcgcctcgtcgccggtgtcgcggcccagtacgagtccgaggtcgtctaccaccagatccgcgaggacctggaggagcagggcgtcatcttcctcgacaccgacaccgccctgaaggagcacccggagctcttcaaggagtacttcggcacggtcatcccggtcggcgacaacaagttcgcgtcgctgaacaccgcggtgtggtccggcggctccttcatctacgtgccgaagggcgtgcacgtcgagatcccgctccaggcctacttccgtatcaacacggagaacatgggccagttcgagcggaccctgatcatcgtcgacgaggacgcctacgtccactacgtcgaaggttgtacggcgccgatctacaagtcggactccctgcactccgcggtggtcgagatcatcgtgaagaagggcgcccgctgccgttacacgaccatccagaactggtcgaacaacgtctacaacctggtcaccaagcgcgccgtggcgtacgagggcgcgaccatggagtggatcgacggcaacatcggctccaaggtcaccatgaagtacccggccgtctacctgatgggcgagcacgccaagggcgagaccctgtccatcgccttcgcgggcgaggggcagcaccaggacgccggctccaagatggtccacatggcgccgaacacctcctccaacatcgtctccaagtcggtggcgcgcggcggtggccgtacctcgtaccgcggtctggtggagatcggcgagggcgcggccggatcgaagtccaacgtgctgtgcgacgcgctgctcgtcgacacgatctcccgctccgacacgtacccctacgtggacgtccgtgaggacgacgtgtccatgggccacgaggcgaccgtctccaaggtcagcgacgaccagctcttctacctgatgagccggggcatgaccgagttcgaggcgatggcgatgatcgtccgcggctttgtcgagccgatcgccaaggagctgcccatggagtacgcgctggagctcaaccggctgatcgagctgcagatggaaggcgcggtcggt

SEQ ID NO: 6303 - DNA, 1179 bp, Streptomyces avermitilis
  CDS (1)..(1179)
atggctgaggctcagaacatccccgtgggctccaccaccgcgggccagatcgcggtggccgccgagtcgaccgtcgccacgcgcatgagcgcgcccccgtccttcgacgtggcggacttcccggtcccccacggccgcgaggaggagtggcggttcaccccgctggagcgcctgcgcgggctgcacgacggcaccgcggtcgccaccggcgacggcgtgaaggtcgacgtgagcgcccccgagggcgtcaccgtcgagaccgtcggccgtgacgacgcccggatcggcagggcgggcaccccggtggaccgcgtcgccgcccaggcgtactccgcgttcgagaaggccggtgtcgtcaccgtccccaaggagacggtgctcaccgagccgatccgcatcgccgtgcacggcgagggcggggtcgcctacggccatcaggtcatcgagctgggagccttcgccgaggctgtcgtcgtcatcgaccacaccggtgacgccgtcctcgccgccaacgtcgactacatcctgggcgacggcgccaagctcaccgtcgtctccgtccaggactgggacgacaaggccgtgcacgtgggccagcacaacgcgctgatcggccgggacgccacgttcaagtcgttcgtggtcaccttcggcggcgacctcgtacgcctgcacccgcgcgtcgcgtacgccggcacgggcggcgaggccgagctcttcggtctgtacttcacggacgccggtcagcaccaggagcaccgcctcctggtcgaccacaacaccccgcactgcaagtcgaacgtcgcctacaagggcgcgctccagggcgacggcgcgcacgcggtgtggatcggcgacgtcctcatcgaggccaaggccgagggcacggacacgtacgagatgaaccgcaacctggttctgaccgacggcgcccgcgtcgactccgtgccgaacctggagatcgagaccggcgagatcgtcggcgcgggccacgcctcggcgaccggccgcttcgacgacgagcagctcttctacctgatggcccgcggcatccccgccgacgaggcccgccgactggtggtccgcggcttcttcgccgagctggtccagcagatcggtgtcgccgacatccaggagcgcctcctcgtcaggatcgacgaggagctggaggcgtcggtc

SEQ ID NO: 6304 - DNA, 318 bp, Streptomyces avermitilis
  CDS (1)..(318)
atgacgaccttcgtacgcgcctgcgggctgagcgagctggaggaggacaccccgaagcgggtggaactcgacggcacgccggtctcggtcgtgaagaccgagggggaggtgttcgcgatcaacgacatctgctcgcacgcgaacgtctcgctctccgagggcgaggtggaggactgtcagatcgagtgctggctgcacggctccgcgttcgacctccgcaccggcaagccgtccggtcttcccgcgacgcgccccgtccccgtatatcccgtaaagatcgaaggggacgatgtgctcgtctccctcacccaggagtcc

SEQ ID NO: 6305 - DNA, 780 bp, Streptomyces avermitilis
  CDS (1)..(780)
atggcaacgcttgaaatccacgacctgcacgtcaccgtcgaggccgacaacgccacgaaggagatcctcaagggcgtcgacctcaccgtgaagcagggcgagacgcacgccatcatgggccccaacggctcgggcaagtcgaccctcgcctactcgctcgcgggacaccccaagtacacgatcaccggcggcaccgtcaccctcgacggcgaggacgtcctggagatgtccgtcgacgagcgcgcccgcgcgggcctgttcctggcgatgcagtacccggtcgaggtccccggcgtctcggtctccaacttcctccgtacgtccgccacggccatccgcggcgaggcccccaagctgcgcacctgggtgaaggaggtcaaggaggccatggagcgcctcaacatggacccggccttcgccgagcgcaacgtgaacgagggcttctccggcggtgagaagaagcgccacgagatcctccagctcgagctgctcaagccgaagatcgcgatcctcgacgagaccgactccggcctggacgtcgacgccctgcgcatcgtctccgagggcgtcaaccgagtccgcgagaccggcgaggtgggcaccctcctcatcacgcactacacgcgcatcctgcgctacatcaagcccgacttcgtccacgtcttctccggcggccgcatcgtggagtccggcggcgccgagctcgccgacaagctggagaacgagggctacgaggcttacgcgaagcacgaagtcgacacgaagggtggcgtatccgcg

SEQ ID NO: 6306 - DNA, 1254 bp, Streptomyces avermitilis
  CDS (1)..(1254)
gtgacgcagctgccgggcctcctcgacaccgaggcgatccgcaaggacttccccatcctggaccgtcaggtccacgacggtaagaagctcgtgtacctggacaacgcggcgacgtcgcagaagccccgccaggtgctggacgctctcagtggctactacgagcgctacaacgccaacgtccaccgcggtgtgcatgtgctcgccgaggaggccacggcgctgtacgagggcgcgcgcgacaaggtcgccgcgttcatcaacgcgccgagccgcgacgaggtgatcttcaccaagaacgcctccgagtcgctcaacctcgtggccaacatgctgggctgggccgacgagccctaccgcgtggaccacgagaccgagatcgtcatcaccgagatggagcaccactccaacatcgttccgtggcagctgctggcgcagcgcacgggcgcgaagctgaagtggttcggcctcacggacgacggccggctcgacctgtcgaacatcgacgagatcatcacggagaagacgaagatcgtctccttcgtgctggtgtcgaacatcctgggcaccgtgaacccggtcgaggcgatagtgcgccgcgcccaggaggtcggcgctctggtctgcatcgacgcctcgcaggccgccccgcacatgccgatggacgtccaggccctccaggccgacttcgtggccttcaccggccacaagatgtgcggtccgacgggcatcggtgtcctctggggccgccaggagctgctggaggacctcccgccgttcctcggcggcggcgagatgatcgagaccgtgtcgatgcactcgtcgacgtacgctcccgccccgcacaagttcgaggcgggcacgcctccgatcgcgcaggcggtcggtctgggcgcggcgatcgactacctcgactccatcggcatggacaagatcctcgcccatgagcacgcgctcaccgagtacgcggtcaagcgcctcatggaggtcccggacctcaggatcatcggcccgacgacggccgaggaccgcggcgcggcgatctcgttcacgctgggtgacatccacccgcacgacgtgggccaggtcctggacgagcagggcatcgcggtccgggtcggccaccactgcgcccgcccggtctgcctgcgctacggaattcctgcgaccacgcgagcgtcgttctatctgtactccacgccgaccgagatcgacgcactggtcgacggcctggagcacgtacggaacttcttcggc

SEQ ID NO: 6307 - DNA, 465 bp, Streptomyces avermitilis
  CDS (1)..(465)
gtgaagctggattcgatgtaccaggaagtcatcctggaccactacaagcacccgcacgggcgcggtcttcgggatggcgacgccgaggtgcaccacgtcaacccgacgtgcggcgacgagatcacgctgcgcgtgaagtacgacggcgaaacgatcagcgacatctcgtacgagggtcagggctgctcgatcagccaggcctccgcctccgtgctgaacgaactcctcgtcggcaaggagctggccgaggcgcagaaggtccaggagaccttcctggagctgatgcagtccaagggccggatcgagccggacgacgcaatggaggaggtgctggaggacgcggtcgcgttcgccggtgtctccaagtatccggcgcgggtgaagtgcgccctcctgagctggatggcgtggaaggacgcgacggcccaggcgctgggcgaggccgacgccgaaaggaagacggca

SEQ ID NO: 6308 - DNA, 330 bp, Streptomyces avermitilis
  CDS (1)..(330)
atgagcgagaccattgagacgaagccggcctcggaggaagaagtccgtgaggcgctgtacgacgtcgtcgaccccgagctgggcatcgacgtcgtcaatctcggcctgatctacggcattcacgtcgacgacgcgaacatcgcgacgatcgacatgaccctgacgtcggcggcctgcccgctcaccgacgtcatcgaggaccaggccaagtccgccacggacggcatcgtcaacgagctgcgtatcaactgggtctggatgccgccgtggggcccggacaagatcacggacgatggccgcgatcagcttcgggcgctcgggttcaacgtc

SEQ ID NO: 6309 - DNA, 948 bp, Streptomyces avermitilis
  CDS (1)..(948)
atgccagaaaggcagtccgagcccactccggacgagtccgccccccgcccgtggagccccttcgcgagttcgccggcgtccgaaccgtcccaccccgggcatctgccgctgccgacggaggagccgccgacgccgtggcagccgggcggtacgccggacacctcccgcgtacccgggacccgacggctctggctggccggcgccctcgccctggccaccgtcgtcgcctgcgtgaccgcgctcaccacgacggaccacgcggccgacacctcggccgcgaaggaagccgacaccaagctggactcggccgaccccggtctcctcacgttcgcctccccctccgcggggccgagtacctaccccggcgccaagagcggccggtcgagcgagcgagccgcgcagaccactcccgacggctccgcctcggccgaccccgcccggcacggctccgcgtcgaagcccgcggccgagcggtcgaagccggcctcgtccaccggcacgtcctcgggctcgaagccctccgccgtgtggaagtccgtccggtcggtcaactaccccgaccgctactggcatctcggcggtgacaccggccggctcgaccccgtgagctccggcagctcggccacgaccaggcaggacgccaccttcaaactggtcaaggggctcgccgacgcgtcctgctactcgttcgccaccgcggacggcacctacctgcgccactcccggttccgcctgcgcgccgaccgcaacgacggcaccgcgctcttcaagaaggacgccaccttctgcccccgcacgtcgtcgtactccggcgccgtcatgctggagtcggtgaactaccccggccgctatctgcgccacaaggacttcctgctccgcctcgacccgtacgagaacaccggccagtaccgggccgactccgcgttccagctggtgaagggctgggac

SEQ ID NO: 6310 - DNA, 165 bp, Streptomyces avermitilis
  CDS (1)..(165)
gtggagccggttcttgacggcctttcactcgccgacggacacgaagcacagtcccggcagcgcgtgttcgtcggcgccgatggtgatttcgacctcgcccccgcgtgcacccgcgtgcgcccctcgccacccctcgtcaccgggcacccgcttcggacgctcgcg

SEQ ID NO: 6311 - DNA, 261 bp, Streptomyces avermitilis
  CDS (1)..(261)
atgaagtacagcgacggcttcagcaggctgtggccctcgctgctcaccgccctcggttacctcgtcgccttcgcgctgctcgcccagaccctgaagaccgtctccgtcggcacggcgtacgcgatctgggccggggccggcaccgccgccatcgcagcgatcgggatggtgttcctgggtgagggcatgaaccccgctaagctcgccgggatcgcgctgatcatctgcggggtcgtggtgctgaacatgggcggtgcgcac

SEQ ID NO: 6312 - DNA, 1338 bp, Streptomyces avermitilis
  CDS (1)..(1338)
atggccgtcgtggcggccacttccgcggtgatggcgccggccagcaggacatatcccatgcgtacgagtgtacacagcgatgcgtacggtcgtacacatcacggcccgccgtcgtgcgccgcacacgtcctgccaccgtgcgcggcaccgcgcacatccgtgcggagaacccccgcgcgacgaagccccggcacgggatatcgttcgcgatcacagtgggggcgcggagtcctgggactcccggagcatcggagcgcggaagcgatgtcgaacacagcggggtggggaccatcgggcccgtacgggggctctccgggcggctggggctgggcaccgccgccgcccccgcccaagccgggcgtgatacccctggcgccgctcggcgtggagtccatcctcggcggcgccttcgccaccatgcgccgctacgccgcgccgctcttcggcctcgccgctctcgcgtacgccgtgctgggcgccctggtcgccggcgcggcagtcatcgcctacgcggccgtacgggaccggctggaagcgctcatcgaccaccaccgcgatgtgcactgggccgacgtccagccactggtgttcgcgttcctcgccgtatgggtgttcgccatgctggccctgatggtcgcctccgccctcgtccaggcgtcctgtgtggcgacggtgcacgacgcggtactcggccggcgcgccacgttccgttcggtgtggcggcgggcctggccccgcactccctcggtcatcggtgtggccctgttgcagggcctggtggcggtggtgccgatgctgctggtggcggcggtgttcgtgtcgctcaccctcctggcgctgagctcctggtcggcgctgccggccgggatcgccttcctgctcctcctgggcgcggcgccggtggcggtctggctctacaccctgttctccttcgcgccggcggccgccgtactggaggcggcggccccggtgacggcgctgcgccgctctgcgcggctggtccgcggcgcctggtggcgggtcttcgggatcacgctgctcgccagcctgatggcggccgccatgtcgtacatggtccggcttccgctcatgttcttcacgccgaccatgcagccgtacgacacgtcgtccgggcagcccgagagcgcccgggccgtgttcgagcagatgctgcccgacctgggcgtctccctggcgatatcggcggccggcactctcctggtccagctgttcgccgcggtgttcgtgccgctgatcacgtcactcctctacatcgaccagcgcatccgcagggagggcctggccgacacactgctacgggcggcctcggctcaacag

SEQ ID NO: 6313 - DNA, 534 bp, Streptomyces avermitilis
  CDS (1)..(534)
atgcctcgtcgttacgaccccgaccggcggcagcggatcatcgacgcggcgatccgcgtcgtgggcgacaagggcatcgccgggctcagccaccgttccgtcgcggccgaggccgatgtgccgctcggctccaccacgtaccacttcaagaccctcgacgacctgatggtcgccgcgctgcgccaggccaacgagggcttcgccaaggtggtggccgcccgcggtcatctggaggacccgcgggccgacctcgccggggacatcgccgcactcatcggcgactggctggccggggaccgcacgggggtggagctggagtacgagctctacctcgccgccctgcgccgccccgctctgcgccccgtcgcggccgagtgcatcgacggtttcgcggaagccgtcgcccgccgcaccgacccggtcaccgcgcgggcgctcgtcgcgctcgtcgacgggatctgtctacaggtgctgttgacgggggcgccgtacgacgaggcgtacgcgcgcgagctgctggcgcggctcattccc

SEQ ID NO: 6314 - DNA, 591 bp, Streptomyces avermitilis
  CDS (1)..(591)
gtgagcggaccaccgccgtccacggcacgagtggacgacgatgcggaggtcgtcgcccagtcgctggagcaaccggagctgttcgcccggctctacgacaggtacgcacccgacatccaccggtacgcggcccggcgcctgggtgacggcgcggcggacgacatcaccgccgacaccttcctgaccgccttccgcatccgctcccgttacgacctgacgcgcaccaacgcgcgcccctggctgtacggcatcgcgggcaacctcatcggcaagcagcggcgcgccgaggtgcgcgcgctcaaggcgctggcccgcaccgggcacgaccccgtcgccgcgtcctgggtcgaggacaccgagagcaggatcgccgcacagggcccgctcgccggcgccctcgccgccctgcccgccggtgaccggcatgtgctgctgctcgtcgcctgggccgacctcacctatcaggaggtcgcccaggcgctggacatcccggtgggaaccgtccgctcccggctcaacagggcgcggcgcaaggtacgtacggcgctgggcgcggacccggcgttcgtgagcgacgcggcggaggtggca

SEQ ID NO: 6315 - DNA, 990 bp, Streptomyces avermitilis
  CDS (1)..(990)
atggacgagatgacccgggtgcgcgagctgcgcgccgacgcacccacacccgatcgcggccggctcgcgccggggcgcatgcggctggtcgaggcggcacggacgggggagaggcggcgcgcggtctgggcacggcgggagttcgtgatcgcgggagtggtcgccgcggtgaccgccgtcgccgtcaccgcgtccgtgctggccgacgggggcgaccaggggcggaaggcgtcgcccgcggtctccccgaacctgaacctgaaggggctgagcgccagggagctgctggaacgggcggcgacggtgctggagacacaaccgccggtgaccgtgccgaaggccaagcagtggatctacacgaagtcgatgtccgaggggcaggaccccaagctcctgaaggagatgggcgaggaggcgttcgtccaggagagctggatccggtacgacggcagcgcctccgcccaccagttgcccggcaggcactccgagcttcagatcaccaagatgcacttggagaacggcggcgagggcgacgaccgctcgccgcgggagatgtaccgcttcctgtccaccctgccgaccgacggagagggggcgctgaagaccctgcgggagaagaacgccatcgccgacgggaaggagtcccaggcggcggcggaccgtactgagatcttcgtgctgctcagcgccgacgtcatgccgcccaaggggctggcagggctctatcgcgcgctggcgacgctgccgggcgggaaggtgaccgaccatctcgtgaagaacgcggccgggcgccgggtgatcgctctgcactacggcggggacggcatcgggagcgacggccaggactggctgctcgacccgcagacgttccaggtcgtcggccagcggctgtacgcccccaagggcggggcggacggcggcaagggcgaggtggccggcggcaactcgctgatcaccaaggccgtggtggacaaggcgggccggcgcggc

SEQ ID NO: 6316 - DNA, 987 bp, Streptomyces avermitilis
  CDS (1)..(987)
atgaccgacacgactgctcctcgtaccaccggtgccgcggccgccgggctcgccaccctcgccgccgacggaaccgtcctcgacacctggttccccgctcccgaactcaccgcagagcccggcccggccggcaccgaacggctgtccgccgagcgtgccgtggagctgctcggcgagggcgccgccaaggcgctcggcccggacgcccgccggggcgtcgaggtggtcgcggtccgcacggtcatcgcctcgctcgacgagaagccgatcgacgcgcacgacgtctacctgcgtctgcacctgctttcccaccgtctggtgcagccgcacggccagagcctggacggcatgttcggcttcctcgccaacgtcgcctggacctcgctcggcccggtcgccgtcgacgacgtcgagaaggtccgcctgaacgcgcgcgccgagggcctgcacctccaggtgacgtcgatcgacaagttcccgcgcatgacggactacgtcgcgccgaagggcgtacgcatcgcggacgcggaccgggtccgcctcggcgcgcacctcgccgagggcacgaccgtcatgcacgagggcttcgtgaacttcaacgcgggcacgctcggcacgtcgatggtcgagggccgtatctcggccggtgtcgtggtcggcgacggctcggacatcggcggcggcgcctccaccatgggcacgctctccggcggcggaaacgtgcgcatcacgatcggcgagcgctgcctggtcggcgccgaggccggcgtcggcatcgcgctcggcgacgagtgcgtcgtcgaagccggcctgtacgtcaccgcgggcacccgcgtcaccatgcccgacggccagatcgtcaaggcccgcgaactctccggcgcctcgaacatcctcttccgccgcaactcggtcacgggcgcggtcgaggcccgcccgaacaacgcggtctggggcggcctgaacgagatcctgcacagccacaac

SEQ ID NO: 6317 - DNA, 618 bp, Streptomyces avermitilis
  CDS (1)..(618)
gtgcacgcgtcacaaggagcacaggggccgggcacagagtccgccggggaagagaaggtgacgatggatgccgcagggcaggagagtttccgggagttcgtggcgaaccggtcgtccgcgctgctgaagacggccgtgctcctcagcggcggggaccggcacgccgccgaggacctgctgcagaacgcgctgatcaaggcggccgaccggtggagccggatcgacgaaccggaggcgtacgtccggcaggtcctctaccggcagcaggtcagccgctggcggctgaagtggcggcgcagggagctgagcgtcgccgagccgccggaggcgagtacgggcccggacgccgcctccgccgccgagctgcggctcgtgatgcgcggcgcgctcgcccggctgaccgcccggcagcgcaccgtgctcgtcctgcgctacttcgaggatttgccggaggccgacgtggcccggatcctggggtgctccgtggggaccgtacggtccacgacgcaccgctcgctggcccggctgcgcaccctcgcgcccgaactggcggcactgggcccggccgacgccgagcaggagccgtcccgtgactactcgcccgtggaggtgcgtccg

SEQ ID NO: 6318 - DNA, 579 bp, Streptomyces avermitilis
  CDS (1)..(579)
gtgcacaggcctgccgctatgcctctcacccgcagaaattccccccggccccgcccgctcctggcgtacgttggcgaggtgagccgaccgctgctgtacctggacgtcgacggccccctcaacccgtacgcggcccagccggaacgccggcccgacggctacacgacgatccgggtggccctgacccccgggcgcccgctacgggtctggctccatcccgaccacggccgggcactgctcgccctcgactacgaactgtgctgggccaccacgtggatggacgccgcgaaccgctggatcgggccggtcatcggccttcccgacctgccctacgtcgacttcggcaccggcctcttctcgcagcgccccgacggggtccactggaagaccgaggcgctggtcgcccacgccggcgagcggcccttcgcctgggtggacgacgaacacagcccggcggacgaggcgtatgtggccgcgcaccatcccggccccgcgctgctgcgccacgtcagcccgcggctcgggctgcgcgagcccgacttcacggtactggcggagttcgcggcgacgatccgccgc

SEQ ID NO: 6319 - DNA, 1218 bp, Streptomyces avermitilis
  CDS (1)..(1218)
gtgaacgtcgatgaactggtgcgggacgccttccgtgagcaggccgcggaccacatgcccgcgcccccctacttcgccgaacgggtgctggccgtccggcgccgccgccgcacccgcaggctcgcgtccgtcgccgtggccaccgccgccgcggtcgccgtcggagtggccgtccccctcctgggcggcggcggggacgatgtgcggcccgcgagcgagatcaaccagagcgacatcatcgggcacccggaccagtccccgccgaagggcatgatcgcggcgggtgacacggtgctggccgcgttctacgtctacaagaacgtcaagcagccgaacggcgacagcgtcaccacgcgggtgtacggactcctcgaccagaacacgggcacgtaccggaagaccaagtgggccttcctggatgtcgcgcccggcacccgtaccgccgccgtgctggagggcgagttgcccgcgaagcgcatcgggctgctcgacatgatcaccggcaaggtggaccgctggattccgatggaccggggcgtcgggggtgtctccttctcgccggacggcaagaagctcgtcgccacgacgtacagcaagaaccccgaccgcaacttcgccgaccacaagcagaacgtcaacggcaaggaggtaccggggcccgtgcagagccggaccgggttcgccgtcgtggacgtggcctcgggcaagtccgactggcacaaggcatcggacaagccggacgagatgggctggttcggcaactcccgcgaggacttcgactggagccatgacggcacgctggtctacgcgaacagggcgatgaagccgtaccgcgagtactacggtctggacggggccgaggccaagtggccggccgacgagaagtacctcacctacgtcgaggcgggcctctcgcccgacgggaaactggcggcgggggatttcgccggcgacggcaaggagatcgccgccgcgatcgacgacccgaagaccggcaagcgcgtcgccaaggttccggggcagcagctcctcgcctgggccgacaacaagcgcctcatcgcctggggctgcgaccccaagaagtgctccggcaagggcgagttccgcaaccagctgctcctggtgaccatcggcaccgacaaggtcgtaccgctgagcgacttccgcaaggcgagcgacgactaccccggccggtggaccccgctgttcagctcacgc

SEQ ID NO: 6320 - DNA, 945 bp, Streptomyces avermitilis
  CDS (1)..(945)
gtggagcttcacggtcgggctgccgagactgaccgtatgaccacacaaggaaccgcacagggaaccgctcccttcggccgtgcgctctgcgcgatgatcacgcccttcaccgcggcgggcacgctcgacctcgacggcgcgcggcggctcgccgaccggctggtctccgagggctgtgacgggctggtcctgtccggcaccacgggcgagtcgccgaccacgacggacgccgagaagtccgcgctggtgcgggcggtgcgcgaggcggtcggcgaccgggcgtcgatcgtggcgggcgtcggcacggccgacacacggcacaccgtggagctggccctggaggccgagaaggcgggcgcggacggcctgctggtggtcaccccgtactacagccggcccccgcaggaggcggtcgaggcacacttccgggacatcgccgacgcctccgggctgccgctcgtcctgtacgacatccccggccgcaccggcacacgcatcgagccggccacgatgatccggctcgcggaacatccccggatcgtggcggtcaaggactgcgcgtacgacctcctcggcacccagaaggtgctggcccgcacggagttggcgtactacacgggctgcgacgagtacgtcctcgcgctgtacgcgagcggcggggccggatatgtgagcacggtggcgaatgtggcgcccggccacttccggtcgattctcgacgcgttcgacgcgggcgacccggctctcgcggcccgtctccagcaacgggccgttccgctcatcgagtcgatgatggcggccggcctgccgggcacggtcacgtcgaaggccctgctcggccggctcggcctgccctcgggcccggtccgggcaccgctgcggcccgccggccgggagacggccgacgggctgctggcgctgtacgaggagttggtcagcgtgagc

SEQ ID NO: 6321 - DNA, 858 bp, Streptomyces avermitilis
  CDS (1)..(858)
gtgccaaacgggacttcatgggtcaccatggccgggacggtcaccaacagcgggaggcgtcatgaagttgggcaaggcagtcgcgaccggggtcgcccaggagcggccgggcgcgcacgaagaggagacggaactccaagtcgccgaagccgtcgaggagttggaggcatccgctcccgaagaggtcccggtcgcgcgatgagactgcggctccccgaggaacgcccgacggagccgccgaccggatacaagatcgcccacccggtgctgtcccaggacggcacccgggtcgggttcaccggcgtctcgctgggcggcgcactgccgtacggggtcctcgacgaggcccgctgcgtctacgggctgcggcaccgggcgccgcaccgccgctgtgactgcggcttccactgcgttcacgaccgcacggaggccgaggcactgctgtgcaccgccgagcaccgggcggccgtcctgctcgaggtctccgtgctcggcgcctacatccgcttcgaacgcggcttccggtacgcccgccagcgggtgcgcaccgcgaccctcgggccctgcggctgcggggcggtggcggcggcactggccgacgccggctgggggcggccgggctggcgcgcactgaccgccgcgtgcgcggggtgcgtacgcggtcgtacgtccctgtcgcccgccgccttcgcccgactggccggagaggggctgcgggtgcgggccggcagcggtgtcgccgagcagcccgccggcctcggagtctccgaactcgtcgccgaggccgcgctgctccaggcgcgactcgactggttccagacccagttggcgcagctcgacgaacggggttcgcagggg

SEQ ID NO: 6322 - DNA, 408 bp, Streptomyces avermitilis
  CDS (1)..(408)
atggacaccaggccgcccgtgtccggcgagcaccactccgtgggcgaactcgtcggacaggccgcggaacagctctccctgctggtacggcaggaagtgagcctggccaaggaggagctggccgagaaggggcgccgggccgggcgcggcggcgggctgctcggcgcggcgggtgccgtcgcgtacgtcggggtgatggccctggccgccacgggcgtcgccgcgctctcactgacgctgccggtctgggccgcggcgctcatcgtcacggcggtgctcttcgccgtcgcgagcgtcctggccgcggtcggccgcggccagttgcgccgcgccgcgccgcccactcccgagcagacgctcgacagcgtcagggccgacgtcgacgagatcaaggaaagggcgcaccga

SEQ ID NO: 6323 - DNA, 744 bp, Streptomyces avermitilis
  CDS (1)..(744)
atgacggacgacagcacgggagcggagaccgcgaaggcgacgggcgcggagacgacgcccggagcgggcgctgcgggcgtggcgggcgagaaggccgcgaacgccaagaaggcgggagccggggcggcgcagaccgggacgagcgcgggcgccgcgaaggtgccgggcgcggctgcggccggtgagaaggccgtggggcggaagaaggcggcagccggggacgccggggcggccgcggccgagaaggccgcggacaccgtgagcggtgccggcgcggcgcgcgccggggccgggccgggcgctggtgacggtgccgatgccgcacgggccgccggggccgaggggccgcaggagctgcggcggcagatcgccgagacgcggagccaactcggcgacaccgtcgaggaactggcggcgaaggcggatgtgaagggccgggcccgggcgcgcgccgcggacctcagggaccgggcgggcgcgctgacggtccagttgcgcagtacggccgcgcacgccggtcacatcgcccaggacagggcggtccgggccgggcacaccgtgcagggcaccgcgggccgggccgggggtgccgtacgggacaccgtgccggggcccgtgaagacggccgccaccgcggtcgtccaggccggtctgcgccatcgccggccggtgctgatcgccggcgccggcgcgggcgcgctggtcgcggccggcctgctgcgacggcggcagggcggacgccac

SEQ ID NO: 6324 - DNA, 1824 bp, Streptomyces avermitilis
  CDS (1)..(1824)
ttgccgagcaagtcttccgcgcgcctcgccgcgctcaccgtcgcagccgtctgttccacggtctccgcggtggttctcacatcgcccgcccaggcggacagtgtgcacatccacgacatccagggcaccacccggctttccccgctcgccgggcagaaggtcaccgacgtggcgggcatcgtcacgggtgtgcggacctacggttcctcgaaggggttctggatccaggacccggccccggacgccgacccggccaccagtgagggcgtcctggtcttcaccagttccgccccgaaggtcgccgtcggcgactcggtcacggtgtcgggcacggtctcggagtacgtcccgggcggcgccgcgagcggcaaccagtcgctgacggagatcacgaagccgacggtgacggtgctctccggcggcaacaccgttccggcccccgccgtcgtcgacgcggggtcggtgccgagccggtacaccgccgccggtgacacggccgcgggcggctcgatcaacggcctcaccctggagccggccaagtacgccctggactactacgagtcccttgagggcatgaacgtccaggtcgccgacgcccgcgtggtcacggccaccgacccgtactccgagctgtgggtcacggtgaagccgcgcgagcacgccaaccgccgcgggggcacggtctacggctcgtacgagtcgcagaacaccggccggctccagatccagtcgctgggctcgaccgcggacttcccgaccgcgaacgtgggtgacgagctcaagggcaccaccgcgggcccgctggacttcaaccagtacggcggctacacgctcgtcgccaaccagctcggcaccctggagaagggcggcctggcccgggagacgacccgtaagcagtcgcgcggcgagctggccgtggcgacgtacaacgtggagaacctggacccgtccgacgccaccttcgcggaccacgccgccgcgatcgtgaacaacctccagtcgcccgacatcgtgtccctggaggagatccaggacaacaacggcgcgacggacgacggcacggtcgccgccgaccagacggtgcggaagctgatcgacgcgatcgtggcggcgggcggcccggcgtacgaatggcgctccatagacccggtcaacgacaaggacggcggcgagccgggcggcaacatccgccaggtcttcctcttcaacccggaccgggtgtccttcaccgaccgcgcgggcggcgactcgacgaccgccgtcggcgtgacgaaggtgcgcggcaaggcgcagctgaccgtgtccccgggccggatcgacccgtccgacgcggcctggaacagcagccgcaagccgctcgcgggcgagttcgtcttccgcggcaggacggtcttcgtgatcgccaaccacttcgcctcgaagggcggcgaccaggggctggccgcgcagtaccagccgccggcgcgcagctcggagacgcagcgccacttgcaggcgaccgcggtgaacgcgttcgtcaaggacgtcctcgacacgcagaagaacgcggacgtcatagccctcggcgacatgaacgacttcgagttctccgacacggcgaagatcctcgagggcgacggcgagctctggtcggcgatcaagtcgctgccgaagagcgagcgttacacgtacgactaccagggcaacagccaggtcctcgaccagatcctggtcagcccgtcgatccggcgtggctgcgacgtcgactacgacagcgtccacctcaactcggagttctccgaccaggtcagcgaccacgacccgcaggtcctgcggttccgtccg

SEQ ID NO: 6325 - DNA, 1443 bp, Streptomyces avermitilis
  CDS (1)..(1443)
atgtcagacagctcctccttgccgccggttcggctgcactccgaagcggagctcgcgcgggacgcgctcgccaccccgttgttctcccgcgccgcgcgcctggcccgctgggccggtccggacacccgcgtcggcgtcggcggtgaactcgaggaggagcagcttcccggggcggccgaagcgctcgggctcgcgggcgacgacgcggcggccctcgcgagcgaggcctggcgggtcgctgtcgacacggggctcgtcgtgatcgtggacgaggaggagggcacggtcgccgcggcaccggacctcgcgctgctcacctccggaagcccgcacgacgtgctcgggttgtggctcggggcgctggagacggtgctggccgacgcgagcgtgcccgatctcgacgacctcggcgacgcgatggacgaggacggcacgatcgacttctccgaactcgactgggatctcgaggcggaggcggagttcctcgacggagtgctggggaacctctatctgctgacggtcggcgaggagggccccggcgaccatcccgtgccgctgccggccctcgccgcgtcgatgatcgtgcccgacgacatgggggagcccaccaacgacgtcctggagcaggtctcggacgcgatgatgcggctcgacgaccagttccggctgctggagccgatcgggctcgtcgagttccggccggtcgacgaggcgctgatggcggacgccgaggacggcgaggacgccgcggacgagccggccgcgccggtcgacgacacggacgtcagccggtacgggatggtgcggctgacaccgctcgggctgtacgggctgcgggcacggctgctcgaggccgggatcagcgcgcccgcggtgggggatctggtcgacaagggtgcggacgcgctgctcgacggcacgtccacgttcccgccgatggcggcgcaggcggagaccgagcagtggctggcgcggcgcgaaccgctcacggcggcacgggagttgctggcggcggcgcggggcggggacacgggtgcgccactgcgccggctgcgctgccagcaggcgctgtcactggtcggtacggaggcggagccggcgcttcgggaggtgctggacgacgcggagctgggcggcctcgcccgggtctggctcgcggagcggggagcggccgacgtgcccgcgcccccggagtcgatggtgttctggctgaccatcgacacggtggccgcgcagctggcggccgaggggaactcgacggaactccaggcgctggtggaggggctggcccagcagcacagcggcttcttcgcgacggcgtggcgagtggaccacccggccacgccggacgtcttggaggcgatgggccgactgcacccggacaagaaggtggcgaaggcggcccggaaggcggcgttcaaggcgcggtcgcagcaagggggt

SEQ ID NO: 6326 - DNA, 1467 bp, Streptomyces avermitilis
  CDS (1)..(1467)
atgtcgctcacccgcagggacttcgccagacgatccgcgctcaccggcgccggcgtcgccctggccggcagcgtcggcgccctcgccaccgcgccgaacgccctcgcgtccaccgacaccgagagcgcgggcgaggaatccgcggaccggcacggcagcgtcggttacggcccgctgatccccgacccgaagggcatcctcgcgctgcccgccgggttctcgtaccgcgtcatcacctacagcggaaagaccaagctggagtcgggcgagttcaccccgtccaaccacgacggcacggccaccttcgacggcccccggggcgccaccctcctcgtcaacaaccacgagctcaagggcccccgcgccaactggaagtacccggtccccctcaccgagggcctcgtctacgacccggccgcggccggcggctgcacggtcgtcgaggtccgccgcgacaaggtcgccgagtgggtcggcatcgccggcacctccaccaactgcgcgggcggcagcaccccctggggcacctggctcaccggcgaggagaccgaggacagggccggccagaacggcatgaccaaggaccacggctacatcttcgaggtggatccggaagaccgccgccgcaaccgggaccccaagcccgtcaaggctctcggccgttacgcccacgaggccgtcgtcgtcgaccccaagcgcggccggctgtacctgacggaggacgcgtccactcccaacggcctcctgtaccgctggaccccgccgcagggcttcgagcacggccacggccggctgcgcaccctcgccgacgacgcgggcgccctccaggccttcaagtgcttcgactccggcggccggttcgtcgacgacctctcccgtgccaccaggatcggcaccgtgtacggcgtcgactgggtggacgtaccggaccgggacgccaagacggtgtccgtccgcaagcagttcgccgccggagaggtcacccgcgcccgcaaactcgaaggcatgtggtggggcgacggcggcgtgtacatcgtctcctcgtacgcccgcgaggagagccccgtccagcacgacggccaggtctggttctacgaccccaagcgccgcacgctcaccctgaaggtgctcctcggggtgaaccgggacccgtccgccgacggcgccttcgacgggcccgacaacatcaccgtctccccctacggcggcctcgtcatcgccgaggacggcgagggcgtccagcacctgttcggcgccaccgacagcggccgtacgtacccgatcgcccgcaacgacctcgcattgacaccagccgctgccgcagcgggcggcaccgaagcggagccgtcgtacagcgagttcaccggcgtcaccttctcgcccgacggcaggaccctgttcgccaacatccaggatccgggcatcatgctcgccatcaccggcccctggaagcgccagaagcgcggg

SEQ ID NO: 6327 - DNA, 1581 bp, Streptomyces avermitilis
  CDS (1)..(1581)
atggcgcgattcaacaagaagacggcgaaggcgcagcccacctcgcgcgtgacgtcgacggggcaggtgctccgtacccaccagggcggccgcggccaggagcgcgacgtgcgctcggagctgttcctgctcgccctcgccaacttcgtctcgcagcagaccttctacgagaccggcgcggcccgcgacgaccggttcgccgcactcgtgcgcgagctggccgtggccgacccgtcgtggacggccgcgctgctcggctggctgcgcggcgagggcaacctccgtacggcctccctcgtcggcgccgccgagtacgtcaaggcgcgcctcgacgcgggcgtgaccgacggcccgtcgaaccgcgaggtcgtcgcctccgtactgcgacgcccggacgagcccggcgaactgctcgggtactggacctcgcagtacggccgcgcggttcccaagcccgtgaagcggggcatcgccgacgccgtacggcgtctgtaccacgcgaagtcgctgctcaagtacgacaccgcgtccaagggctaccgcttcggcgacgtcctcaacctggtgcacgcggcgccggacccggacaagccgtggcagggcgacctgttccagtacgccctcgaccggcggcaccacccggacacggccgtggtcccgaagacgctgcccgtgctcgtcgcccaccgtgacctgatggagctgcggcccgccaagcggcgcaaggtcgtgaccggagcgcacggcgcgcagcgcctggcggacgccggcatgacctgggaggcgctggccggctggttgcagggcccgatggacaaggcggcctgggaggcggtcatcccgtccatgggcgcgatggcgctggtccggaacctgcgcaacttcgacgaggcgggcgtctcggacgaggtggcggcccaggtcgccgcgaagatcagcgacccggcggaggtggcgcgctcgcggcagttccccttccggtacctcgccgcgtaccagcacgcgccgtcgctgcgctggtcgtacccgctggagcaggcgctcgcccactcgctgggcaacgtgcccgcgctgccgggccggacgctggtgctcgtggaccgttcgggttcgatgttctactcgcgtctttcggaccgttcggagctcaaccgggccgacgccgcggcgatcttcggtacggcgctcgcgctgcgggcggcggacgcggatctggtggagttcggcacgagcagcaacgccgtgaagttccgcaagggcgagtcggtgctcaaggtgctcgaccgcttcggcgacctcggcgggacgaacaccagcgaggccgtgcgccggcactaccggaagcacgaccgggtgctcatcgtcaccgacgagcaggcggcgtacagccatcacggcgacccgaccgagcaggtaccggccgacgtcccggtctacacctggaacctggcgggccaccgcgcgggccacggcccgtccgggacggcgaaccggcacaccttcggagggctctcggacgcggccttccggatggtgccgctgctcgagggagcgcgggacgccgactggccgtgggcggcc

SEQ ID NO: 6328 - DNA, 1452 bp, Streptomyces avermitilis
  CDS (1)..(1452)
atgtccaccccgtccaccccgcccgcgtccaccaccggcccaccgcgggcggacccgcaccccgccaggctcggtgccgtcctcttcgtcatcgtcaccgcctacttgatggtcggcgtcgactccaccgtcgtcaacgtcgcgctgcccgacatccagcgggacctgcgcttctcgcccaccggtctgtcctgggtcctgaacgcctacacgctcgccttcggcggcctcctgctgctcggcggccggatcggcgacatcgcgggccgccgccgcaccctcacctgcggtgtcctgctcttcgccctctcctcgctgctcggcggtctcgcgggcgagagcggctggctgctcgcggcccgcgccctccagggcatcggcgccgccctcaccgcccccagcaccctcgccctgatcaccaccaacttccccgacggcccgcgccgccaccacgccctcggcgtctacacctcgatggcgagcatcggcgcctccatcgggctgatcctgggcggcatgctcacctcctgggcctcctggcgctgggccctgctgatcaacgtaccgatcggcatcggagtggccctcgccctcccccgcttcgtcgccgagaccccgcgccacgcgggccgcttcgacgcggcgggcgcactgaccggcacggcgggcacgacctcgctggtctacgcgttcatccgggtctcggagcggggctggagcgacacccgggccctgctcggcttcacgaccgcggccgcgctgctcgcgggcttcgcacgggtcgaatcccgcgccggccagccgatcatgccgctgcgtctcttccgcgaccgcaaccgcgcgggcggctacgcgggcgtactgctgctgccggccggcatgttcggcgccttctacttcctcacgctgttcacccaacaggtcctgggatacggcccgttgcgcgcggggttcgcgttcctgccgatgacgctcgcactgttcgccaccgtgcgcttcgtgccgcgtctcctccagcgccacggcgccaagccgctgctgctcatcggcacgacgctgctcgtggccgcggccggctggctgtggcggctcgagcccggcgacggctatgtcaccgggctgctcgggccgctgatcctgatgggcatgggcgtcggcatgagtttcatgccgctcaacgccacgatcctcgcgggcatcgaaccacgcgacgcgggcgcggcctccggcctgttgcagaccctgcaatggctcggcggcaccctcggcctgtccgtcctggtcacggtgtacggcacggcgacccggcacgcgaccggctccccgtcggcgatcctcaccgagggtgcgtcccgggcgttcggggtgggctcgctggtagcggtgaccgcgctgctggtcgtggcggtggtcatcaccggacgccggccgaaggatcagcacggcgcccgg

SEQ ID NO: 6329 - DNA, 603 bp, Streptomyces avermitilis
  CDS (1)..(603)
atggcgcaggtcaagcccatgcgtgccgatgcgcggcgcaactatgagcggctgatcgaggaagcggcggtcgccttcgccgagcatggggaaggggcgtcgctcgacgacatcgccaagcgggccggggtcggctcgggcacgctgtaccggcacttcccgaaccggcaggcgctgctggaggccgtgtacgtcgacgccatcgaggcgatcgcgatgcgggcggacgagatcgcggcccggctgcccccgggtgaagcgctggtggagtggctgaacgagctgagcgagcggatgatccaggtccgggggctcaagacgctgctgggctcggccgtgacggacgggagttccgccgtgctcaccgcctgcggcagctccgtgaagggcgccgcgacccggctggtcgaggcggcccagcgggaggggaccgtccggccggacgtcgagccgatcgagattctgcggctggcgcacggagtggccacggcgtcggaactggcgaacggggaggggaagcacatccggcggtatctgtcgctgctcacggaggggctgcggccggaacgccgacgggcggacggcgggccggggccggagaac

SEQ ID NO: 6330 - DNA, 1206 bp, Streptomyces avermitilis
  CDS (1)..(1206)
atgacagctatgacccccggctcgaacatccctctccccgtcacccgcgtgacggtggacgtcgccgcccccgtgcggctcgacgtttcgggcctgctgctcaccgccgacggcaaggtgcgctccgacgacgacttcatcttctacaaccagcccaccggcccgggcgtgacctaccgctcgggtggcggcacctccccggacgcgatcacggtcgacaccaccgccgtccccccgggcatcgagaagatcgtcgtgaccgcgagcccggacgccgccggccagaccttccagggcatcgaacccacggccacgctccgcaacgcggacgacaactccgtactggccacgttcacgcccccgcagctcggcacggagacggcactggtggtcgtggagatctaccagcgcaacggagcgtggaaggcccgcgcggtgggccaggggtatgcgaacggcttggcgggcatcgccacggacttcggcgtcaccgtggaggaaccggccgccgcgccggcgcccgccgtccagcccccggtgactgcgccggccccgcccctggacccgcgcgtctccgcacccccggtcccggccgccccgccggcaccccccgcgcccgcccccggcgccggcaagatcaacctggacaagggccgggtcagcctccagaagaaccagaccgtctccctggtcaagggcggccgtcccttgctcacccaggtcaagatgggcctcggctgggagcccgcgtaccgcggcaaggacatcgacctggacgcgtcggtcatcgcgtacggcccgcagcgcaaccacatcgacagctgctacttcggcaagctgtcgatcgtgaacggcgcgatcaagcactccggggacaacctcacgggtgagggcggaggcgacgacgaggtcatcgtcgtcgacctcggccgtctcccccaggaggtcaccggcctggtcttcacggtgaactccttctccggccagaagttcaccgaggtcgccaaggcctactgccgcctcgtggacgccgccacggacgaggagctggtccgcttcgacctcaccagcgccgagccgcagaccggcgtcatgatggccaagctgatcaagcagttctccggcgagtgggagatgacggccctgggcgacttcgtgaagtcccgcacggtccgcggcatggtgaagccttcggcgcaggcgctg

SEQ ID NO: 6331 - DNA, 987 bp, Streptomyces avermitilis
  CDS (1)..(987)
atgaaggccgccgtcatcgagtccgtgggcaaggccgtcgtcgccgaggtcccggacccgacgccagggccccgggaggtcgtcgtcgaggtcgcggcctgcgggctgtgcggcaccgatctgcacatcctccagggcgagttcgcgcccaagctgccgatcgtgccggggcacgagttcgcgggcgaggtggtcgggctgggcacccaggtcaccgaggtgtcggtcggcgaccgggtggcggtggacccgtccctctactgctacgagtgccggtactgccgtacgggccacaacaacctctgcgagcgctgggcggcgatcggggtgacgacggcgggcggcgcggcgcggtacgcggtggctccggtcgccaactgcgtcaagctccccgaacacgtccgcacccaggacgcggccctgatcgagccgctgtcctgcgcggtccgcggctacgacgtcctgcggtcccggctcggcgcgcacgtcctggtctacggctccggaacgatggggctgatgatgctggagctggccaagcggacgggcgcggcgagcgtggacgtggtggacgtgaacccggcacgcctgacgacggcccggcagctgggtgtctccggctccgccgcgaacgccgacgaactggaccggccgcaggggtgggacgtcgtggtggacgcgacgggcaacgcggcggcgatccaggacggcctcggccgggtggcgaaggcgggtacgttcctccagttcggggtcgcggactacgcgacgcgcgtgacgatcgacccgtaccgcatctacaaccaggagatcacgatcaccggttcgatggccgtgctgcacagcttcgaacgggcggcggagctgttcgccggaggcgtcctcgatccggacgtcttcatcagcgaccgcatcccgctggcgcggtatccccaggcgctggagcagttcgcgtcgggggtggggaggaagatcgtggtggtgccg

SEQ ID NO: 6332 - DNA, 867 bp, Streptomyces avermitilis
  CDS (1)..(867)
atgagtgccaccgcgccacgcgtacgacccgtacgccccgtacgcacccgtctcacccggggagcgggcctgggcctggtggcctggctgctcggtctgctgttcttcctgcccatcgcctggatggcgctgacgtccttccactcggagtcggacgcggcgaccaatcccccctcgttcggcgccgccctcaccctcgacggctaccgcgacttcttcggcacgggaggcggcgcgagcccctggccggcgctggtcaactccctggtggcgtcgctggtctcgacgctctgcgtgctgctgctggccttcccggcggcgtacgcgctctcgatccgcccggtgaagaagtggacggacgtcctgttcttcttcctgtcgacgaagatgctgccggtcgtggcgggcctgctcccgatctacctgttcgcgaagaacaccggaatgctggacaacatctggctcctggtcatcctctacacctccatgaacctgccgatcgcggtgtggatgatgcagtcgttcctcgccgaggtgccggtggcggtgatcgaggcggcgcagatcgacggcgcgaaactgccgacgatcctggcccgggtcgtagcccccatagccctccccggcatcgccgccacggccctgatctgcttcatcttcagctggaacgagctgctgttcgcccgggtgctcaccggtgtggtcgccgagaccgccccggtcttcctgaccggcttcatcaccagccagggcctgttcctggccaaggtgtgcgccgcgtcgctcgtcatctccctgccggtgctcgccgcggggttcgccgcccaggacaaactggtccagggcctgtcactgggagccgtgaaa

SEQ ID NO: 6333 - DNA, 936 bp, Streptomyces avermitilis
  CDS (1)..(936)
atgaccgccacgacaacggcccccgtggccgccgctcccgtccgcacgacgcggcagccctccacccggctgcgcgcctgggccacccgggccccgctcctgcccgccctgatcttcatgatcgccgtgacccagctgccgttcgtggccacgctggtgatctccttcttcgactggaacgcgctctacccgaaggcccgccacttcacgggcgtcgacaactaccaccaggtcctggccgacccggacctgcgccactcggtgtggacgacgatcctgctgacggtcaccgtggtgctcgcctgcctggtcctgggcctgggcctcgccctcctcctggaccgcaggttccggggccggggcgtcgtccgtacgctcctgatcgcgcccttcctggtggtcccggtggcggcggccctcctgtggaagcacgtgctctacaaccccgagtacggccttctcaacggcctgctgcactacgtgggcggtccccagccggactggatctccaacaccccgctgctcgcggtcgaggcctccctggtgtggcagtggacgcccttcatgatgctgatcctgctggcgggtctgcagagccgcgaccagcagcagatcgaggcggcgcgggtcgacggggcgagcgactggcagatcttccgccacctgacgctcccgcatctgcgccgctacctcgaactgggcgcgctgctcggctcgatctacatcgtgcagaacttcgacgcggtcttcaccatcacctcgggcggcctgggcaccgcgaacctgccctacaccgtctaccagagcttctaccaggcccacgagaacggcctcgcctcggccgccggcgtcctggtcgtcatcggctcgatcatcatcgccaccttcgcgctgcgcgtggtgtcgtccctgttccgcgaggaggtgtcccgcgca

SEQ ID NO: 6334 - DNA, 1368 bp, Streptomyces avermitilis
  CDS (1)..(1368)
atgcgaacccagagccgacggaggccgcgagccacgctcgccatggccgccgcagggacgctgctcgccccgctgctttccggctgttgggtcggagcaggcgggtccggttccggcggtgactccatcaacgtgttgatggtcaacaacccgcagatggtggagctgcaaaagctcaccgccacgaacttcaccaagaagaccggcatcagggtgaacttcaccgtcctgccggagaacgacgtccgcgacaagatcagccaggatttcgccaaccaggcgggccagtacgacgtcgccaccctcagcaactacgagatcccgatctacgccaggaacggctggctgcactccatggacggctacgtccggggcgacaccgcgttcgaccagcaggacatcctcaagccgatgcgccagtcgctgaccggcgacgacggccggctctacgggcagcccttctacggcgagtcgtccttcctgatgtaccgcaaggacgtgttcgccgagaaggggctgaaaatgcccgcgcacccgacctgggagcaggtgaacaagctggccacggacgtggacggcgcccagtccggcatgaagggcatctgtctgcgcggactgcccggctggggcgaggtcatggcaccgctgaccacggtcgtgaacaccttcggcggcacctggttcgacaagaactggaaggcgcgcctggactcccccgagttcgagaaggcgacgcggttctacgtggacctcgtccgcgcccacggcgagtccggcgcggcccagtccggcttcgccgagtgcctcaacaacatgacgcagggcaaggtcgccatgtggtacgacgccacgtccgcggcgggttccctggagtcggccaagtcaccggtcaagggcaagatcggctacgtacccgcaccggtcgagaagaccaggtcgtccggctggctctacacctgggcctggggcatgcagaaggcgtcccgcaacccggacaaggcctggaagttcgtctcctgggcgtcgagcaaggagtacgagcagctcgtcggcgacacggtcggctggtcggacgtccccgcgggcaagcgggcgtcgacgtacacgaaccccgactaccgcaaggaggccggcgccttccaggagatgacccgcgaggccatcgagggcgcccggcccaccgaccccggtgtgcagccccgccccgcgcccggcatccagttcgtcggcatccccgagttcaccgacctcggcaccaaggtctcccaggagatcagcgcggccatcgccggacgccagtccgtcgactcggccctgaagaagtcccagaagctcgccgagcagatctcgaaggagtacgagggacga

SEQ ID NO: 6335 - DNA, 786 bp, Streptomyces avermitilis
  CDS (1)..(786)
gtggcggccatggcggcgaagacgacgcggaccgcggaggaacggcagcgcgagatcgtccgggccgcccgggtcacgggttcggtcgacgtcaccgcgctcgccgccgaactgggcgtggccaaggagaccgtacgccgggatctgcgcgcactggaggaccacggcctgctccgccgcacccacggcggcgcctaccccgtcgagagcgccggcttcgagacgacgctcgccttccgcgccaccagtcacgtacccgagaagcgccggatcgcggccgccgcggccgagctcctcggggacgccgagaccgtcttcgtcgacgagggcttcaccccccagctgatcgccgaggcgctgcccagggaccggccgctgaccgtggtcaccgcgtcactggccaccgcgggagcgctcgcggaggccgagaacaccagcgtgctgctgctgggcggccgggtcaggccgggcacgctcgcgaccgtcgaccactggacgacgaaaatgctggccgggttcgtcatcgatctggcgtacatcggcgcgaacggcatctcgcgcgaacacggactgaccacccccgacccggcggtcagcgaggtgaaggcccaggcgatccgggcgtcccggcgtacggtcttcgcgggcgtgcacaccaagttcggggcggtcagcttctgccggttcgcggaggtcggcgacctggaggcgatcgtcacgagcaccctgctgccgacgtccgaggcacaccgctactcactgcggggaccccaggtcatccgcgtc

SEQ ID NO: 6336 - DNA, 807 bp, Streptomyces avermitilis
  CDS (1)..(807)
atgcccgctccccgcaccgttctgctcaccggcgccgccggcggactcggcaccctgatgcggggactgctgccgcggtacggctacgaactgcgtctcctcgacctgctgccgatcgagggcgagccggacgcgatcaccgcggacctcggggacaaggaggcgctgcgcgaggccgtacggggcgtcgacgcggtcatccacctcgcgggcatctccctggagtcctccttcgacaagatcctgaaggcgaacatcgagggcacgtacaacctgtacgaggccgcgcgcgaggaaggcgtacgccggatcgtcttcgcctcctccaaccacgcgatcggcttcactccccggccccggggcgacgaccccctgatcccggtcgacaccccgcgccgcccggacacgttctacggcctgtccaagtcgttcggcgaggacctggcccagttctactgggacaagcacggcctggagacggtctccgtgcgcatcggctcctgcttcgccgagcccacgagcgtgcgcatgctctcggtctggatgagccccgaggacggcgcccgcctcttccacgcggccctgaccgccgaggacgtacggcacaccgtcgtccacggctcgtccgcgaacacccgcctgtggtgggacctctcgaccgcccgcgcgctcggctaccagccgcaggacgactccgagccgtacgccgagaagctcatcgccgaacagggcgagctggacccggacaacccggcccacgaccacctgggcggccacttcaccaccgacccgccggtctggccgtac

SEQ ID NO: 6337 - DNA, 939 bp, Streptomyces avermitilis
  CDS (1)..(939)
gtgacgtcagcacctctcgccgctcgactcagcatccccagtggcccgctgttcttccccgtcaccgcctaccgtccggacggcgcgctgaacctcgacgtctaccgcgagcacgtgcgccggggtgtcgaggcgggcgccgccgccgtcttcgcgtgctgcggcaccggggagttccacgcgctggcgcccgaggagttcgagcgatgcgtcggcgcggccgtcgaggagaccgcgggacgcgtacccgtggtggcgggcgcgggctacgggacggccctcgccgtgcggttcgcgcggctcgcccaggacgccggggccgacgggctgctcgccatgccgccctatctcgtcgtcgcggggcaggaggggctgctgcggcactaccgggagctggccgcggcgacctccctggagacgatcgtctaccagcgcgacaacgccgtcttcacccccgaggccgtggtcgagctggcccgcacggacgggatcatcggcttcaaggacgggctcggcgacctggacctgatgcagcgcgtcgtgagtgccgtgcgcaccgaagtcccgggcgacttcctgtacttcaacgggctgccgaccgccgagctgaccggcctggcctatcggggcatcggcatcacgctctactcttctgccgtgttctgcttcgcgccggagatcgccctggccttccacaaggcgctgaactccggtgacgacgccaccgtcaaccggctgctcgacggcttctaccggcccttcgtcgatctgcgcgcgcagggccgcggctatgccgtctcgctggtcaaggcgggggtacggctgcgcggcctcgacgtcggcgaggtgcgcccgccgctgcacgagccgaccgaggaccacgtcaaacagctggcgcagctcgtcgaccgcgggtacgcgctgcttcaggagggcatg

SEQ ID NO: 6338 - DNA, 1230 bp, Streptomyces avermitilis
  CDS (1)..(1230)
gtgaaggcatccgcattcgtctatccctgggatgtcaacggggatccggcggcggccgagcggatcgccgggctcggcgtaccccaggtgacgctcgcgtccgcgtaccactccacgcgcgcgctgaccccccgccacccccgccaccggatcgtcaccgccgaacacgccgccgtgctctacccgccgggcaagcggtggaagggccggactctgcggccgtacgccgccggggactgggcgctgggcgacgcgtacggggaggccgccgaggcgctggccggggccggactcgacgtgcacacctgggtcgtgctcgcgcacaactcccgtctgggcgaggagtttccgtgcaccaacgtggtcaacgcctacggggaccgttatccctgggcgccctgcatcgcacagcccaccacgcgcgcgtacctggtcgacctcgcggcggaggcggcggtacggcccggtgcgcgcggtacggaactggagtcgctcggctggtacggactggcgcatctgcacgcccacgacaagatcggcgggacggggctcggggacgccgggcagtacctcatgtcgctctgcttctgctcggcctgccggcaggggtacgcgggtcgggaactcgacgcgggcgcgctcgcggtggccgtacgggcggccctggagcccgtgtggcgcggcgccccgtccgacgggggctggacgacggtcgagaagctcctgggcagtgaactcgcgacggccacgcgcgcgtggcgcgaggaaacggcgcgcacgctccaggaggcggccgtcacggcggtccgcgcggccgccccggacggcttccaggtcctgctgcacgcggacccggtggcgtaccactgcggggcgaacgccggggtcgacccggcgcacatcctgtccgtcgcggacggtgtggtcgtgccgtgcacgggcggcgcggccctgctcaccccgttcgccgagcagggcaccggcgccgtgctcgcggccaacctcaccgtcgtctcggggatgggcggcagcccgggcacactggccgaggacgcggaccgggccgctcgtctgggcgccacggaactgcggctctaccacgcggggctcgcctcggacgccgacctggccacggttcaggaggcgctggcacggctcggccgggcacccgcgcgcagcggcaccgacgctgtcgccagcagggcgagacccagcagcaccaacagcgtc

SEQ ID NO: 6339 - DNA, 1200 bp, Streptomyces avermitilis
  CDS (1)..(1200)
atgacatggacgatgacgcgtgtcctgagggaccgcaacgcggggttgtacctggccggggtggtggtctccggcttcggatcgtcggcgatgtggctggcctcgggcatctgggtcaaggacctgaccggttcgaacggcctggccgcactgtgcgtcttcgccctctgggcacccacactcgtcggccccgtgctgggcacactcgccgaccgcacccgccgccgcccgctcctgatcggcacgaacctgggcgtggcggccctgctgctcgccctcttcaccgtggactcgccgggcagtctgtggctgctgttcgcggtcctgctggtgtacggcgcggccggcgtggtccacgacgcggcggagtcggccctggtggccgccgccgtcgacagctccctgctgggcgacttcaacggcctgcggatgacggccaacgagggcatgaagctcgtggcaccgctcgccggggcgggcctgtacgcggcgtacggcggcgcgatggtcgcccttctggacgcggtcaccttcgtgctggcggccggcctgtacgcgctgctgcgggtgcgcgaggacgggccggagccgccgcccgacggcctgcgggcgcgggtcgccgagggcgtgcgccatctgtggggccggggggagttgcgcccgctcgtcctggcgggcggcgcgacgatgctcttcgcgggtgtcaacggcgccctgatctacgcggtcgtcgacggcctggggcgctcccccgcgtacgtcggcctgctgtacgtcgtccagggcgccggctcggtgacgaccggcctggccgcgggtcccctcctgcgccggctcggcgaacgccgcttcgcctcgtccgggatcgcgctcaccgcggcggccctggcgctgcgcgcggtcccgtccgacgcggccgccctgacgtccgcggcggcggtgggcgccggccttccctgtgtgctgatcgccgcgttcaccgccgtgcagcgcgagacgcccggcgccctgctcggccgggtcacggccaccgcccacacgctgatgttcgcgccgaacgcggtgggactcgccgtcggggcaggtctggtcggactcgtcgaccgtcagacgctgttggtgctgctgggtctcgccctgctggcgacagcgtcggtgccgctgcgcgcgggtgcccggccgagccgtgccagcgcctcc

SEQ ID NO: 6340 - DNA, 588 bp, Streptomyces avermitilis
  CDS (1)..(588)
atgactgaccacacgaccctcgacctcggcccgcaggcccgcatcgtggcgcgtctcgcggaggcggtgcgtgaggagcagctcacggccgtcactccgtgtcccggctacgcggtgcaccacatgctgggccatctgctcggcctcaccgtcgccttccgggacgccggccgcaaggacctgggcgccacgacggacaccagccctgaagccgccgtgccggacatcggaccgggctggcgcgaggagctgcccaaagtgctcgacgaactcgccgagacctggcgcgacccggccgcctggaccggtgagacccgggccggcggcgtgaccctgccgggcgcggtcgccggggcggtggtggccgacgaactggtgatccacggctgggacctggcgcgggccaccggccaggagtacacgccggaccagggcgcgctgcgggccgcgtacggcttcctggtcgccgcggccgaggacccgagccgcggcggcggcatcttcggccccgtcgtgcccgtaccgcgggacgcgccgctgctggaccgcgcgatcggcctgagcggccgggaccccggctggaagccc

SEQ ID NO: 6341 - DNA, 750 bp, Streptomyces avermitilis
  CDS (1)..(750)
atgcccctcgccctcaccgtcctcggcaccgcttccccgcacccggcgccgggccgcccctcctccggttatctgttgcgcggcgggggcgccgaggtgtgggtggacgccgggttcggaaccttcgcggagttgcagcggcacacggatcccgcgcggctcacggccatctggatctcccatctgcacgcggaccacagcgccgatctgctggcggcggtgtacggactcgcgtacggagggctcaccccgccggcgccgattcccctctacgcgccgcgcgcctgcgggcagcggctcgccgggttcttcgggcggcccaacgagcggttcctcagcggggtcttcgacttccgtcccttgtacgacgggcacaccgtccggcactggaacctccgtctcaccgcccgcgccgtcgcgcacgacatcgaggcgtacgggctgcgcgccgagtgccaggggcgcgtcctcgcgtactcgggggacagcggcccgtgcgggacgctcaccgaactcgcccgcggtgccgatgtgttcctctgtgaggccgacatcgaccggcatcgcgaaggcgaacaggtccatctgacccccgaggacgcgggggcggcggcccgggaggcacgggtgggtgagctgctcgtgacccacgtgggacccacgctcaccccggaggcggcggccggacgcgccgccgcggtcttcggccgtcctgccgtcaccgcccgcgaaggcaccaccacaatcgtc

SEQ ID NO: 6342 - DNA, 654 bp, Streptomyces avermitilis
  CDS (1)..(654)
atgacctctgtgcccaccccgatcccgtcccgcacgcagtacgtgctggaggggatcaaacaccgcatcctcaccgggcagctgacgcccggccaggccctggtcgagaccgaactggccgcacagttcggggtgtccaagacgcctgtgcgggaggcgctcaagaccctggccgggaccgggctcgtcgtgatgaaccagtacaagggcgtcacggtgcgcatggtggacgcggacatggcgcgcgaggtgtacgacgtgcggctgctcctggagcccgaggcgctgcggcgcgcggtgcggcgcggcgcctccctggccgcggcccgtgacgcgctcacccgctccgaccgggccgccgacaccgccgaacgctccctcgccaaccgggagttccaccgcgccctctatgtgtgctgcggcaacccgctgctcggccggatgctcgacgaggtccgcgaccaggccgcgctcgtctccgccgtggcctgggccgccgacccctcctgggagcgcgaggccgacgagcaccgggagatcctgcggctcgccctggacggggacgccgacggcgcggcgagcgccctccacgcgcacatcgcgtcgttcgtgcaacgggcctttcccgaggcccagggagaggacggtcaggaa

SEQ ID NO: 6343 - DNA, 906 bp, Streptomyces avermitilis
  CDS (1)..(906)
atgacagcgacgtacgaggcccagcggacggcgctcgccgaggtcgtggcgatccccgtgaccccgttcgccgaggacgggtcggtcgaccgcgacacccaccgggctctgctgcgtcgactgctcgacggtggcgtcaagaccctcaccccgaacggcaacaccggtgagttctacgccctcacccccgaagagcggcagctcgtcaccgagttgaccatcgaggagacgggggaccggggggccgttctggtcggcgtcgggcacgacgtgccgaccgccgtggcctcggcccggcacgcccgggcgcacggagcgcagatggtgatgatccatcagcccgtgcatccgtacgtctcggacgccggctgggtcgactaccaccgggccgtcgccgaggccgtgcccgagctgggcgtcgtgccctacctccgcaatccgctgctgcccggtgcccggctggccgaactcgccgaccactgccccaatgtcgtcggcgtgaagtacgcggtgccggacgccgcccgcttcgccgccttcgcacgggacgccggcctcgaacggttcgtatgggtggccggactggccgagccgtacgccccctcgtacttctcggccggtgccaccggcttcacctcggggctggtgaacgtcgccccgtccgtctcgctgaacatgatcgaagcgcttcgatcgggcgactaccaggccgcgatgaaggtctgggagcagatccgccgcttcgaggaactgcgcgccgcgggcggctccgcgaacaacgtgagcgtcgtcaaggaggccctcgcctcactcggcctgtgccgccgtgacgtccgcgcccccagcaagccgctgcccgaggacgagcgggcggaagtcgccgccatcgcggcggggtggtccctg

SEQ ID NO: 6344 - DNA, 1737 bp, Streptomyces avermitilis
  CDS (1)..(1737)
gtggtccctgtgaagcgcccggaggagttcagaagccaccagtggtacgggagcggcgtctcgtcgggtctgcgctccttcagccaccgggcgcgcacccgccaactcggctacctgcccgaggagcacctgggcaagccggtcatcgcgatcctcaacacctggagcgacatcaacccgtgccatgtgcatctgcgggaccgtgcgcaggcggtcaagcggggtgtgtggcaggcgggcggcttcccgctggagttcccggtgtcgacgctgagcgagaccttccagaagccgaccccgatgctctaccgcaacctgctcgcgatggagaccgaggagctgctgcgctcgtacccggtcgacggcgccgtgctcatgggcggctgcgacaagtccacgccggccctgctgatgggcgccgcctccgtcgacctgccggccgtgttcgtgcccgccgggccgatgctgccgggccactggcgcaacgaggtcctcggctccggcaccgacatgtggaagtactgggacgacaagcgggccggcctcatcggcgactgcgagatgtccgaactggagagcggcctcgcccgttcgcccggccactgcatgaccatgggtacggcgtccacgctgacggccgcggccgaggccctcggggtgacggtgccgggcgcctccagcatccccgccgtcgactccgggcacgaccggatggccgcggccgcggggctcaggatcgtcgaactggtccgcggcgaccggaaactgtccgacatcctcaccgaggaggccttcgcggacgccgtgacgaccgtcctcggcctcggcggctcgaccaacgccgtcatccatctgatcgcgatggccggacgggccggggtctccctcacgctcgacgacttcgaccgcatcgcccggaccgtgccggtgctcgccaacgtccggccgggcggcggcccgtacctcatggaggacttccacttcgcgggcggactgcccggattcctctcccggatcaccgatctgctgcatctggaccggccgaccgtctcgtacgacaccctgcgcgagcagctcgcctccgcccaggtgcacgacgacgacgtcatccgcacccgcgcgaacccggtcgcggacgaaggcggagtcgccgtcctgcgcggcaacctctgtcccgacggcgccgtcatcaagcacatcgccgccgagccgcggctgctcaagcacaccgggcccgcggtcgtcttcgacgactaccggacgatgcagcggaccatcaacgaccccgggttgggcatcaccgccgacagcgtgctggtgctgcgaggcgccggccccaagggcggccccggcatgcccgagtacggcatgctgccgatcccggaccacctgctgaagcagggcgtacgggacatggtgcggatctccgacgcccggatgagcggcacgagttacggcacctgtgtgctgcacgtggcgcccgagtcgtacgtcggcgggccgctcgccctggtgcggaccggggacacgatcaccctcgacgtcgaggcgcggagtctgcggctccacgtggacgacgcggagctggagcggcgcggggcccggtggacgccgccgcccgagcggtacgagcgcggctacggcgcgctctacaacgaacagatcacccaggcggacaccggctgcgacttcgcgttcctggcccggccgggcaaggtgcaggacccgtacgcgggc

SEQ ID NO: 6345 - DNA, 942 bp, Streptomyces avermitilis
  CDS (1)..(942)
atggcccaagccgcagccgtggcgaaacagcccgcgccaccccggcggcgccgtggctcggcgacgccccgcacactgccgtatttgccgtatctgctgatcgcgccggcgggcctgctgatgctgggcttcatcgcctacccggtgctcagcgtcttctactacagcctgcggaacttcaacccgaccaagccgtggcgcaacggctacgcgggcttcgacaacttcgtccagatcttcaccaaggacacccagttctgggacacgctgaccttcagcgccaagtgggtcgtcgtggaggtcggactgcaactgctgttcggcctggcgctggcgctcatcgtcaaccagaccttcgtgggccgggcgctgggccgcgcgctcgtcttctcgccgtgggccgtctccggtgtgctgacctccgcgatctgggtgctgctctacaactcccagaccggcatcacccgttacctcgccgacatgggtgtcggtgagtacggcaccagctggctgtcggacacctcgaccgtcttcccggcggcggtgatcgccgacctgtggcggggcgtccccttcttcgcgatcctcatcctcgccgacctccagtccgtctcgaaggacctgtacgaggccgccgaggtcgacggcgccggccggctgcgccagttcttccacatcacgctgccgcacctgaaggacgcgatcgtcctgtccacgctgctgcgcgcggtctgggagttcaacaacgtcgatctgctctacacgctcaccggcggtggccccgcgggcgagacgaccacgctgccgctctacatcgccaacaccagtgtcgacgcgcacaacttcggttacgcgtccgccctgaccacggtcgcgttcacgatcctgctcttcttctcgatcgtctatctgcggctgagcaagttcggaggtggagacaag

SEQ ID NO: 6346 - DNA, 900 bp, Streptomyces avermitilis
  CDS (1)..(900)
gtgatcaccaaggacgccgagatcagcgccccggtggtgcccgcgcccgagcccgcggcgccgcagcagtggccgcggaagacccggcgcgcctgggacgaggcccctcgctggcagatctacctccccctcggcagctacctgctcttcaccctgatccccttctactggatcctgctcttcgccctgcgcccggccggctccacgtcgctcgtgccgtggccgatgaccttcgagcacttcgagaaggtgtggaccgagcgcagcttcggcacgtacttccagaacagcgtcctcatcggcgtcgccacgctcgtcatgaccaccgtcatcgcgctcgccggcggctacgccctcgcccgcttcgacttcagggtcaagcggggtttcctgctggccctgctctgttcccagttcgtgcccggcgcgctgctgctcgtccccctcttccagatcttcgccaagctccagatgatcaactcgctcggcagcgtcgtcatcgccgagaccgtcttccagctgccgctgtcgatgatcctgatcagcggcttcatcaggaatgtgccgtactccctggaagaggccgcctgggtcgacggctgcaaccggttcacggccttccggatcgtcgtcctcccgctgctgcggcccggactgatagccgtcggctccttcgccttcgtgcacgcctggaaccacttcctgttcgccctgatgttcctcagcaaccaggacaagcagaccatccccgtcggcctcaacaccctgatgagcgcggacagcgtcgacctcggcgcgctcgccgcgggcggcatcatcgccgccgtacccgtggtcgtcgtcttcgcgttcatccagaagtggctgatcaccggcttcagcgcgggggcggtgaagggg

SEQ ID NO: 6347 - DNA, 1182 bp, Streptomyces avermitilis
  CDS (1)..(1182)
atgactgcttccgtgaccgcttccgtgactgctcctgagaccgctcctgtgccgatcgttctcgcgggcgcccgtggccacggccgctggcatctggacaacatccgccggctccaggaccgggggctcgtccggctcgcgggcatctgcgagctgaccccgctggccgaggaggagctggacgggctcggcgtgcccgagcagtccgccgacttcggctctctcctcgacgccaccggcgccgcgatcgccgtgatctgcaccccgatccccacccacaccgacctggcgctgacagccgcggagcggggtgtgcatctcctcctggagaagccgcccgccccctcgttcgccgagttccggcggatggccgacggggtcgccgcggccggagtcgtctgccagatcggcttccagtcgctgggctcgggcgccgtgcccggcatccggaagctgatcgccgagggcgcgctcggcacggtggccggcatcggggcggccggggcctgggcccgcgacgaggcgtactaccggcgtgcgccctgggcgggcaagcgccggctgaacggcgtcgacgtgatcgacggcgtcctcaccaatccgctcgcgcacgccgtcgccaccgccctcgcgctcgacggctccacccgcgccgaggacgtcaccgacatcgagaccgagctgctgcgggccaacgacatcgagtccgacgacacctcctgtgtgcgggtgacgacgaagtccggcggccggatcaccgtcgccgccaccctgtgcgccgaggagcccgacgagccgtacgtcctggtgcacggcgaccgcggccggatcaccttctggtacaagcaggaccgggtgctggtgcagcgctcgggacacggcccgcaggagatcgagtacgaccgcaccgacctgctggagaacctcgtcgggcatctgacgcacggggccgagctgctggtcacgcccgagtcgacgggcgccttcatgaaggtcgtcgaggcgatccggcaggcacccgatcccgtcgcgctgccgggcgatgcctgggagctgattcccggtgagaaccgccgggtcgtccgcggcgtcgacgggctggtcgccgccgccgccgacaccctcgccctctactccgaactgggcgcctcctgggcccttccgaacgaggtgagcagccga

SEQ ID NO: 6348 - DNA, 864 bp, Streptomyces avermitilis
  CDS (1)..(864)
atgacccctttgacgaacaggacgaacagcggcgactgtccggtcctgcggatcgcgggccgccccgtcggccgctacatcacgcggcccgaactgcccggccggatgtccccgcgcccctatctgcacccggtcaccaccctggccggcacggctgtcaccgaacgcggccccgccgaccacacacaccacctcggcgtcggtgtcgccgttcccgacgtcgaggggttcaacttctggggcggccgcaccttcgtccgcgaccagggccccaccgagctggacaaccacggcgcccagcgccacgccggcttccagctgcgcgaccccgacgggttcgtcgaggagttgcgctgggtggccgcgggcaacgaactgctgcgggagcgccgtaccgtcgccgccaccgcgctcaccgactccgcctgggccctggacttcaccttctcgctcaccaacatcacccccggcccgctctcgatcggcagccccgccaccaacgggcgccccggcgcggcctacggcggcttcttctggcgggcccgcaaggaggccggcgcgccccgcgtcttcaccgccgctgccgagggcgaggaagagatccacggcacccgcgccgactggctcgccctggccggcgccacctggacgctggtcttcgccggggcgaccgagcggacccgccgggatccgtggttcgtgcgcgccgccgagtacccgggcgtgggctcgtccctggcgcacgaggaacggctgcccgtcgcggccggggagaccgtcgtacgccgcatcgtcacggtcgtcgccgacggcagcctgggccggggcgaggccgccgccctcgcccggacggcggtgagcccg

SEQ ID NO: 6349 - DNA, 1308 bp, Streptomyces avermitilis
  CDS (1)..(1308)
gtgatcctcacctccgacctgggcgacggcacctaccgcacccccgtcctgaacgccgactggtccgaccccgaccttctccgcgtcggtgacgacttctacctcaccgcctccagcttcggccgggccccgggcctgcccctgccgcactcccgcgacctcgtcaactggaggctcgtcggccatgcgctcccgcgcctcgaaccggcgcacgagttccggaccccgcgtcacgactgcggagtgtgggcgccctccctgcgccaccactacggctggctctggatctccgcgcccgccgggggagtgcagaccggctggcagggcgccttccgctcgcccggcttcttcgggccgtacgaggagcggatcgtgctggagcagggcgacaccgacgtcgacggaccgcaccagggcggctgggtgcgcaccccggccggcgaggactggttcgcgcacttccaggcgcggggcgcgtacgggcgggtcgtccacctccagctgatgcgccggggctcggacggctggccggtgatcgggaatgagggcgtccccgtggccgtacacaggaagccggacctgccgcggcagccgccctccgcgcccgccaccgacgacgacttccccggcggccggttcgggcgtcagtggcagtggaccgccaaccctctccccagctctcggctgcgctcgagcaggggtgacccccatgacggctgggccacccagctctccggcgacgggctgcgactgacctgcgtgcgcaccgccgacgcgcacgacctgcgcaagctcccgaacgtgctcacccagcggctgcccggcgcgcccgccaccgtcgaggtggagctgcggctggacagcgaggaacccggggcccgggccggactggcggtgctgggcgacgcgttcagctggatcgggctccaacgcggcagggacggctcggtccagctggtgcaccggttcgacgaatccgtcgccatgggggcaccccccacaccttcggggcagtgggggaaggagcgggacgccgcgcacgcgcggctcgcgcccggcgggcgggcccggctgtggatcgagatcggcaggggagcgcgctgccgcttctcgtacgacaccggggacggccgtcggccctccggcccggtcttcgccgccaccccctggcgctgggtcggcgccctgatcgggctcgtcgcgctcgcgcccgtcggcgcgggccacgccggcgcggccacgttcacccggttccgcggcaccgccgccggctccgcctccctctctgcccccgcctccacctcggcc

SEQ ID NO: 6350 - DNA, 1335 bp, Streptomyces avermitilis
  CDS (1)..(1335)
atgaagatcagcatccacagaagcaggcgcgccgccacggccgtcgccctgggctccgtgctcgcgctcaccgccaccgcctgcggcgacgacggcagcggcgccgcgggcgacaagggcaccgagggctccggcaagggcgagatcaccttctgggacaacaacggcggtgtccgcaccgacatctggaagcagatcatcgccgacttcgagaagaagtacccggacatcaaggtcaactacgtcgggatacccgccgcgagcgcccagtccaagtacgacaccgccatccagggcggtggcctgcccgatgtcggcggtgtggggaccgcgatgctcgccgaggtcgcggtccagggggcactggagccgctggacagccggctcaagaagagctcgctgaacggcgagctgagccagaacctgctcgacagcagccgggccgcgggcggcggggacacgctgtaccaggtgccgacctccgccaacaacggcacgctgtggtaccgcaccgacctgttcaagagcgcgggcctggacgcgccgaccacctggtcgacgttctacgaggccgccgacaagctcaccgacaagggcaagaacaagttcggcttcaccatccggggcggcgaagggtccatcgcgccggccctggacgcggtgtacgggcagaccggcatcaccgagttctggaacggcgagaagaccaccgtcaacgacccgaagaacgtcgccgccctcgagaagtacatcgccctgtacaagaaggacaccccgtccgcggacgtcaacaacgacttcaccaagatggtcgcccagtgggacagcggcaccatcggcatgctgagccacaacctcggttcctaccaggaccacctgaaggcactgggcgcgggcaagttcaagggcatccccaacccgacgcgggacgacggcacacgcgtgcagatctccaacccggtcgacgggatgagcgtgttcaagtccagcaagaacaaggcggccgcctggaagttcatcgagttcgccgtctcctccgcggagaactccaagttcaacgagtccgcgggccaggtcccggcgaacaccgaggccgccaaggacacctgggtccagcaggccgagcccaccaagctggccgcggaggcgctcaacggcgccgacaccaagatcgtgcagctgccgtactacctgccggactggaacacgatctccaaggccgacaacgagccgaacttccagaagctgctgctcgggaagatgtcggcgaaggagttcctggacacgttggccgatcagctgaacaaggcgcaggcggactggaaggcgaaccac

SEQ ID NO: 6351 - DNA, 798 bp, Streptomyces avermitilis
  CDS (1)..(798)
gtgtcgctcacccgcagacaagtcgcctcggtggccctcgccgccttacccgtcgccgtcgtcgcgacggggcccgcgtccgcccatacgaaccgtcgggcacgcaccctctacatcgccggtgactccaccgccgcccagaagtacgccgacgccgctcccgagaccgggtggggcatggcgcttccgttctttctccgggaggacctgacggtctccaaccacgcggtgaacgggcgcagttcgaagagtttcatcgacgaggggcgtctcgacgcgatccttgaagtgatcgcacccggcgacttcctcctcatccagttcggtcacaacgacgagaagagcgccgacccgacgcgctacaccgagccctggacgacctaccaggactgtctccgtcagtacgtggacggggcgcgggcccggggtgcgcggccggtgctcgccaccccggtcgagcgcagaaagttcgacgcggacggcaacgccgtgccgacccacggcgactacccggcggcgatgcgcgccctcgccgaggacgagctcgtggcgctgctcgacatccaggccctgtcgatcgccctgtggcagaagctcggcgtcgaggagacgaagaagtacttcaactggaccgcgaccgagcaggacaacacgcacttcgacccgccgggcgcgatcgccgtggcccggctcgtcgcggccgggctgctgcaccgccgggtgctggcgccccgggacgtgcgccggctcgacgcggaagtccccgagtcctggatcacctggccacaggccaccgcg

SEQ ID NO: 6352 - DNA, 1329 bp, Streptomyces avermitilis
  CDS (1)..(1329)
atgaacgcacagacatggcatgggcacgtcaccacgacggtgctggtcggctgcaccgccctggccctcgccgtcaccggtaccaccgccacggccaccgcccaggcccaggcgcagccccgtgacctgggccgccagaccctcgccgccggtgacggctgggcctccgacggcaccggcaccaccgggggcgcggccgccgacgccgcgcacgtctacaccgtcaccacctgggccgggttcaaggccgcgctgaaggacggcggcaccgcgccgaagatcatcaaggtgaagggcacgatcgacgccaacgccgagggctgcgactccttcgccgccgccggctacgacttcgacgcctatctgcggaagtattcgccggagaactggggttacggcgccaacctggacgccgagccggacgacagccccgagggtctgcggcgcgtctccgccgacacccaggccaaggccatcaaggcgagcgtccccgccaacaccacgatcgtcggcctcggcaagaacgccggcttcgagggagccagcctccagatcacggccgtcgacaacgtgatcatccgcaacgtcgccttcgagagccccctcgactgcttcccgcagtgggacccgaccgacacctccgtcggcaactggaactccgagtacgacagcgcggtggtctacggggccacgcacatctggctggaccacaacacgttcaccgacggggagcaccccgacagctcgctgcccacctacttcgggcggatctaccagcagcacgacggcgagctggacatcgtcaagggcgcggaccacgtgaccgcctcctggaacgtcttcaccgaccacgacaagacgatcctgatcggcaacagcgacagcgcgtccaccgcggcggtcgaccgcgggcacctgagggtcaccttccaccacaacctgttctcgggcctcgtcgagcgcgcgccccgcgtccgcttcgggcaggtcgactcgtacaacaaccacttcgtggccggctccgcctactcctacagcttcggcatcggcatggagtcacaactcgtcgccgagcacaacgcgttcacgctgcccgaggggatcagcgcggcgacggtcctgaagaagtggaaggaggcgccggtcaccgccgccgacaactacgtcaacggggcgccgacggacctgatcgccgtgcacaacgcggagatccccgcggagacccttcagtccggcgccggatggacgccgaccctgcgcacgaaggtcgacccgccgagggcggtgccggggatcgtggatcaccgcgcgggcgccggcaaggtctgc

SEQ ID NO: 6353 - DNA, 1137 bp, Streptomyces avermitilis
  CDS (1)..(1137)
atggccggactcccgctcagcagacgggcgttcgtcgccgcgtgcaccggagccgcgctggctccggtactcgcggcccccgcccatgcgaccacgagggcgcctttcggacgctacggttcgcccgccgcccgcctcaccgagcagaccctgtacgtccatcccggcgggctcggcgaccacaccaccgtccaggccgcggtgaccgcggctgggggtacctcccaggcgttcagcactgggggaggcagcggccgcacgctcgtcctcgcgcccggcatctaccgcgagacggtcgccgtcggcgtcgcccgtacggagatgacctggatcggcgcctccggagacccgcgtgacgtcgtcgtcgtgtacgacaacgcggccggcacgcccaggcccggcggcggcacctacggcacgaccggctcggccaccaccaccgtgcaggccgacggcttcaccgcccgctcgatcaccttcgccaacgacttcctgcgcgccgaccaccccgagatcaccggcacccaggccgtcgcgatcaaggtccagggcgaccggtcggccttcctggggtgccggttcctcggccaccaggacacgctgtacgccgactcgatcgcgctcggcacgttcgcccgccagtactaccgcgactgctacgtcgagggtgatgtggacttcgtcttcggccgggcgacggccgtgtacgagcgctgccacttccacaccctgaaccgcacggacctggccggggccccgtacggcttcgtgttcgcgccgtccaccgccgccgccgacccgcgcggctacctggtcacccgcggccgtgtcacgagcggggccccggacgcgtactacaagctcgcccgcccctgggtgcccagctcggaccccaccgcccggccgatgctgacggtccgtgacacccgcctcgccgccgggatcgacgcggtcgcgccctacaccaacatgtcggacagctatccgtggcagagccagcgcttcgccgagtaccggaactccggtccgggcgccgaggtcacggtccccgggaaccggccccagctcacccgcggggaagccgggtcggcgacccgcgaggcgtatctgggtgactggacgccatggagggggtgt

SEQ ID NO: 6354 - DNA, 1053 bp, Streptomyces avermitilis
  CDS (1)..(1053)
gtgactggacgccatggagggggtgttgagatgcgccgacgtgcgttcctcgccagtgcggccggggcggccggtgcgctgacggccctcggttcgacgcccgccccggcttcctcgtgccggacgctgcacgtccgccccggcgactccgtccaggccgcggtcgacgcggtgaccgggcccggccggacgatcgtcgtgcacccgggcacgtaccgcgaagtcgtcacgatccccgccgacaaagccggcctgacgctgaggggtgccacacgcgacccgcgcgacaccgtcatcgtccacgacaacgccaacgggacggtgaagcccgacgggaccacctacggcaccgcgggctcggccaccttcacctcggcggcgcccgggctgaccgtccacgggctgacgctcgccaacgactggctgcgcgcggaccacccggagatcacggggacgcaggcggtggcggcgtacgtcacgggagaccgttcgtccttctcgcgcgtgcggctgctggcgcaccaggacaccctgttcgcggacaccaccgcgctcaccgccttcgaccgccaccactaccgcgactgctacatcgagggcgacgtcgacttcgtcttcgggcgggccaccgccgtcttcgagcgctgccacttccacaccctcgaccgggacgtcgccttcaagcccgaggggatggtcttcgcaccgtccacggcccgcgcgaatccgcacggcttcctggcggtacgcagccgggtcacctccggcgccgaggacggggcgtacaagatcgcgcggccgtgggtgcccacgtacgagacgacggcctggccgtccctggtcgtacgggagacggagctgggccccggcatcgacgcggtggcgccgtacaccgacatgcgcgaggcctacccctggcagtccatgcgctttcgcgagtaccgcaacacgggccccggcgcggagatcaccgcgccggagaaccgtccccagctcacggacgcggaagccgcgtcgcacacgcgtgcggcgtatctcggcgactggcgcccg

SEQ ID NO: 6355 - DNA, 1110 bp, Streptomyces avermitilis
  CDS (1)..(1110)
atgtctcgtcgaaccgctctcgccctgggcgccaccctggcgctcggcgccggactcgccgtcctccccacccaggcccaggcggcgaccgtcgtcgtcagcaccacggctgatctcaccagcgccatcaagaacgccaccgccggtaccgtcatccaggtgcgcggcggcacgtactacccgacggcgaccctccagtcgaccgccaacggcacctcgtcgagcccggtcaccctccaggcgtacggctcggagacggtgaagatcgacgggtcgtcgctgcccgccggcgactggatcttcaagctgaccgccgactactggaacgtctccaacatcaccttccagaactccccggacagcgccgtcgtctgccagtcctgcaccggcacgaactggaacaacatcaagaccatcaacggcggcgactccggcttcaccctcaccggcgacggcaccgtcaacaacacggtcaggaacatcgactcgtacggccactacgacgccgccacccatggcgagaacgcggacggcgtggccgtgaagttcggctccggcaccggcaacctgatcaccggcgcccgcctgtacaacaactcggacgacggcatcgacttctggtccttctcctcgaccgtcaccatcgagcacacctggtccttcggcaacggcaagaaccgctggggcgactcggccttcgcgggcgacggcaacggctacaagctgggcggcgacggcgaggtcgtcgcgcatgtcgtcaacaactccgccgcctgggacgacgccggcagcggcttcaccgagaactccaacaccggcgcgatcgtcatcaaccgcaccaccgcctacgccaacggcaagtacggctactacttcgccaccagctccgcgaagctcggcaagaacctggcggtgagcaacgggtccgcggcggtctccaagggctcctcggtcacgtcctccggcaacaactgggactcgggcatcgccacgccgtccttcatctccacggacgcgacgacgacgtacaactcccgccagtcgaacggcgcgctgccgacgacgacgttcctgacgacggggagcacgacgatcggggcgacgatgaac

SEQ ID NO: 6356 - DNA, 369 bp, Streptomyces avermitilis
  CDS (1)..(369)
ttgcaccgcaggggcgatgacctcggcgacggcatggtcctgcacgaagggaacggaaaattgactgagggactccacctcgccgcgggatcgaacggcccctcgccggtcgtcctcgccgtcttcctgtcgggcggcctggtcgccttctggtgcggggtgagttgggcgttcgacgtgcgcgggatcaccacccggcgcgccgagcggattcgccgtaggaatgaggagagctgggcggcgatgggtcgcctgggcgggtcgcccactgttttcgcgactcccggctatctccggttcctgggcgcgctgatggcgttcgcgggtgtgatcctgtgcgtggtggcgtacgccctgtggcacttgggc

SEQ ID NO: 6357 - DNA, 792 bp, Streptomyces avermitilis
  CDS (1)..(792)
atgcggaagtccctcagagcggctgccatcggcgccgcttgtgccgtcgccggtgccgccctgtacggcaccggcgtcgccaccgccggccagtcgacggcgaactcgacccatgagccctacaacatcgggctcctggtcaaggacatcgacacctactacggcgccacgctcgacagcaacggcgtgtaccaggcgtccaaggacagccagtacgccaaggacctggcgcgcctggagtcgggcgccaagcgctacatcgacaaggcggcgcacaaggcgaagcgccacggagacaagcccgcggtcgtcttcgacatcgacgacacgctgctgctctccctcgactacgagaagaagaccaactacacgtacaactcgaccacgtgggccgactacgtggccaaggccgaccgcccggccgtcttcggcacccccgaactcgtcgcgtacgccaagtccaagggcgtcgaggtcttctacaactcgggcctgaaggagtcgcagcgcgtctccgcggtcgcgaacctgaagaaggtcggcgccgacatcaacctcgacgccgaccacatgttcctcaaggacgcggccaacccgccggcgtacctgagcgcctgcgccaccgccgccgcctggaactgcacgaccgtgcagtacaagtccggcacccgcaagcacatcgagtccctcgggtacgacatcgtcgccaacttcggcgaccagtactcggacctcgagggcggctacgccgacaagacgtacaagctcccgaacccgacgtacttcgtgagc

SEQ ID NO: 6358 - DNA, 2205 bp, Streptomyces avermitilis
  CDS (1)..(2205)
atgcgccgcaccgcccgcacactcctggtgcctctcctcgctctgctgctgggcctgctcgccgcgccgcccagccccgccgcacagtccggagcaccccacgtgaacgccgccaagtacgccggctatctcttcgcctacttcaccggggagggcaccgccgacggcgagcagatccgctacgccctcagccgcggcaacgacccgttgcactggcgggagttgaacgcgggaaagcccgtcctcacctcggacctgggcgagaaggggctgcgcgacccgttcgtgatccgctcccccaagggtgacaagttcttcctgatcgcgaccgacctgaagatgtaccggaacagcagcggcagctgggaccaggtccagcggcacggcagcaggtccatcatgatctgggagtccaccgatctggtccactggaccgaccagcggctggtgcgggtcgcccccggcaacgcgggcaacacctgggcgccggaggcctattgggacgacacgctgggcgcgtacgtcgtcttctgggcgtcgaagctctacgcggacgacgaccccgaccacacgggctcgacgtacaacaagatgctgtacgcgaccacgaaggacttccgcaccttcagcgagccgaaggtctgggacgacccgggctactcggtgatcgactcgaccgtcatcaagcacaagggcagttactaccgctacaccaaggacgagcgcgacccgagctcgtccagcccctgttcgaagttcatcaccggcgagaagtcgacgtcgctcacggacccgacgtacgacttcgtctccgactgcatcggcagcggttcgatcgaccggggtgagggccccacggtcttcaagtccaacaccgagaacaagtggtacctgttcatcgacgagtacggcggccgcggttacgtccccttcgagacgaccgacctcgactcgggcgagtggaccatgtcgacggactaccagctgcccgcgagcccgcggcacgggacggtcatgcccgtgacgcgggccgagtacgaccggctcctggccgcgtacccggtgagcggcacctcggtggtggacgcgacggcgaaggggcagaaggggtacgcggtcgtctccgaggacaccgcgaaggtcgtgctgccgatgaagccggacgcggacctgcggagactggccccggccctggccgtcggcgcgggcgcgaccctgagcccgcgctccggtacgcggcgcgatttccgcaggccgcagacgtacacggtgacggcggcggacggcacgaggcgcacctggaccgtcgaggcggtaccgacccgcagcccggtcctgcccgggctgtacgcggaccccgacatccagtacctggacggccgttactggatctacccgaccacggacggcttccccggctggagcggcacacggttcaaggcgttctcgtcgaaggacctggtccactggaaggaccacggcgtgatcctcgacctggggcctgatgtgacgtgggcggacaagaacgcctgggccccggcgatcgccgagcgcgacgggaagtactacttctacttctgcgcggagcagcagatcggcgtggcggtggccgactccccggcgggccccttcaaggacgcactgggcaagcccctggtcgccaaggggaagttggcgggccagatgatcgacccggcggtgttcacggacgacgacggcacgtcgtatctctactggggcaacggacacgggtacgtcgtgccgctgaacgacgacatggtgtcgtacgacgcgacgaaggtgaaggacatcacccagccggacttccgcgagggatccttcgtggtcgagcggcaggggacgtactacttcatgtggtccgaggacgacaccggcagcgagaactaccacgtctcctacgcgaccggaccgtccccgctcggcccgtggaccaagcggggcacgatcctgtccaagcgccccgagtacggcatcaaggggaccggtcaccactcggtggtgaacgtgcccggcacggacgactggtacatcgtctaccaccggttcgccctgagcggtcccgggaaggcgggcggggacggcacgcaccgggagacgaccatcgaccggatgaccttcgcggccgacggaacgatcgagccggtgacaccgacgctggagtcggtcaggcccgtgcgcgcaaac

SEQ ID NO: 6359 - DNA, 1155 bp, Streptomyces avermitilis
  CDS (1)..(1155)
gtgcgccagagcaccggacgccaccgcagaacccgcacgctctcgatcgccgccgcggtggccgtcgccgcgggggcgggtggcgtctgcctcggcctgtcggacaacggatcggcgcaggccgcctccaccacggtcacggtctccaccaccgcccagctccagtcggccgtcgcgaacgccgccgcaggcaccgtcatccaggtgcgcgccggcacctactacccgacggccaccctcaagtccacggccgacggcaccagttcggcgcggatcaccctccaggcgtacggcagtgagaaggtgaagatcgacggctccaagctccccgccggctcctggctcgccggtgtctacggcgactactggaccgtccagaacatcacctggcagaactcgcccgcccagggcttcgtcgtcacctcgtcggccggcggcgtcttcaagaacctcgtcaccgcgaacaacggcgactccggcttcaccctccgcggcgacggcacgacgaacaacctcgtgcagaacctggacagttacggcaactacgatgccgccgggcacggacagaacgccgacggcatcgccatcaagttcggctccggcaccggcaacaaggtcaccggggcgcgcctgtacaacaactcggacgacggcctcgacctctggcagttctcctcgcccgtcaccatcgagcactcctggtcctacggcaacggcaagaaccgctggagcgactcggccttcgagggcaacggcaacggcttcaagctgggcggcggaggcgtcaccgtcgcccacgtcgtgaacaacaacgcggcctgggacaacaccctgaacggcttcaccgagaactccaacaccggtgccgtcctgctcaaccgcaacaccgcgtacgccaacaccgaggtcggcttctacttcgccaccggcaaggcgcggctcgccaagaacctcgcggtgagcaacaagggcggcctggacaagctcggctcgtccacggtgtccgcgggcaacaactgggacagcggcgtctccacgccgtccctcaagtccacggacgcgtcgacggcgtacggggcccgctcgtcgagcggctcgctgccctcgacgacgtttctcacgaccggctccacgacgatcggctccacgatgaac

SEQ ID NO: 6360 - DNA, 828 bp, Streptomyces avermitilis
  CDS (1)..(828)
atgactgcaccatctgaacagcgcgtccgccaccgccgccgggtcaccaagcggcgggcggtgatcggttcggccgccgccctcggcctcaccgcgggggcgctcgtcacgacgtcgctgctgtcctccgcgggcgccgcgacgtcctggcccgaggccacgggcagcaaggccgtgtcgtcgacgatcgaggtgtcgggcacgtacgacggcaagctgaagaagttctccgggagcggggacctcgggacggccgaccagtccgaggaccagggcccgctcttcgagctcgaggacggtgcggtcctgaagaacgtgatcatcggtaccccggccgcggacggcgtccactgcctgggcagttgcacgctgcagaacgtgtggtggctggacgtcggcgaggacgcggcgagcttcaagagcaagtcctcgtcggcgacgtacaaggtgatcggcggcggcgcgaagtcggcctccgacaaggtgctccagttcaacggggccggcacgctgaccgtgaccggcttccaggtggagaacttcggcaagctggtgcgctcctgcggcaactgcaagacgcagtacaagcgcacggtcgtgctcagcgacatcgacgcgaccgcgccgggcaaggcgctcgtcggcatcaactccaactacggggacacggcgacgctgtccaggatccgcatccacggcgacaccaagaagaagatcaagccgtgcgtccgcttcaagggcaacaacaccggcaaggagccgaccgagctgggcagcggcccggacggcaccagctgcaagttcaagacgtccgacgtcagctacgag

SEQ ID NO: 6361 - DNA, 864 bp, Streptomyces avermitilis
  CDS (1)..(864)
atgaggaaggggcaggacgtgcacgacgagctgcgcgccgggctgcgtgaggcggccgaggcgcacgagcccgaccgcgcacgcatcctggcccgggtggagcgcgggatggcgggagccggcgagcggcggcccgcgccgcgcgcggcgcgcccgcccctgctcggctgggcacgggtcgtgggtgccaccgccgcggtcgcgggtgttctcgcggtgggcggctacgcggtcgcctcggcggtgaaggacgacaccccgccgcagcagaccgtcgcggtctcgccgacccccgatccgacgccggacgcgacgagccgggcgcctctcgccccggaccccacccaccgatccggtacgtcgaagccgtccgggaagccgagttcgccgccctcggggaccccgacgtccgagagctccgccgccaccgaccggccgcccgccaagggcgacacggacggccctgtctggtccgacggctcggtcgacccgcacagcaacgacttctgggcacagagcaatgtgaccctgaagacgagcgagcaactcacgtcgctcaccgtccggttgaagatcaggcagtccggcggggtcaccgacgcgggtgcctggcgttcgctgcccgaggacgacttcacgacgacggtcgtcgagaagggcggcttcctcgtctacacctgggtgctcaagccggaccacacggtctggccgggcgagtgggtgttcgcgggccagtacgaccacgaccgcggcggccgggacgcgaaggacgacagctactcggcgacggccaccgccaaggacggcggacggtccgccgtgcgtggtgacttcgcggcccgggtcaccgacgacggcgactcg

SEQ ID NO: 6362 - DNA, 564 bp, Streptomyces avermitilis
  CDS (1)..(564)
gtgggcacggtcgtcgacgacgccgcctccgtggaattccacgccttcttcgaacggcactatgccgaactggcgcgtctggcagccctgttgacaggcgaaccggacgccgccgacgatctggcggccgatgcgctgctcgccctgtggcaccgctgggaccgggtgcgcgcggcggaccacccggtggcgtacgcgcgcggcgtggtcgccaatctcgcccgcacccggatccgcagcgcggtgcgcgagcgccggcggatcacgctcttctggtcgcagcgcgaggacaagaccgagaaccccgatataccgggcacggtcgatgtccaggaggcgctgcgcagactgccgttccgcaagcgcgcgtgtgtggttctgcggcatgctttcgacctctcggagaaggacacggctctcgccctcggtgtttccgtgggtacggtgaagagccagacgtcgaagggcatggcggagttgaagcggcttctcggcaccgacgaggccccgatccgggtgcacgcgggagtgctgcccacgggtggagccggaggaagggaccga

SEQ ID NO: 6363 - DNA, 1449 bp, Streptomyces avermitilis
  CDS (1)..(1449)
atgtccgaaacgcagcaggtgaccgacctgccaagtgccgtgcccccaggggggaacggcatcgaccggttcttcaagatctcggcccggggctccaccttcggccgggagatacgcggcggcttcgccacgttcttcaccatggcctacatccttgtcctgaaccccatcatcctgggcagcgccaaggacaagttcgggcaccagctcgaccacgtccaactcaccaccgccaccgcgctggtggccgcggtgatgacggtcgtcatgggcgtcggcggcaacctcccgctcgcgctcgccgcgggcctcggcctcaacgcggtcgtcgccttccagatcgccccgctgatgagctgggacgacgcgatgggcctggtcgtcctcgaaggtctgctgatctgtgtgctggtggtgacgggtctgcgcgaggccgtcatgcacgcgatcccgcagccgctcaagcaggccatcagcgtcggtatcggcctgttcatcgcgttcatcggcttcgtcgacgccggcttcgtcagccgtgtcccggacgtcgcgggcaccaccgtgccggtgcagctgggcggcaccggcacgctgaccggctggccggtcctggtcttctgcctcggcgtcctgctcaccatcgggctgctcgcgcgcagggtcaggggcgccatcctgatcagcatcgtgacgatgacgatcgtggcgatcgtcatcaactccgtcgccgacgtcaagaactggggactgaccgtaccgaaggtccccgacgacgtcgtggcctccccggacttcggcctgctcggccacttcagcctgttcggcgccttcggcgagaccggcgcgatcaccgtcgtcctgctggtcttcaccctcgtcctgtcggacttcttcgacaccatgggcacggtcgtcggcatcagcgccgaggcgggcctgctcgacgaggagggcaaggtgccggatctcggccgcgtgctgctcatcgacggcgcggcggcggtcgcgggcggcgccgcctccgcctcctccgcgacctcgtacatcgagtcggcggcgggcgtcggcgagggctcacgcaccggcttctcgaacctggtcacgggcgggctgttcgcgttcgccctcttcctgaccccgctgctgacgatcgtgccgatgcaggcggcggccccggccctcgtcgcggtcggcttcctgatgatgacccaggtcaagcacatcgactgggacaggtacgagatcgccatccccgcgttcctgacgatcgccgtgatgccgttcacctactccatcaccaacggcatcggcgccggcttcctcgcctatgtgctgatcaaggcggtgctcggcaaggcgaaggagatccactggctgctgtgggcgacctccgcgctgttcctggtgtacttcgcgatcgacccggtcgagcagatcctcggcgtgaag

SEQ ID NO: 6364 - DNA, 1449 bp, Streptomyces avermitilis
  CDS (1)..(1449)
atgaacaagacgatcaggcgtgccgccgtcttcacactgctgctcgtgctggccctgctggtcagggccacctgggtgcagttctacgacggcaaggcactcgcggacaacaaggacaaccggcggaacgcgatcgagctgtacgcgaacccgctcgggaacatcatcgtggccggcgacgcgatcaccggttccgcacggacgaagggcagcgacctcgcgtacaagcggacgtacacggacggcagtctgtacgcggccgtgacgggctacagctcgcaggtgttcggggcgacccagctcgaaggcatctaccagaacctgctcgacggcacggacaaccagctgaagaacccgctcgacacgatcaccaacaagcgcgccgacccgggcgacgtggtcaccacgatcgacccggacgtacagaaggccgcatatcgggcactcggtgacaacaagggtgccgccgtcgcgatcgatccgaagaccggcaagatcctcgcggccgtctccaccccgtcgtacgacccctcgacgttcagcgccggcaactccgccgcgtggaagaagctgaccgaggacgccgacaagccgatgacgaaccgggcactgcgccagccgctgccgccgggttcgaccttcaagctggtcgtcgcggccgccgccctggaggacgggctctactcgtcggtggacaaggacacggacagtccgaacccgtacacgctgccgggcacgacccaggtcctggcgaacgagaacgcctcggcgccctgcgagaacgcctcgatccgtgtcgcgctccagtactcgtgcaacaacgtcttcgcgaagatggccgtcgacctgggccaggacaaggtcagggcgatggcggagaagttcggcttcaacgacacgtcgcaggacgtgccggtgcgggcgtacccgagtgtctatccctcggacatggacaaggcgcagaccggtctgtcgggcatcggccagttcgatgtgaccgcgaccccgctccagatggccatggtgtccgcggcgatagcgaacgacggcaagctggtctcaccgcacatggtgtcgcagaccagcgacgccgacggcacggtgctgaaggactacgacgacagcacggagaccaaggagatcgtcggctcgtcgaccgccgagcagttgcggtccgcgatgcagaccgtcgtcgaggaaggcaccggcaccaacgcgcggatccccggcgcgaccgtgggcggcaagacgggcacggcccagcacggcgagaacaacagcaagacgccgtacgcctggttcacctcgtacgcgaagtccgactccagcagcaaggaggtcgccgtcgcggtcatggtggagcagtccggcgcggcccgctccgaggtcagcggcaacgggctggcggcgccggtcgcgaaggcgatgatgcgggcggcactgaagaac

SEQ ID NO: 6365 - DNA, 771 bp, Streptomyces avermitilis
  CDS (1)..(771)
atgtcggcaggcgagacgggcggcggggcgcaggtcaagtccgcggtacggacggttgagttgctcgagtacttcgccggacgccccggcatgcactccctggccgccgtgcaggaggcggtgggctaccccaagtcgagcctgtacatgctgctgcgcacgctcgtggagctgggctgggtggagacggacgcgacgggcacgcggtacggcatcggcgtacgggcgctgctggtcggcacgtcgtacatcgacggcgacgaggtcgtcgcggcggcgcgtccgacgctggaccgcctctccgacgacacgacggagacgatccacctggcgcgcctggacggcacgaacgtcgtctacctggccacgcgccagtcgcagcactatctgcgcccgttcacccgggtgggccgccgcctgcccgcgcactccacctcgctcggcaaggcgctgctggccacgcacaccgacgagcaggtccgcaagatgctcccggagacgctcccggccctcaccgagcacacgatcacggaccgcgagaagctcatcgaggagctgcgccaggtccgcgaccagggcttcgcggtggaccgcgaggagaacacgctgggcctgcgctgcttcggcgtggcgatcccgtaccgcaccccggcccgcgacgcgatcagctgctcggtgccggtggcgcggctgaccccggcgcacgagcagatggtgaaggacgcgctgttcgacgcgcgggaccggctgacactggcgacgcgcaggctg

SEQ ID NO: 6366 - DNA, 1527 bp, Streptomyces avermitilis
  CDS (1)..(1527)
gtggcagcagcaccagtctggagtgtcgacccccgaaccgggaagcagcgtgaacaggttgcggtggaggccacggcccaggaggtggaccaggtggtccgcgccgcacacgccgcgcgcccgtccctcgccgaccgcaccgtccgcgccgcgttcctgcgcaccgccgcggaccagctggaggccgccaaggaccagctcgtcgaggccgccgacgcggagaccgcgctcggcccggtccggctcaccggtgaactcgcccgcacctgctaccagctgcgcgcgttcgcggacatcgtcgacgagggcgccttcctcgacatcgtgatcaaccacccggacgacaccgcgaccccgccgatccccgacctgcgccgctacaaggtgccgctcggcgtcgtcgccgtctacgccgcctccaacttccccttcgccttctcggtccccggcggcgacacggcgagcgcgctcgcggccggctgcccggtcgtcgtcaaggcccaccccgaccacccggggctgtccgagctggtcgcgtccgtcctgcgccgggccgccgccgagcacggcatcccggccggtgtcctcggcctcctgcacggcttcgaggcgggcgtcgagctggtcaagcacccgctggtcgccgcggccggcttcaccggttccgtacgcggcggccgggccctcttcgacgcggcggcggcgcgccccacgccgatccccttccacggcgagctcggctccctgaacccggtggtgatcaccgaggcggcggcggccgagcgggccgaggcgatcggcgcggggctcgcgggttcgatgacgctgggcgtcggccagttctgcgtcaagccgggcctggtcctcgcgcccgcgggagcggcgggcgaccgcctggtgaagtccctcacggacgccgtcagcgacaccgacgccggggtcctcctggaccaccgcatgcgcgacaacttcatcgccggtgtcgccgagcgcgccggactccccggcgtggaggcccccgtgacgccgggctcgggcggcgagcactcggtgagcccgggcttcctgacggtgccggccgagaagctggcggcaccgggcgcgcacgacctgctcctggaggagtgcttcggtccgctgacggtcgtcgtccgctacgaggacgacgccgaggcgggcgcggtgctgtcccggctgccgggcaacctcacggcgacggtccatctctccgaagaggagtcggcgggcgagggccgcggcgcggagatcctggcggaactgacgccgctcgcggggcgcgtgctggtcaacggctggccgacgggggtcgcggtggccccggcccagcaccacggcggtccgtacccggcgacgacgtccacgtcgacttcggtgggcgggacggcgatcgagcggtggctgcggccggtggcgtaccagggggtgccggaggcgctgctgccggtggagctccgcgacgggaatcagctggggttgccgcgacgcattgacggccgtccggaacgc

SEQ ID NO: 6367 - DNA, 606 bp, Streptomyces avermitilis
  CDS (1)..(606)
atggacgtggaacttcccgaactccctttccccctgcgcacttacgggccggacggtaactggtcctacgaggacggtgtgctcaccggctgggcgggcgcacgtcaggaccgtttcgtgccgcccaccggtgaggcactcgaccccgccgccgacgcgccccggctgctgggggcgccggagggcgacttccagctgatcgcccgggtcacggtgggcttcgccgcctccttcgacgcgggagtgctctacgtgcacgtgggcgagcgggcctgggcgaagctctgcctggagtactccccggacgtgcccacggtctgcacggtcgtcacccgtggacactccgacgacgcgaactccttcaccgtggagggcagttcggtctggctgcggatcagccgcacgggccgggccttcgccttccacgcctcccgcgacggcgagcactggacgttcgtccgcctcttcacgctcgccgacgagggaccggcctcggcggcactggtcggcttcatggcgcagtccccggtcggcgagggctgcgtggtcaccttcgaccacctcgcctaccgggactcctggccgcaggggctaagagacggcagc

SEQ ID NO: 6368 - DNA, 1401 bp, Streptomyces avermitilis
  CDS (1)..(1401)
atggagggcatggctacgaacccgaccacggaaactcccccgacggacccccgactcacctctgccacaagcgagttggagcaccacacctctccctcgctcaccctcgccgccgcactcctcggcttcgcgctgatcaccctcgacgcgtccgtcgtgaacgtggcccttccgtcgatcggctcggcgttcgggggcgggatgtccgggctccagtgggtcgtggacgcgtacaccctcgccttcgcggcgctgatgctgtccaccggagcgttcgcggaccgggccggggcgagccgggcctacgggatcgggatcgccgtgttcaccctggcctcggcggcgtgcgggctcgcgcccggcctgccggtgctgatcggcgcccgggtggcgcagggggtggcggcggccgtggtgctgccggcctcgctggcgctggtgcggcaggcgtacccggacgcggcacgccgggcgcgagcggtggcgctgtgggcggcgggcggctcggtggcggtggcgctgggtccggtggcgggcggcgcgctgacgacggcgtgggactggcggggcatcttcttcatcaacctgcccctgggtgcgctggcgctcgtcctcctgctgcgggcgccgcgctcggagcgccggcccgcgccgttggatctgccgggccagctgacggcggtcgtggcgctcacggcgctgacgttcgcggtgatcgagggcggcgccggggggctgatcgcgctggccgtggcggtgacggcggccgtcctcttcgtccggatcgaggcccggcaggcgtacccggtcgtcccgctcggtctgttccgcagccggacggtgtcggtggcggtcgccgccggcgcggcgtgcagcgtggccttctacggggtggtgttcctgttctcgctcttcttccagcaggcgcaggggcggtccgcgctgtccgcggggctgatgttcctgccgatgacggggctgatcgcggtgacgaacatcgcggcggggaagctgtcgggccgctacggagcccggctgccgatgctgctggggcagtcgctggcggcagcgggcctgctggtcctgctgttcgtcgacgcgtcgactcccccggcgctggtggccgtactgctcgtcccgatggccctgggctgcgcgctcaccatcccgccgctgacggcgacgatgatggacgcggtgcccgcggaccgggcggggctggcggccggcgtcctcaactcggcccgccaggtggccggcggcctggccatcgcggcgttcggctccctggtctccggcggcttcggctcgggcctccgggtgagtctcgcgctcgccgccgccctgctcgccctgaccgcgacggcgaccttccggctgcgcggctcagctgccgtctct

SEQ ID NO: 6369 - DNA, 1005 bp, Streptomyces avermitilis
  CDS (1)..(1005)
atggcccgatccacgtccccggcccggggtgtccgccggatcgccgtcgtcgcggcgtcccccgtctcgatgttcaacctcgccatccccgagctgctgttcgagaaggtcgagatcgacggcgctccgggctacgaggtgaccatctgcgccccggagccgggcccggtgcccaccaccggcggcctcgacctgtacgtccggcacgggctcgacgccgtacgggacgcggacacggtgctcgtcgcgggcaccgggctgcgctacacgcccgacccgcgcacggtggacgccgtccgcgaggccgccgccgacggcaagcggatcgcgtccatctgcagcggcgccttcgcactcgccgaggcggggctgctcgcgggccgccgggccaccacctactggggacaggccgaggaactgcgcaagcggtacccgtccgtcgacctcaagggcgatgtcctgtacgtgcaggacggcccgatcatgacctcctccgggtacgccgccggaatcgacctgtgcctccacatcatccgcaccgactacggcgccgccgccgcgaaccgggtggcccggctcgccctcgtcgcgcccgtgcgccccggcggccagacccagttcacccagaccccgctgccgcccgagcgcggcaccgcctgcgccgacacccgcggctgggccatgcgtcacctcgacagtccgctcacgctcaccgacctggcccggcacgcgggcgtcagcgtgcgtaccctcacccggcgcttccacgcggagagcggggtcagcccccttcagtggctgctccaccagcgcatcgagcgggccaaggaactcctggagacgaccacgctcccgatggaccaggtggcccgcgcctcgggcctgggcaccgccgactcgctccgcggccatctggtgcgccgcacgggactgaccccgagcgcctaccgcacccagttcagccgcctgggaagcggaccgggaccgggaatggaacaagccgct

SEQ ID NO: 6370 - DNA, 714 bp, Streptomyces avermitilis
  CDS (1)..(714)
atgcgcgtcgagatctggagcgacatcgcctgcccctggtgctacgtgggcaaggcccgcttcgagaaggcgctcgaagcctttccgcaccgcgacgacgtcgaggtggtgcaccgctccttcgagctcgacccgaaccgcgccaagggcgacatccagcccgtcctcacgatgctgaccaagaagtacggcatgagcgaggcgcaggcccaggccggcgaggacaacctgggcgcgcaggccgccgccgagggactggactaccgcacccgggaccgcgaccacggcaacaccttcgacatgcaccgcctgctgcacttcgccaaggagcagggcaggcaggacgagctgatcgggctcctgtaccgggcgaacttcgccgaggagcgctccgtcttcgacgacgacgagcggctcgtcgagctggccgtcgccgccggtctcgacgcggaggccgcccgcacggtcctcgccgacccggccgcgtacgccgacgaggtccgcgccgacgagcgggaggccgcggagctgggggcgagcggtgtccccttcttcgtcctcgaccgcgcctacggtgtctccggcgcccagcccgcagaggtcttcgcccaggccctgaagcaggcgtggggggaccggccgccgctcacgctcatccaggacagtggtgacgcccaggcgtgcggtcccgacggctgcgccgtgccgcagggc

SEQ ID NO: 6371 - DNA, 1104 bp, Streptomyces avermitilis
  CDS (1)..(1104)
atggacggggggttcgcggggccgcagagtggtcccatggagaccttcgagcccctcgtccgtgccgagttcgccccgaagaacacctacctgaacaccgcgagcaccggcctcgtaccggcccgcacagtggcggccatgcgcgtcgccgtggagtcggccgccgccgggcagccgaccgacatgttcgcggacgtcgaggcggcacgcgcctccttcgcccggctgaccggggtacccgtccgccgggtggcggccggggcctcggtcgcggtctacagcgggctgatcgccgcctcgctgccggagggcgccgaagtcctcaccgccgaggccgacttcagctccgtcgtgaaccccttccacatccgccgcgacctcaaggtgcgcgccgtcccgctggagggcctcgccgagtcggtgcgccccggcacggcgctcgtcgcggtcagcgccgcccagtccgccgacggccgggtcgccgacctgccggccgtccgcgcggccgcccgcgcgcacggcgcccgtacgtacatcgacgcatcccaggccaccggctggctgcagatcgacgcggacgcctacgactacgtctcctccgtcgccttcaagtggctcgtctgtccgcgcggcgtggccttcctggtcgtcccggaggacctcggcggcctcaccccgctgttcgccggctgggtcgcgggacaggcgccgtgggacagctgttacgggcccgtcgaggaactcgcccactccgcacggcggttcgacgagagccccgccctcttctcgtacgcgggcgcccgccactccctcgcgctgatcgaggaactgggcgtggagaacgtacgggcccatgacctcgcactcgccgaccgcttccgtaccggcctcgcgtccctcggccacgaaccggtccccgcaccacacgcgccgatcgtgtccgtgcccggcctcggcgaccggcagccggccctcagccgcgccggagtcgaagtctccgaccgcgcgggcaacctgagggcggccttccacctctacaacacgcccgccgacgtcgaccggctccttgatgtcctgtcgggcctgtccggccgccccctggcg

SEQ ID NO: 6372 - DNA, 840 bp, Streptomyces avermitilis
  CDS (1)..(840)
gtgtcggtcccccgccaggacccggtcctgtggggcacgccggacacaccgggccccatcacggcggccgacctccagtcgtacgagcacgacggcttcctcgccgtcccgcagctcatcggtgatgacgaagtcgcgctctaccacgccgagttggaacgcctgatccacgaccccgcggtgcgcgccgacgagcgctccatcgtggaaccgcagtcgcaggagatccggtcggtcttcgaggtgcacaagatcagcgagatcttcgcccagctcgtgcgcgacgagcgcgtggtggggcgggcacggcagatcctcggctcggacgtgtacgtccaccagtcccggatcaacgtcaagcccggcttcggggccagcggcttctactggcactcggacttcgagacctggcacgccgaggacggcctgcccaacatgcgcacggtgtccgtctcgatcgcgctgaccgagaactacgacaccaacggcggcctcatgatcatgccggggtcgcacaagacgttcctcgggtgtgccggggccaccccgaaggacaactacaagaagtcgctccagatgcaggacgcgggcacgccctccgacgaggcgctgaccaagttcgcggaccggcacggcatccggctcttcacgggccgggccggttcggcgacctggttcgactgcaactgcctgcacggctccggggacaacatcacacccttcccgcgcagcaatgtgttcatcgtgttcaacagcgtggagaacacggcggtggagccgttctcggcgccggtacggcgtccggagttcatcggggcgcgggacttcacgccggtgcgg

SEQ ID NO: 6373 - DNA, 402 bp, Streptomyces avermitilis
  CDS (1)..(402)
gtgatagtccgttcgttcaaggacatcgaaggcaccgaccggcatgtgaaggccgcgtccggcacctgggagagcaagcgcatcgtcctcgccaaggagaaggtcggcttctcgctgcacgagaccgtcctgtacgcgggtaccgagacgtcgatgtggtacgcgaaccacatcgaggccgtgctctgcgtggagggcgaggccgaactgaccgatgacgagaccggcgagaagcactggatcacgccggggacgatgtacctgctggacggccacgagcgccacaccatgcgccccaagaccgacttccggtgcgtctgcgtcttcaaccctcccgtcaccggacgggaggaccacgacgagaacggcgtctacccgctgctgaccgaacccgaggaggtc

SEQ ID NO: 6374 - DNA, 1269 bp, Streptomyces avermitilis
  CDS (1)..(1269)
gtgaccatcacccagcccgacctgagcgtcttcgagaccgtcgagtcggaggtgcgcagctactgccgcggctggcccaccgtcttcgaccgggcgcagggcagccgcatgtacgacgaggacggccacgcgtacctggacttcttcgccggcgccggctcactcaactacggccacaacaaccccgtactcaaacgggcgttgatcgactatctggagcgggacggcgtcacgcacgggctcgacatgtcgacggccgccaagcgcgccttcctggagtccttccagaacctgatcctgcgcccgcgtgacctgccgtacaaggtcatgttcccgggcccgacgggcaccaacgccgtggagtccgcgctcaagctggcgcggaaggtgaaggggcgcgaggccatcgtgtccttcaccaacgccttccacggcatgtcgctgggctcgctcgccgtgaccggcaacgccttcaagcgcgccggcgccgggatacccctcgtgcacggcacgcccatgccgttcgacaactacttcgacggcaaggtcccggacttcctctggttcgagcggctcctggaggaccagggctccggcctcaacaagcccgcggccgtgatcgtcgagaccgtgcagggcgagggcggcatcaacgtcgcgcgtcccgagtggctgcgcgccctggccgagctgtgcaagcggcaggacatgctgctcatcgtcgacgacatccagatgggctgcggccgtacgggcgcgttcttctccttcgaggaggcgggcgtcacaccggacatcgtcacggtttccaagtccatcagcgggtacgggctccccatgtccctgtgcctgttcaagcccgagctggacatctgggagccgggcgagcacaacggcacgttccgcggcaacaaccccgcgttcgtcacggccgccgcggccctccagacgtactgggccgacggatccgccatggagaagcagaccctcgcccgcggtgagcaggtcgagcaggcgctgatctccatcaccgaggagaacctcgccgacgtcaaggagtaccgcgggcggggcctcgtctggggcatcgagttcaaggacaaggaccgcgccgggcgcatcgcacagcgcgccttcgagctcgggctgctcatcgagacgtcgggcccggagagcgaggtcgtcaagctgcttccggccctgacgatcacgcccgaggagctcgacgaggggctgcgtaccctcgcccgcgccgtacgggaaaccgcc

SEQ ID NO: 6375 - DNA, 537 bp, Streptomyces avermitilis
  CDS (1)..(537)
atgaccgccgcacacgcagacctgcaagcggaattcctggaaatgcccgagggactgcggatcgaccgcccggacgtggcggacgggtccgcactctggcgcatcgccaaggactccaagaccctcgacctgaactcctcgtacagctatctgctgtggtgccgtgacttcgccggcaccacggcggtggcacgagccgccgacgggacgcccgtcggcttcatcaccgcgtacgtgcggcccgagcgcccgcacaccctcctcgtctggcaggtggccgtcgacgcggcgtaccgcgggcgcgggctggccgcgcgcatgctcgacggactgaccgcacgcgtcacggacgagtacggggtgaccggcatcgagacgacgatctcccccggcaacaccgcctccgaacgcctgttcacctcgtatgcgcagcgccacggcgcggacctcgagcgtgaggtcctgttcgaggcagggctgttccccgacgccccgcacgaccccgaggtcctgtaccgcatcggccccctctcccac

SEQ ID NO: 6376 - DNA, 1128 bp, Streptomyces avermitilis
  CDS (1)..(1128)
atggaacccgtgagcgaagagagcatcgccgtgacccaccccttcctggacctggcacccctgagcgccgcgcacttcgcctcgatcgaggaccgggtggcccggctgctcgccaccgagcaggacgtcgtgatcatgcagggcgaggcgctgctcccgctggagggtgccattcgcgcggccgcgggccccggcacgaccgcgctcaacgtcatcaccggcccctacggccagaccttcgggaactggctgcgggactgcggcgcgacggtgatcgatctggccgtgccgttccacacggcggtgacggccgcgcggatccgggaggcgttcgcggcgcacccggagatcgacttcgtgtcgctggtgcacgcggaggcggccacgggcaacacgaatccggtcgcggagatcggcgcggccgtacgggagcacggtgcgctgttctatctggacgccgtcgcgtcgatcggcgccgagccggtgctgccggacgcgtggggcgtcgacctgtgcgtgatcggggcgcagaaggcgatgggcgggccggccggggtgtcggcggtgtcggtgagcgagcgggcgtgggcgcggatggcggccaacccggcggcgccccggcggtcgtacctgtcgctcctggactggaaggagcggtgggtcgacggcggccgcaaggcgctgctgcacgcgccggcgcagctggagatgctggcgctcgaggcgtgcgtggagcggatcgaggccgaggggctggaggccgtgatggcccggcacgcctcggccgcggcggccacgcgggccggggcggtcgccctgggtggcgggctcgaaccgtatgtgcacgaggccgcggacgcggcgcccgtcgccacgacgctgcggacgccggccgggatcgacgcctcggagctggtcgccaaggcgctggcctcggatccggtgctgccgctcgtcgcgggcgggggcgcgctcgcccgcgagatggtccgggtcaaccactacggacccggcgcgacgcggggtgtggtgcagtcctgcctgggtgcgctgggggccgcgctggccgagttcggcgtgccggtggacctggagggggcccggcgcgcggtggccgaggcctgggcc

SEQ ID NO: 6377 - DNA, 846 bp, Streptomyces avermitilis
  CDS (1)..(846)
gtgaagacggtcctcggacgccggtcccgcattctggccgccaccaccgcgacggccgggctgctgctcgtggccggctgctcctcggacaacgggggaggcaagaccaccgtgaagggcgtcccgctcgtcaaggcggggcagatcaccacctgtacccacctcccgtacccgccgttccagtcggagatcgacggcaaggtgcagggcttcgacgtgtcgctcatcgacctggtcgccaaggacctcggcgtgaagcaggccatcgtcgacacgcccttcgagaacttcaagacgggcgccttcctcaactccggccagtgcgacgtcgccgcggccggcatgaccatcaccgaggagcgcaagaagaacgtcgacttctccgacccgtacttcgaggccacccaggccgtgctggtcgacaagaagagcggcgtcgactccctcgccgacgtgaaggccaagggcaagaagctcggcgcccaggcgcagaccaccggcgaggagtacgcgaagagcaagggcttcgacgcggtctccttcgagtcctccgacgcggtcctcaacggcctgcgcaccggccaggtccaggccgtcatcatcgactacccggtggtccagggctggctgaaggacaaggccaacgccgacgccttcaaggtcgtcgacaacctcaacaccggtgaggagtacggcttcacggtgaagaagggcaacaccaagctcctcgccgagatcaacaaaacaatcaagcaggcgaaggccgacggcacgtacaagaagatctacgagaagtggatcggcccgtacaccgcgtccgcggccaccgcctccccgtccgcctca

SEQ ID NO: 6378 - DNA, 831 bp, Streptomyces avermitilis
  CDS (1)..(831)
atgagtgatgccgacgcacagctccagccccgcaggtccggtctgagcagacggcagaagcgtgccgtctcgcgcggcgtgcagtacgtcgtcttcgtcgcggccgtcatcgccttcgcggtgctggccgactggggacagctgaagaaccagttcgcgcagtgggacctggtcaagcagatgttcccggacgtcatcacactggcgctgaagaacaccgtgctctacacgatgtccggcttcgtcgtcggactcgtactcggcatggtcatcgccctgatgcggctgtcctcggtgggcccctaccgctggctcgccggcatctacatcgagatcttccgcggcctgcccgccctgctgatcttcgtcttcgtgggcgtcgccgtgccgctggcgttcccgggtacggagatccccggcggcacctacggcaaggtggcactcgcgctcggcctggtctcggccgcctacatggccgagacgatccgcgcgggcatccaggcggtgcccaagggacagatggaggccgcccgttcactgggcttctcgcacgcgcgggccatggtctcgatcatcatcccgcaggcgttccgcatcgtgatcccgccgctcaccaacgaactcgtcctgctcttcaaggactcctcgctggtgctgttcctcggcgtcaccctggaggagcgcgaactgacgaagttcggccgcgacctggcgagccagaccgccaactccacgccgatcctggtcgcgggcctgtgctatctgctggtcaccgtgccgctcggattcgtcgttcgccgcctggaggccaaggccggggaggccaccaag

SEQ ID NO: 6379 - DNA, 801 bp, Streptomyces avermitilis
  CDS (1)..(801)
gtgagtacgccagagatcgacgtccggggcctgcacaagtccttcggcgacaacgaggtgctgcgcggcatcgacctggagatcggctccggagaggtcgtctgcgtcatcggcccgtccggctccggcaagtccaccctgctgcgctgcgtgaacctcctggaggagcccaccaaggggcaggtcttcgtcgccggtgcggaggtcacggaccccgacgtcgacatcgacgccgtacgccgccgtatcggcatggtcttccagcagttcaacctcttcccgcatctgtcggtgaccgacaacctcacgctgccgcagcgccgcgtcctcgggcgcgacaaggcgcaggcggccgaggtggccgccgacaacctcaggcgcgtgggcctgtcggagaaggcggaggcgtaccccgcctccctctccggcggccagcagcagcgcgtggcgatcgcccgcgcgctcgccatgggtccccaggtgatgctgttcgacgagccgacctcggcgctggaccccgagctcgtcggcgatgtgctcgcggtgatgcgcaggctcgccgacgagggcatgacgatgatggtcgtcacccacgagatgacgttcgcacgcgaggtcgccgaccgggtcgtcttcatggacggcggcgtgatcgtcgaggacggcacgcccgagcaggtcatcggcaacccgcgacacgaacggacccggcacttcctgtcccggctcctcgaccccgcgatggcggacgtggaggaggagatctcggaccaggtggggaagagcgagcagccgccgaac

SEQ ID NO: 6380 - DNA, 1089 bp, Streptomyces avermitilis
  CDS (1)..(1089)
atgagcgatcacgcggtgctgcacgtgaaggggcgggtgctcgtcggacccgacgacgtccgcgacgaactctgggtggtcggcgggagaatcgcctacgcgcctcccgccggcgcccgggacatccgtaccgtcgagggctgggcgctgcccggtctggtggacgcgcactgccatgtcgggctcgaccggcacgggccggtccccgacgacgtctccgagaagcaggcgctcgccgaccgcgaggccggcaccctcctcgtccgcgacgcgggctccccgtccgacacccgctggatcgacggccgcgacgacctcccgaagatcatccgggcgggccgccacatcgcccgcacacggcgctacatccgtaactacgcccacgagatcgagcccgaggacctggtcgcgtacgtcgcgcaggaggcccggcgcggcgacggctgggtgaagctggtgggcgactggatcgaccgcggcacgggcgacctgagcgcctgctggccgccggacgccgtccgggccgcgatcgcggaggcccaccgcctgggggcgcgcgtcaccgcgcactgcttcgccgaggattccctgcgggacctggtcgaggcgggcatcgactgcgtggagcacgcgaccgggctgaccgaggacaccatcccgctgttcgccgagcggggcgtcgccatcgtaccgacgctcgtgaacatcgcgctgttcccgcagttcgcggccgacggcgaggccaagttcccgcgctggtccgcgcatatgcggcgactgcacgagcggcgctacgacaccgtgcgcgcggcgtacgacgcgggggtcccggtgtacgtcgggaccgacgcgggcggttcgctggcgcacggactcgtggcgggcgaagtggccgagctggtgaccgcgggcatcccgcccctcgatgcgctgtcggccacgacgtggggtgcgcggcggtggctggggcgccccggactcgacgaaggggcgccagcggacctcgtcgtgtacgagggtgacccgcgcgcggacgtccgtgtgctcgcggcgccgcggcgggtcgtgctgaacgggcgggtcatcggc

SEQ ID NO: 6381 - DNA, 978 bp, Streptomyces avermitilis
  CDS (1)..(978)
gtgaacgtgcgggccgacacgcccccggcctggctgcgcgagcggatcgccgagtcgctgggcgggctcgcggcatacccggacgggcgtgcggcgcgggccgcggtggcacagcggcacgcgctgcccgtggagcgggtgctgctcacggcgggcgccgccgaggcgttcgtgctgctcgcgcgggctctgaaggtgcgccggccggtggtcgtgcacccgcagttcacggagccggaggcggctctgcgggacgcggggcacacggtggaccgggtgctgctgcgggaggaggacggcttccggctggacgcgggggccgtgcccgaggacgcggatctggtcgtgatcggcaatccgaccaacccgacgtcggtactgcacccggccgcgtcgatcgccgaactggcccggcccgggcggacgttggtggtggacgaggcgttcatggacgcggtgccgggtgagcgggaggcgctctccgggcggacggacgtccccggtctggtggtgctgcgcagtctcaccaagacatgggggctggcggggctgcgcatcggctacgtgctcgccgcgcccgagacggtcgccgagctggagcgggcgcagccgctgtggccggtgtccacgcccgcgctggcggcggcggaggtgtgcgtgtcgccgcgggcactggcggaggccgcgcacgcggcgcaccgtatcgcggcggaccgggcgcatctggtcgcggggctgcgggagttcgcctccgacgggctgtgcgtggcggagccggccgagggtcctttcgtcctggtgcggcttccgcgggcggccgcggtgcggggtcacttgcgcgggctgggcttcgccgtgcgtcggggggacacgtttccggggctgggcgaggagtggctgcggctggcggtgcgggaccgggcgacggtgaaccggtttctccaggcgttggaccgggcggtcacgttggcggaccgc

SEQ ID NO: 6382 - DNA, 936 bp, Streptomyces avermitilis
  CDS (1)..(936)
gtgaccacccctgcccctgccctgctcatcgccggtcacggcacccgggacgaggccggagccgaggcgttccgcgacttcgtccgcgaactgggccgccgccaccccgaactgcccgtcgcgggcggcttcatcgagctgtccccgcccccgctcaccgaggcggtgggcgagctggtggagcggggggtgcgccggttcgccgccgttccgctgatgctggtgtccgccggacacgccaagggggacatcccggcggctctggcccgcgagaaggagcggcacccggggatctcgtacacgtacggccgtccgctcggcccgcacccgtcgctgctgaacgtcctggagcggcggctcgacgacgcgctcggcggcggcccccgtacgccgcaggaccgggccgatgtgaccgtgctgctcgtcgggcggggctcgacggacccggatgccaacgccgaggtgcacaaggcggcgcggctgctgtgggaggggcggggttacgcgggcgtggagacggcgttcgtgtcgctggcggcgccggacgtgccctcgggtctcgaccggtgcgtgaagctgggcgcccgccggatcgtggtcctgccctacttcctgttcaccggcatcctcccggaccgggtgcggcagcagaccgagggctgggcggccgcgcaccccgaggtcgaggtgcggtccgccgatgtcatcggtccggagccggagttgctcgatctggtgatggagcggtaccgggaggcggtgcagggcgatctgcggatgaactgcgactcgtgcgtgtaccgcatcgcgctgcccggcttcgaggacaaggtggggctgccgcagcagccgcacttccacccggacgacgacggtcaccaccaccacgggccacacggacacggacaccacggtcatgcgccttcacacgcccac

SEQ ID NO: 6383 - DNA, 612 bp, Streptomyces avermitilis
  CDS (1)..(612)
gtgaaccgggcgttcgtacccgaggaccgtgtcgtccaccccatcgagcaggagtcgttccggcggctgcgcgcccgtctggacacctcgcacttcccgccgctgacccgggcggtcgtggagcgggtcatccactccgcggccgatctcgactacgccgaggacctcgtcatggacgagggcacgctggagcgggcacacgccgcgctgcacgcgggggcgccggtggtggtggacgtggagatggtcgcggccggcatcacccggcgcgggacggtctgccgtctcaaggacgccaggtccggtccggggctgacccgttcggcgcacgcggtccggctcgcgtacgaggaggtcggccccggcgcgctgtgggtgatcggctgcgccccgaccgcgctggaggaactgctcaccctggacgcctccccggcgctcgtcatcggtctgcccgtcgggttcgtcggcgcggccgagtcgaaggccgcgttgcgcgagagcgggctgcccgctgtcagcaacgtgtccatgaagggcggttcggcggtcgccgcggccgcgctcaacgccctgctgtaccacctcgccgcacccgcttcgaaggagaaatcg

SEQ ID NO: 6384 - DNA, 1599 bp, Streptomyces avermitilis
  CDS (1)..(1599)
gtgtacgacgggcccgtcggcgaggccgtgcggcgggccttcgcggagtgcgagcagctcgtgtgtttcctggcgacgggcgcggtggtgcgtctggtggcgccgctcctcggcgacaagacgtccgacccgggcgtcgtgtgcgtcgacgaggccggccggttcgccgtgtccctggtcggcggccatggcggcggcgccaatgaactcgcccgtgaggtgggcgagttgctgggggccgagcccgtcgtgacgacggcgacggacgccgtggggctgcccggcctcgacacgctcggcttccccgtggagggcgatgtctccggggtctcccgggccctgctggacggcgaggccgtggcgctggacgcggaggtgagctggccgctgccgccgctcccggtcgccgccgagggccggtacgcgatccggctcaccgatcgtctcgtcgagcccggcgaacgcgaggtcgtgctccggccgccctccctcgtcgtcggcgtcggggcctccaggaacgcacccgtcgaggaggtcctcggcctggtccaaggcgccctgcgtgacgcggggctgtccgtgaagtccctcgccgagctcgccaccgtcgacgccaaggccgacgagcccggcatcgtcgaggcggccgcgcggctcggggtgcccctggtgacgtactccgccggggaactggcggcggtcgaggtgccgaacccgtccgacgcgccgctcgccgccgtcggtacgccctccgtcgcggaggccgccgccctcgtacgcgggggtgaactcctcgtgccgaagcgcaagtcggccgcacagccggcgatggcgacctgtgccgtcgtacggcggccggcccgcgggcgcctcgccgtcgtgggactgggacccggcgcccgggatctgctcacgccccgcgccagggacgaactccgccgcgcctccgtgctcgtggggctcgaccagtacgtcgaccagatccgcgacctgctgcgccccggtacccgggtcctggagtcggggctcggcgccgaggaggagcgggcccgcacggcggtggccgaggcccggcgcgggcacgccgtcgcgctgatcggcagcggggacgccggtgtgtacgcgatggcgtcgcccgcgctggccgaggcgtccgacgacatcgacgtggtcggcgtgccgggcgtcacggcggcgctggcggccggggcgatcctcggggcgccgctgggccacgaccatgtgtcgatcagcctttccgacctgcacacgccgtgggaggtcatcgagcggcgggtacgggccgccgccgaggcggacatcgtggtgacgttctacaacccgcgcagccggggccggggctggcagctgcccgaggcgctcgcgatcctcgccggacaccgggagccgacgacgcccgtcggtgtcgtacgcaacgcctcgcggacggacgagtccagccgcctcaccacgctcgcgggactggatccggcgacggtggacatgatgacggtcgtgaccgtggggaacacggcgacccgtgagatcgccgggcgcatggtgacgccgcgcggctaccgctggcaggaggagtccgag

SEQ ID NO: 6385 - DNA, 1248 bp, Streptomyces avermitilis
  CDS (1)..(1248)
gtgatcaccgtcgtcggtacgggaacgggggcgcccctgtccgcggacgccgcgcgcgccctggccggggcggggctcgtggtgggcggccgacggcatctggcggcggccgcgctgccggacggggccgagcggatcgtcctggggccgctggcgcccgctctcgacgcgatcgaggcggctctggagaagcaacggcgggtggtggtgctggcctccggcgacccggggttcttcgggatcgtacgggcactggccgagcggttcggcgccgagcggctggatgtgcgtccgggtgtctcgtccgtggcgaccgccttcgcgcggctcgggctgccctgggacgacgcggtggtggtgagcgcgcacggacgtgatctgcgcaccgccctgaacgtctgccggtcgcgtcccaaggtggcggtgctgaccgggcccggcgccgggcccgccgagctgggggccgcgctcgcccacgggttcggcgcgcgggtcctcgtggtggcgagcgcgctcggcgaccccgagcacgaacgcgtggagcgggtgacgccggccgaggccgcggcccgcgactggggtacggcggtcagcgtggtgctgtgcctggacgcctcccgggccctcgctcccgtgcgcacggtcgcgggcccgccggccggtcccgcccgctgggccctggaagagggcgacttcgcccaccgcgattcgatgatcaccaagttcgaggtgcgcgccctggcgctggcccggctcggcccgcggctcggggacctcgtctgggacgtcggcgcgggctccgggtcggtggccgtcgagtgcgcgcgcctcggtgccgccgtcacggcggtcgagaagacgctcgacggggtggagcggatccacgccaacgcgcgggcgcacggcgtggacgtccacgtcgtgcacggggccgcgccggacgcgctgaccgctctccccgacccggacgccgtgttcatcggcggcggcgggcgcgaactgcccgccctcgtcaccgcgtgcgcgcggcgcgcccggcggacggtcgtcgtggcgatggccgcgctcgaccgggtgccggccgtgcgcgaggcgctcaccggggccgggttcggctgcgacggtgtgctgttgcagtcgtcccggctcgccccgctgcccggggacgtcacccggctcgcggcgaccaatcccgtttttctgctgtggggcgcccggcctccggcccgtaccgaaggagcactccag

SEQ ID NO: 6386 - DNA, 822 bp, Streptomyces avermitilis
  CDS (1)..(822)
atggccgatgcccccaccggcaaggtgaccttcgtcggggccggccccggcgccgccgacctgctgacgttccgtgccgcgcgcgccatcgccgaggccgacgtcgtgatctgggcggccagcctggtccaggccgaggtgctcgaccacgcgcgcgcgggcgcggacatcctggattccgcgacgatgtccctggaggacgtcgtcgccgtgtaccggcgggcgcacgcggagggcctgaaggtggcccgcatccactccggcgacccggccctgtggggcggtacgcaggaacaggccgaccggtgtgcggagatcggcatcgagaccgagatcgtgcccggcgtctcctccttctccgcggtcgcggcgctcgccgggcgcgagctgaccatccccgaggtcgcgcagtccgtgatcctcacccggctcggcggcggcaagacgccgatgccgcccggggaggaggtccgcgagttcgcccgccacggtacgacgatggccctgttcctgtcggccgcccgcagcggtcagctggtacgggagctgctggagggcggctacccgacgtccacgccggtcgtggtcgcgtaccaggcgacctggccggaggagctgatcgtgacgtgcacgatcgagacgctggaggagacggtcaaggagcacaagctctggaagcacacgctcttcctggtcggcccggccctcggcgcgcacggcacccgctcgcacctctaccacccgggccacttccacgggttccgcaaggccgacccgcaggcgcgggcggagctgcgggcggcccgcaagggaagtccgtcg

SEQ ID NO: 6387 - DNA, 726 bp, Streptomyces avermitilis
  CDS (1)..(726)
atggcggtcttcgtcgcgctcggcgcgttcctgatgacgctggccggcggctggacggcacagcgggtgaccgaccgtcgccacctggtgctgggcctggccggcgggctgatgctcggcgtggtcggtatggacctgctgccggaggcgctcgacgcggcgggcggcaaggtgttcggcgtaccggccgcactgctgctgttcgtggccggcttcctgctggcccacctggtggaacgcctgctggcgcaccggcaggccgcccacggcggcgcggagagcaacggccgggcgcccgaggtgggcctgacggccgccgccgcgatggtcggacacagcgccatggacggcgtcgcgatcggcgccgccttccaggtgggcggcggcatgggcctggcggtggccgtcgcggtcatcgcgcacgacttcgcggacggcttcaacacgtacacgctcacggccctgtacggcaacgcgcgccgcaaggcggtcatcatgctcgtcgcggacgcggtggcccccgtgctgggcgcggcgtccaccctggcgttcaccatcccggagcgcctgctcggcggctacctcgccctcttcggcggcgcgctgctctatctcgccgccgccgagatcctcccggaggcacaccacgagcaccccgcccgctccaccctgctgtgcaccgtggcgggcgtgggcttcatctggctggtggtgggcctcgcgggc

SEQ ID NO: 6388 - DNA, 747 bp, Streptomyces avermitilis
  CDS (1)..(747)
atgagcagcaagctgatcggagtcggggtcggacccggcgaccccgagctggtgaccgtcaagggcgtcaacgctctgcgggccgccgacgtcgtggtcgtaccggtgatggccgcaccggacgggacggacggcggcgagcgggggcgcgccgaggcgaccgtcctgcactacgtgcccgaggagaaggtcctgcgggtcgtgttcgcgctcaacgagcgtgccgaccgcggccggcgcgaggccgcctgggacgccgcgggcgggcgggtggccgagctgctcacggcgcacggcaccgtcgccttcgccacgatcggcgaccccaacgtgtactcgaccttcacctatctcgcgcacacgatccaggacctggtcccggggaccgtcgtcgagaccgtgcccggcatcaccgccatgcaggacctcgccgcccggtcgggggccgtcctcaccgaggggaccgaacccctgaccctcgtcccggtgaccgccggggcggccgtgctcaaggaggcgctgaacgggcccggcacggtcgtcgcgtacaagttcgggcggcaggcgcacgaggtggccgaggcgctgcgcgagaccggccggatcgacgacgccgtgtggggctcggcgctggggctggcggaggagtccatccggcccgccgcggacctcgacggcgggccgctgccctacctctccacgctgatcgcccccgcgcggcgcgagggcggacgcggcgggaagctg

SEQ ID NO: 6389 - DNA, 1362 bp, Streptomyces avermitilis
  CDS (1)..(1362)
gtggtgatgtcgtccgtccctcggctggtcattgccgcgccctcctcgggcagcggcaagaccaccgttgccacggggttgatggccgcgttcaccgcgcgggggctcgccgtgtccccgcacaaggtggggcccgactacatcgaccccgggtatcacgcgctcgccaccgggcgggtgggacggaacctcgacgcgtatctgtgcggggcggagctgatcgcgccgctgttcgcgcacggggcgcggggctgcgatctcgccgtcgtcgagggtgtgatggggatgttcgacggggccgccggggagggcgagctggcctccaccgcccacgtggcgaagctgctgcgggcgccggtggtgctggtcgtcgacgcgtcgtcgcagtcgcggtcggtggcggcgctggtgcacgggttcgcctcctgggatccgcgggtgcgggtcgggggcgtgatcctgaacaaggtcgcttcggatcggcacgaggagctgttgcgggaggcgctggactcggcgggagtaccggttctcggggtgctgcggcgggccgagcaggtggacacgccgtcgcggcatctcgggctggtgccggtcgccgagcggctggcggcggccgtggcggcggtggccgcgatggccgcgcaggtgcgcgagggctgcgacctcgacgcgctgttcgcgctggcgcgcggtgcgggtgcactgtcggatgacccgtgggagccaccggtgctctccgcgacggaacgtccgacggaacgtccggtcgtcgccgtcgccggcggccccgccttcaccttctcctacgccgaacacgccgagctgctggccgccgccggggccgaggtcgtcaccttcgaccccctccgcgacgagcgactgcccgacgggagtgccgggttggtgatcgggggcggcttccccgaggtgtacgcgccggagctgtccgccaacgagccgctgcggaaggccgtcgcggagctggcgctcgcgggcgcgcccgtcgccgcggagtgcgccgggctgctgtatctctgccgtgaactcgacgggcagcccatgtgcggtgtgctcgacgccgaggcgcggatgtccggcaggctcacgctcggctaccgcgacgccgtcgccgtcggcgacagcgtgctcgccgcggccgggacccggatgcgcggccacgagttccaccggaccgtcgtcgagccgggcgcgggggcggctcccgcctggggggtacgcgccccggttcggcgggtcgaaggtttcgtacaacacggtgtgcacgcgagttatctgcacacgcactgggccgccgcgcccggtgtcgcccacaggttcgtcgagaggtgccggacgtca

SEQ ID NO: 6390 - DNA, 597 bp, Streptomyces avermitilis
  CDS (1)..(597)
atgccgcaggggcagccgagtgtcgtaccggacgatggactgaccacccgccagcgccgcaaccggccgctcgtgatcgtgcacacgggcatcgggaagggcaagtcgaccgccgccttcgggctggcgctgcgcgcctggaatcagggctggccgatcggcgtgttccagttcgtgaagtcggcgaagtggaaggtcggcgaggagaacgcgctgcgggtgctcggcgccagcggtgagggcgggtccgtcgactggcacaagatgggcgagggctggtcctgggtccagcgggatgcccagatggacaacgaggagaaggcccgcgagggctgggagcaggtcaagcgggacctggcggccgagacgtacaagctgtacgtgctcgacgagttcgcctacccgatgcactgggggtgggtcgacaccgacgaggtggtctccgtgctgcgggagcggcccggtacccagcacgtcgtcatcaccggccgcaacgcgcccgagaagctcgtcggcctcgccgacctcgtgaccgacatgtccaaggtgaagcacccgatggacgccggtcagaaggggcagaggggcatcgagtgg

SEQ ID NO: 6391 - DNA, 2067 bp, Streptomyces avermitilis
  CDS (1)..(2067)
gtgagtaccccgtttccgttcacggccgtggtcggccaggacgatctgcggctcgcgctgctgctgaacgccgtgtcgcccgcggtgggcggcgtgctggtccgcggcgagaagggcacggccaagtccacggccgtacgcgcgctttcggccctcatgcccgaggtggacgtcgtcgcgggctgccgcttctcgtgtgcgcccggctcccccgacccggcgtgcccggacggaccgcacgaggtcgggccgggcgttcggcgtcccgcgcgcatggtcgaactgcccgtcggcgcctccgaggaccggctcgtgggcgcgctcgacatcgagcgggcgctcgcggagggtgtgaaggccttcgagcccggcctgctggccgacgcgcaccgcgggatcctgtacgtcgacgaggtcaacctcctccacgaccacctggtcgacctgctcctggacgcggccgcgatgggtgcctcgtacgtggaacgcgagggcgtctccgtacggcatgccgcccgcttcctgctcgtcgggaccatgaatcccgaagagggcgagctgcggccgcagttgctcgaccggttcgggctcaccgtcgaggtcgcggcctcgcgggagcccgatcagcgggtcgaggtcgtccggcgcaggctcgcgtacgacgacgatccggaggccttcgccgcgcgctgggccgacgaggagtccgccgtgcgggcccggatcgtggccgcgcgggagctgttgccgtccgtgcggctcggcgacggggcgctgcggcagatcgcggcgacctgcgcggccttcgaggtcgacgggatgcgggccgacatcgtgatggcgcggacggcgaccgcgctggccgcgtgggacgggcgctccgatgtgctcgccgaggacgtacggcaggcggcgctgctcgcgctgccgcaccggcggcgccggaatccgttcgacgcgccggggctcgacgagaacaagctcgacgagacgctggaggagttcggcggccaaaacgaggacgaaggcgacgacgatccggatccggacgggccgggcggtggcgggcagccaccggagaacggccccgagggcggacctcaggacggccctcaggacggatctcaggaagggcctcaggacggggccgacagctcggaaccgggtggtgacgaggccgcgcggcctcaggccggtgagtcggggcagccgggggcgtccggtgccggtgagcagcaggccgtgcgggccggtgagccgttccgtacgaaggtgctgagcgtgcccggtctcggcgagggcgcggcgggccggcgttcgcgcgcgcggaccgagcacgggcgcacgaccggggcccggcggccccgggggacgctcaccaagctgcacctggcggcgaccgtgcaggccgcggcaccccatcagcgggcgcgcggccggtcggggcgtgggctcgtcgtacggcgggacgatctgcggcaggccacccgtgaggggcgtgagggcaacctcgtgctcttcgtggtcgacgcctccgggtcgatggcggcccggcagcggatgagcgccgtcaagggcgcggtgctgtcgctgctgctcgacgcgtatcagcggcgggacaaggtggggctggtgaccttccgcgggtccgcggccgaggtggcgctgccgcccacctcttcggtggacgcggccgcggtgcggctggagtcgctgcccacgggcgggcggacgccgctggccacggggttgctcaaggcgcacgacgtgctgcgggtggagcggctgcgggatgcggcacgccggccgctggtcgtcgtggtgacggacgggcgggcgacgggcggccccgagccggtggcgctcgcgggccgggcggcgcggctgttcgcggccgacggggtcgcgtccgtggtcgtcgactgcgagtcggggccggtgcggctcgggctggccgggcagctcgccggggagctgggcgggacgcccgtcacgctggacgagttgcgggccgactcgatcgccgggctcgtacgagacgttcagtcaagcaacaggagggccgcg

SEQ ID NO: 6392 - DNA, 3651 bp, Streptomyces avermitilis
  CDS (1)..(3651)
atgagcacagtgttgttgttgtcgaccgccgacaccgatctgctggcggcccgcgcctccggcgccccgtaccggatcggcaatccgacccgggtcgacgtgtccgaagagctgcccgcgctcgtcgcgggctcggacatcgccgtcgtacggctcctcggcggcaagcgcgcctgggaggacgggctggcggcgctcaaggcgtccgggattccgaccgtgctcctcggcggcgagaccgtcccggacgcggagctgatggccgagtcgtccgtgcccgccggggtggtcgccgaggcgctgcggtatctggtcgagggcggttccgccaacctcgtcgagctggcccgcttcctgtcggacaccgtgctgctgaccggcgagggcttcgtcgagccgcagcagatgccggagtacggcgtccacggcgagcgtccgtacacgcagggccgtccgaccgtcggcgtgctcttctaccgggcccacgagctgagcggcaacaccgccttcgtggacacgctgtgcgatgccgtcgaggcgcggggcgccaacgccctgcccgtgtactgcggttcgctgcgcggcgcggacaccgggctgtacgagatcctcggcaaggccgacgcgctcgtcgccaccgtcctcgccgcgggcggcacccacgcctcccaggcatccgccggcggcgacgaggaggcgtgggacatcggcgcgctcaccgatctcgacatcccggtgctgcaaggcctctgtctcacctcctcgcacgccgcctgggaggggtcggacgccgccctgtcccccatggacgcggcgatgcaggtcgcgatcccggagttcgacggccgcctcatcacggtccccttctccttcaaggagcagggccccgacgacgtcccggtgtatgtcgccgaccccgagcgggccgcgcgggtcgccggaatcgccctgcggcacgccctgttgaagcacaagccgaacgcggagaaaaagctcgggatcgtcttcaccgcctatccgaccaagcactcgcgggtcggcaacgcggtcggtctcgacacgcccgcctccgcggtacgggtcctcgacgcgctccgggacgcgggctacggcctcaccgaataccccgacaacggcgacgagttgatccaccggctcatcgcggccggcggccacgacgtcgagtggctgaccgaggagcagctcgccgccgctccggcgcgcgtgccgctcgcggactaccgggcgtggttcgagacgctcgaccccgctctgcgcgagggcatgctggaggcctggggcgagccgccgggctccctctacgtcgacggcgacgacatcgtgctggcctgcctccagttcgggaacgtcgtcgtgatgatccagccgccgcgcggcttcggcgagaacccgatcgcgatctaccacgacccggacatgcctccgtcgcaccactacatggcggcctaccggtggctggagaacagtttcggcgccgacgccgtcgtacacatgggcaagcacggcacgatggaatggctgccgggcaaggggctcgggctcagcggtggctgcgcccccgacgccgtactcggcgaactccccctggtctacccgttcatcgtcaacgaccccggcgagggcacccaggccaagcgccgcgggcacgccaccgtcgtcgaccacctcgtaccgccgatggcgcgcgcggacacgtacggcgacctcgccaagctggagcagctcctcgacgagtacgcgctcgtgtccgacctggacccgacgaaggcaccggccgtgcgcgcccagatctggacgctggtcaaggcggccgagctgcaccacgacctgcacgtggacgatcagccggacgacgacgcgttcgacgagttcgtcatgcacatcgacggctatctgtgcgagatcaaggatgtgcagatcagggatggcctgcacattctcggcggcgggccggaggccgagccgcgcgtgaacctcgtgctggccgtgctgcgggcctcgcaggtgtggggcggtcaggccaacgccctgccgggcctgagggcggcgctggcggcccatttcggcctggtcgagaaggagttgctgggcgagccgggtgcgccggtgaaggtgccggccgagctgagcgacctcgtcgaggggccgtcccggtcggcggccgacgcgatcgacctgctggagcagctgtgccgacgggccgccgagggcatggaggagcgcggctgggacgtcgccgccgtccccgcactcgtccgcgaggtcctgggcagcgaactcccggacgccgtggcggtgctggagttcgcgtgccgtgaggtcgtgccgcggctcgcccggaccacggacgagatcgaccacatcctccgcgcgctgaacggcggttatgtcccggcgggcccctcgggttcgccgacgcgcggactcgtcaacgtcctgccgaccggccgcaacttctactccgtcgaccccaaggccatcccgtccaggctgagctgggaggtcgggcagtcgctcgcggactcgctgatccagcggtatctccaggacaccggcgagtacccgaagtcggtgggcctcacggtctggggcacgtccgccatgcgtacgcagggcgacgacatcgccgagatcctcgcgctgctgggctgccgtcccgtctgggacgacgcctcgcgccgggtgaccggcttcgaggtcgtgcccctggacgaactcgggcgcccccgcatcgacgtcacggtccggatctccggcttcttccgggacgcgttcccgcacgtggtcgggctgatcgacgacgcggtgcgggcggtggccgaactggacgagcccgtggacctgaactacgtccgcaagcacgccgacgaggacaccgccgagcacggtgaccggcgacgcgccacggcccgtgtcttcggctccaagccgggtgcgtacggcgccggtctgctcccgctcatcgacgcgcgcaactggcgctccgacgcggacctcgccgaggtgtacgcggtgtggggcggatacgcgtacgggcgcgggctggacgggcgggcggcgcgcggggacatggagacggcgttcaagcgcatcgccgtcgccgcgaagaacgtcgacacccgcgagcacgacctcgtcgacgcagacgactacttccagtaccacggcggcatggtcgccatggtccggcatctgacgggcgcgagtccggaggcctacgtcggtgacagcgccgtaccggaccaggtgaagacccggaccctcggcgaggagacgcaccgcgtgttccgcgcgcgggtcgtcaacccgcgctggatggcggcgatgcggcgccacggctacaagggcgccttcgagatggcggcgaccgtcgactacctcttcgggtacgacgccacggccggcgtggtcgacgactggatgtacgagaagctcagcgcggagtacgtcttcgacgcggagaaccgggacttcatgaagaagtccaacccgtgggcgctgcgcgggatcacggaacggctgctcgaagcggccgagcgcgggctgtgggccgagccggacgcacagacgctggagcggctgcgcgccacctatctggagctcgaaggcgatttggagggcgacgaccag

SEQ ID NO: 6393 - DNA, 1506 bp, Streptomyces avermitilis
  CDS (1)..(1506)
atgagcggcggactgctgatcgccggtaccacctccgacgcgggcaagagcgtcgtgaccgccgggatctgccggtggctggtgcgccagggcgtcaaggtcgcgcccttcaaggcgcagaacatgtccctgaactccttcgtcacgcgcgaaggtgccgagatcgggcgcgcgcaggccatgcaggcacaggccgcccgggtcgagcccaccgcgctgatgaaccccgtgctgctcaagcccgggagcgacagaagcagccaggtcgtcctgatgggcaggcccgtgggcgagatgagcgcgcgcggctaccacggcgggcggcaggaggcgctgctcgggaccgtcctggactgtctcgccgagttgcggggcacgtatgacgcggtgatctgtgagggggccggcagtcctgccgagatcaatctgcggcggaccgacatcgtgaacatggggatcgcacgcaacgcgcggctgcccgtgctcgtcgtcggcgacatcgaccgcggcggcgtcttcgcctccttcttcggaaccgtcgccctgctgtcgcgcgaggaccaggaactcgtcgccgggttcctcgtcaacaagttccgcggggacgtgtccctgctggagccgggcctcgacatgctccggaacctcaccgggcggccctcgtacggcgtcctccccttccagcacggcctcggcatcgacgaggaggacggactgcgggtgtcgttgcggggatccgtacgggagtcggcggtgtcctcccccgtcggcgaggacatcctccgcgtcgccgtctgcgcgatccccctcatgtccaacttcacggacgtggacgcgctggccgccgaaccgggcgtcgtcgtgcggttcgtggaccggcccgaggagctggcggacgccgacctcgtggtgattccggggacccgcgggacggtcaaggcgctggagtggctgcgggagcggggacttgccgaagcgctgcggcgcagagccgcggccggacggcccgtgctcgggatctgcggcggtttccaggtcctcggcgagcacatcgaggacgacgtcgagagccgtcggggccatgtggaggggctcggactcctccccgtgcgcgtccggttcgcccgggagaagaccctcacccggcccgtcggcgaggccctcggcgagcacgtcgaggggtacgagatccaccacggcgtcgccgacgtcacgggcggcgaccccttcctggacggctgccgggtcggcgccgtgtggggtacgcactggcacggctcgctggagtcggacggtttccgccgggccttcctgcgcgaggtggcggccgccgcgggccgccgcttcgtaccggccgccggcacgtcgttcgccgggctgcgcgaggagcagctggaccggctcggcgatctgatcgaggaacacgcggacacggacgcgctgtggcggctcatcgagtcgggcgcaccgtcaggactgcctttcattccaccgggagcgcccgca

SEQ ID NO: 6394 - DNA, 939 bp, Streptomyces avermitilis
  CDS (1)..(939)
atgcgtgccgatcgcgtcttcgcgtacggcgccgccgccgggctcatcggcgacctgctcctgggcgatccccgccgcgggcatccggtcgccgcgttcgggcgggccgcgggcgtcgtggagcgggtgctgtggcgggaccaccgcgggtggggcgcgctgcacaccgtcgtctgtgccggtggggccgtgggcctcgccgccgtcgccgcccgttccgtacgcacctcccgtaccgcttccgtcgcgctgaccgccgccgccacctgggccgtggtcggcgggacctccctcgggcgcgaggcgcgggccatcgggcaggccctggacgcgggggacatcgagggggcccgggagcggctcccccatctgtgcgggcgcgacccgggggccctcgacgccgacgggatcgcccgcgccgtcgtcgagtccgtcgccgagaacacctccgacgcggtcgtgggggcgctggtgtggggggctgtcggcggcgtgccggggctcgtcggtttccgggccgtcaacacgctcgacgccatggtcgggcaccggtctccccggtatctgcggtacgggtgggcctcggcccggctcgacgacgtcatggggtggccgggcgcccggctgacggccgtactcgccgccctcgccggacacgatccgcgcggcgccctgcgcgcctggcgctcggacgccgcccggcatccgagccccaacgccggcccggtggaggcctccttcgcgggggctctcggggtacggctgggcggaacgctctcgtacgggggcagggtcgaacaccggcccgtgctcaacggcggcggacgggccgtggacagcaaggacatcgagcgggccgtacgcctgtcgcggcgggtgggctggctcgccctgggcgtggccgccgccgggcggctgtggaaacggggagggacgtca

SEQ ID NO: 6395 - DNA, 213 bp, Streptomyces avermitilis
  CDS (1)..(213)
atgagcatcgactgggcagcactgggctccgtcttcggagtcagcctcgtggtcaccgtcggcctggtgggcctcttcaccctgggcatcgtcggcctcaccaagaaggagtcggccgagggcgggtcggccgcactggcgaccaccggcgcctacgcctgcttcgcggcgtgcgcggcggcggtggcgtacgggatctatctgatcgtcgcc

SEQ ID NO: 6396 - DNA, 1251 bp, Streptomyces avermitilis
  CDS (1)..(1251)
atggaacacatcacgcttctcctcgggatcgtgatcgttaccgctctcgtgttcgatttcacgaacggtttccacgacactgccaacgcgatggcgacgaccatctcgaccggcgctctgaaacccaagacggcggtggccatgtccgccgtgctgaatctcgtcggcgctttcctctccgtggaggtcgccaagacgatctccggcggcatcatcaacgaagagggcatccgcgtcgaagtgatcttcgcggcgctcgtcggcgccatcctctggaatctgctgacctggctcctgggtctgccctccagctcctcccacgcactgttcggcggcctgataggcgccgcggtcatgtcggccggctggtcgtcggtgaacggcccgaccatcgtcaccaagatcctgatccccgccgtcgccgcgccggtcgtggccggaatcgccgcgatgctggcgacccgcctcacctaccggatcggcgcccgcgccgacgagaaggcgaccaagaagggctaccgcgccgggcagatcgcctcggccggcctggtctccctcgcccacggcacgaacgacgcgcagaagacgatgggcatcatcaccctcgcgctggtgaccggcggtgtcgtcgcccccggctcgaaccccccgatgtgggtcatcgtctcggccggcacggccatcgcgctgggcacctacctcggcggctggcggatcatccgcaccatgggcaagggcctgaccgacctggccccgccgcagggcttcgccgcccagaccagcgccgcgacggccatcctggcctcctcgcacatcggcttctcgctctccaccacccaggtctgctccggctccgtcctcggtgcgggcatcggccgcaagggcggggtggtccgctggtccaccgcgacccggatgttcgccgcctggggtctgaccctgccggccgccggcctggtcggcgcgggcgccgaactcctcaccaagcagggcacctggggcaccatcgccaccggcgtgctgctggtcgccggtgcgggtgccatctgggccctgtcccgccgccagccggtgaccgtcgacaacgtcaacgacatcgcggccgagcccgcgggtgtcgtcaccaccgcgatcgccgcggtcaccccgccgccggcgggcccggtctccgtggtcgacgccaccgccgacctgaagaccaccatcccggccccgtccccgggcgcggagcccacccgtccggccacggtg

SEQ ID NO: 6397 - DNA, 741 bp, Streptomyces avermitilis
  CDS (1)..(741)
atggcccgtgatcacaaaccgtcccgtcgccgcgcccgcgtcctcgccgcgtccgcggcggtgttcgccatcggggggaccgtcttcgccgggcttcccgcctcggcggcgggcaagccgctgggccacgacgtctcgtcccaccaaaaggatgtcaactggtcgggcgcgcaggcgaagggcgccaggttcgtctacatcaaggcgaccgagtccaccgactaccgcaaccccttcttcggccggcagtacaacggttcgcgcaacgccggcctgctccgtggcgcgtaccacttcgcactgccggacaagtcgtccggcgccgcccaggccgcgtacttcgtgcgcaacggcggcggctggcgcgccgacggctggacgctgccgcccgcactcgacatcgagtacaacccgtacagcaagaagaagtgctacggcctgagcaaggccaggatggtcggctggatccagtcgttcagcgacgaggtgaaacggcagaccggccgccgcccggtgatctacacgaccacgcactggtggaacaagtgcaccggcggcagcgccgccttcgccgccgaccacgcgctgtggctggcccgctacgactccgcgaacgcgggggcgcttccggcgggctggtcgttctggacgttctggcagtacgacaacagcggcagcctgccgggtgaccagaatctcttcaacgggtccatgaccggactgaagcgcttcgccaagggc

SEQ ID NO: 6398 - DNA, 723 bp, Streptomyces avermitilis
  CDS (1)..(723)
atggctgagcagcggcgcgacgggcgggatgcggggggcgtgcgggagcacccccaggagcggcgcgaggaggggcagcgggacgaggtggcccgggcctgggacgacctcgtggccaccgcccgccgcacggtgtccgacggtctggtcgtcggcacgtcgggcaatgtctccgtgcgcgtgggggacaccgtcctggtcacacccacgggagtgccctacgagcggctgacgcccgccgatgtcgtgggcgtcggcctcgacggccggcaggtgctcggttcgctggtcccgacgagcgaactgcccatgcatctggcggtctaccgcaccaccgacgcgcgcgccgtcgtccacacgcacgccgtgcacgccacggccgtgtcgacgctcgtaccggagctgccgctgatccactacatggcgggcgcgctcggcgggccggtccgggtcgccccctacgcgacgtacggcacgccacagttggccgaaaacatgcgacgggccctcgaggaccgcacggcctgcctcctccagaaccacggcacgatcgcctacggcgcgaccctgccccaggcgtacgaccgcacggcccaactcgagtggatgtgccgcgtatggctgacggcgtcctcgataccgggcctgaccccgacgctcctcacggaggaacaggtggcggaggcgggggagcgcctgcgggggtacgggcagccggggcgg

SEQ ID NO: 6399 - DNA, 1125 bp, Streptomyces avermitilis
  CDS (1)..(1125)
gtgcgcacagtcaaagcgacggccgccgccgtcaccgtagccatagcagccggcgcggccggtgtcgccgccggccggttcgccagcgacgccgcgctcaaggcgccgccgggcagaccgctgcccaccgaaccccgcctcaccgtgcactccacggccgcgggccagatcacgctcacccgcgccctggcctcccaacggcccggcacctacggcatctccggcgacggctcccacgcggtcgtcggtccggtcctcgccgccgctccccactccgccgacacggtcgtacgccgcctggaacgcgtcacccacggcaccctggagcccggcgacaaggtctggctgacaccgaacgtgcacatcggcaaccccagctccgccctcggcctcgagcacgccgacgtcgacatccccggcgagctcggccccttgcccgcctggttcgtacccggcgtccgcgacacctgggtgatcaccgtgcacggcctcggcgccacccgcgaacaccccatgaacgtcatggggttcctgaaccgccaccacttcccggtgctcgacctcgcctaccgcggcgacctcggcgcgccccgcccccaggacggcctgaaccacctcggcgagaccgagtggcgcgacctggacgcggccatccgctacgccgtgcgctacggcgccgagcgggtcgtcctgcacggctggtccaccggcgccaccatggccctgcgcgccgccgcgcactccgggctgcgcgagcggatctccgggctcatgctggactcgcccgtactcagctgggagaccaccgtgcgcaccctcgccgcggcccgtcgcacccccggcgcgctgctgccgctcgccgtccgcgccgcccagggccgcaccgggctgcacggcgaccgcatccaggtggccgccgacccccagcacctccaggcgccggtgctgatcttccacggtccgggcgacaccgtcgccccctggggcctctcgcgccgtctggccgacagccgccccaatctggtcaccctccacacggtcaccaacgccccgcacggagccatgtggaacgccgaccccggagtgtacgaagaggccatgcgccgcttcctcacccccttgatg

SEQ ID NO: 6400 - DNA, 1365 bp, Streptomyces avermitilis
  CDS (1)..(1365)
gtgacccagcgccgcacgcgccgcccggcaccccggccgccggagggcacccctccgcccgcggaactggcccgcatggcacgcaccggcctcgccgacgcggcccgtgtcgcccgctgggccgacgccgcgctccgcccggggcacggcgtagggccctccgacggcaggggcaccctctccgacaccaccgccgaacgggccgccgccgatctgggcctgaccccggctcaggtccgtgccgactgggacaccgcacgcctcgcgggcctcgtcgaggtgcacggcgacagtgcccgccccggctggcggctgcgcgcgtggaaccgcgacgacagcgccgtactgcgcggctgggtcgcccttttcgacgcctggtcgctcgcctacccggaacccgaggagcacgagcacgccgccgtcgccgaggtcgtctccgcgatgccgcaggtgctctccttcctccagctgtcggcgggccccgtccccttcgagcaactcctcgacctgctcgaccagcgggtcaccgagctgcgcacggaacgctgcgaggtcccgtacggcccccaggcggagcccgtcgaggtccccgcggggcgttccggcggtgtcttcggcatccccggtgagcgcctcgccgaggacaccccgctctcccccctcctcgactgggccctgcacgccctcgcctccgtgggcgcgctcacctgcgccgacgggcaggccacgctcaccccgctcggcagttgggcggtgtgggtcaagctggagcagatctgcgtggccgcgcagagccccgccgggaacatcgagcagaacgcggaggacatgctccgcggctgtgcccagctgcgcccgaacgccgcccgtgccgagtaccgcgcctggctcgccgcccgcaccgtcggcagcgccgtcaccgagctcctcgacgcggcccgcggcgacgacgccctcctgcgcggcctcgccttcgaggcgctgcgcgtggtcggcgctcccgccgagcccgatgtgcgcgccgtggccgaggccaccccgctgcgcccgtacgccctgctgtggctcgcggagcacgacggtcacgaccccgaggacgcccacgaggtgctcacccgcgaggagtccacctggctgtgggtggacaccgcggcggccgtcgccgaccacggcgaagccccgctcctcgtgcgccacctggagtccgcggtacagcccaccgtgccggcgctcctcgacgaggtacgcgcggtcgggcacccccgcaccgtgcaggtcctggtcgcgctcgccgccgcccaccccgatccggcactcgccagggcagtccgccgtgcggccttccaggtgcacacgggcgggagc

SEQ ID NO: 6401 - DNA, 420 bp, Streptomyces avermitilis
  CDS (1)..(420)
gtgatcggcatggcaggcatggacagcgggcgtccgagtatctgtccgtcgttgctgtacgcggacgcgaaggcggcgatcaagcagctcacggaggccttcggcttcacggagctgtcggtgtacgagggcgaggacggctcggtgatgcacgccgagctggtgcagggcaacggcgcggtcatgctcggctcgaagggccgcggcggccgcttcgacgaggcgatgaagaacgcgggcccctgcggggtgtacgtcgtggtggacgacgtcgacgcccaccaccggcgcgccgtggaccacggcgcggagatcctgatgcccccgacggaccaggactacggctcgcgggactacatggcccgggacgccgagggcaacatctggagcttcggcacgtacgcccccgagatacagggc

SEQ ID NO: 6402 - DNA, 1179 bp, Streptomyces avermitilis
  CDS (1)..(1179)
gtgtggcatcgggcactgacaacgcggccccgggcgaaggaccgaaggaccgaaggaccgaagggtcgaaggaccgaacggccgaacggaggacgcacccgggcccgcccgccgtgtcacggcagccgtccgccgtacccgcgcctacgctccgcctggtccgtgggcagcgctttgagggggcgaggtggtcgctttgccgaccgggacgacgggggagggccccggcgaccagcgctacgcggccctcaccgacggccggcccgcagcgtcccgcgccgacagccggcccaccgcccccaccgcccacgcgcgcacgccggccccgcgcgccccgcgaacccgcaggccgagcaccccgcgacccgcacagccgagcgccccgcgaacaccgaagccgcgtggactgtgaacgcctctccccgcccccgcctccccaccgaccccctgcccccgccccacttccgccgtctccaccgcctcctgcccaccgccctcgcgctcctgctcggcgcctccctcctcgccgcggtccaccacgcccgccccgccccctacggagatcgcctcaccgtccacgcgcgcgtggcgcccgccgtggagcccaggttgcgtatgcgaggggccgccgtcgaggcgtacggcggccgcggcggctcggttcactggacctacgcgcgggcggggcgtcgaccgctcgccgtgctccccgcgcgcggggacgccatcgcactgtgggacgacggcctggtgaccgccaccgacgccaccggcgtccgctggcaccgcgccctgcccgcggccgcggactggctggcggcccacggcggagccggggtcctgcggatgctcgatccgggcacccgcatgctcgccgtcgtcaccccgcaccgcatcgccgcgtaccgtctcgccgacggcgatctgcgctgggtgctgcccgcccgccagggctgcgccttcgcccccgcgcgcgcggtgcaccgcggcggcgccatcctgatcgcgcagccctgcctcgcggcagactcctggagcggcgagatcgtcgccgtggacgacctcggcccgatcgccccgcgccgcacaccgctgggcaacgaatggcagggcgaacggcggggcgagcatcacagtgccgaacacccgcacacaggaaatctggttgcacggccccgt

SEQ ID NO: 6403 - DNA, 1596 bp, Streptomyces avermitilis
  CDS (1)..(1596)
gtgatctccgcctccggtatcgagctgcgcgccggcgcccgcatcctcatcgagtccgccaccttccgcatcgccaagggcgaccgcatcggcctggtcggccgcaacggcgcgggcaagaccaccctcaccaaggtcctcgccggcgagggagtccccgccggcggcaacgtcacccgctccggcgaggtcggctacctcccgcaggacccgcgcaccggcgacctggacgtactcgcccgcgaccgcatcctctccgcacgcggcctggacaccctgatccgcaagatgcgcgagaacgagcagcgcatcgcgaacggctcgggtgccacgcgggagaaggcgctgcggcagtacgagcgccaggagacggagttcctcaccaagggcgggtactccgccgaggcggaggccgccaccatcgccgccgcgctcaacctgcccgaccgcgtgctcggccagcccctgcacacgctctccggtggtcagcgccgccgtgtcgagctggcccgcattcttttctccgacgcggacacgctcctcctggacgagccgacgaaccacctcgacgccgactcgatcgtctggctgcgcgactacctgaagacctaccgtggcggcttcatcgtgatctcccacgacgtcgacctcgtcgagacggtcgtcaacaaggtcttctacctggacgccaaccgctcccagatcgacgtctacaacatgggctggaagctctaccagcagcagcgcgaggccgacgagaagcgccgcaagcgcgagcggcagaacgccgagaagaaggccgccgcactccactcccaggccgacaagatgcgcgccaaggccaccaagacggtcgccgcgcagaacatggcccgccgcgcggacaagctcctcgcgggcctcgaggcggtgcgccagcaggacaaggtcgccaagctccgcttccccgagccgtcgccgtgcggcaagaccccgctcacggcggagggtctgtcgaagtcgtacggatcgctggagatcttcaccgacgtcgacctggccatcgacaagggctcccgcgtcgtcatcctcggcctcaacggcgccggaaagacgacgttgctccggctcctcggcggcgtggagacgcccgacaccggcgaggtggtcgagggacacggcctcaagctcggctactacgcgcaggagcacgagaccctcgaccccgagcgcacggtcctcgagaacatgcgctccgccgcccccgacctcgacctggtcgaggtccgcaagacgctcggctcgttcctcttctccggcgacgacgtcgacaagccggccggcgtgctgtccggcggcgagaagacccgcctcgcactcgcgaccctggtcgtctcctcggcgaacgtcctgctcctcgacgagccgaccaacaacctcgacccggccagccgcgaggagatcctcggcgcgctgcgcacctacaagggcgcggtcgtcctcgtcacccacgacgagggcgccgtcgaggcgctccaacccgagcgcatcatcctgctgcccgacggcgtcgaggacctctggggcgccgactacgccgacctcgtggccctcgcc

SEQ ID NO: 6404 - DNA, 219 bp, Streptomyces avermitilis
  CDS (1)..(219)
gtggccgagactctgaagaagggcagccgggtgaccggcgccgcgcgcgacaagctcgcggcagacctgaagaagaagtacgactccggtgcgagcatccgagcgctggccgaagaaaccggccgctcgtatggcttcgtgcaccggatgctcagcgagtcgggcgtcacgcttcgtgggcgtggcggtgcgacgcggggcaagaaggccactacggcc

SEQ ID NO: 6405 - DNA, 831 bp, Streptomyces avermitilis
  CDS (1)..(831)
atggcttcgcatgagcacgagacggacgtcgacaaggaccccggcaaggtcctcgatcccgtactcgacaaggacggcgtacggctcaccgtcgacgaggctgtcgccacggtgacgctgaccaacccggccaagcgcaacgcccagagtcccgcgctgtggcgggcgttggcagaggccgggcgggtactgccgggctccgtccgtgtcgttgtgctgcgcgccgagggcccgtcgttctcggcggggctcgaccggcaggcgttcacgcccgaggggttcgacggcgagccgtcgttcatcgagctcgcgcgcagttcggacgccgagctggacggaaccatcgccgagtaccaggagggtttcacctggtggcggcggagcgacatcgtgtccatcgccgcggtgcaggggcacgccgtcggcgcgggtttccagctggccctcgcctgtgacctgcgcgtcgtcgcggacgacgtgcagttcgccatgcgcgagaccagcctgggcctcgtccccgacctcacgggtacgcatccgctggtgagcctggtgggttacgcccgcgcgctcgaaatctgcgcgacgggccgttttgtgctggccgaagaggccgaacgcaccggcctcgccaacctcgccgtgcccgccgagcagctcgacggcgcggtacgggatctcgccggcgcgctgctcgccgctccgcgtgacgccgtcatcgagacgaaggcgttgctgcgtggggcgcaggagcggacgtacgaggaccagcgcgcagccgagcgtgccgcccaggctcgccgcctgcgggatctggccggggtcggcgac

SEQ ID NO: 6406 - DNA, 738 bp, Streptomyces avermitilis
  CDS (1)..(738)
atgacggcagaccggtggactcaggaagtacggcatctgctcaggctcggcaggctgctgcccctcggcctcccccacgacggctcgtggatcacggagagcgcggccggctcggtgctgcggcgcgcggcggatcccgtgcgcgaggtccgcctcggcacgctccggatctccctcgccgacccggagcagcaggtgcacgagccggtcgtgccgcccccgccgagcgcgctgccgcccggccccctccgcatcatcgcggagttcaccgtctcggcggaccccacggcgccgggcgtcgacccgctccccacgacggccgaccgcctgcgcctggccctggccgcggccgcggaggagcggctcggtctgacggtcacggaggtggatctgctggtgacagagttgtcgaacggggcggacgaggcgcccgtcgccgtacgccctgacgacgagcggccgactgcccagccgaccggtgccgacgagctccgggcggcctcggccgcgctgtccgtcccgggcgtcgcccgtctgacggacgccctgggccgcccggtccacatcgaggacgtcggcgggaagaccaccctgccgcaccgtcacgttcgcgtcgaactggcggtgacggcggaacggcggaccgccgatgtggccagggcggtccgctcggcggtgacggaggccctgccggaccacccgtcggtcgccgtggtggtcacggcggtgggccggccc

SEQ ID NO: 6407 - DNA, 480 bp, Streptomyces avermitilis
  CDS (1)..(480)
atgaccgacatgacggagcggaaccggccggagacccccgagggcgcggtggagtcgccgcaggcacgcagggccaccaagcgaggcggcggcgaccccgcgacccgaggccgcaccaccatcgccgacggcgtggtggagaagatcgccgggctggccgcccgtgacgtactcggcgtgaacgccatgggcagcggactcagccgttccttcggggccatgcgcgaccgggtgcccggcggcaccaagtccgtcgcccgcggggtgaaggcggaggtgggcgagctccagaccgcgctcgacctggagatcgtcgtcgactacggcgtgtccatcaccgatgtcgcccgcgccgtgcgcgagaacgtcatcgcggccgtcgagcgcatgaccggactcgaggtcgtcgaggtcaacatcgccgtcagcgatgtgaagctgccggacgaagaggaagaggagccggagacacggcttcag

SEQ ID NO: 6408 - DNA, 183 bp, Streptomyces avermitilis
  CDS (1)..(183)
atgagcttggccgtgatcggcatgattgccggaatggcgctgggcttcgccgggtacttcggcggattcggcgcgtttctgctggtggccgccctgggcgccgtcggcctcgtcgtcggccgggtcatcgagggggacctggagttcggcgacttcttccgcccccgcgacgaccggcggcga

SEQ ID NO: 6409 - DNA, 399 bp, Streptomyces avermitilis
  CDS (1)..(399)
gtgcccggccaggccggtgagctcgaacagcgctacgggccccaggcggtccggcggcccccgacggccgtggcgccggccgagcgcggggccaccaggatcgccgaccgggtcgtcgcgaagatcgccgcgcaggcggcgcgcgaggcagtgctgccgctgaccaggggcgccgagtcgccgcacgccacggtcgtcgtgcaccacggcaccgcccgcgtccgcatcagtctcgaactcgactatccctccgacatcggtggccggtgccgtgcggtgcgtcgtcaggtcgccgagcgggtaggcgctttgacggggatggaggtgcacgaggtggccgtccaggtggagcggctgcaccgggcaccggcacccggcgcggcacacgggaggacgcag

SEQ ID NO: 6410 - DNA, 684 bp, Streptomyces avermitilis
  CDS (1)..(684)
gtgagcgagccccagggacacgagggacacgagagcacgcagcggctgccggtcatcgagaagaccgacgacacggaccccggccggtccgcctccccggaggcctacgaaccgggcccggtcccggccgccgacgagggcgcccgcgacggccgcttctggtcggcccgccgtgtcccggcgggcctcctcgccctgatcgtcctcctcggcgccggcctcctcctgtacgacgtcgtggccgtacgcgcccaccggcccgccatgcactggcgcagattcctggcccgtcagctcgccgagcggcccctcgacgacacctgggtgctcgtcggcgcgggtctcgccgccgccctcggcgtctggctgctcgtgctcgccacgactcccggtctgcgcggcttcctgccgatgcgccgcgcacaccccgacgtacgggccggactgcaccggaaagccgccgcgctggcgctgcgcgaccgggccatggaggtgtccggcgtgcagtccgtgcgcgtccgtgtgcggcgcaggaaggcggacgtccgcgcggtgtcgcacttccgtgaactcgacgacgtacgcgccgacctggacgccacgctcgccgacggcgtccgggggctggggctggtccggccgcccgcgctgtcggtgcgcgtggggcgtccccggcggaagggg

SEQ ID NO: 6411 - DNA, 585 bp, Streptomyces avermitilis
  CDS (1)..(585)
gtgaggacggtgctgaggaccgtcaaccgtgtgctgctcggactcgccgggctgatcctggtcgccctcggcggctccgtgctggccgtcggactcggcgtccggccaccctcgtggtggatccacgacggacggcgcgacgtgctcctcagctacgccgagcggacgcggtggcgggacgagggctggtggtggccgaccgtcatcgccgtgctagccgttctcgtcctgctcgccctgtggtggctgtccgccgtactgcgcaggcggcggctcgcggaggtgctcgtcgacaccggcgacggcgagggcgcgatgctgcgcggacgggccctggaggacgtactcgccgctgacgcggagcagttggacggcgtcgggcgcgcacacgtcctgctgaccggccggcgcgccgcccccgaggcccgggtgcggctcctgctggaaccgcacgtggatccggggaccgcgctgcacggcctgaccactcggtcgctcgcccacgcccgggactccgcggccctcgcggcactgcccgcggaggtccggctgcgcgcggtcaaacaccgggcggagcgggtgagt

SEQ ID NO: 6412 - DNA, 753 bp, Streptomyces avermitilis
  CDS (1)..(753)
atggatcttggacttgaggatcgtgtgtacgtcgtcaccggggcgacccgtgggctcggcaacgcggcggcgcgggaactcgtcgccgacggggcgaaggtggtcgtcacgggccgggacgacaagagtgtcgccgacgccgcgtccgcgctcggcccgaacgcggtcggggtggccgtggacaacgcggaccccgaggcgccggcccgcctcgtcgcggccgcgcgtgcgcacttcggcggcttcgacggcatcctcatcagcgtcggcggaccaccgcccgggttcgtcgccgacaacacggacgagcagtggacggccgcgttcgagtcggtgttcctcggtgcggtccggctggcccgtgcggcggcggccgagctggccgagggcggggtcatcggcttcgtgctgtccggctcggtgcacgagcccatcccgggcctgaccatctccaacgggctgcgcccgggcctcgccggcttcgccaagtccctcgcggacgagctgggcccgcgcggcatccgcgtcgtcggcctgctcccgtcccgcatcgacacggaccgtgtccgtgaactcgacgggctctccgccgacccggaggccacccgcgtggccaacgagtcccgcatcccgctgcgccgctacggcacaccggaggagttcggccgcgcggccgcgttcctgctgtcgccggcggcgtcgtatctgacgggcatcatgctgccggtggacggcgggatgcggcacgggttc

SEQ ID NO: 6413 - DNA, 1809 bp, Streptomyces avermitilis
  CDS (1)..(1809)
gtgcacaaatctgtcgagtccccagcattcagcgcatccattgaggactacgccctcatcggggaccagcagagcgccgcccttgtcgcccgcgacggatccatcgactggctctgcctcccccgcttcgactcgccggcctgcttcgccgcgctgctcggcgacgagcacaacggcaagtggcgtatcgcccccaagggcgcgggcccctgcacccgtcgcgcctaccgcaccgactccctcgtcctcgactccgagtgggacacccccgagggcacgctgcgcgtcaccgacctgatgccccagcgcgacagcgcccccgacctcgtacgcatcgtggaggggctgcgcggccgcgtcaccgtacgcagcgcgatccggctgcgcttcgactacggctcgatcgtgccgtggatgcgcagggccgaggggcatcgcgtggcggtggccggccccgacgccgtgtggctgcgcagcgagcccgcggtgcacacctggggcgaggacttctgcacgcactccgagttcaccgtcggggagggcgagaaggtcgccttcgtcctcacctggcatccctcgcaccagccgcgcccgccgctcgtggacccgtacgagtcgctgcacggcagtctcgcgcagtggcgggagtgggtgtcgcagtgccgttacgacggaccgttccgggatgccgtggtgcgttccctgatcactctcaaggccctcacctacgccccgaccggcggcatcgtggccgcccccaccacctcactgcccgaacagctcggcggcatccgcaactgggactaccgctactgctggctgcgcgactccacgctcaccctggacgcgctgctgtcggccgggtaccacgaggaggccgcggactggcgcgactggctgctgcgcgcggtcgcgggcgatccggcggatctgcagatcatgtacgggctgtcgggagagcggcggctgcccgagttcgagctgccctggctgccgggattcggggactcggtcccggtccggatcggcaacgacgccgcgaagcagttgcaactggacgtctacggcgaggtcatcgactcgctgtcgctggcccggtgttcgggtctgccggccaaaccgcacatgtggcaggtgcagcgcgccctgatggatttcctgtgctcggcctggcggcagccggacgaggggctgtgggaggtgcgcggcgggcgtcgccatttcgtgtactcgaaggtgatggcctgggtggccgccgaccgcgccgtacgcaccctggagaacgagccgcagctcggcggcgatctggcgggctggcgggccatgcgcgacgaggtgcaccgcgaggtgtgcgagcgcggctacgacgccgagcggaacaccttcacacagttctacggctcacgtggactcgacgcctcgctgctgctcatcccccgggtcggttttctgccgcccgacgatccgcgggtgatcggcacggtcgacgcggtgcgcgaggagctgggccgagacggcttcgtacgccgttacagcaccgacgtggcagaggtggacgggctgcccggcgacgagggcacgttcctggtctgttcgttctggctcgcggacgccctgcaccggctgggccgcaccgaggaggcccgcgccctgttcgaacggctggtcgggctctgcaacgacgtgggtctgctcgccgaggagtacgacccggcgtcggaccgcttcctcggcaactacccccaggccttcagccacctcggcctggtgagcaccgccctcgccctcttcggtgaccaggaggcagga

SEQ ID NO: 6414 - DNA, 795 bp, Streptomyces avermitilis
  CDS (1)..(795)
gtgtaccgcttcctgttgtcccggcagtgggtgatcctcacccttgtgacgctcgcgctcatcccgacgatgattgagctgggcttctggcagctgcaccgccacgagcaccgcgtcgcgctcaacacggtgatcggcaactcgctggccgccacgccggtgccggcggagtcgctcacctcgcccggcgcgaccgtcaagcacgacgacctgtaccaccgggtgaccgcgaagggcaccttcgacaccgcgcacgaggtcgtcgcacgccgccgtacgaacgtggacggcgaggtcggtttccacgtcctgaccccgttcgtgctggacgacggcaaggtgatcctggtcaaccggggctggatcccggcgaacggcgtgcagaccgagttcccgaagatccccgcccccgcgaacggtgagatcaccgtcaccgggcggctgatgcccgacgagacgaccgccgagagcggcatcaagaacgtccaggggctgccggcccgccagatcatgctgatcagcagcggacagcaggcgaaggccctcggcaagcaggtcctcggcggctatgtcgagctgacctcgccccggcccaagggggacagccccgagctgattccggcccccgaccacagcgacatcggcccccacatggcgtacgccgtccagtggtggctgttcgcggcgggcgtccccgtcggctgggtcgtcctggcccggcgcgaacgccgcgaccgcgcggaggcggcagcggcgaaggagacggagaccaaggagacggccccggcggccgtc

SEQ ID NO: 6415 - DNA, 231 bp, Streptomyces avermitilis
  CDS (1)..(231)
atggcacgttgcgaagtctgtggaaacgactacggcatgacgttcgaggtgcacgcgcagggcgcggtgcacgtcttcgactgcttctcctgcgcgatccaccgcatggcaccgatctgcgagcactgtcgcgtccagatcatcggccagggagtcgaggtcgggggccgctggttctgcggtgcgcactgctctcgcgcggaggggagggcgggaatcgtcgacaaggtc

SEQ ID NO: 6416 - DNA, 975 bp, Streptomyces avermitilis
  CDS (1)..(975)
atgctcgaagaccgtacgaccgcagcgaccccagccccctggccggccgcgtatccacaggggtacgcggtcgtcgacgtggagaccaccggcctggcccgggacgaccggatcatctcggccgccgtctaccggctggacgcgcgcggcgaggtcgaggaccactggtacacgatggtcaacccggagcgggacccgggcccggtgtggatccacgggctgacgagcgatgtcctcgaaggggcaccgctcttcgaggacatcgcggcggagttcgcgtcccggctcgccgaccgcgtgctcgtcgcgcacaacgcggtcttcgactggtcgatgatcgcccgggagtacgcgcgcgcgaagagccaggcgccggtgcggcagcggctgtgcaccatcgcgctctccaaggagctgggcctgccgctgcccaaccacaagctggagtcgctggccgcgcacttcggcgtcgtacagcagcgggcccaccacgccctggacgacgcgcgcgtgctggccgaggcgttccggccgagtctgcacgcggcggcgcgggacggcgtccggctgccgctgctggagtgcctgccgctcaccgagtggaacgccaccccgcggatcggccggcagccctccggcggctatccgtccggcagttggcgcccctcccgcaaacgccccgtatgcccctatcccaacccgggtcgctacgaagagggcaaaccgctcaagcaaggcatgcgggtggcgttctccggggacacctcggtcgaccgcgagctcctcgaggaccgcgccgtcgaggcgggcctgcatgtggcgacgagcctgtcccggctcaccagcctgctcgtcaccaacgaccccggctcgggtacgtccaagacggccaaggcgcggcagtacgggacaccggtgatcgacgaggcggcgttcggccagctgctgcgggacgtggagccggcctcgcagggg

SEQ ID NO: 6417 - DNA, 690 bp, Streptomyces avermitilis
  CDS (1)..(690)
gtgccgggtaaatacgtgtgcacgaacatggacgggggcgggatggcgagaccggcactcacccgcgacgaggtcctggactccgcggcggatctggtgaagcggcacggcccggcggcgctgacgatgcgggggctcgccgccgagctgggcaccgcggtcacctcgatctactggcatgtcggcaaccgcgagtccctgctcgacgcgctggtcgagcggaccgtcgccgatctcggcgagatccgcccggtggggcgcacgcccgcgcgccgcatcgcctccgtcgcccgcgccctgcgccggcagttgcgcgaccatccacatctcgtcgcgatggtgcacgaacgcggtctgacagaacgcatgttcctgcccgcacagcaggcgctggtgcgtgaggcgcacgcggcgggactgcgcggcgcgcgggccgccgaggtcgtacgggccgtgcagttcctggtcgtcgggcacgtcctggtcgagcgcaaccgcgagcgtgccccggcgcagcgccccggcgagcaggagctgtggggggcacgtacggcggacggggacccggcgctcgcacgaacactcgcctggcccgtcgatccggagaaggtgttcacggcatccgtgaaggccctggtcgccgggctgttggaggcggcgcctgagaccgcccgcggcccgggcccgtcc

SEQ ID NO: 6418 - DNA, 795 bp, Streptomyces avermitilis
  CDS (1)..(795)
atggcacgagtgcgctatggcgcgcggaccgacgcggagatcgcggccgcgcgctccgcgagctcccggctccccgacatctggtccaccggtgtggtggccgtctgggagaccgacccggacgcggtcgcggcggtgctgccgcccccgctcaaacccaccgggcggcccctggcccgggtcaacatcagcaaggtcgacctgcccggataccggctgggcgcgggctcgttcgcggtcgccgccgcgcacgacggcgtcgagggctggtacccgctcgtcatgccgatgacccatgagcgggccctcatcggcggccgtgaggtgttcggggagccgaagaagctgggcgaggtcacggtcgaacgggacggcctcgtcgtacgcgcggcgctggcccggcacggcatcgcgttcgtggaggtgcgcggagcggtcagcggtgatctgccgcttccggagcccgtccggaagaccgacttctacttcaagttcctgccctcggtggacggtccgggtttcgacaccgccccggtcctggtgcactgcctgcgcaacgagaaggtgcgcaggctggagcggatcaccggtgacgtcgtcctgcgcgagtcgatgtacgacccggtcgccgacctgcccgtacgccggctcgtcgagatcaccatcggtgagaagaccaccgaccagaagggcaaggtcgtcgaacaggtcagtgcccaggccctgttgccgtacatccaccagcgctacgacgatccgcagcagttgctcgacggtccgccgcaggggagtgtc

SEQ ID NO: 6419 - DNA, 882 bp, Streptomyces avermitilis
  CDS (1)..(882)
atggatctccgggcgggacaggtcgccgtcgtcaccggcgcggcgagcggcatcgggctcgcgatggcacggcggttcgcggccgagggactgaaggtggtcctcgcggatgtcgaggagggggccctggagaaggccgcttccgcgctgcgggaggacggggccgaggtgcacgcgcgcgtggtcgacgtcggggagcgtgatcaggtcgaggcgctggcggccgggacgtgggagaggttcggcgccgtgcacgtgctgtgcaacaacgcgggcgtcggctccggagccgagggccggatgtgggagcacgacccgaacgactggaagtgggccttcgcggtcaacgtgtggggcgtcttccacggcgtccaggccttcgtgccccggatgatcgcggggggtgagcccggccatgtggtcaacacctcgtcgggggacggcggcatcgcgcccctgcccaccgcctccgtgtacgccgtcaccaaggcggccgtcgtgacgatgacggagtccctgtacgcgcacttgagggcggagcacgcgcgcgtgggcgcctccgtgctgttcccggggccgcacatgctccgtaccggcctgtgggagtcgcaccgcaaccggccctcgcgctacgcgaagcacaagccgaggaagaccccctaccgcagcctcgaccagtgggaggccgcgatgcgggaggcgggccgggaagtgcgcttcacgccggtcgaggaggtcgccgagctggtggtggacggcatccgggcggaccgcttctggctgctgcccgagagcgagcacagcgaccggcagatcagggcgaggtcgcggtcgatgctcgagcggaccgacccgtcgtacttggaaagcttcatcctcgac

SEQ ID NO: 6420 - DNA, 1314 bp, Streptomyces avermitilis
  CDS (1)..(1314)
gtggtgaccgacaaggacgcgaccggcagggacgtgacggaccaggatccctacctgatcatctcctccgactgccacgccgggctgcccaccgaggagtaccggccctacctggactcccgtttccaccgggacttcgacgaattcctcgccgggcgcgaccggcgccgcgaggagatgacgcggctcggcatccgcaacgaggcgttcgcggacaagtggttccaggacaacgaggagggcctgcgcggcggctgggacaccgcccagcgtctcaaggagctggacggcgacggggtggccgccgaggtcgtcttcccggacgccgacgccgtggacagccggaccgccgcccccttcggcgtgggcctcggcctctccggcgaccaggatccggagctgggcatggcgggcgcgcaggcgcacaaccgctggctcgcggacttcgtctccggacaccccgaacggcactgcggggtggccctgttgcccgtcacggccgagcccggccgcgtggtcgcggaggtgtaccgggccaaggagtcgggcctcggcgcgctgatgatcccctccatgtgggtcgacaaggagccctaccacgaccgccgttacgacccggtgtggaccgcggcggccgagtgcggcatgccggtcctcacgcactcgggggcggcgccccggcacgagtacggcgaccatctgggcatctatgtgagcgaggtgacctggtggccggcccggccgctctggttcctgctgtggtcgggcgtcttcgagcggcacccggggctgcggttcggcgtggcggagtcgggctgctggtggctccccaatctcctctggttcatggaccgcctctacctcggcgcgcacggcggcaagaagctgtcgcccttcgccgaactgacgcgcccgccacacgcgtacctggaccggcaggtcttcatctgcgcgacgaacaccaagcgccgcgaactggcccagcggtacgagatcggcgtcgacaacatcctctggggcagcgatttcccgcaccccgagggcacctggcccgacacgcgcgcgtggctgtcgaaaaccttccatgacatcccggtcggggagacgcgccggatgctcggcctggcggccgcggaggtcttcggcttcgacgtcgagaagctggcccccctcgcccggcggatcgggccgaccccggccgacctcggccagtccgacgaccgggcggccgtcgaggcgtcctgggcgcgctcgcgcgaggtgggccgccactggctgaccggccacgacttcccggccctggggacgacccca

SEQ ID NO: 6421 - DNA, 1227 bp, Streptomyces avermitilis
  CDS (1)..(1227)
atgaccgacgaccggtacacggtgatctccgccgactgccacgcgggcgccgatctcctcgactacaggccgtacttggcgaagcggcaccacgacgcgttcgacgcgtgggcggccacctacgtcaatccgtacgaggacctgctcgccgacaccgcggaccggaactggaactccgagcggcgcctggcggagctggcggcggacgggatcgtcgcggaggtggtgttcccgaacacgatcccgccgttcttcccgtcggcgtcgctgatggcgcccgcgccgacggcggcggagttcgagcagcggtgggccggcctgcgggcccacaaccgctggctggcggacttctgcgcggcggcacccggccgccgggcgggcgtcttccagatcctcctgaacgacgtggaggaggcggtgaaggagatcagctgggcggccggcgcgggcctgcggggcggcctcctgctccccggcaccccaccgggctcgggcctgccggagctgtactcgaaagcgtacgacccgatctgggcggtgtgcgaggagctggacgtgcccgtgaaccaccacgcgggctcggcgtccccgccgctgggcgacgaaccggccgcgcgggcggtcttcatggtggagacgacgtggttctcgcaccgggcgctgtggcacctggtgttcggcggagcgttccgccgtcacccgggcctgcggctggtgctcacggaacagggttcgggctggatccccggggtcctggacatgctggactactaccacggccgtctggtcgcggccggcccgaagtcggcgacggcggaggccaagttcggcgccggcctggaccgggccatgggcaaggggccgtcggaggtctggcgggacaactgtttcgtcggcgcgagcttcatgcgcccgcacgaggtgccgctgcgggaccgcatcggcctcgacaagatcatgtggggcagcgactacccgcacgacgaggggacgtacccgtactcgcgcgaaggcctgcggatcgcctacgcggggctgccgcgcacggagatcgcggcgatggccggcggcaacgcggcacgggtgtacggcttcgacctctccctgctcgacccgatcgcggcgaaggtgggaccgacggtggcggagctggcgcggccgctggaagagccaccggcggacgcgacgagtcccgtcttcgcgcggggagggtcggtacgcgtctgg

SEQ ID NO: 6422 - DNA, 708 bp, Streptomyces avermitilis
  CDS (1)..(708)
gtgacggaacccacgcacgacgaggcacacgggggcgcgctcggctcccgcctgaactggctgcgggcggcggtcctcggcgcgaacgacggcatcgtctccaccgcgggcctcgtcgtcggcgtggcgggcgcgacgggcgcccgctccgcactgctgacggcgggtctggcggggctgctggccggttcgatgtcgatggcggcgggggagtacgtgtccgtctccacgcagcgggactccgagaaggcggcactggcgctggagaaacgggaactgacggagcagcccgaggcggagctggaggagctgacggagctgctggaggagcgggggctgtcccgggacgtggcgagggaggcggcgcagcagctgacggagcgggacgcgctgcgcgcccacgcgcgcgtggagctcggcatcgacccggacgagctggcgaacccgtggcacgcggcgtgggcgagcttcctggcgttcacggtgggggcgctgctgcccctgctggcgatcgtgctgccaccggccgactggcgcctgcccgtcaccgtgctctccgtcctcgccgcgctggtcgtcaccgggtgggtgagcgcgcggctgggggcggcgcggccggggcgggcggtgctgcgcaacgtgggcggcggcgcgctggcgatgggggtcacctatgcggcgggcgcgctgctgggggcggccggggtg

SEQ ID NO: 6423 - DNA, 867 bp, Streptomyces avermitilis
  CDS (1)..(867)
atgccgaacctgcccgatgtcgtgctgtggtcgatacccgcctttgtgctgctcaccgtgatcgagatcgtgagcgtacggatccatcccgaggaggacgcggaagggtacgagacgaaggacgcggcgacgagcgtcggcatgggcctcggcagtctcgtcttcgacctcctgtggaagatcccgatcgtcgcggtctacacggcgatctacgaactcacgcccctgcgcgtccccgtcctgtggtggaccgtcccgctgatgctgctcgcgcaggacttcttctactactggtcccaccgcggccaccacgtcatccgcatcctctgggcctgccacgtcgtccaccactccagccggaagttcaacctcaccaccgccctgcgccagccctggacctcgctcaccgtctggcccttctacgttccgctcatcgccctcggcgtccatccggccgcgctcgcgttctgttcctccgtgaacctcgtgtaccagttctggatccacaccgagcgcatcgacaagctgccccgggcgttcgagttcgtcttcaacacgccctcgcaccaccgggtgcaccacgcctcccaaggcgggtacctcgaccgcaacttcggcgggatcctcatcgtctgggaccggatcttcggctccttcgtccccgagaccgagcggcccgtctacggactcaccaagaacatcgccacctacaaccccctgcgcgtcgccacccatgagtacgtcgccatcgccaaggacctgcgggcggcgcgcggttggcgtgagcgggcgggcagggtgttccgcgggcccggctggcagcccgtgcggccggcggctgagcagccggtcacggagcccgtcgcg

SEQ ID NO: 6424 - DNA, 675 bp, Streptomyces avermitilis
  CDS (1)..(675)
gtgaggccggccgccgcgcgcgtgctgctcggggccttcgccttcgccgtcgtcgccgacctcgcctcccaggccctcgggtccgacaccggacacctgctcgccaagcccctcctgatgccgctgctcgccgcctacgcggccgtacgcggcggaccccgcctcctcgtcgtcgcgctgctcctcggctgggcgggcgacgtcctcctgctgtccgacgccgacccggccttcctcgccgggatgagttccttcgccgccgggcacgtctgctatctcgtgctcttcgcgcggcacggccggacgcgcgcgcgtggcgccctgctcgccggcggttacgggctcgtcctcgtcaccaccgtcgccctcctgtggcccggccttcccgccgggctgcgcgtccccgtcgtcggctacagcctgctgctgaccgcgatggcgtacggggccacccggctcgggcccgtcgcagggctcggcggtgccctcttcctgctctccgacacgctcatcgccaccggcgtcgccgactggccacagctcccacgacccgacttctggatcatgctcacctatgcggcgggccagtatctgctggtccgcggcgtgacggacaccctcggcgcgccaaccgcgccggcggcggcgtacggtgaggtgcgctcgaccaccccc

SEQ ID NO: 6425 - DNA, 1041 bp, Streptomyces avermitilis
  CDS (1)..(1041)
atgcgcgccaccaccatccacgccccgtacgacatgcgcgtggaggacgtgcccgaacccgtggtgcggcagcccaccgacgcggtcgtacgggtgctgcgcgcctgcatctgcggcagcgacctgtgggcgtaccgcggcgaggcggcccggcagccggggcagcgcatcgggcacgagttcctcggcatcgtcgaggagaccggctccgaggtgaccggcgtccggcgcggcgacctcgtcgtggcgcccttcatgtggtccgacggcgtgtgcgactactgccgcgagggtctcaccacgtcgtgcgagcacggcggattctggggctccgtgggccacgacggcggccagggcgaggccgtgcgcgtgccctacgccgatggcaccctcgtccagctgcccaaggacgcggcctccgacgaacacctgctgtccgcgctgctgacgctctccgacgtcatgggcaccgggcaccacgccgccctcggcgccggagcccgtcccggggcgaccgtcgccgtcgtcggggacggcgccgtcgggctgtgcgcggtactcgccgccaagcggctcggcgccgagcggatcatcgcgctcggacgccacgaggtgcgtacggacatcgcgcgccgcttcggtgccacggacgtcgtcgccgagcgcggggaggcggccgtcgaggccgtccgcgagctcacccgggggcagggcgcgcactgtgtcgtggaggcggtcggcaccgagcagtcgatgcggacggccgtggacatcacccgggacggcggcgccatcggcttcgtcggcgtgccgcacggcagcgggaccgggctcgacctgggggtcatgttcgaccggaacatcgccctgcgcggcggggtcgcccccgtacgcgcctacattccggagctgctccccgacatcctcgccggcaggatcgacccctcgcccgtcttcgacaggaccgtcgacctggaaggcgtgcccgagggctacaaggcgatggacgagcgcaccgccctcaaggtgctcgtcaccaac

SEQ ID NO: 6426 - DNA, 1050 bp, Streptomyces avermitilis
  CDS (1)..(1050)
gtgagcctgatacgaccgccggccggcccgaacggcggtgacgcggccccttcgcccgtccccgccgccgctccggcccggcgcctgtcccccggccgggccgtcgccgtgctcgccctggtggcggtcgccgcgctgatcccgctcctcggccccgccgccgcgctgcacggcaccggcgaggcggccgcgcccggagccggtggcatcgccctcctgcgtacggtcctgttcgcggcggtgtgcatgcccgcgggcgagtggttcgcgggccgcctggcccgccgcgtgccgggcgcgcccttggcagacgcgtcggacgcgccgcgcggctgggcgcctggttcgcggccggcgccggtttccgtcgccgcgcctggggctccccctcggtcgtggccaccgggaaactcgtaccggattcgcctcgccgagatcgacgtcggcgggctgtaccggacccgggacggcgccctcgccctgctggaggtcaacgcgttcgccgtggccggcctgtgcgcgctgtcgcgccgcccggccggccgggtgtggccgtcggccgcggtggtggtcgccgaggcactgcgcgtccaccccaccacggagcacagcccgtcggtcggctcgggcctgacgctcgttcacctgacgtgcgcggtcctgtgggcgggcgggctgccgcatgtgctgcgcacggtgcggcggtggcgcgcccctggacccggcgcggctctgctgggcctctacgcgcgcgtggcggccgtcctgctggccgcgatcaccgcgacgggggtgtggagctcgctgcgccgcatgcctgcgggcacgatcccgcaccagctgacggcgacggcgtacgggcgcaccctggtcgccaaggtgttcctcgtggccgccgtcgccgtgctcgccctgtgggcccgccgtcggctgcgccgtgccgacgacccgctcggcgcctgtgtgcccgcgcgtgcggaggtggtggcgctgggcgtggtcgtggcggtgtcggcgctgctgacggcgctgccgctgccgatccgctgg

SEQ ID NO: 6427 - DNA, 1509 bp, Streptomyces avermitilis
  CDS (1)..(1509)
gtgccgtgcggtgccgtatccccgcccctggtccacatgttgattcagtacaccctgcatagtgccgtcatgactgctgtgaacacggagttcgcctgggccgcgctgggcggcgatcccgcactgaccgagcgggtctcgaccgtcgtacgggacggggcgctgaaggcgcggctgccggtacgggagctcgcgcgggcctgcgtggcgacctgcgcgctggccgccgccgaactgggcgcgcggcgggccggacgcgcggacgtgcccggggtgcgggtcgacgacggggcggtggccacggcgttcgtgagcgagcggcagctgcgcgtcgacgggcgggcgccggtcaccttcgcgccgctgtcccgcttctggcgcacggcggacggatgggtgcggacgcacgcgaactatccgcatcaccgggagcggctgctctccgcactgaaacttccggaggaccccgcgtccgtcgccgcggccctcgccgagcgctcctccagggagatcgaggacgccgtgtacggggccggaggcctcgccgtcgcgctgcgcacccccgaggagtgggcgcggcacgagcaggccgtcgaggtcgccgcccgccccctggtcgaacggcggcggccgggcgggggccgggcccgtcggccggcggcgctcttcggcagtccgctgctgcccgccgccgggctgcgggtgctcgacctgaccagggtcatcgcgggcccggtcgccacccgtacgctcgccctgctcggcgcggacgtgctgcgcgtcgactccccgcagctgcccgaactcgtggaccagcacgccgacacgggcttcggcaaacggtccgccaaggtcggcctcggcacggacaggcgcaccttcgaggagctgctcgcggcggcggacgtcgtcgtcaccggctaccggccgggcgccctcgaccggttcgggctctcgcccgaggcgctggccgagcgccggcccgggctggtggtggcgcagctctcggcgtggggcgcgtacgggccgtgggccgagcggcgtggcttcgacagcctggtgcaggtcgccacgggcatcgcggcggtcgaggggtccgggcggcaggagccgggcgcgctgcccgcccaggctctcgatcacggcacggggtatctgctggcggcggccgtgctgcgctcgctcaccgagcaactgacggacggcggggcccggttcgtacgactggcgctggcgcggaccgcgggctggctgctggaggggcgcgccgcgggcgaggcggggaacgccgtacacgccggcgcgggggctgccgcgtacgccgaggcgggggctgcgtacgccggcgcgggggctgccgcctacgacgggccggatgcctggctcgccgagcgggacagtgagctggggcggctgcggtacgccctgccgcccgtctccttcgccggcggaccggtcgactgggcccggccgccgagcccttgggggacggatggcgcgcgctgggcc

SEQ ID NO: 6428 - DNA, 1521 bp, Streptomyces avermitilis
  CDS (1)..(1521)
atgacagcgccccgtaagcgctcccgtcgggccgtggccattccgctgggaatggccacggtcacggctctcgcctttctgcccaatgtcagcgcctcggcggccgagacggccgccccggggaccgtgacggcggacgcgacctcgctgagctacgtcgtcaacgtccgtcccggccacggcacttcgtccgtcgtgaagaaggccatcgcccaggccggcggcacgatcgtgacgtcgtacgaccagatcggcgtgatcgtcgtccactcgtcgaacgccgacttcgccaagaccgtccgccgtgtgcgcggggtggactcggcgggtgccacccgcaacgcgccgctgcccgcccagtcgacgaccgacgtggggacgccgaaggcgctcacctccgaggaggtggcgagcgctcaggcggtcgacgggcaggacccgttggagccgctgcagtgggatctgccggccatccaggcggacaaggcgcacgagaagacgctcggcagctcgaaggtcacggtcgccgtgatcgacaccggcgtcgacgacacccaccccgacatcgcgccgaacttcgaccgcgacgcctcggtcaactgtgtgaccggcaagcccgacacgaccgacggggcctggcgcccgagcgccgcggaaagcccgcacggcacccatgtcgcgggtgagatcgcgggcgccaagaacggcgtcggcatcaccggtgtcgcgccgggcgtgaaggtcgccggcatcaaggtgtcgaccacgggcggctacttctacaccgagtccgtcgtctgcgggttcgtgtgggcggccgagcaccacgtcgacatcaccaacaacagctattacaccgacccctggtacttcaactgcgccgacgacccggaccagaaggcgctcgtcgacgccatcacccgggcctcgcggtacgcggagaagaagggcacggtcaatgtcgcggcggcgggcaacgagagctacgacctcgccgccgactcgatcaccgacccggtctccccgaacgacggcacgccgtcggaccgggtgatcgacccgtccaagtgctatgacatcccgacccagttgccgggggtggtgaccgtcgcgtcgaccggcgcgaagggcatcaagtcctccttctccaactacggactcggtgtcatcgacgtggccgcgcccggcggcgactcgacccgctaccagaccccggccccgccggccaccagcggtctgatcctcggcccgctgcccggcggcacgtggggctacatggccggtacgtcgatggcgaccccgcacgtcgccggcgtcgccgcgctcatcaagtcgacgcatccgcacgcccccgccgccctggtgaaggcgctgctgtacgccgaggccgacgccacgccgtgcacggacccgtacgacatcgactccgacggcaagatcgacgcggtgtgcgagggcacgaagaaccgcaacggcttctacggctggggcaccgtgaacgcgctggccgcggtcacgaag

SEQ ID NO: 6429 - DNA, 1533 bp, Streptomyces avermitilis
  CDS (1)..(1533)
atggctcatctgcgttccagacgccggctcgccctcgccgtgcccgtcgccctgtccctcaccgcgtccctgggcttcctgccgggcgcggcggccgcggccccgctcagcacgcccgcctcggcctccgcctcccccgccgacggcaccgaactggcctacgtcgtcaacaccaagacggaccgtcacacgatcgagtcggtgaagcgggccatcgcccgggccgacggcaccgtcgtcgtgacgtacgacaagatcggtgtgatcgtcgcccactcggccaaccccgacttcggcaagcagctccgggcggtgcgcggggtgcagtccgcgggcgcgacccggaccgcgccgctgaccgccgccgggacgaccgacgagggcgccgcgcagtacctgacgaagactcaggccgcgaagatcgccgcgcggagcacggcttcgggtgaggagcccctcgaggccgaccagtgggacctgcgggcgatcggcgccgacaaggccgcgaagatcaacccgggcagcaggaacgtgacggtcgccgtgatcgacaccggcgtcgacgacacccacccggacctcgccccgaacttctccgccgcgcagtccgccaactgcgtcggcggcaaggcggacacgtcgtacggcgcctggcgcccggccaacgccgaccactaccacggcacgcatgtggccggcgagatcgccgccgcccgcaacggcatcggtgtcgccggggtcgccccgaacgtcaaggtcgccggcatcaaggtggccgacccggtcagcgagctcttctaccccgagagtgtcgtctgcgccttcgtgttcgccgccgaccacggtgtggaggtcacgaacaacagctactacgtggacccgtggctgtacaactgcatggacgaccccgaccagcgggcgatcgtcgacgcggtcaaccgggcccagctgtacgcccagcacaagggcaccctcaacctcgcctcggcgggcaactccaacgacgacctcgactcgcacgccctcgtcgacgactccagtcccgacgactcgaccgcggtgccccgcacggtcgacccccacaagtgcttcgacgtgccgacccagctgccgggcgtggtcacggtcagcgcgaccggtgtcgcgagcaccaagtcgtactactccagctacggcgacggcgtcatcgacatcgcggccccgggcggtgacaagttccagctcccggacacgccgtcgaagaacggccgcatcctctccacgatgccgaacaacgagtacgcgttcctccagggcacgtcgatggcgtcgccgcacgccgcgggcgtggccgcactgctgaagtcggcccacccgtcggcgaccccggcaaagctccaggcgctgctcaaggcgcaggcggacaaccctggctgcccgacggacccgtacgacggggacggcgacggtgtcgtggacgcgacctgcgtgggcggcaagcgggtgaacggcttctacggcttcggcatcgtcaacgcgctgcgcgcggtgaag

SEQ ID NO: 6430 - DNA, 354 bp, Streptomyces avermitilis
  CDS (1)..(354)
gtggctaccgacgcaccgcccccctcgaaggtccatccccgatacccctccacggaggagttcgtcgcggagcaggagagcgccgagttcggtgaactgcgccgctcctaccgctcgttcgcctttcccctgaccatcgcgttcatcgcctggtacctgctctacgtcctgctgtcgaactacgccggcggcttcatgggcaccaagctcttcggcaatgtcaacgtcgccctggtgctcggtctcgcccagttcctgaccacgttcctcattgcctggtggtactcgcggcacgccgccgccgagctcgatcccaaggccgaggcgatcaagtcccggatggagggcggcgca

SEQ ID NO: 6431 - DNA, 1647 bp, Streptomyces avermitilis
  CDS (1)..(1647)
atgagccccgcgatcaccctggccgccgacgcggccggcccacgtcttctcgccgccggtgaggcgagcgagcaccggccgctgatcatcaccctgttcgcggtgttcgtcgccgcgaccctcgtcatcaccgtctgggcgggccggcagaccaaggacgccgccgacttctacgcgggcggccgccagttcaccgccttccagaacggcctcgcggtctccggtgactacatgtccgccgcgtccttcctcggcatcgcgggcgccatcgccctcttcgggtacgacggcttcctgtactccatcggattcctcgtcgcctggctggtcgccctgctcctggtcgccgagccgctgcgcaactccggccgctacaccatgggcgacgtcctcgcgttccgcatgcgccagcgccccgtccgcacggccgccggcacctccacgatcgtcgtctcgatcttctacctgctggcccagatggcgggcgcgggcgtcctcgtctcgctgctgctcggtatcaccagcgacggcggcaagatcggcatcgtcgccctggtcggcgtgctgatgatcgtgtacgtcaccatcggcggcatgaagggcaccacctgggtccagatggtcaaggccgtgctgctgatcgccggcgccctgctgctcaccttcctggtgctgctgaagttcaacttcaacatctccgacctgctcggcaaggccgcctccaacagcggcaagggcagcgccttcctcgagcccggcctcaagtacggcgccacctcgacgaccaagctggacttcatctccctgggcatcgccctggtcctgggcaccgcgggcctgccgcacatcctgatccgcttctacacggtgcccaccgccaaggccgcgcggaagtcagtgaactgggctatcggcctcatcggcggcttctacctgatgaccctcgcgctcggcttcggcgcggccgcgctcatcaagccggacgagatcatcgcctccaacaaggcgggcaacacggccgcacccctgctcgccctgcacctgggaggcgtcgactccaactggggtgccatcctgctcgccaccatctcggcggtcgccttcgccacgatcctcgcggtcgtcgcgggcctgaccctggcctcctcctcgtcgttcgcgcacgacatctacgcgaacgtcatcaagaaggggcaggccagcgagaaggacgaggtacgggccgcccggtacgcgacgatcgccatcggcgtcgtgtccatcggcctcggcgccctcgcccgcgacttgaacgtcgcaggcctcgtcgccctcgccttcgccgtcgccgcctccgccaacctgccgacgatcctctacagcctcttctggaagcggttcaccaccccgggagcgctctggtcgatctacggcggcctgatcacggcggtcggcctggtgctgttctcgccggtggtctcgggcaagcccacgtcgatgttcccgggcgtcgacttccactggttcccgctggagaaccccggcatcgtctccatcccggtcggcttcctgctgggctggctcggcacgatcctgtcgaaggaggagccggacaccgccaagtacgcggagctggaggtgcggtccctgtcgggcaccggagcgcac

SEQ ID NO: 6432 - DNA, 1029 bp, Streptomyces avermitilis
  CDS (1)..(1029)
gtgtccgaggaatgtgatccgcatcgaggggagggggcccgcgtgctcatcgacacctacggccgggtggcaaccgacctgcgcgtctcactgaccgaccgctgcaatctgcggtgcacgtactgcatgcccgaagaaggcctgcagtggctggccaagcccgatctgctcacggacgacgagatcgtccgtctgatagacatcgccgtcacccggctcggcatcaccgaggtccgcttcaccggcggcgagcccctgctgcgccccggcctggtcggcatcgtggagcgggtcgccgccctcgcctcacgcccccagacgtccctgaccaccaacggcatcggcctcagccgcaccgcgaccgccctgaaggcggcgggcctggaccgcgtcaatgtctccctcgacaccctccgccccgacgtcttcaagaccctcacccgccgtgaccgtcacaaggacgtcatcgcgggcctcgaagcggcccgcgacgccggcctgacccccgtcaaggtcaacacggtcctgatgccgggactgaacgcggacgaggcccccgacctgctggcctgggccgtggcgcacgactacgagctgcgtttcatcgagcagatgcccctggacgcccagcacggctggaagcgcgagggcatggtcaccgcgggcgacatcctcgcctcgctgcgtacgcgtttcgagctctcggaggagggcgccgacgagcgcggctccgccccggccgagcgctggctcgtcgacggcggcccgcaccgcgtgggcgtgatcgcctcggtcacccgcccgttctgcgcggcctgcgaccgtacgcgcctgacggccgacggccagatacgcacatgtctgttcgccaccgaggagaccgacctgcgcgcggccctgcgctcggacgcccccgacgaggagatcgcccgtatctggcggctcgcgatgtggggcaagaaggcgggctcgggcctggacgatccctcgttcctccagccggagcggccgatgtcggcgatcggcggc

SEQ ID NO: 6433 - DNA, 240 bp, Streptomyces avermitilis
  CDS (1)..(240)
gtgattttcaacgcccccggcgccggctccgatccgtcctccccgatgtgctccgcaaagggctgtcgcgccgaagccgtgtgggtgctcgcctggaacaacccgaagctgcacactcccgagcgccgcaagacttggctcgcgtgcgaggaacaccgcgagcacctctcccagttcctcggcgtccgtggattcctcaaggacgtcgtcaggctcgaggactgggaagccgcgcagaac

SEQ ID NO: 6434 - DNA, 477 bp, Streptomyces avermitilis
  CDS (1)..(477)
atgtgttcgggcctggtccctgaccgggttcgagccgggtacggggcgggggcgagtccgatacaaggcggatggtggaacgtgatgcggaagcagggcaacggcggcaacgctgaggtgttccggatcaccggcgcccggcagggtctcgccgacgacgtacgcgggcggcagcggcgctatgtcatctcgatggccgtgcgcacggtctcggtgatcctcgcggccaccctctggaacgtggaacggcacgtcgccgtggttgcgctggtgctcggcgcccttctcccctacatcgccgtggtgatcgccaacgcgggccgggagaacgcgccctcgctcccctcgacgttcgtcaccaccccgatgcgtccgatgatcgcgccgccacgggcggacgactccgcggaacccgaccccgagggcgtgtcggccgagcccggagcccaggtgcgcagcgagccgcacgagcgggcc

SEQ ID NO: 6435 - DNA, 273 bp, Streptomyces avermitilis
  CDS (1)..(273)
atgggctggttgtgggcgatcatcgtcggatttgtgctgggtctgctcgccaaactgatcctgccgggcaagcagcacagcccgctctggctgaccaccatcatgggcatcatcggcgccatcgtcggcaacgcgatcgcacagggcctcggcatcgcggagaccaagggcatcgactggggccgacacggcctccagctggcggcagcggtcgtcctggtgttcctcggcgacatgctgtacatggcgatgcggggcagcaaacagcgggcc

SEQ ID NO: 6436 - DNA, 1266 bp, Streptomyces avermitilis
  CDS (1)..(1266)
gtgacggacatcgtcgatgagctgaagtggcgggggctggtcgccctctccaccgacgaggacgcattgcgcaaggcgttcgcggacggtcccgtcacgttctattgcggattcgacccgacggcgcccagtctgcacctcggcaacctcgtgcagatcctgacgatgcgcaggatccagcaggcgggcaaccgtccgctgggcctggtcggcggtgccaccggtctgatcggtgacccgaagccgaactccgagcgcacgctgaactcccgcgaggtcgtcgccgagtgggtggagcggctgcgcgcgcagatcgcgccgctgctcgacttcgagggtccgaacgccgcgatcatggtcaacaacctggactggacccagggactgtcggccatcgagttcctgcgcgacgtcggcaagtacttccgggtcaacaagatgatcgcgaaggaggccgtctcccggcggctcaactccgacgcgggcatcagctacaccgagttcagctaccagatcctccagggcatggacttcctggagctgtaccgcaggtacggctgcacgctgcagaccggcggtagcgaccagtggggcaacctcacctcgggcaccgacctgatccaccgggccgaaccggacgccgtggtgcacgcgctgggcaccccgctgatcaccaaggcggacggcaccaagttcggcaagacggagtccggcacgatctggctcgatcccgagatgaccacgccgtacgccttctaccagttctggctgaacgcggacgaccgtgacgtctccaagttcctgcgcatcttcagcttcaagtcccatgaggagatcgaggagctggagaagcagaccgaggagcgcccccaggcccgcgccgcgcagcgcgcgctcgccgaggagctgacgacgctggtgcacggcgcggaccagacggccgccgtgatcgccgcgtccaaggccctcttcggccagggcgagctgaccgagctggacgaggcgacgctggccgcggcgctctccgagctgccgcacgtcaaggtcgccgagccggccccggtcgtggacctcttcgccgaggtcgctctggtggccagcaagtcggccgcgcggcgcacgatcaaggagggcggcgcgtacgtgaacaacgtcaaggtcgccgccgaggacgccgtccccgccaaggaggacctgctgcacgggcgctggctggtgctgcgccgcggcaagaagaacctggcggcggtggaggtcacgggcggc

SEQ ID NO: 6437 - DNA, 1392 bp, Streptomyces avermitilis
  CDS (1)..(1392)
atgaccgctcgtacgaacaagccgcacgagatcgtcgagcgcgccctcgaactgtcccgggccgacggctgcgtcgtgatcgccgacgagcactccaccgccaacctgcgctgggcgggcaacgcgctgacgacgaacggcgtcacgcgcggacgtacgctcaccgtcatcgcgaccgtcgacggccgtgagggcaccgcctccggtgtcgtctcgcgctcggccgtgacggcacaggaactggagcccctggtgcgggcggccgaggccgcggcgcgcggtgccgctcccgccgaggacgcccagccgctggtcacgggcgtcccccaggcacccgacttcacggacgcgccggccgagacctcgtccgccgtcttcacggacttcgcgccggcgctcggtgaatcgttcgcacgcgcgcgtgcgggtggccgggagctgtacggcttcgccaaccacgaactcgtctccagctatctcggtacgtcgacgggtctgcggctgcgccacgaccagcccaacggcaccctggagctcaacgccaagtcgccggaccggacgcgctcggcgtgggccgggcgctcgacgcgcgacttcaaggacgtcgacccggcggcgctggacgcggagctggcgcagcgcctggcgtgggcggagcggcgtatcgagctgcccgccggacgctacgagacgctgctgccgccgaccgcggtcgcggacctgctgatctaccagatgtggtcggcggcggcccgggacgcggccgagggccggacggtgttcagcaagcccggcgggggcacgcgcatcggcgacaaactctccgagctgcccctgacgctgcgcagcgatccgaacgagccggggctggaatccgcgcccttcgtgctcgcgcactcctcgggcgacgacgcctcggtgttcgacaacgggctgccgctcaaggccaccgagtgggtgagcgagggcgagctgaggcatctgacgaccacccggcacagcgcggccctgaccgggctgccggtcgcgccggccatcgggaacctgatcctggaaggcggtgaggaccgttccctggaggagatggtcgccgccaccgagcgcgggctgctgctgacctgcctctggtacatccgcgaggtcgacccggcgacgctgctgctgaccgggctgacccgggacggcgtctacctggtggagaacggggcggtcgtcggcgaggtgaacaacttccggttcaacgagtcgccggtcggtctgctgggccgggcgacggaggcggggcgcacggagaagactttgccgcgtgagtggagcgattggttcactcgggccgcgatgcccgctctgcgcatcccggacttcaatatgagctcggtcagccagggcgta

SEQ ID NO: 6438 - DNA, 1521 bp, Streptomyces avermitilis
  CDS (1)..(1521)
gtgcctcattccatcgacgaagccttcacggcactgccgctgcgggccctggccgacgcggcgctcgcgcgagcccgtgcgctgggggccgagcacgcggacttccgcttcgagcgggtgcgcagtgccgcctggcggctgcgggacgccaagcccgccgggtcgtcggacacgaccgacctcgggtacgcggtgcgggtggtgcacggcggcacctggggcttcgcctcgggggtggatctcacgatggacgccgccgcgcgtgtcgcgtcgcaggcggtggcgatggcgaagctgtcggcgcaggtgatcaaggcggcgggttccgacgagcgcgtggagctggcggacgagccggtgcacgccgagcggacctggatctcgtcgtacgagatcgatcccttcaccgtgcccgacgaggagaagtcggggctgctggccgactggagcgggcggctgctcgcggcggacggggtcagtcacgtcgacgcctcgctgctcaccgtgcacgagaacaagttctatgcggacacggccggcacggtgaccacacagcagcgggtgcggctgcatccgcagctcaccgcggtcgcggtcgacgagtccacgggcgagttcgactcgatgcggaccatcgctccgccggccgggcgcggctgggagtatctgacgggcaccggctgggactgggagtccgaactcgggcagatccccgagctgctcgccgagaagatgcgcgcgccgagcgtcgaggcgggcatctacgacctcgtcgtcgatccgtccaatctgtggctgaccatccacgagtccatcggccacgccaccgagctggaccgcgcgctgggctacgaggccgcgtacgcgggcacctccttcgccaccttcgaccagctcggcaagctgaagtacggctccgagctgatgaacgtgacgggtgaccgcaccgccgagcacgggctcgcgaccatcgggtacgacgacgagggtgtcgagggccagtcctgggacctcgtgaaggacgggacgctcgtcggctaccagctcgaccggcgcatcgcgaagctgaccggcttcgagcggtccaacggctgcgcgtacgccgactcccccgggcatgtgccggtgcagcgcatggcgaacgtgtcgctccagccggatccggccggtctgtcgaccgagggactgatcggcggcgtcgaccgcgggatctacgtcgtcggtgaccgctcctggtccatcgacatgcagcgctacaacttccagttcaccgggcagcgcttcttcaagatcgagaacgggcggatcacgggccagctgcgcgatgtcgcgtaccaggcgacgaccaccgacttctggggctccatggcggccgtcggcggtccgcagacgtatgtcctgggcggcgccttcaactgcggcaaggcccagccgggtcaggtcgcggccgtctcgcacggctgcccgtcggccctcttcaagggcgtcaacattctgaacaccacgcaggaggccggccga

SEQ ID NO: 6439 - DNA, 717 bp, Streptomyces avermitilis
  CDS (1)..(717)
ttgagccgctcggttctcgtcaccggaggcaaccggggcatcggcctcgccatcgcccgcgcgttcgccgaggccggcgacaaggtcgcgatcacataccggtcgggtgagccgccggccaccctcacggacttgggctgtctcgccgtcaagtgcgacatcacggacaccgagcaggtggagcaggcctacaaggagatcgaggaccagcacggccccgtcgaggtcctcgtcgccaacgccggcgtcaccaaggaccagctcctgatgcgcatgtccgaggaggacttcacgtccgtcctcgacaccaacctcaccggcaccttccgcgtggtcaagcgtgccaaccgcggcatgctgcgcgccaagaagggccgcgtcgtgctcatctcgtcggtcgtcggcctcctcggctccgcgggccaggcgaactacgccgcgtccaaggccggcctggtcggcttcgcgcgctccctcgcccgcgagctgggctcacgcaacatcaccttcaacgtcgtcgcgcccggtttcgtcgacaccgacatgaccaaggtgctcaccgaggagcagcgcaagggcatcgtcggccaggtgccgctcggccggtacgcgcagcccgaggagatcgccgcggcggtgcggttcctcgcctccgacgacgcctcgtacatcactggagccgtcattcccgttgacggcggactgggaatgggtcac

SEQ ID NO: 6440 - DNA, 765 bp, Streptomyces avermitilis
  CDS (1)..(765)
atgagcggaattctcgagggcaagcgcgtcctgatcaccggtgtgctgatggagtcctccatcgccttccacaccgcgaagctggcccaggagcagggcgccgagatcatcctgaccgccttcccgcggcccacgctgaccgagcgcatcgcccggaagctccccaagcccaccaaggtcatcgagctcgacgtcaccaacgacgagcacctcggccgcctggccgacatcgtcggtgaggagctgggcggcctggacggcgtcgtgcactccatcggtttcgcgccccaggacgccctcggcggcaacttcctgaacacgccgttcgagtcggtcgccacggccatgcacgtctcggcgttctccctgaagtcgctgaccatggcctgtctgccgctgatgcaaagcggcggctcggtcgtcggtctcaccttcgacgcgcagtacgcctggccgcagtacgactggatgggcccggccaaggccgccctggaggccaccaaccgctatctcgcccgcgacctgggcaagcagaacgtgcgctccaacctcatctcggccggcccgatcggctccatggccgccaagtccatcccgggcttcagcgagctggcagccgtctgggactcccgcgcccccctggagtgggacctcaaggacccggagccggccggtcgcggtgtcgtcgccctgctgagcgactggttcccgaagaccacgggcgagatcatccacgtggacggcggtctgcacgcgatcggcgcg

SEQ ID NO: 6441 - DNA, 525 bp, Streptomyces avermitilis
  CDS (1)..(525)
ttgcgcaatcgcttacgcgcgaccgcccggtcgctttcgtacgaggccgacgccccgtttcccgcaccgcggggagcggggcgtcgcccgttcggcccaactggccgggcagccgggaccgggcagcacgcacgctgggactacgcaccgccccgcagccgaacggccgaggaggtcccccttgtgcgcctgtcccgccgcttcgccccggtgatcctcgccgtcactctggtgatggtcctgccgtccgacgccatgccccacgcgcgcgtggcggaccgaaaacccgctgacccgcagcctttcggcgccgagtgccgtaccagcgtcaccggctcccacgcggtcgcgtactgccacaacccctacgtggacacggatcgcgtacgcctgcacatcgaatgcgaccgctggtgggatctcgacaccgacagcgcgccggtcgacaccggaccggcgatgaccgtccggctgagcgggcggtgctgggaggagatccgctcggtgtgggtcagccacgagaag

SEQ ID NO: 6442 - DNA, 693 bp, Streptomyces avermitilis
  CDS (1)..(693)
atgccgctgagccacccccgccgttcggcactgtccgagcaggtcatcgccgagctgcggaatcagatcacctcgggcgagtggccggtcggttcgcgcatccccaccgagcccgagctggtcgagcagctgggcgtcgcccggaacacggtccgcgaggccgtccgggccctcgcgcacaacggtctgctcgacatccgccagggttccggcacctacgtcgcggcgaccagtgagctggcgggtgtgatgcaccgccgtttcgcggacgcggacccccggcacatcgccgagctgcgttccacgctggagtcgggtgccgcgaagctggccgcgaggcggcgcaccgagcgcgatctgaagcagctggacacgctcctcgtacgccgcgaggaggcctgggagtcgggcaacgccgaggccttcgtgacggccgacgcgaccttccacatggcggtggtggccgcgtcccacaacgacgtcatgacggcgatgtacgcggacctgggcgaggtgctgcgcgactggctgcgcgaggacgtcggcgaggagctgactccggagacgtacatggaccacgcccgcctggtcgacgcgatccgtacgggcgacgcggaggcggcggcgacggaggccgccgggtatccgttcctgtgccggcccgggcggcggaagtccgcccccgcggacggc

SEQ ID NO: 6443 - DNA, 1338 bp, Streptomyces avermitilis
  CDS (1)..(1338)
atggcaagcgaggagatccggacggcgacgtccacaccgatacgcagctccgcaggtacgggggccgacagcgaaacgccgtccacgcgcgcgtggaggacgcgtctggtggtcgtgggcatcgtcctcaccgcgctcaatctgcgtccggccatcaccagcctcggcgccctcctcgaagaggtgcgcgacgggctcggcatgagcggcagcgtcgccggactgctcacctcggtgccgccgctctgcttcgcggtcttcggcgtgatggcaccgcggctggcccgccgcttcggggccgccgccgtcgtgggcgccggaatggtcgcgatcaccgcgggcctggtgatccggccgtacgccgggggcacggcgggattcctcgccgccagcgcgctggcactcatgggcatcgccgtgagcaacgtcctgatgccggtgatcgtcaagcgctggttcccggaccgggtcggctccatgaccggcctgtactcgatggcgctcgcgctgggcacctccgccgcggccgccgtgacggtgcccctgaccgacgcactgggcggcagctggcagtccgggctggccgtctgggcgggactcgcggcggcggccgtcctgccctggattccgctggtacgcgcgcggggaggggccggaggctcgcacgggttcggctcgtcggaagcggccggagggtcgcacgggctcggctcgtcggaagcggcggccgccgcggcccctcaggaggccgacgggctgcggatcacccggagccgtacggcctgggcgctggccgtcttcttcggactccaggccaccgccgcgtacatcacgatggggtggatggcgcagatcttccgcgacgcaggtgtcgccgcgggcacggccggactcctgctggccgtcaccatggtgatgggcgtcccgctggccttcgtcatcccccggctggccacgcgcctgccgcaccaggggccgatcgcggtggttctcggggcgtgcggactcgccgggtacgcgggcctctacttcgcccctgcggccggcgcctgggcctgggcgctgctgctcggcgtctccaactgcgccttccccctcgctctgacgatggtgggcatgcgggcccggacgggtgcgggcgtggccaagctgtccgccttcgcgcagagcacgggctatctgatctccatccccggcccgctcctggtgggggtgctgtaccagcacagcggcggctgggggctgccgatcgcgctgatggcggggctgatgatcccgcagatcgtggtggggatcgtcgccgggcgcaatcggacggtggaggaggaggcggctcgc

SEQ ID NO: 6444 - DNA, 198 bp, Streptomyces avermitilis
  CDS (1)..(198)
gtgccgcgagtacctccgtgtcacgacgcggccggtcgcgaccccgggggagtccgggcgggcgatgggtgcgagactggccgtatgcccgtgctcgacccgaatccccagaacggccagaagaagatgctgctcgtcttcggcgcgttcctcgccatcttcgtgatcatcggcatcatcgcgtcgatcgcgtccccc

SEQ ID NO: 6445 - DNA, 210 bp, Streptomyces avermitilis
  CDS (1)..(210)
atgtcggcctgcacccccacccggccccacccggcgacctcgggcggcgtcgacatccggctgccctggtgggcgctcgccctgcccgccctcgccttcgtcgccctcctcgcgctgatcatcaacccgtcggacgcgagtgcggccgccggggagcccgcgatcacgcatcttctcgagcgcgtccggacggtgctgggccaggccctt

SEQ ID NO: 6446 - DNA, 516 bp, Streptomyces avermitilis
  CDS (1)..(516)
atgagcgtcgcagaaccccgcaggattgtcctcttccggcatgcgaaggccgactggccgcaggtgtccgaccacgagcggccgctcgccgaccgggggcgcacggacgccgccgtcgccggacgcaagctggccgacaccggcatccccgtcgatctggccctctgctccaccgcgacccggacccgcgagacctggaagctcgccgtccacgagctcccgcaccggccgaaaaccgtctatgaggagcggctctacgaggcctcgcccggggagatcatcgccgtgctcaacgagaccccggacgacgtgcagaacgtggtcctgatcggtcacaaccccggtgtgcagggcctggccgacatcctcgccggctcggccgagggcgatacccgcacccggatggccgaccgcgacttcccgaccgccgccttcgccgtgctctccttcgacggcccctggaagtccctggagccgggtgtggccacactgctcgactactgggccccgaccgag

SEQ ID NO: 6447 - DNA, 1212 bp, Streptomyces avermitilis
  CDS (1)..(1212)
atgagtgcttcgcagacctccgacgcccgcacccttctcgtcaagatcttcggcaaggaccggccaggcctgaccgccggcctgttcgacaccctcgccgccttctccgtcgacgtggtcgacatcgagcaggtcgtcacccgtggccggatggtgctgtgcgcgctcgtgaccgagccgccggccgggctcgagggtgatctgcggtccaccgtccacagctgggcggagtccatgaagatgcaggcggagatcatctccggcctgggcgacaaccggccgcgcggactcggccgctcgctggtcaccgtgctcggccaccccctcaccgcggagtccacggccgccatcgccgcgcggatcacctcgaccggcggcaacatcgaccgtattttccggctcgccaagtacccggtgacggcggtcgagttcgccgtgtccggcacggagaccgagacgctgcgcaccgccctggcgaccgaggcggcggcactcggtgtcgatgtcgccgtcgtcgcggccgggctgcaccgacgggcccagcggctggtcgtcatggacgtggactcgacgctcatccaggacgaggtgatcgagctcttcgccgcgcatgccggctgcgaggagcaggtcgccgaggtgacggcggccgcgatgcgcggcgagctggacttcgaacagtcgctgcacgcgcgcgtggcgctgctgaaggggctggacgcctcggtgatcgacaaggtgcgcagcgaggtccggctcactcccggcgcgcgcaccctgatccgtacgctgaagcggctcggcttccaagtcggtgtcgtgtccggcgggttcacccaggtcaccgacgatctgaaggagcggctcggcctcgacttcgctcaggccaacaccctggagatcgtcgacgggaagctgacgggcaaggtcaccggggagatcgtggaccgcgcgggcaaggctcggctgctgcgccggttcgcggcggaggccggggtgccgctggcccagaccgtggcgatcggtgacggcgcgaacgacctcgacatgctcaacgcggcggggctgggtgtcgccttcaacgccaagcccgtcgtccgcgaggccgcgcacaccgcggtgaacttccccttcctggacacggtcctgtatctgctcggtgtcacccgggaagaggtcgaggcggcggacacgcacgacgacgacgccggc

SEQ ID NO: 6448 - DNA, 2013 bp, Streptomyces avermitilis
  CDS (1)..(2013)
atgagcatcgagaccgcggaccacggcaggagggtgccgtggggagacgtcctgctgtccgcgatcgcctccgtgagctgggcgttgatcgggatggcggggacggccgcgctcgggctgcatctgctggacgcggacgcggagggctcgctcggcccgatgaccgccgccgttgtggcgcttggggcgggtggttcggtgacgccgtccggcgatgtgtcggcgttcggcctgaagggagcggaggcgacgaccgccatccagatcacgccacttggcgtggggctggtgggcgcgctgctgctgtgctggttcttcttacggtccctgcgcgcggcgggagttgtggtcgcgccgtccgaactcctcgcgcgcgcggcagcggtggtcgtcctgttcgtggcgatgctgggcgggctcgcctgggccggtcacgacgtcatcaccatcgacggcgaacggctcgggctcggcagactgcccggaggcggcgggagcggcaagatcgacattcccgggctcggggacatcggcgggctgctgccggaccggatcggcgatctggtgaaggcgaaggcggcggtcggcttctcggtcgacacggtgcccacgctgctcggcggcgcggtctgggcggtcggagtgctggtgatcgcgctgctggcgtcgcgccgtacgcccctgccgcgcggctgggaggcggtgcaccgggtggtgcggccggccgtgtccgcgctggtgaccgtactgctggtggcggtcgtggcaggactctcggcggcggcgtacgcggcgatcggcgacgaccatccccggcggatcgccggcgcggccctgctcggcgcgcccaacggggtgtggctgggcatcccggtcggcctgttcgtgccatgggacggcaaggcctcgggcgcactggccacgctgctgccccaccccctggacgagctgctgagcgtgcggtccgaccagcccgtcacgctggggcgcctggccgaactggacggcagagtctggctgttgggggtcgcggccgcgctcatgatgctgttcgcgggggtgctgacggcagcgcgtacgccttttgtacgggggccgggtgccgcctcgcggccgaggaagggccgtgcggacgtacgaggcgggagtgcggcttccggaccggtgccgggcactgcggctgtacgaggtgggggtgccctcggcttcgcggggcactgcgctcttcggctcggcgtggtgaccgcgctggcactgccgttgctggtctggctgacggatgtgtccgtggacgcgtcgctgtcggtgctcggcttcgacgcgttcggcgcggggatccgactgcacgggcacctggggatggcgctggtgctgggcgcggtgtggggtgcgggcgcgggggcggccggggcgttgctcgcgtacgtgagcggagcggccgggcggcgggcggcgccgctggcactgggtgacgtgggggcaccggggccggtcgggccgcagcggacggatgtgtcgctggggacggatgtgccgcagcggacggatgtgccgcagcggacggagagtccgaagcatgcgggaccgtacgcgccgagcaggccgtaccggcctgcgaatcctgacacgaacccctatctgagggtgccggaggaactgcgggcggcggaggggcggcgggccccggaggacgggcgggccccggaggcccggcggccggcgggaggtgcggcgccgggagacagggatgtgcggccgggagacagggatgtgcggaggccggagggggccgcgccctcgcagggcgtgaggccgcccgacgacgtgtacggggcgcccaccgtgatcgggccgatcacgccaccgccccggtcgccggggcgacggtccaggccggctgcgcctggggcttcgccggaggaggggccgccgcctcccccgccacctcccccgcctccgccgcctccgccgcctgggaggcctcaggggggcggtgggcgcggcgggcggggc

SEQ ID NO: 6449 - DNA, 2529 bp, Streptomyces avermitilis
  CDS (1)..(2529)
gtgccggaactcgtactggaattgaatggacggacctggacgctcgacgcgtcccggccctacaccctcggacgtgatccgcagggagacatcacgctcgacgacgccagggtgtcctggcggcacgccacgatcagctggaacggccgcagttgggtcatcgaggaccacggcagcaccaacggcacgttcgtgcagggccagcggatccatcagatggagatcggcccgggttcggccgtgcatctgggcaacgcgaccgacggaccgcgtctgaacctgtccggcgcggcggcggccgtcgccgcgccgcagcaagcgcagccccagcagcagccgtacgtggccaagggcgcgagccccggctgggcccagcaggccccgccgcagcagcaggccccgcagcagcaggcaccccagcagggctggcagcagcctcagcagagtgcggccgttccgcagcagcagggacccggtggtggcgcgggggcgccaccggtctacggcgaccgcagcccgaccacgttccaccagttctcgctcggccgcgtgatgcgcatcggtcgtgccctggagaacgagctggtcgtctccgaccttcaggtctcgcggaaccacgccgagttccacgcgacgcccgacggccgcttcgagatccgcgacctcggctcgcacaacggcacgtacgtcaacggtatgccgatcgccaagggcggctcggcgctcctcggcccgaacgacatcgtcggtgtcggccactcgacgttccgcctcatcggcgaccgcctcgaggagttcgtcgacaccggtgaggtctccttctcggcccgccatctgaccgtcacggtcgacggcggcaagcagatcctcaaggacgtctccttcggcgtcccggagaagtcgctcatcgcggtcatcggcccgtcgggctccggcaagtcgacgctgctcaaggcgctcacgggctaccgcccggccaaccagggcgatgtcctctacgacaaccggaacctgtacaagcagttcgccgagctgcgtcagcgcatcggtctggtcccgcaggacgacatcctgcacaaggagctgaccgtcaagaaggccctcaagtacgcggccaagctgcgcttccccgcggacaccacggggcaggagcgcgaggcccgcatcgacgaggtgctgcgcgagctgaagctggacatccacaaggagaagaaggtcacctccctctccggtggccagcgcaagcgggtctccgtggccctggagctgctgaccaagccgtcgctgatcttcctggacgagccgacctccggcctcgacccgggcatggaccgtgacgtcatgcagctgctgcgcggtctcgccgacgacggccgtacggtcctcgtcgtcacgcactccgtggccgagctggcgatctgcgacaagctcctggtcatggcgcccggcggttcggtggcctacttcggcccgccggaggaggcgctgaacttcttcggctacgacacctgggccgacgtcttctccgccttcgagaactaccgcgactacgactgggcgggccgctggaagggctcgcagcactaccagatgtacgccgcggacatcgacgccgtcgctccgcaatccgtacacatgcctccgccgcagcagatgcgcccgcccaagccacagggctggggctcgcagttgatgaccctgatccgccgctatgtgtcggtgatcgtgtccgacaagggcttcctggcgctgacggtgatcctgccggcggtactcggcgcggtgagcctgctcatcgactcggacaagggtctgctggtcaacccggcgaacccgaagaccggggtgcacatcccgaacggcacggccaccacggtcctgctgatcctcgcggtcggcgcgtgcttcgcgggcgccgcgaactccgtgcgcgagctgatcaaggaacgggtcatctacgagcgggagcgggcgaccggcctgtcacgctccgcgtatctgatgtcgaaggtgatcgtcctcggcaccatcaccgtgctccagggcgcgatggtcggcgcgatcggcttctccagccgcgagatccccgacaagggcctcgtcctgggcaacgcggtgctgctcgagctgtccatcccgatcatggcgctcggtttcacctcgatgatgttcggcctgatcatttcctcgctggtgaagaccgccgagaagaccatgccgctgctggtgatgttcgcgatcatccaggtcgtgttcacgggctgcctgttcacgctgcacggcgcggtcggcgtcaacgagttctcgtacctgatgccctcgcgctgggccgtcgccgccgccggtacgacgctcgacttcaacaacatcgccccgaacaccgacgacccgaccagcacggacccgctgtgggaccacgcggcgggcgcctggaccatggacatggccgcactgatcgtcctcggtgtcatctgcggcttcttcgtggcccgcttcctgcgccgccacgagccggaggtcatgcggaag

SEQ ID NO: 6450 - DNA, 741 bp, Streptomyces avermitilis
  CDS (1)..(741)
atgcccaagaacatcaacactcctggtcatcgtccgaagctgaccaagacccacaagctctcggtcgccggtgtggccgccctcggcgccgccgccctcgcgttctccgcggtgccgagcagcgcacagaccccgacgcaggagaccgccgccgtgtcgtccgctccggtggtgtacagccaggagcagatcaaggacgtcaaggccagcatcaccgaccagctggccggcgccaccgtcaaggccgaggcgatcgcggcgaagaagcaggccgccgacgcggccgccgccaagaagctggccgccgtggccgccgccaagaagcaggccgtggcgaaggccgcgcaggtgcgcaaggcgaaggcggccgcgagccggtccgcccagcgcgtcgaggtcaagccggtcgccgcgaagacgtacgccaacaacctcgacggctggatccacgagtcgctcgacatcatggcgaagcacaagatccccggctcgtacaacggcctgtaccgcaacatcatgcgggagtcgtccggcaacccgaaggccatcaacggctgggacgtcaacgcgatcaacggcatcccgtcgaagggcctgctccaggtcatcccgccgaccttcaacgcgtaccacgtgcccggcacctcgtggaacatctacgacccggtcgccaacatcacggccgccgccaactacgcggccgacaagtacggctcgatggacaacgtcaacagcgcgtac

SEQ ID NO: 6451 - DNA, 1230 bp, Streptomyces avermitilis
  CDS (1)..(1230)
atgggggtccccccggtcgggcgcggtcgcgcgtgggggaaggtgccggaggagttgtcggcgcgggtgccggccgagcagcgcgggcccggcctcgaccgggattccgtacggctgctggtctcgcgcgggaccgaggtgtcgcaccacgacttcgtggagctgccgcggcagctgcgggccggggatctgctcgtcgtcaacacgtcccccacgctggccgccgccgtggacgggcggatcgggcacgcgcgcgtggtggtgcatttctccacgcggggcgaggacggacgatgggccgtcgagctgcgggatcccgacggaaggggcactacacgcgcgcgtacgggcgggcccgcgggcacagaggtgcgtctcccggacggcgtacgcctcgtactcgaggagccgctggccgggcggagcgagcgcctgtggtgggcgcgggtgtcggcccccggggacgcggacgtgacggtgctgctgcgcgggcacgggcgccccatccgttactcctatacagaaagggatcagcccctctccgtctatcagacggtgttcgccctgccgtccgccgacggagcgggcagtgcggagatgccgagtgccgcgcggcccttcaccgcgcggctggtggcggagctggtgagccgtggtgtgcagttcgcaccgatcacgctgcacacgggggtggcgtcggcggaggcgcacgagccgccgtatccggagcgcttcgcggttccggaggcgtcggcgcggctgatcaacgcggcgcgggcgcatcggacaccacgcgaggcgtcctcttcgaggggtggggacgggagccgggagggcggccgggtgatcgcggtcggtacgacggccgtgcgggccgtcgagtcggcgaccggcaccgacggagtggtccggccggcggagggctggaccgacctcgtggtgaccccggagcgcggggtgcgggcggtcgacgggctgctgaccgggctgcacgagccggaggcctcgcatctgctgatgctggaggcgctggcgggacggaccgcgatcgaccgcagttatgaggaggcgctggccgggctctacctgtggcacgagttcggggatctacatctcatccttccggacggagagtcctcacacagtgcattgcttccgcaacctaatgtgagactgccgctcggtcgatgtgaccccgcacatagggcgcacatcacgtacgaagaagga

SEQ ID NO: 6452 - DNA, 702 bp, Streptomyces avermitilis
  CDS (1)..(702)
atgccggtagcgatcatcacgggggcttcgaaggggctggggcgggcactcggcgcggccctggcggagcgcggctgggatctggtgctcgacgccagaaccggtgaggtgctggaggagacggcggcggccctgtccgcgtacggaacgcgggtgcgggcgctgcccggggacgtcacggatgccgggcaccgggccgggctggtgacggcggcccgggaactgggcgggctcgacctcctggtgaacaacgcgagcgctctgggtgccgagccgctcgtacgactggaagcgctgacgctggaggggctgcggcacgccctggaggtcaacgtggtcgccgcgctgggcctgatccaggaggcgctgccgctactgcgggcgtcgcgggcgggcacggtgatcgacatcagctcggacgcggcggccgaggcgtacgagacgtggggtggctacggggcgtccaaggcggcgctcgaccatctgtcggcggtgctcggcgaggaggagcccgggttgcgggtgtgggccgtggaccccggggacatgggcacggacctgtacacggcggccgtaccggacgacgacgatccgcgcccggctccggcgagtgtggtgcccgccttcatcggactgctggacgagcgcccggcgagcggccgctacggcgcgtcggcgctgtcggcgctgccggcggggcga

SEQ ID NO: 6453 - DNA, 1143 bp, Streptomyces avermitilis
  CDS (1)..(1143)
atgagtcatggaccccggtccggcctgtccgcggtgagttccgcgctgctggccatgagcaggcatctcgaggtgcgcgacgtcctcaagacgatcgtcgcctcggcccgcgagctgctcgacgccgagtacgcggcgctcggggtccccgacgaccacggaggcttcgcccagttcgtcgtcgacggcgtcagcgacgcccagtggaaggccatcggcccgctcccacgccagcacggcatcctcgccgcgatgctgcacgaggcgaagcccgagcgcctcgccgacgtgcgcgaggacccccgcttcgagggctggcccgcggcccaccccgacatgtccgacttcctgggcctgccgatccgtgacggcgacgagatcatcggcgcgctgttcctcgccaacaagaggtgccccaaaccggagggcggctgcggcttcacccctgaggacgaggaactcctgacgatcctcgcccagcacgcggcgatcgccctcaccaacgcccgcctctacgagcgcagccgcgaactcaccatcgccgaggagcgctcccggctcgcccacgaactgcacgacgccgtcagccagaagctcttctcgctgcgcctcaccgcgcaggccgccgccgccctcgtcgaccgcgacccctcgcgcgcgaagggcgaactccagcaggtggccgcgctcgccgccgaggccgccgacgaactgcgcgccgccgtcgtcgagttgcgtcccgcggccctcgacgaggacggtctggtcgccaccctgcgcacccacatacaggtcctcgaccgagcccacaccgcgcgcgtgaccttcgacagccgcggtgtgcgcgcgctgcccgccgcccaggaggaggccatgctgcgcgtcgcccaggaggccctgcacaacgccctgcgccactcgggagggtcgcgtgtcgacgtgaccctcgtgaagcgcggaccgggcgtcgtcctgcgcgtcacggacgacggcagcggcttcgaccccgcctcgacccgccgtgcgggacgccacctcgggctggtctccatgcgggaccggacgagcggggtcggcggcacactgaccgtggattcggcgcccggcaagggcaccacgatcgatatggaggtccctggtggc

SEQ ID NO: 6454 - DNA, 639 bp, Streptomyces avermitilis
  CDS (1)..(639)
gtggctgatgcaatcaaggtgctgctcgtcgacgaccaccaggtggtccgccgcggcctgcgcaccttcctcgaagtgcaggacgacatcgaggtggtgggagaggcgtccgacggcgccgaaggggtcgcccgcgccgaggagttgaagcccgacgtcgtcctcatggacgtcaagatgccgggcatggacggcatcgacgcgctgcgcagactccgcgaactcgccaaccccgcacgcgtgctgatcgtcaccagcttcaccgagcagcgcacggtggtcccggccctgcgcgcgggcgccgccgggtacgtgtacaaggacgtggaccccgacgccctcgccggcgccatccgctccgtgcacgccggacacatcctgctccagcccgaggtcgcgggcgcgctcctgtcccaggaggaggccaactcgggccagggcaggggaggttcactcaccgagcgggagcgcgaggtgctcggcctgatcgcggacggccgctccaacagggagatcgcacgcgcgctcgtactctccgagaagaccgtcaagacacacgtctcgaacatcctgatgaaactggacctcgccgaccgcacccaggccgcactgtgggccgtacgccatggagcggcgggc

SEQ ID NO: 6455 - DNA, 243 bp, Streptomyces avermitilis
  CDS (1)..(243)
gtgaagaacctgaagaaggtagccgctgtcacgatggtcgccggtgggcttgtcgccgcgggcgccggtatggcctcggccaccgacggcgcgtgggcgggcggcaaggccgtgggctccccgggtgtcggctcgggcaacgtggtccaggccccggtccacatccccgtgaacgcggtcggcaacaccgtgaacgtcatcggcgccctgaacccggccttcgggaacctgggagtcaaccac

SEQ ID NO: 6456 - DNA, 786 bp, Streptomyces avermitilis
  CDS (1)..(786)
atgctctcggaaccacgctcaggacggctggccgcatggggaaatgcccttttggccggatttgtttcaccggacgacgccgtgctcgccatcgtcggggaggacgcggtgcaccgggtcgaggggctgcccggtgagtccgggcccgtcggcctcacgctcgcccttggccggatgcgcgcgctgggggtgaccgggctgcgggtcgccctgcccgcgccggggcatccgctcgggctgagcgggccgccggaattcaatgcgcgggcgctggacgccgaggaggccgcgatctgtttcggggccgcgctcgggctggtccccgaggtgtacgaggccgggcccgacggcgatgtgcatgtggaggtcgtgtggcactgccttgccgtgcgggaggcgccgcccgccgatgtgccttccctcggggaggccgagcgggagctggcggaggcgctgcgcgaggccaccgaggtgttgtcgcggctcgatgtggcgggctccgggccggtggcggaggcggccgtcgacgcgtatcgggcccgggccgagcgggggcgcgaggtgctggcgccggggtatccgccgcgtgcggttcgcgtgttggagctggcccagcgggtggggctgctgatttcggtggcgtacgagaacgggcacggcggggcggtgagcgcgtcggagatcgcggcgaggtcgctggcgctcaggccggtcgagcgaactgcccgtcgggcgcaggtggccgcctacaacgcgtttgtggaggagcgggagcggggggtgcgg

SEQ ID NO: 6457 - DNA, 789 bp, Streptomyces avermitilis
  CDS (1)..(789)
atgagcgatgttctggagctggaggacgtatccgtggtccgcgagggccgggctctggtggaccaggtctcctggtcggtcaaggagggcgagcgctgggtcatcctcggccccaacggcgccgggaagacgaccctcctgaacctcgcttccagctacctgttccccagcagcggcaccgccaccatcctcggcgagaccctcggccaggtcgacgtcttcgaactgcgcccgcgcatcggcgtggcgggcatcgccatggccgagaagctccccaagcgccagaccgtcctccagaccgtgctcaccgccgcgtacggcatgacggccggctggcaggaggagtacgaggacatcgacgagcagcgcgcccgcgccttcctcgaccgcctcggcatgagcgactacctggaccgcaggttcggcacgctctccgagggcgagcgcaagcgcaccctcatcgcccgcgccctgatgaccgaccccgagctgctgctcctcgacgagcccgccgccggcctcgacctcggcggccgtgaggacctcgtacgccgcctcggccgcctcgcccgcgacccggtcgccccttcgatgatcatggtcacgcaccacgtcgaggagatcgcgccgggcttcacgcacgtgctgatgatccgccagggcaaggtgctcgccgccggcccgctggagctcgaactcacctcacgcaacctgtccctctgcttcggcctcccactcgtcgtggaacagatcggcgaccgctggaccgcccagggcctgcccctgtcc

SEQ ID NO: 6458 - DNA, 429 bp, Streptomyces avermitilis
  CDS (1)..(429)
gtgaacgacatcgaggcatgggtgtggtggctcgtcggcgcggtcgcgctgggaattccgctcgtggtgaccgccatgccggagttcggcatgctcgcgctgggagcagccgccgccgcggtcacggcgggtgtcggcggcggcgtcgtcctccaggtcctcgtcttcgccgtcgtctcggtcgcccttctcgccgtcgtacgccccatcgcggcccggcaccgggcccagcggccccaactcgccacgggtatagacgcgttgaagggcaagcaggccgtcgtactggaacgggtcgacggcgcgggcggccggatcaagctcgccggggaagtctggtccgcgcgatccctcgactccggacgcgcctacgaggtaggccaggaagtggacgtcgtggacatcgaaggggccacggcgatcgtcata

SEQ ID NO: 6459 - DNA, 948 bp, Streptomyces avermitilis
  CDS (1)..(948)
atggaaccgatcatcatcgtcctgatcattctggtggtgttggtcttcatcgccctgatcaagaccatccaggtcatcccgcaagcgagcgcggccatcgtcgagcgcttcggccgctacacgcggacactcaacgcgggcctgaacatcgtggttccgttcatcgactcgatccgcaaccgcatcgacctgcgtgaacaggtcgttccgttccccccgcagccggtgatcacccaggacaacctggtcgtgaacatcgacaccgtcatctattaccaggtgaccgacgcgcgtgcggccacgtacgaggtcgccagctacatccaggccatcgagcagctcaccgtcaccacgctccgcaacatcatcggcggcatggacctggagcgcaccctcacctcccgcgaggagatcaacgcggccctgcgcggtgtcctcgacgaggccaccggcaagtggggcatccgcgtcaaccgcgtcgagctcaaggcgatcgagccgccgacctccatccaggactcgatggagaagcagatgcgcgccgaccgtgacaagcgcgccgcgatcctcaccgccgagggcacgcgccaggccgccatcctcaccgccgaaggtgagaagcagtcccagatcctgcgcgccgaaggtgaggccaaggccgcggccctgcgcgccgagggcgaagcgcaggcgatccgtacggtcttcgagtccatccacgccggcgacgcggaccagaagctcctcgcctaccagtacctccagatgctccccaagatcgccgagggcgacgccaacaagctctggatcgtgcccagtgagatcggcgacgccctcaaggggctgagcggcgccatgggcaacttcggcccgatgggcggcggttcgggcagcgggaactcaggcggctccggctcggagcgccgcgagaagccgccgatcacggac

SEQ ID NO: 6460 - DNA, 504 bp, Streptomyces avermitilis
  CDS (1)..(504)
atgcgggacacgctggtgctgaacgcgagctttgagccgctgtcgacggtgacgttgaaccgagccgtcattctggtgctgcaggacaaggccgtcgtcgagcaggcccaccccgaactccgtatgcgcggagccgcgctggacataccggtgccccgggtgatcaggctctgccgctatgtccgggtgcctttccgaagacaagcgccatggtcgaggcgaggtgtcctggtacgggacaggcacaggtgcgcgtactgcggcaggcgtgcgacgaccgtggaccacgtggtgccgagggcgcaggggggccaggactcctggctgaacacggtggcgtcgtgcgcggaggacaatcaccgcaaggcggcccgtacgccggagcaggcggggatgccgctgctgcggcagccgttcgagccgacaccggcggacgcgatgctgctggcgctggggcaggacgacttcgagtcgctgccggagtggctggcacagccggccgcc

SEQ ID NO: 6461 - DNA, 537 bp, Streptomyces avermitilis
  CDS (1)..(537)
gtgaccgagctcaagaggccgccgctcccccacgacttccatccgcccgtgccgtccttcacggtcacgagtgaggatgtcgagccgggtgcgacgctcaaggacgctcaggtctacgcggcggggaacacctcgccgcagctgcgctgggaaggcttcccgccggagaccaagagcttcgccgtgacctgctacgacccggacgcacccacggggagcgggttctggcactgggtcgcgttcgacatcccggcctcggtgaccgagctgcccacgggtgcggggagcggcaagttcgagggcctgcccgacagcgcgatccaggtgcgcaacgactacgggtcgaaggacttcggtggtgccgcgccgccgcccggggacgggccgcaccggtacgtgttcacggtctacgccgtggaccaggagaagctcggtccggacgcggacgcatcgcccgccgtggtgggcttcaacctgcggttccacgcgttggcgcgcgcccagctcatcggtgagtacgaggttcccgctgaagac

SEQ ID NO: 6462 - DNA, 783 bp, Streptomyces avermitilis
  CDS (1)..(783)
atggggttcaagcggctgcttgcgagcctgggggccggtggggcttcggtcgagacggtactgaccgaggtcaacgtcgttccgggcggtgtggtccagggtgaggtacggatccagggcgggtccgtgaaccaggcgatcgaggggctgagcgtcggcctccaggccaaggtcgaggtcgagggccacgacgaccaggagtacaagcaggacatcgagttcgccaagctgagcctcggtggtgccttcgagctccaggccggagcggtgcacgcggtgccgttcgggctcgagatcccgtgggagacgccgatcacgatgatcgacgggcaggccctgcgcggcatgaacatcggtgtgacgaccgagctggagatcgcgcgcgccgtggactccggtgacctggacccggtcaacgtgcacccgctgccggcgcagaaggcgattctggacgccttcgtccagctgggcttccgcttcaagaacgcggacatggagcgcggccacatccgggggacccgccagcggctgccgttctaccaggagatcgagttcttcccgccgtcgcagtaccgcggtctcaaccaggtcgagctgagcttcgtcgcggacgaccgggagatggacgtgatcctggagatggacaagaagccgggtctgttcagcgagggcagcgactcgtaccgctccttccaggtcggtctcaacgacttccagggcaccgactggaccgcgtatctccaccagtggctgtcggaggtcggcagcaagcgcagctggttc

SEQ ID NO: 6463 - DNA, 639 bp, Streptomyces avermitilis
  CDS (1)..(639)
atgatcgcggcccctgaccgtacgcccctcacccgggagttcttcgcccgacccgtccttgacgtcgccccggacctcctcggacgcgtcctcgtccgcacgaccccggacggtccgatcgaactgcgcgtaaccgaggtcgaggcatacgacggcccgagcgatcccggctcccacgcatatcgcggccgcacggcccgcaacggcgtgatgttcggtccgcccggccatgtgtacgtctacttcacctacggcatgtggcactgcatgaacctggtgtgcggtccggagggccgagcgagcgcggtcctgctgcgggccggcgagatcatcgagggcgcggagctcgcgcgcacacgtcgactctcggcccgcaacgacaaggaactggccaaaggaccggcacgtctggccacggcgctggaggtggaccgcgcactcgacggcaccgacgcatgcgccccggagggcgggccgctgaccctgctgtcgggcacgcccgtgccccccgaccaggtgcgcaacggtccgcgcaccggagtgtccggtgacggaggggtccacccgtggcgcttctggatcgacaacgaccccacggtgagcccctatcgggcccatacgccccgacgccgacgaact

SEQ ID NO: 6464 - DNA, 1389 bp, Streptomyces avermitilis
  CDS (1)..(1389)
atgagcgaccggagcgcgacgagcgccgccgggacagtggtgaccgcggcggctaccgcgggggcccgcgccgggacaacgaccgcgctggctccggcgaccgcggtggttacggccggcgtgacgaccgccgtgatggtgaccggggcggagatcgcggtagtgaccgcggcggagaccggggtggtttccgccgtgacgatcgccgcgatgaccgtcgtggggatgaccgcggcggccgacccggcggcttccggggccgggacgaccggcgcgatgaccggcgtgacgaccgcggtggcgaccgtggcggagaccgtggtggcttccgtcgcgacgacaaccgtggtggcggcggcttccgcggaggggacgaccgcgaccgtggtggacgcccggcgttccgccgcgacgaccgcgccgccggaccgcgccgcgatgaccggggtgctggaccgcgtcgcgacgaccgcgctgctggaccgcgtcgcgacgaccgcgctgctggaccgcgccgcgacgaccgcgaccgtgatcgtgggttccgccgcgacggtgatcgccccgcggtccgtcgcgatgacgaccgtggtggcttccgtcgcgatgaccgacgtgatggcgaccgtggcggcttcgcccgtcgcgatgaccgtcgtggggatgaccgtggcggccgacccggcggcttccggggccgggacgaccggcgcgatgaccggcgtgacgaccgcggtggcgaccgaggcggagaccgtggtggcttccgtcgcgacgacaaccgtggtggtggcgaccgggaccgtggattccgtcgcgacggtgaccgtccggccttccgtcgcgatgacgaccgtggcggcttccgccgtgacgatcgtcgtggcgacgaccgtggcgatcgtggcggcttccgccgcgatgaccggcgtgacgaccgtggcggcgaccgtggtggcttccgtcgcgatgaccgcggtgacgaccgtggcggagaccgtggtggcttccgtcgcgacgacaaccgcggtggcgatcgcggtggtgaccgtggtgggttccgtcgtgatgaccggcgtgatgaccgcggcggcgaccgtggcggagaccgtggtgggttccggcgtgatgaccggcgtgatgaccgtggcggcgatcgtgggggcttccgtgggcgtgatgaccgcggttcgcgtggcccgcgtagtgatgaccgtggcggccgccccggcggcttccggggccgggacgaccggcagggcgacgaccggcgcggtggcggccggttccgcgacgagcgggaccgcgaccgtgagccgatcaagcggctgccgatcccggacgacgtcacgggcgaggagatcgacaaggacgtacggcaggagctgc

SEQ ID NO: 6465 - DNA, 774 bp, Streptomyces avermitilis
  CDS (1)..(774)
atggtcgcgcggctcatcgacgaggacccggagagcgcctacgggtactccaaggtggccctgaggctggcgtcccgcgtcgccgccgtgcgcgaggcggccggcttcgccgcgtacgcgaaccagaagtacagcgaggccctcggcgagttccgtgcggcccgccgtatgaccggcggcgtcgagctgtggcccgtcatggcggactgcgagcgcggtctcggccggcccgagaaggcgctggagatggccggtgcgcccgaggtgcacaagctcgacaaggccgatcaggtcgagatgcggctcgtcgccgccggagcgcgtcgtgacatggggcagctcgatgccgccatcgtgacgctgcagagccccgagctggcctccaactcggtgcagccctggaccgcgcgactgcggtacgcgtacgccgacgcgctcctcgccgcgggccgcgagagcgaggcgcgcgagtggttcgccaaggccgccgagtccgacaaggacggcagcacggacgcctcggaccgccttgccgagatggacggtgtcgagttcgtcgacgcgctcgtcgaggacgaggagagcgacgagggcacgcggggcgagaccgaggccccagtggcagccgccgagggcgacgcggacgcggacgtggacgaggagcaggtcgacgtcgtacgcgaggtcgtagaagccggcgttgaagacggcgacggacacggtgacgacaagagcgacaacaacgacaacaacgacggcgacggcgacaagagc

SEQ ID NO: 6466 - DNA, 1290 bp, Streptomyces avermitilis
  CDS (1)..(1290)
atgaactatgcaggtcccgcggaggaaaccccggcgcgcagtggcctcgacctgacaccgttccggggcctgcgctacgaccccgaccgggtcggcagcctggccgccgtgacatcgccgccgtacgacgtcgtcgtccggccggacgggctgctccacctcgaatcggcggacccgtacaacatcgtccggctgatcctcccccaggccgtcacgcccaccgcccgcaacgaacaggcggcggacaccctggagcactggctcaccaagggcgtcctcaccaccgacagcgagccgggtctgtacgtctacgaacaaagcgacggcagcatgctgcaacgcggcatcatcggcgccctgcgcctgtcggagccgtcggacggcgtggtcctcccccacgaggacgtcatgccgcacgtcatcgcggaccgcgcggccctgatgcgcgcgacctccgccaacctcgaacccctgctgctgacctaccgcggcaacggctccgaggccggcacgacggccgtcatcgaacgtaccgtcgagagcactccgctgctctcgacgaccacggaggacggtttcagccatcggctgtgggcggtgacggaccccgccgagctggccgagatccagaccgatctgggcagccaccaggcactcatcgccgatggccaccaccgctgggcgacgtatctgcgtctacgcgcggagcacccttcgccgagcccctgggactacgggctcgtcctgctggtcgacacggcccgctatccgctgcgcgtacgcgccatccaccgtctgctgcaccggctgccggtggcggacgccctggccgctctcacgggcctgttccgcgtccgccgcctcgacctgccgctcgcggacgccctggccgcgctggccgactccgcctgcgcgggcaacgccttcctcctcgcgggtgatggcgccttccatctggttgaccacccgtccccggacctcctggcgcgtacgatcccggcggaccacccggaagcctggcgcactctcgacgcgacggtcctgcacgccacgctcctggaccacgtctggaacatccccgaggactcccccacggacatcgcctacatccacgacacggccgccacggtcgagaaggcggagcgcgacggcggtacggccgtgctgttgcacccggtccgcgaggaggtcgtacgggacctcgcccgccagggcgtgacgatgccccgcaagtcgacgtcgttcggcccgaaacccgcgtcggggctggtgctgcgcgcgctgacggtc

SEQ ID NO: 6467 - DNA, 1026 bp, Streptomyces avermitilis
  CDS (1)..(1026)
atgagccagaccgtcaggacgcggcccgagggcagtacgcaggccctgagtgaggcgtacgacacggcgctgctcgacctcgacggggtggtgtacgcggggggaaacgcgatcgctcatgccgttgagtcgctcggcacggcccgcgcgggcgggatgcacctcgcatacgttacgaacaacgcgctgcggacgcccgacgccgtggccgatcacctcacggaactggggataccgaccgggccctccgacgtcatcacgtcggcgcaggccgtcgcccggctgatcagcgagcaggtgcccgcgggcgcgcgtgtgctggtgatcggtggcgagggactgcgggtggcgctgcgggagcgcgggctggagccggtcgattcggccgaggacgacccggcggccgtcgtacagggctacggcggtcccgagctgccctggggacgtttcgcggaggcgtcctacgccatcgcgcgcggggtgccgtggttcgcgtccaacaccgatctgacgattccgagtgcgcgtgggatcgctccgggcaacggggcggcggtggaggtcgtacggatagcgaccggcgccgagccgcaggtggcgggcaagccgctgcccccgatgcaccgcgagacgattctgcgcaccggcgccgagcggccgctggtggtcggggaccggctggacacggacatcgagggcgcgttcaacggcgaggtggactcgctgctcgtcctgaccggcgtgaccgacggcgcccagctcctggcggcgccgccgcggcaccggccgacgtatgtcgacgcggacctgcgcggactgctgaccgggcagccggaggtcgtcgaggccggcgacgggtttcgctgcggtggctggaccgcgacagccggaagtgaacggctggagctcgcgggcgagggagaggccatggacgggctgcgggcgctgtgcgcggcggcctggacggctgcgggcgagggctcgtgcgagctggacggggggaaggcgctggcgcggctggggctt

SEQ ID NO: 6468 - DNA, 1041 bp, Streptomyces avermitilis
  CDS (1)..(1041)
gtgttggtcgacagtccccccgaacagcgcgcggagaccgcccccgcgcccccaacccgccgggcgatacgtgccgttgggctccttgtgtccgttgtgatcctggtgctcgtcgccctggcgagcatcgcgatcggcgcgaaagagctgcccctggaccaggtctggcacggcctgttccacgactcggggacgtatgccgacgtcgtggtcggtgagcggcggtcgcgcaccgttctcggactgctcgtcggcgccgcgctcgggctctccggagccgtcctccaggcgctcacccgcaatccgctggccgacccgggactgctcgggatcaacgcgggtgcgtccgcggccgtcgtcaccgccatcacctatttcggcgtcacgacgctgagcggctatgtgtggttcgccttcttcggagccgccgcggtgggggccctggtgtggttcctcggtggcagccggggcgccacccccgtgcggctcgccctcgcgggcaccgcgatcagcgccgcgctctacggctacctccaggccgtgatgatcatggatgacgccgcgctcggcaagatgcgcttctggacggtcggttcgctggcctcggcgacggactcgatgatcatgcaggtcctgccgttcctggtgatcggcacggtcctcgcgctggccctcgcccggccgctgaacgccatggccatgggcgacgacaccgcccgtgcgctcggcgccaacctcaaccgcacccgtgccctgtccatggccgccgccaccgtcctgtgcggcgccgcgaccgccgcctgcgggccgatcgtcttcgtcgggctgatggtcccgcacgtcgtacggtccttcaccgggcccgacctgcgctggatcctgccgtacgcgaccgtcctgtcgcccgtcctgctgctcggcgccgacgtcgtcgggcggatcgtggcgcggcccgcggaactccaggtcggcatcgtcaccgcgatcatcggcggcccggtcttcatctatctcgtacgacggcggaggacggctcagctg

SEQ ID NO: 6469 - DNA, 1056 bp, Streptomyces avermitilis
  CDS (1)..(1056)
gtgaagaccacccgtaagccggcgctgcccacgcggaccgtgcgcacgcccggcggtctgtccctacggctcgacgtccgcgccgtcaccgtcgtcgtcctgctcctggtcgccgcgctcgccgcgagtgtcgtgctgatcggcaccggcgacttcccgattccggccgccgacgtcctgaggacgctggtcggcaacggcaacgccggccaggagttcatcgtcaacgagctgcggctgccgcgggttctcgtcgggctcctggtcggtgcctcgctcgggctcggcggcgcgctgttccagtccatctcccgcaatccgctgggcagcccggacgtcctcggcgtcggccagggctcgacggccggtgcgctcgtcatgatcgtgctgttctcgggcagcgccgcccaggtcgccctcggcgcgctcgtcggcggactcgcgaccggactggccatctatctgctcgcctggaagcggggtgtgcacggttatcgactggtcctggtcggtatcggcatctcggcgatggtcacggcggtcaacggctacctgatgaccaaggccgacatcgtcgacgcggcccgtgcggtggtgtggatgaccggatcgctcaacggccgtgggtgggagcaggtctggccgctggtctggctgtgcgccgtcctcgtaccgctcgtcctggcgaacgcgcgcggcctgcggatgaccgagatgggcgacgacgtgtcgtacgccctcggagtgcgcgtcgagcgcgtacggctgctgctgttgctgtccgccgtgctgctcaccgccggggccaccgccgccgccggcccggtcggcttcgtggcgctcaccgcgccgcagctggcccggcgactgacccgctcgccgggcccgaacctgattccctccatgtgcatgggcgcgaccctgctgatcgtcgcggactgggcctcgcagcgggccttcggcgccgaccagctgccggtcggcgtcgtgaccggagtgctcggcggggtctacctgctgtggctgctcgtcaccgagcgcaaggcgggccggata

SEQ ID NO: 6470 - DNA, 885 bp, Streptomyces avermitilis
  CDS (1)..(885)
atgagcggccgagcgaacaagaacacccgaaggagcactgtgaaccgcctgtccgccgacaacgtcaccctcgcctacgaccagcgcgtcatcgccgagcagctgtcggtggagattcccgacaactccttcacggtgatcgtcggccccaacgcgtgcggcaagtccacgttgctgcgtgccctttcgcggatgctcaagccggccgaggggcgcgtcctgctcgacggacaggtcatccagtcgatgcccgcgaagaaggtcgcgcggacgctcgggctgctcccgcagtcgtcgatcgcgcccgacggcatcaccgtcggcgacctcgtggggcgcggccgctatccgcaccagggacttctgcggcagtggtcgtccgaggacgagcgggtcgtgcgggagtccatggagtcgaccggggtcgccgagctggccgaccgctatgtcgacgagctctccggcggccagcgccagcgcgtgtggatcgccatggcgctcgcgcagcagacgccgctgctgctgctcgacgagccgacgacctacctcgacatccagcaccagatcgacgtgctcgacctgtgcgccgaactccacgaggagcagggccgcacgctcgtcgccgtactgcacgacctcaaccacgcggcccggtacgccacccatctgatcgccctgcgcgacggccgggccgtcgccgagggggcgccgaacgacatcgtcacggccgagctggtcgaggaggtcttcggcctgcgctgccaggtcatcgacgacccggagacgggcacaccgctggtggtgccggcggcccgcagggcgcgggtggcagccgcggcggccggaccggccgcggaggccgcaacggtggctacggggggctcc

SEQ ID NO: 6471 - DNA, 345 bp, Streptomyces avermitilis
  CDS (1)..(345)
atggcgacgatcgaggagtgccgtgcggcactcgacaagctctcggacaacatggcggcctccgaaggggaagtacgcggcgcggcggccctggaccgctcgctgagctgccgtatcaccgacctggacatcaccttcgccggccggctcaaggacggccggatcgaagtggtggacacgtatgagggtccgccccgcgagaaggcccagatacggctcacgatgaccggcgacgacctggtcgcgatggtcgacggcgagctgaacttcgcgaaggcctggggttccggccgggtgaagctggaagcgggcctgcgcgatctcctccggctcagaagtcttctg

SEQ ID NO: 6472 - DNA, 303 bp, Streptomyces avermitilis
  CDS (1)..(303)
atgagcgactcagtgtcagaggccgaggtcccgccacaggcgtcggccacagagcctgcgcgggaggcggcggcacccgaggacgacccggccgcgcccgcgcccctgtacgtggcccgcacctccaccggcaacgccgaggtcgacgcccagctcgaccggctggccgacgccgaccacctcgccacggacggacacgtcgaggtgtacgaggatgtacaccgggggctgcgtgacgcgctcaccgcgctcgacgcccgcccgggacctccggcgccccccacctcgtacgaccgcaggagc

SEQ ID NO: 6473 - DNA, 813 bp, Streptomyces avermitilis
  CDS (1)..(813)
gtggcaggagtggcacgccgacgcctcgacgccgagctggtccgtcggaagctggcgcgctcgcgcgagcatgccggccagctgatcgccgcgggccgggtcaccgtcggtaagaccctcgcgaccaaatccgccacccaggtggagaccgcggccgcgatcctggtcacccaggacgacagcgaccccgactacgtctcgcgcggcgggcacaagctcgccggcgcgctcgccgccttcgtaccgcaggggctgacggtcgagggacggcgggcgctggacgccggcgcgtccacgggcggcttcaccgacgtactgctgcgggcgggggtcgcgcacgtcgtcgccgtcgacgtcggttacggacaactcgcgtggtctctgcagagcgatgaacgcgtcaccgtcaaggaccgtacgaacgtacgcgagttgacgttggaggcgatcgatggggagcccgtggatcttgttgtcggggatctgtcctttatcccactgggcctggtgctgcccgccctcgtgcggtgcacggcccccggggccgatctggtgatgatggtcaagccgcagttcgaggtggggaaggagcggctgggcagtggtggtgtcgtgcgcagccccgagttgcgcgccgaggccgtgcgcggtgtggccgggcgcgcctgggaactgggcctcggggtgaagggcgtgacggccagcccgctgcccggaccctcgggcaatgtcgagtactttctgtggctgcgggccggagcagccgaactggacccggccgacgttgaccgtgcagtggcggaggggccgcgt

SEQ ID NO: 6474 - DNA, 903 bp, Streptomyces avermitilis
  CDS (1)..(903)
ttgactcagacccgagctcgtactgttttcctgctcgcccacaccgggcggcccgctgcgatccgcagcgccgaactcgtcgtacaggggctgctgagatcaggcctcggtgtacgcgtcctcgaggcggaggcggccgacctgccgctgccggacgaggtggagctggtcaaggaggcgactccgcagtgcctcgacggctgtgaactgctcatcgttctcggcggtgacggcacgctgctgcgcggcgccgagttcgcccgcgcctccggcgtgccgatgctcggcgtcaacctcggccgcgtcggtttcctcgcggaggccgagcgcgacgatctcgacaaggttgtcgaccgggtggtgacgaaggcgtacgaggtcgaggagcgcatgaccgtcgacgtcgtcgtgcacaagaacggcgacatcgtgcacaccgactgggcgctcaacgaggccgccgtgcagaaggtctccgccgagcggctcctcgaagtcgtgctggagatcgacgggcggccggtgaccgggttcggctgcgatggcatcgtctgcgcgaccccgaccgggtcgacggcgtacgccttctccgcgggcggacccgtggtgtggccggaggtcgaggcgctgctcatggtgccgatcagcgcgcacgccctgttcgccaagccgctggtgacctcgccgaactcggtcctcgcggtcgaggtccagccggacacgccgcacggggtgctgtggtgcgacgggcggcggacggtcgaactgccgcagggcgcgcgggtcgaggtgcgccggggcgccgtgccggtacggctggcgcggctgcaccatgcgtcgttcaccgaccggctggtggccaagttcgcgctgccggtggcggggtggcggggggcgccgcac

SEQ ID NO: 6475 - DNA, 1521 bp, Streptomyces avermitilis
  CDS (1)..(1521)
gtgcgaaggcgcaggtggcgggagcacgatccggagccgtgtcacccgcgggggtggcccgcggaaaggccgcggaggtggggttttccccagcccggtgctggcgcggcccccctgtcggccctggggcgctccccatggcgcaagatccactcgtcgcgccagcctggacccatgaccaccggcctggcccgagcggcccttcgtgcgcaccgacccgccttcgccgggacggcggtcgcggcgctgttcgcgtcgaccgtggtgagcgcggccacgtcggtactcctggcgacgagcgccgacgggctgcccgcacgggcccgcgcacagctcgccgagagcgaggtcggcggcatggcggccgtcctgctgatcggctcgatctacatgtcgattttcgtgatcgcctcgacgatgggcacggccgtggcgcagcagtaccgcgagctggccatggtccgcgcgatcggcgcgaggccccgccaggtgcgccgcgccgtcgccggacaggcactggccgcctcggtcccggccgcactgctcggatgcctcctgggcggcttcctggcccgggcgtggtgcgcgggcatgaaggagcacggtctgctgccccgggaggtcgtcttccaccccgcgtggctcgccctgccggtgtgcctgggggtggcggtggtgacctcgacgctcgcggccctgctgtcctccctgcgcttctcgctgctgcgcccggccagggccctggccgaggccgcggccggccgccggcacctgggcgtcctccgggctccgctcggcctcacggcgctcgcgggcgcgtgcgccctctccgtcctgctctcccaccagcccgcggagaaggccgggcagggcgcgttcctggtcctcatcctctgctgcgccggggtgggcctgctgggcccgcgcatcgtgggtcccgcggcccgcctggtctccgcgctcgtcggccgcctcggcccgagcgcccggctcgcgatgctcaacgtccggtcccagccgaggcgtttctcggccgcggtcgtgccgctcgtcctcgtcgtcggcttcggcctgacgaagatcgcgctgcacaccaccgccgagcaccgcacgggttcgccgggcagcccgggcgaggtctggctcgactacgcggggacggcgctgtacgcggggttcgccgcgatcgccgccgcgaacaccctctgcatgatctccttcgagcgccgccgtgacatcgccctcctgcgcgtcatcggcacgcagacccgccagatacgcgccatggcggcctgggaggcggtcgtggtcgccggtacggccctgctgctgggcgccgcgatcgccctcggcaccctcgcaccgatcctcgacacggccttcggctccccggtcccgtacgtcccgtggaccgtcctggccgggatcggcgcgggcacgctgctgctcaccctgtcggccaccggactgccggtacgtgcggtgatgcggcgccgagcgatcacggtcgtcggcgccgcg

SEQ ID NO: 6476 - DNA, 1734 bp, Streptomyces avermitilis
  CDS (1)..(1734)
gtgtccgtgttggaggagatgcggatacggtcgctcggagtcatcgacgacgcagtcgtcgagctgtcgcccggcttcaccgccgtgaccggtgagaccggtgcgggcaagacgatggtggtcaccagcctcgggctgctgctcggcggccgcgcggacccggccctcgtgcggatcggcgcgaagaacgcggtcgtggaggggcggatcaccgtacccacgggcgggtcggcggtcgtacgggccgaggaggcgggcgccgaactcgacgacggtgcgctgctcatcagccgtaccgtttccgccgaggggcgctcccgggcgcacctgggcgggcggtccgtgccggtgggcgtgctcgcggagctcgccgacgaactcgtcgccgtgcacgggcagaccgaccagcaggggctgctcaagctgtcccggcagcggcaggcgctcgaccggtacgcgggcgacgcggtcgccgcgccgctcgccaagtacgcgggggcgtaccggaggctgcgcgcgatctcggcggagctggaggagatcaccacgcgcgcgcgagagcgcgcccaggaagccgacatgctgcgcttcgggctcgacgagatcgcggccgtcgaaccgcgcgcgggcgaggacgtggagctggccgcggaggccgagcggctcggccacgcggaggcgctggcgtcggccgccacggccgcgcatgccgcgctcgcgggcaatccggaggaccccgagggcatcgacgcggcgacgctcgtcgcgggcgcgcaccgggcgctggacgccgtacggtcccatgacgcggcccttggcgcgctcgccgggcggatcggcgagatcgggatcctgctgggcgatgtggcgggggagctcgcgggctacgccgacgacctggacgccgatccgctgcggctggcggccgtcgaggagcgccgggccgccctcacccagctgacccgcaagtacggccaggacatcgacggcgtgctggactgggccgagcagagcgccgcgcggctcaccgaactcgacggcgacgacgagcggatcggggagctgaccgccgagcgggacgcgctgcggaccgaactgggcgggctcgcacaggcgttgacggacgcgcggacggaggccgccgaacggttcgccgccgccgtgaccgcggagctggcgtcgctcgccatgccgcacgcgcgcgtgtcgttcgacatccggcagaccgaggacccggagggcgcggaggtgggcgggcgcacggtcgcctacggcccggcgggtgtcgacgaggtcgaactgctgctggccccgcaccccggagcgccgccgcggcccatcgccaagggggcgtccggtggtgagctgtcgcgggtgatgctcgcggtggaggtcgtcttcgcgggcacggatcccgtgccgacgtatctgttcgacgaggtcgacgcgggggtcggcggcaaggccgcggtcgagatcggccggcgtctcgcccggctcgcgaagagcgcgcaggtcgtggtcgtcacacaccttccccaggtggcggccttcgccgaccggcagttgctggtcgagaagacgaacgacgggaccgtcacccgctccggcgtgaaggtcctggagggcgaggaccgcatccgcgaactctcccgcatgctcgcgggccaggaggactcccagacggcccgggcccacgcggaggaactgctggcgacggcccgggcggacgga

SEQ ID NO: 6477 - DNA, 897 bp, Streptomyces avermitilis
  CDS (1)..(897)
gtgacggccggggcggacggttaccgggctgcctgtcagctggggcggacgggggagcggtctgcccgacggctcgggcggcggacgggtggcgggccccgggagggcccgcggatttcggtccctagggtggttcatatgatcacacgaagaggcggctcgttcgggctcgccgcggcggccacgcgcgcgggaatcgccgccctgcgcgccaacgcgcccggcggacgggggcgttgggagcggcagaactacgccgggcggaccgtcgagttgtacgccgggcccgccgccgtcgccggtgccgcgctcggggccgggcgggtccggccggccgcggggttcgtggtccttgccgccggggcgtgcggtgcgtacgacgacgtcgcgggggccggggatccgcggcgcgggttccgggagcatctcgccgcgctgcggaagggcgaagtcaccagcggtgcggtgaagttgttcgggatctccgccgccgggctcgtcgcgggggcgctcctcgaggagcggctcccggacaaggcgctggcgggagtcgtcatcgccgggaccgcgcacttcgtcaacctcgtggacgtacgccccgggcgggccgccggggccgtactggccctgggagcccccgggttgctacggcagggagccgcgggtgagctggccgcggccgccatgggcgcagctgccgccgtcctgcccgacgacctcggcgagcgcgcgatgatcggcgacagcggggcgcacgccctcggtgccgcgctgggcgccgcgatcgtcgcgggcaacggacgggccggactcctcgcccacgccgccgcgttggtggccgcgacggtgtacggggagagggtgagcgagctggcacgctcgatcggcgcgcggaag

SEQ ID NO: 6478 - DNA, 1170 bp, Streptomyces avermitilis
  CDS (1)..(1170)
gtgaccgtccgacgccgaaccaggagccccggccacgtgagcctcgtgagcagccactcaccgcacggccagtcgccgctgcgcaccgtgcaggtgctcggcggcggcagcgcgggcagcagcgcgcatgtgcgatcgctggcctcgggcctggtcgcccgcggtgtgcgggtcaccgtgtgcgctcccgccgaggccgatcgcacctatgacttcgcaggcgtcggtgccgaacacgtccccgtgccccgcagcggcgaccccgcctccgtcgccgcgctccgggccgcctgcgcggacgccgacctggtgcacgcgcacggactgcacgcctccttgcgcgccgccctcgcgctcagcgggcgccgcactccgctcgtcgtcacctggcacacccgcgcggaggccgagggcacccgggcccatctgctgcggctgctcgaacggcgggtcgccaaggccgccgcggtcgtgctcggcacctcctccgacctggtcgaccgggcccgcagccggggcgcccgggacgcacggctcgccgcggtcgccctcccggtgctccgcaagcccgtcgaccgggacgaccccgaccggctgcgccccaaggcccgtgccgaactcggcgccacgggacggccgttgctcatgtccgtcggctccctggaccggcagcgcggatacgaggtcctgctcgacgcggcgcgcgcatggcgtcggctcgaaccggtgccgctgctggtgatcgcgggggaggggccgctgcgtacggtcctgcaacggcggatcgaggacgaggagctgccggtgcggctcgtcgggcggcgcgacgacgtgggcgagctgctcgcggccgccgatctcgccctcctgaccagcagttgggagtcccgctccgtcctggcccaggaggccctccacgcgcgcgtgccactcgtcgcgacggcggtcggcggcatccccgaactggtcggcgacgccgccgaactcgtgccgtacggcgatgccgaagcgctcgccgtggccgtcgtacgcctgctggacgatcccggccgccgcgagctgctcggcgagaagggcgtacggcaggcggccggctggcccacggaggacgagacggtcacccaagtgctcagtgtgtacgacgagttgacccagccgacaccgctcccc

SEQ ID NO: 6479 - DNA, 1647 bp, Streptomyces avermitilis
  CDS (1)..(1647)
atggacagccgttccgacagccgtttcgacagccagaacacccagggcgccgggatcaccgtgcagcgggccctggagctgcccgggctgcgcagcggcctgccggaggtgctcgcgggggccgaccggctgcaccgcacggtgcgctgggtgcacgcgggcgaggtgccgaacatcgcctcgctcctcaagggcggcgagctgctcctgaccaccggctacggcctgggcacccgccccgccgaccagcgcgcgttcgtccgcaccctggccgagcgcggtatcgcggccctcgtggtcgaactgggcccccgcttcacccggctgcccgcggccctcgtggagacggccaggaccgccgggctcccgctggtccagctgcaccgggaggtgcccttcgtgacggtcacggaggaggtgcacaccgagatcgtcaacggccactacgcgctgctccagcgtgccgaggaggtccaccgccgctgcacggaggccctgcttggcggcggcggagtgccccaggtgcttcgcatcctggcggacttcagcggcaaccccgtcttcctggagaccgcggacggccggctcctgtacgccgccggggccggacccgcggacacggatccgctccaggtgtgggaggggctgcgcgggcagcacaaggacgcgccgccggccgggacgacgatcgtggacgtgcccggcggcggacctggcgccggctcggtccgggcccggctggtcctgctgccggtcggcaacccggtggcgccggtgcaccggatcgcggccgagcgggccgcgggcagccttgccgtggtcctgatgcaggcccgccaggaggaggagctggcggcacgcggacgcggcgacttcctcaccgacctcgcggagggccgtatcgacgccgcggacgcccccgcgcaggcccgggtcctcggcttcaagccgggcgccggtccgctcctgccggtggtcatgcggctcgccgacgggctctccccgggcggcggctgggcggtgctggcgcgcgcggtcgcggaggagctcgcgtcgatcggggtaccggtgctgctcggcgtacgtcccgtcgagggccgtgtcccgctgctgctcgggctgcgctcggagtccgagcggtcggccgtggcggaccgcgtcgcggcggccctgcgggcgggtgtcgagcgggccggtatgcagcggccgggggcgcagccgccggtcgtggtggtcggggtcgcgggcggctgggcggccgcgtcggcggggctgcggcacgccgcgcagacggcgacggcggcccaggggctgtccgaccgcccctggtacgacgcccggcgtctcgacatcgacctgctgctgtggcggctgcgcgacgatccggacctggcggcgttcgtggaccgcgcgatcgggcccctgcgcgaccacgacaaccgttccaaaccgccgctgctgccgaccctgcagacgtatctggcgcacgcgggccgcaaggcggagacggcccgcgaactccacctcaaccggcagacgctctacaaccgcctcgcccggatcggcgagttgctgggcacggacctggacgacccgcagacggtcctggcgttgagcctggcgctgcgggcccgcagacacgtcccc

SEQ ID NO: 6480 - DNA, 1824 bp, Streptomyces avermitilis
  CDS (1)..(1824)
gtggccgttcgactggagttgcacgtggccgggcgcatcgaagactacgcactcattggagacatgcagatcgccgcactggtctgccaggacggcacagtggactggctgtgcctgccccgattcgactcccatgccgtcttcgcgggactcctcggcacggaggagcacggtttctggcgcctcggtccggcccacgcctccgacgccgagccgcccagagcgtcccggcgcacctaccgcggcgactcgctgatcctggagtccgagtgggacaccccgcgcggcacggtccgggtgaccgatttcatgccgccgcgtgacggcgccccgcagctgatccggatcgtcgagggcgtcaccggccgggtgccgatgcgctcggccctgcggatgcgtttctcgtacgggcgtgtggtgccctgggtgcacaggcacgaggggcgcacggtggccgtcgccggccccgactcggtgtggttcgacaccgcctgcgagacctacggcaagggtctgaccacgtacgcggacttcacggtggccccgggcgaccggatcgcgttcgccatctcgtgggagccctcgcacaagcagccgcccgcgctgccggagccggagcaggcgctggaggcgaccgaggagttctggcgggagtgggtcgagcactgtacgtaccacggcccctaccgtgaggcagtggtccgctcgctgatcacgctgaaggccctgacgtacgcgcccacgggcggcatcgtcgccgccccgacgacctccctgccggagcacgtcggcggcgtacgcaactgggactaccgctacacctggctgcgcgacgcggccatcaccctctcctcgctgctgcgcaccggctaccgcgaggaggcccgcgcctggcgcgagtggctgctgcgcgcggtcgccggcgatccggagaacctccagatcatgtacggcatcgcgggcgaacgggagctgggcgaggccgagttggactggctgccgggatacgaaagctcggcgccggtgcgcgtcggcaacggcgcggcgcaccagctccagctcgatgtgtacggcgaggtcatcgaagccctgcacctggcccacatgacgggcctggcgcgcaacgactacgcctcgctcctccagctgaagctgatccgctacctggagaagcactgggacgagccggacgagggcatctgggaggtgcgcggtccgcgccgccacttcgtgcactccaaggtgatggcctgggtcgcggtcgaccgcacgatcaagctgatcgagtccggtgacgcggacggcccgctggagaagtggcgcgagctgcgcgacgacatccaccgggacgtgtgcgagcggggctacgacaaggagcgcaacacgttcacgcagtcgtacggctccaaggagctggacgcctcgctgctgctcatcccgcagatgggcttcctgccgcccgacgacaagcgcgtgatcggcacgatcgaggcgatccagcgggagctgtcgacgccggacggcttcatcctgcgctacccgacctcgggcgaggaagagggcgtggacgggctgccgggcgacgagggcgccttcctggcctgctcgttctggatggcggacgacctggcgatgatcggccgcgtggacgaggcccgcaagctcttcgagaagctgctggccctgcgcaacgatctggggctgctcgccgaggagtgggacccgaccctccagcgccaggtgggcaacttcccgcaggcgttcagccacgtgccgctgatcgacacggctctccggctgacggcttcgggcgcgtacggcggc

SEQ ID NO: 6481 - DNA, 1647 bp, Streptomyces avermitilis
  CDS (1)..(1647)
atgccgcccaaatccacgacgaccaagcacatcttcgtcaccgggggtgtcgcctcctcgctcggcaagggcctcaccgcctccagcctgggcatgctgctcaaagcgcgggggctgcgggtcgtgatgcagaagctcgacccctacctgaacgtcgacccgggcacgatgaacccgttccagcacggtgaggtgttcgtcaccaacgacggcgccgagaccgacctggacatcggccactacgagcgcttcctcgaccgtgacctggacggttcggccaacgtgaccaccgggcaggtgtactcgacggtcatcgccaaggagcggcgcggcgagtacctgggcgacaccgtgcaggtcatcccgcacatcaccaacgagatcaagcaccgcatccgccgcatggcgacggacgaggtggatgtcgtcatcaccgaggtcggcggcacggtcggcgacatcgagtcgctgccgttcctggagaccgtccgccaggtccgtcacgaggtcggccgggacaacgtcttcgtggtccacatctcgctcctcccgtacatcggcccctcgggtgagctgaagacgaagccgacccagcactcggtcgccgccctcaggaacatcggtattcagccagacgcgatcgttctgcgctgcgaccgcgaggtccccaccgcgatcaagcgcaagatctcgctgatgtgcgacgtcgacgaggccgccgtggtcgcctgccccgacgcccgctcgatctacgacattccgaagaccgtgcacggcgagggcctggacgcctatgtcgtccgcaagctggacctcccgttccgcgacgtggactggaccacctgggacgacctgctcgaccgcgtccacaagccggaccacgagatcaacctcgcgctggtcggcaagtacatcgacctgcccgacgcctacctctcggtcaccgaggcgctgcgcgcgggcggcttcgccaatcgcgcccgcgtgaagatcaagtgggtcacctcggacgactgcaagaccccggccggcgccgcggggcagctcggtgacgtcgacgcgatctgcatcccgggcggcttcggcgaccgcggtgtgtccggcaaggtgggcgcgatccagtacgcccgcgagcaccggattccgctgctcggcctctgcctgggcctgcagtgcatcgtgatcgaggcggcccggaacctggccgacatccccgacgcgaactcgacggagttcgactccgccaccggccaccccgtcatctccaccatggccgagcagctcgacatcgtggcgggcgagggcgacatgggcgggacgatgcgcctgggcatgtacccggccaagctcgccgagggctccatcgtgcgcgaggtgtacgacggcaaggagtacgtcgaggagcgccaccgccaccgctacgaggtgaacaacgcctaccgcgcggagctggagaagaaggccggtctgcagttctccggcacgtccccggacggcaagctcgtcgagtacgtcgagtacccgcgcgaggtgcacccctacctggtggcgacgcaggcgcacccggagctgcgctcgcgcccgacccgcccgcatccgctcttcgcgggcctggtgaaggccgctgtggagcgcaagacgggcaag

SEQ ID NO: 6482 - DNA, 693 bp, Streptomyces avermitilis
  CDS (1)..(693)
ttgccggggtgcgtgtctttcgggacgcgtgccccggctttcgtacgtgcgtgggaggaacagggcgacatgaccatcaaggacacccccgaggagtgggaggtcagggcgaccgagacccccttcaagggcaacaagacctccgtccgcaccgatgacgtggtcatgcccgacggctcggtcgcccgccgggactaccaggtccaccccggctcggtggccgtggtcgccgtcgacgacgagggccgcgtgctggtcatccgccagtaccgccacccggtgcgccacaagctctgggagatcccggcgggcctgctcgacatccccggcgagaacccgctgcacgcggcccagcgcgagctctacgaggaggcgcacgtcaaggccgaggactggcgcgttctcgtcgacctctacacgacgcccggcggctgcgacgaggccgtgcgcatcttcctcgcccgcgatctgtccgaggccgaggggcggcgcttcgaggtcgaggacgaggaggccgacatggagctgtcgcgcgtcccggtcgacgagctgctgcgcggtgtgctcgccggcgacctgcacaacaactgcctcgtgacgggcgtcctgtcactgatcgcggcccagaacggcgagggactcgacgcgctgcgcccggccgacgcgccgtggcccgcgcgccccttcgaggcc

SEQ ID NO: 6483 - DNA, 2079 bp, Streptomyces avermitilis
  CDS (1)..(2079)
gtgacggatcaggcggtggacacaggcggctctcagctgccgggaaacgagcagcggcccgctgccgcccccgctcccacggtcagtcagttcctcggccgcacaagagagttgaaggaactccgcgccgacatcgagcgcgcgggtctcgacaccctctccggccgcaaggccccccgcgcgcgggtgctgctcatcgcgggccggcccggctccggccgcaccgcgctcgccgaggagctcgtacgacaggttgcggaccgttaccgggacggggtgctgcgcgcccggctcaccgagcccgacggcacgcccgtcccgaccgagcgcacggcgcgcgagctgctggcggccctggaggtggccacgccccccggcgccgccgaggacgacctcaccgaggcgctgcgcgaggccctcgccgaccgccggacgctgctcctgctcgacgacgtggccgccgccgagcaggtcgacgccttgctgcccggcacccccgactgcctggtcgtggccgtctccgagggccccctgaccggcatcgcggacgtccggccgtgcaccctgggcggcctcgacacgaagtccgcgctggagctgctgggccgcctcaccggggcggtgcgcatcaccgtcgacccgcgagccgccgaagggctcgtcgaggagtgcgccggccagcccctcgccctggtcctcgcggggagctggctggccgcccgcccccaggccgccgtcgccgacctcgccaagcagctgcgctccgagggcgacgagggcccgccgacggcacgcctcttccggctcgcctacgccgggctgccggccaccgcccagcggatactgcgcctgctctccctcgcccccgcgggcctcgtcgacccgcacaccgcctccgcgctcgccggctgctcggtgagcgcggcccacacgaccctcgacgacttcgccgcgctcggcctcgtgcggctgctggaatcccccctgccacagtacgaggtgcccggctccctgctgccgctgctgcgcgccctcgccgagtcacgggagcgtcccgccgagcttcagctggcccgcgcccggatgctcgagcggaccgtgcggctgctgcagtcctgccgggccatcaccgagacggacagcatcgaggcgcgcgagaagctcctcgggatgccccgcacgctgcgcttcccgaacccccgggcggccgccgactggctgcgcgtgcggcagcccgcgctgttggccgccgctcgcagcgcggtcgccgacggggagctggacaccctggcccggcggctcatgtcccagctggtgcgcgcgatggtcgcccacttcggcacgcaggcgtcggcgccggagctgtacggcatccaccgcctggtcctcgacgtcgccgagcgccggaacctgccccgtgagcaggccgcggccctgctgaacctcgccgacctggacacgcggaccggccgcacgaccgaggccctcgcccgctaccgggccgcgctggacgccggccgcgaggcgaacgatccgtatgcgaccggccgcgcgatggaatccgtaggcggcgcccaccaggaactcggggactacgaccgggccgccgactggtacggccgggcgctggcccagcggctggcgcgcgacgagcgcgtggacgcggcgcggctgtacggccgtatcgccaccgcgcacacctatgcgggccgctacggcgaggcgctgcgcaactggcgctcggcggtcgccgggcaccgcaagaacggcgatgtggcggcccaggcgcgggcgttgagcgagctggcccgggtccaggagtacgcgggccgccccgaggagtcgctgcgcacctgccaggaggccgtggagtgggcgcgccgggccgacgacgtacgtctgcaggccgcgctccagctccggctggccgacaccctggagcacctcggcgaccccgcggcggccaagctgcaccgcggcgcggccgagcggatgctgggagaagagctcctggagagcgactcaggtgcggaacaagcccctaacgcctgcgaaatccgcagtgcatccagcaaagat

SEQ ID NO: 6484 - DNA, 1113 bp, Streptomyces avermitilis
  CDS (1)..(1113)
gtgaaggtcggcatcccccgcgaggtcaagaacaacgagttccgggtggccatcacccccgcaggcgtgcacgagctggtgcgctacggccaccaggtcttcatcgagcagaacgccggcgtcggctcctcgatcacggacgacgagtacgtctccgccggcgcgcagatccttccgaccgccgacgaggtctgggccatcgccgacctgctgctcaaggtcaaggagcccatcgccgaggagtaccaccgcctccgcaaggaccagacgctcttcacctacctgcacctggccgcctcccaggagtgcacggacgccctcctggagtccggcaccacggcgatcgcgtacgagaccgtcgagctgcccagccgcgccctgccgctgctggccccgatgtccgaggtcgcgggccggctcgccccgcaggtcggcgcctaccacctgatgcgcgccaacggcggccgtggtgtcctgccgggcggtgtcccgggtgtgctccccgccaaggcggtcgtcatcggcggcggcgtctccggctggaacgccgcgcagatcgccatcggcatgggcttccaggtgaccctgctcgaccgtgacatcaacaagctcaaggaggcggacaagatcttcggtacgaagatccagaccgtcgtctccaacgccttcgagctggagaaggcctgcctcgaggccgacctcgtcatcggcgcggtgctgatcccgggtgcgaaggccccgaagctggtcaccaacgagctggtctcgcggatgaagcccggaagtgtccttgtcgacatcgcgatcgaccagggcggctgcttcgaggactcccgtccgaccacgcacgccgagccgaccttccgggtccacaactcggtcttctactgcgtcgccaacatgcccggcgccgtccccaacacctcgacgtacgcgctgaccaacgccacgctgccgtacatcctggaactggcgaaccgcggctgggccgaggcgctgcgccgtgaccccgcgctcgccaagggcctcaacacccatgacggcaaggtcgtttaccgcgaggtcgcggagtcgctcggcctggagtacgtcgagatcgagtccctgctcggc

SEQ ID NO: 6485 - DNA, 1038 bp, Streptomyces avermitilis
  CDS (1)..(1038)
atgactcagacagcacacccgagcatggatggccatcacgtgaacgccatggccggcaacggaagtggcgagaaccgcacccacttcgccgactacgacgaactgcccgaggggcacttctacgaccccgacgccgagtacgagcccgaccccgagtacgcggccacgctcgcgcccgacgctgcccgccagcgccgtgagcgcgtcggcccgaccggccgcccgctgccgtacttcccgatcccgggcccgctgaccgaccacggtcccgcgaagatcatcgcgatgtgcaaccagaagggcggcgtcggcaagacgacgtcgaccatcaacctgggtgccgccctcgcggagtacggccgccgggtcctgctcgtcgacttcgacccgcagggcgcgctgtccgtgggtctcggcgtcaacccgatggagctcgacctcaccgtctacaacctgctcatggagcggggtatggcggccgacgaggtgctcctgaagacagcggtcccgaacatggacctgctgcccagcaacatcgacctgtccgccgccgaagtgcagctcgtctccgaggtcgcgcgcgagtccacgctccagcgtgcgctcaagcccctgatggccgactacgactacatcgtgatcgactgtcagccctcgctcggtctgctcaccgtcaacgccctgacggccgctcacaaggtgatagtgccgctcgagtgcgagttcttcgcgctgcgcggtgtcgcgctgctcaccgagaccatcgagaaggtccaggagcggctcaaccccgagctggagctcgacggcatcctcgccacgatgtacgactcccggaccgtgcacagccgtgaggtcctcgcgcgcgtggtcgaggcgttcgacgatcacgtctaccacacggtgatcggccggaccgtgcgcttcccggagaccacggtcgccggtgagccgatcacgacgtacgcctccaactccgtcggcgccgccgcctatcgccagcttgccagggaggtgctcgcccggtgtcacgccgag

SEQ ID NO: 6486 - DNA, 582 bp, Streptomyces avermitilis
  CDS (1)..(582)
gtgtcacgccgagtgagtctgccgggggccgacgaactgttccgtaccaccgggggaatggggctccaggcgtccacccccaggcgccaggccaacggcgaggcccgagtgccggctccggcgggcgagagcgacgccgccgccgccgcggagaacacgccggtctcggtgcccgtgcagggcggcgacggcgagggtgacgaacacgtcgcggcggacaccgccgaggcggaggcgggggagtcccgtacgcggtccggcggcgcggagcgctccgggcggcgtcagccgccgcaggaaggttctgcctcgccctcgtcgcagccgcaggcccagccgcgcaagcgcgggcggtccggcggacggcggcccagcggacgggagcggcacgacgagaagatcacggtgtacgtgtccgccgaggaactgatggatctcgagcacgcacgtctggtgctccggggtgagcacgggctcgcggtcgaccgcgggcggatcgtccgcgaggcggtcgccgtggtgctcgcggatctggagtcccgcggggacgcgagcattctggtacgccggctgcgtgggcgg

SEQ ID NO: 6487 - DNA, 789 bp, Streptomyces avermitilis
  CDS (1)..(789)
gtgcggctcgcgaacttcgagggccccttcgatctgctgctccagctgatctcgaagcacaagctcgacgtcaccgaggtcgcgctctccaaggtgaccgacgagttcatggcgcacatccgggccatgggaccggactgggacctcgatcagacgaccgagttcctggtcgtcgccgccacgctgctcgacctcaaggccgcccgcctcctgcccacggccgaggtcgaggacgaggccgacctcgcgctgctcgaagcgcgggacctgctgttcgcgcgactgctccagtaccgcgcgtacaaacagatcgccgacatcttcaaccgcagggtggaggaggaggcccgccggtatccacgtaccgtcggactcgaaccgcaccacgccgagctcctgcccgaggtcgtcatcagcatcggggcggaaggcttcgccaagctcgccgtgaaggcgatgcagccgaagcccaggccgcaggtgtacgtcgaccacatccacgccccgctggtcagcgtgcaggagcaggccgggatcgtggtggcccggttgcgggagctgggcgaggccagtttccgcacactcgtcgaggacacggacgacacgctcaccgtcgtcgcccggttcctcgcgctgctggagctgtaccgcgagaaggccgtcgccctcgaccaggagaccgcgctcggcgacctgatggtgcgctggaccggcggcgaggacggcgagcagccgaaagtcaccgacgagttcgaccgaccgccccaggaagccaaggaggaccaggcg

SEQ ID NO: 6488 - DNA, 648 bp, Streptomyces avermitilis
  CDS (1)..(648)
gtgagcgaggagatcaccgaagtcgcggcggacctcgacagcgtcgcggggctcgatctgaagcccgcgctggaggccgtcctcatggtcgtggacgagcccgccaccgtggagcacctcgcgaagatcctggagcggcccaagcggcagatcgcggatgcgctgcgcgagctggccgacgaatacaccgggcaggggcgcggcttcgagctgcggctgatcgcgggtgggtggcggttctacaccaggccaaagtacgcgacggccgtggagcgcttcgtgctggacggccagcaggcccggctcacccaggcggcgctggagacgctcgccgtggtcgcgtaccgtcaaccggtcagccgttcgagggtctccgccgtgcgtggagtgaactgtgacggggtgatgcgcaccctcctgcaacgcggtctggtcgaggaggcgggcgcggaacccgaaacaggtgcgatcctgtacaggacgacgaactacttcctggagcgaatgggcctgcgtggcctggacgagctcccggagctcgcgcccttcctccccgaggcggacgcgatcgaggccgagacgcaggaaggtgtgccgtcgttcgatccggacgcaccggagacagacgacccgacgacgacggaactt

SEQ ID NO: 6489 - DNA, 1068 bp, Streptomyces avermitilis
  CDS (1)..(1068)
atgcgaagcagtggcagcggcaagagcggcggacgcggtaactaccgtggcgccggcaacgacagggaccagaagcaggggcaggggcagggtcgccccagcaagccccgccccgaggagcgccgctacgacgtgggccccggcgccacccaggacggcccgaaggccgggcgcggcaacgcggcgcgtggcggtgccaagggcggccccaagcagagccggcagcgcggcggccgtacggagcccgcgcgctcccgtgagtacgagacgcgggccgaggagcgcaaccgggaccggtacgcgggcaagccggaggtcaagacgcccaagaccttcccgggcgccgagcaggagggtgagcgcctgcagaaggtgctcgcgcgcgcgggctacggttcgcggcgttcctgtgaggagctgatcgagcaggcccgggtcgaggtcaacggcgagatcgtcctggagcaggggctgcgcgtcgacccggagaaggacgagatcaaggtcgacgggctgaccgtggccacgcagtcgtaccagttcttctcgctgaacaagcccgccggtgtcgtctcgaccatggaggacacggagggccggcagtgcctcggtgactatgtgacgaaccgcgagacgcggctcttccacgtggggcggctcgacaccgagaccgagggcgtcatcctgctcaccaaccacggcgagctggcgcaccggctgacccaccccaagtacggcgtgaagaaggtctacctcgcgcacatcgtgggcccgatcccgcgcgacctgggcaagcggctcaaggacggcatccagctggaggacgggtacgcgaaggcggaccacttccgggtcgtcgagcagaccggcaagaactacctcgtggaggtcaccctgcacgaggggcgcaagcacatcgtgcgccgcatgctcgccgaggccggcttccccgtcgacaagctggtgcgcgtcgccttcgggccgatcaccctgggcgaccagaagtcgggctggctgcgccgtctgtccaacaccgaggtcggcatgctgatgggcgaggtcgacctg

SEQ ID NO: 6490 - DNA, 759 bp, Streptomyces avermitilis
  CDS (1)..(759)
atgtgcgcatcggagaacactccacgcgcacccggcggccgtgcccccgagggctacgacaagcacgcgttcgagcccttcgctgtcaccgtcgacctggccgtcctcacgatccgcgcgggcgtgctccaggtgctgctcgtggaacggggacaggagccgtacgcgggccgctgggcgctgcccggcgggttcgtgctgccgcacgagtccgcggaggccgcggcccggcgcgagctggccgaggagacgggcctggcggatctgaccgggctccatctggagcagctgcggacctacagcgaaccggaccgggacccgaggatgcgggtcgtctccgtcgcgtacaccgcgctgctcccggaccctcccgagccgcacggcggaggggacgcggcgcaggcccagtggctgcgctacaacgccctcggcccgctcgccttcgaccacgaccggatcctcgccgacgcccacgaacgcgtcggcgccaagctcgagtacacgtgtctcgccacgtccttctgtccgcccgagttcacgctcggcgagttgcagcaggtctacgagaccgtgtggggcaccgcgctcgaccggcccaacttccggcgcaaggtccttgccacgccgggcttcgtcgaacagatcccgggcgccgcccgcctgaccggcggccgcggaaagcccgccgcgctctatcgcgcaggcggtgcgaccaccctgcacccgcccctgctgcgacccacttcggaaggacggccc

SEQ ID NO: 6491 - DNA, 1020 bp, Streptomyces avermitilis
  CDS (1)..(1020)
atgaccaccacgaccctcacgaaacgcgccgccaccggttccctgctggggctcgccctcggagacgcgctcggcttcccgaccgagttcaacgacgtgccgtcgatcctcgccaagtgcggcccgtggcgggagatggagctgccgagcccggcgatcgtcacggacgacacacagatgacgctggcgctggggcggggactgcggtcggcgatggaccgcgggctgctcgagccgcagcggatggaacggccggtgcgcgaggagttcgtggcctggtacgagtcgcccgagaacaaccgcgccccgggccgcacctgcctggtcgcctgcaacctgctgaagaccgaggggcgtccctggcagctggccagccagatcggttccaaggggtgcggggccaacatgcgcgtggcgcccgtcggtctcgtccgcggcctgagcgacgaacagcgggccggtgccgcgcagttgcaggccgcgctcacccacggccatcccacggcgctcgccgcgtcggacctgaccgcccacgcggtccgcctgctcgtccagggagtcgagccgaccggactggtggggctgctgcgctcgtacgcgtacgagaaccgcacccgctaccaccggcgctggctcggcgacctgtggaccttcagccaggaccccacgccggagcacttcatcgcgcgtggctgggacgagtgcctggagatactcggccgactccagcaggccgtgtgcaccgtgtcgcccgaggtcgacccctgcctggccaccggggagggctggatcgcggaggaggccctggccaccggtctgctgtgcttcctcctcttccccgaggagccgctgaccgccctgcgccgggccgcctgcacctccggcgactcggactccatcgcctgcctcacgggcgcgttcgccggcgcccacctcggcgtcgacgcctggccgaccgaatgggccgaccgcatcgagtaccggggtgatctgcagacgctcggagcgctctgggacgct

SEQ ID NO: 6492 - DNA, 747 bp, Streptomyces avermitilis
  CDS (1)..(747)
atgcttgacgccctcgacatcgacctggcgcccgtggtggcggcgcagcccgacccggtgctgttcgccaccgtctccggagcgcacctgtacggtttcccctcgcgcgactcggacatcgatctgcgcggcgcccatctgctgccggcggccgagctggtcgggctgcgggagccgacggagacccggtcgcgcatgtgggaccgggacggcgtcgagatggacctggtgacgcacgatctgcgcaagttcgtccggttgatgctgcggcgcaacggctatgtgctggagcagctgctgtcgccgctcgtcgtgcacaccagcgacgcgcatcgggagctggccgagctggctcccggggtgctgacccgtcaccacgcccaccactaccggggcttcgcgacgacgcagtggcggctgttcaagaagaccggtgaactcaagccgctgctctacaccttccgcgtgctgctcaccggcatccacctcatgcgcagcggtgaggtgcaggcccacctgcccacgctcgtcgggcaggtcgacgctcccggctggctgccggagctcatcgcggccaaggcggaacgggagcacggcgccgccgatgtcgaccaggcgcgcgtacggctcgatgtggagcggttgcacgggctgctggacgaggcggagggcgcctcacggctgcccgacgccccgaccgcgtacgacgccctgcacgacctcgtcgtccgggtgcgcctggagggc

SEQ ID NO: 6493 - DNA, 759 bp, Streptomyces avermitilis
  CDS (1)..(759)
atgcccgagacagacccggacctgggcgcgcgcctggtccgccaccacacgatctactcctgcgtgatgggctcgcgcgccttcggtctggcgacggacggcagcgacacggaccgccgaggcgtgttcctcgcccccactcccctgttctggagcttcgccaagccgccctcgcacgtcgagggcccggcggaggaacagttcagctgggagctggagcgcttctgcgagctggcgctgcgggcgaacccgaacatcctggagtgcctgcactcaccgctggtggagcaggccgacgcgacgggccgtgaactcctcgccctgcgcgaggcgttcctctcccgccagacgcacgagacgttcgcgcgctacgccctgagccagcgcaagaagctggaggccgacgtgcgtgcccacggcgccccgcgctggaagcacgccatgcacctgctgcgcctcctgacgagctgccgggacctgctgcgcacgggctcgctgacgatcgacgtgggcgaccggcgcgagcccctcctcgcggtgaagcggggcgaggtcccgtggcccgaggtcgagtcccggatgacccgcctggcggcggagacggacgaggcggcccggcacaccccgctgcccgcggaaccggaccgacgccgcgtcgaggacttcctgatccgcacccgccacgcctcagccctccaggcgcacccggacgacgaggtcgtgcagggcgtcgtacgcggtcggggcgtcgggcagccg

SEQ ID NO: 6494 - DNA, 462 bp, Streptomyces avermitilis
  CDS (1)..(462)
atgacgatccgcccgacacggcgcacccttctcgggacgggcggcgcggtcgcgcttctcgccgggtgcagcaagtacggcgacagcaacaacagctccagccagtcgacgtccggtaccccgtccggcagcccgtccggcacggcgtccgccacggcgtccggcggcgcggccgccgggccggaactggccaagacctccgacatcccggtcggcggcggcacgatcttcaaggacgagaaggtcgtggtgacccagcccgagcagggcgagttcaaggccttctcggcggtctgcacgcaccagggctgcacggtgagcaccgtctcggacggcaccatcaactgtccctgtcacggcagcaagttccgcatcaccgacgcctccgtggcggccggccccgcgccgcgtccgctgcctgccgagaagatcacggtggagggaaattcgatccgcctgacg

SEQ ID NO: 6495 - DNA, 582 bp, Streptomyces avermitilis
  CDS (1)..(582)
atgcccgtggatccgaacgccgccactcagagcttccctccgtcccagcccgcccaccgcggcccgggcgccgcccgcttcctcgtccccgcactggtcgcggccgtggtcgcggtgggcctcggagcgtacggaaaggtgcacgacccggccgggaccgccttcaacctggcgggcttcagcagtacgggcgcggtgaagtcgtggctggcgaccacggcgttcttcttcgcactcgtgcagctcgtctccgcactcatgatgtacggcaagctgccgggcccgagctgggcgccggtgctgcaccgctggtcggggcgggtggcgttcctggtggcggtgccggtcgcggtgcactgcctgtacgcgctgggctatcagacgtacgaaccgcgcgtgctgtggcactcgctcctgggttgcttcttctttggtgcatttagtgccaaaatgctcttgcttcgtgcggagcgactgcctggctggctgctgccgatcgtcggcggactcgtcttcgcggtgctcacaggcatctggctgacctccgccctctggttcttccgtacgttcggagtgacgaca

SEQ ID NO: 6496 - DNA, 693 bp, Streptomyces avermitilis
  CDS (1)..(693)
atggcaggaaactcgcctcgggggaggcccgtaatgaagcgctccggaccccttttcacccttctcgcgggactgctgctcgccgtgttcatgctgtcgttgaacgcgatgacggggacgaagagcacgtcgtcctaccaggaggagccgcccgccgccacggtctcaccgagcccgcggcccgagcggtcgactccgccacccagcccgtcgccgtccaccagccccctgccgaacgccgactacgcgggccgtaccgacgacaactcctcggcggtcgccgtgtccctgcgcgacggcaaggcgatcgcgtacttctgcgacggccggaacaaggagtcgtggctcaagggtgacgtcaaggacgacggcacgatgaagctcaccggcaagcagggcgccgagctgaacggcaagctcaaggagggcaagcggatccgcggcaccgtcgacctgggcggcacccgctacggcttcaccgccgacaaggcgctcaagccgtccgggctgtaccgcgcgacggccagcgtgcgcggcgccaagatcgacggcggctggatcgtgctgccgggcggcaagcaggtcggcatcctcaaccgggacggcaagccgcaggccgccccccggatcgacccggaaaccggtgcggtgacggtcgacggccagcagctcacggcccgccccgtcaccccc

SEQ ID NO: 6497 - DNA, 360 bp, Streptomyces avermitilis
  CDS (1)..(360)
gtggcggtacgagcggtccggggcgccgtccaactggagcgggacgcggccgatcacatggacgagcaggtcagcgagctgctcaccgccattttggagcggaacgggctgaccgcggacgacctgatcagcatctggttcaccgcgacgcccgatctgcacagcgacttcccggcggccgccgcccgcaagctcggcatcgtcgacgtgccgctgatctgcgcgcaggagctggacatcaagggcgcgatgccgcgtgtcgtgcgggtcctcgcgcacatcgagtccgacaagccgcgggccgagatcgcccacgtctacctgggtgccgcgggcgcactccgcaaggacatcgcccag

SEQ ID NO: 6498 - DNA, 1092 bp, Streptomyces avermitilis
  CDS (1)..(1092)
gtgaggaccgcactcgtcatcgggaccgggctgatcggtacgtcggcggccctggcgctggccgggcgcggcgtcgtcgtgcacctcgccgaccacgacccggaacaggcgcgtacggcggcggcgctcggcgccggcacggacgaggcgcccgaaaagcccgtcgacctcgtcatcgtggcggccccgcccgcgcacgtggcggccaccctcgccgacgccatgcggcgtggcctggggcgcggctacctcgacgtggccagtgtcaagggcggtccgcgccgcgagctggaggcgctcggcctcgaccggtccgtcatgtcgacgtacatcggttcgcaccccatgtcgggccgcgagaagtcgggccccctcgccgcgaccggcgacctcttcgaggggcgcccctgggtcctgacgccgacccgggacacggacaccgaggtgctgaacctggccctggagctggtgtcgcactgccgtgccgtgccggtcgtcatggacgccgacgcccacgaccgggccgtggcgctcgtctcgcacatgccgcacctggtgtccagcatggtcgccgcccggctggagaacgccgaggagacggccgtacgcctgtgcggccagggcatccgggacgtgacccgcatcgccgcgtccgacccccggatgtggatcgacatcctgtccgcgaacccgggcccggtcgccgacctgctcaccgacgtgtccgccgacctcgacgagacggtgcgggccctgcgctccctccagtcctccgacgaggcgaagcggcgtgcgggcgccaccggcatcgaggacgtcctgcgccggggcaacgcggggcaggtccgggtgcccggcaagcacggcagcgcgccgcggacctacgagaccgtggccgtcctcatcgacgaccagccgggccagctggcccgtatcttcgcggacgcggggctggccggggtcaacatcgaggacgtacgcatcgagcacgcgaccgggcagcaggcgggtctggtccagctgatggtggagccgaaggaggcgccggtactgagcgcggcgctgcgggaacgaggctgggcgttgcggcag

SEQ ID NO: 6499 - DNA, 693 bp, Streptomyces avermitilis
  CDS (1)..(693)
gtggaaaacggcgccgcccggaccgtaccggcagtgattgtcgccatcgacggcccctccggcacgggcaagtcgagcacctcgaaggccgtggccgcgaagctcgggctgagctacctggacaccggtgcccagtaccgggcgatcacgtggtggatggtgagcaacggcatagacatcacggacccgaccgcgatcgccgccgtggccgggaagccggagatcatctccggcaccgacccgtccgcgccgaccatcaccgtcgacgggaccgacgtcgccgccccgatccgcacgcaggaggtcacctccaaggtgagcgcggtcagcgcggtgcccgaggtacgcacccggatcaccgagctgcagcgctcgctcgccacgtccgccgagaacggcatagtggtggagggccgtgacatcggcaccaccgtgctgcccgacgccgacctgaagatcttcctcaccgcctccccggaggcgcgtgccgcccgccgcagcggtgagctgaagggcgccgacgtcaacagcacgcgcgaggccctgctcaagcgggacgcggccgactccagccgcaagacctccccgctcgcgaaggcggacgacgcggtcgaggtggacacctccgacctcacgctccagcaggtcatcgagtgcgtcgtcaccctcgtcgaggagaagcgggccgcgaag

SEQ ID NO: 6500 - DNA, 714 bp, Streptomyces avermitilis
  CDS (1)..(714)
gtgcgtcgtcaccctcgtcgaggagaagcgggccgcgaagtgaccgaggcaccatcggtacgcggcgccgaggtcgggcggcgcatcggcgtcggcctgatgtacgggctgttcaagccgcgcgtcctcggggcctggaaggtccccgcgaccggcccggtgatcctcgccgtgaaccactcgcacaacatcgacggcccgatggtcatgggcgtggcaccccggccgacccacttcctgatcaagaaggaagcgttcgtcggcccgctcgaccccttcctgctcggcatcggccagctgaaggtggaccgcgagaccaccgaccgctcggcggtcacccgcgctgtcggcgtcctcgacaacggcggcgtcctcggcatcttcccggagggcacccggggcgagggcgacttcgcctcgctgcgcgccgggctcgcctacttcgcggtccgtggcggcgccccgatcgtcccggtcgccgtcctgggaagcaccgagcggcgcggacggttgatcaaggcgctgcccccgctgcgcagccgggtggacgtcgtcttcggcgaccccttcgaggcgggcgacggcagcgggcgacgtacgcgcaaggcgctcgacgaggcgaccgtgcgcatccagaagcagctgagcgcacacctggaaaacgccaggcgtctgaccggacgccgggaaaacgccgggcgccccaccgggcac

SEQ ID NO: 6501 - DNA, 1473 bp, Streptomyces avermitilis
  CDS (1)..(1473)
atgaacgaccacatccagcccgagggctcggccgagcacgagcacggggcgcttggcgatgccgagtacgcggagttcatggagctcgccgcggaagagggcttcgacatcgaggacgtcgagggcgcgatcgacgaggccggtcacggcccgctcccggtcctcgccgtcgtcggccgcccgaacgtcggcaagtcgaccctggtgaaccgcatcatcggccgccgtgaggccgtcgtcgaggacaagccgggcgtcacccgcgaccgcgtcacctacgaggccgagtgggcgggccgccgcttcaagctcgtcgacaccggcggctgggagcaggacgtcctcggcatcgacgcctccgtggccgcgcaggccgagtacgcgatcgaggcggccgacgcggtcgtcttcgtcgtcgacgccaaggtcggcgccaccgacaccgacgaggcggtcgtacggctgctgcgcaaggccggcaagcccgtggtcctgtgcgccaacaaggtcgacggccagagcggcgaggccgacgcctcgtacctctgggccctcggcctcggtgagccgcaccccgtctccgcgctgcacggccgcggcaccggcgacatgctggacgccgtgctggaggcgctgcccgaggccccggcgcagagcttcggcgccgcgatcggcggcccccgccgcatcgccctcatcggccgcccgaacgtcgggaagtcgtcgctgctgaacaaggtggcgggcgaggaccgcgtggtcgtcaacgagatcgcgggcaccacccgtgacccggtcgacgagctgatcgagctcggcggcgtcacctggaagttcgtcgacacggcgggcatccgtaagcgcgtccacctccagcagggcgccgactactacgcctcgctgcgcaccgcggccgccgtcgagaaggccgaggtcgccgtcatcctcatcgacgcgtccgagtccatctccgtccaggaccagcgcatcgtcacgatggccgtcgacgcgggccgcgcgatcgtcctggcgttcaacaagtgggacaccctcgacgaggagcgccgctactacctggagcgggagatcgagaccgagctcctccaggtggcgtgggcgccgcgggtgaatgtctcggcgcgtaccggacgtcacatggagaagctcgtcccggcgatcgagacggccctggacggctgggagacccgggtcccgaccggccgcctgaacgccttcctgggcgagctggtcgccgcccacccgcacccggtccgcggcggcaagcagccccgcatcctcttcggtacgcaggcgggcaccaagcccccgcgcttcgtgctcttcgcctccggcttcatcgagcacggctaccggcgcttcatcgagcgccggctccgcgaggagttcggcttcgagggcacgccgatccacatctcggtacgggtgcgcgagaagcgcggcaacaagaagaag

SEQ ID NO: 6502 - DNA, 387 bp, Streptomyces avermitilis
  CDS (1)..(387)
gtgcacgcatacgatcccccccgccgcccgtcgttccagccggttccggccgcgcgaccggcccaggacctggcgaacggttcctcggccaccccgatctacgacgcgctctacgccgagtacgtcagatcgttccgatcgctgcccggagaccgcagcggcgaggaggatctgggcttcaccgccttcgccaacactccgaggggcactggctcgtacaccacgggctcgtacggcgcggtcgggtacggcgcgcgccacggcaccccccagcacgcgaccgggcatctcgccacgaccgccatctggcagccgggcacgcgccagcacgccacggggatgcatcacgtcccggcggcgctgccgcccgccccgcgcaggggcatg

SEQ ID NO: 6503 - DNA, 825 bp, Streptomyces avermitilis
  CDS (1)..(825)
gtgagccgggagccacccggcatcgccacgcaccgcatcccgagggagccacccgtgccgcgcatgctcgacgtcagcgacgacgtacgcgccgagatcggcgacgaagaagccgaccggctgctcgccggagagaacgccccgggcagttacgactgcacgtcctgccgtaccccgggcgactccgagcaggagcacaccagcaccgtcctgttcatcggcgacgagaccgccgtcctcgccttcgcccacgccacctgcctgccctcgcaggtcgtccaggtcaccgaggagcagctccagggcgcagtccgctccatcgccgccgaggaagggcccggcactccggtgcccgagcaggccgtgctcggtgtcaccagcggactggtcctgatcagcggcgagttgcacccggcgctcgtcgtcgagccgaccggacccatcgtgcgcccgggctcgaccgccgccggcgacgacttcctgccgctgctcatcgagcagggcttcatgccgctgacccggatcgagtcggtgccgtccgtgctgcacggctggtccgtgctgctcgccatgggccagctgcacgccgtgctccagccgggcaccggcggcggctcaccggtcgcctggtggcaggcgcaccaggcgctccaggtcgccgagaactggcgcgcagccgccaacaagcaccagcaggtgatcatgttcgcggccccggtcggctcgatcggccgccagccccgcgaggacctgctgcgcgacgcgctcgacaaggcggcggcaggcggcaagctggtggcggcggcgctgccgctcgccggcacc

SEQ ID NO: 6504 - DNA, 672 bp, Streptomyces avermitilis
  CDS (1)..(672)
atgtccgaatgtgccgatagcactcgtaaggttcgtacgactcgtacgacggcggtcctcgccggggcagcgctcctcgccccgctcggactgctcgccgcgaccggcgaagccgccgcggccgacagcggagtgtgggaccgcatcgcacagtgcgagagcggcggaaactggcacatcaacaccggcaacggctactacgggggactgcagttctccgccggcacctggcgcgcgtacggcggcacggcctacgcggcgaccgccgaccaggcgtccaggggccagcagatcgccgtcgccaccaaggtccagcgtgcgcagggctggggtgcctggcccacctgctcggcacgcgccggagcaggcggaagcgcgcccgccgcatcgggcaccggggcgagcggcgggtcgtcctccgccggttcggccaccaccgagtcggccgcatcggccaagcaggccccgtcgaagcagtcgaaggcgccgacgcgcgcgccggaacacaccaaccgcaactcctcccgcggcgactacaccgtccgcgacggtgacacgctcagcggcatcgcgtcccggcacgggaccacctggcagaagctgtacgccgccaacaagacggtgctcggcggtgaccccgacctgatcatgcccggacagcggctcgcgctc

SEQ ID NO: 6505 - DNA, 588 bp, Streptomyces avermitilis
  CDS (1)..(588)
atgcgccccgtgtcccgccgccgcgaccgtgaccgcctttctgtgcgggtgcgtgcccgcgtcggcttcccgtacctggtggtggccgcgctggccgtcgtactcgcccccgcgggggcggtcgccgcgccaccgcccccgcttcccggcccccaggcggcaccggtgtcgtacgagtgcgccaaggacgagtggccctgggactgcctcgccgactgcgagagcagcgggcgctgggacgcgaacaccgggaacgacttctacggggggctgcagttccggcagcccacgtgggaggagttcggcggactgacgtacgccccgcgcgctgacctggccacgcgcaagcagcagatcgcggtcgcggagcgggtgctggccacccaggggtggcaggcgtggcccgcctgcgccaagaggtacgggctcgagggccgcgcgcacgtggtgaaggccggcgagacgctcgcctcgatcgcccgcgcgtacgacgtcaagggcggctggacggcgctctaccaggccaacaaggaagtggtcggggcacggccggaccggctgaagaccgggacggtgctgctgatcccg

SEQ ID NO: 6506 - DNA, 648 bp, Streptomyces avermitilis
  CDS (1)..(648)
atgagcatcgccctgcgccacgcgcgcgtgcgctacggccccctggaggccttgcacggcgtgtccctggtcgcgccgggcccgggcctcaccgtgctgctcggccgcaacggctcgggccgtacgaccgtactgcgcgccctcgccggcggcgtcccgctgtccggcggcgcggtggtctgggacggcgccgacgtgacccgcctgcccgcgtacgagcgggcccggcgcgggctgtgcctcgtcccggagcggcgggccgtgttcgcctccctcacggtccgggagaacctggagctgacggccggggacctcgcgcccgccctcgacgcctacccgcagctcgagccgctgctcccgcaccgcgccggcaccctctccggcggcgagcagcgcatgctcgccctctcccgggcgctggcggcacccgcgcgcgtggtgctcgtcgacgaaccggcacagggcatgtcaccggaggtcgcggcccgtacctaccggctgctgagcggcctcgacgcctgtgtgatcgtcgccgagcagcgcctgccgcacggtctggccggaccggcgggccgtaccgtcctcgtccacgaactgcggcgcggcgccgtcgccttcagcggagaggcggccgaactcgcccggccg

SEQ ID NO: 6507 - DNA, 807 bp, Streptomyces avermitilis
  CDS (1)..(807)
gtgtcccgcccggcagccggccagggccccggtgcgtcccatggcccgcggtcacgctcccggaacgcgcctcgcgccgcggctccccgcccctcccccgtcgccccgcacaccctgcgggcccgccggctgcacgccgcctacggtgactgcaccgccctcgacggcgtcgacctcgagctgccgcccggccgtgtcaccgccgtcgtgggccccaacggcgccggaaagagcaccctgttccactgcctcgccgggaccctgcgccccgcgcgcgggcaggtgctgttcggcgaccgcgacgtcacccggctggccgcgcacgcccggacccggctcggtatcgcgcggacctttcagcagttggccgtcttcccctcgttgaccgtggccgagaacgtgcggatcggcgccgagcagggacgcctccccgatccggcggccgtggcacggtccctgcggctgctcggactcgacgggcccgtacgtgcgctgcccaccgccgggctgccgaccggaaccctcagacgggtcgaactggcgcgggccctggccggcagcccgcgcgtcctgctgctcgacgaacccgccgcaggtctcgacaccgccgaggtgaccgcgctggcccgcgtgctgcgggccctcgccgcggacggcaccgccctgctcgtcgtcgaacacgatctcgacctggtcgccgacctcgccgacatcgtgcatgtgatgaccgccggccggatcgtcgcctcagggcccgccgaccgtgtcctggacggcggagccgaaggcgggggcggaggcggagca

SEQ ID NO: 6508 - DNA, 480 bp, Streptomyces avermitilis
  CDS (1)..(480)
atgcggacacggcgactgcggaccgcgcacctcgtcctctgggccggctgggccgcgctcgccgccggcgcggtgttctgcgtcctcggctggtacggcgtctccggcgagcggtacgcggagcggcagttgccgtatctggcgtcctgcacggtgcccggcgccgcgctgatcatcgcgggagcggtgctgctcacgcacggcgggcccgcgtcggcggcggcgcgtgtggaggagctgtacgggctgctggtcgcggccgagcccgccggcgtggcggagccggggcaggcggcggccgcccccgtcgccaccagcggggagctgctgagggtgccgggcggcacgctgtggcaccgggccgactgcccgctggtcgccggcaagtccgaggcggtaccggcggattcacggctgtgggcgagcggggaactcggcccgtgcccgatctgtgagccgccgccccccggtccggtcggc

SEQ ID NO: 6509 - DNA, 567 bp, Streptomyces avermitilis
  CDS (1)..(567)
atggttctcgggagcgacctcaggcgggcagacacacagcgggggcgcggccccggacgggcgacggcctgggcggccgtcgccgttctgctactcggcccggctctcgccgcgtgcagcgacgaaagcggcggcgagaacaccactccgccgaccccctcggtcgagaagccgaccggcgcgcagccgagtccgacggccccggcggaccccgccgcggccaagaaggagatcaagaagaactgggagaagttcttcgacccggccgtccccaccaaggacaagcaggccgtcctggagaacggcgacaggatgaccgcggtcctgcggagcttcaacggcgacaaacgcggcgggcaggtcgcggcacacgtcgagaaggtcgcgttcacctcgccgaccgaggcggacgtgacgtactcgctgaccctgaaaggccagaccgtcctgcccggtgccgccgggaccgcggtggagcagcacggcacctggaaggtgtccgtgaacaccctctgcgcgctcgtccagttgagcggcgatgcgtcggcgagcccggctcagggctgc

SEQ ID NO: 6510 - DNA, 1287 bp, Streptomyces avermitilis
  CDS (1)..(1287)
atgcgtcggcgagcccggctcagggctgctgagacggccgccgcggtcctgctgctcctggtgggcgcgggctgcggcagccgcctgccggagagcgacttcgcacaccggtccgcgccgcccgcgtcgcggcgcaccgagccggtccgtgtcggcatcctcaccagcgccaccagcccggtcggcggctccgccttcaccggcccgcgcgacggcgcacgcgcctacttcgaccgcctcaacgcgcgcgggggcatcgacgggcggaaggtcgacgtgcggacctgcgacgacggcggcagcggcgtcggcaacaacgagtgcgtgcacaggctgatcgacgaggacaaggtcgtcgcgctcgtcgccaccaccgccctcacctacgcgggcgcctcccgggtgtccgccgcgggcgtgcccgacatcggcggccagcccatcggggccgcgtacgacacctatccgcacctgtacgggatctacggcagcctcgcgccccgcaccggcacacccggctggggcgggaaggtgtacggcggcaccgaggtctaccgctacttcaagcgggagcacggcgcccgtacggccgccgtcgtctcgtacaaccagtccgcgtcggccgcgtacgcctcactcgtcgcgcggggcctgaaagccgagggctacaaggtggtcaccgagcaggtcgacttcgcgctgcccaacttccgtgccgcggcggccgacctgaaggaccagggcgccgatctggtcttcgacgccatcgacacgcacggcaacgcccagctgtgcagggcgatggacgaggtcggcgccgacgtcatcgccaaggtcaccaacgtgcagaactggacgtcgtcggtccccgaggactacaaggactccccgcgatgccgcaacgtcctgtgggcgaccgggtcgagccgcaacgccgacgacacggccgacccggccgtacaggagttccgcgccgcgaccagggggctgaagacgcactcccagtggcagttggaggggtgggcggccgcgatgtggttcacggacgccgccaggtcctgcgcgacggacctcacgcgcgcgtgcgtcgaccgcttcatgagccgcggcacgccgtatacggccgacgggctgctgatccccgtcggctacgagcggctggccgagccgcccaggacccgcaggacctgcctctcggtcgcacgctggaaggacgccgaggggtgggtcgcccagggggacatgaacgccacctgcttcgtcgtaccgcaactcccttaccagccc

SEQ ID NO: 6511 - DNA, 1260 bp, Streptomyces avermitilis
  CDS (1)..(1260)
atgcatatctctttcttaatacacaatgcgtacggaatcggagggacgattcggaccacgtacaacctggcgaacaccctggccgagcagcacgacgtggagatcgtctcggtcttccgccaccgcgagcagcccgtcttcgcgcccgacccgcgcgtgcgggtgcggcacctcgtcgacctgcgcgagggcgcccctgacgcgggccaccccgacctgggccgtccggccagggtcttcccgcgcgcggagggccgctaccagcagtacagcgccctcagcgaccggcgcatcgccggccacctcgcctccgtcgaggccgatgtcgtggtcggcacccgccccggcctgaacgtgcacctcgcccgcgagacccggcgcggcccgctgcgcgtcggccaggagcacctgacgctcgacagccactccagggccctgcgtgccaccctgcgcggcgcctacccccgcctcgacgcgctgaccacgaccaccgaggccgacgcccacgcctaccgcggcacgatgcggctgcccggcgtccaggtgcacgcggtgcccaacccggtgcccgcgccgggcatcgagcccgcggacggcaccggcaagtgggtcgtcgcggccgggcggctcgcgccggtcaagcgctacgacctcctcatcaaggccttcgcgcgggtgcgcgcccagcggcccgactggcgtctgaggatctacggcggcggcaagcagaaggacacgctgcgcgccctcatcgacgagctcggcctctacaaccacgtgtatctgatgggccccgccaaccccatcgagcccgagtgggccaagggctccatcgccgccgtgacctccagcctggagtccttcggcatgacgatcgtcgaggccatgcgctgtggcctcccggtggtctccaccgactgcccgcacgggccgggcgagatcatcgacaacggcgtcgacggccggctcgtcgaggtcggcaacgtcgaggccatcgccgagggactgctcgaactgatcaacgacgacgcgctgagacagcggatgtccgtcgccgccctcaaggactccgagcgcttcgacccgtcccggatcgccgaacgctacgaaagcctgttcaccggcctggccccgcgcggcggcgccacgctcggcgggaaggtgcgcggctccctgcaccgcacccgcggagcgctgctcggtggggcgtacgcggttcgcgatgtcggacgtaccgcactcaagaaagggcgcgccgcg

SEQ ID NO: 6512 - DNA, 834 bp, Streptomyces avermitilis
  CDS (1)..(834)
gtgatgacgctggctgagcggaccaccggccggcaccccgacgaggagaccgccccgcccccgcgcgccgactgcatcgccgactccgcgggcggactgaccttcgacatcggcgggagcgacgaagcgggcctcgcccacctggtgctgcgccgccgcgaggacgacgcggaggtccggctcccgctgaccccgagcgccgagggccggctgcgcgccgccctgcccagcagcgtcgaactgcccgagggccgctgggacgcgtacgcccagaccgcggacggcgagccacagcggctggtgcccggcgtcagcgacctgcgctccctcgtggaccgtgggccgggcgcggcgggccacgtcgccgtccgcatcccgtacgccaccaagcacggcaacctcaccgtccgcagctggctgcgcgccccgcacgccgaggcgggcgaactgcgcatcggcgacggcgggctacaggtgagcggccgggtgcacggggccgcgctcgcgccgggcgcgcacgccgagctgtgccgccgcggcgagcccgcgtcggtcctgaccgccgaagtcgccccgcggcagggtgagttccggttcacggtggactacggcgccatggcggaaggtgtctgggacctgtggcttcgcccggcgggggaggacggaccgcgggtgcggatcgcccggctcctcgacgacatcgcggacaagaagccgatcttcacctacccgaagctcacgctggagacgaagcacgggccggtgcaggccgggccgtactacacggcggacaacgagctgtccgtgacggtcacttcagcaccgccaccccag

SEQ ID NO: 6513 - DNA, 1032 bp, Streptomyces avermitilis
  CDS (1)..(1032)
ttggagacatcggcacgactgctgcgcctgctctcactgctccaggcccaccgtgaatggtccggtgccggcctggccgaacgcctcggtgtcaccccgcgcaccgtccgccgggacgtggaccggctgcgcgagctgggctaccccgtcaacgccagccccggtaccggcggcggctatcagctcggcgcgggggcggagctgccgccgctgctcctggacgacgacgaggcgatcgccgtcgcggtcgggctgcgcacggccgcggggcagggcatcgagggcatcggcgagagctccgtacgcgccctcgcgaagctcgaacaggtgctgccgaaccggctgcgccgccgcgtgagcgccctcaacgccttcaccgtgccgatgctgcgcggcccccagccctccgccgtcgaccccgccgtcctcaccgaactcgcccacctctgccgggacgcggaacgcctgcgcttcaggtatcgcggcaacgacggcgcctccacccgccgcaccgtcgaaccgcaccggctggtgtgctccgagcgccgctggtacctggtcgcctgggacgtcgaccgtgacgactggcgtacgttccgcgtcgaccgcatcacgcccaggccgccgcacggcccgcgcttcgcgccccgcacgccaccggccgacgacctggccgcctacgtctccagaggggtctccacgcgcgcgtacgccgcgcaagccgtcgtccggctgctcgtgccgatcgaggaagcggccgcacgcgtctcgccgtccgccgggacgctggaggccgagacccccggaagctgcgtcctgcgcaccggggccgcgagcctcgacgtgatggtgatccacgtgatgatgatgggcttcgagttcgaggtgctggagcccgccgaactcaccgaggcggtcaggacggctcgcgatcggcttgctcgtgcttcggctcgggctgcggagcctccccggcgtgcgccggatggtgcaggtcgaacgccggggactccgagcggacccggggcagcg

SEQ ID NO: 6514 - DNA, 1689 bp, Streptomyces avermitilis
  CDS (1)..(1689)
atggggacggacaccgcgcaggcgacggcgcgacccgtacggacacagcagccggggcggctgatcgtcgactggctgaccaccaccgaccacaagaagatcggccacctctatctgatcacgtcgttcgcgttcttcctgatcggcggcgtcatggcgctggtgatgcgggcggaactcgcgcggcccggcatgcagatcgtggacaacaaccagttcaaccagctgttcaccctgcacggcacgatcatgctgctgctgttcgcgactccgaccttcgcgggcttcgccaacgagatcatgccgctccagatcggctccccggacgtggccttcccgcgcctgaacatgctgtcgtactggctgttcctcttcggcggcctgatcgtcctcggctcgctcgcggtgccgtcggggcccgccgccttcggctggttcgcgtacgcgccgctcaacagcctggagcgctcgccggggatcggcgccgacatgtggatcatgggcctcgcgctggccggcttcggcacgatcctcggctcggtgaacttcctgacgaccatcatcgggatgcgcgcgcccggcatgacgatgttccggatgccgatcttcacctggaacaccctgttcacgtcgattctcgtgctgatggcgttcccggtgctcgcggcggccctgctggtcctggaggcggaccggcggttcggctcgcaggtgttcgacgcggccaacggcggggcgctgctgtggcagcacctgttctggttcttcgggcatcccgaggtctacatcatcgcgctgccgttcttcgggatcatcacggagatcatcccggtcttcagccggaagccgatcttcggctatctgacgctgatcggcgccacggcggcgatcaccggtctgtcggtggtcgtgtgggcgcaccacatgttcgcgaccggcgcggtgctgctgccgttcttctcgttcatgtcgttcctgatcgcggtgccgacgggcgtgaagttcttcaactggaccggcacgatgctcaaggggtcgctgtccttcgagacaccgatgctgtgggcgaccggattcctggtgtcgttcctgttcggcggcctcaccggcgtcatcctggcctcgccgcccctcgacttccacgtcaccgactcgtacttcgtggtcgcccacttccactacgtggtcttcggcaccgtcgtcttcgcgaccttcggcggcttctacttctggtggcccaagttcaccggcaagatgctcgacgaacggctcggcaagatccatttctggacgctgttcgtcggcttccacaccacgttcctggtgcagcactggctcggcgccgagggcatgccacgccggtacgcggactatctggccgccgacggtttcaccgcgctcaacaccctctcgacgatcggcgcgttcctgctgggcatgtcgacgctgccgttcctctacaacgtctggaagaccgccaggtacggccggaaggtcgaggtcgacgacccgtggggcttcggccgctccctggagtggacgacctcgtgcccgccgccgcggcacaacttcgtcacgctgccccgggtccgctcggagtccccggcgttcgacctgcaccatccggcgcacgccggggaggctccgcagcccgagccgaagcacgagcaagccgatcgcgagccgtcc

SEQ ID NO: 6515 - DNA, 213 bp, Streptomyces avermitilis
  CDS (1)..(213)
atggcaccgactcccgctccgcccgcagaacccgaggactccccccaggcatacgtcggcctgccggcccggcgtgccgagcaactggccggtgaacgcggctggagttcggtgcgctcgctgccgccgggcgcgatcatcaccatggagtaccgggtgggacggctgaacttcgaggtcgccgacggcacggtcgtccgctgctggaagggc

SEQ ID NO: 6516 - DNA, 1014 bp, Streptomyces avermitilis
  CDS (1)..(1014)
gtgcgtaccgaactaaagctgactcgtctggaccgggtcttcgcccggctggaccgtgagccggaacgaccggcccatatcgacgtgcccaggatgagccggcaccgggtggtcctcttctcggcgacccttgccttctacctggccatcgtgtgggccgtggtcgtcacctcgtggctggtccggctcgactggcaggtcatgttcttccggccgtaccagcagtggcccgagatccacgcgttcctcgactactacgtggtgctgggccagcgcggccccaccgccgtgatggtcgcgtcctggctgggctggcgctcctggcggcagcacaccctgcgcccgctgctgaccctgggcgccgcgctgctgctgctcaacatcacggtcggtgccgccaagtacggcatgggccgcctcggaccgcactacgcggtcacgatcgggtcgaacgagatgtggggcggcggcgatatatttccctccggccacaccgcgaacgcggtggtgacctggggcatcctggcctatctggcctcgaccccgagggccaggcgctggctgtcggcgctgtccgcggtgacctcgctcggcgtcggtctcaccaccgtctacctcggcacgcactggctgagcgatgtcgtgctcggctgggccgcggggctgctgatcctgctggcgctgccctggttcgagccgctgatcgccctcgccgaagccgggatcttcaggctgcgcgactccttgcggtcccgccccggacgcacggcgcccgctccggccccggtcggcgcgcccgtgccgatcgcccgctcggccccggacgaggagactcccgtccgcgagccggccggcccagcccggacctcccgtccgcccctctacctggcccccgggccgcacaccgcccgctcggagcgcaccccggtgacaccggtcggcagccgtcgtccgccgcactcggaccgagtcgcgcgcaccaccaccacttcggcccgcccggtggcgggcggc

SEQ ID NO: 6517 - DNA, 1164 bp, Streptomyces avermitilis
  CDS (1)..(1164)
gtgaccgatcttgaaacgcgcccggcgccgccccacgcgggcgctctgcgccgggccgcgcccgccctcctcgggttcgcggccgtacgcgccctgggcctcgtcgcgctcgcactgtggagcgcggcgcgcggctcgagcgcgcacaccctgctcaccgcccgctgggacgcgctctggtacacccgggtcgccggcctcggatacggctacgaggtgcgcctgcccaacggggacgtgcactcgaacctcgcgttcttccccctgctgccctggctggagcggctgggggcagcggtgacgccgctgtcgtacgcggatgcgggtctggtcgtcgccacgctcgcctcgctcgccgcggcctgggggatcttcgccgtcacggagcacgtccacgggcgccgggcgggcgtgtgcgccgtactcgtgtgggccgtgctgccggtcgggatcgtgcagtcgatggcgtacagcgagtccctgttcacggcgctcgccgcctggtcgctgtacgcggtcctgaccggccgctgggtgacggcgggcgccctcgcctcgctggcggggctgacccgtccggtgggcgcggcggtggtcgctgccgtgtgggtggcggcgatcgcctcgttcgtgcacgaccgacgcgcgccggcggcggacggcgcgtcggcgtggcggcgcgccctcggcatgctcctcgcgccgctcggcgccgccggctacgtcctgtgggtcggccaccgcaccgggaagggcccgctgggctatctcgacgtccaggcgggctggcgcaacggcttcgacggcggctacgccttcgcgcgcttcgtcggcgacaagttcacgtcgttcccctcggccctggccggcgtcgggctgatcgtcggggtggcgctggtcgtctggctgtacgtggtgtgcgtacggcaggggcagccgctgccgctcctggtgtacgcgggtgtggtgaccgcgctcgccctgtgcgcgtcgagttacttcggctcgaaaccgcgcctcctgctgcccgcgttccccctgctgctgcccctcgcgcgggccctggcccggctgcgtacccccaggtcggcggcggttctcggcggtgtcgcggtggcgtcggccgtgtacggggcgttctggctgaacggctcgggtccgcca

SEQ ID NO: 6518 - DNA, 1605 bp, Streptomyces avermitilis
  CDS (1)..(1605)
atgtccggcacgaccacggccgctgcgcgatgccgtcgggagaccgggcccggtgccaaccgctgggtcgtactcgtcgtcctctgcgtcagtctgctgctcgtcgcgctcgacgccaccgtgctgcacgtcgcggtgcccgccgtcaccgaggacctcaagcccggcgcgatagagctgctctggatcgtcgacatctatccgctcgtctgcgcctcactgctcatcctcttcggcacgctgggcgaccgcgtcggccgcagacggatccttcttctcggatacggcctcttcggcgtcgcctcggggatcgccgcccttgccgacagcgcacaggtcctgatcggcgcccgcgccctgctcggcgtcggcggcgcgatgatcatgcccgcgacgctgtccatcctgcggcaggtcttccccgaccggcgcgagcgggcgctcgcgatcggcatctggagcgccgtggccgccgtcggcgcggcggtggggccgctgctgggcgggttcctcctcgagcacttctggtggggttcggtcttcctgatcaacatcccgctgatgctgatcagcctgccggtgggacggctgctgctcccggagtcgaagggggaccgcgacggcccctgggacgtcgtcggagcgctgatggccgccgccggcctcttcggcgccgtcctcggcgtgaagcggctcgggggcggggagccgccgctcagcccgttcaccgtggtgccgttggtggtgggcgcggcgctgctggtcgctttcgtacggcggcagcggcggcgggcccacccgctcgtcgatctccggatgttcgcgcggcccgcgttcagtacgtcggtgggatgcatcgtcctggcgatgctcgcgctggtcggcctcgagctgatcgccgcgcagtacttgcagctggtcctcggtctgtcgccgctggagacgggactgcggctgctgccgctcacgatcgcggcgatggcggcgggactcgtcgggtcgaacatgctgcaccggttcgggccgcggcgcatggtcgtcttcggcttctgtctcaccgcgggctcggtcgtcacgctcaccgcgatgggcgcggaggacaacaccgggctgctgctcttcgggttcctcctgctggggttcggcctggagaccacgctcttcggggcgtacgagtcgatgctgagcgaggcgccgcaggaacaggcgggcggggcggccgcgataggggaaacgtcgtaccagctgggggccggtatcggcatcgccctgctgggcagcgtgatgaacgctgcgtacgcgcccggactgtcgtcggtgccgggggttccggcgtcggcttcgggggcggcggggcattcgctgggggaggcgtacgaggtcgccgcgcgcctcggcggggcgcccggcgctgccctgcggcacgccgcgcgggactccttcgtgcacgggctccatgtgacgctgctggtcagcgcggggttgttgatgctgggggcggtgatggcgctgcgtctgccgcgggtgatggagtgcgaggagcccgcgacgggcttcgcggaggtgccggcgccgcgggaggccgcggagtcgcgcgtctcggct

SEQ ID NO: 6519 - DNA, 1173 bp, Streptomyces avermitilis
  CDS (1)..(1173)
atgaccgcgttcgatcccgccgacttccttggcatcgacgacctcctggacgccgaggacctcgcgatccgcgacaccgtgcggacctgggcggcgcagcgcgtgctgccgtacgtcgccgagtggtacgagaacggcgagctgcccggaatccgggatctggcgcgggagttgggggccatcggcgccctcgggatgtcgctcaccggctacggctgcgccggcgcctccgccgtgcagtacggactcgcctgcctggaactcgaagccgccgactccggcattcgctccctcgtctccgtccagggctcgctggccatgtacgccctgcaccgcttcgggtccgaggagcagaagcaggagtggctgccccggatggcctccggcgacgtcatcggatgcttcggactcaccgagcccgaccacggctccgacccggcgtcgatgcgcacgtacgccaagcgcgagagcggcggtgactgggtcctcaacgggcgcaagatgtggatcaccaacgggtccgtcgccggtgtggccgtcgtgtgggcgcagtccgacgacgggatccgcggcttcgtcgtgcccacggacgcccccggattctccgcgcccgagatcaagcacaagtggtccctgcgcgcctcggtcaccagcgaactcgttctcgacgacgtacggctgcccgcggccgccgtcctgcccgaggtcaccggactgaagggccccctcagctgtctctcccacgcgcgctacggcatcgtgtggggcgcgatgggggccgcgcgcgccagcttcgaggccgccgtcgagtacgcgaagacgcgggagcagttcggcaggcccatcggcgggttccagctcacccaggccaagctcgccgacatggcggtcgagctgcacaaggggatcctgctcgcccatcacctggggcggcgcatggacgcgggacggctgcgtcccgaacaggtcagcttcggcaagctcaacaacgtacgggaggccatcgagatctgccggaccgctcgcaccatcctcggcgccaacgggatctccctcgagtaccccgtgatgcggcacgcgaccaacctggagtccgtgctcacctacgaaggcaccgtcgagatgcatcaactcgtgctgggcaaggcgctcaccggtctcgacgccttccgg

SEQ ID NO: 6520 - DNA, 435 bp, Streptomyces avermitilis
  CDS (1)..(435)
atgggatcggtgcgcaaggcgagtgcctggcttggcctcgtcgacgacaacgatgacgagcgttactacgacgacgactacgccgaaggacaggaatccggcgaggcctgggtcaccgacccgcgcgtgaaggtcgcttcggagacggccgaggagaagggccgccggatcggcacggtcaccccggacagcttccgggacgcccgcggcatcggcgagctcttccgggacggggtcccggtcatcatcaacctcacggccatggagcccaccgacgccaagcgcgtggtggacttcgcggccggcctgaccttcggtctgcgcggcacgatcgagcgggtcgcgacccgggtcttcctgctgacccccgccaacacggagatcgtcagcggcgaggcggccggccggccgacggacggtttcttcaaccagagc

SEQ ID NO: 6521 - DNA, 1146 bp, Streptomyces avermitilis
  CDS (1)..(1146)
atggcgcatttgtgcgggctgtgcctcgcactgcgcaaagaccacgggcagttcgccagactggtcacgaattatgacggtctgctgatatcggttttgacggaggctcaggcagagcggacgacgggcggacgccggaccgccggtccctgcccgctgcgtggcatgcggaccgcctccgtcgcgcagggcgagggcgcgcgcctcgccgccgccgtctcgctggtgctcgccgccgccaaggtgcgcgaccacatggccgacggtgacgggctgttggcccgcaggccggtggcgctcgcggcgcgcagggtcgccgcgagctggggcagggccggcgcccgtagcggctccggcgtcggcttcgacaccgccgtgctcgtcgacgccgtggaccggcaggtgggcctcgaggcgctcgccggacccggcaccccgatcctgacggtcaccgagccgaccgagaccgccaccgccgcggcgttcgcgcacaccgcgatactcgccgggcggcccggcaacgccgagccgctcgccgaggccggccggctcttcggccggctcgcccacctcctggacgccgtggaggaccgggaaactgacgccgcgtcgggtgcgtggaaccccctgacagccaccggaacacccctggccgaggcccggcgcctcgccgacgacgcgctgcacgggatacggctcgcgctgcgcgaggcggacttcgtggacgccgggctgacgcacgtcctgctcgcccacgagctgcgcaactcggtcgaccgcgccttcggcggcaccgcctgctcgcaccggcccgaactgcacgggccgtcggcctccggtccgtacgcgcccggtccggggccgtacgcacccggtggtccgggtgggcccgggggtccgccgctgccgcccgagccgccgcggggcaaccgccggggtctgctcgcggggtgtgccgtgtgggcggggctggcctgcacctgccagctgtgctgcggcacgtacgacgatccctggacccgggagcgcaaggacgggctctgccacgactgcgactgcggcgactgcggggagtgctgcgactgctgtcagtgctgcgggagttgctgcgacggctgcgacgggtgtgactgcggctgcgactgc

SEQ ID NO: 6522 - DNA, 954 bp, Streptomyces avermitilis
  CDS (1)..(954)
atgagtacgtcctcgcggccccgtcgccgcattttcatcccctttgccctgatcacgtccgccgcggtgctgctgacggcctgcggctccggcgactcggagggcgcgggcaaaagcgacgcccaggccgcggcgaagaccggcggcatcccgacggcggacgtggtctcggccgtccggaagaacgaggccgcggccaagctgctgccctcgggcacccggagcctcacggtcgcgatcagcgtcggcggcactccgcccggcaccagctatctggacgacggcaagacgctggccgggcaggacgtcgacttcgcgaacgcggtcggcaaggtgctgggcatcaaactcaagaccgagtcggccagtttcgaggcgatcctgccggccctcgacagcggcaagtacgacttcggggccagcaacttcggcgtgaccgacgagcggcgcaagaccatcgacttcgtcacctacatcaacgacggccagggcttcgccacccgcgaggacagcaagctgcagaagatcaccgacctgaagcagctgtgcggcctgaacgtggcgaccggcgcgggcacgaccttcgaggcgacgctggaggagaacaagaaggtctgcacggacgccggcaagaaggcgtacgaggtgcagacgtacaacgagtccggcgcgatctggtcctcgctccagcagggccgcagcgacatcgtgatgtccacgatcaacggcctgcgctacgccgtggcccagcagcagggcctgaagttcctcaacgagttccaccgcctcgatgtcggcttcgccttcaagaagggcacgaagctggcaccggccttccaggccgcggtgaacgagctgatcgccgacggcacctacgagaagatcctgaagaagtggggcacgacgggctcggcgatcgagaagtcccaggtctcgccgccggaactgaaggac

SEQ ID NO: 6523 - DNA, 843 bp, Streptomyces avermitilis
  CDS (1)..(843)
atgtcctccgacaccctcgccaaacccgccgcggcagcagaagccgcacccgtgcgcatcgtcgcccagcgccggctcggccagtggaccgcggccgccgtcgttctggtcctgctcgggctcgccgtcaactccgtcgtgcgcaacgacgcgttccagtgggacgtcgtcgccgactacttcacctcggcctccgtgctgcggggcctgtggctcacgctctggctgaccgcggtcgtgatggtgttgggcttcgcgctcggcaccctgctcgccgcgggccggctgtccgccaacccggttctcagatcggtgagttggggatacgtctggctgttcaggtcgatgccgatcctggtgcagctgctgctctggttcaacatcggggcgctgtatccgcagatcctcggcgtgaagacggtgaacctgctcggcccggtcaccgtcgccatcgtcggactgacgctccacgaggccgcgtacgccgccgaggtcgtgcgcgggggcatcctctccgtcgaccgcggccagatcgaggccgctcaggcactcggcctgagccggtggcgccgctggtggaggatcgtgctgccgcaggcgatgcggtccatcgtgccgccggccggcaacatgctgatcggcaccctcaagggcacctccatcgtcagcgtcatcgccgtacaggacctgctctactcggtgcagctcgtctaccaccgcacctaccaggtcatcccgctgctgatggtggccaccgtctggtacgtcgtggtcacctcggtgctcagcgtcggccagtactacgtcgagaagtactacgcgcgtggttcggagcggacccga

SEQ ID NO: 6524 - DNA, 1758 bp, Streptomyces avermitilis
  CDS (1)..(1758)
atgacgcccactctggtgatcgtgggggcggggccgcggggcaccggactcctggaacggatcgccgccaacgcgcccgagctgtacgccggttcggagctggacgtgcacctggtggacccctacccgcccggtggcgggcgcatctggcgtgaggcccagtcgccgctgctgtggatgaactccgaggcacaggacgtcaccatgttcaccgacgagacggtggccatggcggggcccgtacgaaaaggccccaccctgcacgagtgggcggccctcgacggccgcgccttcaccggccggcggcgccagggcgcatatctgcgctgggtgtacgagagcacggtggccgcgctgccgccgggcatccgcgtccaccaccacgcccgccgcgccctgcgcgtcagcggaccgcccgaggggcgccagcaggtgtggctggaagggcggcccgagccgctcctggccgacctcgtcgtcctcacactcggccatctcgacgccgaactcgacgacgagcagcggaggctggccgcccatgcccgcgcgcacggcctcgtccatctgccgccggacttcaccgccgacaccgacctggccgccctcgcccccggtgaaccggtcctcgtgcgcggcttcgggctcgccttcgtcgacctgatggtcctgctgaccgaggggcgcggcgggcgctacgagggagcggagtacgtgccgtccggtcgcgagccggtcctccatgtcggctcccggcgcggcgttccctaccattccaagatcggctacgactggacgggcgaccggccgccgctgccccggttcttcgggcccgccgaggtcgacgaactgctcgcacgccccgaggggatcgacttccgacgggacgtctggccgctggtggagaaggagctggggttcgcgcactaccaccgcctgttcacggcgcaccccgaacgcaccaccgtcgcctgggcggacttcgaggagaagtacgcggcgggagtcggacccgagctccgggcgctggccgcctcggccgtccccgaccccgcggaccggctcgacctcgacgccctcgaccgaccgctggagggggtgagccacacctcgtacgaggaactccaggacggtctgcgcgcgtacatacaggacgacctgacgcgccgtcatgacccctcgttcagcccggactcggcggtgttcttcgggctgctctccgtctacgggcagctcgtgcggctcggggacatcggctcgtggtggcacggcttcttcagctatctggcgtccgggccgccggggccgcggctgcggcagatgctcgcgctgtcccgggcgggcgtactgaagttcctgggcgccgacatgaccgtcagtgccggggacggcgtcttccgggcggcgagcgccaccgttcccggaaccttcgtcgaggcccgtgccctcgtcgaggcgcggttgccgcatcccacggtcgagcgcacccgcgacgcgctgctgcgcgggctgtacgccgacggggccgccgcgacccccgaggggctgctcgccgtggaccccgccgacggccgggtcctggacggctccggcaccccgcatccgcggcgcttcgcgctcggcccgcacaccgacgcccggggctccggcgcgttcacccggccgcgcaccggcgggccggccttccggcagaacgacgcgacggcacgcgccgcgctgacgttcctgcacgcacaccaccacgccgagggagcagtgcga

SEQ ID NO: 6525 - DNA, 786 bp, Streptomyces avermitilis
  CDS (1)..(786)
atgagcaccaccacccccgcgacccccgcccccgcgatggtcgacatcaggtccgtccacaagagcttcggcccgctggacgtgctcaagggcatcgacctcgaagtgcgcgccggggaggtcaccgtcgtcctcggcccctccggctccggcaagtcgacgctgctgcgcaccatcaaccacctggagaaggtcgaccagggcacgatcagtgtcgacggccggctggtgggctaccggcgctccggcgacaagctgtacgagctgcccgagcgcgagatcctcaagcagcgcacccgtatcgggttcgtcttccagaacttcaacctcttcccgcacctcaccgtcctcgacaacctcgtcgaggccccggtctccgtgctgaagcggccccgcaaggccgccgtggagagcgcgcgccggctgctcggccgggtcgggctcgccgacaaggcggacgcctacccggggcagctctccggtggccagcagcagcgtgtcgccatcgcccgcgcgctcgccctggagccggcgctgctgctcttcgacgaaccgacgtccgcgctcgaccccgagctggtgggcgaagtcctcgatgtcatcagggatctggcgcaccagggcaccacgatgatcgtcgtcacgcacgagatcggcttcgcccgcgaggtcgccgacacggtcgtgttcatggacgacggccgcatcgtcgagcagggcaccccgggtgaggtactcgaccgtcctcggcatgaacgtacgcgggcgttcctctccaaagtcctc

SEQ ID NO: 6526 - DNA, 1116 bp, Streptomyces avermitilis
  CDS (1)..(1116)
atgacctcatcgaccggccgggggttgctgcacctggccgccgccgtcgatcagccgacggtgttcgacgccggctcgtacgtcgagctggtgcggctcgcggagcgtggcgtactcgacttcgtcaccctcggcgacaccttcgcgcgtcccggacccgacgcgctcgccgtgctctcgcgggtggcgcccgccacccggcggatcggtctggtgccgaccgtgaccaccacgcacaccgagcccttccatgtgcaggcggccgtcgcgaccctcgactgggtcagccgcggccgcgccggctggcacctcgacgtgtccaccaccgagggcgaggcccgcctcttcggccgccgccatgccgcgcccgccgacaccctgtggcaggaggcgggcgaagtcgccgacgtggccgcccggttgtgggacagctgggaggacggcgccgagatacgcgacgtggcgaccggccgcttcgtcgaccgggacaagctgcaccacaccgatttcgagggggccgccttctccgtgaagggaccctcgatcgtgccgcggcccccgcagggacaccccgtacgggtcgtcgacgccaccgagggacaggcgaggagaacagccgcccggtacgccgacgtggcgctcctccgtgtcacctctcccgcccaggccgccgccgtacggaccgaactgcggggcacggcggaggagttcgggcgcgatcccgacaccctgcggatcctcgcgtgtctggtcgtcgacctcggggacggcgagcacgcggccgagcccggatgggggtccccgctgttcgggcgaagacgagaactcgggggaggcgggggcggacccctggggaccgcgcagggcccgcggtatcgcggcggccccgtcgacctggccgacctgatcgccgtctggcaccaggccggcgccgtcgacggcttccacctcaccccggtcgagccgcgccgtgacctggagcggctcgtcaacggcacagtggcgctgctccagcaccgcggcctgttccgcaccttctatccgggcagcacgctcagggagcacctggggctgggccggcccgccaaccagtacgccgtgaccgggggaacgtca

SEQ ID NO: 6527 - DNA, 1383 bp, Streptomyces avermitilis
  CDS (1)..(1383)
atgaccgtacgcaagcccgccgtcaaacagatccacctggccgccctcccccactcccactcccactcccgatctcgctcgagcggggagagccccgtcccaggggtcgacaacacgaccgtctgggccgacccgcgcgcgaagtcgcagatcgagttcgcctccttcgagcatctggcgcgcaccgccgaacgcggtctgttcgacttcttcctcctcgccggagggctgcggctgcgcgaacacaagggacgcatccatgacctggacgtcgtggggcaccccgaggcgatcaccgtgctcaacgcgctggccgccgtcaccgagcggctcgggctcgccgccacggtcgacgcgaccttcaacgagccgtacgaaaccgcccgcaggctcgccacgctggaccacctcagcgggggccgggccgcctggaacgtggtgacctccgccgacgcgttcaccggggcgaacttccggcgcggcggcttcctcgaccgggccgaccggcatgcccgtaccgccgaattcgtggcggcggcaagggagttgtgggactcctggacgcccgagggggtgtcgcggccgttcgcccaccgtgggcggcacttcgacatcgcgggtgagttcaccgtgccgcgctcgccgcaggggcaccccgtcgtcatccaggccggcgactcggccgaggcccgggagttcgccgcatcctcggcggacgtggtcttcgccaggcacgggacgctggaggcggggcgcgcgttctacgctgatgtgaagagacggctcgcggcgtacggacgcgagcccgaggacctgaagatcatgcccggggtcaccttcgtgctcggcgacaccgccgccgaggcgcaggaacgggccgccgagatccggtggcagcagatctcgccgcagaacgcgatcctcacgctggagcagatctggggcgtcgacctgtccgaccacgaccccgacggtccgctgcccgccttcgacccggacccggacccccacccggacccggagccgggcctgatgcagggcggggtggaggtcgccgatccgcgggcgatcgccgagaaatggcgcgccctgtcccacgagaaggggctgtccatccggcagaccgtgatcgaggcgaccggacggcagtccttcgtcggtacgccggaggcggtcgccgccgaactcgaggagttcgtacggaccgacgccgccgacggcttcatcctcgcaccgcatctcaccccgggcgggctcgacgagttcgtggaccgggtggtgccgctgctccaggagcgcggcgcctaccgcacgcactacccgggaaccacactgcgctcgcatctcgggttggcggatccccctacggaagcgctgatccca

SEQ ID NO: 6528 - DNA, 270 bp, Streptomyces avermitilis
  CDS (1)..(270)
gtgaccgcggccccggtcgcgcacggtgagcgccggctcgtcgttctcgtccgcgaaggggtctggggcgtacgcgacttcgaccccgcctcggccgcccgccgggcgttcaagggcatcgaggcgagctcgtacgatccgcgctggtcggtgccggggcgcttcacctcgtacggcgagaaccgcaccgtacgcgtcgagaacgccgacggccgcgagcgcgggctggtctcggcggcgaactcgtcctcaccctggccggacaggagc

SEQ ID NO: 6529 - DNA, 1095 bp, Streptomyces avermitilis
  CDS (1)..(1095)
ttgttgaggggtccgcaagttgaacgctgcacggccgaaaggcgcccttgcgccttgcggtcgcgcggccgaatactcccccacagcgcttgtcaggggcacggcttgtccggaaaccggacaacgggctcttggctgcgcctcacgggccccatcccccacgtgggccccccgacttcccctgggagggaacgaaaagtgaggatcaagcgcaccaacccccgcagcggtgtggcgagacggacccggctgatcgccgtggccaccggtttcctggccgctgccgcgttcgccgtccccaccgcgaacgcgagcgacgcacagacgttcagcgccacccagctcaccacggtcgccaagtcggtgctcaagtccgatgtagcgggcaccgcctgggccgtcgaccccaagacgaaccgcgtcgtcgtcacggtcgacagtacggtctccaaggccgagatcgcccagatcaagaaggacgcgggcagtaacgccggcgccctcaccgtcaagcacaccccgggcacgttcaagaagctgatcaccggcggcgacgccatctacggcggtggctaccgctgttcgctcggcttcaacgtgcacagtgggagcacctattacttcctgaccgccggccactgcggtgaggtcgcctcgacctggtactccaactccggccagaccacgacgctgggcacgaacgtcagctacagcttcccgaccaacgacttcgccctggtgcgctacacgaacacctcggtcgcccacccgagcgcggtcggcagccagaccatcagcagcgccgccacgccgagcgtgggtacgaccgtctaccgccgtgggtccaccaccggcacgcacagcggccgggtcaccgcgctgaacgccacggtcaactacggcagtggtgacgtcgtctacggcatgatccagaccacggtctgcgccgagggcggcgacagcggtggtccgctgtacggcggatccgtcgcctacggtctgacctccggcggcagcggcaactgcacctccggcggtacgaccttcttccagccggtcaccgaggcgctcagctactacggcgtgagcgtcggc

SEQ ID NO: 6530 - DNA, 1164 bp, Streptomyces avermitilis
  CDS (1)..(1164)
gtgcgccgcctccgtgcccgtacgccttccggtcgtcgaggtccccacaacctcgttgaccgaccccccacaggaggacgtaagttgaagcaccgacgcatatccaggcggcgcgcagccgtggccggagccggcatcgccgcgctcgtcgccgcgggtgtcaccttccagactgcgaacgcgagcgaggccccgaagaccgaagcgccccacaccctctccctctcggcggccggaaagctcgcctcgaccctgggcaaggacctgggcaccgacgcggcgggaacgtattacgacgcgaaggcgaagcacctcgtcgtcaacgtgctcgacgagacggcggcgaagaccgtcgaggcggccggcgccaaggccagagtcgtgcggaactccctggccgagttgacgagcgcgcgtacgacgctcaagcaggacgcgaccatccccggcacctcgtgggcgaccgacccggagaccaacaaggtcgtcgtcaccgcggaccgcacggtctccaaggccgagtgggccacgctgaccaaggtcgtcgacggcctcggtcagcgagccgaactccagcgcacgaagggggagtacaagcccttcatcgcgggcggcgacgcgatcaccggcggcggcgggcgctgctcgctcggcttcaacgtggtcaagggcggccagccgtacttcatcaccgccgggcactgcaccgagtcgatctcgacctggtcggactccagcggcagccagatcggcacgaacgagcagtccagcttcccgggcaacgacttcggcctggtcaagtacacctcgaacgccgaccacccgagcgaggtcgacctctacaacggctccacgcagcccatcaccaaggcgggcgatgcgaccgtcggccagaaggtcacccgcagcggctccacgacccaggtgcacagcggcacggtcaccggtctggacgccaccgtgaactacggcaacggcgacatcgtcaacggcctcatccagaccgacgtctgcgccgagcccggcgacagcggcggctcgctcttcgcggccgacaccgccatcggcctcacctcgggcggcagcggtgactgcacgtccggcggcgagacgttcttccagccggtgaccgaggcgctgtcgacgttcggcgcgcagatcggc

SEQ ID NO: 6531 - DNA, 528 bp, Streptomyces avermitilis
  CDS (1)..(528)
atgaccgggacctcgcactcctcggcgtggatctcctccgatccgcccgactacggcgaggagccggcgatcccgtacggcgacggcggcaccttcgagatcgagctcaccgtcgacgcgaaggacgagtacaccgactgcttcaaggcgacctgcgtactggccacccgcgccgaccacaccctctccggcgaccgttcccaggacgtgaaggtcccggtcagctttgtcggccaggacccggtggacacggacgacgggacgggcggtacgggcggcggcaccggcggcaccggcggtaccggcgattcgggctcggcctcggcctccggcggctccggaacctccacgaacacggccggcacgtccgccggcagcctcgcctccacgggcgtcgccgccctgaccctgtcctttctggccgcgctgctcacggcggcgggctggttcgcgtaccgacgcggccaccaggacaacggacacccccgccacttccggaccggcggaccggccgacggaccgaccgac

SEQ ID NO: 6532 - DNA, 3483 bp, Streptomyces avermitilis
  CDS (1)..(3483)
gtgccgggattcacgcatctgcacaccgtctccgggttctccccgcgctacggcgcctcgcacccggagcggctcgccgagcgcgcctccgagcggggcatggacgccctcgcgctcaccgaccgggacaccctcgccggcacggtccggttcgccaaggcctgcgccgcggcgggcgtccggccgctgttcggagcggagctcatggtggcttcggcgggggagcgcgagcacggaggcaagcggcgcgccccggtccgcggcggtgccttcatcgacgagtcgacaccccgtgtgaccttcctcgcccgggagggcgcggccggctgggccgacctctgcagaatcgtcaccgcgtcgcatacgggggaggggcagccgctgctcccctggcccgacaaccacgccgagggcctgaccgtactgctcggccccgcctccgacgtcggccgcgcgctcgccgccgggcgccccgaccgggccgcgaggctgctcgcgccctggcgggaggtctacggcgacgcgctgcgcctcgaagccgtgtggcacggccgcaagggcaccggacccggctcgctgcgcctggccgcccgtaccgtcggcttcgccgccgagcagcgcgtccgcccggtgctcagcaacgccgtccggtacgccgaccccggcatgggcccggtcgccgacgtcctggacgccgcccgtcggctcgtccccgtcgaccccaccaaggagctggactccggcgaggcctggctcaaggacgcggacgccatgctgggcgccgccgagcggatcgtcgaggccgcgggctaccgccgggacaccgcgtaccgcctgctcgaacagacccaggccaccgccgccgagtgtctcgtcgaccccgaggacgacctcggcatcgggaccgtccacttccccgagccgcacctcgtcggcgccggccgccgcaccgcgcagcgtgtgctgacctcacgggcggcggcggggatggtgcggcacggctacgcggaccggcgcgactactgggagcggatgcaccgggagctggacatcatcgcccaccacggcttcgcgtcctacttcctgacggtcgctcaagtcgtggacgacgtacgggatatggggattcgggtcgcggcacgcggctccggtgcgggctcgctggtgaaccacctcctcggcatcgcgcacgccgaccccgtcgaacacggcctgctgatggagcgcttcctgtccaagcggcgcgcggtcctgcccgacatcgacatcgacgtggagtccgcgcgccgcatcgaggtctaccgcgcgatcatcggccggttcggcaccgagcgggtcgcgaccgtcgcgatgcccgagacgtatcgcgtacggcatgccatccgcgacgtgggcgccgccctctccatggacccggccgacatcgaccggatcgccaagtccttcccgcacatccgggcgcgtgacgcccgcgcggccctggccgagctgcccgaactgcgggaactggcgggcgagttccggcgggaaggggggcggtacgggaagctgtgggagctggtcgaggccctcgacgccctgccgcgcggagtcgccatgcacccgtgcggggtcctgctctccgacgcctcgctgctcgcccgtacgccggtcgtgccgaccagcggcgaggggctgcccatgtcgcagttcgacaaggaggacgtcgaggacctcgggctgctcaagctcgatgtgctcggcgtgcggatgcagtccgcgatggcgcacgcggtggccgaggtggagcgggcgacggggacttccgtggacctggacgccgtaccgccgggcgacccggcgacgtaccggctcatccggtccgccgagacgctgggctgcttccagatcgagtcgccggggcagcgggacctggtggggcggttgcaacccgccaccttccatgacctggtggtcgacatctccctcttccggcccggaccggtcgccgccgacatggtgcggccgttcatcgaggcgcggcacgggcgggcgccggtccgctgtccgcacccggacctggaggggccgctgaaggagacgtacggggtcgtggtcttccacgagcagatcatcgacatcgtggacatcatgaccggctgcgggcgcgccgaggcggaccgggtgcggcgggggctgtccgatcccgagtcgcaggggcggatccgcttctggttcgcccagcacgcggccgtgcgcgggtacgacgcggagacgatccagcgcacctgggagatcgtcgaggccttcggttcgtacggcttctgcaaggcgcacgcggtcgccttcgccgtaccgacgtaccagtcggcgtggctgaaggcccatcacccggccgcgttctacgccggtctgctcacgcacgaccccgggatgtacccgaaacggctgctgctcgcggacgcgcggcggcgcggggtgccggtcctgccgttggacgtgaaccggtcggcggtcgcccaccgtatcgaactggtgtctgaatccggcgacccttccggtggttcttccggcggtccttccggtggttctcccggccgatggggtgtgcggctggccctctccgacgtgcacggcatcagcgaggccgaggcggcacggatcgcggacgggcagccgtacgcctcgctgctcgacttctgggagcgggcccggccgagccggccgctcgcccagcggctcgcgcaggtcggcgcgctggacgcgttcggcgccaaccgccgtgatctgcaactgcacctgaccgagctgcaccggggcgcgcgaggcgggggcgggggccagctcccgctgaccggagggcgcgggaccgcgtccgcggggctgcccgacctctcgtcggcggagcggctcagcgccgaactgggcgtgctctccatggacgcctcgcgccatctgatggacgaccaccgggagttcctcgacgaactgcgcgtggtgtcggcgcgtcggctgcgcgaggcgaggcacggcgagacggtcctggtcgcgggcgccaaggcggccacccagaccccgcccgtccgctccggcaagcgggtcatcttcaccaccctggacgacggcacgggcctggtcgacctcgccttcttcgacgactcccacgacgcctgcgcgcacaccgtcttccactcctggctgctgctcgtccgtggggtcgtacagcggcgcgggccacgcagcctcagcgtggtgggcgccgccgcctggaacctcgccgagctggtcgagctgcgcgccgagggcggcctcgacgtggtggcggcgcgactggcggagcccgtaccggcggcggagaggtccggtgacgacgatccggccgagggcgggaagatccgcatgcccacggggtacgagatgcacccctgggccgatctgcgtcccgcgggcgaaggcccggcgggtggaaagaagttgtggcaccagagtccggggagtgcggga

SEQ ID NO: 6533 - DNA, 972 bp, Streptomyces avermitilis
  CDS (1)..(972)
atgaccatcctctgtatacgtttccagctgccgccgatgtacgaggccgccctgccggggctcctcgggctgctcgaggagttcacgccggtggtggaggcgctgccgcccgacggggcactggtggatctgcggggcgccgagcggtacttcgggcgggggaccgtggagttcgcctcgctgatccgggtgcgggcgctcgcgcactacgggatcgactgcgcgatcggcgccgggccggggcccatgctcgcgcggatggccctgcgggacgccgtacccggggtgacccgcgtggtgcccgaagagccggacgccgtcgcggagttcctggcggagcggcccgtcgtcgcgctgcccggcgtcggccacgccaccgcccgcaccctgtgcgagtacgggctcgacaccctcggcaaggtcgccgccgcgcccctgtccacgctgcaacgcctcaccggtgcccgcaccggccgcgagctgcgcgagaaggcgtccggcatcgaccgcggccgggtcgtgccgaacgccgtatcgcgctccctcaccgccgaacgccccttcccgcgcgacgaggtggacccgtcccggcaccgccgcgccctgctctcggtcaccgaggagctgggcacccggctgcgcaccctggaacaggtctgccgcacgctcaccctcaccgtgcgctacgccgaccggtcctcgacgacccgcagccgtacgctcgccgagccgaccgcgcactccgcggcgctcaccgcgacggcgtaccgcatgtacgaggcgctcggcctccagcgggcccgggtccgcgcgatcgccctgcgtgccgaggggctgagccccgccgaggacgccgcccatcagctcaccttcgacccggtcgacgagaaggtccgccggatcgaagaggtcgcggaccgggcgcgggcgaagttcggcccgcgcgcgatcgtgccgggggcgctggccgcc

SEQ ID NO: 6534 - DNA, 384 bp, Streptomyces avermitilis
  CDS (1)..(384)
atggaggtctccatgcccgtcgtccgcccgtccgaggccgtggtccacgagatccacggcgcccgtttcgtctcgtacgccactccgctcagcggcagcaaggagctgtgcgcctggcggggcgagattcccgcggggacgaaggcccccgtgcacaccgtcaaccgtgaggagatcttccatctgctgtccggcgaactggtgatcaccctcgacgggcgcaccgagcggatcaccgccggcgacacggtgatcatcaatcccggcgcgaccctgggcgtcgagaacccgaccgatcggaccgcggtctcctgggtcaccacgtccatcggcctcgaggcggagctggccgacggcagccggatcgtgccgccgtgggccaac

SEQ ID NO: 6535 - DNA, 444 bp, Streptomyces avermitilis
  CDS (1)..(444)
gtgcagaactccgaagccatggccttctccgccgccctgctcgccgccgcgggtgagctgacacaacgcattcacgacggcgtggtcgcccgcggcttcgaggggttgcggcccgcgcacggcttcgccttctcgcggctcgcccccggcggggcgacggtcaccgacctcgccgcccacctgggggtcaccaagcaggcggcgagccagctcgtcgacgagatggtgcgcaaggggtacgtcgagcggcggccgcaccccggtgacgcccgggcccgcctcgtcgtgctgaccgagcgcggctgggcctgtacgcgggccgcggaagaggcggcggcggaggccgtgcggccatgggtcgagctgctcggcgagggggaagtcggccttctgcgggcgcggttgtcgcgcatcgcgccctccggccccatcaggcccacctgg

SEQ ID NO: 6536 - DNA, 858 bp, Streptomyces avermitilis
  CDS (1)..(858)
atgctgccctggaaacgagttctcagacctctgaccgcgctgctgctgaccgtcgcggtcgccctcgtccccgccgccaccgcccacgccgactccgccccgagcagcggctggaacgactactcctgcaagccgtccgccgcccatccccgccccgtcgtcctcgtccacggaaccctcgggaactccgtcgacaactggctgggcctcgcgccctacctggagcaccgcggctactgcgtcttctcgctcgactacggccagctgtcgggtgttcccttcttccacggcctcggccccatcgacaagtcggccgaacagctccaggtcttcgtggacaaggtgctcaccgcgaccggcgccaccaaggcggacctcgtcggccactcgcagggcggcatgatgccccgctactacctcaagttcctcggcggagccggcaaggtgaacgccctcgtcggcatcgcacccaacaaccacggcaccaccctgtccggcctcaccaacctgctgccgtacttccccggcgccgaggacctgctctccacggccacacccgggctcgccgaccaggtcgtaggttccgcgttcatggccaaactcaacgcgggcggcgacaccgtggcgggcgtccactacacggtcatcgccacccagtacgacgaggtggtcaccccgtaccggacggcgttcctgagcggttccgacgtccacaacgtcctgttgcaggacctgtgcccactcgacctctcggagcacgtggcgatcggactgatcgaccggatcgcgttccacgaggtgacgaacgcgctcgacccggcgcacgccaccaggaccacctgcgcgtccgtgttcagc

SEQ ID NO: 6537 - DNA, 1029 bp, Streptomyces avermitilis
  CDS (1)..(1029)
atgtctgctcgccgcaaggcggccgccgtcgccgccgccggtgccgccccgctcgccctgaccgcgctcgccgccgcgcccgcgtccgcgcacggctcgatgggcgacccggtcagccgggtgtcccagtgctacgcggagggtcccgagagccccgggtcggcggcgtgcggggcggcggtcgcggccggcggcacacaggcgctgtacgactggaacggcatccggatcggtgacgcgaacgggcggcatcagcggctgatcccggacggcaggctgtgcagcgcggacaacgacgagttcaaggggctcgacctgccccgcgccgactggcccgcgaccggcgtcagcggcgggtcgtacaccttcaagtaccgggtgaccgccccgcacaagggcaccttcaaggtgtacatcacgaaggccggttacgacccgtccaagccgctcgcctgggacgacctggacctcggccacccggtggcgacggccaccgacccggccgcgtcgggcggcttctacacgttctccggcaccctcccgcagcgctccggcaagcagctcctgtacgcggtctggcagcgctcggacagcccggaggccttctactcctgctcggacgtcacgtacggcgcgagcaacggcggcggcgaccgtggcagcggcggtacggcgagcggctcctcgcccgcgccgaccgcctccgcgccctccgaccggcagatcgagaacggtgccgacaagtcgaccgtcgagcaccacggccacggcgactccgacgcgagtacgtcggcgaagcccaccgccgccggcggcgccgcgcggacgaccgggagcgcggcgaagagcccggcgaagagcgccgacgaaccggccgccgccggtgccgcggagaacctcgccgagaccggtggcgacggcagcgccccgtacctcgcgatcggcggggcggcggcgctggcgttcggcgccgccgccctgttcgcctcggtccgccgccgtgcgacgagcggcggccggcaccaccgc

SEQ ID NO: 6538 - DNA, 468 bp, Streptomyces avermitilis
  CDS (1)..(468)
gtgtcggccatgacagatgcctggaacgacgccgagacacggcccgccgtcgccgccgacgtggacgccgtgaaggccgtgaccgatgccgcgtaccaccactacgtcgaacgcatcgggcgcgtgccgcagcccatggaggcggaccacgcggcgaacgtggccgcggggcgggtgttcgtcctgggcgagccggtgacgggcctcgtggtgatcgaggcgttcgaggaccatctcttcctcgacagcatcgccgtccgccccgacgcccatgggcagggcgtggggcgacggctgctcgccttcgtggacgcacgcgcgcgtgcgctcgggctcgacgaggtcaggctctacacgaacgccaagatgtgggagaaccagaagatctacccgaagtacggatacgagttcgtggagcgccgggtggacgggccgtacgaccggatccattaccgcaagcggctcgcc

SEQ ID NO: 6539 - DNA, 171 bp, Streptomyces avermitilis
  CDS (1)..(171)
gtgaacatcgcggaacccggtaggcacaaggaggcagccatgcgccgtgtgaccttgcagaagcccctgaggaagtctgtctcccgccgggtgcgggaggaggccgaggaacgccccgccgagcgcccggaggtccgaaaggacatcgcacgcacctggtggccggacggc

SEQ ID NO: 6540 - DNA, 645 bp, Streptomyces avermitilis
  CDS (1)..(645)
gtggcgggtgccactcttggcggcatgaccattaacgggggccccgaaacctcggcgatctcggcggacgtggattgggacgccgagtccgccacgttcgacgacgagccggaccacgggctgcgcgacgcggtggtgcgggaggcctgggcggcccggctgcgggactggctgccgggcaaggcctgcgacgtgctggatctgggctgcggcaccggcagtctgtcgctcctcgcggccgagcgggggcaccgggtgacgggcgtggatctgtccccggccatggtcggcctggcccgcgccaagacggccggacgtgacgcggcgttcctggtcggtgacgcggcggcgccaccggtcggcgagcagcggttcgacgtcgtgctcgtccgccatgtgctgtggacgctgcccgacccgggccgcgccctgcggcggtggtgcggactgctgaggcccggcgggcggctggtgctggtcgagggggtgtgggggacggtgagtccggtcggcctgtccgccgaccggctgaccgggctgctcgctcccctcgcgaagagcgtgcgcgtggagcggctctcggacgattcccggctgtggggcaaagaggtggccgacgagagatacgcggtggtggccacccct

SEQ ID NO: 6541 - DNA, 516 bp, Streptomyces avermitilis
  CDS (1)..(516)
gtgcgacggaggtgcgctatgtccgcgaactcggctgaggcagtcggccaggtggaggtcgtgctggtcaagtccggccggacgaagatccgttaccccgccgagctgctccatgacgacggcacccgggtggccgtacgcgccccctgggcgggtgacggtgtccgcgacttcggcttcgtacgcttcgagccgggtgatgtcttcaccgagtactactggcgtgaccgctggtacgcggtgaaggaggtccgtgacggccggggcaccctgaagggctggtactgcgacatcacccgcccggccacgctcgtgggcaccgaactcgtcgtcgaggatctcgacctggacctgtggcgctccgccgacggcacggccgtgctccgtctcgacgaggacgagttcgccgcgagcggtctggcggtgtcggacccgcgggccgcggccgccgccgagaacgccctcgacacgctcgaacgcctcgcccgggagggcgacttcgaggcgctgctggcc

SEQ ID NO: 6542 - DNA, 384 bp, Streptomyces avermitilis
  CDS (1)..(384)
gtgcgggacaatcactcggtgaccttgaagatcgtcatcgaagcaggcggcgcgccctacgaacaggtacgtgcccagatcgccgagcaggcgcgttcgggggagctgccggtgggataccggctgccgaccgtgcgggggctggccgagtcgctcggcctcgcggccaacacggtcgccaaggcgtaccgggcgctggagtcggacggggtgatcgagacgcgggggcgcaacggaacgttcgtcgccgcagcgggctcggccgcggaacgggaggcggcgtcggcggcgcaggcgtacgccgagcgcgttcggcggctcgggttgagcgagggggacgcgtcggcggccgtacgcgacgccttgcgggcggcctacggagac

SEQ ID NO: 6543 - DNA, 1026 bp, Streptomyces avermitilis
  CDS (1)..(1026)
gtgattgtcccgcaccggccgcccggcgcggagcgctcgtcccgcgcccccggaaaatcggaggcccccgcccgtggtccccgcgtagcgtgcgagcccatgaccttgatcgttcgcgagctgcgccaggacagccggccagacgccgagggcttcgcccacatccggcgcctggccctccccttcttcatcgtcacccccgagtccatcgcctacgaccggcggcacacgcaccccgacgcccactaccagcccctgctggccgaggcggacggtgagctcgtcggcacggcccaggtcggcctggtgcacgacagccccgagcccggacaggcgtacctcaacgtctatgtgcaccccgagcggctgggcggcggcgcgggctccctgctggtacgcacagccgaggaacgcctccgcgccctgggcgcgacgaagctgttcgcatgggtgctggacgagcccgcgaaccgggcgttcgccgagcggcggggctatcgcgccagtcgctccggccacttcctccgcctcgacctggcgcacggcaccctccccccgctccagtccccgccccccggcgtggaactgcgcaccgccgcggacttcgccgacgacccgcgcccgctgttcgaactcgacgcggagacgagcggggacgaaccgggcgacgtcgatcacgagttcacggactacgaggcctggctggaggagacctggcggcatcccctcctcagccacgagctgacctcggtcgccctcgtcgacggccgccccgcggcgttcagcgcggcccgtaccgacggcgccacccgctaccacaccggtatgacgggcaccgcccgcgccttccgcggccgcggcctcgccaagctcgccaagaacgactcgctgcaccgggcccgcgccgccggcttcaccgaggcgttcacgggcaacgacgccggcaacgagccgatgctggcgatcaacaagtggttcggctacgagatctgtgcgacggaggtgcgctatgtccgcgaactcggc

SEQ ID NO: 6544 - DNA, 762 bp, Streptomyces avermitilis
  CDS (1)..(762)
atgaccctgttcgtcggcacctcggggtggcagtacaaggactggctgggcgccttgtacccgcccgggtgtcccacgcggctctggctggaggagtacgcgacccgtttcgccacggtcgagatcaacaacgccttctaccggctgccgtcgcggggcaccttcgagacctggcgggagcgcaccccgccggacttcgtggtcgccgtgaaggcgagccggtatctgacccacatcaagcggctgcgggaccccgaggagccggtccaccgcctgatgacccacgccgccggcctcggcgaccgcctgggcccggtacttgtccagcttccgcccacgctgcgtgccgaccccggtctgctggacgcctgtctcgcctgtttcccgtccggcacccggatcgcggtcgaaccgcgccacgactcctggtgggcaccggcggtgcgcgaggtgctcgaagcgcggggcgccgccctgtgctgggccgatgtcctgtcccggcccgccaccccgctgtggcgcaccgccgactgggggtacgtccgcttccacgagggccgcgcccgcaggtggccgcgctacggccgccaggccctggtgacctgggcgcggcgcatcgccgagacctggcccgacgatcacgaggtctacgcgtacttcaacaacgacccgcatgcggcggcggtcgaggacgcggcggtgttcgcccgggtggcgaaggcgacgggcctgacggtcacccgtactccgggcggtgacgaa

SEQ ID NO: 6545 - DNA, 1092 bp, Streptomyces avermitilis
  CDS (1)..(1092)
atgtctgcgaacccacacgacgctctgccgatccggctcaacgtcgacgacagcgactccccgtccgatgtcgtcgacgcgctgttcctcggccgcttcgcgacgggcgagcagccgcactcgcacgcggcgaacatcgaccgggtgcgcaccggggcgacgctgctgccgccgggcgcccgggtgctgcgttcggcgcgcgacgacgaccgcagcgcgacgctggcggagggtgacggctggacgctcctggtgtcccgctggaaccggggcgccgacgtcacggtcaccgcgaccagcgccgagctggcggagaaggtgctcgggcaggcgacggacggcgcggcggacgagccggagccgcagccggagaacgtgacgatggggttctggtacgtgtccccgaggcgcggcccgcaccgtacgacgcgccagatctcggcgggcacgtgggaggaggtccgccccaactacacgacgcccgtcgcggacgcgatggaccgtctgatgaagaccaccccggaggacatcgcgggccggctgctgctgctccacggaccgccgggcaccgggaagacgtcggcgctgcgcaccctcgcccgctcctggcgggactggtgccaggtggactgcgtcctcgaccccgagcggctgttctcggacgtcggctatctgatggacatcgcgatcggcgaggaggacgggacgggcaagggccgctggcggctgctgctcctcgaggactgcgacgagctgatccggggcgaggcgaaacacacggcgggccaggcgctgtcgcggctgctgaacctcaccgacggcctgctgggccaggggcgcaacgtcctggtgggcgtcacgaccaacgaggacctggaacgcctccacccggcggtcgtccgccccggccgctgcctggcccgcatcgaggtgggcccgctgacccgccgcgaggcggtgaactggctcggcacggaggagggggtgggccgcgagggtgcgaccctggcggagctgtacgcactgcgccggggcacgtccccgacctcgctgccggagccgcgggagggggcggacgcggggctctacctg

SEQ ID NO: 6546 - DNA, 1263 bp, Streptomyces avermitilis
  CDS (1)..(1263)
gtgcacggcacgcccgccgtcccgcccaagaacaccggaccggaagtgggctggggcttcacccacacccagttcagcgccgacgagggcagcggcgacgccacccagcgcgtcgaggggctgctcgcgcagcgggcggtgccccagatccagcacatcatgggctggggggccggcaaccccgagcccgtcaaggggcgttacgacttcgcggagatggaccgccgcatcgacttcatccgcgagtccggcggcacgccggtggtcaccctgtgctgcgccccggactggatgaagggcggcaagtccggtgcggacaacaccgactggagccggtccgccctggagaccgcaccggatcccgaccactacaaggacttcgcggcgctcgccgtgacggtcgccaagcgctatccggacgtacgccacttcatcgtctggaacgagttcaagggcttctggaacgactccagggcccgctgggactacgagggctacaccgagctgtacaacctggtctacaaggccctgaagaaggtcgacgagaagaacatggtgggcgggccctacctggtcatggacagcgtcgacccgcgccagcaggagaacgcctcgacggccgtgaagggcccgtggggtgccatggaccagcgcgtcctcgacgccttcgactactggaacaggaacaaggccggcgccgacttcgtcgtcgtggacggctccagctacaccaaggacgacgacctcctgccgaacgagttcgcggccacggacaagctcacggccgtcggcgagtgggtgcgtgcgcggacccgcggcctgccgctgtggtgggccgagtactacgtcgagcccgccgacggcaacgacgaccgcacgggctggtccgagacccggcgcgtcgccgtccaggccaccggaatgatcgcgatggccaggggcggtgcctcctccggcttctactggaacccggaggaggagcggggctccgactgcgcgggttgcctgtggaccccgacctccggcggcgacggcggcacgaaactgcccatgtacgacctggtctcgcggttcggcaaggagttcccgccggggacgacgtacgaaacggtgccggtcgccaaggacgacgtgcccaatgtccgcgtcctcgccgacgacaaggccgtcctcgtggtcaacaccctcgaccgggcgatcagcgcgaaggtcgacggaaagcggttcgagttgccggcgtacggggtgaagtggctgcggcgc

SEQ ID NO: 6547 - DNA, 3690 bp, Streptomyces avermitilis
  CDS (1)..(3690)
atgctcaacaccggtatctccgcggtgctcggcctgggcttctggctggccgcggcccggtactacgacgagtcggcggtgggccagggctccgcggcgatcgccgcgatgaagctcctcgcgggcctgaccgcggtgacactcacgggcgcgctcgcccgcttcatcccggtctccggacgcgccaccggccgcctcatcttccgtacgtacgcgggcagctcggtcgtcgtcgcactcgccgcggtggtcttcctgctgacgctcaacgcatgggggccctcgtaccgcttcctgcacggaccgctcaacgggctcggcttcatcgtcgcggtcgtcgcctggtcgctgctgacccttcaggacggggtgctgaccgggctgcgcagcgcgctgtgggtgcccgtgggcaacaccgtgttctccgcggtgaagctggccctgctcgtcgccttcgcggtggcgatcccggccagcggcgtcttcgtgtcctgggtcgcggcgatcgccacgtccgtggtgccactgggctggctggtcttccggcgcctggtgccccggcatgtgaaggcgaccaaggaccacacgcggccgccgacactcaaggaggtcggacggttcctggccggcgactacaccggctcgctgttctcgctcgcggtggtctacctcgtacccgtgatcgtcgcctcgcaggtcagctccgagaacaacgcgtacttctacatcaccacgaccatcggcggaacggtcaacctgctggccatcaacatgggcgcctcgctcaccgtcgagggctcgcacgacccggcgcggctcgccgcgaacacccgggcggcgctcaggcggatggcccgcctcatgctgccggtgtgcgggatcctgttcgtcggggcgccgttcatcctgcgcgtcttcggtgagggctacgcacacgcggcgaccccgctgctgcgctggttcgccgtcggagcgctgctgcgcgtcgtcatggagacgtacttcgcggtcctgcgcgcccagagccgcacctccggactcgcctatctccagggcctgctgtgcgtcctggtgctcgggctgacgctgatcctgctcccccgtatgggcctgaccggcgcgggcgtcgcggagatctccagcctcgccgtgatcgtggcgatcgccgcgcccaagctgttcaagatcgtgcggaccgcgccgtcgcccgccgtgcccgaggacgcggcgccggacggcgacctcgccgatctgggggcgcgcgaggccgccggggcggggagtggtccttcctgggcgaggaaactggacgccgacaccctggcgctcggcctccacgtcgacttcgaccacctggaacgccggccggatgtgcgtccgggcccgggcacaccgcccaccgggtcgcccgcggtccggccggaccgccggccgacctgggccctgcgggtgcagtcggccagggagcccgagccgcacgtgggcctgcccgtggaggaacgggagccgggctccgaggcgtcgctcgggcccgccgaggtgcccgaggtggacgcgccgttcacgggggaggccgtacaggcgcgggcgtccgtaggggagtcgggggccgtacgggagccggaggctccgtctccgggagcgccgccggacactcccctgtccctgcgggaccggctgcggccgtcccgtcccggggtcgtcctgggctgtctgctggtctcggcgctgctgctgtactgggtgcccgcgctgggcctcgacgaagccgcgctcgaccggatgggcggcctcggactgatctcggtcctgccgatgccgaccctcgtcggtgccgcgctgctggtcgtggtcttcgcctcgctgctctggcggacccgcgagcaccaggggctgctgctgttcaccctgctcgccaccgtggtgtcgctgcacgcgctgcccgcggtgatcgagaccgagccgcggttcgcgacggcctggcagcacctcgggttcctcgactacatcgaccggaccgggtcggccgtgcccgacctggacgcgcgctggagctggcccggcttcttcgcggtggccgcgttcgtcgccaaggcctgcggggtcaccgatctcaccgaggtcatccgctggtggccgatgaccgtccaactcctctatctggcaccgctgttcctgctcgtacgctcgctgcgggcgggctggcgcgccaagtggaccggcatctggatcttcgtgctcagcggctgggtcggccaggactacttctcgccgcagggcttcacctatctgctctacctggccttcgtggccatcctgctggtgtggttccgggcgccgcgcgtgctgtggagcacacggcgtcccggcgaggcggaggtcgaacccgccggccggcgtcagcaggcggttctgctgatggtcctgatcggcctgttcgccgcgaccgtcccggcccaccagctcacaccgttcgtgatgctgggcgtgctggcggtgctggtcctggtgggccgctccgagctgcgcggtctgcccatcctgttcgcggtcgtcgtcgccgtctggataggcttcatggccgagccgtactggtccgggcacttcgacgacctcttcggcggggtcggcggcgtcggcagcaatgtgtcgacctccgtctccggacgtatccagggcggcagttccacccacaaactcgtcctctacacccgcgtgctgctcgccggcggcgtgctggccctggcctgctggggctggtggcggcggcgcgaccacaagtaccgggagcgctcgctgctggtgctgaccttcgtgccgttcctgggcttcggcatgcagtcgtacggcggcgaaatggcgctgcgcgtcttcatgttcgccctgccgggcgcggccctgctcgccgggctcgccctgttcccgcgcaccggcgtcacggccgaggaacgggacaaggaccgggtgagcctcgctccggtcgcggccctgctggcgggcctgctgctcatgggcggcttcctggtggcccgctggggcaacgagccgttcgagcggatccgccccggcgaggtcgcggccatgaactacgtgtacgagcacgacaagccgagcgtgcggctgctgtggctcagcaacgacaccgtcgacaatgtgacgcccgcgatgccgtggggcgcccgggacatggagaaggtggagtacgtgccgacgctcgcgcccagcgatccggtcctcgtgtcgggtctggtcaagtcgctcaaggacgcgggcccgaactcgtatctgatgatcaaccgcagccaggtcacctaccttcagctggacgtgggctattccacgacctgggaatcccggctcgtccgcaacctggacgaccggcaggaactgaagaaggtcctcgtcaacgacgacgtgaccatgtacacgctgcgcaagcagccggcgggcaaggtcccgaagcccgatccggggccgatcggaccgcaggtgacctggactccgtggtccgtcgtcggcggcctggcggccgtggcgctggtgctgatgctgaccgcgcgcgaggtcgtacgggtcgcggtgcggccgggcgtacggcagctgcaatggctccagagcagcttctggttctcgctaccgctgctcgccgtgctgctggcgtcactcgtgcagcggttcatgaccatgaag

SEQ ID NO: 6548 - DNA, 798 bp, Streptomyces avermitilis
  CDS (1)..(798)
atgagggaaccggccgtgccgattctcatgtaccactcgatcgcgacggcgccgaacgacgcgacccgcgccctgtccgtcgcccccgaggcgttcgccgagcagatggcgctgctcggcgacctgaagatcactccggtcagcaccgcgcagctcgccgagagctggcgctcgggcggtccgctgcccgagcgccccgtcctcatcaccttcgacgacggctacgagggagtgcaccggcacgcgctgccggtgctcgccgagcacggtttcgcgtccaccctgttcgtctcgacgggctggatccggggcgcgtacgacaccggtggcggcctggacaccatgctcgactgggaccaggtccgcgaactcgcggacgcgcaggtggagataggcggccacagccacacgcatccgcagctcgacgagatcgacgacgacgctctccggttcgagctgctgcgctgcaaggagatcgtcgccgacgaactgggcgcccgcccggtgtcgttcgcgtacccctacggctactccagccgccgggtgcgcgaggcggtgcgcgaggcgggtttcgctcagtcgctcgccgtcggcaacgcgctggcacgccgccgccagggcccgtacgccctgcggcgcgtcaccgtgcgccgcagtaccggtgtcgaggagttcacgcggctcgtcgagggccgtgcgatcgccctcgacttcgccagggaccgcgccctcaccaaggggtatgccatggtccgcagagcacgacaggtccgccggaaggccatccgttcccgtgtc

SEQ ID NO: 6549 - DNA, 969 bp, Streptomyces avermitilis
  CDS (1)..(969)
gtgatctgcgtctacaccgaggaccgctgggcggacatcctcgcggcggtcgcctcggtgcgggcgcagtcccgcccggcgcgcgagacgctgctggtcgtggatcaccaccagacactgctggaacgattgtcccgggagtacaaggaggttcccgaggtgcgggtgctcgccaacgcgggcccccgcggcctgtccgcgggccgcaacaccgggatcgcggcctcgcacggcgagatcatcgcgttcctggacgacgacgccgtcgccgaacgggactggctgcggcacttcgccgaggggtacgaggacccgcgggtcatggccgtcggcggccgtacgatgcccatctgggcgtcgggccgccgcccggcctggttccccgaggagttcgactgggtggtgggctgcacgtacaagggcctgccgcccggccgcgtgcgggtgcgcaacgtcctcgggggcaacgcctcgttccgccggacggcgttcgacgcggcgggcggtttcgcgacgggcatcgggcgcgacggcgacaagcgtccgctgggctgcgaggagacggagctgtgcatccgcctcacccgggccagaccggacgcgatcctgctgatcgacgaccgtgccgtgatccatcaccgggtgccggagccgcgcgagcacttcgcctacttccgcacccgtacctacgccgagggtctctccaaggccctggtggcgcgaagtgtcggcgccggcaagggactcgagtccgagcgccggtacacgacccgggtcctgcccgccggggtcgcccgcggtctgcgcgacgcggcgctggcccgcccgggcggcgcgggccgtgcgggcgccatcgtcgccggggtgctcacggcggccggcgggtatgtgctcggcagtgtccgggcccgtaggggcggcgccaccttctcggtggtggagcccccggacagcgagggggaagcagca

SEQ ID NO: 6550 - DNA, 816 bp, Streptomyces avermitilis
  CDS (1)..(816)
gtgagctcattcctgcgcccggcggtttcgggccaagatccatttacgaccggtaattaccgggccatctcatctcacctggcgatcacgcctccggtgagtgtcgtgattcccgccatgaacgaggcggagaatcttccctacgtcttcaagtcccttcccgactggatacacgaagtggttctggtcgacggcaattccaccgacggcaccgtcgaggtggcccgcgagctgtggcccgacgtcaaggtcgtcgagcagcggggcaaaggcaagggcgatgcgctgatcaccgggttcgaggcctgcaccggcgacatcatcgtgatggtcgacgcggacggctcggccgacggccaggagatcgtcagctatgtctcggcgctggtgtcgggggccgacttcgcgaagggttcgcggttcgccaacgggggcggcacctccgacatgacgccgatccgcaagctcggcaaccgggtgctgtgcgcggccgtcaacgccaagttcggcgcccgctacaccgatctctgctacggctacaacgcgttctggcggcactgcctggaccagatcgacctcgactgcaccggcttcgaggtcgagaccctgatgaacatccgggtggtcaaggccggtctcaaggtgcaggagataccgagccacgagtacctccgcatccacggcgcgagcaatctgcgggccgtgcgggacgggttgcgggtactcaaggtgatcctcaaggagcgctccaaccggcgcgcgctgcgcagcaggccgcacgccatgcagctcaactcgggtcagggagaggtgtct

SEQ ID NO: 6551 - DNA, 1092 bp, Streptomyces avermitilis
  CDS (1)..(1092)
gtggacatcagcgtgtaccgccccggcgaactgagcgccgccgaccgggcggcctggacggccttgcagtcgaaggcccatctggacggctcgcccgagctggcgaacccgttcctgtcccccgagttcacactcgcggtgggccgctgcagacgcggcgtacgtatcgcggtcgcccgcgaggacggggagcccgccgcgttcttcccgttccagaggacggccaccggcgtgggccgggccgtcggtctcggtgtctccgactgccagggcctcgtgcacagggccggcttcacctgggacgcccaggagctgctccaggcctgcgggctcgccctgtgggagttcgaccacctggtggcaggccaggcgccgttcgaggcgggagccgccggcaccttcccgtccccggtgatggaggtcgaccagggctacgaggcgtatctgcgcggactgcgcgcccggtcgccgaagttcaccaggaccacgctcgccaaggagcgcaagctcggccgggacaccggcggcgtgcgctacgtccacgacgagcgcgatccggccgcgctgcgcacactgatgacctggaagtccgcgcagtaccgcaggaccgggcgcagcgaccgcttcgcgcacgcctggatcacccacctggtgcagcagctcttccactcccgctccgagccgttcgcgggcatcctctcggtgctctacgcggacgacaggccggtcgccgctcacttcggactgcgcagtgagcgggtgctggcgtgctggttcccggcgtacgacccggcgtacgcgaagtactcgcccgggctgatcctgcatctgcgcatggccgaggccgcggcggcggacggcatcgcccatctggatctcggccggggtcagaaggattacaaggattccctcaagacacgggaaatcgccgtgtccgaggggtgggtgacgcgccgtcacccgatcgcgttcgggcacagggcgcatcgcgccccggtccgggcactgcgcaatgcggtgctgtcccggccggagcttttcgagtcggccgacaggatactcaaacggatggggaaaatccgttcgagtcgt

SEQ ID NO: 6552 - DNA, 489 bp, Streptomyces avermitilis
  CDS (1)..(489)
ttgacggccccccgtccgctgcgcgacattgaagcccggcatccggcgcttcggggggcaaagtcgccaatgcagaccatacgcatcaagacaccttcaacagacagcgcacagcggtcggggcagggtccggggagggacctgtcgccgctgctcgcgggcgcagcgaccgcgatcggaggagtcggcgcggtcctcgcgctcgccgacgtggactcacccctgcgcggcccgttcacgctgttcttcctgctcgcggcgccgtccgtcgccatcggcgccgtgctgcgcgggctggaacccttcggtcgcgtcctggtctcggttgcgggagccgtcgccgtcgacatgctggtggcccagggcatgctggccgtgcaccgctggtcggtccacggcggcatcgcggccgtcaccgcgatcagctccctcgttctcctgctggtactcgtacggcggctgcgcggccgtacggcaagaagacgggcc

SEQ ID NO: 6553 - DNA, 1089 bp, Streptomyces avermitilis
  CDS (1)..(1089)
gtgctcgccgccggctcccccaccgcgatcaagggcagctacatcgtcacgctcaagaagggcaccggcttcaaggccgcgtcgagcaagggcaagggcctgatcaacgagtacggcggcacggtgaagaagacgttcggcgccgcgctgaacggctacacggccaacctctccgcgaccgaggccaggagactcgccgccgacccggcggtggccacggtcgagcagaaccagacggtgcacctgaccgacaccacgcagtccagcgccccttggggcctcgaccgcgtcgaccagacctcgctcccgctctccaccacctacacctacccggacacggcgggcagcggtgtgacggcgtacgtcatcgacaccggcgtacgcatcacgcacgcgcagatcagcggccgggcctcgtacggctatgacgccgtggacggcgacaccaccgcctccgacggcaacggccacggcacccatgtggccaccaccatcgcgggctcgacctacggcgtcgccaagaaggcgaagatcgtggcggtccgggtgctcgacgacgccggctccggcaccaccgcgggcgtgatcgcgggcatcgactgggtgaccaacaaccacagcggcccctccgtcgccaacctctcgctcggcggcggcgcctccacctcgctggacacggcggtgtcgaactccatcgccagcggtgtgacctacgcggtcgcggcgggcaacagcagcgccaacgcctcctcgtactcccccgcccgggtcgccgcggcgatcacggtcggcgccaccaccagcaccgacgccaaggccagctactccaactacggctcggtcctggacatcttcgcgcccggctcctcgatcacggcgggctggaacaccagcgacacggccacgaacaccatctccggtacgtcgatggcgaccccgcacgtcgcgggcgcggccgccgtctatctggccggccacacctcggccaccccggcacaggtcgcctcggccctgaccggcggcgccaccaccggcaaggtcaccagcgcgggcaccggatcgccgaacaggctcctgaagatcgtcccg

SEQ ID NO: 6554 - DNA, 807 bp, Streptomyces avermitilis
  CDS (1)..(807)
atgagacgttcccgaattacggcatacgtgacctcactcctcctcgccgtcggctgcgccctcaccggggcagcgacggcgcaggcgtccccagccgccgcggccacgggctatgtggccctcggcgactcgtactcgtccggtgtcggcgccggcagctacctcagctccagcggcgactgcaagcgcagttcgaaggcctatccgtacctctggcaggccgcgcattcaccctcgtcgttcagtttcatggcttgctcgggcgctcgtacgggtgatgtcctggccaatcagctcggcaccctgaactcgtccaccggcctggtctccctcaccatcggaggcaacgacgcgggcttctccgacgtcatgacgacctgtgtgctccagtccgacagcgcctgcctctcccgcatcaacacggcgaaggcgtacgtcgactccaccctgcccggccaactcgacagcgtgtacacggcgatcagcacgaaggccccgtcggcccatgtggccgtgctgggctacccccgcttctacaaactgggcggctcctgcctcgcgggcctctcggagaccaagcggtccgccatcaacgacgcggccgactatctgaacagcgccatcgccaagcgcgccgccgaccacggcttcaccttcggcgacgtcaagagcaccttcaccggccatgagatctgctccagcagcacctggctgcacagtctcgacctgctgaacatcggccagtcctaccacccgaccgcggccggccagtccggcggctatctgccggtcatgaacagcgtggcc

SEQ ID NO: 6555 - DNA, 1650 bp, Streptomyces avermitilis
  CDS (1)..(1650)
gtggagcaatcgcgcggatgcgatggggggacgcccgtgtccgaagaaccgggcagtgaacgtgtgatcgcgggacgctaccgcctgctgtcccccctcggcgagggcggcatgggcaccgtgtggcgcgcccacgacgaggtcctgcaccgcgaggtcgcggtcaaggaggtgcgcgccccggcggggctcccggccgccgagatcgagcggatgtacacccggctggagcgtgaggcgtgggccgccgcccgcgtcgcgaaccggaacgtcgtgacggtctacgacgtcgcccacgaggacggccgcccctggatcgtcatggagttgatccgcgggatcgcgctgtccgacctgctggacgccgagggcccgctctcgccgcagcgggccgcgcacatcggcgccgaggtgctcgccgccctgcgcgccgcgcacacggcgggggtgctgcaccgcgacgtcaagccgggcaacgtcctgatggcgaacgacggccgggtggtgctcaccgacttcggcatcgccacggtcgagggcagctcggcgctgaccatgaccggcgaggtcatcggctcgcccgagttcctcgcccccgagcgggcactggggcgtacgccgggacccgagtccgacctgtggtcgctcggcgtcctgctctacgcggccgtggagggcaactctccgttccgccacgacaccccgctgagcacgctccgcgcggtcgtggacgaggagttgccgccgccgttccgggcgggcccgctggccccggtcatcgaggggctgctgcgcaaggacccggcggaccgcgtccccgccgaacaggccgagcaggacctgcggctgatcggcgcgggcggcaccccgcgcaccggcacgtcggcctactcgcccacggtcaccgccttcccgggcccgtcggacactcctccgcgcccggtccccgcctcggcagccacacggccctcggcggcgcgcgcggaggcggcctcccccgaacccgcccgcaaccgacgcgcggccgtcgccgtcatcgcgggactggccgcgctggccctcgccctggcgggactgacgtacgccctgctgacccgtgacaacggcggcggcacggcaggcacgacgagcagcagctcgaacgggagtgccggaggcgggagttcgaaaacccccgaggacgacaacgccgacggcgggggcgaccacagctcgggctccactccgggaggcggcggtggcggcggcggtacgacgaccccgccggcccagtccgtgaaggtgacggtcaccggcgtgcacaccgactactccggtgcctgcccgccgcccaccgcccaggcgcccacgttcacggcgaccttcacggtgggccgggtgccggtcgaggtggagtaccgctgggtgaccaagaagggcgaggtcccggatccgggctggaagacgctgtccttcccggcgagcggcggaaagacccagcagaagcaggtgttcgtcaccacgtacgacacgagcggaacgatctcgaacgagatcgccgtcgaggtgcgcgacccggtgcgcacgacgtccaactccgtgccgttctcggtgacctgtgcgacggagaccccgacggacggggcctccgcttccggttcaccttcgcct

SEQ ID NO: 6556 - DNA, 1722 bp, Streptomyces avermitilis
  CDS (1)..(1722)
gtgaacccccgccgcgcgttcgcctcctgcgccgccgtactcacggccgcctgcgccctcgtcctcgtcccgtccgggccggcgagcgcgcatccgctcggcaacttcaccgtcaaccggtacgacggtctcgtcgccgccccaggacagctccgggtcgaccacgtcgaagacctcgcggagatcccggcgacccaggccaagccggagatcaagaagctcggcatgaccgactgggcgcggcagcggtgcgagacggccgcgcacgacagcaaggtgaccgtcggcggccgccaggtcgcgctctccgccggcaccagccacgcgcgcgtgcggcccggccaggcggggctgaacaccctacgggtggagtgccggctgacggcacccctgcccaagggcgactcggtcaccctcggcttccacagcgcgggcgccacgtccggccccggctggcgggagatcaccgcgcgcggcgaccgtatgacgctcaccgcgtcggacgtaccgaagaagtcggtgtcacaggaactgaccagctaccccaagcagttgctgtcgtccccggccgacaccgcggccgcgtccctgcgggtacgccccggcggccccgcgctcgtcgaggagcagcgggacgcacccgccgcctccgtgctcccgcgcggcgccgaccgctggacccgggcgctggacggtctggtggcccgccacgatctgacggccggcttcgccgcgctggcgctgctcatcgcggtcggcctcggcgcgctgcacgcgctcgcgccggggcacggcaagacgctgatggccgcgacggcggcggcccgcggcggccgcgccacgcttcgggacgtcctgccgctggccgcgtcggtgacggtcacccacaccttgggcgtggtggcccttggcctcctggtcaccgccggttcggcggccgcgccctcggtgatcgcctggctgggcatcgcgagcggggttctggtgacgacggcgggcatgaccctcgtacgacgggcttggcggaaccgggtgcctgcgcacggccacgaccacgggcacaagcacgaccacagccacgaccacgaccacagccacgaccacggcgatcacgtgcatcacgatcacgcggaccacagggaacacgcgcacgagcggcccctggtcctcgcacacgcgcacggcgagacccacgcgcacgacgcaccccacacccacccgcacgaccagaaccacaaccacagcaacagccacaagcacaacgagaaccacggccacggccacggccacaagcacgaccacgaccacgaccacaagcacccccactcccccaccctcgaacacacccacggcggcttcacccacacccacgagatcgcccccaccctccgcggcacgatcctgctcggcttcgccggcgggctggtgcccagcccctcggccgtcgtcgtcctggtgggcgccgcggcgctggggaaggcgtggttcgggctgctgctcgtcgtggcatacggcgtcggactcgccctcacactgaccgcggccgggttcgccgtggtcaagctgggcagcgggatgacacgtgtgctgaaccggcgtccccgctggaccgacgggccgatggccgcgctggtgcgcaggaccgtgcccctggggtccgcgttcgtcgtcgtagctctcggggccggattggtgctcaagggggcggcatccgcactcggg

SEQ ID NO: 6557 - DNA, 2010 bp, Streptomyces avermitilis
  CDS (1)..(2010)
gtgcgggccgcgccgctcatccgccacaacgaccgtttccctcaaggacatcgaggagagggcatgtccccgcgtacgaacgacagcgcgccggagagcgacggcggcgagcagccgcccgccgggccggaggccgggaccgccgagaccggcacaccggcttcggcgaccggtacggccggggccatgcccgaggaatccgcggggggcgccacgaccgaggaaccctcggtgggcgccacgaccgagaagccctcggcgggcgccacgaccgaggacccctcggcgggcgctacgaccgaggaatcgcccgccgacgccgtggctcagcaatccgcggccgccgccccggccgaggagtccgcagcggcggctacggccaaggagtcaccggccgacgccagggccgaggagcccgcagcgggagctgcggtcaaggaaccgccgaccggcgccgcgcccgagaagcccgccggcgccacggccaagaagtccccggccgacaccacggccgaagagcccgcagcgggaactacggccaaggagctccaggccggtgccgtggcccaggaggccccggcgcaggaggccgtggcgccgaaggccctggcgcaggccccggggtccggggccgatggcgtgcgcgacgagcgtgtcgccgccgtccgccggctgtccgtgtccgggcgtcgttggcgcgcggcccaactcggcttctgtgcggccgcgttggcggtcgcactcaccgccggggccgtggtgctcggcgccgtccgggacggcggaaccgccaatgccgccgccgcgccggtcgccgtgtccccgcaactgctcgccagtggcgacctggacgcgagcatcacctccctccaggctcacctccgggcccagcccaaggacttcggcggctgggcgacgctcggcctcgcgtacatcgagcaggcccgcaccaagggcgacccctcccgctacccgcaggcgcagcgcgcactggaccgctccctgcgactgcggcccgacaacgacccggcgctcgccggacgcgccgccctcgccgccgcccggcacgacttccacggcgccctgacctacgcggaccgggcgctgaagcagaacccgtacagcgagcgcgccctgtcctcccgtatcgacgccctcgtcgaactcggccgctacgacgacgcgtcgaaggccgccgacgtggccgaccaacggcgccccggcgtcccggtcttcacgcggtacgcctacgtccgggaactgcggggggacgtgaaaaccgcccgccgcgtcctggagcaggcgctgagcaccgccacgagccgcggcgacatctcgtacgtcgcgtcggcgctgggccaactcgcctggaaccagggtgagtacaaggcggccctcacctactacgcgcgcgccctcgccgccgacgacagctacctcccggctctcgagggccgggcccgcgcccaggccgcgcagggcgacagcgcagcggcgatccgcggtatggagcaggtcgtggagcgcttcccgctgccccaaccactggtggaactgggtgagttgtacgaggcgcgcggcaagaagggcaatccgcagaaggcccgcgaccagtacgcgctggtcgacgcctgggtcgcgctggcccgcgccaacggcgtcaacgccgacctcgacacggccctggccgccgccgaccacggtgacgccaaggccgcgctgaaggcggcccgcgccgaatgggcccgccgccacaccgtgcacaccgcggacgcgctcgcctgggccctgcacgtcaacggccgcgacaaggacgccctgccgtacgcccgtcgggccaccgccacgggctaccacaacgcgtccttcctctaccaccgcggcatcatcgagcgcgccgccggcgacgcgaaggacgcccgcgcctccctgaagtcggccctcgacctgaacccgggcttctcaccgctcggcgcccgcgaggcccgcacggcactgggggcggcgaag

SEQ ID NO: 6558 - DNA, 1518 bp, Streptomyces avermitilis
  CDS (1)..(1518)
atgacacctatctccaggagcggtgcgggacgcaggagccttgcgaccctcataagtggtgcgctggccgccggggggctcgcggccgccggcgtcaccgcgctggaaccgggggcggcctccgcctccagtcaccgggaggccccgctgatctcgggcactccccagtacgacaacaccgacgtgtacgcgttcgtgagcccggacaagccggacacgacgacggtcatcgcgaactggatcccgttcgaggatccggcgggcggtccgaacttctacacgttcgcggaggacgcccagtacgacatccacatcgacaacaacggtgacgcccagggcgagttgatctaccgctacacgttcaagacgcaccgcaagaacggcgacacgttcctgtacaacacgggtccggtggacagcctcgacgaccccgacctgaacatcacgcagacgtacgacatcgatctgctcaggctgcacgaccagaagctggtctcccgcacgaaggtcgcggacgacatccccgtggcgccgtcgaacgtcggcaaggcgtcgatgccggactacaccaagctgcgcaaccaggccgtgtacaagctcgcgggcgactccacgacgttcgccggccaggcggacgacccgttcttcctggatctgcgggtcttcgacctgctgtacggcggagacctgtcggaggtcgggcgcgacaccctcaagggctacaacgtcaactcgatcgcccttcagctgccgaccgacatgatcaccgagtcgaaggaccagccgatcgtcggcatctggtccacgacccagcgcaaggacgcccgcggtcactacacgcaggtctcgcgcctcggcaacccgctggtcaacgaggtcgtcaacccgcagaaggacaaggacaagttcaacgcgtcctcgccctgggaggacgcgcagttcctgaagaacgtgaccaacccggagctgccgaagctcatcgaggcgatctacaagatcaaggcgcccgccgagccgcgcaacgacctggtcgacgtgttcctgaagggcgtgaagggcctcaaccagccgccgcacgtgacaccggccgaggaactgcggctcaacacctcgatcgagcccaccgccaagcccaagcggctcggtgtgctcgacggcgacaacgcgggcttcccgaacggacgccggctcaccgacgacgtgatcgacgaggcgctccaggtcgtggagggcgaactggtcggctccaagaacgacttgggtgacgcggtcaacaagaacgacaagaagttcgagcactccttcccgtacgtggccgagccgacggccggttcgcgcgggaagaccgccggcggcaccggcaacagcgtgcgcaaccagctgggcgacggtctgatcgcgaacgccacggacggttccaacaccacgctgatcgcggcctccgcggcggcgggcgcggccgggttcctgctgatcgccaccggtctggcgtggtggcgtcggcgcaaccgggcgtac

SEQ ID NO: 6559 - DNA, 546 bp, Streptomyces avermitilis
  CDS (1)..(546)
gtgctggtgcatgcggacgagctcctggtgctcgtggccgaaggtgaccaacgggcattcgaagagctgtacggactggtgtccgggccggtgttcggtctggtgcgccgggtcgtgcgggatccggcgcagtcggaggaggtggctcaggaggtgctgctcgaactgtggcgctccgccgcccgcttcgaccccggccggggcagcgccctctcctggatcctcaccctcgcgcaccgccgcgcggtcgaccgggtgcgcagcgcccgcgcggccggcgaacgcgagcagcgcgaggcgctccgcgcccaccaccccgccttcgaccaggtcgccgaggaagtcgaggccggcctcgaacgcgagtgggtacgccgctgcctggaccgcctgaccgccctgcaacgccagtccgtcaccctcgcctactacgacggctacacgtaccgtgaagtggccgagcggctctcgctgcccctcggcacggtcaagacgcgaatgcgcgacggactcacgcggctgcgcaactgcctgggaggagccgca

SEQ ID NO: 6560 - DNA, 813 bp, Streptomyces avermitilis
  CDS (1)..(813)
atgagcgccctcgaccgtctgctgcgccgcgatctgcactcgcttgccgcgccctacgccctcgacgccctcgagcccgacgaacgccgtcgcttcgagagacacctcaagggctgcgaccgctgtgcggcggaggtgcgggacctgtacgaggacgcggtgcggctcgcctggtccacggcggccccgccgccggcggcgctgcgggaccgggtcctcagcgccgtacgcagcacaccccaggaagctccccagggtgcgtcgcgtgcgcgggagccgcatctgccggcccatgtctggggaaccgcgccgcccccggcacgcgcccgcgcccgccgcacgcgccccctcttcgtcccgctcgccaccgccacggccgccgccgccctcgtcgtggcgtcactgttcgccgtgcaggccggccgaacccaggaccaactcgccgagcagcaggcccaggcacgtgagatcgcccacgttctggccgctcccgacgcccgggcgaccagtgaccgggacgcgaagggccgtggtatcggagtgatcgcctccgcatctgaggggcgcgcggtcgtcaccctgagcgggttccgggcgccgtccggcggccgcgtgcatcagctgtggctcatgcgccccaacggccaaccgcgctccctcgggctcttcgacggcgacgcgcccttggtcgcgagcgggctgaacaccaaggcgacgtcacttgctgtgaccgtcgagcccgacggaggctcagcgcagcccaccagccagccagttgtccaactcgccctggaatcggtcggattcggagag

SEQ ID NO: 6561 - DNA, 267 bp, Streptomyces avermitilis
  CDS (1)..(267)
atggaacagataacagtgcgcagcagggcacgggtccctgcgatcacctgcgggagcagcgcgaccagctcgcgcctcgaccgccatctcgcagtgctgggcggccccgccatcccgcagcgcgagacggccgaggccacgtcgctgatgcgtgagctcaccgcgcgtgacaccgcgcacgaccgcagcggcaggggcgcgcgagtgaggcgagtctcgctcttcgcaccactgcgccgactgcgccgttcgctgttcggcgggcgc

SEQ ID NO: 6562 - DNA, 1185 bp, Streptomyces avermitilis
  CDS (1)..(1185)
atgcccagcgtgacgcacgacgacgctccgctgctcgcggacctcatgccgtggtcggtcgcacctctgcggctgggccgtggctggccgatggcgcccgacgtggcctcgctgaaggcgcgctgggacgccctgctgaaggccgaggggccggaccgcgaggccttgttcgagccgacccgcgcacgcaccctgcactccgcggtggcccagctgccgggccagtccagcgggacggggcggctcgcccgtgcgacgggcccgtgcccggagcccgtgcgtgtgctcggcgacccgttcgacgaacagtggctgatcccggaccaccggctcctcgacgcggcacggcccgagctgtggcgggtggcggacgagggccaggtgttcgtggccgagcagacggtcgcgcccgggtccaccggccccctgctgctggcttcgccgctgctgccggtgaagtcgccggccgtccgctcaggtcccgtccgcccgctgtaccggcgcccgggacgtctcgaaccgaacctggcaccgggcctggtggagcatctcgccggacgcctgggccgccccgtgtcacccgtcgacgccctggcctggattctggcggccgcgcggccgggccccgagggcatcgaggtgccgctcaccgcggaccccggcctctggtcccggggcacggagtcgggccaccggacgctgtggctgatgtgccgcaccggcgagcgccccaagctgccgggcgggcgccgcccctacgtccgcgctccgctccccgcccgccccctggaactcctctacgaccgcgcggaggaggccctgcacatcggcgagggccggatctcaccggtgccgggcggcgcctgggatttccacgtcggcggggtccgggtcctcgaggcgtggttcgcccgccgcacggagcccgccgagccgggcacgctggaggcggtgcgccccgcggcctggccgcaggcgtggacgtccgaactgctggaactcatcaccgtgctcgccctgctgggcgagatcggcccgcgccacggcgagtcggcggcgggggcaccggtcaccgcggccgagctgtaccgggccggtgtgctcccggtaccggatgcggcacgtcggcccgcttcggtgctcgaccaccacgaagagggtccggaaggccagttcgcgctgatc

SEQ ID NO: 6563 - DNA, 747 bp, Streptomyces avermitilis
  CDS (1)..(747)
gtgacctctttcgccccggactcgatcgttctgaaccgcaaactgccgctctggtatcaggtatcgcagtccctgcgcgcctcgatactcggccggtcgccccaggacccgctgcgcctgccgaccgaggaacagttggcggggcactacggagtgagcgtgctgaccatgcggcaggcgctcaaggagctggaggacgaggggctgatcacccgccatcgccgacggggcacgttcatcgagccgggcgtccagcggggcgccccggtgcggctgctcggctcggtggacgcgatcgtggcgcagcagtcgggcatggtggcggagctgctggagcacggcagatcacccgtttcgggggaactcgccgagtatttcccggatgtggacgaggtggcgacgtaccaccggctgcgcgccgacgagcggaccggcgagccgacgaaccacgcccgcaactacgtgcggcccgaactggccgagcgcatcggcctggacgacctggcccgctggccgatgaccaaggtgctgcgggacgtcgtgggcgtacgcatcggccgtatcaccgacaccgtggaggcgcggctggcggatccggagacggcgcggctgctccaagtgccgctgctcagcccgatcctgcactacacgggcgtgacgtacgacgaggacggacaggtcctggacgtggcggtcatccactaccgcggcgaccgcttctcgttcacggtcaccctcgacgccgac

SEQ ID NO: 6564 - DNA, 1314 bp, Streptomyces avermitilis
  CDS (1)..(1314)
atgagcggggacgcacggaagaccgccgaaggactggcccatctcaccgggttcggcaacgaacacgcctcggaagcggtccccggcgccctccccgagggccgcaactccccgcagcgcgccccgctcggcctgtacgcggagcagctcagcggctcggcgttcaccgagcccagggcacacaaccggcgctcgtggctgtaccggatccgcccctcggccgcgcaccccccgttcacccgcgcggacaacggcgcgatccgcaccgcccccttcacggagacggcgcccgacccgaaccggctgcgctggaacccgctgcccgagccccccgccgggacggacttcgtcggcggcctgtggaccctcggcggcaacggcgacgccacccagcgcaccggcatggccgtgcacctgtatcacgccaactcctcgatggaccgcgtcttcagcgacgccgacggggagctgctgatcgtgccggagcgcggcggactgctcctgcgcaccgagttcgggctgctgcacgcggagccgggccaggtcgcgctggtcccccgcggcgtccgcttccgcgtggacctcctcgacgagtccgcccggggctacgtctgcgagaactacggcgcccccttccagctccccgacctcggcccgatcggcgccaacggactcgcggccgcccgggacttcaaggctcccgtggccgcgtacgaggacgtcgagggccccgtcgaggtggtgaacaagttctgcggcaacctctggacggcgacatacgaccactcgcccctggatgtggtcgcctggcacggcaaccacgtgccgtacacctacgacctgcgccgtttcaatgtgctgggcaccatcagctacgaccacccggacccgtcgatcttcacggtgctgacctcaccgtccgacaccccggggctcgccggcgtcgacttcgtggtgttcgcgccgcgctggctggtgggtgaggacacgttccggccgccgtacttccaccggaacgtgatgagcgagtacatggggctcatcgagggcgcctacgacgccaaggcggccggtttcgttcccggtggggggtcgctgcacaacatgatgtcggcgcacgggcccgaccgggagaccttcgaccgggcgagcgccgccgagctgcggccgcagaagatcgacgacggtctcgcgttcatgttcgagacgcgctggccggtgaccgcgacggcccaggcggcccgcgccgagcacctccaacccgcgtacgacgacgtgtggcaggggctccagcgccacttccgtccgtcggac

SEQ ID NO: 6565 - DNA, 663 bp, Streptomyces avermitilis
  CDS (1)..(663)
atgtcgtggacgcgcggaccgctcgcggcgctcgcggtgtgcgccctgctcggcggcgcggcgggctgtggcgccgacggcgcgcacgggcggcggggcggggcgacggcctcgccggtgggcaagctgctggacgacacggacgagaggggacggcactaccgtgaagtcgacgagaagggcgcacccgaggtctccgtcgaggtccagccggactccgacgacagctgggacgtcctgctgaccgtccacaacttccgcttctcgccgcccggcgcgcgagcggtgccggtggccggacgcggtgtcgccctgctctcgctggacggccgcgccctcgcgcggctgcgcaccccggaccatcacctccccggcaagctggtcccgcgcggcacgcatcacgtcacggtgcgtctgtacgcggacgacggcacggtgtgggccgtggacggccggcccgtccagagcacggcggacatcacggcgtcggggacggggccgacgaggccgcactcgacgccgagcggggccgggggcggggcggagggggcgagcgggacgcccacccagggcaccggcgactccgcggccgggatgagtgtggggcgcacccatctccgtacagacgggcgaggttcaccggactcccgcggaaaggcatca

SEQ ID NO: 6566 - DNA, 618 bp, Streptomyces avermitilis
  CDS (1)..(618)
atgaagcccgtgccccaagcgacatcgctgcgccgcgcgcccgtccaacgacggagcgccgaacggctgaccaggatcctcgacgcctgcgccgacctcctcgacgaggtcggctacgacgccctgagcacccgggccgtggccctgcgtgccggcgtgcccatcggctccgtgtaccgcttcttcggcaacaagcgcgcgatggccgacgcgctcgccgaacgcaacttcgagcgctacaccgaccgcgtcacccaccgcctcgagcagtcggacggcgagggtgactggcgcgcggcgatggacgcggtcctcgacgagtacctggacatgaagcgcacggcgcccggcttctccctcgtcgacttcggcaaccagatcccggtcggcgcccgctacgccgaacccaaccaccgcgtcgccgaccgtctgacggaactcctgtcggcgtacctcggccgcacccccgacgacgacctccgccgcacgttcctgatcgcggtcgaaaccgccgacaccctggtccacctggccttccggatgtcccccgagggagacgaggacatcatcgcggagacccgggcactgctgagggcctatctggggcgcgtactggac

SEQ ID NO: 6567 - DNA, 2229 bp, Streptomyces avermitilis
  CDS (1)..(2229)
gtgtcccgcaccgccctgcgtatctgccccttgtgcgaggccacctgcgggctgacgctcaccatcgaggggacccgggtgaccaaggcccgcggcgaccgcgacgacgtgttcagcaaggggttcatctgcccgaagggcgcgtccttcggggcggccgacggagacccggaccggctgcggacgccgctcgtccgcgaggacggggagctgcgcgaggccacctgggaggaggcgttcgacgccgtcgccgccggactgcggcccgtcgtcgaggagcacggaccgcacgccgtcggtgtcgtcctcggcaacccgaacgtccacaccatggccggcgccctctacccgcccgtcctgctcgccggtctgcgcacccacagcctcttcaccgcctccaccgtcgaccagatgcccaagcacgtctccagcggtctgctgtacggcgacgcggtggccatccccgtgcccgacctcgaccgcaccgaccatctgctgctgctcggcgccaaccccctcgaatccaacggaagtctctgcaccgcccccgacttccccggcaagctcaaggccctcaaggcccgcggcggcaccctcaccgtcgtcgacccgcgccgcacccgcaccgccaagctcgccgaccggcacgtcgccatccgccccggcaccgacgcactgctgctcgcggcgatggcgtacgtgctcttcgaggagcggctcgtcgacctcggggagctcgccccgcatgtccagggcgtcgacgaactcgccgacgcgctgagggacttcacccccgaagcggcgagcccgtcgtgcgacgtaccggccgacgtgatccgggagctcgcccgtgaactggccgccgccccgaccgccgccgtctacggccgcatcggcagctgcaccgtcccgcacggcacgctcgccagctggctcgtcgacgtgctcaacatcctcaccggcaacctcgaccggcccggcggcgccctgttcccgctgtccgccaccgacaaggcgccccggcccgccggacccggccgtggcttcgcgctcgggcggtggcacagccgggtgagcggacacccggaggccaagggcgagctgccgctgtccgcgctcgccgaggagatcgacaccgccaccggcgagggcagcccggtccgcgccctcatcgcagtcgccaccaacccggtactctccgcgcccgacggcgaccgcctcgacaaggccctcggctcgctcgacttcatggtcagtgtcgacccgtacctcaacgagacctcgcgccacgcccatgtcgtcctgccgccgcccccgccctcccaggcgccgcacttcgacttcgcgttcaacgccttcgccgtgcacaaccaggtccgctacacccgcgccgccgtccccctggaacccggccggatggcggagaccgagatcctcgcacggctcgtgctcgccgccacgggcatgcacggcgccgcccccgacgccgtggacgccctggtcatcgaccagacactgggcaaggccgtcacggacccgcacgcgcccgtgcacggccgcgacccgggcgaactcgccgccgtgctcaccggggacagcggccccgagcggcggctcgacatgatgctgcgcctcggcccgtacggcgacggattcggcgcccggccggacgggctcaccctggagaaggtgctcgcccacccgcacggcatcgacctcgggccgctcacgccgcgcctgccgcagcccctgaagacacgcagcggcaaggtcgagctgctgcccggacccatcgccggcgacctgccgaggctgcgcgaggcgctgcgggagcggtccgaggggctcgtgctcatcgggcggcggcatctgcggtccaacaacagctggctgcacaacgtgcccgccctcaccggcggcaccaaccgctgcaccctgcacatccaccccgaggacgccgagcgcctcggcctcaccgacggggcgccggtccgggtcaggggcgccgggggagcggtcacggcccccgtcgaggtcaccgacggcatccggcgcggggtcgtcagcctcccgcacggctggggccacgaccggcccggcacccggatgagccatgccgcgctggaccccggcgtcaacgtcaaccagctcctcgatggcagcctgctcgacccgctctcgggcaacgccgtgctcaacggcgtacccgtcgagctgacacgcacatcc

SEQ ID NO: 6568 - DNA, 1404 bp, Streptomyces avermitilis
  CDS (1)..(1404)
atgctgaccatcctcggcttcaccatgatcgcgaccttcttggtcctgatcatgctgaagaagatgtcgccgatcgcggcgctcgtgctgatcccggcgctcttctgcgtcttcgtcggaaagggcgccaagctcggtgactacgtcatcgacggcgtcaccagcctcgcgcccaccgcggcgatgctgatgttcgcgatcgtctacttcggtgtgatgatcgacgtcggcctcttcgacccgatcgtgcggggcatcctgcggttctgcaaggcggacccgctgcggatcgtcgtcggcacggccctgctcgccgcgatcgtctcgctcgacggcgacggctcgaccaccttcatgatcacggtctcggcgatgtacccgctgtacaagcgcctgaagatgagcctcgtcgtgatgaccggtgtcgccgcgatggccaacggcgtgatgaacacgctcccctggggcggcccgaccgcccgcgccgcgaccgcgctgaagctggacgccagcgacatcttcgtgccgatgattccggccctcgccgtgggtctcctcggtgtcttcgccctcgcctacgtcctcgggcgccgcgagcgcacgcggctcggcgtgctgacgctggacgaggcactggagccgcaggaggccgagacggtgctggtgggtgcgggcggttccgaggagaagtccccgcgcgccaccggcggttccggctccggcaccgacgcggacgcccccgagtccgccaccgccgacgacggattccagggcctcgacccccaccgcgccaccctgcgccccaagttgtactggttcaacgcgctgctcacggtcacgctactcaccgccatgatcatggagtggctgccgatcccggtcctgttcctgctcggcgccgcgctcgcgctcaccgtcaacttcccgcacatgcccgaccagaaggcccgcctcggcgcccacgccgagaacgtcctcaacgtctccggaatggtcttcgccgccgccgtcttcaccggcgtcctccagggcaccggcatggtcgaccacatggccgagtggctggtctccaacatcccggacggcatgggcccgcacatggccttcgtcaccggtgtcctgagcatcccgctcacgtacttcatgtcgaacgacggcttctacttcggcatcctcccggtcctcgccgaggcgggccaggcgcacggcgtctcgtccctggagatcgcccgcgcttcgctggtcggccagccgctgcacatgtcgagcccgctggtgcccgccgtgtacgtcctcgtcggcatggccaaggtcgagttcggcgaccacacgaggttcgtggtcaagtgggccgcgctcacctcgctggtggtgctcggggccgggatcctcttcggcatcatc

SEQ ID NO: 6569 - DNA, 1158 bp, Streptomyces avermitilis
  CDS (1)..(1158)
atggcgcggcccgccgtctcctaccgggccctcgcgctgggcgccgacgagcgcgcggtcggtgtgatcgcgggcgtgtacgcgctgcttccgctgttcgccgccgtgccgctcggccgccgtacggaccacggccggtgtgcgcccctgctgccgctgggcgttgtcctgatcgcgggcggctgtgccctgagcggcgcggccgactccctcgccgcgatggccgcctggagcggggtgatgggtctcggccacctctgcttcgtcatcggcgcgcagtcgatcgtcgcccgccagtccgcgccccacgaacaggaccgcaacttcggccacttcacgatcggcgcctcgctcggccagctgatcggcccggtcgtcgcgggtgccctgatcggcggcccggaccgggcgggcagcagcgcgctggcgctgctggtggcgggcgcggtcgccgcggtgtcctgcgcgtcgctgtggcgcatcgaacaccgtacgacggccaactcccgtaccgagcgcggcgatcgcatccccgtccaccgcatcctgcgtacccggggggtgcccgcgggcatcttcgtcagcctcgccgtgctgtcggcgacggacatcctcaccgcgtatcttccggtggtcggtgaacaccggggcatcgctccgtcggtggtcggtctgctgctgagcctgcgcgccgcggcgaccatcgcctgccggctggtgatgacaccgatgctgcggtggctgggccgggccgccctgctcaccgtgacctgtctcgcggcggcgctgctgtgcgcgggcatcgcgctcccggtgccggtgtgggcgctggccgtgatgctcgcggcgctcgggttctgcctcggcgtcgggcagccgctgtccatgacgaccgtggtgcaggcagcgccggacgacgcgcgctccaccgccctcgcgctgcgcctgaccggcaaccggctcggccaggtcgccgcgcccgccgcggccggtctgatcgccggagtcgcgggcgtggcggcgccgttcgtgatgctcggcgcgctgctgctgatctcctcgggaatcgcgctgcgcgcgccggggaagcaggtggtgcgacagcggaccggtggcccgcggcggtccggtgcgccattgggccggacgagggattcc

SEQ ID NO: 6570 - DNA, 759 bp, Streptomyces avermitilis
  CDS (1)..(759)
atgaccacctcgccactctcccgccgcgccggagcagcccgcaccggtgccgccgccgccctggcggttctcgccaccgccacgaccgcctcgatcggggcgccggtcgccttcgccgccccgggggacgaaggcgaactcaggatccacagagtgggtgcgcccctgggcgtgcccaaggacgactccaaggtctgccggttctacctcgacgcgaccaacttcgacggggcgacgaccgtcacctacaccatcgaggcgcagccgccgctgcccaacaccgcgacgctcaccggcgccatcatcctcgcggcgggtgtcggccgcacggaacccctcgccctgcccgacgggcagtacaagctgacctggcccgtccccccgagcgccaccgccccccagaaggagaagatcttccgggtcgactgccgcgaagagaacgagcacggcgaaaaggagtacaacggcgcgtcgggcccgcagggcggcggctaccagggcggcgacagccagggcggcgccggccagggcggcgacagctcctcgcagggcggcggacacgagagccagggcggcgggaacagctcctcgcagggcggcgaggacggcccgaagggcggcgtccacgcgggcggcggcgggctcgccgacatgaccgaggcggtctcgccggtcgccgcgacggcggccgtcgggctggtcgtggccggaggcgtcacgtacttccggctgatccgccgtcggccccatggcgccgcg

SEQ ID NO: 6571 - DNA, 729 bp, Streptomyces avermitilis
  CDS (1)..(729)
atggcgccgcgtaggcggctccgcaggccctggtaccggactcgcgcctaccgcctcaccaggacggccgcgctcgtggccgtcctggtgacggtgggcaaccggtgcggacaggacgacgagccgggcgggccggccgtcctcgccgggcccgagcggcccgcggtggcggccgacgccgccggccccggcaccgacgcgcgcggtcccgggaccggagcggagcggaccggccggtcggcccggtccgctccgccgcccaccccgctgccgcgctcccgggccaccgtgctgcgcatcccgcatctgggcatcgaggcgccggtcatcggcctccggctcgaccgtgaccggcagctcgccacgccgccggtggacaaacccaagctcgtaggctggtacgagggcggaccggcgccgggcgagaagggcacggccgtcgtcgtcggccaccgcgacaccaggaccggccccgccgtcttcgccgcgctcggccaactgccgccgggacggctggtcgaggcccggcgcgcggacggacgcaccgccgtctacaccgtggaccgggtgcagacgtacgagaagtcgcactttcccgacaaggaggtgtacggcaccaggaagcgccccgagctgcgtctgatcacctgcggcggcacgtacgaccgcaagaagggctacgccagcaacatcgtggtcttcgcccacctcacggcgacccggaagggc

SEQ ID NO: 6572 - DNA, 1386 bp, Streptomyces avermitilis
  CDS (1)..(1386)
atgaaggcacaggacggcatgtacatcgacggcgcctggcggcccgccgcggggccggacatgatcgaggtcgtgaacccggccgacgagcaggtgatcggccgggtgccggcgggcactcccgaggacgtggacgcggccgtacgtgccgcgcgtgccgccctgaccgcctgggccgcgaccccgcccgccgagcgggccgcgcggatctccgccctccgggacgtcctggtggcccgccaggacgagatcgccgagaccgtcacggccgaactcggctcaccgctgtcgttctcgcagagcgtgcaggtgggcctgccgatcctggtcgcgggttcgtacgccgaactcgcggcgacgtacgccttcgaggagagggtgggcaactcgaccgtccaccacgagccggtcggcgtggtcggcgccatcaccccctggaactaccccctgcaccagatcgtcgccaaggtcgccccggcactcgcggcgggctgcacgatcgtactgaagcccgccgaggacaccccgctgaccgcccagctcttcgcggaggcggtccacgaggccggtgtcccggcgggtgtgttcaacctcgtcaccggcctcggcccggtcgcgggacaggcgctcgccgagcacgaggacgtcgacctggtctcgttcaccggctcgacggcggtcggcaggcagatcggtgccacggccggtgcggccgtcaagcgggtcgccctcgaactcggcggcaagtccgccaacgtcatcctgccgagcgccgacctcgccaaggcggtgaacgtgggcgtcgccaacgtgatggccaactccggccagacgtgcagcgcctggacgcgcatgctggtgcacgcggagcggtacgaggaggcggtcgagctggccgcggccgccgcggtgaagtacgcggaccgcatcggcccgctggtgaacgccaagcagcgcgcccgggtgcgcggttacatcgacaagggtgtcgccgagggcgcacggctcgtcgcgggcggccccgaatccaccgagccgcagggctacttcgtcagccccaccgtcttcgccgacgtcacgcccgagatgacgatcgcgaaggaggagatcttcggcccggtcctctcggtcatccggtacgaggacgaggaggaggccctgcggatcgccaacggcacggtgtacggcctcgccggcgccgtctgggcgggcgacgaggcggaggcggtcgccttcgcccgcaggctcgacaccgggcaggtcgacatcaacggcggccgcttcaacccccttgcgcccttcgggggttacaagcagtcgggcgtgggccgtgagctcggcgcgcacggcctcgccgagtacctccagaccaagtccctccagttc

SEQ ID NO: 6573 - DNA, 1077 bp, Streptomyces avermitilis
  CDS (1)..(1077)
atggtccgcgcagctgtactgcccgccgtcggtgctccgctggagatcaccgggatcgaactgcccgagcccggtcccggccaggtccgggtccggctcgccgccgccggggtctgccactccgacctgtccctgtccgacggcaccatgcgggtgccggtcccggccgtcctcggccatgagggcgcgggcaccgtcgtctccgtgggggagggcgtcacccaggtgtcgcccggcgcgggcgtcgtcctcaactgggcgccgtcctgcggaaggtgccacgcctgctcgctgggcgaggtctggctgtgcgccgacgcgctgaccggcgccgggaccgtgtacgcgcggcgcaccgacggctccgacctgtaccccgggctgaacgtcgccgcgttcgccgaggagacggtcgtcccggccgcctgcgtactgcccgtgcccgacggcgtgccgctcaccgacgcggcgctgctcggctgtgccgtgctcaccggctacggagccgtccatcactcggcgaaggtccagccgggcgagacggtcgccgtgttcggggtcggcggggtcggcctcgcgacgctccaggccgcccggatcgcgggcgcgtcgaagatcgtcgcggtggacgtctcgccggagaaggagtcgctcgcccgccgggccggggccaccgactacctcgtcgcctccgagaacacggcccgcgagatccgcgggctcaccgacaagcagggggtggacgtcgccgtcgagtgcgtgggccgcgccgtgaccatccgcaccgcctgggactcgacgcggcgtggcggccgcaccacggtcgtcggcatcggcggcaaggaccagcaggtcgtgttcaacgcgctggagatcttccactggggccgcaccctgtcgggctgcgtgtacggcaactcggacccggcgaaggacctgccggtcctggccgagcacgtacgggcggggcgcctggacctcggcgcgctggtgacggagcggatcgccctcgacggcatcccggcggcgttcgacaacatgctggccggcaagggcggccgggcgctggtggtgttc

SEQ ID NO: 6574 - DNA, 1008 bp, Streptomyces avermitilis
  CDS (1)..(1008)
atgagcactcccccgttcacccccgcaccccgccgccgcgcggagctgctcgccgcgggcgcggcggccgtcaccgtcgtcctgtgggcctccgccttcgtgtcgatccgcagtgcgggtgccgcctactcgccgggcgcgctggcgctcggccggctgctggcgggcgtcctcgcgctcggtgtcatctgtctcgtccgcggggagggtctgccgccgcgcgcggcctggccggggatcgtcatgtccgggctgctctggttcggctgctacatggtcgtgctcaactggggcgagcagcaggtggacgcgggcacggcggccctggtcgtgaacatcggcccgatcctcatcgccctgctcggtgcccggctgctcggcgacgccctgtcgccgcggttgctcgcggggatggcggtgtccttcgcgggtgcggtcgccgtgggtctctccctgtccggggagggcggatcctcggttctcggggtggtgctgtgtctgctcgccgccgccggatacgcgggcggagtcgtcgcgcagaagccggcgctgggcagtgccagtgcgctccaggcgacgaccttcggctgcctggtcggcgcggtcgggtgtctgcccttcgccgggcagctcgtccacgaggcggccgccgcgcccgtctccgcgaccctcaacatgctctacctgggcgtcttcccgaccgcgctggcgttcacgacctgggcgtacgccctcgcccgtacgaccgcgagccgcatgggcgcgaccacgtacgccgtgcccgccctcgtcgtactgatgtcctggctggtgctcgacgaagtgccgggaccgctgacgctggccggtggcctgctgtgtctcgccggggtggcggtgtcgcgttcccggccgcgcggccggacgaccgcgcctgtgcccgaggacacggccccggcgccggccccggaaccagctcctcgaccggctccggatccagttcctcgaccggccccggagccgcgcgcc

SEQ ID NO: 6575 - DNA, 753 bp, Streptomyces avermitilis
  CDS (1)..(753)
gtgccgaagtgtccgtaccgcatgctggaacgcatgacgagccgacacaggtcccgggatgcccaggcgccgcggctggcccggctcgccgggctgatcgccgacgagacgcgggccgcgtttctgctggcgctgctggacgggcgggcgtggacggccggcgagctggcgcggcacgcgggagtcgcggcctccaccgccagcgagcatctgggcaagctggtcgcgggcgggctgctcgccgaggagcggcaggggcggcaccggtacgtacggctggccgacgggcggaccgcgcagctcgtcgaggatctcgcggcccaggtcgcgcccggcgccctcgaacaaccgcgcacgctgcgggagtccagcgccggcaccgcgatggcccgcgggcgcacctgctacgaccacctcgccgggcggctcggcatcgccctcaccgacgcgctgaccggacgtgggctgctgcgccaggacaccgggttcgcgctcacggacgacgggctgaagtggttcgcggacgccggtatcggtctcgaacccaccggccgacgcccgctggcccgggcctgcctcgactggaccgaacgccggccccatctcgcgggcgtcgcgggcgcggccctgtgccggcacgctctggacgcggggtggtgcgtacgcatcggctccgagcgggccgtgaaggtcacggaccaaggggagcgggcgctcgcggcgctgctgggcatcgcgacgggtgcgctgcgc

SEQ ID NO: 6576 - DNA, 639 bp, Streptomyces avermitilis
  CDS (1)..(639)
atggcccgaccgcgcaagcccctcctcagcaccgaccgcatcgtcgacgcggcacgggcgctggtggacgccgagggcctggcggccgtttccacccgccggctcgccgccgaactcggggtcagcgggccctcgctctacaaccacttccgcaccaaggaccagatcctcgaggcggtcgcggactcggtgagcgcgcaggtcgacctgtcgatgttcgaggacggccggaactggcggacggcgctgcacgactgggccttctcctaccgcgccgcgctgcgcgaccacccgaacatcgtcccggtgctcgcccggggccccgggcgacgcccggccggcctccgcctcgccgacgccgtcttcggggcgatggtccgcgccggctggccgcccgcgcaggccacgtccatcggcgcgctgatgcggtacttcatcatgggctccgcgctgggctcgttcgcgggcgggttcgtcgacgacgagacggcgtacgaccccgccgactatccccacctcgggcaggcccacctgcttgccgagcagcaggagaagatcgacgagcgggcgttcgagacggggctcacggcgttgctggacgggctcgcgcagcagtacgagcaggtacggcgggccctc

SEQ ID NO: 6577 - DNA, 1149 bp, Streptomyces avermitilis
  CDS (1)..(1149)
atgaacctggagctcagcgaggagcagaccgccgtccggcagctcgccaaggacttcgtggaccgcgaggtcgccccgaacgtcatcgcctgggaccgcgcagaggaggtcgaccgctccctcgtcaagaagctgggcgaggtcggcttcctcgggctgaccgtcgacgaggagtacggcggctccggcggcgaccacctcgcgtactgcctggtgacggaggagctgggccggggtgactcctcggtgcggggcatcgtgtcggtctccctcgggctcgtcgccaagacgatcgcgtactgggggagcgaggagcagaagcggcagtggctgccggggctcacctccggcgcgtacgtcggctgcttcggcctcaccgagcccggcaccggctccgacgcgggcaatctgacgacgagggccgtacgcgacggcgacgactacgtcgtcaacggcaccaagatgttcatcaccaacggcacctgggccgacgtcgtgctcctcttcgcccgctccacggacgcacccggacacaagggcgtctccgccttcctcgtccccaccgacacccccggcctgacccgccgccccatccacggcaagctcggcctgcgcggccaggccaccgccgagctggtcctcgaggacgtccgcgtgcccgcctcggcgatgctggcgcccgagggcaagggcttctccgtggccatgtcggcgctggccaaggggcggatgtcggtcgcggcgggctgtgtcggcatagcccaggccgcgctggacgtggcggtgaagtacgccaccgagcgcgaacagttcgggaagacgatcgcccaccaccagctcgtacaggagctgatcagtgacatcgccgtggacgtggacgccgcccggctgctgacctggcgggtcgccgacctcgtcgaccgggggcagccgttcgccaccgcgtcctcccaggccaagctcttcgcctccgaggccgccgtgcgcgccgcgaacaacgccctccaggtcttcggcggctacggctacatcgacgagtacccggcgggcaagctgctgcgcgacgcccgcgtgatgacgctctacgagggcacgagccagatccagaagctgctgatcgggcgggcgctgacgggggtctcggcgttc

SEQ ID NO: 6578 - DNA, 288 bp, Streptomyces avermitilis
  CDS (1)..(288)
atgtggttccggccgtggccgccgacccttgtccgtatgagcgagacaccggtcaagcagcagaacacggcagccttctacggtcaggccgtcgcctctttctccgtcgccatggcggccaccgccatcggcatcttcaaactgcacgccgacgcctgggtgcggggcttcctggccatcgccgtcctgtacctggtgacctcggccttcaccttggccaaggtgatccgggaccggcaggagggcgcgcaccccgcggggcgcgcgtacggccccttcgaaaagctg

SEQ ID NO: 6579 - DNA, 627 bp, Streptomyces avermitilis
  CDS (1)..(627)
gtgatgagtacggcggaggagacggccggcggcgagatccagccgtgggccgaggtcacccctgacgcggcccggcggttgctggtcgccgccgtggaggccttcgccgagcgcggctaccacgcgacgaccacccgcgacatcgcgggccgggccggcatgagccccgccgcgctctacatccactacaagaccaaggaagagctgctccaccgcatcagcaggatcgggcacgagaaggcgctggagatcctgcggccggcggtggagggcgagggcagcgccgccgagcggctctccgaggccgtacggtcgttcgtgcgctggcacgccgggcagcacaccaccgcacgggtcgtgcagtacgaactggaggcgctcggccccgacgcgcgcgccgagatcatcgcgctgcgccggcagaccgacgcggccgtgcgcgggatcatccaggacggcgtggcggcgggcgacttcgacgtcccggacgtgcccggcaccaccgtggcggtgctctcgctctgcatcgacgtggcccgctggttcaacgtcaacggcccccgtacgcccgacgaggtcggcgcgctctacgccgacctcgtgctgcggatggtgagggcgaaggtc

SEQ ID NO: 6580 - DNA, 459 bp, Streptomyces avermitilis
  CDS (1)..(459)
atggcagagccgaggatcttcacatccgccgacgagctgaaggcggcggtgggcgagcagctggggtacagcgactggctggaggtcgaccagaagcggatcgatctgttcgccgacgccacgggcgaccaccagtggatccatgtggaccccgagaaggccgccgcgggtccgttcggcacgaccatcgcgcacggctatctgacgctgtcgctgctgcccgcgctggtgccgcaggtgatgcgggtcgagggcatgaagatgggcgtcaactacggctcgaacaaggtgcgtttccccgcgccggtgccggtgggctcacggctgcgcgccaccgccgtcctccaggaggtcacggaggcgggcgagggcgtccaggtcacggccgcggtgacggtcgagcgtgagggcggcgacaagccggtctgcgtggcggagtcggtgtcgcgctactacttc

SEQ ID NO: 6581 - DNA, 507 bp, Streptomyces avermitilis
  CDS (1)..(507)
gtgccccagattcccgagaagatccatgagctcacggtcggccagctgtcggcccgcagtggcgccgccgtctccgccctgcatttctacgagtccaagggcctgatcagcagccgccgcaccgcgggcaaccagcgccgctaccaccgcgacgcgctgcgccgggtcgctttcgtccgcgccgcgcagcgcgtcggcatcccgctggccacgatccgcgaggcgctcgccgaactccccgaggagcggaccccgacgcacgaggactgggcgcgcctctccgaggcctggcgcgccgaactcgacgagcgcatcacccagctgggccggctgcgggaccatctgacggactgcatcgggtgcggatgcctgtcgttggagacctgtgtgctctccaacccggacgacgtcttcggcgaacggcggacgggctcgcggctcatggtggaccgcgccgcgagccggccgcggcgcacaccgggtcagcagcagcccgaggactgctgc

SEQ ID NO: 6582 - DNA, 1065 bp, Streptomyces avermitilis
  CDS (1)..(1065)
atgtcgacgctgcgcgtcaccgccgaagtgctgaccatccacccccacccgaacgccgacgccctcgaactggcccaggtgggcctgtaccgggccgtcgtcgccaagggcgcgtatcgcaccggcgagaccgccgtctacatcccggagcagtccgtgctgccggccgggctgatcgaggagctggggctgaccggacgcctcgcgggcagcggctccgaccgggtcaaggccgtacggctgcgcggtgagctgtcgcaggggatcgtctgccggccgaaggcgctggcggacgtcgacctcgcgcggacggtggcggacggaaccgacttcgcggagctgctcggcatcaccaagtgggtgccgccgatcccgcccacgatgagcggcgagatcgagtccgtgcccgatctgctgcgctgggtcgacatcgagaacatccagcgctacccggacatcttcacgcccggcgaacccgtcgtcctgacggagaagctgcacggcacggcatgcctggtgacgtacctcgccgacgaggaccgtgtgcatgtctcctcgaagggcttcggcgccaagtccctcgccctgaaggaggatccgcgcaatctgtactggcgcgccgtgcacggccacggcgtggcccaggccgcggcccgcctcgccgaacggctcggggcacgccgggtcgggatcttcggcgaggtgtacggggccggcgtacaggacctgacgtacggcgcggacggccgccgcgacaccctcgggtacgccgtgttcgacgtgtccgcggacatcgacggcgaggtccgctggctggacgcggcggatcggctggacggcgaactgcccctcgtacccaggctgtacgagggcccgtacgacatcgagcgggtcctggagaccgcctccggacgggagacggtctccgggcacgggctgcatctgcgggagggcgtcgtgatccggtccgccaccgagcggcgcagcccggtgaccggcggccgggcgatcgcgaaggcggtcagtccggcgtatctgacccgcaagggcggcacggagtacgag

SEQ ID NO: 6583 - DNA, 519 bp, Streptomyces avermitilis
  CDS (1)..(519)
atgagcgtcgtcatcagctcgttgaagtacgaggccgcgcactcgggggcgcagaagatcacatacgacaacgacggctaccacctggtccgcttcccgtacgaggtgagcgaggagtcgtacgacccctggaagatgcacgatccggcccggggcggtggccaggcgtcgacgtacccggacacccgctccgggctgatctggcccagccacgacggctgggccgtgctgtccgcgatggtcttctgggaggccgacgcccgcgcgctggagtaccgggcgcgcttcgtgcgcgacccgctgggtgtctccacggggtacgactcgacggccacgaacgacacgacgctcacccgcggcggccagtaccgcacttatctctggcagatgttcgtgcatccggggacccccgtcggcctgaagatctcggcgcgcggtgtcggtgacgcgaagatcgccgtaccgatcaccctcgccgagttcaagctcgccatccacacggacgtcaagacgccttcg

SEQ ID NO: 6584 - DNA, 600 bp, Streptomyces avermitilis
  CDS (1)..(600)
atggccggtttccggagtctggcgagacaggtgcgagatccgaggtgcgatctggcactgcggcggtactcactgcgcaagtgccttgagaggttcgccccctacgggcatcgggcgacctgggaccatctgtgctcccgggccgggttcggtcctgaggaccgttcgcccgatccggcgcggctcgtggccgcgctggacgagctggaggaggcccgctccgtctggctcgcctacgaggtcgagttcgcgcagcgccgcaagaaggagaagcacgacgggctgcgcaggccgggcagcgtggacgactggcaccggctgacctggggcggtttcggcgtcgcctggtgcgacgacccacgggtccatccccatgaagcactggccgaggtgctgcgccggctcatcgccgcactggagcgcgagccgggcgaggcctgccccgtgtgcgccggggagcgcctcacatggaagtacgacctggcccacgaaccgtcgtcgggcccggtctgcacgggctgcggaatagtggtgccgcggcccgttctgacacccgaagccctggtggaggccaggcgcggacggctgctggtgtcggcg

SEQ ID NO: 6585 - DNA, 2787 bp, Streptomyces avermitilis
  CDS (1)..(2787)
atgtcacggcgcaccccacgcatcgccctcgacagactgagaactcctcgcagaatccccaagttcctcaaggccgcttcgatatgcgtcctcgtcgccggtcttttgtcccccgtcacccaggtggccgccgccgacacctcggccgcggccgccggtgactactgcggcggccagtgttccgacatcctcccgcccggcgagaacggcaacgccaccctcgcccagatcctcctcaaccaggccttcggcacccagcccgaccacgccgaggaccagctcgcgccgtacggcaatctgccctccggctactccgcgctcaccgacgcgaagatcaacaacttcttcaacgacgcctccttcggggtcgcctccgaccaggtcgcctccaccaccaagcccggcgggcgcagcgacgtgacgatcgtccgcgacaagaagacgggcgtcccgcacatcacgggcacgacccgttacggcactgagtacggagccgggtacgccgctgctcaggaccggctctggctgatggacgtcttccggcacgtcggacggggccagctgacctccttcgcgggtggcgccccctccaaccagggcctggagcaggagttctggcgcaacgccccctacaccgaggccgatctgcaggcccagatcgacagcgccatcgcgaacaacggcgcccgcggccagcaggccctggccgacgccaacgcctacatcgagggcatcaacgcctacatcgacgcctccgacagcggccgctacttccccggcgagtacgtcctgaccggccacaaggactccatcaccaacgccggcaccatcgaccacttcaagctcaccgacctggtcgcgctggcctccgtcatcggcgcgctcttcggctccggaggcggcggcgaggtcaacaacgccctctcgctgatcgccgcccagtccaagtacggcgtgaccgagggcaccaaggtctgggagtccttccgcgagcgcaacgaccccgaggcggtcctcaccgtccacaacggcgagagcttcccgtacgcgtcgaagcccgactccccgcagggcgcggccctgcccgacgcgggctcggtgacccaggagccgctggtctacgaccgcaccggcagcgcggccaccgccggtgccaccggcgcctcggccacggcggccgccaccaccctcacctcagccaagcgcggcatgtccaacgccctcgtggtcagcggcaagcacaccgcgagcggtcacccgatcgccgtgttcggcccgcagaccggctacttcgcaccgcagctgctgatgctccaggagatccagggacccggcctgagcgcccgtggcgcctccttcgcgggcctgagcatgtacgtggaactcggccgcggccaggactactcctggagtgccaccacctccggccaggacatcatcgacacctacgcggtcgagctgtgtcaggacgactaccactacctctaccacggcacctgcacggccatggacaaggtcgagcggaccaactcctggaagccgaccaccgccgactccaccgcggccggctcctaccgcatgcaggtctaccgcaccaagtacggccccgtggaataccgggcgacggccggcggcaagaaggtcgcgtacaccaccctgcgctcctccttcctgcacgaggccgactcgatcatcggcttccagatgctgaacgacccggactacgtcaagagtccgcagacgttccagagcgccgtgcagcacatcaactacaccttcaactggttctacgccgactccacgcacaccgcgtactacaacagtggcgacaacccggtacgcgccacgggcgtcgacgccgagttcccggtctgggcgcaggcggcgtacgagtggcggaactggaacccggcgacgaacaccgccgactacacggcggcgtccgcgcaccccaactccgtcgaccaggactactacatctcctggaacaacaagcaggccaaggactacaccacggcctcctggggtgacggctccgtgcaccgcggcaacctcctggaggaccgggtgaagaagctggtggccgcgggcggggtgaccagggcctcgctcgtgaaggcgatggccgacgccgccctcgccgatctgcgggccgaggacgtgctgccgaagctcctgagggtcatcaacagctcgacggtcacggacaccacggccgcggcggcggtcggcaagctgtccgcgtgggtgacggccggcgccaagcgcacggagacctcggccggctcgaaggcctacgccaacgccgacgcgatccgcatcctggacgcctggtggccgctgctggtgaaggccgagttcgaaccgggtctcggcagcgacctgttcaccgccttcaccagcaacctgccgaccgacgagcccccgtcgtccgcgcacggcccgaccggcgcgcacgccggaagctccttccagtacggatggtggagctacgtcgacaaggacatccgggcggtgctcggcgagccggtgcagggcggactggagaagtcgtactgcggctccggcagcctcagtgcctgccgggacaccctgatcagcaccctcaaggaggcggcaggcaagaccgcggcccaggtctacccgggtgacgaccagtgctcggcgggcgaccagtggtgcgccgactcgatcgtccagcggacgctcggcggcatcaagcacggcaagatcacctggcagaaccggccgacgtaccagcaggtggtggagtacacgtcgcaccgg

SEQ ID NO: 6586 - DNA, 1359 bp, Streptomyces avermitilis
  CDS (1)..(1359)
atggcggaacgggcaatgagtgtgactccctactgggagctgacgttcgacgcggacggggacgtggacggccgggaacgggatcggctgctcgcgcaggtggcgcagcgcaaggtccatgacctggtcgtcttcgcccacggctggaacaacgaacgctcgggggccacccggctctacagccgcttcttccagccggtcccggcgctcgcaccgcgggcgcgtctcgggtacgtgggtgtggtgtggccctcgatgatcttcccggacgagccgatccccgacttcccggcgtccgtgccggccgaggtcacggcggtcgcgcgcccggccctcgccaagggggccaggcaggcgctggtggaggtgttccccgaccgggccacgctcgtcgagcagatcgcgcggctgctggagcggcatccggacgaggaggcctcgctggagacgttcggacagctcgtacggctgctggtcgaggcgcggccgcaggatccgcaggacgcgtgcgccgcggacaccctggcgacgggcgggccggtgagcggccccgagatgctctcgggggacacggcgctggtgtgccgcgacttcgcgcgggcgctcgaccgggtcgcgtcgttacacggtacgagcgcggcgtccggcgcggtcgacttctccttcacgccggcggggctgtgggacggggcgcacgagctgctgcggcaggccacgtactacgcgatgaagcggcgcgcggggacggtcggcgaacggggactcgggcgcgtcctcggccggctcgcacaggcggcgccggacgtacgcgtgcatctggtcgggcacagtttcgggggacggctggtgtcgttcgcgctgcgcggactgccggcgggggtgcgcacggtgaagtccgtgacgctgctccagggggccttctcgcactacgcgttcgcggcgcgtctgccgcacgacacgcacgcgagcggggcgctgcacggtctccagagccgcatcgacggtccgctggtgtgctgctactcccacttcgactcggcgctcggaacgatgtatccgctggcgtcgcgcatggccggtgacgcgcggtcggccgccggggagctcggggccgacttcgacatcgggcggacgctgggcccccggtggggtgcgatgggccacgacggggtgcaggcggtggacggcacgcgcgcgttcaccctcgccgaggcgctgcgggccgagctgccggcgtcgggctgtgtgaacgtcgacgccgccgcggtcgtcaagcgcggcggcccgccgaccggcgcgcacagtgacatcgtgcaccgggagctggcgcaggtggtgctggcggcgggccgcatacgc

SEQ ID NO: 6587 - DNA, 1359 bp, Streptomyces avermitilis
  CDS (1)..(1359)
aacatgccgacccccgacaccgctctcgtgtacgcgggaacgtgtctcttcgaggggacgaacctgtcggaggggcgcgggacgacacgcccgttcgagctgctcggcgcggacgggatcgacggccggtgggctcgcgaggccgagcggctcggcctgcccggcgtgcgcttcagggaggcgtacttcgcgcccaccttctccaagttccagggcaagaccgtcgggggtgtgcagatccatgtgcacgaccgggccgcctacgaccccgtacgcaccggagtcgcgctgctggtgaccgccaagaaggtctggagcggcttcacctggcgctccgacaactggatcgacaagctgacgggctccgcgcgggtgcgcaccatgatcgacgcgggggcgaccgccgacgaggtggtggccgcctggcaggacgagctggccgcgttccgccgcgtacgcaaggagtacctcgtctaccgctgaagcggcgaccgcacccggcacttcggttcggtcgcaccggaccgcacgtgacatctggccaacctcccccgccggcaggacgatacgcccacatcgtgggaccacaggggccaagggggcctgtcatggcggaacgggcaatgagtgtgactccctactgggagctgacgttcgacgcggacggggacgtggacggccgggaacgggatcggctgctcgcgcaggtggcgcagcgcaaggtccatgacctggtcgtcttcgcccacggctggaacaacgaacgctcgggggccacccggctctacagccgcttcttccagccggtcccggcgctcgcaccgcgggcgcgtctcgggtacgtgggtgtggtgtggccctcgatgatcttcccggacgagccgatccccgacttcccggcgtccgtgccggccgaggtcacggcggtcgcgcgcccggccctcgccaagggggccaggcaggcgctggtggaggtgttccccgaccgggccacgctcgtcgagcagatcgcgcggctgctggagcggcatccggacgaggaggcctcgctggagacgttcggacagctcgtacggctgctggtcgaggcgcggccgcaggatccgcaggacgcgtgcgccgcggacaccctggcgacgggcgggccggtgagcggccccgagatgctctcgggggacacggcgctggtgtgccgcgacttcgcgcgggcgctcgaccgggtcgcgtcgttacacggtacgagcgcggcgtccggcgcggtcgacttctccttcacgccggcggggctgtgggacggggcgcacgagctgctgcggcaggccacgtactacgcgatgaagcggcgcgcggggacggtcg

SEQ ID NO: 6588 - DNA, 1317 bp, Streptomyces avermitilis
  CDS (1)..(1317)
gtgcgcactagcgtgcgtggccatgacagttccgtcgatcacggaggtcaccgcatgaaactgtccagacgagggctgctcgccgcgaccacggcggccgtgtcgctgaccgcgcccccggccgcggcggacggcggccggctgcgcacgggcttcgagcggctcgccgcggacggctacgggctgctcgacgggcagcgggtcggcatcgtcacgaaccccaccggcgtcaccagtgggggcccctcccgctcgagcgaagccgagagtgggggagtgcgccacatcgtcgacgtgatgcacgcggacgaccgggtgcacctcaccgcggtcttcggtccggagcacggcttccgcggcaccgcgcaggcgggcggttcggagggccgctacgacgacccggcgaccggcctgcccgtctacgacacgtatctgaagagcggccggccgctcgccgacgtcttcaccgcgtccggcgtcgacaccgtcgtgttcgacatccaggacgtgggcgcccgcttctacacgtacatctggacgctgtacgactgcatggaggccgccgggctcgcgggcaagcgcttcgtggtgctcgaccggccgaacccggtgaccgggcggacggcccaaggcccggtgctgcacaaggagttcgcgacgttcgtcggccggcagccgatcgcgcaggcgcacgggatgacggccgcggagctggcacggctgttcaacggggagttcctgacgacgccggtaccgctggacaccgtcctcgtgtccggctggaaacggtcggagttctacgacgcctccggcctcccctgggtgccgccgagcccgaacatgccgacccccgacaccgctctcgtgtacgcgggaacgtgtctcttcgaggggacgaacctgtcggaggggcgcgggacgacacgcccgttcgagctgctcggcgcggacgggatcgacggccggtgggctcgcgaggccgagcggctcggcctgcccggcgtgcgcttcagggaggcgtacttcgcgcccaccttctccaagttccagggcaagaccgtcgggggtgtgcagatccatgtgcacgaccgggccgcctacgaccccgtacgcaccggagtcgcgctgctggtgaccgccaagaaggtctggagcggcttcacctggcgctccgacaactggatcgacaagctgacgggctccgcgcgggtgcgcaccatgatcgacgcgggggcgaccgccgacgaggtggtggccgcctggcaggacgagctggccgcgttccgccgcgtacgcaaggagtacctcgtctaccgc

SEQ ID NO: 6589 - DNA, 762 bp, Streptomyces avermitilis
  CDS (1)..(762)
atggtggaagccgtgcaggatgccggagtggtcgtcaccggagcgggaggcggcatcggtgccgcactggcccgccgcttcgccgccgagggggccagggtcgtcgtcaacgacctggacgccgttcgggcgaaggccgtggccgacgagatcggcggcatcgcggtcccgggcgacgcctccgcgatcgtggccgaggcacgggacgccctcggcggcacggtcgacgtgtactgcgccaacgcgggcctcgcctccggcggcaccgaagccgccgacgagaaggtctgggcgctcgcctgggacgtgaacgtgatggcgcacgtccgggcggcccaggaactgctccccggctggctggagcgcggcagcggccgtttcgtctccaccgtctcggccgccggcctgctcaccatgatcggcgcggcgccctacagcgtcaccaagcacggcgcgtacgccttcgccgagtggctctcgctgacgtaccggcaccggggcgtgcaggtccacgcgatctgtccgcagggcgtgcggaccgacatgctgaccgcgtccggcagcgcgggcgacctggtgctcgcgccgaccgcgatcgagcccgacgacgtcgccgacgccctgttcaaggggatcgaggaggaccgcttcctgatcctgccgcaccccgaggtcgccgagtactaccaggcgcgggccaccacgcccgaccgctggctggcgaacatgaaccacatccagcagaagtgggaggcggcccga

SEQ ID NO: 6590 - DNA, 1665 bp, Streptomyces avermitilis
  CDS (1)..(1665)
atgaccggatccccctacgcggcgaagccctggaccgccctgctcaacgatgcccagggcgcccccgtcgcccccgtcgcctccctggtgcacgccgtacgcagggccgccgccgacaccccggagcgcaccgccctcgcctacttcgacgggcggatcacctatcgcgcgctcgacgagctgagcgactccgtcgccgggcacctcgccgcgcgcggtctggagcgcggcgaccgggtggcgatcctgctccagaactccccgcacttcgtgctcgccctgctcggcgcctggaaggcgggcgcgatcgtcgtgcccgtcaacccgatgtacaagtcgggcgaggtcacccatgtcctgaaggacggcgaagtggccgccctcgtgtgctccgaccgcgcgtgggactcgtacctgcgggagacggccgccggtacgccggtacggatcgtgctcaccgcctgcgagctggacctccagacccgtaacgacgcgcgcgtgctgaacttcgagcgccttccgcaggctgcggacgccgacgacctgatcgcggtcgcccggcgagggcacaaggcgcccgccgaccgcgcggccgtcccctccgacatcgcgctgatcagctacacctcgggcaccagcggtgctcccaagggcgccaccaacacccacggcaacatcatgtacaacgccgagcggcagcgcaccgggctcgccctgcccgggacgcccgtctacttcgcgatggcgccgctgttccacatcaccggcatggtcgcccagctcgccggatgcctcaacagcgcgggcacgcttgtgctcgcgtaccgcttcgaggccggggtcgtgctcgacgcgttcgccgagcaccggccggtctacacggtcggcccctcgaccgccttcatggcgctggccgcgcacccggacgtcacccgcgaccacttctcctcgttccggatgatctcctcgggcggcgcgccgctgccgcccgccctggtggagaagttccgcgccggcttcggcccttacatccacaacggctacgggctcaccgagtgcaccgcgccctgcgcctccgtaccgcccggcctggaagcccccgtggacccggtctcggggacgctggccgtcggcgcacccggtcccgacaccgtcgtacgcatcgtcgacgaccagggcgaggaggtgcccttcggggagcagggcgagatcctcgtccgcggcccgcaggtcgtgcccggctactggcgcctccccgaggccaccgccgagaccttccccgaaggcgagctgcgcaccggcgacatcggcttcatggacccccagggctggctctacgtcgtcgaccgcaagaaggacatgatcaacgcgtccggcttcaaggtgtggccgcgcgaggtcgaggacgtcctgtacacgcatccggcggtgcgcgaggcggccgtcgtcggggtgccggacgggtaccgcggggagaccgtcaaggcgtacatcagcctgcgtccgggggccgacgaggacccggctgcgttcgccgcgtactgcaaggagagactggccgcctacaagtatccgcgtcaggtggagatcctgcccgacctgccgaagacggcgagtgggaagatcctccgtcgggaactgcgttcccggtccggcgaaacccag

SEQ ID NO: 6591 - DNA, 600 bp, Streptomyces avermitilis
  CDS (1)..(600)
gtggcggcagtgcccaggacgacggacggtgacggcacgcccgtcccgcagcggctcctcgccgccgccacccggctcttcgccgaccgtggctacgaccgcacgtcggtccaggagatcgtcgaggcggcgggcgtcaccaagggcgccctgtaccactacttcggctccaaggacgacctcctgcacgaggtgtacgcgcgagtgctgcgcgtccagcaggagcgtctcgacgcgttcgcggacgccgacgcgccgatcgaggagcggctgcgggcggcggcggccgacgtggtcgtcaccaccatcgacaacctcgacgacgcgatgatcttcttccgctccatgcaccatctgagccccgagaagaacaagcaggtacgcgcggagcggcgccgctaccacgagcgcttccgcgcgctgatcgaggagggccagaaggagggcgtcttctccaccaggacgcccgccgacctggtggtcgactaccacttcggctccgtgcaccacctgtcgacctggtaccgcccgggcggcccgctcaccccgcagcaggtcgccgaccaactggcggacctgctgctgcgggcgctgcggccg

SEQ ID NO: 6592 - DNA, 1221 bp, Streptomyces avermitilis
  CDS (1)..(1221)
atggacttcgcgttcgacgcgcgcaccgaggaactgcgccagaagctcctcgccttcatggacgagcacgtctatccggcggaggccgtcgcccacgagcagcgcgagcggctcgcctcgccgtgggacacgcccgtgatcgtcgaggagctgaaggccgaggcccgccgccagggcctgtggaacctcttcctgccggactccgagtacggcgccggactcaccaacctccagtacgcgccgctcgccgagatcaccggccgctccccgcagctggcgccgaccgcgctgaactgcgcggcgccggacaccggcaacatggaggtgcttgcgcagttcggcgacgagcgccagcgcaagcagtggctggagccgctgctcgccggtgagatccgttcggcgttcgcgatgaccgagcccgaggtggcctcctccgacgccaccaacatcaccacgctgatcgagcgcgcctccgacggcacggacgagtacgtcatcaccggccgcaagtggtacatctccggggcgatgaacccggactgcaagatcttcatcgtgatgggcaagacggacccgggcggcgcggacatccggcgtcagcagtccatgatcctggtcccccgcgacaccccgggtgtccaggtcaagcgggcgatgcaggtgtacggctacgaggaccactcccacggcggccacgccgaggtgatcttcgaccacgcgcgcgtgccggtgtcgaacctgatcggcgaggagggcggcggcttcgccatcgcccaggcccggctgggtccgggccgcatccaccactgcatgcggctgatcggcatggcggagcgggcgatcgagctgatgtgcaggcgggccgtctcccgcacggccttcggcaagccgctggcccagcagggcgtggtgcacaactggatcgccgacgcccgcgtggccgtcgaacagctgcggctgctggtgctgaagacggcctggatgatggacacggtcggcaacaagggggcccacgccgagatccaggccatcaagatcgccacgccccgtacggttgtcgacatcatcgacaaggcggtccagctgcacggcgcgggcggcgtcagccaggacttcccgctggccgaactctgggcgagcgcccgcacgctgaagctcgcggacggccccgacgaggtgcaccagcgctcgctggcgcggcgggagctgaagaagtacgtc

SEQ ID NO: 6593 - DNA, 1020 bp, Streptomyces avermitilis
  CDS (1)..(1020)
atgagcccagaccacccgccaggactcgatctcgaccggctgcgcggcctgctcgacgccgagcggcccggcctggtgaccggcccgctgaccggccggctgatcgagggcggacggtcgaatctcacgtacgtggtcacggacggcaccgggaagtgggtcgtacggcggccgccgctgggccatgtgctcgccaccgcgcacgacatgaagcgcgagcaccgggtgatcagcgcgctgcacccgacggccgtgccggtgccgcgcccggtgctgctgtgcgaggacgactcggtgctgggctcgcccttctacgtgatggacttcgtggagggcaccccgtaccgcaccgccgaacagctcgccccgctcggcccggagcggacccggggcgcgctgctcggcctggtcgacacgctggtcgagctgcacgcggtggaccccgccgaggtgggcctcgtggacttcgggcgccccgagggcttcctggaccggcagctgcgccgctggggcaagcaactggacgcctcccgcaaccgggaactggccggcatcgacgagctgcacgccgcactcggccgcgagctgccccactcccccgcgcccacggtcgtacacggtgactaccggctcgacaacgtgctgctcggcgcggacgaccggatcaccgccatcctcgactgggagatgtccacgctcggcgacccgctgaccgacctgggcctggtggcgatgtacagcgtgccgctggcgctgccggactcgcccatcagcaccaccgccgcggccgccggacacccggacccggccgagctgatcgagcggtacgccgcgcgctcggggcgcgacgtgtccgccgtctcctggtacacggcgttcgcctggttcaaactcgccgtgatcctcgagggcatccactaccgctacacgctcggccagacggtcggcggcggcttcgaccgcatcggtgaactggtccccgtcttcatcgagcacggcctgaccactcttcaggaaggc

SEQ ID NO: 6594 - DNA, 909 bp, Streptomyces avermitilis
  CDS (1)..(909)
atgaccgcagcggagccttacacggtcgagctcgccgccgacgtgcacgcctatgtgcagccggacggcggctggtgcctgaacaacgccgggttcgtgagcgacggcacgaccaccctgctcgtggacacggcggccaccgagcggcggacccgggccctgagcgcggcgatcgccgccgcgggcgtccccgctccgcgcttcgtcgtcaacacgcaccatcacggcgaccacacctacggcaacagccacttcgcgcccaccgcgacgatcgtctcgcacgccgaatgccgccgggagacactggccaacgggcggcagctgcatctgctctggccggagaacgacttcggggacatccggatccaggccgccgacctgacgtacaccggccacacgacggtccatgtcggcgcggtggacgccgaggtgatccaccccggggtggcgcacaccgtgagcgactcggtggtgtggttgccgcaccggcgggtgctgttcaccggcgacctggtcttcgagggcggtacgccgttcattctgatgggctcgctcagtggctcgctgcgggccctggacgtgctgcgccagctgggcgccgagacggtcgtaccgggacacggcccggtcaccgacccgtcggcgttcgaccgtacggagcgctatctgcgcttcgtcgccgacatcgcgcacaagagccacgcggcgggccgcactcccctggaggcggcccgggagacggacctcggggagttcgcagcgctgccggagagcgagcggttcgtggccaatctgcatcgcgcgtacgccgagctggacggggcgccggaaggcgcaccgctggacgtgcccgccgccgtccgcgacatcgcggccatgaacggcggacggatggtcgcctgccacgcg

SEQ ID NO: 6595 - DNA, 321 bp, Streptomyces avermitilis
  CDS (1)..(321)
atgaccgcgcccgcccaggagcgcgacccggggctgcaacccgagcgcactcggctcgcgtggcggcgtacgaccctgtcgggcaccgtggccgccgtactcgccgtgaagacgacgctgcacagtggcacggcggcgggactgatcgtctgcgcgctgtgctgcgcgctctgggtcggcttcctcgccgtcgcccaccaccgcatccgcgacctgtcgacggccggagcgcaccgcccgcccgcgctcgccccacggcacgcggccgcggcggccttctgcacggtcgccctggccctgtgcgcggcggcgctggtgctc

SEQ ID NO: 6596 - DNA, 390 bp, Streptomyces avermitilis
  CDS (1)..(390)
gtgatcgaattcgcacggaacgtccggctgtggttcgcgccccaggaggtacgaaaggtcggcggcacgcccgactaccggttctcgctggccaacgagcgcaccttcctggcgtggctgcgcaccgcactggcactgatcggcggaggattcgccgtcgaccagttcctgccggatctgaggtggggctggcgcgtcggactggccctcgcgctgctcgccgccggtgtgctgtgctcgctgcgcgccgtcaaccactgggtgcggtgcgagcaggcgatgcggcggggcgaggaccttccggtgtcccgcttccccgcgctgctgagcatcgccgtggccgtcgtcgcgatcgcgatggtcctcgtcgtactcgtcggctgggaagga

SEQ ID NO: 6597 - DNA, 600 bp, Streptomyces avermitilis
  CDS (1)..(600)
ttggatgggcccatgagcgaacccgtgagcgaagccgtgaccgaagcagccgtgagcggagcgacgagcggaccgacgggtggccccgtcgaccccgccgatgaactcctcgacatcgtggacgagaacgacagggtcgtcgggcagtcggcgcgcggggaggcgtacgcgcgggggctgcgccaccggtgcgtgttcatcctggcccgggacggcgaggggcggatcttcgtccaccgccggacgcccaccaagctggtcttcccctccttgtacgacatgttcgtcggcggagtcgtcggcgcgggcgagacgtacgacgacgcggccctgcgcgaggccgaggaggaactcggcgtctgcggtctgccccgcccggcccccctcttcaagttcctgtacgacaacggcgccggccagacctggtggtcgtcggtctacgaggtccgctgcgacctcccggtcagcccccaggtggaggaggtcgcctggcacgacttcctgccccaggacgaggtggagcgccggctggccgactgggagtgggtcccggacgggctcgcggcgtacgagcggctcaaggcgcatcgcgccacgggc

SEQ ID NO: 6598 - DNA, 921 bp, Streptomyces avermitilis
  CDS (1)..(921)
gtggccccgctgagtttcgaggtacgcagcgtgtcggtactggttctggttctcgccgtgagcgcggccttctgcctgggcatcgggttcgtgctccagcagaacgcggcccagcatgctccgctgagcgacttcctctcgcccagactgctcctggacctgatgcatgtgcggcgctggctcggcggcatcgggttcatggtggtcggcatggtgctcggtgcggtcgccctggcccatggcgagctgtcgctggtcgagccgctgctcgccacgaacctgctcttcgcgctgggcctctcccgccggcagaccaagcagccgctgggacgccagggctgggcggggctcgcgctgctcgcgggcggcgtcacggcgttcatcgtcgccggccagccgaccggcggcgacgcggtcacgaatcccctacggcactgggtgatcatcggcgtgatggtcgggttcgcgctgctgctgacgacctacgcgaagcagtcgcggctgagcgccgcccccgtgctcctgtcgctcgcggcgggcctgctgtacggcgtgcaggacgcgctcacccgggtcagcgggcagcggttcagcgagggcggctggccggagctggtcaccggctggcagccgtacgcggtgctggccctcggtgtgaccgggctggtgctggtgcagagcgcgttcgagacggcgccgctgcggatgtccctgccggccctcaccgcggcccagccgctggccggaatcgtctgcggggtgggcttcctcggcgaccagctgcgcacggacaccggggcgctcgcctgggaggcggcggggctcgcggcggtcgtgctgggcatcgtcctcctcggactgcacccggcgatgccgcggggctccgcggaggcggagcggcagcgggatctccagccgcat

SEQ ID NO: 6599 - DNA, 1653 bp, Streptomyces avermitilis
  CDS (1)..(1653)
atggcccacgacgcagacgtcatcgtgatcggcgccggcctggcagggctcgcggcgaccgcggagctggtggacgcgggccgcaaggtgatccttctcgaccaggagccggagcagtcgatgggcggccaggccttctggtcgttcggcgggctcttcttcgtcgactcgcccgagcagcgccgtctgcggatcaaggacagccacgcgctcgccctccaggactggatgggaacggccggtttcgaccgtcccgaggaccactggccgcgcaagtgggccgaggcgtacgtcgacttcgcggccggtgagaagcgggcctggctgcaccggcagggggtgcgcttcttcccggtggtcggctgggcggagcgcggcggctacgacgccaacggacacggcaactcggtgccgcgcttccacatcacctgggggaccggacccgggctgatcgagccgttcgtgcggcgggtgcgggcgggggtcgcgcggggactggtcgagctgaggttccgccaccgggtcaccggtctgtcgcgcagcgcgggcgccgtggacaccgtcacgggtgaggtgctggaggcgtcggacatccagcggggccgggccagcagccgcgaggtcaccggagccttcgagctcacggcccaggcggtgatcgtcacctcgggcggcatcggcggcaaccacgacctcgtccgcgcgaactggccggagcggctgggcagggccccggagaagatgatctcgggtgtgcccgcgcacgtcgacggcaggatgctcgccatcgcggagggggcgggtgcgcgtctgatcaaccgcgaccgcatgtggcactacaccgagggcatccagaactggaacccgatctggcacaaccacggcatccgcgtcctgcccggcccgtcctccctgtggttcgacgcccgcggcaaccggctgcccgtgccgctcttccccggcttcgacacgctcggcacgctcgaacacatcatgaagaccgggtacgactacacgtggttcgtgctcgaccagaagatcatcggcaaggagttcgccctctcggggtccgagcagaaccccgatctgacgggcaagtcgatcaaggacgtgatcgggcgggcgcgggccgaggtgccggggccggtgaaggcgttcatggaccacggtgtggacttcgtcgtggagaaggacctgggcgcgctggtgcgcggcatgaacgcgctgaccaaggaaccgctcatcgacgaggccgcgctgcgccgtgagatcgtcgcgcgcgaccgggagatagcgaaccccttcaccaaggacctccaggtgacggcgatgcgcggggcccgcaggttcctcggcgacaagctgatccgcacggccgccccgcaccgcatcctcgaccccaaggcgggtccgctgatcgccgtgcgcctcaacatcctcacccgcaagacgctcggcggcctggagacggacctctcgtcgcgggtgctgaccgagggcggcgccccgctggagggcgtgtacgcggccggcgaggccgccgggttcggcggcggcggcgtccacggctaccggtctctggagggcacgttcctgggcggctggctgttctcgggccgcacggtgggccgggcggcggcacaggccgtgggc

SEQ ID NO: 6600 - DNA, 948 bp, Streptomyces avermitilis
  CDS (1)..(948)
gtgcccccacccccacccccactcggccgtggtcgcaagcgtgcggcccatgccttcgacgcggcgctcgacgacgccgaactcgtcgcctcccgcgcctcgttgacccaggggcgatgggcccccgtgcgcgcgctgctcgccgcgacccgcgacgactgggaccgtcggggacaccgcgtcaccgtcctggcgcaggagtccgccgcccttccctgggcgcgcgaatggcagctcgccgaacccgagtccccctgcgccgccgtactgctcgcctgcgccaccgtccaccgcgccctgaacggcaaggagcgcccgcagacggcacgcgaggcctgccacgccgcggccgccctcgcccccgacgaccccacaccgtggctcggcctgctgatactggagcgctcactcggcaccgacgaggacgtggtccgcctcttcgacgaggtccgccaccgctgccccgaccaccaccacgcccaccagctcatcgtcgcccggctcgccgaacgccgcgcggacgccggacgggacccgctgcacgaggtctacgacttcgccaactgggccgccgaacaggcccccgccgactcgccgctcgcgatcctcccggtcgtcgcgcacgccgagcgctaccgcgtcctcgccgccgccggtgccgagcccgccgacccggtcgcctccgggcactgggtggggcggcgggcccgccaggtgatgaaggccgccttcgactggtggctggagtgggagcgcgacgaccatccgcgccgcttcgtcgacctcaacttcctggcccacgccaagttctgcgagggccgtggcgccgaggccgccgccctgttccaccgcatcggagaacacgccaccccggcgccgtggtcgtacccggaccgcgacccgtaccaagccttcagcgccgcacgcgccagcgcgctcggcgccccc

SEQ ID NO: 6601 - DNA, 1560 bp, Streptomyces avermitilis
  CDS (1)..(1560)
atgacgacgggcagttcgagcacgagtgagagcagaccagcgaacaggtccgccgtcgcggacgacatcagcaccttcaagggacaggaacgcgctctgcgcgccgaccggctcggcacggcgggcctgttgctgtccgtgctcgccgcgaccgcccctctcatggtggtcgcgggtgtcatgcccactacattcggggtcatgggcatcgtcggccagcccctgctcttcgtcgtcctcggcgcggtgctggccctcttctccctggggtacgcggagatgagccgccacgtccacaacgcgggcgccttctacgcctacatctcgcgcggcctcggcggcacggcgggcgcgggtgccgcggcggtcgcactcgtcgcctacagcgcgctccagttcgccatctacggcatcttcggcttcgaggtctcgggtctgtgcgccacctacctcgaactccaggtcgcctggtggatcccggcgctggcggccgtcctcgccgtcggcgcgctcggcctgctgaagatcgacgtcaacgcgcgcgtgctcggcgtgctgctgctcatcgaggtcgtcctcgtcgtcgtgttcgacatcgcggcggtcgccgaccccgccaaggaaggcctgtcgctgcacgccttcaacccggacaccctcaccggtgcgggcgtcggcaccgcgctctgcttctgcgtcgccgccttcctcggcttcgaacaggcccccgtctacgccgaggagaccagccgcccggacgtcctcgtgccgcgcgtgatgttcctcgcgatcggcttcgtcgccgtcttcttcgcggtcagctgctgggcgttcacggtcgccgccggtccctccaccatcgtggccgccgcccagaaacagagcgcgggcctgctcttccagctgacggagtcccggctcggcggcaccttcaccgacgtactgcacgtgctcttcgtgaccggcatgttcgcggcgatgctcagcttccacaacgtggtcgcgcggtacgccttcgcgatgggccgcgagggactcctgcccgccgccttcggccgtacgacgggcgcgagcggcgcccccggtacgggctcgctccttcagacggccgtgtcggcggtgatcgtcatcgccttcgcgatggccgacgacaagccggccggcgacccgaccgcgcccgtgctgcacctgttcacctggttcggcagcgtcggggcgctcggcgtcaccctgctgatggtggcggcctccctgtccgtgatcgtcttcttcgcccgccgcggcgccgcccgcgcacaggcctggcggctggccacgtccgcggtgtcgggggccgcgctgctcgtgatcgtgggctacacggtcaaggacttcggcgtactggtcggaacgggaccggactccgcgctcggctgggtgctcccggcgatcatcggggtggccctggtcctcggcctggcgcagggactggtcctgcgctcccgtaagccccaggcgcatgcccgtatcgggctggacaacgaggcgttccagctggacaaggcggcggagtcggcgacc

SEQ ID NO: 6602 - DNA, 609 bp, Streptomyces avermitilis
  CDS (1)..(609)
atggagtccgtcctcgccggagcggccgagaaggacccgacgggcctgaccggtctgctgcccaacggcgggggctttcgctactactcggtgacgtcgtcggtcccgcacaagggggaggcgaactaccgcctcacgatcgacggcctggtcgaccacccgacgtcgttcaccctggccgatctgcgggccctgccgcagacccggctcgtgcgcgacgtccagtgcgtcaccggctggcgggtgccggggacgccgttcgagggcgtacgtctgtcccggctgctggacgcggcgggcgtccgctcctccgccagggcggtccgcttcacctgcttcgacggggcgtacaccgagagcctgacgctcgcgcaggcccgccgcgcggacgtcctggtcgccctgcgcatgcaggacaagcccctgggccacaaccacggcggccccgtccgcctgtacgtcgcccccatgtacttctacaagtccgccaagtggctctccggcatcaccgtcaccgaggacgtccgtcccgggtactgggaggaccggggatacgacgtggacgcctgggtgggcaagtcgaacgggcgggacgatgaccctacgagc

SEQ ID NO: 6603 - DNA, 654 bp, Streptomyces avermitilis
  CDS (1)..(654)
atgaccctacgagctgacgcccccgcccccgccgtgtcctcacgggtacggcgcttcacgcgcgcggagcgctgggtgcaccgggtgacggccgcgctgatgggcgtgtgcgtggtgacggccgcctgcctgtacatccccgttttcgcggaactggtggggcgccgggacctggtcgtacgggtccacgagtgggcggggctgctgctgccggccccggtgctcgcggggctggcgtcgcgcgcgttccggtcggacctgggtcacctcaaccgctggggcccgcacgaccgggtctggctgcgggcggtcctgcgccgcgacgcccggccctcgtcccgtccggcggcgaagttcaatgcgggccagaagacgtatgcggcgtggatcgcgggagcgtccctggtgatggtgggcacggggctgctgatgtggttcacccacctcacgccgctgatgtggcgcacgtcggcgacgttcgtccacgactggctggccctgacgatcggcgtcgtcctcgcgggccacatcggcatggccctggccgacccggaggcccgccgcggcctgcgcacgggctcggtgagccgggagtgggccagccaggaacaccccctgtggcgcgaaggccctccgggcggggaccggcggggg

SEQ ID NO: 6604 - DNA, 1023 bp, Streptomyces avermitilis
  CDS (1)..(1023)
atgctcggttgtgtgatccacggtcggggcgacctgcgggtcgacgaactgcccgagccggccgccggaccggggcaggcgctggtcgccgtccgttacggcggcgtatgcggctccgacctgcactactggcggcacggcggagtcggggacttccggctgcgggagccgatggtgctcgggcacgaggtggtggggacggtcctctcgtacgggcccggggccgccggtcccgcgccgggtacggccgtggccgtgcacccggcgacgccgtgcggggtgtgtccggagtgcgcggacggccgggcgaacgtgtgccgggacacccgctatctgggcagcgcggcccgtatgccgcacgtccagggcgggttcgccgcgcgggtcgtggtacccgccgcgcaggtgagggcgctgccggaggggctggatctgcggcgggccgcgctcgcggagccgctgtcggtggcgttgcacgcggtacggcgggcggggccggtggccggccggccggtgctcgtgacgggggccgggccgatcgggtgcctggtggtggccgcggcgaaggccgccggagcggggcgggtgacggtgacggatctgctgccgcgggcgctgtcgtacgccgccggggtgggcgcggacgacgtcgtacgcgccgacgatccggccgacgccgggtggccggactcggtcgacgtggccgtcgaggcgtccggggttgccgcgggtcttgacacctgcctgcgcctggtgcggcgtggtggggtggtcgtccagctgggcatgctgccgcccggacagacgccgttcgccgggaacctggtggtcagccgggagatcgaactgcggggagcgttccgcttcgccgacgagttcgacgaggcgctgaccctgctggcgcgtgagccggcgttcgactccctgatcagcgcggtggttccgctcgaggaggcggagtcggcgttcgcgctggccgcggaccgcggtgaggcgtgcaaggtgctgctggacttcggggtc

SEQ ID NO: 6605 - DNA, 756 bp, Streptomyces avermitilis
  CDS (1)..(756)
atgagccatccgctcttcgacatcgccggccgtacggccctggtcaccggctccagccgcggcatcgggcgcgcgctcgcccgcggcctcctggaggcgggctgcacggtcgtcctgaacggacgggacggcgaccggctcaccgcggcggccgccgaactgccgggcgacgtccgtacggccgcgttcgacgtgaccgacggtccgtcggtggccgccggcatcgcggaggtcgaggagcgggtgggtccgctcgacatcctggtcaacaacgcgggcatacaactgcgcgccccgctcctggagttcacggactccgactggcaccggatcctgaacaccaatctgacgagcgcgttcctggtgggccgcgaggcggcccgccgtatgacggaacgcggccacggcaagatcgtcaacatctgttccctccagagcgaggtcgtccgccccggcatcgccccgtacgcggcgaccaagggcgcgctgaagatgctcaccaagggcatgtgcgcggactggggcccgtacggggtgcaggtcaacgggctcggccccggctacatagagaccgagttgacccgcccgctcgtcgaggacgaggagttcagcgcgtgggtgcggcaccgcaccccggccgggcgctggggacgtacggaggacctggtcggcggggtgctcttcctcgcctctcccgcggcggacttcgtcagcgggcaggtgctgtacgtcgacggcggcatgacgagtgtgctc

SEQ ID NO: 6606 - DNA, 1395 bp, Streptomyces avermitilis
  CDS (1)..(1395)
gtgaccagactcagcgtcgagaagctggcagcggacaccgtcgaaccgatcacctcggcgggccacgctcaactcggcatcgcggtactggcgggcatcgccgtcatcgtgctgctcatcaccaagttcaagcttcacgcgttcctcgccctgaccatcggttcgctcgcgctcggcgcgttcgccggggcgccgctcgacaagaccatcgtcagcttcacggccgggctcggctcgaccgtcgccggtgtgggcgtcctgatcgcgctgggcgccatcctcggcaagctgctcgccgactccggcggcgccgaccagatcgtcgacacgatcctcgcgaaggcgggcgggcgggccatgccgtgggcgatggtgctgatcgcctccgtgatcggcctgccgctgttcttcgaggtgggcatcgtgctgctcatcccggtcgtgctgatggtcgccaagcgcggcaactactcgctgatgcggatcggcatcccggcgctcgcgggcctgtccgtgatgcacgggctgatcccgccgcaccccggcccgctggtcgcgatcgacgcggtcaaggcgaacctcggcctcacgctggcgctcggtgtcctcgtcgccatcccgacggtgatcatcgcgggcccggtgttctcgaaatacgcagcccgctgggtggacgttccggctcccgaccgcatgatccccacccgcgcttccgaggacctggacaagcgccccggcttcggcgccaccctcgccaccatgctgctgccggtcgtgctgatgctggcaaaggccctggtcgacatcatcgtcgacgaccccacgcaccaggtgcagcgcgtcttcgacgtcatcggcgcaccgctgatcgcgctgctcgcggccgtgatcgtcggtatgttcacgctgggccgcgcggccggcttcaccaaggagcgcctctcgacgaccgtcgagaagtccctcgccccgatcgcgggcatcctgctgatcgtcggcgcgggcggtggcttcaagcagacgctgatcgactccggtgtgggccagatgatcctggagatctccaaggactggtcgatcccggcgctgctgctggcctggctgatcgcggtggcgatccggctcgcgaccggttcggcgacggtcgcgaccatctccgcggccggtctcgtcgcgcccctcgcggccgacatgtcgaccgcgcacacctcgctcctcgtgctggcgatcggggcgggctcgctcttcttcagccatgtgaacgatgccgggttctggctggtcaaggagtacttcggtctgagcgtcggccagacggtcaagacctggtcgatcatggagaccatcatctcggtggtcgccggcggactggtcctgctgctgtccctcgtgatc

SEQ ID NO: 6607 - DNA, 534 bp, Streptomyces avermitilis
  CDS (1)..(534)
atggaacaggtgcacaccccccacgtagtcgtggtgatgggcgtcgcggggacgggcaagaccacgatcggtccgctgctcgccgcccggctcggcgttccctacgccgagggtgacgacttccaccccccggccaacatcgccaagatgtcggccggagtgccgctggacgacgtggaccgcctgccctggctggacgcgatcggcgcctgggcgcacagccgggcggggctcggcggagtggtcagcagctccgcgctgaagcggtcgtaccgcgaccggctgcgggccgcggcgcccggcgtcgtcttcgtgcatctcaccggcgaccgcgagctgatcgaggaccggatgtcgcaccggcaggggcacttcatgccgacggcgctgctggactcgcagttcgccacgcttcagccgctggcggcggacgaggccggggtcgccgtggatgtcaccggcggtcccgaggagatcagcgagcgggccgtgacggcgctgcgggccctcgaaccggcctctcagccggcgaag

SEQ ID NO: 6608 - DNA, 699 bp, Streptomyces avermitilis
  CDS (1)..(699)
atgaccacaccgggccgggggctgcacggccatgtactggagaccctcgggcccgccatcgccgcgggcacctacccaccgggaagcgtgctgcgcacggacgagctcgcccagcgcttcgaggtctcacgctccgtgatgcgcgaggcggtccgcgtactggagtcgatgcacctggtggagtcccgccgccgcgtcggcgtgacggtccgtcccaaggccgagtggaacgtgtacgacccccaggtcatccgctggcgactggccggcgccgaccgcccgcaccagctgcgctcgctgaccgtgctgcgttcggcggtcgaaccggccgccgcgggcctggccgcacggcacgccaccgccgatcagtgcgcggacctcaccgagtgcgcgctgggcatggtcgccacgtcccgcggccatcagctggaggcctatctggtccacgacgtggccttccaccgggtgatcctcaacgcgtcgggcaacgagatgttcgcccgcctgggtgacgtcgtcgcggaggtcctggcgggccgcacccaccacgaggtcatgttcgaggaccccgacccggccgccgtcacgctccacgtccaggtggcggaggcggtacgcgagggcgacgccctccgcgccgagcagctcacccgtgagatcacggtcggcgccctccaggaactggacatcctggcgccg

SEQ ID NO: 6609 - DNA, 420 bp, Streptomyces avermitilis
  CDS (1)..(420)
atgagcaagtcccgtcgtacgcgttccacttcgcgccccacgtcgcgcccgcagccggcttcgtgtccgtgcgggcttcccgaggtgtacgaggcgtgctgcgggcggttccactccggtgccgccgacgcacccaccgccgcgttgctgatgcggtcgcggtactgcgccttcgtgcggcgggacgaggcgtatctgctgcggacctggcatccgcggacgcggcccgccgaggtcgacttcgacccgcggatgcggtggaccggcctggagatcctggggacgacggaggggtccgcgttccactcggccgggacggtcacgttccgggcgtcctaccggggcggtgcgctccaggagcggagccggttcgagcggatcggcggggcgtgggtgtacgtcgacggggagttcttcgag

SEQ ID NO: 6610 - DNA, 1449 bp, Streptomyces avermitilis
  CDS (1)..(1449)
gtgactcgctccgggccgaaggacggtgcaccggcacgacgtacgagcccagcgcagggagcagacgcagcagtgagccctcggcagaaggcggaagccgatccgtacttccccacgaacggtgatgcccgctaccgggtgcaccgctacgagctcacgctggactaccgtcccggcccgaaccggctcgccggcaccgcgcggctcaacgccatagcgggccgggctccgctcgccgagttccagctgaacctggccgacttccggatcggccgggtccgggtcgacggcaaggcgccgcactacacgcaccgcggcggccggctgcgcatccgtccgccgaagccggtccgggccggcgcggcgttcaccgtggaggtgcactggtcgggcaatccccagccggtcaacagcgcctggggcggtctcggctgggaggagctggaggacggtgcgctggtggcgagccagccggtgggcgcgccgtcctggtacccgtgcaacgaccgccccgccgacaaggccgcgtaccagctctcggtcacgacgccgtcggcgtactcggtggtggcgggcgggcgcctgctcactcgtacgacgaaggcgtccacgaccacctgggtgtacgagcagccggcgccgacgtccagctatctggtcgggctgtcgatcggcaagtaccagacggtgctgctcggcgatccggggctgggcggtgtcccgcagacggggcacatcccggctcatctgctgaccgagttctcccgggacttcgcgcgccagcccgcgatgacggagctgttcgaggagctcttcgggccgtatccgttcggcgagtacgcggtggtcgtgacggaggaggagctggatgtccccgtcgaggcacaggggttgtcgttgttcggcgccaaccacgtggacgggaagcggggttcggagcggcttgtcgcgcacgagctggcgcaccagtggttcggcaacagcgtgaccatcgccgactggcggcacatctggctcaacgaggggttcgcgaagtatgccgagtggctgtggtcggagcgctccggcggccgtacggcacagcaactcgccacgctcgcgcaccggaagctgtcctcgctgccgcaggatctgcggctggccgatccgggccgcaagctgatgttcgacgaccggctctacgagcgcggcggtctcgtgctgcacgcggtgcgctgtgcgctgggcgacgaggcgttcttccggatgctgcgcgggtgggcgggtgtgcaccggggcggggtggtgaccaccgccgcgttcaccacgcatgccgcgcgcttctccgcccagccgctggacgagctgttcaccgcgtggctggaggagaccgccctgccgtcgctgcccgtcctcgccgcgccggtaccggcgcgtccgccgtatccgccgcacattacggggtccgca

SEQ ID NO: 6611 - DNA, 3873 bp, Streptomyces avermitilis
  CDS (1)..(3873)
atggctgccctccagcaaggccccgcactcgcgctgtccgacgacgaggtgcgggcggagttcggtgaccgggcacgcttctccgccggctcccccgcctcgcctcggacccttgtggacattctcgacgcctccgtccgggcgtaccccgacgagcccgccctcgacgacggccggcgctgcctcacctaccgtgcgctcgccgtcgagatcgaggccctgcggcggcggctcgcggccgccggagtcggcctcggcgaccgggtcggcgtccgtgtcccgtccgggaccaacgatctgtacatcgcggtcctggccgttctggccgccggcgccgcctacgtaccggtggacgccgaggaccccgacgagcgcgccgaactggtcttcggggaggcagaggtgcgggcggtcgtcggggccgggcaccacctgaccgtcgacgggacggccggggtccccgccgcgcggcccggtaccgggcacgacgcctggatcatcttcacctccggctccaccggcaggcccaagggggtcgccgtcagtcaccgcagcgccgccgccttcgtggacgccgaggccgacctcttcctcaccgaggagccgatcggccccggtgaccgggtcatggccgggctgtccgtcgccttcgacgcctcctgcgaggagatgtggctggcctggcggtacggggcctgtctggtgcccgtgccgcgctcgcaggtccgcggtggcgccgacctcgggccctggctagtcgagcaggagatcaccgtcgtctccaccgtgcccacactggccgccctctgggagcccgaggccctgagcgacgtacggctgctgatcttcggcggtgaggcctgcccgcccgagctggcggagcggctggtcaccgaggggcgcgaggtctggaacacctatggcccgaccgaggcgaccgtcgtggcctgtgcctctctcctgaccgggaacgagcccatccggatcgggctgcccctgggcggctgggagctggccgtcgtcgacgaggccggggagccggtgccgatgggcggcagcgggcagctggtgatcggcggcgtgggcctcgcgcgctatctcgacgccgagaaggacgcggagaagtacgcgccgctggcgtcgctcggctgggcgcgcgcgtaccgcagcggtgacctcgtcagggccgagcccgaggggctggtcttcctcgggcgggccgatgagcagatcaagctcggcggccgtcggatcgagctgggcgaggtggacgccgcgctccaggcgctgccgggggtcgcgggcgcggccgccgccgtgcgcaccgcccgcagcggcaaccagcttctcgtcggctatgtcgtcacccaggacggctgggaccaggcagcggccgtcgagaagctgcgcgccgagctgccggccgccctcgtaccgctgctcgcgcccgtcgccgacctgccgacgcgcacgtccggcaaggtcgaccgcactgcgctgccctggccgctggaaggggtggaggcccccaccgccgagctctacggcaccgaggcctggctcgccgagcagtggaccgaagtgctcggcatcccggtcggcggcgccggtgacgacttcttcgcgatcggcggcggcagcctggccgcagcccagctcaccaccaggctgcgcacccgctacccgggcgcggccgtcctcgacgtctaccagcagccggtgctgcgcaagctggcccgccggctggagaggtccacgcgggacgacggagcggcccgcgtgatcgccccggtcccgccgcgtgccaaggcccttcagcttctcctgctgatcccgctgttcacgctgctcgggctgcgctggacggtggcactggccgcgctggggaacgtactgcaccggttcggcccgtatccgtgggcgccgtccgcctcctggtgggtggtgaccgccggagcggtgctgttcttcagtccacccgggcggctcgccatcgcggcgggcggggcccggctgctgctgcgggggctcaggccgggccggtacccgcgcggcggcagtgtgcatctgcggctgtggacggcggagcggctggccgagttcagcggggcgacctcgctgaccgggtcctggctggagcggtacgcgcgggccctgggcgccaaggtcggcgcggacgtggatctgcactcgttgccgccggtgaccgggatgctcaagctgggccggggcgcggccgtcgagtccgaggtggatctgtcgggccactggctggacggcgaccgcctcgagatcggcccggtcagggtcggtgcgcatgccgtggtcggtacgcgcagcatcctctttccgggtgcgcgggtcggcaagcgggccgaggtggcgcccggttccgccgtcgccgggcagattcccaccggtcagcgctgggcgggggcgccggcgggcaagctcggcaaggcgaagcgcgcgtggcccgaggagcggccgcggcgtggcacgtactggcgggcgatgtacggcgcggccgggttcgcgctgagtgcgctgccggtgctcgcggggctggccgccctgctggtggccggggtgttcgtggcgccggacgccgggctcggcgccgccctgcggggtgccgcgatcgccctggtgccggcgacgctcgccttcgggtgcgcgtacgccctgctgcttctgctcgccgtacgtctgctcagcctggggctgcgcgagggcacgcaccccacgcacagccggaccggctggcaggcgtggacggtcacgcagctgatggaccgctcgcgcgagacgctgttcccgctgtacgccgggctgatcacgccggtgtggctgcggttgctcggcatgcggatcgggcggggcgccgaggtgtccaccgtgctcgcgctgccgagtctcaccacggtcggcgagggcgcgttcctcgccgacgacaccctgaccgctccgtacgagctgggcggcggctggatgcggatcgggcgcgcgcagatcgggcgccgggcgttcctcgggaactccgggatgaccgcgccggggcgcagcgtgccggacggtgggctggtcggggtgctgtcggcgaccccgaagaaggcgaagaagggcagctcgtacctggggctgccgccggtgaagctgccgcgttcgacgcgggacggcgatcagagccgtacctacgacccgcccgcgcggctgctgtggggacgggcgctcgtggagctgtgccggatcgtgccggtgttctgctcggcggcgctggtggtgctgaccgtcgccgcgctgagcgcgctgggcggctgggcgccgctgctggccggactcgtgttcctgggcgccggcgtgctcgcctgcctgacgtccgtcgtggcgaagtggctgctggtgggccggcaccgggcgggcgagcacccgctgtggagcggtttcgtgtggcgcaatgagctggctgacaccttcgtcgaggtcgtcgcggtgccgtggctggcgggatccgtgcccgggacgccgctgatgacggcgtggctgcgcggcctcggcgcccgtatcggcaagggcgcgtggatcgagagttactggctgcccgagacggacctggtgaccctggaggacgcgaccacggtcaaccggggctgtgtcctgcagacccacctcttccacgaccggatcttgcggacggatactgttgtcctccgtgagggcgccactctgggcccgggcggaatcgtccttcccggcagcacagtcggggcgcgcagcacgctgggacccgcgtcgctcgtcatggcggcggaatccgtccccgacgacacccgctggctgggcaacccgatcgaggcgtggcgtccccgggcg

SEQ ID NO: 6612 - DNA, 1323 bp, Streptomyces avermitilis
  CDS (1)..(1323)
gtgagcgagtcgaacacggccaggggcatctctggcgaggacgaggtcgtggacctctgtcgcgagctgatccggatcgacaccagcaactacggggaccactcggggccgggcgagcggaaggccgccgagtacgtcgccgagaagctcgccgaggtcgggctcgaaccgcagatcttcgagtcccaccagggacgcgcctccacggtcgcccgcatcgagggcgaggacccgtcccggcccgcgctgctcatccacggccacaccgacgtcgtaccggccaatgcggcggactggacccaccaccccttctccggcgagatcgcggacggctgtgtctggggccgcggtgccgtcgacatgaaggacatggacgcgatgaccctggcggtcgtacgcgaccggctgcgcaccgggcgcaggcccccgcgcgacatcgtgctcgccttcctcgccgacgaggaggcgggcgggacgtacggcgccaagtacctcgtccagaagcaccccgacctcttcgagggcgtgaccgaggcgatcggtgaggtcggcgggttctccttcaccgtcaacgagaagctgcggctctacctcgtcgagacggcccagaagggcatgcactggatgcgcctcaccgtcgacggcacggcaggccacggctcgatgaccaacgacgacaacgcgatcaccgagctgtgcgaggccgtcgggcggctcggccggcacacctggccggtgcgggtcaccaagaccgtgcggtccttcctcgacgagctctccgacgcgctcggcaccgagctcgacccggagaacatggacgagaccctcgccaagctcggcggcatcgccaagatggtgggcgccacgctgcgcaactccgcggcgcccaccatgctgggcgccggctacaaggtcaacgtcatccccggccaggccaccgcgcacgtcgacgggcggttcctgcccggtcacgaggaggagttcctcgccgacctcgaccggattctcggcccccgcgtgaagcgcgaggacgtgcacggggacaaggcgctggagaccgacttcgacggcaggctcgtcgacgcgatgcagagcgccctgagcgccgaggacccgatcgccaaggccgtgccctacatgctctccggcggcaccgacgccaagtctttcgacgacctcggcatccgctgcttcggcttcgcccccctgaaactgccgccggagctggatttcgcgggcatgttccacgggatcgacgagcgtgtgccggtcgacgggctcaagttcggcgttcgcgtactcgaccggttcatcgacgcgtcc

SEQ ID NO: 6613 - DNA, 231 bp, Streptomyces avermitilis
  CDS (1)..(231)
atgatcaagaaggtcgtcgccgctgcggctgccactggtggcctggttctcgcgggtgcgggcctggccgtcgccgactcgggtgcccagggtgccgcggtgcactccccgggtgtcgtttccggcaacgtcatccaggtgccggttcacgtcccggtgaacgtctgcggcaacacggtctccgtgatcgggctgctgaaccccgccttcggcaacacctgcatcaacaag

SEQ ID NO: 6614 - DNA, 909 bp, Streptomyces avermitilis
  CDS (1)..(909)
atgcgacaggtcacccgcaagggcctgatgaccgtggcggcggcgaccggcgtgctcgccgccaccggcggctacgcacacgccgactcgggtgcgtacggctccgcgtcacattcgcccggcgtgctgtcgggcaactcggtccaggtgccggtgcacgtgccggtgaacgtctgcggtaacaccgtgaacgtggtcgggctgttcaatccggcggtgggcaaccaatgcgccaatgggggcggcggcggtcaccacgatggcggcggtcaccacggaggcggcggtcaccacggtggcggctacggcgacagtccgtccggtggtggcggtcatcacggtggcggcggtcaccagggcggcggctacggcgacggcccgtccggcggcggtggcggcggtggtgggtcgcaggccggcgggcacaccggcgactcgccgggcgtgggctccggcaaccacgtccaggtcccggtggacgtgccggtgaacgtctgcgggaacaacgtcaccgtgggcgggctcggcaacgcggcaggcggcgacgcctgcgccgacaccccgggcggcggccacgcgacgaccccgcccggcggcggtggcgggacgacacctccgggcggcggcggcggtggcacgacgcctccgggcggtggcggtggcgggaccacgcctccgggcggtggcggtgggacgacgcctccgggcacacccggacaccccgggcagccgggcggcgacagctcggcgcaccccaaccaccccggtggacagtccgtcacccagcccgagggcaccgcgcagcttgcccacaccggcagcgacatgccgctcggcctgctggtaccggcgggcgcgggcgcactgctcggcggcgcgctgctctaccgcagggcgcgatcggcagcg

SEQ ID NO: 6615 - DNA, 186 bp, Streptomyces avermitilis
  CDS (1)..(186)
atgccggaatacgaatttgtcgacgtgtacgtgcctcgcggggtgtcccgcaaggaagccacacgcctgctgaccgaccatgccgagtacggccactgggagttggaccgcctcagcctgcaccgcgacggcagccgcagggtgcggttgcgccgacggatcatccgccaggtgcgcgccacatgg

SEQ ID NO: 6616 - DNA, 708 bp, Streptomyces avermitilis
  CDS (1)..(708)
atgtctgatgctgcgcagtccaccgctgccgaggtacgtgccgccgcggaggcggtcaagaccgcgctcgaccgccacctggccgcggtcgagcgcaggtcgggcgaggacgacccggccgtctatgaggcgttcaacgagctggccgcggcggccgaggagtacgacgaactgctctacgaccgctatgacgaggtcacgccgttcgagatccccggcacggacgattcgctgcccccgtacacgggacccgaggagcccagcgcggtgagtgtgctgatccgccgggactacgcggtggtggagccgcaacgactgctggcgcaggctcagcgggtcgaggccgcggaggagcccgccgacgaggtggccggcacggtccacggggcgctcggtgtgctgttcgaggagtacgagccggacgagatcgcctcccggcacaaggagttcggcctggaggagggcgactccacactctgggtgacggccgaggaggagcggccggagccgggggagtggctggaggcccccttcgagcagatcgacccgcagcacatcgtgtgccgcttcgatgccagcgccgtctacgacgaggagtcggacggcgaggagtcggacggcgaggttccggaggacgacctcggcccggactccgagctcgacggggagctggacgaagacgacctggaaccgctggacgcggatcgc

SEQ ID NO: 6617 - DNA, 2202 bp, Streptomyces avermitilis
  CDS (1)..(2202)
gtggacggcgtcccggagaccgagggcacgcccggcagcggggcggcgggcgacgccgagagctccgcggaaggcacagccgggagtgaggcggcgggcgctaccgagagctccgaaggcacagccgggagtgaggcggcgggcactgccgagggctcgggcgacgcggccaagcccaccgaggccgaggccgagttggcggcccagcgggtcgagcgggagcggatcgagcggcggaaggcggagaagcaggcgccgatcgaggccggcacgaagctgagcggcacggccgccgatctgctcgcggcggtgcgggtcgtggagagcggtgcgaagccggtggccagcgctttcagcgagccgccggcgccgcgcaggccggcccccgagcccgagcggcgcccggagcccgtggcggccccggccgggccggcggtccccgcggcacaagccgttgccggtgtgcgtgccgtactgaccgagggcggcgcccccgaggcgctcgcgccgcagctcgccgccctcctgggcgacggagccgacctgcaactgcgcgaggacccctggcagttgctgcgggtctccggagtgcgtcccgagcaggccgacggcttcgcccgggcgctgctcggcgcggagtgcggcccggacgacgagcggcggggccgggcggtcacggtgtggctgctggagcaggcggccctcgcggggcatacggcgctggaggtggcggccctcaccacggcgctcgcgcagcgggccgtgccggacccggacacagcggtgcagagcgcgctcgccgagggcgaggtgctggtgttccaggacgccctcgacgcggccgcgcccgccgcggaggcggaggccgaggaggagggagcggagcgtccggtccgcgtcctgatcggcctggagcggtacgccctcgcggaggagagcctcgccgacgcgctcggccgggtgatgaactccgtgccgaaggaggacggctcggccgccgactgggagcgggccgccgcatcggcgggcggctccgccgcggagctgatccgcgcggtcgcgggccacggcctggtcctccacaccggcggcgacgcctccggtgcggaggccgcggcgctgctgtccgccgcccgcgggctggggctgcggacctgggccgccgcgcacagccggatcggctgcgaccgcttcacggctcggctcgccccgtcggacctgccgggcgggccgcagcagggcccgggcaccggtgtctccaccgtggcgggtctgctgtccggcgcggagggtcccggccgggacgcggacggcgccctggtcctcgacctcctggtcgtcctggacgctccccagctcgacgtcgagaccgccgccatgctcgccgagtcgctgcccgacggggcccggctggtgctgagcggcgacccgggggtgttgtggtcggccggtccgggacgggtgttcgcggatctgctcgccgcacgcgtctgcccggggatcgcctcgcgcacccccgatcccggaccgatcggcgagctgatctccggcatcggcgtcggcgagctgaaccaggtcgaggcgcccggcaaggaggtcgtgatcgtgccggtgcgggacgccggtgaagcggtgcaccgcaccgtgcagctggtcgcggactcggtgccgcgggcgctcggcgtcccggccgagcagacgcaggtgatcactccggggcacggtggcgcggccggcacgcgcgcgttgaacgccgcgctcaaggagcggctcaacccgggccccgggcgcttcggcggattcgatcccggtgaccggatcgcgtactcccccgccccgggccgtacgctgccgggccgcgtcgtgaaggccgacgccgacgggctgcacctggagatcccgggcgcccccgtcgtcgtaccgaaggagcgggtggagcagtgcgtgcggcacggctgggcgctgaccgcgcaccaggcggtggggagccggtggcccgccgcggtcgtggtcctgcccggcgacgcggcgcagtccctgacccgcccctgggtgtacacggcgttcggcctggccgagcgccatctgtccgtcgtgcacggagtggagcaggcactgccccgggccgtggccgaggtcaccgccaagccgcgcaccacgcgcctgcccgccctgctcaggccccaggttccggccgccgac

SEQ ID NO: 6618 - DNA, 981 bp, Streptomyces avermitilis
  CDS (1)..(981)
atggagcagaggcatctcggccgtaccggcctgcgtgtgtcccggatcgggctcggcaccctgacgtgggggcgcgacacggacgagcatgacgccgcggagctgttgaaggtgttctgggaggcgggcgggaccctcgtcgacaccgcggacgtgtacggcgacggagaagccgagtacgtactcggacagctcatagaagggctcgtgccgcgccgggacctggtcatctcgacgaaggcggggagcgtagcggacccggaccggcggttcgacggttcgcgcgggcatctgctctccgcgctggacgcctcgctcgcccggctcggcacggactacgtcgatctgtggcaggtccacgccttcgacccgcacaccccgctggaggagaccctccaggcgctcgacctcgcggtcagcaccggacgggcgcggtatgcgggcgtgtccaacttctgcggctggcagctcgccaaggcggccacctggcagctctcggcgccgggcccgcggacccggatcgccagtacacagatggagtactccctgctccagcgcggcgtggagcgggaggtgctgccggccgccctggacctgggggtcgggctgctgccgtcctctccgctcggccggggcgtcttgacgggcaagtaccggggcgggacgcccgccggctcccggggcgcctcggagcatctggctccgttcgtcgctccctatctcgacgacacggcgagcggcatcgtggacgcggtacagaccgcggccgacggtctcgcggtcaccccgctccaggtggcgctcgcgtgggtccgcgaccggcccggcgtggccgcgccgatcgtcggcgcgcgcaacgcgcagcagctcacggcggcgttgtcagtggagacccttagtcttcctgacgagatctgccgggcgctggacgacgtgtcggccccggtgcaccactatcccgaccaggactggagcacgctg

SEQ ID NO: 6619 - DNA, 1053 bp, Streptomyces avermitilis
  CDS (1)..(1053)
atgcagctcgggatcaacctcggctactggggcgccggaatggacgcggacaatctcgccgtcgcccaagaggccgaccggctcggatacggcgtctgctgggccgccgaggcctacggctcggacgccgccaccgtactcacctgggtcgccgcccagaccgaacgcatcgacgtcggctcggccatcttccagatcccggcccgccagcccgcgatgaccgcgatgaccgccgccaccctcgactcgctttccggcggccgcttccgcctcggcctcggcgtctccggcccgcaggtctccgagggctggtacggcgtcaagttcgacaagccgctggcccgcacccgtgagtacgtcgagatcgtccgcaaggcgatgacccgcgagcgcctgtcgtaccagggcgagcactggaccctgcccctgcccgacggcccgggcaagccgatcaagctgaccgtccaccccgagcgtgagtacatcccggtctacatcgccgcgatcggcccgaagaacctggagcagaccggcgagatcgccgacggtgcgctgctcatcttcccctcggccgaccacctcgaggacaccgcgatcaagcacctgcgggcaggccgggagaaggccggcaagaccatggacggcttcgacgtctgcccgaccctcccgctcgcgctcggcgacgacaagaacgtgaccgcgctcgccgacacgttccgcccctacaccgcgctgtacgtcggcggcatgggcagccgcaagcagaacttctacaaccagctcgcccagcgcatggggtacgagaaggaggccgccgagatccaggacaagtacctgtccggcgacaaggagggcgccgcggccgccatcccgcacgagctgatcgaccagaccacgctgctcggttccgtggaccgcatcgcggaccggatgaaggcctacgcggccgccggggtcaccacgctcaccctggcgcccgcgggcttcacgctggaggagcggatcgccgcgctgcgggcggggaccgacgccctggagcgggcgggcctcgca

SEQ ID NO: 6620 - DNA, 786 bp, Streptomyces avermitilis
  CDS (1)..(786)
atgctttcggtcaggagtctgttccaggagatcctcgacaacgacgagtcgttccggctcttctgctccatcgctgccagcggcgagtcccagggcggctgggagaacgggcggatcgccgcgctcgtcccgcacagccagcgtgacctcgcccccaagatcacccggcacggcgccgacgaggacaaacacgggcggatcttccacgccctcatgaagaagcgcggcctggaccccgtagcgatcccgcccgacaccgactacacgatgctcctggaacggcacggcatcggtctcgcccacgagaagctcaagggcgacgagccgctcaccgtgcaggacatcgtcacctacctcgcgcacagcagggtcaccgagcagcgcgccgccgagcagatggagctgctccgcaggcacttcgccgaccatcccgacatcggccgcgcggtcaggatgatctcccacgacgaggacaaccacctcgcgtactgccacgaagagctgttgcgcttcgcgtacaccggacacggccgcgccatccagcggacgctgcggcagtgcgcgctcgccgagatccgcgtctaccgggacgtcagcctcgccgtgatggcccacatgggccgcctcctcggctggccgaaggccagggcggcggcgctcgcggccggtatccacgcggtgtacgcctacgagcgcgccgtcggctggcgccgcatggtctccctgaggatgccggagcgccgcgacgcgctgggcggaccggcgaccaccgccgccgagtacgcg

SEQ ID NO: 6621 - DNA, 1029 bp, Streptomyces avermitilis
  CDS (1)..(1029)
gtgcgcacctgtccgcgcgacggaagaatacgctcagtgatcgtcgattgcgccatctaccgtgacggccgccgcacggagggcccggaggacctctccgacgcccttgacgaggcgcgtgcacagggtgacagcttcctctggatcggcctccacgagccgacggagaaggagttcgacctggtcacccatgagttcggactccatccgctggccgtcgaggacgccctgaaggcgcaccagcggcccaagctggaggtgtacgacgactcgctgttcgtggtcctcaagccggtgacgtacgagccgtacagcgacaccgtctcctcgggcgaggtcatggtcttcgtcggtgactccttcgtggtgaccgtgcgccacggggagggtgcgccgctgtcgagcatccggcacgaactggagcgccggccggacatgctccggcacggtcccaccggggtgctgcacgcgatcgcggactccgtcgtcgaccactatctggacgtggccacggagctggggaccgatctggaggagctggaggcggaggtcttctcgcccagcggcggggcgcggaacacggcgtcgcggatctactcgttcaagcgccagatccaggagttccgccgggccacggttccgctcacgccgccgctgacccggctcgccggcctggggcccaacctcgcggcggtgccgttcgtgaaggaggaggcgcggcccttcttccgcgacgtcaacgaccacctgacgcgcgtcaacgaatccgtggagggcctggaccggctggtctccgacatcctctcggcgcatctcgcgcagatgagcgtgcgtcagaacgacgacatgcggaagatctccgcgtgggcggccatggcggcgatccccacgatgatcgcggggatctacggcatgaacttcgagcacatgccggagctgcactggacgtggtcgtatccggcggtgatcgcggcgatggtggtgctcgaggttctgctgtaccggctgttcaagcagcgggggtggctg

SEQ ID NO: 6622 - DNA, 720 bp, Streptomyces avermitilis
  CDS (1)..(720)
gtgaggaccgccgggggcccctttaggctgggccgcatgcccacgttgatcctcgtccggcacggacgttccaccgcgaacaccgcgggactgctcgccgggtggacgcccggcgtcgccctcgacgagcggggcgccgcccaggccgccgccctcccgggccgcctcgccgaggtgccggtctccgagatcgtcaccagcccgctccagcgctgccgggaaacggttcagccgctgctcgacgcccgccccgggctgcgcgcgcacaccgaggaacgcatcggggagtgccactacggcgactggtcgggccgcaagctcgccgagctgaaggacgagccgctgatggaggtcgtccagtcgcacccgtcggcggccgcgttccccggcggcgaatccatgcgcgccatgcagacccgcgccgccgaggcggtgcgggagtggaacgcgcgcgtggagcgcgatcacggctccgatgccgtctacctcatgtgctcgcacggcgacatcatcaagtcgcttgtcgcggacgcccttggactccatctggacctctttcaacgaatctccgtagaaccgtgttccatcaccgcgatccgttacacccgactgcggccttttctcgttcgcctcggggacaccggcgatttcgcgtcccttgccccgcgcgaggaaccctccggtggcgacgctccggtcgggggcggtgcgggcgcaccg

SEQ ID NO: 6623 - DNA, 588 bp, Streptomyces avermitilis
  CDS (1)..(588)
gtgtcgcgtcaggtgttcctctacgaccccccggaccgtttcgtggccggtacggtcgggctgcccgggcgccgtaccttcttcctccaggcctcctcgggaccccgtgtgaccagcgtggccctggagaagacccaggtcgccgcgctcgccgagcgcatggacgagcttctcgacgaggtcgtacggcgcagcgggggcagcgccccggtccccgccatggcccccaccgagatctccgacaacgcccccctcgaggctcccgtggaggaggagttccgggtcggcaccatggcgctggcctgggacggtgacgagcagcgcatgatcgtcgaggcgcaggccctcgtggagctcgacgccgaatccgacgaggacctcgccgaggcggaggagcggcttctccaggacgaggagaacggtccgccgatgctccgcgtccggctcaccggcctacaggccagggccttcgccaaacgggccctcgacgtcgtcaacgccggccggccgccctgcccgctgtgcagcctcccgctcgacccggaaggacacgtatgtccgcgccagaacggataccgccgcggagcg

SEQ ID NO: 6624 - DNA, 783 bp, Streptomyces avermitilis
  CDS (1)..(783)
gtgaccacggccgaactgctcgccgagggtgagctgaaagtacgtggccgcatccgcgaggcgtccaacgcggcgctgtactgcacggtctcgcacgacgggcaggaggcgttctgcatctacaagcccgtcgccggcgagcggcccctgtgggacttccccgacgggacgctcgcccagcgcgaggtcgccgcgtacgaggtctccgaggcgaccggctgggggctcgtgccgaccaccgtgctgcgcgacgggccctacggcgagggcatgtgccagctgtggatcgagggacagccggacgtcgagctgctggccctggtggacggcgaggagcccgaggccggctggaaggcgatcgggttcgcggacgtcggggaggggcgtacggcgcttctcgtgcacgccgacgacgaacgcctgcggcggctggccgtcctcgacgccgtcatcaacaacgccgaccgcaagggcggccatctgctgcccaccgacgagggccgcctgtacggcatcgaccacggggtgactttcaacaccgagaacaagttgcggacgctgctgtgggggtgggcgggggagccgctcacggccgacgctgccgaggccctcggcaccttgaaggacggcctgacggcgggaggcgccctcgccacccgtctggcggagctgatcacaccggccgaactcgacgccacgcgcgcgcgggtcgacgccatgctcacctcgggaaagcacccggagccgagcggtgagtggccggcgattccatggccgccggtc

SEQ ID NO: 6625 - DNA, 1227 bp, Streptomyces avermitilis
  CDS (1)..(1227)
atgcatgcctggcccgcttctgaggtccccgccctgcctggtgagggccgcgacctccggatccacgacaccgcgaccggcggggtaatacccctgcaccccggtcccgtcgcccgtatctacgtctgcggcatcacgccgtacgacgcgacccacatgggtcacgcggcgacctacaacgcgttcgaccttgtgcagcgcgtgtggctcgacaccaagcggcaggttcactacgtccagaacgtgaccgacgtcgacgatccgctcctggagcgcgcggagcgcgacggcgtcgactgggtcgggctcgccgagaaggagaccgccctcttccgcgaggacatgacggcgctgcggatgctgcccccgcagcactacatcggcgccgtcgaggcgatacccggcatcgtcccgctcgtcgagcggctgcgggacgcgggcgccgcgtacgaactggacggggacgtctacttctccgtcgaggccgacccgcacttcggcaaggtctcgaacctcgacgccgccgccatgcgtctgctctccgccgaacgcggcggcgacccggaccgtcctggcaagaagaaccccctcgacccgatgctctggatggccgcccgggagggcgagccgagctgggacggcgcctcactgggccgcggcaggcccggctggcacatcgagtgcgtggccatcgccctggaccacctcggcatgggcttcgacgtacagggcggtggctccgacctcgccttcccgcaccacgagatgggcgcctcgcacgcccaggcgctgaccggcgagttccccatggccaaggcgtacgtccacgccggcatggtcgcgctcaacggcgagaagatgtcgaagtccaagggcaacctggtcttcgtgtcgaagctgcggcgtgacggcgtggacccggcggccatccgcctggcgctgctcgcccaccactaccggtccgactgggagtggacggacgccgtcctcgaagaggccctcgcgcgcctcggcacctggcgcgcggccgtctcccgccccgacggtccgcccgccgaggcgctcgtcgaggagatccgcgacgccctcgcgaacgacctggacgcgccggccgcgctcgccgcggtcgaccgctgggccgcgctccagcacgagcggggcggtaccgacgagggcgcgcccggcgtggtgtcgcgggccgtcgacgcgctgctgggcgtggcgctg

SEQ ID NO: 6626 - DNA, 681 bp, Streptomyces avermitilis
  CDS (1)..(681)
ttgagggaaggtggcacccgaatgagcaccaccccgcaactcagctccatgggacagcagcaggaccagcagggccgacagggccagcagggcccgagcacggcaccgccgcagttcggccagcagcagccgtacgggcagcagcagccgtacgggccgcagatgcagcagcccttcggccagcagggcatggggcagcagggcatgggccagcagaacatcgggcagcagggcatcggccagcagcagcccttcgggcagcaccagcagcagattccgcagcaccttcagcagcagctccagcacctcggccagcagcagccgttccagcatctgctccagcagctcgctcagccgcaggacatcggcggccagcagcaacaacagcaacagcaacagcagcaacaggacgtccagcacggccaggccctggtgctgccgagcgccgtctcgaccgcggcgctctccatcggcgtggcccagcacttccaggacgtcgtgacaccgctcccgggccagccccaggtgctctacctgttcatcagcaacggatggcgccgactcatcaacccgaaccaggtgacgcacgacgcggtccaggaggccttcgcctacgggcagccggtctacgggatctacgacaccgcgaccggcgtcctgcagtccgtcatcgtgacgaag

SEQ ID NO: 6627 - DNA, 1956 bp, Streptomyces avermitilis
  CDS (1)..(1956)
ttgcacaggtttccccattcaacttgtttccaaaccaagttggcgaaatcgggctggactggacggcacgggcgtgccaggttgtgcgtcgaaggcgcggttccgggccggaccacgaaagccggccgcggcgccccggaagggggcaagtcatccgcgccgtccgctacttggcacccgcagcacggaccgaagggagcggcacacgcgatgaccgaccagggacagccggcgcagggcccgggagcgtccgggccggggcccgacggagcgggattcacctatcgaggagccgagcacgagctgatcgtcgtcgcccgtccggaggcgcggctgcgcgcccgggccgacggcgtccgctcggcggtgggcgccgacgtatcggccctcaacatgttcctcagtgacgaacagctcgcgctcgaaccgctgttcggcagcgaggagcgactccagcagtccatgaccacgggcgtcgagaacgtgcccgacctcggactcttctaccgggtgcgcggtgtgcggagccgcgcccaggaactgcgcgcacgcatcgccgcacttccggaggtcgacacggcgtatgtgaaaccgggcgccgtgcccgcctccaccggctccggcaggccgaccggagagagcgccgacgacagccggcggctgaaggaaggcacgcccgtcacccccgacttcggcagccgccagggctatctgcggcccgcgcccgaggggatcgacgcccactgggcatggcagcggcccggcggctcggggcaggacgtgacggtgatcgacgtcgagggcgcctggcagttggggcacgaggatctggccgccaagctcgccggtgtcgtcgtcggcaccccgctgaccgacctcgcctggcgcaaccacggcacggccgtcatcggagtgatcggcggcgaccgcaatgagcggggcgtcaccggcatcgtgccggacgccgtgaccgccgccgcgtccttccagggcatcggtacggctgccgcgatccacgcggcggccgaccggctcggccccggcgacgtcgtcctggtcgaactccatcgcccgggaccgcggttcgactacgaacagcgcgacgaccagcggggctacctcgcgctcgagtggtggccggacgacttcgcggccatccggtacgcgaccgcgaagggcgtcatcgtggtggaggccgccggcaacggtggcgagtccctcgacgacgcggcgtacgagcgccgccccgacgagttccccacgtggtggcgcaacccgttcaacccctcccaccggtcctccggcgcggtcctggtcggcgcgggcgcccctccgcccggcacccacggccgtgatcacggcccggaccgctcccggctcgcgttctccaactacggggcccgtgtggacgcgcagggctggggacgcgaggtcacgacgaccggcggcttctgggaccggcccggcgatctccagggcggtgccgaggaaatcgtctggtacacggacacgttctccgggacctcttccgcctccccgatggtggtcggcgccctggccgcgctgcaaggcatgctgaaggcggccgaccaggagccgatgtccccggaacgtgcccgcgtcctgctgcgggccacgggttccccgcagcaggacgcgccgggccggcccgcctcgcagcggatcggcaaccggcccgacatcaaggcggcggtcactcatctgctgcccgaggcggtcggctcggcccaggccgagcggtactgggacgagctgctgccgtatccgcgtgaactcccgcccaggctccggctgttcgcggccggcgcctggcgcaacctgaacaacccgtcccccgagatccgtcaggcggtgcacaccgccttcgcgggcggacggcccgacatccgtgtctggttctcggacgacgagatcatcggcctggtcgtcacgggc

SEQ ID NO: 6628 - DNA, 1002 bp, Streptomyces avermitilis
  CDS (1)..(1002)
gtgatcgagctcgagggggttcccgagctgatcgacccggtcatggtggccgcgttcgagggctggaacgacgccggcgacgccgcctccaccgcggtcgcacatctggacagggagtggaagggcgaggtgttcgcggcgctcgacgccgaggactactacgacttccaggtcaaccgccccaccgtgtggctggacggcggcgtgcgcaagatcacctggccgacgacccgcctctcggtggtgcgcgtcggcggggagaagccgcgtgacctggtgctggtgcggggcatcgagccgtcgatgcgctggcgctcgttctgcaacgagctgctggcgttcgcccacgaactgggcgtggagctggtcgtcgtcctgggcgccctgctcggcgacaccccgcacacccgcccggtcccggtcagcggcgtcacgtccgacccggacctggcccgcacgatggacctggaggagaccaagtacgagggccccacgggcatcgtcggcatcctccaggaggcgtgcacccacgcgggcgtcccggccgtgtcgctgtgggcggccgtgccgcactacgtgtcgcagccaccgaacccgaaggcgacactggccctcctcaaccgcctggaggacctgatcgacgtacgcattccgctgggcgagctgcccgaggacgcgcgtgcgtggcaggtgggcgtggaccagctggccgccgaggacagcgaggtcgccgagtacgtgcagtcgctggaggaggcccgggacaccgccgagctgcccgaggcgtcgggcgaggcgatcgcccgcgagttcgagcgatacctgcggcgcagggacggcggcggaccggcggccggcggacacgccacggcggacggcagcgacggcacctcgtatctgcgggacgcccccggcggccgtacgcggccaccgaagccgccgaagccggaggccgaggacgacggcccggccgacgaggggtccgacgactcgtcggaggac

SEQ ID NO: 6629 - DNA, 696 bp, Streptomyces avermitilis
  CDS (1)..(696)
atgtctgagcgacagggaggccccgccatggcagtcaccgatgaggcgatcgagaagatcaagggaatgatcgtctccggcgcgctgcgtcccggcgaccggttgcccaaggagagcgaactcgccgccgaactcgggctgtcccgcaactccttgcgcgaggcggtgcgcgccctgtcgctgatccgcatcctggacgtgcggcagggcgacggcacgtatgtgacgagcctggatccccaactcctgctcgaggcgctgagtttcgtcgtcgacttccaccgcgacgacacggtcctggagttcctcgccgtgcgccgcatcctggagccggcggcgacggcgatggccgcgtcgcgcatcagcgagcggcaactggacgcgctcacctcccagttggacgcgctgggcgcggcaccctccgtggaggaactcgtcgcctgcgacctcgagttccaccggggcatcgtgcagagttccgggaactcggtgctgtgctcgctgctcgacgggctgtccgggcccaccacccgggccaggatctggcgcggcctgacgcaggaggacgcggtcagccggaccctgcacgagcaccgcgcgatcctgaccgccctgcgcgaccgggacgcggaggcggcgcggtcgtgggcgacggtgcacatcgcgagcgtggagcagtggctgcgcagcaccctg

SEQ ID NO: 6630 - DNA, 1296 bp, Streptomyces avermitilis
  CDS (1)..(1296)
atgagcgagaccgtcgatctgctggtgcacggcggtgacgtgctgaccgtggacgaggccggaaccctcgtacgggacggggcggtcgccgtccgcgccggggagatcctcgcggtggggcccgcccaggagctgcggacgcggtacgcggcggccgaggacatcgacgccgagggctgtctcgtgctgcccggcctcgtcaacacccatacgcatctggcgatgacgctgctgcgcggccgcgcggacgacgtcacgctccagcgcttcctggagcggatgctgaagtgggaggccgagctgctgtcgccgaagaacgtggcggcggccgtacgggtcgcggtcgccgagagcgtacgggccggggtgacgtccgcgctggacatgtactggttccacgaggcggccgagcgtgcggcgcgggagtcgggctggcggctgcacaccggccccaccttcatggacgtaccggatccggccgacggcatcgcgtacgaggaccgactggcgtgggcgcggcgcgacctggccgaccgcgcgcaccggcccggcacgcgcccggtcctcttcgcccactcgacctacaccctctctcccgggcagctcctcgacatcgccgcgctggcccgggagttcggggcgctgctgcaccttcacgcggccgagaacgcgaccgaggtcgccaccgtcgaggtgcgtcacggcaagcgtccggtggaactgctcgactcgctcgggctgctcgggcccgatgtgctgctcgcgcacgccgtcgatctgacgggtcccgagatcgcggcgctggcccgcaccggcacctcggtcgcgcactgtccggtgtcgaacctcaagctgggctgcgggatcgcaccggtgccgcggctgctcagcgcgggtgtcaccgtcgggctgggcacggacggagccgtcagctccaacacgctggacgtgctgggtgctttgcggcaggccgccctggtgcacaaggcgggcggcgaccccaccgcggtgggcgccgagcaggccgtacggatggccaccatcgagggggcccgcgcgctggggctcggtgatcacctgggctcgctggaggcgggcaagcgcgccgacctcatcgtgctcgacctcggccggccgcatctgtgcccaccgcacgacccgtggtccctgctcgcgtacgccgcgcatgcgccggacgtacgggacaccgtggtcgacggcaggatcctgatgcgcggccgtacactcacctcgctcgacgaggcggccgcgctggccgaactcggcgcgcttgcc

SEQ ID NO: 6631 - DNA, 786 bp, Streptomyces avermitilis
  CDS (1)..(786)
atgacgcaggacctgctgcccgtcacccgcataccccgcaccgggctgcccccgtacgccgtggtcgtcggcgacccggcgcgcgccgcggccgtcgccgcactgctcgacggtgccgaagaggtctcgtaccaccgcgagtaccgggtgttccgcggggcctggaagggtctgccggtcacggtcgcctcgcacggggtgggcggtcccggcgcgatcctgctgttccaggagctggcggacgcgggggtccgcacgtttgtgcggttcggcacggcgggcgcgatgaagcccgggatcggcgacggcgacctcgtcatcgccgaggcggccgtgcgcgacgacggcgtgacacagcagctgctgccggccgcgtacccggccgtgtccgcgccggaggcggtactcgccctccagcgcgccgcccgcgagacgggtgccccgcaccaccggggcatcgtgtggacccgggccgccttccagcccggcctcatcccgctcgacggctacgcccgggccgggctcgccgcgatcgagatggagctgtccgcgctgctcgtgacggcctcgctgcgcggtctcgtcgcgggcggggtgctcgtggtggacggcgcgaacgccgacgaactggtcgacgaggacgcactgctgacgacgggcgcctacgacccgcaccgggacgtggtggcggcgggcgtggaacgcggcgcggtcgtgtcgctggaggcgctgcggctgctggcgcagggtgccgccgggaccgaggggaccgaggagtacaccgca

SEQ ID NO: 6632 - DNA, 864 bp, Streptomyces avermitilis
  CDS (1)..(864)
atgttcttcgactccgacctcctcatgtcggcgctgcgcgcgctcacgcccatcctgctggccgcgctcggcggggccctgtgcgagcgcgcgggcgtcttcaacatcggcctcgagggcatgatgctgatgggctgcttcacgtccgtcgccaccagctggttcaccggcagcccctggctcggcgtcctggccgcggcactcgccgccgccggatactccctgatcctcgccgtcggcgcggtgacgctgcgcggggacgcggtggtcctcggcatcgccatgaatctcctggccgtgggtctgaccggcttcctgctgcgtacggtcttcggtgtgcagggcactttcgacgatccgtcactggccgggctgccgctggtcggcggcttctcgccgctcgcctacctcgcctgggcggcggtcggcgtggccgcgctgatgctgtcccggcatgggtggggtctgcggctgcgcggagtcggcgaggctccggacgcggcggccacactcggggtgagcccggcgaagtaccagtacgcggccgtgctcgtgtcgggtgtgctgtgcgggctcgccggggcccaactcgccctcggcaacgtgacgttgttctccgagaacatgacggcgggacgcggctggatcgcggtcgtcgcggtcatgctgggccgtgcgctgccgctcggggtcctgctcgccgcactgctgttcggcgtcgccgaggcggccggcttccgccttcagggcctcggcctgccgcagcaggcgaccgacgccgcgccgtacgtcgtcaccctcggcgccctcttcctcacgacggcccgccgccgtcgccgtatccgtgccactggagccacctca

SEQ ID NO: 6633 - DNA, 1059 bp, Streptomyces avermitilis
  CDS (1)..(1059)
atgaaccgcatcaccggggccctgcgctcccccgtcgccttctcgattctcgccggagtcgtcatcggcgcgctgttcctcgtgggcacgggcgccgacccggtcgccgcctacggcgcggtcatcggcggctcgctcggcgcggacggcatcggctcgaccctgagcaccggcaccagcgtcctcggcatggcgctcgcgctggcgatcccgctgcgtgccgggctcatcaacctgggcggggacggccagctggtgctcggcgggatcgccgcggcggtcaccggcctgtacgcgccgctgcccgccccgctcaccgtcgtgctcgccctcttcgccggcatggcggcaggcgccggctacgcggccctggccgccctgtgcgagaaccacctcggggttccgctcctggtcagcagcctgcttctgagctatccggcggcgtcgttcgcctcgtacctggcccgttatccgctcaaggaacccggctccagcctcccccagacccgtcagctgcccgacggggtcgcgctgcccgccttcggcgggtcgaccgtgaccgtcgggctggtcctggtggcgctcgcggcggccgcgtactggttcgcggaccggcgcacggcgatcggctacgaggtccggatgaccggcctgaactcccgcttcgccgcgtatgcgggcatcgagcggaagggtctgacgctccgtctgatggcggtctcgggcgcgctggccggactcgtcggctcgatcggcgtgctgagcttcccgtaccgcttcgtcgacggctcgctcaccgctcccggccacacctggacgggcctgaccgccgcgctgctggcgggggcggccccgctgggcacggtggtcgcgtcgttcttcttcgccgtcctccaggtcggcgggctctcgatggaacggacgaccgaggtgccgcgcgagctgacccaggtcctccaggccatcgtcatcgtgttcctggcggcccggctgcggttcccgcggttctcgcggttccggcgagggcgcgagaagccgtccgcacaaggggagttcgcc

SEQ ID NO: 6634 - DNA, 1527 bp, Streptomyces avermitilis
  CDS (1)..(1527)
atgaccccgccgccgagtgacgctcccccggcggccgtcgaactccgcgggatcaccaagcgtttccccggcaccctcgccaacgacgccgtcgacctgacggtccgccgcggcgagatccacgccctgatgggcgagaacggcgcgggcaagtccaccctgatgtcggtcctgtacggcatggagcggcccgacgccggttcgatccggatcgacgggcgcgaggtgtccttcgccgatcccggtgccgcgatggccgccgggctcggcatggtgcaccagagcttcaagctgttcgactcgctgacggtcgccgagaacgtcgtgtacgccgccgagccgcgccgcttcggtctggtggaccggtccgcggcccgtcggcgggtgcgcgaactcgccgaggtgcacggcctcgccgtggacccggacgcccgcgtcggtgagctgccggtcggtctgcgccagcgggtggagatcctgaagctgctgcaccgcggcgcccggacgctcatcctcgacgagccgaccgcggtgctcacgcccgccgaggccgacgcgctgttcgcggtgctcaagtcgctggccgccgagggccgtacggtcatcctggtcacgcacaagctgcgcgaggtcctcgaaggcagcgaccgtgtgacggtgctgcgggacggcagggtcgtcgcccggctgcgcaccgccgggaccacggccgacgagatcgcggccgcgatgaccggccgcgcggtggaactggaccgcgtccacgcgccgggcacaccggccgacgtggtcctgggcgtgcgggggctcaccacggacgccgtgcgcgaggtcgaactgacggtccgcgcgggcgagatcgtcggtatcgcgggcgtcgccggcaacgggcagagcgagctggtcgaggcactggccgggctgcggccgaccgccgccgggcaggtcacgctgcggggcgaggacatcacgcacgcctcggcgaccgagcggcgcgccaggggcctcgcgtatgtgcccgaggaccggcacgcggtcggcaccgcgcccgccgcgtccgtcgcggacaacctcgcgatggggcaccaccgaacgtcgctgtcgtcccggggactgctgtcagccgcggccgtccgcgcccacgcgctggggctcgtcgagcgcttcggtatcaaggcggccacccccgaggtgcccgcgtccgccctgtccggcggcaatctccagaagctgctgatcggccgcgagctcgcccacgaggcaccgctgctgctggtcgaacagcccacgcgcggcgtcgacatcggcgccgtccagaacatccacgaccagctgatcgcctaccgcgacgccggtcacgccgtactcctggtctcggccgagctgagcgagatccgcgggctcgccgaccgggtgctcgtcatgtacgagggccgggtgacggcgacgtacccgaaggacgaggcggacgagcggacgctggggctcgcgatggcgggagccgccgcaccggcagaggtcggagac

SEQ ID NO: 6635 - DNA, 1047 bp, Streptomyces avermitilis
  CDS (1)..(1047)
atgcaccgcagatcccgtcgtaccctccagctcgccgctgccaccacgctcctcgtgaccggcctcaccgcctgcaacgccgccgcgaagaacgacgcctccggcaccgcgaagagcggcggcaagtccttcaccctggtcactcccgacggcgtcggccagaacgagttcctcaagctcgccgtcgacggggtgaaggccgcggccgaggcgcacgacgggacgcagaaggtctaccagtccaccgacacctcctcgcagcagcagaacgtgcaggcggccgtggacgccgagccggacgtgatcgtgctggtcggcttcgagttcgccgacgtggtcgcgcagcaggcgaaggcgcaccccgagcagcagttcctgatcgtcgacgcgtgcaccaccaagacgtatcggaacgtcagctgcgcggtcttccgcgagcacgagggcgtgtacctggcgggcgccgaggccgggctgctgagcaggagcggcaaggtcggcgcggtggacgtgctcgacaccccccagttccgccgctacagcgacccgttcgcggccggcgccaaggaggtggccgcgaagacgtccgcctccacccgcttcgtcggcggccagtccccgttcgacgactcggcccgcgcgaaggagcaggcgaactccctgctcgccaagggctacgaccagatcatggcggcggccgcggccggcaactacggcgtcttcgaggcggcgaaggccaagggcgcgtacgcgtacggcgtcgacgtcaaccagtgcgtcgcggcgcccggcacggtcgtcgacaacgtcatcaagcggaccgatgtcgccgtgcggaagggcatcgaccaggtcctgggcggcaaggcggggaccaccgtctcgtacggcctgaaggagggcggcatcagcctcacggggctcgaggacggcgtggccacctccaagtgcgtcatcgcccagcacaaggacgtcctgaagaaggtcaccgcgctgcgcgaccggatcgtcgccggagagctgaaggtcgatgaccccgccgccgag

SEQ ID NO: 6636 - DNA, 1038 bp, Streptomyces avermitilis
  CDS (1)..(1038)
gtgtctgttatgtcccagaaactgcgcgccgtcgactggaccggaaacagcctcgcgctcatcgaccagaccgtgcttccgcaccgtaccgaaaccatccaagtccgtgatgtggacggcctggtggacgcgatccagcgactcgtggtgcgcggcgcgcccgcgatcggggcggcgggcgcgtacggggtcgcgctggccgtgctggagggcgagcgcgagggctgggaccgtacgcaggtccttgcggcggtcgcccggatccgcgcggcacgccccaccgcggtgaacctcatggtgtgcgtggaccgcgtgctgacccgcttcgacgagggcctcgacgcggtgctcgcggaggccgcggcggtgcagcgcgaggacgtcggggcgaaccgggcgatgggggcgtacggggcggactggctgctgaagcgggtggccgccgaccgtccgctccgcgtcctgacgcactgcaacacgggtgcgctggcgacggcgggctggggtacggcgctcggtgtgatccgcgaactgcacgcgcgcggacagctggaagtggtctacgcggacgagacgcgcccgctgctccagggctcccgcctgaccgcctgggaactcgtccaggagggcataccgcactacgtccaggcggacggggcggccgcgggcacgatcctgcggggcgaggtggacgcggcgatcgtcggcgcggaccgcatcgcggccaacggcgacacggcgaacaaggtgggcacggtgggggtcgcgctggcctgcgcgtacgcggggatcccgttcctcgtggccgctcccaccacgacggtggacctgtcgacggcgacgggcgacggcatccacatcgaactgcgcggcgaggccgaggtgttggagtggtcgggcatccggacggctcccgccgggtcgcgcggccacaacccggcgttcgacgtgacgccggggcggctggtgacggggctggtgacggagcggggcgtgctcgaggtctcggcgggagaactgccgggggagcacctgcgg

SEQ ID NO: 6637 - DNA, 606 bp, Streptomyces avermitilis
  CDS (1)..(606)
atgaccgtcgacacgtcagttccggacctggagggggcgggcgcggtcctggccgccgagtccgcccgcttcgcctccttcggctggatgcgcggcacgtcgggcaacctgtccgtggtcctgtcccgtgacccgctgcggctcgcggtcacggcgagcggccacgacaagggtgaactgacgcccgcggacgtggtcctggtggacggcgacggtgcggccgtcgccgggggcaggccctccgcggaggccgcgctgcacgcgcgcgtggccgcgctgaccggtgcgggggccgtcgtgcatgtgcacacggtcgcctccgtggccatgggccgccgcgagccgggcggcatcgcgttccgggacctggagatgctgaagggcgtcggcctgcccgcccatgacgtcgaggtcacgctgcccgtcatcgccaacagccaggacatgaaggtgctcggcgaccgtctcgaggaggcgcgcgatccccggatgccggcggtggtcgtggcggggcacgggctgtatgtgtggggcgagaaccctcgtcaggcccggcatcacaccgaggtcgtggaatggctgctcgagttggagctcacgcagcgg

SEQ ID NO: 6638 - DNA, 717 bp, Streptomyces avermitilis
  CDS (1)..(717)
atgagttcggtcttcgacatcgactccgtggtgctcgacatcgagggcaccacgagcgccacggggttcgtcgtggacgtgctctacccgtactcgcgctctcgtttcggagcactgctcaccgagcggagcggtgatccggaggtggcgcgggcggtggcgcaggtacgggagttgctcggcgagccggacgccgatgccgtacgcgtcgagaaggcgctgaacgagtggctcgacgacgaccgcaaggccacgccgctgaagacccttcagggcctcgtctggtccgagggcttcgcccggggcgagctggtgtcgcacttctacgacgacgtggtgccggcgctgcgcgcgtggcacgcggcgggagtgcgcctgcatgtgtactcgtcgggttcggtggccgcgcagcgcgcgtggttcaggtcgagccccgagggcgatctgctgccgctggtcgaggggttgtacgacaccgagaacgcggggccgaagcaggagccggagtcgtaccggacgatcgcggcggcgctgggcaccggggccgaccggatcctcttcctctccgaccggccgggcgagctggacgcggcccgcgccgcgggctggcggaccgtcggtgtccggcggcccggagagccgtactacgagcagggcgtcggggaccacgcgcaggcggggtcgttcggcgggatcaccatcgcaaggagcaccgca

SEQ ID NO: 6639 - DNA, 591 bp, Streptomyces avermitilis
  CDS (1)..(591)
atgaccctgctgacgacctggcccgagtccggaccggagaccgtggtgcgccgcacctccgaccccgccgagatcgccgccgcgctcgcgccgctcggggtccgctacgagcagtggccggtccgcgcggacgtgccggcggacgcggacagcgacacggtgttcgccgcgtacggcccggagatcgaccggttgaacgccgaggagggcttcaccacggtcgatgtgctcgggctgcacccgagcgacgacccggagtacccggtgaaggcgaaggccgcgcgcgcgaagttcctccaggagcacacgcacgacgacgatgacgaggtccgcttcttcgtctcgggctccgggatcttctatctgcatgtgaacggcgaggtccacgccgtgtactgcgagaagggcgacctgctgggcgtgccgcgcggtacgacgcactggttcgacatggggacgcggcccgccttcaccgcgatccgcttcttccacgaggaggacggctggatcggcagcttcaccggctccaccatcgcgtcccggttcccggactacgacacgatccacgccggtcacgtgggttctgccgca

SEQ ID NO: 6640 - DNA, 1116 bp, Streptomyces avermitilis
  CDS (1)..(1116)
gtgattcctcccctgccgctccggaccggcactccctcttcatcctcttcgccccgccctggagcgcctcatgtcccgtacccgcctgcccgtcgccgcgctctcactaagcaggccctgccctgggtgcgggtggcgggcccctcctggccgatgagccccgagcgcgccgacgccgaggcccgggcctacgagcaggtcgccggggtcgcaccggacaagatcccggcgatccacggctacgacggcgagaaccacgccctcgtcatggaggacatgtccgacctggaggtcctgcgcacggtcctcaacgagggcgccgcgtacggccccgacacctcgcgccgcatcggcgagttcgtcgcccagctctccttcgcgaccagcggcttcggcatgccgtcagccgagcgcaaggcgctgatcgcggcctgtgtcagccccgagctgtgcaagatcaccgaggacgtggtcctctccgagccgtacatcgaacacgagcacaaccactggcaccccggactcgacgacctggcggccgcgttccgcgccgacccgcgcctgcgcaccgaggtcgccgacctccgccacgtcttcatgacgagcgcgcaggccccgctccacggtgacctccacacgggcagcgtcatggtgggcgagcgcgacggcgccccggtcgtccgggtcttcgaccccgagttctccttcgtcggcccgatcggcttcgacctcgggctgtactgggcgaacaccctggtgtcgcaggagcgggcgcgggccctcggcacgctcaccgatcacggtgagcaactccggctgtcctgggaagcgttcgcggctcagttccgccggctgtggccgacccgcgtcgacaccttcttcgacgacgcctatctcgaccgcttcctcgaccgcgtgtgggccgagtcgctgggcttcgccggtacggagatcgtccgccgcgtcatcggcttcgcccacctcaccgacctgacaacgctcccggacccggtaccggcgtcccgccgggcgctgctcctgggccgggaactgatcgtgcgacgtgccgagttgacgggaccggacgacgtacgggccgtggtggcgtcgctgtcc

SEQ ID NO: 6641 - DNA, 1614 bp, Streptomyces avermitilis
  CDS (1)..(1614)
atgaccagtcagcccacccttcagtccgtgcctgccctcggtacgcacccggcctccggctccaacccgagccgcgccgagacccgggagcagctttccaaggcgacgtacgacctcctcgtcatcggcggcggcatcctcggcatctccaccgcctggcatgccgcgcagtccgggctgagggtggccctggtcgacgccggcgacttcgccggcgccacctcctccgcctcctccaagcttctccacggcggtctgcgctacctgcagaccggcgcggtgaagctggtggcggagaaccacttcgagcgccgtgcggtctcccgccaggtggccccccacctggcgaacccgctcacgttctacctccccgtgtacaagggcgggccgcacggcgcggcgaagctcggggcaggcgtcttcgcgtactccgcgctgtcggcgttcggcgacggcgtggggcacctgctcggcccctcgaaggccgcgcaggacgtgccggagctacgcaccgagaacctgaaggccgtggccgtgtacggcgacgaccagatgaacgactcgcggatggccctgatgacggtccgcgcggccgtcgagtcgggcgccgtcgtcctcaaccacgccgaggtcaccggcctgcgcttcaccaggggccgggtcacgggcgcggagctcaaggaccggacgaacggcgaggagttcggcgtcaacgcgcgcctcgtcctcaacgcgaccggcccgtgggtcgaccacctgcgcaggatggagaacccggacgcggctccgtccatccgcctctccaagggcgcgcacctggtgctgaagcgcacctcgccctggaaggcggcgctggccaccccgatcgacaagtaccggatcaccttcgccctcccctgggaggacatgctgctgctcggcacgaccgacgaggagtacgagggcgagccgggcgacgtcgcggtcaacgagaaggacatcgcccagatactggacgaggccgcgttctcgatccgcgaccagcagctctcccgtgacctgatcacgtactccttcgccggtctgcgggtgctgcccggcggtcccggcgacacctcgaaggccaagcgcgagacggtcgtcaccgagggccgcggcgggatgctgtccgtcgcgggcggcaagtggaccaccttccgccacatcggccgtacggtcatgaagaagctggagtcgctgccgggccatccgctcggtgaggacttcgagccgatcaacgagctgccgaagaagctgccgctgccgggtgtcgccaacccgcgcgcggtcgcccaccggctgctggtcgacggcccggcgcccggcccgcgcatggccgccgacacggccaagcacctggccacgcactacggttcgctcgccttcgacatcgcgcgcctggcgaacgacaacccggagctcggcgagcgcgtccaccaggacgccccggagatctgggcgcaggtcgtctacgcccgggacaacgagtgggccgagacggcggacgacgtgctgcgccgccgtacgacgctgacgatccgcggcctcgccacggacgaggtccggggcaaggtgcaggacctgctcgacaagaag

SEQ ID NO: 6642 - DNA, 1536 bp, Streptomyces avermitilis
  CDS (1)..(1536)
gtgaccgacgcacacaccgccggccccttcatcgccgcgatcgaccagggcaccacgtccagccgttgcatcgtcttcgaccgggacggccgtatcgtctccgtcgaccagaaggagcacgagcagatcttcccgaagccgggctgggtcgagcacaacgccgccgagatctggaccaacgtccaggaggtcgtcgccggagccgtcgagaaggccggcatcacccgcgacgacatcaaggccatcggcatcaccaaccagcgcgagaccacgctgctctgggacaagaacaccggtgagcccgtccacaacgccctcgtctggcaggacacccgcaccgacgcgctctgcaaggaactcggccgcaacgtcggccaggaccgcttccgccgcgagaccggcctgccgctcgcgtcgtacttcgccggcccgaaggcccgctggctgctggacaacgtcgagggcctgcgcgagcgcgccgaagccggcgacatcctcttcggcaccatggacacctgggtcatctggaacctgacgggtggtgtcaacggcggcaagcacgtcaccgacgtcaccaacgcctcccgcaccatgctgatgaacctgcacaccatgcagtgggacgacaagatcgccgagtccatcggtgtcccgctggcgatgctgcccgagatccgctcctccgccgaggtgtacggcgagatcaccggcggcaagctcggcgacctgctcggcggcatccccgtcgcctccgcgctcggcgaccagcaggcggccctgttcggccagacctgtttctccgagggcgaggccaagtccacgtacggcaccggcacgttcatgctgatgaacaccggtgacaagatcatcaactcgtacagcgggctgctgaccaccgtgggctaccagatcggcgaccagaagccggtctacgccctcgagggttccatcgccgtcaccggttcgctcgtgcagtggatgcgcgaccagatgggcctgatcaagtccgccgccgagatcgagacgctcgcgtcgtcggtcgaggacaacggcggcgcctacttcgtgccggccttctccggtctgttcgccccgtactggcgctccgacgcccgcggtgtgatcgccggtctcacccggtacgtcaccaaggcgcacatcgcgcgcgccgtcctggaggccacggcctggcagacccgcgagatcaccgacgccatgacgaaggactccggcgtcgagctcgcggccctcaaggtcgacggcggcatgacctccaacaacctgctgatgcagacgctctcggacttcctggacgcgccggtggtgcgtccgatggtcgccgagaccacctgcctcggcgccgcctacgccgccggtctcgccgtcggcttctggaccaacaccgaggacctgcgggccaactggcgcagggccgcggagtggaccccgaacatggccgcggagacccgcgaccgtgagtacaagagctggctcaaggccgtcgagcggaccatgggctggatcgaggacgaggag

SEQ ID NO: 6643 - DNA, 792 bp, Streptomyces avermitilis
  CDS (1)..(792)
gtgtccagctccgacatcttcatcggcgagaccatcggtaccgccgtactcatcctgctgggtggtggcgtgtgcgccgccgtcacgctgaaggcctccaaggcgcgcaacgccggctggctcgccatcaccttcgggtggggcttcgcggttctgaccgcggtctacatctcggcgccgctttccggtgcccacctcaatccggccgtgacgctcgcgctcgcgatcaaggacaacgactggagcaacgtccccacctactgggcgggacagctgctgggcgccatgatcggtgccgccctggtctgggtcgcctactacggccagttccacgcgcacctcaccgaccacgagatcgtcggcggtccgggcgcacaggccaccaagaccaaggccgtagaggcccaggagacgggagccggccccgtgctcggcgtcttctccaccggccccgaggtccggaacgtggtgcagaacctcgccaccgagatcatcggcaccgtcgtcctcgtgctcgcgatcctcacgcagggcctgaacgacaacggcaacggcctcggcaccatcggcgccctgatcacctcgctcgtggtcgtcagcatcggcctctccctcggtggcccgaccggctacgcgatcaacccggcccgtgacctcggtccgcgtatcgtgcacgccctgctccccctgcccaacaagggtggttccgactggagctacgcctggatcccggttgtcggcccgctgatcggcgccgcgatagccgcaggcatatacaacgtcgccttcgca

SEQ ID NO: 6644 - DNA, 762 bp, Streptomyces avermitilis
  CDS (1)..(762)
atggcacggaacatccagtcgctcgaacgggcggccgcgatgctgcggctgctcgcgggcggcgagcgacggctcggcctctcggacatcgcctcgtcgctgggcctcgccaagggcacggcccacggcatactgcgcacgctgcagcaggaggggttcgtcgagcaggaggcggcctcggggcgctaccagctgggcgccgagctgctgcgcctcggcaccacgtatctcgatgtgcacgagctgcgggcgcgcgccctggtgtggacggacgacctggcccgctccagcggcgagagcgtctatctgggcgtgctgcaccagcagggcgtactgatcgtgcaccacgtcttccggcccgacgacagccggcaggtgctggaggtcggggccatgcagccgctgcactccacggcgctcggcaaggtcctctcggcctacgacccggtggcgcacagcgaggtcctggaggccgagcgcaaggtgttcacgccgcgcacgatcagtgagctggaccagttcgagggcgtgctcgacctgacccgcgcgcgcgggtacgcggacgatgtcgaggagacctggacgggggtcgcctcggtctccgcaccgatccacaaccggcggcggatgccggtcggcgcggtgggcatcaccggggccgtggagcgggtctgcaaggacgggcagctgcgtccggacctgatcgcggcggtccgggactgcgcccgggcggtgtcacgggatctgggcgcggggcggttc

SEQ ID NO: 6645 - DNA, 3570 bp, Streptomyces avermitilis
  CDS (1)..(3570)
atgggaagcgcaaagccgacagccgtcgcactccagggagcatcttccatggcctcgttgccgaatccgtccccttcgtccgcctccgccgcgagccggagccgaaccgacgccctacgcgaagccctcgccacccgtgtggtggtggccgacggcgcgatgggcacgatgctccaggcacaggacccgacgctcgaggacttcgagaatctcgagggctgcaacgagatcctgaacctgacccgccccgacatcgtgcgctccgtccacgaggcctacttcgcggtgggcgtcgactgtgtggagaccaacaccttcggagccaaccactcggcgctcgccgagtacgacatcgccgaccgtgtcttcgagctgtccgaggccggggcccggctggcccgcgaggtggccgacgagttcggcaccggcgacggccgccagcgctgggtcctcggctcgatcggccccggtacgaagctgccgacgctcggccatgtgggatacggcaccctgcgcgacggcttccaggcgaacgccgagggcctgatcgcgggcggcgcggacgccctgatcgtggagaccacgcaggacctgctccagacgaagacctccgtgctgggcgcccggcgggcgatggacgcgaccggcgtggacctgcccctgctggtctcgatggcgttcgagacgaccggcaccatgctgctgggctccgagatcggcgccgcgctcacggcgctcgagccgctcggcatcgacatgatcggcctgaactgctcgaccggccccgcggagatgagcgagcacctgcgctatctcacccgccactcccgcatcccgctgctctgcatgccgaacgccggtctgccggtgctgaccaaggacggcgcgcacttcccgctcggccccgagggactggccgacgcccaggagaacttcgtacgcgactacggcctgtccctggtcggcggctgctgcggtacgacacccgaacacctgcgccagctcgtggagcgggtgcggggggtcgagcccaccgagcggcgcccccagcccgagccgggcgccgcctccctctaccagaccgtcccgttccgccaggacaccgcgtacatggcgatcggtgagcgcaccaacgccaacggctccaagaagttccgcgaggccatgctggacgcccgctgggacgactgcgtggagatggcccgcgaccagatccgcgagggcgcgcacatgctcgacctgtgcgtcgactacgtgggccgcgacggcgtcgccgacatggaggaactggccggccgcttcgccaccgcctccacgctgccgatcgtgctggactccaccgaggtcgacgtcctgcgcgccggactggagaagctcggcggccgggccgtcatcaactccgtcaactacgaggacggggacggccccgagtcgcggttcgcgaaggtcacccggctcgcccaggaacacggcgccgcgctgatcgcgctgaccatcgacgaggagggccaggcccgcaccgtcgagaccaaggtcgccatcgccgagcggctcatcgaggacctgacgacgaactggggcatccacgagtcggacatcctcatggactgtctgaccttcaccatctgcaccggtcaggaggagtcccggggggacggcatcgccacgatcgaggcgatccgcgagctgaagcgccgccgcccggacgtccagaccacgctgggcctgtcgaacatctccttcggcctcaacccggcggcccgcatcctgctcaactcggtcttcctcgacgagtgcgtgaaggcgggcctggactcggcgatcgtgcacgcgagcaagatcctgccgatcgcgcgcttcgacgaggagcaggtcaccaccgcgctcgacctgatctacgaccggcgctccgaggggtacgacccgctccagaagctgatggcgctgttcgagggagccaccaccaagtccctcaaggcgggcaaggccgaggaactggccgccctgcccctggacgagcggctcaagcggcgcatcatcgacggtgagaagaacggcctggaggccgacctcgacgcggcactccaggaccggccggccctcgacatcgtcaacgagacactcctcgacggcatgaaggtcgtcggcgaactgttcgggtccggccagatgcagctgccgttcgtcctccagtccgccgaggtcatgaagacggcggtggcccacctggaaccgcacatggagaagtcggacgccgagggcaagggcaccatcgtcctcgccaccgtccgcggcgacgtgcacgacatcggcaagaacctcgtcgacatcatcctgtccaacaacggctacaacgtcgtcaacctcggcatcaagcagccggtctccgcgatcctggacgccgccgaggagcaccgggccgacgtcatcggcatgtccgggctgctggtcaagtccacggtgatcatgaaggagaacctggaggagctgaaccagcgcgggctgtcggccgactacccggtcatcctcggcggcgcggcgctgacccgcgcgtatgtcgagcaggacctgcacgagatctaccagggcgaagtccgctacgcccgggacgcgttcgagggcctgcgcctgatggacgcgctgatcggcgtgaagcggggcgtgcccggtgcggcgctgcccgagctgaagcagcgccgggtgcgcgcggccgcggtcgaggtcgaggagcggccggaggagggcgcggtccgctccgacgtcgccaccgacaaccccgtccccgcgccgccgttccggggcacccgcgtcatcaagggcatccagctcaaggagtacgcctcctggctggacgagggcgccctgttcaagggccagtggggcctcaagcaggcgcgcacgggcgacgggccgacctacgaggaactggtggagagcgagggccggccccggctgcgcggactgctcgacaagctccagaccgagaacctgctcgaagcggccgtcgtctacggctacttcccgtgtgtgtccaaggacgacgacctgatcatcctggacgagcagggcaacgagcgcacccgcttcacgttcccgcgccagcgccgcggccgcaggctgtgcctggccgacttcttccgcccggaggagtccggcgagagggatgtcgtcgggctccaggtcgtcaccgtcggctcgcggatcggcacggagaccgccaagctcttcgaggcgaactcctaccgcgactacctcgaactgcacggcctgtccgtgcagttggcggaggcgctggccgagtactggcacgcccgggtccgttccgagctgggcttcgccggcgaggacccggaccggatggaggacatgttcgccctccagtaccggggcgcccgcttctccctcggctacggcgcctgccccaacctggaggaccgcgccaagatcgccgctctgctcgagccggagcgcatcggcgtacacctgtccgaggagttccagctgcacccggagcagtccacggacgcgatcgtgatccaccacccggaggcgaagtacttcaacgcgcga

SEQ ID NO: 6646 - DNA, 750 bp, Streptomyces avermitilis
  CDS (1)..(750)
ttgccaaaaaagggcagccggcctgatcgtccctcaaggaggtgcgcccggatgaccagtacggtccccgcgctcggtacccgttcggccgaaggctccgctctgcaggccgtgctcctcgacatggacggcaccctggtggacaccgagggcttctggtgggacgtcgaggccgaggtcttcgccgccctcgggcacccgctcgacgagtcctggcgccatgtcgtggtcggcggccccatggcgcgcagcgcgggcttcctcatcgaggccaccggtgccgacatcaccctcgccgaactcacggtgctgctcaacgacgggttcgaggcacgtatcggccgtacgctgccgctgatgccgggcgccgcacggctgctggccgaactcgcggcgcacgagatccccaccgccctggtctccgcctcgcaccggcgcatcatcgaccgggtcctgacctccctcggctcccagcacttcgcgctgaccgtggcgggcgacgaggtggcgcgcaccaagccgttccccgacccgtatctgctggcggcctccggactcggcgccgagccggcgagatgcgcggtcatcgaggacacggcgaccggtgtcgcggccgcggaggccgccggctgccgggtggtcgccgtcccgtcggtggcccccatcgcacccgccgcccggcgcactgtcgtgacctctctcgaagaggtcgacctgccatttctccgcggcttgatgacggaaatgcgc

SEQ ID NO: 6647 - DNA, 1602 bp, Streptomyces avermitilis
  CDS (1)..(1602)
atgaaccgcaagactttggtgctgccggcggtcgtcggcctgctcgccccggtgctcgccgcctgcggcggatccgacagcgggagcagtggcggcggttcggtcgtcgtcggcaccactgaccggttcaccgcctccagcgacgcccccgcgcccgtcgacccggcgtacgcgtacgacgtgggcacctggaacatcctgcgccagacggtgcagaccctgatggtccagccccgcggcgacggcgagccggagcccgaggccgccgagagctgcggcttcaccgacaccggcaacgagcgctacgcctgcaagctgcgcaaggacctgaagttctccagcggcaaggccgtcacggcggccgatgtgaagttctccatcgaccgcgcccgctcgatcaaggccgacagcggtgtgttcgccctgctgtcgaccgtcgacaccgtcgagacgcagggcgaccgtgaggtgatcttccacctcaagaccgcggacgccaccttcccgttcaagctgtcgaccccggtcgccggcatcgtcaaccctgacgactacgagaaggacaagctgcgcgacggcttcaagatcgacggctccgggccttacacgatggaggccgaggagaaggacaacgagctggtcaaggccgtcttcaccaagaaccccaactacaagggtgcgctgaaggtgaagaacgacgaggtcgagatgaggtcgttcgaggacgcctcggcgatgggcgccgccctcagcaagggcgacatcgacctgatgacccgcacgatgacgccggaccagatccagaagctctccaccgactcgaagggcgacgtcaacctcgtcgagatgcccggcctggagatccgctacctggccttcaacaccgacgccacgaccgtcaagaccaaggcggtccgccaggcggtggcccagctcgtcaaccgcggcgagctggtctccaaggtgtacggctccacggccgagcccctcttctcgctggtcccggccaccatcaccggacactccaactcgttcttcaacaagtacggggacgcgagcgtcgccaaggccaagtcgctgctcgccagggcgagcatcaccaccccggtgaagctgacgctgcactacacgaccgaccactacggctcggccaccaagaccgagttccagcagctgcagcagcagctgaacaacagcggtctgttcgacgtccgcatcaagggcgagccctggtcgaccttccgcccggccgagcagaagggcaagtacgacgtctacggaatgggctggttccccgacttccccgacgccgacaactacatcgcgccgttcctcgacaaggacaacttcctcggctcgccctacgcgaacagcgagatcatcggcaacctgatcccgcagtcccgtcgtgaggccgaccgtctgaccgcgtcgaagtccatcactgacatccaggacatcgttgccaacgacgtaccggtgctgccgctgtggcagggcaagcagtacatcgccgcccaggacgacatcaccggcgccgagtgggcgctcaactcctcgtccacgcttcagctctgggagctcggacgcggtgtgagcgac

SEQ ID NO: 6648 - DNA, 1581 bp, Streptomyces avermitilis
  CDS (1)..(1581)
gtgaacatgcgcaaccagtggccggtcctgtctgtcgcgacggggctggccgccggcctgctcaccggatgcgggtcggacacgggcgactccggaggcaccggctccgaggtcgtgatggggatgtccgacgacgtcctggcgaccgaccccgcctccggctacgacccggggtcctggctgctgttcaacaacgtcttccagtcgctgctgagcttccccaagggcggtacggaacccgagcccgaggccgccagggagtgcaagttcacggacacggagacgaaggtctactcgtgcaccctgagggacggactgaagttcagcaacggtgacgcgctcacctcgaaggacgtcaagttctccttcgaccgcatgctgaagatcaacgacgcctccggccccgcgatcatgttccccatgctggacagggtcgagacgcccgacgcgaagaccgtcaccttccgcctcaagacccccgacgccaccttccccagcaagatagcctccggcgccggctcgatcgtggaccacaactcctactccgcgacgggactgcgcaaggacggcggcgcggtcggctccggtccctacaagctggactccttcgacgacgacaaggccgtcttctccgtcaacgacagctacaagggcaccgccaaggtgaacaactccggcgtgaccctcacgttcttccacggcaaccagaccgccctgaagaacgcgctgctgaacaacgagatcgacgccgcctaccggggcctggccgccgccgacgtcgccgacatcgacaacgacacgtccaccggcaagggcatcaacgtcgtcgagggcaccagcgccgaagtccagcacatggtcttcaacatggacgacccggtggcgggcaagctcggagtccgcaaggccatcgcctacctcctcgaccgcgacgccctcgtcaacaaggtctacgacaacacggcgacgccgctctactcgatcatcccggccgggatcgccggccacgacacgtccttcttcgacacctacggcgcccgcccctcgaaggcgaaggcggcggccgcgctgctggccgagggcatcaccggcaaggtgaagctgaccctctggtccacgccgtcgcgctacggcccggccaccgacgaggagttccggaccatcgccggacagctcaacgccagcgggctgttcgacgcgaccgtgaagtccgtcgcctacagccagtacgagaaggacatcgcccagggcaagtacggcgtgtacgtgaagggctgggtgcccgactacccggaccccgacaacttcaccgcgccgttcttcggcaagggcaatgtgctgagcaacaactactccaacagcacgatcaccggtcagctcatcccgaagaccgccgcccagagcgaccgcgcctccaccgacgcggagtacggcaggctccaggacatcgtcgccgaggacctccccgtcatcccggtctggcaggccaagcagtacgcggtcgtccgggacaacgtctacggcctcgagtactgcctcgacgcgtcgacggtgttccggttctgggagatcagcaagggc

SEQ ID NO: 6649 - DNA, 669 bp, Streptomyces avermitilis
  CDS (1)..(669)
gtggccatccgcgtcctactggtcgacgaccagccgctgctgcgtaccggcttccggatgattctggaggcggagcaggacctcgcggtcgtcggcgaggccggagacggactccaggcgctcgaccaggtgcgtgcgctgcagcccgatgtggttctgatggacatccgtatgccccggatggacggagtggaagcgacccggcagatcaccggtcccgggcgggacggcccggccaaggtgctcgtgctgaccaccttcgacctcgacgagtacgtggtggaggcgctgcgggccggggccagcgggtttctgctcaaggacgccccggccaatgagctggtgcaggcgatccgggtggtcgcggccggcgaggcgatgctcgcgccgagcatcacgcgccggctcctcgacaagtacgccgggcacctcccgtccggtgacgagcccgtcccggacacgctgcacacactgaccgaacgcgaggtcgaggtgctgaagctggtggcccgcgggctgtccaacgcggagatcgccgccgacctgttcgtcagcgagaccacggtcaagacgcacgtcggtcacgtcctcaccaagctggggctgcgcgaccgggtgcaggccgcggtgtacgcgtacgagagcgggttggtgcgccccggcgcgcag

SEQ ID NO: 6650 - DNA, 858 bp, Streptomyces avermitilis
  CDS (1)..(858)
gtgaccgtcgccgtgccgccccgctcgttgtctccctcgcgtgccagtgacttcatgcagtgccctttgctctaccggttccgggtgatcgacaagttgcccgagaagcccagtgaggcggcgacgcgggggacgctcgtgcacgcggtgctcgagcggctcttcgacgcgcccgccgccgagcggaccgcgccgcgtgccaggtccctcgtccccggccagtgggaccggctgcgcgagagcaggcccgaggtcgtcgagctgttcgccgacgatccggagggtgagcggctggcgcgctggctgggtgaggcggagcagctcgtggagcggtggttctccctggaggacccgacgcggctcgagcccgccgagcgcgagctgttcgtcgaggccgagctggattccgggctcaggctgcgcgggatcatcgaccgcgtcgacgtcgcgccgagcggcgaggtgcggatcgtcgactacaagaccggcaaggccccgcggccggagtacgccgaaggcgcgttgttccagatgaagttctacgccctcgtggtgtggcggctgaagaacgtggtgccgcggcggcttcagctcgtctatctcggcagcggcgacgtcctgacgtacgacccggtcgtcgccgacctggagcgcgtcgagcgcaaactgcacgcgctgtgggacgcgatccagttggccacggagacgggcaactggcggccgcggcccaccaagctgtgcggctggtgcgaccaccaggccgtgtgcccggagttcggcggtactccgccgccgtatccgctccagatcgggccgcccgagtccggcggcagggagcagggcagaatggggccggac

SEQ ID NO: 6651 - DNA, 1128 bp, Streptomyces avermitilis
  CDS (1)..(1128)
atgggccgccccttcggcgtccccgtgtacgtcgcccccagctggttcctcgtcgccgccctcatcacctgggtgttcggcggccagctggatcgcgtactgcccgaactcggcgccgcccgctacctcgtctccctcttcttcgcggtcgccttctacgcctccgtcctcatccacgaactcgcccacaccgtcgccgccctgcgcttcaagctgcccgtgcgccggatccagctccagttcttcggcggagtctccgagatcgagaaggagaccgaaacccccggccgcgagttcgtgctggccttcgtcggccccctgctctccctgatcctcgcggggatcttctacctcgccatgcagaccgtggaccggggcaccgtccccggcgtcctgatcgcgggcctgatgatctccaacctcatcgtcgccgcgttcaacctgctgcccggcctgcccctcgacggcggccgcatgctccgcgccgtcgtctggaagatcaccggcaagcccatgagcggcaccatcgccgccgcctgggtcggccgcgccctcgccgtcgccgtcctgatcggcctccccctgctcacccagaccggcgcactcggctcgaacgccgaggacgtcggcggcatggacaccgtcacggacgccctgctcgccgccatcctcgccgcgatcatctggaccggcgccggcaacagcctccgcatggcccgtctgcgcgaacacctccccgagctgcgcgcccgcaacctcacccgccgcgcggtccccgtggagaccgacaccccgctctccgaagccctgcgccgcgccaacgacgccggcgcccgcgccctggtcgtggtcgacgccgacggcgaacccctctcgctcgtacgcgaggccgccatcgtcggcgtaccggaacaccgccgcccctgggtcgacgtcagcggcctcgcccaggacctcaccgacggcatgcgcatctccgccgagctcgccggcgaggacctcctcgacgtcctgcgcgcgacccccgccaccgaatacctggtggtggaggagtccggcgagatctacggcgtcctgtccgccgcggacgtggaacgcgccttcgtgaaggccatggccaggccgaac

SEQ ID NO: 6652 - DNA, 900 bp, Streptomyces avermitilis
  CDS (1)..(900)
atgtccgaaccgaccggtgccgcccgcaggcgcgggcccttcaaggtcggggaccaggttcagctgaccgaccccaagggccgccactacacgttcacgctcgaagcggggaagaacttccacacccacaagggttccttcccgcacgacgagctgatcggctcccccgagggcagcgttgtccgcaccacggggaacgtcgcctatctcgcgctgcgccccctgctccccgactacgtcctgtccatgccccgcggcgccgccgtggtctaccccaaggacgcggggcagatcctcgccttcgccgacatcttccccggcgcgcgcgtcgtggaggcgggcgtgggctccggatcgctcagcagcttcctgctgcgcgccatcggcgaccagggcatgctgcactcgtacgagcgccgcgaggacttcgccgagatcgcccagcagaacgtggagcgctacttcggcggcccgcaccccgcctggcagctcaccgtcggtgacctccaggacaacctgagcgacacggacgtcgaccgcgtcatcctcgacatgctcgccccctgggagtgcctggaggccgtctccaaggcgctcgtccccggcggcatcctgtgctgctacgtcgccaccaccacccagctcgcccggaccgtcgagtccatccgtgagatcggctgcttcaacgagccgacctcctgggagtcgatgatccgcaactggcacgtcgagggcctcgccgtccgccccgaccaccggatgatcggccacaccggcttcctgctcaccgcccgccgcctcgccgacggcgtcgagccgcccatgcgccgccgccgccccgccaagggcgcctacggcgaggactacaccggccccaacgccgacggaggcgccggccgc

SEQ ID NO: 6653 - DNA, 573 bp, Streptomyces avermitilis
  CDS (1)..(573)
gtgcagcaatccgccgtcccggaactggcacacaccaccacccgccccatccactgggtcgccacggccaccgccctcgccggggtcgtcgcgctctcctccgtactgcagcccggctccgcgacagcggcccagcccggccccggaacgaaggcggccaaggtcgcgacagcgccccccgatcccgcgaaggccgacttcccgctcgactgcggccccacgaagctcctcgtccagaagaaggcctccggggacctcgacggcgacggacagccggagaccgtggccgtggtccgctgcgacgcgagcatgggcaccccgcccgacggcgtctacgtcctcacccgggccgcggacgccaagaagccccgcgtggtggccacactcgtggacccgaaggaccggctgaccgtcaccgacttcgcggtgcgcgacggagcggtcaccgccacgttcctcggctactcgtcgtccgacgtgccgagttgctgccccgacgtgaaggaccgcgccaagtggcagtggaagggcggagcgttcgtccgctcgacaccgtccgcagcacagagcgtg

SEQ ID NO: 6654 - DNA, 303 bp, Streptomyces avermitilis
  CDS (1)..(303)
atgaccgtgcagcaggaggccgcagtcgacggtgaggcgctggaggtctggatcgaccaggatctctgtacgggcgacggcatctgtgtccagtacgcccccgaggtctttgagctggacatcgacggcctggcctacgtcaagagcgcggacgacgagctgttgcaggccaagggcgccacaacgcccgtacccctgacgcttctgcgggatgtcgccgactccgcgaaggagtgtcctggcgactgcatccacgtgcgtcgggtttcggacagcgtcgaggtctacgggccggacgcggag

SEQ ID NO: 6655 - DNA, 1764 bp, Streptomyces avermitilis
  CDS (1)..(1764)
gtggcagcccacgacgacgacatgaaccgcggcatccgcccgggaagagggtccgacgaccccgccgggcagattgcctaccttgagcaggagatcgccgtcctgcgacgcaagctcgccgactctccgcgacacacgaggattctcgaagagcggatcgtcgagctgcagaccaatctggccggcgtgtccgcacagaacgagcggctcgccaacacgctccgtgaggcccgcgaccagatcgtggccctcaaggaagaggtcgaccggctcgcacagccaccggccggcttcggtgtcttcctcacggcgaacgaggacggcacggcggacatcttcaccgggggccgcaaactccgggtgaacgtcagccccagcgtggagctcgaagagctcaggcgcggccaggaactgatgctcaacgaagccctcaacgtggtcgaggccatggagtacgagagcgtcggcgacatcgtcaccctcaaggagatcctcgaggacggcgagcgcgccctcgtggtggggcacaccgacgaggaacgggtggtacggctcgccgagccgctgctggacgtcaccatccgccccggcgacgccctgctgctcgaaccccgctccggctacgtctacgaagtcgtaccgaagagcgaggtcgaggaactcgtcctcgaagaggtcccggacatcggctacgagcagatcggcggtctgggcaaccagatcgagatgatccgcgacgcggtcgagctcccctacctctaccccgacctcttcaaggagcacgaactgcggccacccaagggtgtcctgctgtacgggcctccaggatgcggaaagacgctcatcgccaaggccgtcgccaactcgctggccaagaaggtcgccgaggtcaccggacaggccacgggcaagagcttcttcctcaacatcaagggccccgagctcctgaacaagtacgtcggcgagaccgagcggcagatccgcctcgtcttccagcgtgctcgtgagaaggccagcgagggcacaccggtcatcgtcttcttcgacgagatggagtccctcttccgcacccgcggctcgggcgtcagctcggacgtggagaacaccatcgtcccgcagctcctcgccgagatcgacggtgtggaaggcctgcagaacgtggtcgtgatcggcgcctccaaccgagaggacatgatcgaccccgccatcctgcgccccggacgtctcgatgtgaagatcaagatcgagcggccggacgccgaggcggcgaaggacatcttcggcaagtacctcaccgagcgtctccccctgcacaccgaggacgtgggagagcacggcggggaccggtcggccaccgtccacggcatgatccagaccgccgtggaacagatgtacgccgaatccgaggagaaccgcttcctggaggtcacctacgccaacggagacaaggaagtcctctacttcaaggacttcaactccggcgccatgatcgaaaacatcgtcgggcgcgccaagaagatggcgatcaaggacttcctcgagcacagccagaagggcctgagggtctcccacctcctccaagcgtgcgtggacgagttcaaggagaacgaggacctgccaaacaccacgaacccggacgactgggcccgaatctccggaaagaagggcgaacggatcgtatacatccgtaccctcatcaccggaaagcagggcgcggacacagggcgctccatcgacacagtggccaacaccggtcagtacctg

SEQ ID NO: 6656 - DNA, 1509 bp, Streptomyces avermitilis
  CDS (1)..(1509)
atgaccgtacggcgagtaatgggcattgagacggagtacgggatctccgtccctggccaccccaacgccaatgccatgctcacctcatcccagatcgtcaacgcatacgcggcggcgatgcaccgggcgcgccgcgcccggtgggacttcgaggaggagaacccgctgcgggacgcgcgaggcttcgacctcgcccgcgaggccgccgactccagccagctcaccgacgaggacatcggcctggccaatgtcatcctcaccaatggggcacggctgtacgtggaccacgcgcaccccgagtacagcgccccggaggtcaccaacccgcgggacgccgtcctgtgggacaaggccggcgagcgcatcatggcggaggccgcggagcgcgcggcccagctccccggcgcccagccgatccacctctacaagaacaacaccgacaacaagggcgcctcctacggcacgcacgagaactacctgatgaagcgggagacccccttctcggacatcgtgcgccacctcacgccgttcttcgtctcccgtcaggtcgtcaccggagcgggccgcgtcggcatcggtcaggacgggcacgagcacggcttccagctcagtcagcgcgccgactacttcgaggtcgaggtgggcctggagaccaccctgaagcgccccatcatcaacacccgggacgagccgcacgcggacgccgagaagtaccgcaggctgcacgtgatcatcggcgacgcgaacctgtcggagatctcgacgtatctcaagctgggcacgacggccctggtgctgtccatgatcgaggacggcttcatcgccgtcgatctggcggtcgaccagcccgtacgcaccctgcaccaggtctcgcacgaccccacgctgaagcggctcgtcacgcttcgtagcgggcgcacgctgaccgccgtgcagctgcagatggagtacttcgagctgtcgcgcaaatacgtggaggaacggttcggggccgacgcggacgagcagaccaaggacgtcctggtccgctgggaggacaccctgaaccgcctggagaacgacccgatgagcctcgccggggagctggactgggtcgccaagcgggagctcatggagggctaccggcgccgggacgacctcgactgggacgcggcccggctgcacctggtcgacctccagtacgccgacgtacgcgccgagaagggcctctacaaccgtctggcggcccgcggccggatgaagcgcctgctggacgagaacgacgtcgagcgggcccgcaccaagccccctgaggacacgcgcgcgtacttccgcggacgctgcctggagcagtacgcggacgacgtggcggcggcctcctgggactcggtgatcttcgacctgccagggcgggactcactgcaacgcgttccaaccctggagccgcttcgcggaacgcgtaatcacgtcaaggagctcctcgaccgctgtcgtacggcggaggacctggtcagggtcctgtcaggcgcc

SEQ ID NO: 6657 - DNA, 216 bp, Streptomyces avermitilis
  CDS (1)..(216)
atggcgaccaaggacaccggcggcggacagcagaaggcgacgcgcaacaccgaggaggtcgaggagcaggcgcaggacgcgcaggcttccgaggacctcaaggagcgccaggagaagctgagcgacgatgtcgactcggttctggacgaaatcgatgatgtcttggaagagaacgccgaggatttcgttcgatcattcgttcagaaaggcggcgag

SEQ ID NO: 6658 - DNA, 606 bp, Streptomyces avermitilis
  CDS (1)..(606)
atgggggcgtcggggttggtaaacgaagagggcgtgaagcgctgtgtgcggtgtggcgagtgccggccgcgcgcagccttcgctcgcaggcggtcgaacctcgacggcctgcagcgacattgccgagagtgcgcatcggactatcaccgagcgcgtcaggaaagcctgggcaagaaggtccgtcccaaggtcgaggtgcccgaagggcacaagctttgcctgaagtgcggcgaggtcaagccgtggagcgcgtggcaccgtaacgccacggcttcggacgggctgtcgacacgctgcaaggcgtgccgagccgtcgaggggcgtgcgggccacctcaagcgccactacggcctcacggaagccgagcgggacgagatggtcgcgtcccagatggggatctgtgtgatctgcctgaaagccccggcagctcatgtggatcactgccacaggacgggtagtgtccgtggcgtactgtgcttcaactgcaattcggccatcggcaagttgggagacgatcccgacgctgttcgtcgggctgccgcctacctggaaggaaccccgtggaagccaacactcgtagcaccgggcgtctaccggctgccttcc

SEQ ID NO: 6659 - DNA, 843 bp, Streptomyces avermitilis
  CDS (1)..(843)
gtggaagccaacactcgtagcaccgggcgtctaccggctgccttcctgacacctgggtcgtcgtccttcatggacttcctgtccgagcaccagccggagatcctcccgggcaaccggcagctgccgcccacccagggcgtgatcgaggccccgcacggcacgaccatcgtcgccaccacgttcccgggcggggtggtcctcgccggtgaccggcgggccaccatgggcaatgtcatcgcacagcgcgacatcgagaaggtcttcccggccgacgagtactcggcggtgggcatcgccggtacggcgggtctggccgtcgagatggtgaagctgttccagctggagctggagcacttcgagaaggtcgagggtgccacgctctccctggagggcaaggcgaaccgcctctccacgatgatccgttccaacctcgccatggccatgcagggcctggccgtggtacccctcttcgcgggctacgacgtggaccgcgaaaagggccgcatcttctcctacgacgtcaccggcggccgctccgaggagcacggctacgcctccaccggctccggctcgatcttcgcgcgcggtgccatgaagaagctctaccgcgacgacctgaccgagcagcaggccacgacgctcgtcatccaggccctgtacgacgcggccgacgacgactcggcgacaggcggtcccgatgtcgcccgccggatctacccgatcgtcaccgtgatcaccgaagacggattccgccggctcaccgacgaggagtcctccgagatcgcccgcgcgatcctggagcggcgcctggagcagcccgacggcccgcgggccgcgctgctc

SEQ ID NO: 6660 - DNA, 759 bp, Streptomyces avermitilis
  CDS (1)..(759)
gtgtcgacgccgttctatgtctccccccagcaggccatggccgaccgggcggagtacgcccgcaagggcatcgcccgtggtcgcagccttgtcgtgctgcagttcgccgacggcatcgtgttcgtcggcgagaacccgtcccgcgcgctgcacaagttcagcgagatctacgaccggatcggcttcgcggccgccggcaagtacaacgagtacgagaacctccggatcggcggcgtccgctacgccgatctgcgcggttacacctacgaccgggacgacgtgaccgctcgcggtctcgccaacgtctacgcccagacgctgggcacgatcttctccagcgcggccgagaagccgtacgaggtggagctggtggtcgccgaggtgggggagaccccggagggtgaccagatctaccggctgccgcacgacggctcgatcgtggacgagcacggctcggtcgcggtcggcggcaacgccgagcagatcagcacctacctggatcagcgccaccaggacggtatgacgctcgccgaggcgctcaagctggccgtccagtccctgtcccgcgacacgaacggcagcgagcgggagatccccgccgagcgcctggaggtcgcggtcctggaccgtacgcgcccgcagcagcgcaagttcaagcggatcgtgggccgtgagctctctcgtctgctggaggcggccggagcgagcaccgcgggcgaggccgggagtgccgaggacgagggctccgacgacgagaag

SEQ ID NO: 6661 - DNA, 1014 bp, Streptomyces avermitilis
  CDS (1)..(1014)
gtggcacgagccagcacgcaccccacgagccgggacgtcgcccaggccgccggagtctcccaggccgcggtgtcactggtactcggcgagaaatggcgcggacgggtctcggaggcgacggcggaacgggtacgggaggccgcgcgggagctgggctaccgaccgaacctggccgcccgcaatctgcgcctcggccgcacccggaccgtgctcctcgtggtgccggccctgaccacggagttcttcgccggcgtctacacgggcgccgcccgcctcgccgcggaacacggcttcggcgtggtgctctacccctcccccgaaggcatcggcccggcccgggaccccttcggctcggcgcaggccgccctggacggcgtgatcgcctcctcgatggccgcggacgcgctcacggccatccggggcgaccagctgccgctggtgatgctggacagcgacccggagggcagcctgggcgcggcgaccgtgaacctggacatcgcggacggcgtgcgtcaggtggcggaacatctgctcgccctggggcaccgccgcttcctgcatctggcggcggacatcccgtcctggacgttcgaggtgcgcgcccgggaactcgccgcgcgcgtgggcacgatcccgggcaccgaggtacgcacgacccgcgcgcccatctccatcgagggcgccgtcgccgccgcggaggccgcgctcgcggcccccggcccccggcccaccgcgctggtctgcgacgacgacaagctggcggccggcgcctacaaggcggcccggcgcctcgggctgcgcgtccccgacgacatctccgtcaccggtctcgacgacctggccctcgccacggccatcgacccggagctgaccaccgtccgcctcgacgcggagcgcttcggcgagcggggcatggcggccctcctggccgtcctggagggccgcacccccgaggagggcgacatccccgtgcaactcgtcatacggggctccacggcgccgccacgcacgtcc

SEQ ID NO: 6662 - DNA, 1257 bp, Streptomyces avermitilis
  CDS (1)..(1257)
atggccgcgggatacctggagatcctccgagcgaggcacgccgcgcggctgctcaccggcacgctggtgggccggctgccgaatgccaccgccgcgatcgccgtcgtgctgttcatccgtgccgagggcggcacttacagcctcgccggggcgctcgccgccgtgtacggggtcgccaacgcggtgggccagccgctgctcggccgcctcgtggacctgtacgggcagccgcgcgtgcagctgcccgcggcgctcgtctccgccctcgccatgaccgccttcgccctcagcggcaccaacccgctgccgcccgcgtatgtctccatggccgtcgccggactcttcaccccgccgctggagggcggactgcgggccctgtggccctccgtcctgcgccgggaggaccaggtgcacacggcgtacgcgatggacgcggtggcccaggaagtcatgttcaccgtcggccccttgctggtgaccctgtgcgtggcgttgtggtccgcccaggccgcgctcgtggtgctgaacgtcatcggtgtcctgggcgccctctccgtggtcgtctcgcccccctcgcgcgcgtggcgttcggcgccgcgcgaggcacactggctgggtgctctgcgctcgcccggactgctcgcgctgctcggcgcgttcctgttcgtggggctcgcgctcggctccatcaccgtcgcgggcgtgtcgtacgcggacgacaacggcggcgacgcggtctacggctggctgatggcggcgctcggactcggcgccctcgtcggcggcacggtgtacggggcgcggcagtggggcggtgccccggagcggcgactgcgggggctcgtcgccctgctggcggtctgttacctgccgctggtgctggtgcccggcccggtcgccatgacggccctgacggcgctcgccggggtcttcctcgccccctgtatcgcctgcgccttcatcatcgtcgaccggcacgcgccgagtggaaccgtcaccgaggcgttctcctggcttgtgacgacgttcaccgtgggcgcctcggtcggaacgggcctggcgggcccggtcgtcgagtggggcggaaccctgtgggggttcgccgtaccgggggtcgccggggccgtctccctgctggttctgctggccacggggcgggtcctcgcagctcccgccggggggccggtggttgcggcctcgtcggaaaatgatccaaaccgtgctgtcgaaccccgtttcagctcaggggatcgggcg

SEQ ID NO: 6663 - DNA, 1359 bp, Streptomyces avermitilis
  CDS (1)..(1359)
atggaccgccgcattttcgggctggagaacgagtacggcgtcacgtgtacgttcaggggacagcgccgcctgtctcccgacgaggtggcgcggtacctcttccgccgtgtcgtgtcatggggccgcagcagcaatgtctttctgcggaacggtgcccgcctctatctcgacgtgggatcacatccggaatacgcgacacccgaatgtgacaacgtgaccgaactggtcacccacgacaaggccggcgagcgcattctcgagggactgctcgtagacgccgaacgacgcctgcacgaggagggaatcgcgggcgacgtctacctcttcaagaacaacaccgactcggcgggcaactcgtacgggtgtcacgagaactatctggtggcacggcacggggagttctcccggctcgcggacatcctcattccgttcctggtgaccaggcagcttctgtgcggtgccggcaaggtgctgcagactccgcgaggcgccgtctactgcgtcagccagcgcgccgagcacatctgggagggtgtcagctccgcgacgacccgctcccggccgatcatcaacacccgcgacgagccgcacgcggacgccgagcgctaccgccggctgcacgtcatcgtgggcgactcgaacatgtccgagacgaccatgctcctcaaggtcggcgccaccgacctcgtgctgcgcatgatcgaggcgggcacggtgatgcgcgacctgaccctggagaacccgatccgggcgatccgcgaggtcagccacgacatcacgggccgccgcaaggtgcgcctggccagcggccgcgaggcctccgccctggaggtgcagcgcgagtactacgagaaggccgtggacttctgcgagcgccgcggcatccgtaccggcaccgtcgagcaggtcctcgaactgtggggccgcacgctcgacgcgatcgaggccgaggacctcgaccggatcggcaccgaaatcgactgggtgatgaagtacaagctcatcgagcggtaccgggccaagcacaacatgacgatgtcgcacccgcgcgtcgcccagatagacctcgcctaccacgacatccaccgccgtcgtggtctctactacctgctggagaagcggggacaagccacccggatctgcaatgacttgaagatcttcgagggcaagtccgttcctccgcagaccactcgggcccggctgcgcggcgacttcatccggcgcgcccaggaacagcgccgcgatttcaccgtcgactgggttcatctcaagctcaacgaccaggcgcagcgcaccgtgttgtgcaaggacccgttccgttccgtcgacgaccgggtggagaagctgatcgccggaatg

SEQ ID NO: 6664 - DNA, 1002 bp, Streptomyces avermitilis
  CDS (1)..(1002)
gtgcgccgacgctcagttcttctcgccgtgccggccggactggtcacgctcgccggatgcggtgacgaaaagtccgacacggccaagaccaagcccagcaccagcccgtctccgtcggcctccgcatcgtcggccccgccccccaagatcgtcgacggcccgctgccggccatcaccgccggtaccaagttcgacgagaagccgaccgtggccaagggcagcggcgacccctcgaaggacgtggcggtcaagacggtcatcgcgggcagcggcaagacggtcgcggagaacgactacatccaggcgaactacctgggccaggtctgggacacggcgaaggtcttcgacaactcctacgaccgcaagacgccgctggtcatccagctcgcccagggaagcatcatcgacggctggcgctatgcgctggcgggcaagaaggccggcagccgggtcctgatgtccgtgccgcccacctggggctacggcaagcagggcaactcgcaggcgggcatcaagggcaccgacaccctggtgttcgtggtcgacatccagaacacgttcaacgcgaagagctccgcccagggcaaggacgtcgcacagggcgacgccaagctgccgaaggtcggcaccaacaccgacggcaaggccccctccatcgacgtaccgaagacggccgccccgacgaagctcgtggcgaactacgtcatcgagggcgacggcgacgtggtcaaggcggacagcagcgtcctcgtgcagtacaagggcgtgctctgggacaccggcaaggagttcgactccacgtacagccgctcggcgctgacgtccttctcgctgcagcaggtcgtcaagggctggtcccagggtctgaccggcaagaaggtgggcagccgcgtactcatcgtggtgccgccgaagctgggttacggcgacagcccgccgagcgggagcggcatcgagaaggactccaccctggtcttctccgtcgacatcctggcgaagatg

SEQ ID NO: 6665 - DNA, 372 bp, Streptomyces avermitilis
  CDS (1)..(372)
gtgagcatcgagaagcccgagatcgacttcccgggcggcgagcccccggcggacctcgagatcaaggacatctgggagggcgacggaccggtcgccaaggcgggcaacaccgtctccgtgcactacgtgggtgtggccttctccaccggcgaggagttcgacgcgtcctggaaccgcggcaccccgctgcagttccagctcggtgccggccaggtcatcaagggctgggaccagggcgtgcagggcatgaaggtcggcggccgccgccagctgaccatcccggcgcacctcgcgtacggcgaccgcggcgccggtggcggccgtatcgcccccggcgagacgctgatcttcgtctgcgacctggtcgcggtc

SEQ ID NO: 6666 - DNA, 975 bp, Streptomyces avermitilis
  CDS (1)..(975)
atggccattgccaaggccgagcggctgatgaacctggcgctgtgtctgctcgggacacgacggccgctcagcaagcgcgagctgcgtgactccatcgaggcatacgtcgaggcttttgggccgggcaagggtgcggcgagttcggacgactccttcaaccggatgttcgagcgcgacaaggacgatctgcgcgagctcggcctggtcatcgagacggtggagaacctcgacggcgaggtcggctacctcgcgcgccgcgacagcaaccgcctgccggccatcaccttggacgccgaggaggccgccgccctcggtctcgccgcgaaggtctggcagcaggcccgtctcgccggtgccgcgagcggcgccctgcagaagctgcgcgccgcggggcttcccgaggatgtcgacccgtacgaggcccacggcgccctggaaccgcgcatccccgtgcacgaggccgctttcgaacctctgatgctcgcctgccgtgaccggcgccccgcttccttcgactaccgcaaggcgaacgcggcccgtcccgagccgcgcaccgtggagccctgggccctcgagtgctggcgcggccactggtatctggccggctgggaccgtgaccgcggcgccgagcgggtctttcggctctcccggatcaccggcaaggtccgtacgcgcagcggaaggtacaccgccgaggtgcccgatgtcgtcaccgtgcgcgagacggtggcgagctgggcgggggagaccgccgaccgttccgctctgatccggctgcgtaccggtgccggctatccgctgcgggccaaggccgtctcggtacgggaactgggcgacggctgggacgagttggagattccgtacgggcacggtctggacgcgtggctcgtcgagttcgggcccgatgtggtggtcctggagccggccgagctgcgggccgacgtggtggaccggctgcgtgccgtggccaagggc

SEQ ID NO: 6667 - DNA, 1038 bp, Streptomyces avermitilis
  CDS (1)..(1038)
gtggcaggcaaaccggccaggcccgcgaacgcgatcgaccagacccggcggatgctgtccctggtgacgtatctgcgcgagcgtcccggcgcgcgcgtcgaggacgtcgcccgcgccttcgggatcaccgaggacgagctgatctccgacctcgacgtgctgccgctgtgcgggacgagtttccgcggtggcgacctcctcgacatcgacaccgacggcgaccggatctggtggcacaatccggccgctctcggcgcggacgcggccgagcccctgcggctcgccgccgacgaggcgaccgccctgctggtggccgcccgcgccgtgtccacgctgccgggcctgcgggagggcgaccggcaggcgctgctgcgggccaccgccaaggtggagaccgcggcgggcgaggcggccggggccagctcccggctctcggtgaccttcgagtcggagggcggtgtcttcgcggacgtcgaccgggcgatctcggagcgccgccgactgtggatccgctactactcgcccgcccgcgacgagctcaccgaacgcgagatcgacccgatccggctggtcagcgtcggccacacctatgtggaggcgtggtgccgccgctccgaggcgcggcgcaccttccggctggaccgggtggccgagatccgcattctggacgagccttccgcgccgcccgaggtcgagctgcgggacctctccgaagggctggtacagcccgcggccgaggaccccgaggtggtggtcgaggtcggtcccggcggccgctgggtggccgagtactacccgcacgacagcgcggatgagcttccggacggcgggctgcgtatcactctgcggacccccgagcccgcgtcgttgcggaggctcgcgctgcgcctcggccgcgacgggcggatcgtctcgccgcaggacctggcggacagcgcccgccgcgccgcccaggaggcgctcgccgcgtacgacgacgcaccgcggggtgccgacggagttcaggacgggccgtacgacaggcaggagcaggggctg

SEQ ID NO: 6668 - DNA, 378 bp, Streptomyces avermitilis
  CDS (1)..(378)
gtgagcacgtcgtcgatgtctggtgcgccggagcagtcggatacggcgcggagggtcgtcgtcccggggccggcgtcgggtacggcggacagggccgtcgtcccggtcgaggcgccggagatgtcggtgggggcggcgttcgcggggatgcggagagtggcccatgtggtcttcagggcgggctgccccgactgccgggcccgcttcgagctgggggcgaacgccctgcgcctggccatcggcgccaccagcaggaccaccttctactccttcacctgccccgagtgcggagtccccgtccgcaagccggccggggagcggatcgtcgcgctcctcaccgggggcggggtgcgcaccctgcgcctgcactcgacggtc

SEQ ID NO: 6669 - DNA, 192 bp, Streptomyces avermitilis
  CDS (1)..(192)
atgttctggccgatgctcgcgattgccgtggggttcctgggtcttgccgtgctcggcgtgctcgccgtccgcgtttttctggcggccgagcggctgggcaggcaggtcacggactccgcgcgccggatcaatcgcgccgccgacgacctggagcgggcgaccgtggcggcggcacgatccgcggatccggta

SEQ ID NO: 6670 - DNA, 282 bp, Streptomyces avermitilis
  CDS (1)..(282)
atgttcggaaggctcggagctcccgagatcattctcatcctcgtcgtcatcatcctgctgttcggcgcgaagaagcttccggacatggcgcgttccctcggtaagtccgcgcgcatcctcaagagcgaggcgaaggcgatgaagtcggagggccaggagtccactcccgcgggcccgccgaacaccgacgagcagcccccggctcagcgcacgatccaggccgcgcccggcgacgtgaccagctcccgtccggtcagcgagcccacggacacgaccaagcgc

SEQ ID NO: 6671 - DNA, 945 bp, Streptomyces avermitilis
  CDS (1)..(945)
ttgctcaagcctgcccgcaacaaggagaaggatcccgaggggcggatgcccctcgcggagcaccttcgtgagctcagaaaccggctcgcgaaggcgatgctggccatcgtcgtggtcacggccgtcgcagccttctactacaacgacatcatcaacttcttcaccaagccggtcctggaatccgtcgggtgcccgaagaccttcgccgaggtggcgaagatgcccgagggcaagcagtgcgcgcagatcacgatcaacggtctgctcgcccccttcaccctggcgctgaaggtctccttgatggcgggcgtcgcgctcgcctcgccggtctggctctaccagctctgggcgttcgtcgcgccgggcctgcacaggagcgagaagaagtacgcgtacgcgttcgtcgggacgggtgttccgctcttcatgggtggcgccttcttcgcctacaaggtgctgccgaccaccgccaaggtactgatggagttcacgccgaacggcgtcagcaatctgctgccgctggacgatctcctcgacctcgtcacgcgcatggtggtcgtcttcggcctctccttcgagcttccgctgctgctggtcatgctcaacctcactgggatcctcaccggcaagcgcatgctcggctggtggcgcggcatgatcatgggcatcacggtcttcgcggccctcgccacgcccagcaccgacccgctgaccatgctggcgctcgccggccccatctggatcctgtacttcggagcggtcgccttctcgctcgtcaacgaccggcgcaagcgccggcgtgaggccgaggggccggacgacgacgaggcctccgagctggacctcacccccgaggacatcggtgagatcgagaccgtgtcggcgaaccgggcgttgccggagcagtcggtcacggaccgggtcaacggttatgacgacgtgacc

SEQ ID NO: 6672 - DNA, 888 bp, Streptomyces avermitilis
  CDS (1)..(888)
gtgaccagcgagatcaccctcttcgtcaaccccaccgcgggacgcggccggggcgcccacgcggcgcagccggccgcttcggctttgcgggcggcgggattctccgtccgtacgatcctcggggagaacgccgaggacgctctggcccgcgcgcgcgaagccgtcgcgggtggaacgggcgccttggtggccgtcggcggggacggcatggcgcatctggcccttcaggccgtcggcggcacgcgcaccccgctcggcctggtcgccgtcggcaccgggaacgacttcgcgcgggccctggggctcccggtgcgcgacccggcggccgcggggcgggtgatcgcggaggctctgaagggggcgcggctgcgtgacgtcgatctggggcgtgtcgacggaacctggttcggcaccgtcctcgcctccggcttcgactcccgggtcaacgaccgcggcaaccgtatgcgctggcccaccggccgcttcaagtacgacctggcgatgctcgccgaactggccgccttcacgcccgtcccgtaccggatgacgctcgacgacggagcggtccgggagatcgaggcgaccctcgtggcagtcggcaacgggtcgtcgtacggcggcggcatgaagatctgcgcggacgccgacctcgacgacgggctgttcgacatcacggtcgtcggggactgcagccgtacgacgctgctcaaggtgttccccaaggtgtacaagggcacccacctcgaccatcccaaggtcaccgtgcaccgggccgcgaaggtcgaactcgtcgctcagggcatcacggggtacgcggacggtgagccgctgggcccgctgccgctcacggcggagtgcatacccggggcggcgcgggtcgctgtgccc

SEQ ID NO: 6673 - DNA, 2811 bp, Streptomyces avermitilis
  CDS (1)..(2811)
atgacagaggacctctcaccggccgagcggtacgcggcagctcgtcagcgcgctgccgagcaggccaccgcgctcgcccccttccgcgagatgtacgacttcggcctcgaccccttccagatcgaggcctgtcaggcactcgaggcgggcaagggggtgctggtggccgcgcccaccggctcgggcaagacgatcgtcggcgagttcgccgtccacctcgccctccagcagggcaagaaatgcttctacaccacccccatcaaggcgctctccaaccagaagtacgccgatctggcccgccgttacggcgcggacaaggtcggcctcctcaccggcgacaacagcgtcaactccgacgccccggtggtcgtgatgaccaccgaggtcctgcggaacatgctgtacgcgggttcccagaccctcctgggtctcggctatgtggtcatggacgaggtgcactacctctccgaccgtttccgcggcgccgtctgggaggaagtgatcatccatctccccgagtcggtgaccctggtgtcactttcggcgaccgtgtcgaacgcggaggagttcggcgactggctggacacggtgcgcggcgacacccaggtgatcgtgtccgagcaccggcccgtgccgctgttccagcatgtgctggccggacgccggatgtacgacctgttcgaggagggcgagggccacaagaaggccgtcaaccccgacctcacgcggctggcccgcatggaggccagccgcccgtcgtaccaggaccgcaaacgcggccgcgccatgcgcgaggccgaccgcgagcgtgagcgccggcagcggtcgcgggtgtggacgccgggccggcccgaggtgatcgagcggctggacgccgaagggctgctgcccgccatcacgttcatcttcagccgcgccgcctgcgaggccgccgtccagcagtgcctgtacgcgggcctcaggctgaacgacgaggccgcgcgcgacaaggtgcgcgccctcgtggaggagcgcacggcatccatcccgaccgaggatctgcacgtcctcggctactacgagtggctggagggactggagcgcggcatcgcggcccatcacgcgggcatgctgccgacgttcaaggaggtcgtcgaggagctcttcgtacgcggcctggtcaaggccgtgttcgccaccgagaccctggcgctcggcatcaacatgcccgcccgctcggtggtgttggagaagctcgtcaagtggaacggcgagcagcacgccgacatcacccccggcgagtacacccagttgacgggccgggcgggtcgccgtgggatcgatgtcgagggccacgcggtcgtgttgtggcagcgcggcttcagccccgagcacctggcaggcctcgctggcacccgtacgtacccgctgcgctccagcttcaagccgtcgtacaacatggcggtgaacctggtcgaccagttcggccggcaccgctcacgcgagctgctcgagacgtccttcgcgcagttccaggccgacaagtcggtcgtcgggatctcccggcaggtgcagcgcaacgaggaggggctcgagggctacaaggagtccatgacctgccacctcggggacttcgaggagtacgcgcggctgcgccgcgaactcaaggaccgcgagaccgagctggccaagcagggcgcggcgcagcggcgggccgaagcggcggtggcgctggagaagctcaagccgggcgatgtcatccacgtcccgaccggcaagtacgccggactggcgctcgtgctcgacccgggcctgcccgcgggccgctccaacggccatcgtggcttcgagcagcacgacggcccgcggccgctggtgctgaccgccgagcgccaggtgaagcggctcgcctcgatggacttcccggtgccggtcgaggcgctggagcggatgcggatccccaagtccttcaatccgcgctcgccgcagtcccgtcgggatctcgcctccgcgctgcggacgaaggccgggcacatcgtcccggaccggcatcgcaagggccgttccgcggccgccgacgaccgtgagatcgcccggctgcgggcggagttgcgcgcgcacccctgccacgggtgcaacgaccgggaggaccacgcccgttgggccgagcgctactaccggctgatgcgtgacacctcgcagctggagcggcgcatcgagggccgtacgaacacgatcgcccgcaccttcgaccggatcgtcgcgctcctgaccgagctggactatctgcgcggcgacgaggtcaccgcgcacggcaagcggctcgcccgtctctacggcgaactcgacctgctggccagcgagtgcctgcgtgccggggtctgggaaggcctcgatccggccgaactcgccgcgtgcgtctcggcgttggtgtacgagtcgcgggtcggtgacgacgcgatggcgcccaagctgccgtccggcaaggccaaggcggcgctgggcgagatggtccggatctgggggcgcctcgacgccctggaggaagacttccggatcacccagacggagggtgtcggacagcgcgagccggacctcggcttcgcctgggccgcgtacatgtgggcctccggcaagggcctggacgaggtgctgcgcgaggcggagatgccggccggtgacttcgtccgctggtgcaagcaggtcatcgacgtgctgggccagatctccgccgccgcacccgtcaggggcgagggctccacggtcgcgaagaacgcccgcaaggcggtcgacgaactgctgcgcggggtggtcgcctactcgtcggtgggc

SEQ ID NO: 6674 - DNA, 1098 bp, Streptomyces avermitilis
  CDS (1)..(1098)
atgcccgtagagttcctcggcatcgccgcaaccaacgaaggctccgaagtgaccgcccgctccgggccgtccttcgacaaggagtacacgctcaggctggcccgcgcccacgaggagtacggctgggaccggatcctgttcgcgtacgggtccggctcccccgatccgtcgcccgcggccgcctacatcgcggcccgcacggagaagatccagatcctggtggcgcaccgcccgaacgtctcgtacccgacgttcgcggccaagaccttcgcgaccctcgaccgcatcagcgacggccggctggccgtccacttcatcaccggcggcaacgaccacgagcagcagcgcgagggcgacttcctgaccaaggacgaacggtacgcgcgcacccgggaagccatccagatcatcaagaaggcgtggacgacgcacgagccgttcgaccacgagggcacgcactaccgcttccacgacttcgtcagcgacacctttcccgtccagcagccgcatccgcccgtctccttcggcggctcatcggccgccgcgtacgcggccgggggcgccgaggcggacatctactgcctgtggggcgagccgctggcgcagaccgccgagcagatcgagtcggtgaaggccgcggcgaaggcggcgggccgcacggacatcccaaggatccaggtcgcgttccgcccgatcatcgcgccgacggaggaactggcctgggagaaggcgcaccggacgctggcccggatcaaggcgcgcacggccggggctccgctcagccgccgccatccgctgaagaatccggagaactcgggctcccagcggctgctggcggtggccgcccggggcgaccgccacgaccgcgccctgtggaccccgacggcggcggagacgggcggcgccggcaactccacggcactggtcggcacccccgagacggtggccgaggccctcctcgactactacgacctcggagtcgacatcctctcggcccgcggctacgacctcctcgacgacgcgatcgacttcggccggcacgtgatcccgatcgtccgcgaagaagtcgcgaagcgggacgcggcgcgggtggcggcc

SEQ ID NO: 6675 - DNA, 1650 bp, Streptomyces avermitilis
  CDS (1)..(1650)
atgtccactctgtcccgtgtccgtgccgcgtacgcccgtgtggcggccgtcgaccgtccggagatctggatcgatctccgatcccgggcggacgtcgaggccgaggcggcggtgaccgacgagcgcgtcgcggcgggtcagcggctcccgctcgccggacgcctgttcgccgtcaagggcaacatcgacgtccacggcctggcgaccaccgcgggctgccccgcgtacgcctacctgcccgaggccgacgccccggccgtcgcccggctccgggcggccggcgcgatcgtgctcggcacgacgaacctggaccagttcgccaccggcctggtcggcacccgttccccgtacggggcggtgcgcggcgcgtacgacccggcgaggatcagcggcggctccagcgcgggctcggccgtggccgtggccctgggcatcgtggacttcgccctcggtacggacaccgcgggctccggccgtgtccccgccgccttcaacggcatcgtcggcctcaagcccacccgcggcctcgtccccacgacgggcaccgtccccgcctgcgcctccctcgactgcgtcaccgtcttcgcccgtacgctcccggaggccgagcaggccctcgcgcacctggcgtcgccgcccggccgggacctccctccgctcccccagcgcgcccccggcccgtggcgcgtcgcggtcccgccgctgccgcagctcggcgagctggacgagggctggggcgaggcgtacgaggccgcggtggagcacctcgtggcggcgggcgtctcggtccgcacgatcgatctcagcccgttcaccgaggccgcggcgatgctctacgagggtgcgttcgtggccgagcgctacaccgcggtggggagctttgtcgacaagttgatcagcgagggcggtgcggggctcgaccccaccgtcgccggcatcatcacccgcgcccgggacatcccggcccaccggctcttcgccgaccaggaacgtctggccaccctgcgcacccgggcgctcgccgaactcggtgatgccgacgccctgctgctgcccaccacccccggtcaccccacactcgccgaggtcgccgccgacccgctgggcgccaacgcccgcctcgggcgcttcaccaactccacgaacctcttcgacctggccgcggtcgccgcccccgccggtctcacgcccgcccaactgcccttcggggtgatgctgatcggcccggcgttcaccgacgggcggctcgcccggatcgccgccctgcttcagccacagctgagcgtggcggtgatcggcgcgcatctgtcgggccagccgctcaacccgcagctcctggccctgggcgcgcgacgggagcgtacgaccaccaccgcacccgcctaccggctgcacgccctgccgaccaccccgcccaagccgggcctcgtgcacgtgcgtcagggcggcgccgcgatcgagacggaggtctggcggctgcccgccgaaggcctcggccggctgctcgcctcactcccccgcccgatgacgctcggccaggtcgaactggccgacggcagccgcgtcccgggcttcctgtgcgagccggacgcgctcacggacgcggcggacatcacggagtacgggggctggcgggcgtacctggaccgt

SEQ ID NO: 6676 - DNA, 3513 bp, Streptomyces avermitilis
  CDS (1)..(3513)
atgaccttcgacaccctgctcgtcgccaaccggggcgagatagccgtccgcgtcatccgcacggcgcgtgaactcggcctgcgcaccgtcgcggtgtactccgacccggaccgctcggcgccccatgtccggctcgccgacgaggccgtacgcctgggccccgcgcccgcgaaggagtcgtacctcgacgcggatctcgtactgaaggccgccaaggacaccggcgccggcgcgatccaccccggctacggcttcctctccgaggacgcggcgttcgcgcgccgctgcgaggacgccgggatcgtgttcgtcggaccgacgcccgagcagctggaactcttcggcgcgaagcacacggcgcgggccgcggccgaggcggccggggtgccgctcgcacccggcacggggctgctcgcctcgctcgacgaagcgctcgacgcggcctcccgcatcggctatcccgtcatgctcaaggccaccggcggcgggggcggcatcggcatgtcggcctgccgttccgccgccgaactggccgagtcgtgggagcgggtgcggcgcgtcaccgcggcctcgttctcctcggcggggatcttcctggaacgcctggtcgagcacgcccgccatgtcgaggtacaggtcttcggcgacggccggggccgggtcgtcaccctcggcgaccgggactgctcgctccaacgccgcaaccagaaggtggtcgaggaggcccccgcgccgggactcccctcacacgtgcgcgaccacctcgcctcggcggcacgggacttgtgcgccgcggtcggctaccgctccgccggaaccgtcgagttcgtgtacgacgccgcccgcgaggaggcgtacttcctcgaggtcaacacccgtctccaggtggagcatccggtcaccgaggagatctacggggtcgacctggtcgcctggatgctgcggctcgcgggcggcgacgccgacgtcgtacgcgatccggggccgccccgcggccacgccgtggaggcccgggtgtacgcggaggacccctcccgcgagcaccggcccagcgcgggcctgctgacgcgggtggagttcccgcagggcgtacgggtggacggctgggtggagacggggacggaggtcacgacgtcgtacgaccccatgctcgccaaggtcgtggcgtacgggtccgaccgggcgcacgcgctggcccgcctcgacgaggcgctggcccggacgcgggtcgacggcatcgagacgaatctggggctcgtccgggcggcgctcgccgaccacggcttgcgcaccgccacccacacgacggcgacactggccaagatcaccgaccccactccgcgcgtcgaggtggtcgcggccggcacgctcaccaccgtccaggactggccgggccgcaccggctactggcaggtgggcgtgccgccgtgcggcccgatggacgaccgctccttccggctcggcaaccgggcgctcgggaacgaggagggagcgccgggtctggagtgcaccctgcggggaccggcgctgcgcttcacccacgccacgacggtgtgcgtcacgggcgccccggcaccggtcaccgtggacggaacgccggtcgcccagtgggagccggtgacggtgcccgccggggccctcctggaggtcggcgcccccgccgagcccggcctgcggacctatgtgctgttcgcgggcggcctggacgtccccgcgttcctcggcagcgcggccaccttcacactgggccggttcggcgggcacggcgggcgggcgctgcgcacgggggacgtgctgcacggcgggtcggtcacggaccggggcgctcccgtgcccgccggggaccggccggtgttcgctacggagtggcacgtcggcgccctggaaggaccgcacgccgcaccggagttcttcaccgaggacgacatccgcgacttctacgcggccggctggaaggtccacttcaactcggcccggacgggcgtacgactggtcggacccaagccccgctgggcgcgctcggacggcggagaggcggggctgcacccgtccaacatccacgacaccccgtactcggtcggtgccgtcgactacacgggcgacatgccggtactgctcggcccggacgggccctcgctcggcggtttcgtctgcccggcgacggtcgccacggcggagcgctggaagctcgggcagctgcgccccggcgacacggtccgcttcacaccgctggccgaggacggctcgacgcggcccgcgatcgtggacggcggggtgctcgcacgggacggcgacgtgacctaccggcgcagcggcgacgacaacctgctggtcgaattcggcccgatgcagctcgacctggccctgcgcatgcgggtgcacgcgctgatggaagcggtggccgaagccgggctggacggcgtcacggacctcaccccgggcattcgctcgctccagatccggacggacccgcgccgcctgccgctacgcgaactcctcgcggtcgtacgggagacggtgagcgcgctcccgcccaccgaccagctcgtcgtcccgtcccgcacggtccacctccccctctcctgggacgacccggccacccgcgaggcgatcgagcgctacatggcgggcgtgcgcgacgacgcgccctggtgcccgtggaacatcgagttcatccgccgcgtcaacggcctggagtcggtggcggacgtgtacgacacggtcttcgacgcggagtacctcgtactcggcctgggcgacgtgtacttgggagcgccggtggccacaccgctcgacccgcgccaccgcctggtcaccaccaagtacaacccggcgcgcacctggaccgccgagaactcggtcggcatcggcggcgcgtacctgtgcgtctacgggatggagggccccggcggctaccagttcgtgggccgcacgacccaggtctggtcgggctggcagcagcgcggcgcgttcgaaccgggctcgccgtggctgctgcgcttcttcgaccggatcaagtggtacgccgtcgggcccgacgaactcctcgacctgcgcgccgacatcgcctcgggccgcttcgtgccgcgcgtcgaggagggcgagttctcgctggccgggtacgagtccttcctcgccgcgaacgccggctccatcgccgccttccgggcccgccagggcgcggccttcgcggcggagcgggacgcgtgggaggcggcgggcgagttcgcgcgggccgaggcggcgacggcgcccgaggccccgccggccgaggtgaccgttccggtgggcggcgctctggtggaggccgagttcgccgcgtcggtctggcagctgaacgtgggaccgggcgacgcggtgacggccggccagccgctgctcaccctggaggcgatgaagatggagtccagggtgcccgcgccgatggccggtgtggtgacggagatcctggccaggccgggcgatcaggtggcggcgggcacggcgctggtcgtgctcgcaccggccacgagc

SEQ ID NO: 6677 - DNA, 633 bp, Streptomyces avermitilis
  CDS (1)..(633)
atgacccggacagccgtcacggagaccgtcgttcccgcccgggccgcctggtccgccgtcgtccgcgcgggcgagacgctcaccctcaccgacctgcacggcaaccaggccgtggacttcctcgtgtacgacgcccacgacaccgcggtccgctacagcgcgcccgacacgatccacgcccagggcagcgtcttcctcaccaccggcagtgtgctcctgtccaacgagcacaccccgctgatgacggtcgtcgcggacgaggtggggcgccacgacacggtcggcggcgcctgctccaaagagtcgaacacactgcggtacggccaccacacctggtcgcagcacgcgtgcgtggacaacttcctcgcggagggcgccaagtacggcctcggcaagcgcgatctcgtctcgaacatcaactggtacatgaacgtgccggtcgagaaggacggcacgctgggcatcgtcgacggcatctccgccccgggtctggccctgaccctgcgcgccgagcgcgacgtgctcgtgctggtctccaactgcccgcagatcaacaacccctgcaacggcttcgagccgacggcggtgcggatgacgatcggggccgccgtccaggtccagggggacgcgtca

SEQ ID NO: 6678 - DNA, 822 bp, Streptomyces avermitilis
  CDS (1)..(822)
atggcgacagcgaccacctacggggcacgcgcccacgcccgggcgcaggagggcgcccggaccgaggccatgcccgtcgtaccggcgagcgcctggcccgcgccgccctgcgcggcgggccacctggtgtgggcggagacggtcgcgggcggcaactacacgcaccgggtgctggcccgcggcaccgagctgcgcctgaccgacctgcggggcgacgcctgtgcgcatctcctcctgtacgtcgccgaccgtccgtgggagcggctgaacgtagccgacacggtcaaggtgcagtggaacgcctacctcggcgaggaccggctgctcctgtccgaccagggccgggtcctcgcctcggtggtcgccgacacctcgggacggcacgacgcgctgtgcggcacctccacgctcgtacgcaacacggagcggtacggggacggcaccccgcagtccgcctccccggcggggcgcgagctgttcaaactggccgcggccaagaacggtctggagccgcgcgacctgccgccctcgctctccttcttccagggcgtggaggtacgtgacgacggcaccctcgacttcaccggctccgccggccccggcggcagcgtgaccctgcgcgccgagcaggacctcacggtgctgatcgcgaacgtgccgcaccccgccgatccgcgtacggactacgtcagcaccccgctggaggtgctcgcctggcgcgcggacgccacccgccccggcgacccgctgtgggaggcgacccccgaaggccgccgcgcgttgctgaacaccgccgaattccttgccgcgagggggctcgca

SEQ ID NO: 6679 - DNA, 621 bp, Streptomyces avermitilis
  CDS (1)..(621)
atggggaccagtggacggcgggtgggcagaccgcgcgccgcgcagcggccggacagcggtctgtcgccgcgcgacgaactcctcacggccgccgccgagttgttcacgacccgtggctacgccgccacgaccacccgtgccgtcgccgagcgggccggcatgcggcaggcgtccatgtaccactacgtctccggcaaggaggaattgctcgccgcgctcctggagtccacggtcacgccctcgctcgccctggcccggcacctgctcgccgaggacgccgccccggccgagagccggctgtgggagctgtgccgcacggacgtggaactgctctgcggcggcccgcacaacctcggcggcctgtacctgctgcccgaggtgcacaccgaacgcttcgccggtttccatgccgtacgggccgaactgaaggacacctaccggcagttgctggccgcgacggccgtgggcggcgcactcgccaagagtgagctggatctgcgtacggatctggtcttcgggctgatcgaaggtgtcatcctcgttcaccgctccgatccggagcgcccggtctcggctttcgccgaggcgaccgcggacgccgcgctgcgcatcgtcggcgtc

SEQ ID NO: 6680 - DNA, 1581 bp, Streptomyces avermitilis
  CDS (1)..(1581)
atggtgagtgttcaatcgcctcccggtggccgtgaacttccctacgcgcgcgtgctgttgctgccggccatactgatggccgcggcgaccggggccgccgtcgccttggtggcggagccggcccggatcgccgtcggctggtgcggagccgtcgcgacgctcctcgtcatcgccgccgcggccgaagcggtacgccgcggccgcaccgtccgtgagctgcgcgccgaggtcgcgcgccggaccgccgacctggaagaacgcgtcgccgcccacgacgcggagttcgtgcgcctgggtcaggaaatcctgcccgcggcactggagttggtgcgggtcggcgagtccccgtcggaggtgatccgcaaaaccgtcgacgcggagcccgagtggcgcgaccttcccccaccgcagcgcagtctgctgaccaccgtcgtcagggtcgtggaccgccagttcgccctgcgcgactcctcgcagcgcaccttcgtcaacatcgcccgtcgcgtccaggcgatcgtccaccagcagaacaaggaactgcgggagatggaggaggaccacggccgtaaccccgaggtcttcgacgacctgctccgcatcgaccacggcaccgcgctgatcggccgtctcgccgactccatcgccgtcctcggcggcggccggcccggccgccagtggcccctgcccgtaccgctgtacagcgtgctgcgcggcgcgatgtcccgcatcctggagtaccgccgcgtcgaactgcactccatcgccaaggtcaatgtcgccggcgtctccgtggaaccgctcatccacgccgcggccgaactcctcgacaacgccacccgctactcgccgccgcagaccaaggtgcacgtcaccgcgatcgaggtgcagaccggcgtcgccatcgagatcgaggacgccggcgtcagcctcagcgaggaggccctcgcccgcaccgagggcatgatcgagcgcgccaagatgagcatggacctccaggacatcggcgagaccccgcgtctgggcatggccgtcgtcggccgcctctcgacgatgtacaacatgcagatctcgctgcggcagtccgcgtacggcggcgtccgcgccgtcctcgtcgtgccgcgcgacatgctcaccgacgaccccgcccccggcttcgcccacggcatcggcgccgcctccgcaccgatcatggacaccgacgcggtcgaggcacccgaccgcaaggccaagaagcgccgccccaccaccggaccccggatcccgagccagtacgcggacatggaggacgacgtccccgaggtcaccgagtggacggccaacggactgccgcagcggcgccgccgcgtgcagatgtcgctcaccgagcgatacgccgagcaggcgcggatcgaggccgaggcgaaggccaccggggtcaacatctgggaacccgagcccgccccggaggagccgaaggagcccgagcccgaacccggactgtgggtcgaggcgttcatgaacggtctcaagggcgacccggatccgaccgctttcaccaagaacccggcccttgcggaggccgatgacgagggggacctcaag

SEQ ID NO: 6681 - DNA, 405 bp, Streptomyces avermitilis
  CDS (1)..(405)
gtgatccagcagcgagccaacttcgactggatgctcaaggaactcgccgacggggtacccggcgtccaccagatcgtggtgctctcggccgatggactgcgcatcgcgcgctacggcggtgacccggacgccgccgaccgcgtcgccgcggcctgcgccggactgcagagcctggccggtgccgtcgccaccgagatcccgcacagcgacggcaagatgcgcatggtcatcatcgagatggacggcgcctacttctacatgatggcggcagggcccaacgcctacctcgcggtgctctccgacgtgacggcggaggccgggctgatgagcaaccgcatgcgcgacctcgtcgtgcgcatcggcgcccacctgaccagcccgccgcggcgcaacgggcagaccgta

SEQ ID NO: 6682 - DNA, 423 bp, Streptomyces avermitilis
  CDS (1)..(423)
atgactcctccgcaacgccgacggcgctcccccgagccacagcctccgccccggccccctcagccgaacgacgggaacgacgggaaggacggcgacgcgagcaacccggaacggctgttcatcctcaccggcctggccgacgggggcgaacgggcggccctcgacctggtcacgctgatcgtggcgggcgccgacccgccgccgaccgccccgccggagcagtcggcgctcctgcggctctgccaggcccccctgtccgtggccgagatctcggcctatctcaggctgccgttcagcgtggtgaccgtcctgctcaccgagctgctggcggccgaactggtaacggcacgcgcccccatctcgcgagaggcgctgcccgaccgttccctcctcgaagcggtgatgcatggacttcaaaagctc

SEQ ID NO: 6683 - DNA, 618 bp, Streptomyces avermitilis
  CDS (1)..(618)
atggacttcaaaagctctgacgccatcaggggcccccggaccgaggaccatctgccgcacacggcccaggccgccgtgaagatcgtcatcgtcggcggcttcggcgtcggcaagacgaccatggtcggttccgtcagcgagatcaggccgctgaccaccgaggagaccatgacacagatgggcatcggcgtcgacgacaactacggctcggagagcaagacggccaccaccgtcgcgatggacttcggccgtatcagcatcaccgagcaactggtgctgtacctgttcgggacgcccggccaggagcgcttctggttcctgtggaacggcctgttcgaaggcgccctcggcgcggtcgtcctgatcgacacccgccgcctcgaggtcagcttcgacgtcatcggccggctggaggaacgcggggtgcccttcgtcatcgccgtgaacgacttcccggacgcgccccgctaccccgtcgaggatctgcgcggcgcactcgacctgaccgaggacatccccatcgtgaagtgcgacgcgcggcgccgggcctccagccgggaggtcctgatgacgctgatgcacttcctgcactcgctggccgtgtccaagacgtccgtc

SEQ ID NO: 6684 - DNA, 1458 bp, Streptomyces avermitilis
  CDS (1)..(1458)
gtgacgcctgaaccccacccctcgaccggcacggacgacccgacgttcggcccgccccccggctgccccgcccacgaccccggcctcggcggggtgcgcaggctgtacgggcccgaggcggaggacctgggagacctgtacgagaaactccgcgccgaacacggtgcggtggcccctgtgctgctccacaacgacgtaccgatgtgggtcgtgctgggccacaccgagaacctgcacatggtgcgcagcccctcgcagtacacccgtgacagccgcgtctggacccccgtcctggacggcaccgcgggccccgaccacccgctgatgccgcacatcgcctggcagcccatctgctcgcacgcggagggcgacgagcatctgcggctgcgcggggcggtcagcggtgccatctcgaccatcgaccaccgaggcatccgccgctacatcaaccggtcgtcgcaggctctcgtcaaccggttctgcgaggagggcagagccgacctggtcggccagttcgccgagcatctgccgatggcggtgatgtgcgagatcctcggcatgcccgacgagtacaacgaccgcatggtgcaggccgcccgcgacatgctcaagggcaccgagaccgcgatcgccagcaacgcgtacgtcatggacgccctgatgcggctcaccgcccgccgccgggcccaccccgagggggacttcaccagccacctcatcaaccacccggcgcagctcagcgacgacgaggtcggccagcatctgcggctcgtactgatcgccgcgtacgaggccaccaccaacctcctcgccaacgtgctgcgcatggtcctcaccgacccgcgcttccgtgcccagctcaacggcggccagatgacggtgcccgaggcggtcgagcagtccctgtgggacgaaccgccgttcagcaccgttctcggctacttcgccaagcaggagaccgagctcggcggccagctcatccgcaagggcgacggtctgctcctcgggatcgcgccgggcaacgtcgacccgcacgtacgcccggacctgtcggccaacatgcagggcaaccggtcccacctcgccttcggcggcggcccgcacgagtgcccgggccaggacgtcgggcgcgccatcgccgacgtcggcgtcgacgccctgctcatgcggctgccggacgtccagctcgactgcgcggaggacgagttgcgctggacggcgtccatctcgtcgcggcacctggtggagctgccggtacggttcgcgccgaaggaaccgcaggacgtgtcgcagcggcccagcctccgtccgctgccgcagccggtcccgagccggccggtccggacgcagcagccgcaggccacgacaccgcccccggcgcccccggccccgcccgccgccgcgccggaacgcggtcctggcgcctggcagcggttcctgcgctggtggcgcggctac

SEQ ID NO: 6685 - DNA, 963 bp, Streptomyces avermitilis
  CDS (1)..(963)
gtggcccctcgtacgctgatcgcaatgagacgcaaaccccgcatcccgccctctcccctcccccagcgcgagggggtcgacccggtgcgggtgaagctgccgcagggcggggcctggggcaccgtccgcgaccatctcgtggcccggctcgcggccggggacggagtggtcgacgggatgctcgacgccggtctgatcgtcggggcggacgggcggcccgtcgagcgcgacacggcgtatgtgccggggatgttcgtgtggttccaccgcgaactgcccgacgaggagcgcgtgccgttcgcgctcgacgtggtgtaccgcgacgagcacatcgtcgtcgccgacaagccgcacttcctcgccaccaccccgcgcggcagccatgtcgccgagaccgttctcgcacggctgcggcgggacctcggcatcccggagctcggggccgcgcaccggctcgaccggctcacggccggccttgtgctgttcaccgtacggcccggggagcgcggcgcgtaccagtcgctgttccgcgacaagctcgtgcacaaggagtacgaggccgtcgccacgtacgacccggaggtcgcccttccgcgtaccgtgcgcagccggatcctgaaggagcggggcctactggccgcccgggaggtcgccggggagcccaacgcggtgagccggatcgagctgacggagcaccgggacggccgggggcggtaccggctcctcccccgcaccggccagacccatcaactccgggtgcacatgaacgcgttgggcctgccgatcctcggcgaccccctctacccggtggtgaccgaccccgggccggccggtgacttccggcgcccgctccaactgctcgcgcgggtcctggagttcaccgatccggtcacggggcacgagcaccggttcctgagcgagcgggtactcaccgcctggtcggcgtacgaggactgggtccgg

SEQ ID NO: 6686 - DNA, 600 bp, Streptomyces avermitilis
  CDS (1)..(600)
atgccctacctcaccggcccggtgctccccgccggcaccctcgcccgctccgagcagcccacgatccccaccggcgacggcctggtcctgcggccctggacggccgaggacgcgcccgctgtccacgaggccttccaggaccccgtcatgcatcaatggcacatccgcgccgcagactcgacggacgaggtcgccggctggatcgaggagtggcggacggcctgggcgggagaacggaacgtgcagtgggccgtggccgacgcggacaccgaccggctgcgaggacgcgtcgcgctgcgggacgtcctgctcggcgacggggtggccgaggtcgcgtactggaccgtggcgggcgcccgcggacagggcgtcgccgcgcgtgccacctcggccctcgcgtcctgggcgctcgacgaggtcggcttccaccgcctggagctgagccacgccacggccaacgaggcctcctgccgtgtcgccgccaaggccggcttcaccctggagggcaccaggcgcagcgccctcctccaccaggacggctggcacgacatgcatctgcacgcgcgcgtacagggcgatccgagccagggccccacggcc

SEQ ID NO: 6687 - DNA, 1578 bp, Streptomyces avermitilis
  CDS (1)..(1578)
gtgcgaaagcaggttgccgccatgacgagcaccgcccccgccgatgtccgccccgacccgccacggcccgaaagtgccgccgatctcgcggagttcggctaccgccaggagctgcaccgcagcctgggacggtacgcctccttcgccgccgggttctccttcatctccgtcctgacgacggtcttccagttcttcgccttcgggtacgccttcgggggccccgtcttcttctgggcctggcctgccgtgctggtgggccagctgctggtggccgcgtgcttcgccgagctggccgcgcgctatccgatctcgggcgcgatctaccagtggtcctcgcgcctgtcgaacctcaccttcggctggttcgccggctggatcatggtgatcggccagatcgtggtggtcgcggcggcggcactcgcgctccagatggtgatgccgccgatctggtcgggcttccagctggtgggcggcgatccggcgcccaccagcgcgagcggcgcggcgaacgcggcggtgctgggcgtcatcctgctggtgctcaccacgttcgtgaacgtcatcgacaaccgcgtgatgtccgtgatcaaccgcgtcggcgtgaccgccgagatcatcggggccgtcctcatcatcgtgctgctgctcacccactccgagcgctcgcccggcatcaccttccacaccggcggcggggctcaagcgggcctgttcggggcgctggcggtggggtcgttcacggcggcgtacgtgatgatcggcttcgacagcgcgggcgagatgagcgaggagacccacaacccgcgccgcgtcgcgccccgcacgatcctcaccgcgctcggcgcggccggcctgctgggcgggctgatcgtcctcggcggactgctcgcggcccccagcctgacggacggccgcctcggggtcgacggtctgagctacgtcctgaccagcagcctcggcgacggtgtcggccgggttctgctcgccgacgtggtggtggcgatctccgtggcgaccctcgccatccagacggcggcctgccgcatgctcttctccatggcccgcgacggccggctccccttcgcccggcgcctggcccgggtcaacccgcgcaccggcatgcccagcgcccccgccctggtggtcggcgtcctggcggccgcgctgctgctcctcaacttcgcctccccggaggccttcctggccatcggtacgacctgcatcgtgatgctgtacctggcgtacgcgatggtgaccgggccgctgctggtacggcggctgcgcggcgagttcaccaccgagggcacggacgagacgggcgccccgctcttctccctgggccgctggggcgtacccgtcaacacgctcgccctcctctacggcctcctcatgaccgtcgacctcgcctggccgcgggcggaggtgtacgaccccgcgggcgggcactggtacttccagtggttcaccgtgctgttcctggcggtgaccctcgcggcgggcgcggcctaccgggcgtaccgcgggcggacgtcggccccggctcccgcgccggaggcgacggtccaggaggcgaccgcc

SEQ ID NO: 6688 - DNA, 645 bp, Streptomyces avermitilis
  CDS (1)..(645)
atggggaccaagcgccgcaagctcggcaatccgctggcgctggccgtgatggtgctgctcatggagaagcccatgcatccgtacgagatcgcgcagaccctctgccgccgcggcaaggacaccaccacgaagatcaactacggctcgctctacacggtcgtccagaacctggagaagcacggtttcgtggaggtcgccgaggtgcagcgacagggcaaccgccccgagcgcacgctgtacggcatcacggacgccgggcgcgaagaggcgacggagtggctgtccgatctgctggcggtcccggcccgggagtacccgatcttcgagaccgcgctctccttgctgggtgtgctccaccccgacgaggtgacgcgtctgctcgaggagcggctcacccagctggaagtgcaggtggcgagcgcgcgaggcggcctggagaagctgtacgagacgctgccgcgcctcttcctggtggagaccgagtaccaactgcacatggtcgaggcgcaggccgagtgggtccgcggcttcctgcgggagctgcacgacggctcgctggccggcgtcgaggcatggcggcgtttccacgagacgggggagatcccgcccgagttcaaggacttggaggagcgccacttcgagaag

SEQ ID NO: 6689 - DNA, 1029 bp, Streptomyces avermitilis
  CDS (1)..(1029)
atgaacacccgtgcgcccgcggtagaggcgcgtcagctgatcaagacctatcccggtgatgtcaccgccctgagcggcatggacatcaccgtcgagccgggcaccgtcttcggcctcctcgggcccaacggcgcgggcaagtccaccaccgtcaagatcctcaccaccctggcccgccccgactcgggcacggccaccgtcgcgggccacgatgtgctgcgccaccccgaccgggtgcgccgcgcgatcggcgtggtcgcccagagctccggcgccgacccggtcgccaccggccgggagaacctccgactccagggcaggctccatgggttgaagggcgccgggctgagccgccgggtggccgagctgctggaccgcttcaagctggccgacgccgccgggcgtcaggtcaagggctactccggcggtatgcggcgtcggctcgatgtcgcgctcgggctggtccaccggcccgaggtgctcttcctcgacgagcccaccaccggcctcgaccccgaggcgcgcaccgccatgtgggacgagatcgcccggctcgccggcgacgagggcctgaccatcctgctcaccacccactacctcgaagaggccgaccggctcgccgaacgtatcgccatcgtcgaccgcggccgtgtggtcgtcgaaggcacaccggacgggctgaagggggaactgcgaggtgacgccatccacttggagctgcgcgaagcggtcggccaggccggtcgtacgctgctgaagggctccctcggcggggtgcccggagtgcacgaggtgctcttcgacgacgcgcagggccgccgcgtcagcgtccgcgcggacgacggagccgccgcgatgcccgccctgctcggcgctctggagcgagccggtgtcggggtggccgcggcgaccgtggcccgtccctcgctcgacgacgtctatctccgtcacgcggggcgccgttactccgaggcggaggcggaaggcgccgacagcctcgccctcgcgggagccacgggaggtacccga

SEQ ID NO: 6690 - DNA, 774 bp, Streptomyces avermitilis
  CDS (1)..(774)
atgagcacggccgtctcccagacctggtacatgacacagcgtcaactcatggtgttcgtacggcagcccgcgtatctgctgatcacgttgatccagccggtggtctggctgttcctgttcggcaacctcttcaagaaggtcgtcgaactcggcggcttcggcacgacctcctacctggactacctcgtcccgggcgtggtggtgatgagcgcgctcagctccaacatgtgggcgggcatgagcacgctcgacgagatccagcggggcacgctcgacaggttcctcaccacaccggtcagccgggcggccctgatgaacggcaatgtcgtcaacaacggcctggtcaccgcactccagtcggtgatcatcgtgctgctcggcctgctgggcggcgcggactatccgggcgggttcggcggggtagccgttctgatcgtcgcctcggtgctgctcggcacggtcttcggagcactgtccaacgcgctgggcatgctggtccgggagcgggagtccatcatcggcatcaacacgttcctgctgctgccgctgaccttcctgtccagtgccttcatggccacgtcccagatgcccggctggatgcggcgcacagccgacttcaacccgctcgactgggcgatggtggcgggtcgttcggccatgtccgagcatccggactggggcggcgtgctcggccggggcggggcgctgctggccttggcggtcgcggcggtgtggctctcgatccggacgttcaggtcgtaccagcggtcggtg

SEQ ID NO: 6691 - DNA, 846 bp, Streptomyces avermitilis
  CDS (1)..(846)
atggcagagcgtccggaacgcaggacccctaagccccactcggcgcgggtcatccgcaccgagcggctcaccccgcacatgcagcgtgtggtgctcggcggcgacggcctcgccgagttcaccgtgggcacccgcaccgaccactatgtgaagctgctgttcggtgccgagggagtcacttaccccgagcccttcgacatgcagcgcgtccgcgaggagttcccgcgcgaccagtggcccgtgacgcggacgtacacggtgcgcgcctgggatcccgaactgcgcgagctgaccctcgacttcgtggtgcatggcgacgaggggctcgccgggccgtgggccacccgcgtccagtcgggcgaactcgtgcggttcatgggccccggcggtgcgtacgcgccggacacgagcgccgactggcatctgctggcgggtgatgagagcgcactgcccgcgatcgccgcggccttggagtcgctgcccgacggcgccgacgtgcgtgccttcatcgaggtctccggcccggaagaggagcagaagatcgcctccgacgtggatgtcgtctggctgcaccgcggagaccggccggtcggcgaggccctggtcgaggccgtccgtgcgctggagttcccggcggggcgggtgcacgcgttcgtccacggcgaggcgggcttcgtgaaggagctgcgcaagctgctgcgcgtcgagcgcgagatcccgcgcgaggacctctccatctccggctactggcgcctcggccacaacgaggacggctggcaggcggcgaagcgggagtggaacgcgcaggtggaggcggagcaggagacggccgaaccggccgcctcc

SEQ ID NO: 6692 - DNA, 927 bp, Streptomyces avermitilis
  CDS (1)..(927)
gtgacgcagccaactcgacgactcatgcttctcgacaccgcctcgctctatttccgcgcctatttcggcgtcccggactccgtgaaggccccggacggcaccccggtgaacgccgtgcgcggactgctcgaattcatcgaccgcctggtcaaggaccaccgtcccgacgaactggtggcctgcatggacgcggactggcgtccgcagtggcgggtcgacctgatcccctcctacaaggcgcaccgcgtggccgaggagcgcgagtcggggccggacgaggaggaggtccccgacaccctctctccgcaggtgcccgtcatcgagaacgtgctcgacgcgctcggcatcgcgcgcgtgggcgtcgaggggtacgaggcggacgacgtgatcggcacgttcacggcccgcgcgaagggccccgtcgacatcgtcaccggcgaccgcgacctgtaccaactggtggacgacgagcgcgggatccgggtcctctatccgctcaagggcgtcggcctgctccagctcaccgacgaggcgtggctgcgtgagaagtacggagtcgacggaggggggtacgcggatctggcactgctgcgcggtgacccgagcgacggtctgccgggcgtgcccgggatcggcgagaagacggccgccaagctgctcgccgagttcggcgacctggccggcatcatggccgcggtcgacgacccgaaggcgaagctgacgccgtcgcagcgcaagcgcctcgacgagtcccggccgtacctcgcggtcgcgcccaaggtcgtgcgggtggccggtgacgtgccgctgccggacgtcgacatcacgctgccgggcgccccgcgcgatccggcggccctggacgaactcgccgcccgctgggggctcggcggctcgttgcacaggttgctctcgacgctgcaggca

SEQ ID NO: 6693 - DNA, 1077 bp, Streptomyces avermitilis
  CDS (1)..(1077)
gtgtcatccaggctgcaggccgagagcctgtacaaggtcttcggcagacgacccggcgaggccgtggagcggctccgctcgggagccgaccgcgaggagctgcgcgccgacggcaccaccgccgccgtgatcgacgcctccttcacggtggagccgggtgagatcttcgtcgtcatgggcctgtccggctccggcaagtccacactgctgcgcatgctcaacggactcctcgagccgaccgccgggcacgtccgcttcgacgaccaggacctgaccgcgctcggcgaccgcgcactgcgcgaggtccgctccaagaagatcagcatggtcttccagcacttcgcgctcttcccgcaccgcagcgtccgcgagaacgccgcctacggtctcgaggtgcagggcgtgccccgcgccgagcgcgagcggcgcgccgacgaggcgctcgccctgtgcggcctcggcggctgggagaagtcctggcccgacgagctctccggcggcatgcagcagcgggtgggcctggccagggcgctcgccaccgacgccgaactgctgctgatggacgagtcgttcagcgctctcgacccgctgatccggcgcgatatgcaggaccagctcctggaactccagaagaccctcaagaagaccatcgtcttcatcacccacgacctgaacgaggccatgcgcctgggcgaccggatcgccgtcatgcgcgacggccgcatcgtccaggtcggcaccgccgaggacatcctggtacgtcccgccgacgactacgtcgcctccttcacccaggacgtcgaccgctcccgcgtcctgaccgcgggcgccgtcatggacccggacgtacgcggcgacgaggcggactgcgcctgtgagaccgccacgcccgacacgccgttcaacgaactctgcgccatcagcgcgcgtctctcgcatcccgtcgcggtgctggacaagaaacggaaactcctcggtgtggtgccccggcaacggctcgtcggcttcctcggtgacgagcggggcgaacccgccgcgtgtgcgacgccgcgcgcgaaggcggtgacgaccgatgcc

SEQ ID NO: 6694 - DNA, 2613 bp, Streptomyces avermitilis
  CDS (1)..(2613)
atgcctaggatccccttcggcgactgggtcaacgacaccgtcgactggctgctgaaccacatgtcgtggctcttcgacttcttcaagacggtcttcctgggtgccttcgacggcatcgacgcggtcctccaggctccgcagccgctcctcctcgccggaatcctcgcggtgatcgcgttctggctgcgcggcacgtcagcgggtgtcctcaccttcgtgggattcgcgttcatcgactccctcgaactgtgggaggacgcgatggtgaccctgtcgctcgtcctcgtggccacggtcatcgcgctcgtggtctccgtgcccgtgggtatctgggcggcgcgttcggaccgggtcagcagcatcgtgcgccccgtgctcgacttcatgcagacgctgcccgcgatgatctacctcatcccggcgatcctgttcttcggcaccggcgcccccgcgggcatcgtggcgaccctgatcttcgcgctggcacccggcgtccggatgaccgagctgggcatccgtcaggtcgacaaggaactggtcgaggccgccgacgcgttcggcaccaccccccgcaacatcctgctgcgcgtccagctcccgctggcgctgccgacggtcatggccggtgtcaaccaggtcatcatgctgggtctgtccatggccgccatcgcgggcatggtcggcaccggcggcctcggcggcgacgtcaacgaggccatcggccagctcaacgtcggcctcggctcggaggccggtgtcgccatcgtcatcctggccatctacctggaccgcatgaccagtgccctgggcacccaggtctcgccgctcggccgccgcgccgccgccaagctgcgcgccgcgcagggcctgaagatctggtcctaccgcccccgggccgccgtggccgtggtcggtgtggtcgtcctcgcgctggtcgcgggcggcatgggcatcttcggcggtacgacgtcgtcgaccgccgcgtccgacgccgagaacgtcggccagggcaagaaggtcaccatcggctacatcccgtgggacgagggcgtcgcctccaccttcctgtggcaggaggtgctggaacagcgcggcttccaggtcgacaccaagcagttcgacgcgggcccgctctacacctcgctcgggcagggagacatcgacttccagaccgactcctggctgccgaccacgcacgcgcagtactggaagaagtacggcaagcaactcgacgacctgggttcctggtacggcccgacgtcgctggagctgagcgtgccctcgtacatgaagggcgtcgactccctggcggacctcaagggccaggcctcgaagttcggcggcaagatcaccggcatcgagtccagcgccggcatgatgggcctgctcaagaccaaggtcctgaaggagtacgggctcgacaaggagtacaaggtcgtcgacagctccacgcccgccatgctggccgagctgaagcgcgcgtacgccaagaaggaccccgtcgtcgtcacgctctggtcgccgcactgggcgtacagcgactacgacctgaagaagctcaaggaccccaagggcgcctggggcaagggcgacggggtgcacaccctcgcccgcaagggcttcgcccaggacaacccggtcgtcggccggtggctcaagaacttcaagatgaccgagaagcagctcaccggtctcgaggcggagatcaacaaggcgggcaagggcaagcagcaggacgccgtgcgctcctggctgaagcggaacccgggtgtcgtcgacaagctggcgccggtcaagagcgccacgtccggcgccgccggcgagacgaagcgtccgctggacgtagcctggttcccctgggacgaggacgtcgccgtcacctacctgtggaagaacgtcctggcgcggcgcggctacacgctgaatctcaagcagatggacgtcggccccgtctacacgggcctggcctccggagatctcgacctcaacttcgacgcgtggctgccgtacgcccagaagaactactgggaccagcacaagaacgacctgagagacctgggcacctggtacaaacccacgtcactcgaaatcgccgtgccctcctacgtgaaggacgtcaagtccctcgcggacctcaagggcaagggcggcaccttcgacgggaagatcatcggaatcgagccgggcaccggcgagatgaacctgctcaagacgaaggtgcttccggggtacggcctggacaaggagtacaaggtcgtcgacggctccacgcccgcgatgctcgccgagctgaagcgcgcgtacgccaagaaggagccggtcgccgtcgtcctctggtcgccgcactgggcctacagcgagtacaagctcaccaagctggcggacgacaagaagctgttcggcgagggcaacacgatccggaccatctccagcaagcagttcccggagcggtatccgcagctcaccaagtggatcaaggacttccggatgagcgaggccgaactcggcagcctggagagcgagatcaagaagcgtgggcaggggcatgagcaggacgccgtcgccgcgtggctgaaggagcacccggacatggtgggccggatgactccgcag

SEQ ID NO: 6695 - DNA, 678 bp, Streptomyces avermitilis
  CDS (1)..(678)
gtgtggcgtagcccacccctcgcggcatgtccgcggggcgcccgtcggcccgcgctcggcgccgacggcaagtgcggctccgtactggcgtacgagaaggatccggacaaccgcatcgcggtccgcggccgtgccggccccgacgccccgccggccgggcgagtcgaacgcggcttcgaggtaccccgcaccctgtcgcgcggtgccgagggcaccccggaccccgtctccgtgcacgacggcacgcaggtgaggtccggcccctaccggggggcctgcggctccgaccgccggctccggctgtccggcgggacttcaggacctggcggacccgccctgaccagcggctcgaccgtgccctggaggcgtgcgggaccggcggcgacatcggtgaccgctcgccgctccgcctcggcgcggggccgctcgtcccgaaaacgggggcagggccgatgcgacgacttcgggagccggcggacgtacgcccatgatcgggccaccggcggggccgaacggctcgccgtccgcacccacggtggcaacagggccttggcccacccgccggcgaccctcctcgccggccgggacgggcgtcccgcgcttctggtcagccgcttcgtcccgcgcgagggctcggcgcccggcgagacgggcgggccgttccactggcgcgaactg

SEQ ID NO: 6696 - DNA, 573 bp, Streptomyces avermitilis
  CDS (1)..(573)
atgggcgaccacaaagaacagccccttcgggtgggcgcggccgtacggcgtcggcgccgggcactggagctcaccctcgccgtcgtggccgagcgcagcggcctgtcggtccccttcctgagccaggtcgagaacgaacgggcccgccccagcaggccctccctggagcgcatcgcggacgccctcggcaccaccgcggtcgaactgctcgccgcggccgacccggcacgcagcgtcgacgtcgtgcgcgcggacgacaccgggctcacgcccacccgggcgcgcgtgcgccccctggtgcgcggtcaccaccagttgcacgccatggagttcaccggcgaccacgacgagggccgcgaattccagcaccgcaacgacgagttgatgtacgtcgccgacggtgccgtcgagatcgaggcggagggccgcgcccaccggctcgggcgcggcgacaccctgtatctgacgggcggggtgcgccaccggtggcgggcgaccgtaccggacacccgggtgatcgtggtcgcggtcgccgaccacatcgaggcggccgaggatccctcgggccggcgc

SEQ ID NO: 6697 - DNA, 795 bp, Streptomyces avermitilis
  CDS (1)..(795)
atgcccgacacctccggatatgccttcgacaacacatccgaaagagcaggcagccgctatgacgtgctggagtccacctacgaccccgtgaccttcgcgcggctcgccgaattgggtgtggcgccgggaatgcgctgcctggaggtcggcgccggtgcgggctcggtcgccgcatggctcgccgagcgcgtcggaccggacggctccgtgctcgccacggacatcgaaccgcgctggctgggcgagctcccggcggccggcaacgtacgcgtcgtacgccatgacatcacccaggaggatctgcccgaggggcggttcgacctgatccacgcccgtctcgtgctgctgcacctgcccgagcggcaggccgcgctcgaccggatggtgcgggcgctgcgccccggcgggcggctggtcctcgacgagttcgactgcggctgggtgccggtgctgtcggcgccctcgcccgaatccgcggagctcttcgagcggatgcacgacgcggtgatgggcgtgctcacccgggccggcgccgacatccgctggggactgcacgcctacggggcgctgcgcgcgaccgggctggccgaggtggcgtccgccacctgggccgaggcgtgggtgggcggttcgcgcggcattcggctgcaccaggtcaacatccgggatgtgggcgggcagttgaccggggacgggctgacggacgacgatctggagcgttgtctgcggctgctcgacgacccgtcgttcgccgtcaactcctatccactgatcaccacttggggcaggcgccgg

SEQ ID NO: 6698 - DNA, 753 bp, Streptomyces avermitilis
  CDS (1)..(753)
gtggggcaggcgcactcggggcgggtgtccgtgacgcgtgtggtctcgctcgtgccctcgctcaccgaggccgtggcccggtccgcgcccggtgtcctggtcggcgccaccgactggtgcagtcagccggcggacctcgacgtcgtgcggatcggcgggaccaagaaccccgatgtcgagcggatcgtccggctcggccccgatctggtgatcgccaacgaggaggagaaccgcgcgcccgacctggccgctctgcgcgaggccggggtcgaggccctggtcaccgaggtgcgggaggtgccgcaggccttccgcgagctggagcgggtgctgcacgcgtgcggagtgccgggcggccggccgcgctggctggacgaggcggaggcggcctggtcccggctgccggcgccggggcgtcgtacgaccgccgtcgtgccgatctggcggcggccctggatggtgctcggccgggacacgttcgccggggacctgctggcccggctgggcgtcgacaacgtgtacgcggcgcacgcggagcgctatccgcgcgtgccggtcgaggagctgcgagccgccgctcccgagatcgtggtcctgccggacgagccgtaccgcttcaccgccgacgacggccccgaggccttcgcgggcacggcctgcgcgctggtcagcgggcgccacctcacctggtacgggccgtcgctgcgggaggccccgcaggtcatcgtcgaggcggtgcgagcagctcgccgg

SEQ ID NO: 6699 - DNA, 1158 bp, Streptomyces avermitilis
  CDS (1)..(1158)
atggtcaccgcagcccagcccctcgccccgcccagcgtccgcacgtcgcgtccccgggccgccgccttccgccacctcggccccaactggtacgcctcggtgatgggcaccgcgatcgtggccacagcgggagcgggccttccctcgggctccgccgcgggcctccccggtgacctcccgggcctgcgcaccgcctgcacggccttctgggcgctctccctgatcatgctcgtgaccctcctcggcgcccgcgccctgcactggatccaccaccgcgaccaggcccgcgcccacctcctcgaccccacgacgggccccaccacggcccccttctacggctgcctcgccatggcgctgctggccgtcggcggcgccaccctgaccgtcggccgggactggctcggcaccaccgcggccgtcgtcctggacgccgtactcttcaccgccggcaccgccgtcggcctcgccgcggccgtcgcggtgccctacctgatggtgacccgccaccgcatcgagccgggccgggccacccccgtctggctgctccccctggtcgccccgatggtctcggcggccctcggccccctgctcgtcccgcatctcccggccggtcagccgcgggagaccctgctgctcgcctgcgtcgcgatgttcggcctcagcctgctgggcacgctcatgatgctgccgatgattttcgcccggctcatcaccacgggccccctgcccctcgtcctcaccccgacgcttctcctggtcctcggcccgctcggccagtccaccaccgccgtcggcaagttcgcggacttcgccccgggggtcgtccccgccccgtacgaccagggcttcggcgtcctcgccgtcctctacggcgtcccggtgatgggcttcgccctgctgtggctgggccttgcggtcgcgctggtggtgcgggcccggcggcggggcatgggcttcgcgctgacctggtgggcgttcaccttcccggtcggtacatgtgtcaccggcgcggaggccctggcccggcacaccgggctcgccgcgttcgacggactcgccgtcgcgctgtacgccgggctggtcgccgcctgggccgtcaccgcggcccgtaccgcccgcgggctggtcaccggcgagctgctcgcaccgcctcgacga

SEQ ID NO: 6700 - DNA, 918 bp, Streptomyces avermitilis
  CDS (1)..(918)
atgagcgagggtgttgatggtgggttgtcggccggtcttgcgcatcgggtgccggagttgggtgcgctggagctgctgcttgccgtggcacggctcggaagcctcgggcgggcggcgcgtgagctggggatcacccaaccggcggccagcagccggattcgctcgatggagcggcagctgggcgtggcgctggtggaccggtcaccgcggggctcccggctgaccgaggcgggggcgctggtcacggactgggcgcggcggatcgtggaggcggcggaggcgttcgacgcgggggcccaggcgttgcgggggcggcgggactcgcggctgcgggtcgccgcgagcatgacgatcgcggagtatctgctgccggggtggctgatcgcactgcgggcgcagcggccggacacggcggtgtcgctgctggcggggaactcggcggtggtcgcggagcggttgctggcggacgaggcggacctcgggttcgtggaggggctgtcggtgccggcggggctggactcgacggtcatcgcgcacgaccggctgatcgtggtgacggcgccggggcatccatgggcgcggcgccggcggccgttgtcggcggcggagctggcggcgacgccgttgatcctgcgggaggaggggtcggggacgcggcaggtgctggacgccgcgctgggcggactggcgcggccgctgatcgaactgtcgtccaccaccgcggtgaaggcgtccgcggtgagcggggcggggcccgcggtgctgagcgaactggcgttgggggaggagctgtcggcgcgtcggctggtgagcattccggtggccgaggtgcggttggggcgggcgttgcgggcggtgtggcggtcggggcatcggccgacggggccggcgcgggatctgctggggttgacgcggggg

SEQ ID NO: 6701 - DNA, 783 bp, Streptomyces avermitilis
  CDS (1)..(783)
gtgcgccacgcgccacgcgcctccagccaggggggcttgctttgccctggaccacccgcaaaggtatgggcaagggccattgggagtaagggaggcggccacgtgaccggacgaccgctgatcggcgtgagtacgtatctggagtccggcgcgcgctggggcgtgtgggagctggaggcggcgctgctcccggccggatatccgcggctcgtgcagcgggcgggcggactcgccgcgatgctcccgccggacgatccggcgcacgccaccgcggccgtgggccgcctggacggcctggtgatcgcgggcggtcccgacgtcgacccgtcccactacggcgcggcccgctccccgcgcacgggcccgccggctcccgagcgcgacgcctgggaactggccctgatccgggccgcgctggcgtccggcacccccctcctgggcatctgccggggcatgcagctgctcaacgtcgcgctgggcggcacactcgtgcagcacatcgacgggcacgtcgagcaggtgggcgccttcggccaccacccggtcaagccggtacccggcacccgctacggagacctggcgccggaggagaccgcggtccccacctaccaccaccagtcggtggaccgcctgggcacggatctgctgccctgcgcccacgcggcggacggcaccgtggaggcgatcgaactccccgcacccgcttgggccctgggtgtccagtggcacccggagatgggcgaggacctgcgggtcatgcgggccctggtggcagctgcttcc

SEQ ID NO: 6702 - DNA, 774 bp, Streptomyces avermitilis
  CDS (1)..(774)
ttgggaagggggcacggccagatgccacaggcggattccgatgatgacctcggcggcctcggcggccggggggaccggctggcgccggtactgcgtccggtgcgggcgggcaacggcttcgaggaggcgctggagcagatcctccaggtcgtccggctcggactggtgccggggggcgaacggctgccctcggagcgggagctggcggaacgtctcggtatcagccgggtgacgctgcgcgaggtcctcaaggtgctccaggaccagggtctggtggagtcgcggcgcggccggtacggcggcacgttcgtcctgccgagggccgatgcgggcggcgaggacgagctgcgccgccgcatcgagaaggtggacatggaggacgtactgcgcttccgtgaggtgctggaggtcggcgcggcgggcctgtgcgcggcccacggcctcacggcggagcaggaggaccggctgcgcgaggccctcgcccgcacccaggacgcaccgctcgccgactaccgccgcctggacacgctcctccacctcacgctcgccgaactgggcggttccccgtccctcaccgcgcagtacgcggccgtacgcgcgacggtcaacgacctgctggactgcatccccctcctggtgcgcaacctggagcactcgcagcggcagcacgccgcactggtggaggcggtgctggacggggacgcggacggcgcccgggagatgatgcgggagcactgcggggggacggcggcactgctgcggggcttcctggcc

SEQ ID NO: 6703 - DNA, 1362 bp, Streptomyces avermitilis
  CDS (1)..(1362)
gtggcagaccgcacaccaccgctcggtgtcgaggagctgcacgccctcgtcgcgggcggcgagatcgacactgtcgtcctcgcgttccccgatatgcaagggcgcctccagggcaagcggttcgccgcgcgcttcttcctcgacgaggtgctggagcacggcacggagggatgcaactacctgctcgccgtcgacaccgacatgaacaccgtcgacggctatgacatgtcctcctgggaccgcgggtacggcgacttcgccatgcatcccgacctgagcacgctgcgccaggtgccgtggaacgcgggcacggcgctgctgatcgccgacctcgcctggaacgacggatcgccggtggtcgccgccccccgccagatcctgcgtcgccagctcgaccggctcgccgccctcggctacaccgcccaggtcggcaccgagctggagttcatcgtcttcaaggacacctacgagcaggcctgggacgccggatacaaggggctcacaccggccaaccagtacaacatcgactactcggtgctcgggacgggacggatcgaacccctgctgcgccgcatccgcaacgagatgcaggccgcgggcctcaccgtcgagtcggccaagggcgagtgcaaccccggccagcacgagatcgtgttccggtacgacgaggccctggtcacctgcgaccagcacgccgtctacaagaccggcgccaaggagatcgccgcccaggagggcgtgtcgatcaccttcatggccaagtacaacgagcgcgagggcaactcctgccacatccacctgtcgctggcggacgcggacggcaccaacgccatggccggcgacggacccggcggcatgtcggacgtcatgcgccacttcctcgccgggcagctcgccgcgctgcgcgacttctcacttctgtacgcgcccaacatcaactcgtacaagcggttccagccgggctccttcgcgccgaccgccgtggcctggggctacgacaaccgcacctgcgcgctgcgggtggtcggccacggccgctcgatgcgcttcgagaaccggctccccggcggtgacgtcaacccgcacctcgccgtcgccggactcgtcgcggccggcctgtacggcatcgagcacaagctggagctgcccgaggcctgcgcgggcaacgcctacgccgccgagtacgagcacgtccccaccaccctgcgcgaggcggccgaactctgggagaacagccccatcgccaaggccgccttcggcgacgacgtggtcgcccactaccgcaacatggcgcgcgtcgaactgaaggccttcgacgccgcggtgaccgactgggagctgcgccgctccttcgaacgcctg

SEQ ID NO: 6704 - DNA, 1389 bp, Streptomyces avermitilis
  CDS (1)..(1389)
gtgaggccccacgtgtcgcacccgcacgaactcgtcgtcctcgacccggcgaccgaggaggtcgtcgccaccgtcccggccgcgacgccgcaggacgtcgacgcggccgtcgtacgcgcctcgaaggcgcaggtacggtgggccgccctcgctccgggcgagcgcgcccggctgctgcgccgcttcgccgtcgtcgtcgacgaacacctggaggagctcgcccggctggaggtccgcgaggccggtcacgtcatcggcaacgcccgctgggaggcgggcaacgtccgggatctgctcgactacgcggccgggggagtggagcggctgaccggccgtcagatcccggtgccgggcggcctcgacatcacgatcctcgaaccgctcggcgtggtgggtgtcatcgcgccctggaacttcccgatgccgatcgcggcctggggcaccgccccggcgctcgccgccggcaacgccgtcatcctcaagcccgccgagaccacaccgctgaccgccctgcggctcgccgaactcgccctggaggcggggcttcccgagcacctcttccaggtcctgccgggtgcggggcccgtcgcgggcaacgcgctggtcgagcacccgggggtcgcgaagatcgtcttcaccgggtcgacggccgtgggcaaacaggtgtgggcgaagggttcggcccttctcaagcgcgtcaccctcgaactcggcggcaagagcccgaacatcgtcttcgccgacgcggatgtcgaggccgcggccgccgcggctcccatggccttcctcgacaactccggccaggactgctgcgcccgcacccgcatcctcgtccagcgttccgtgtacgaccgcttcctcgcactgctcgccccggccgtcgagtccgtcgccgtcggcgaccccttggacgagcggaccgcgatgggcccgctgatctccaaggtccagctggagcgcgtacggtcgtacgtcccggccggcgcccccgccctgcgcggcaaggcgcccgaaggccccggcttctggttcccgcccaccgtcctgaccgacgtcgacccccacgcgcccgtagccgtcgaggaggtcttcggacccgtcgccgtcgtgctgccgttcgaggacgaggcggacgccgtccggctcgccaacgccaccgagtacggcctcgccggttcgatctggacccgggacgtcggccgcgccctgcgcgtctcgggggccgtccgggccggcaacctgtccgtcaactcccactccagcgtccgctactggacaccgttcggcggcttcaagcagtcgggcatcggccgcgaactcggcccggacgccctcaccgccttcaccgaaaccaagaacgtcttcatcagtacggagggccccgcacag

SEQ ID NO: 6705 - DNA, 789 bp, Streptomyces avermitilis
  CDS (1)..(789)
gtgaccgaagcgaccgaacagaccagctgccgccgcctcgtcggacggaccgccgtcatcaccggggccggcagcggcatcggcctcgccaccgcgcgccggctcgcctccgagggcgcccatgtcgtctgcggcgacatcgacgaggtcagcggcaaggcggccgccgacgaggtcggcggcaccttcgtgcaggtcgacgtgaccgacgccgaacaggtcgaggcgctcttcaggaccgcgtacgacacctacggctccgtcgacatcgccttcaacaacgcgggcatctcacctcccgacgacgactccatcctggagaccggcctggaggcctggaagcgggtccaggaggtcaacctcacctccgtctacctgtgctgcaaggccgccatcccctacatgcgacgccagggccggggctccatcatcaacaccgcgtcgttcgtggcccggatgggcgcggcgacctcgcagatctcgtacacggcctccaagggcggtgtgctcgccatgtcccgcgaactgggtgtgcagttcgcccgcgagggcatccgggtcaacgccctgtgccccggcccggtgaacacccccctcctccaggaactcttcgccaaggacccggaacgggccgcgcgccggctcgtgcacatcccggtcgggcggttcgccgaggccgacgagatcgccgccgccgtggccttcctcgccagcgatgactcgtcgttcgtgaacgcgaccgatttcctggtggacggcgggatctccggcgcgtacgtcacacccctg

SEQ ID NO: 6706 - DNA, 1212 bp, Streptomyces avermitilis
  CDS (1)..(1212)
gtggccgcaccagccgcctcggccaccaccaccggccctcgcaactgccctcgcctgtcaggaagttggtacggcgacaaccgcgcccgcctccagcaggtcatcgacgagcgcggcacctgtgccggccaccccggcagccacccggtcgccgcgttcgactgggacaacacggtcaccaagaacgacgtcaccgacgccaccctcgcctgggccctccagcacgacaggatccggcgcccggcgcgctggaaggacaccagtaagtggctcacggacgcggcggacgcggccctgaccgaggcctgcggcaccgccgtccccgcgggcgcgcccctgccgacctcgacgaacacccgctgcaccgacgagatcctcgagatccgcgagaacgcgaagaccatgagcggggccgccgccttcaccggtgacttcgatcaccggcgcacggtcccgcagtacgcctgggtgccccagctgttcgccgggcacacggtcgcggaactctcgtcgtacgcgagcagggcgcgtgaggaggcactcgcggcccccgtcggcgccacccggaccctcggcacccacacgatcgcggcctacgtgcgctactacgaccagcagcgcgacctggtccatgccctccagaaggccggattcgacgtctacatcgtctccgcgggctccgagcccgtcaccgaggtctggtcgcggggcatcggcatcgacgcgcggcacacgatcgcgatccggtcggtcctcgaccggcacgggcggatcaccacctggaaccagggctgcggcgacgtacccgtcagccagggcgaggcgatcccgtacatcgacggcaagcggtgctggatcaaccaggagatctacggcgtacgcggcaaggcggcctggcagcgccagaaccggccgcaccggcccgccatcgccggcggtgacgcggacaccgacgtcaccttcgtcggggacgccaccggcgcccacctcgtgctcaaccggaacaagagcgagctgatgtgccgggcgtacgacgacgccgacgggcactggctgatcaaccccatgttcatcgagccactgccgcgcaggcccgccccctacccgtgctcgaccgccgcctacaacgaacccgacggcggcaaggggccggtccggcgggaggacggttcggtggtgccggaccaggaggacaccgtgttccgcatcccg

SEQ ID NO: 6707 - DNA, 930 bp, Streptomyces avermitilis
  CDS (1)..(930)
atgagcagtacgcctccgcccggctggtaccgagacccgtcgtacccgctcgtcgagcgctggtgggacgggtccgcgtggaccgaccaccggcgtcagcccgagacaccccaggagcccctggtgggcccgcggccggccggccgcgggcccggccgcgccaaggtgatcgcgctcaccgcggccggggccgtcctggtcgccgccgtcgtcacgggggtggtggtcctggcccgcgacgccggcggcagcgggagcggcgccgaggcgaagaccaccgccggctcctcggtgaccaccacgccctccgcgtccgcgtccgcgacctggccctccgcctccgcctccgaaccgtcggccgacgacccgtccgtcgtcgaggacgaactcaacggcatcacaatgccgttgcccgacggctgggtcagggccgagaacgtggcggaggacgacgtcgtcatgaccacgccgggtacgtacgactgccccggcgaccccggcctgtgccgtcacggccaggtcctgtcacgtaccgccacggcgagcgacgcatcgccgaaggcgctcgcccggggcgacatcgcggatgccatggacacggcgttcgaccgcgacggcctcggcagccggcccttcggcggcgtgacgtcgcaccgtgaggtcaaggccggcacggtcgccgtcggcggccgcgcggggtacttcgtgcgctggcgcgtcaccaccgcgaaggggcccggcggttacgtccagtcgctggccttcccgtccagcgtgggctccgaggcgccggtcatcgtccgcttcgccttcgacgcgggcgccgacgggccgccgctcaccgacatggacaagatcaccaaggggatcaggccgatcggcgacccggcgaccggcgggggcgtgggcagcagcatcggcgcgtcgagg

SEQ ID NO: 6708 - DNA, 1200 bp, Streptomyces avermitilis
  CDS (1)..(1200)
atgactgcccgcgccgcagaccgggcccgctacgatcgggccaccgctcagctcgacgcccctgtcgcgatcgtggacctggaggctttcgacgccaacgccgacgacctggtccgccgggccggcggcaagccggtccgcgtcgccagcaagtccgtacgctgccgtgccctgctcgaacgcgtgctggcccgggacggcttcgcgggcatcatgtcgttcacgctcgccgagtccctgtggctcgcccgctccgggttcgacgacgtcctgctcgcctacccgtcggcggaccgcaaggccttctccgagctggcgggcgaccccaagctcgccgccgccgtcaccgtcatggtggacgaccccgcgcagctgcgtctgatcgacgaggcacgccagggcggcaccgaagtcgtgcgtgtctgcctggagttggacacctcgctcaaactcctcgggggccgcgtccgcgtcggcgcccgccgctcccccctgcactccgccgcccaagtcgccgacctggcccgcgcggtggcgcggacgcccggcttccggctcgtcgggatcatggcgtacgagggacacatcgccggcgtcggcgacgcggtggccggccggccggtgcgctcgcgtgccgtccggctgatgcaggccgcggcgcgcaaggagctggcccagcggcgtgccgacgtcgtgcgtgcggtccgcgccgtggcgcccgacctggagttcgtcaacggcggcggcaccggcagcgtgcagcacacggccgccgaggacgcggtgaccgagatcgcggccggctccgggctgtacgtgccgcggctgttcgacaactacacctcgttcagcgggcgtccggccgccctcttcgcgcagcccgtcgtgcgcaggcccggggtcggggtggtgaccgtgctgggcggcggctaccccgcgtccggcgcggctggcgccgaccggctgccggtcccctgcctcccggagggactgaagtacgacccccaggagggacccggcgaggtgcagacgcctctgctgggctcccccgccgacgatctgctcatcggcgacaaggtgtggttccggcacgccaaggcgggcgagctgtgcgagcggttcgacgtgctccatctcgtcgagggcgacgaggtgacggcgaccgtgccgacgtaccggggcgaggggcacacgtttctg

SEQ ID NO: 6709 - DNA, 1107 bp, Streptomyces avermitilis
  CDS (1)..(1107)
atgccgtccgtgctcggcggaacggcgggcctcggcggcgcggcggtcgggccgaggtcggcgggggccgccgaggacctggcgtcccgtgcggggtcggcgggcgacacgggcggcgcgtccgggaaccgcgccgaagccacgggcgggggcggggagtcgggtgcggagttccggtcgagacggaggttggggaaccgtggggactcggcggcccgccgggacgacacggcggacgagggcgcgtccggggtgacggaacgcgggagcacaccggagttgccgttgcggacggtcggatcggccgcggagccggacggtacgggcgcgctgccctgcgccggtacggacgcggagccggacggtacgggcgcgctgtcctgcgccggcgggcgggtgggccggggcgggggcgccgtcggtggggacgcggcggaggcggcctgtcgccctgcggtcggcggcaccgtgggcccggccccgacggccgggggccgttgcggtgcgggcggcggtgcggtcggtgcgccgcccgtggtggggcgtcccccgggcgtggacggaggcacgttcggtatgcggctcgcgaaagggcgttcgtacgacggaggcattccgggccgcgggttccgcgcggccggacgcggtaccgcgagacgcgggaccgcggagggcggatcctgcggtaccggaggcaccgccccgtccgtgtcccgcgaagtcgcctgcccgtcccgcgaggccggcccggtgggcggcggtgtcgtcgggcggggcgggaccgcagggcgcgggggaatggaggcgcggcgcgcttcggtgctcatgcaccccccgtttcgttgtggccgggccgccccggggcctgccgggggcgttcgaccgcctgtgcggagcggtctgcacgcggggtacgggaaacacctcgcaggatcgcccgccacgggcagacatacccgcccggccggtccgccatcccgggcgcacccgcccgggcaaggtcgttcccctcgccgcgtgcgcgtcactctacgggttgacacgcccgtaacgggaaccagtccgcacccccggggcatctgcccggaacgtccccctaccctgcgg

SEQ ID NO: 6710 - DNA, 750 bp, Streptomyces avermitilis
  CDS (1)..(750)
gtgcggccccgcgtcgccgcggccgccgcctgcgtcgtactcggcctcgggctcatcggcggtgcggtgaccgggagttggctcaccggggacgactcggcgccgtccggttcgcccagcgccttcgtcgcggccggcggcctgtggcacagcgtccccgtggacaagctgttcccggccaccgtcgacgggacgggcgcgggccccggcggcgccgaccggacctggacacgtatagccgtcgcccccgacagcggctgcaaggacgccttcgacccgctgctgcgcaaagccctcgcgcccgtcggctgcctgcgcctgctgcgcgccacctacatggacgcgacccgcagccatgtcaccaccgtcggcctgctgttcaccaaggcggacaccaccgccatgagcgctctgaaaacccgcttcaagacggaggacctcggccggcgcacggacctgatgccccggccgtacgccgccaagggcaccgtcgcggccggtttcggcgacgaccagcgcgcctcctggacgctgtcggtcctcacggacgctcccgtcgtcgtctacgccgtctccggcttcgccgacggccgcagcgtcaccgacccgcagcccgccgcggaggccatacaggccggcgccaccaccgcccccgcccaggccggcctcggccacgaggcgcagggcctcgccgaccgcatcgagcgcggcctccgcaagaccgtcacctcggccacggagaagccttca

SEQ ID NO: 6711 - DNA, 1218 bp, Streptomyces avermitilis
  CDS (1)..(1218)
atgacgcgccggcccacagatgtccgcaagccgtccaaagaccgcgccccgcgccggaccggtgcgcgcctgctcacgctcctcctcgccggctccctggcgctgctgcccgccaccacggcccacgccgacggcatacgcgccaagcagtgggccctggacgccatgcacacccagcaggcctggagcacgaccaagggcaagggcatcaccgtcgccgtcctcgacacgggcgtcgacgacgaacaccccgacctcgcgggcaacgtcctcaccggcacggacatggtcggcttcggcgcccggcgcggcgaccgtgcctgggcccggcacggcacggccatggccggcatcatcgccggccacgggcacggcgtcggcgacgccgacggtgtcatgggcatcgcccccgaggccaggatcctgcccgtccgcgtgatcctcgaagacggcgacaacgcccgtgcgaaggcccgcaacacccgtggcaacgcgctggccgaaggcatccgctgggccgccgaccacggcgccgacgtcatcaacctctccctcggcgacgactccaagtccgcccaccccgaacccgccgaggacgaggccgtccagtacgccctgaagaagggcgcggtcgtcgtcgcgtcggccggcaacggcggcgagaagggcgaccacatctcgtacccggccgcgtacccgggagtgatcgccgcgaccgccgtcgaccgctacggcacccgagcctccttctccacccgccgctggtacgccaccgtcagcgcacccggcgtcgacgtcgtcatcgccgacccggaccacaagtactacgaagggtggggcacgagcgccgcgtccgccttcgtctccggcgcggtggcgctcatcagggccgccgatccgggcctgaccccggcacagatcaagcagctcctggaggacacggcccgcaacgcccccaccggcggccgtgacgactcccgcggcttcggtttcatcgaccccgccgccgccatcgaggccggcgcccggctcaagaccgaggggctgcactcgacggcatacggcaagcggtacttcggttccggtcccgacaccgcggaggactccggcgattcccccggctgggcgggtccgctggcgggcggcctgggcgcggcactgctgatcgcggcggtggccctgtggcgcggccgcaacaggcgccgcccccacggtttc

SEQ ID NO: 6712 - DNA, 948 bp, Streptomyces avermitilis
  CDS (1)..(948)
atggagtctcacagagctcaccgccgcgctcgtccgccccgtcgccgtccgctgctctacaccgttctcgccaccgccgtcatcgtgggcggtacggccgcggggaccgcgtacgtgaaggcacaggcgcacgccgacgcgggcaccgtatcgtcgtcggcgacaccctcggcttcggccccggcgagcgaggaggcatcggtggaacccgcggctgacccgtccgtggaccggaacgcgctgctggccaaggccatgaagtcggtgaccgtggaggacggcgcggacgtgtccgtggccgtgctcgacccggactccggcgacagcgcctcgtacggcgacggcaccttcgacacggcgagcatcgtcaaggtcgacatcctggcgacgctgttgctccaggcgcaggacgcgaaccggcagctgacggcgcgggagaagacgtacgccaccgagatgatcgagaacagcgacaacacgtccgcgtcggcgctgtgggccgcgatcggccgggcggacgggctgggatccgcgaaccagcgcttcgggctcgaggggaccgagggcggggacggcgagctgtgggggctgacgcagaccacggcggccgatcaactcgccctgctccagcaggtgttcggggacgactccgagctgagcgaggcctcgcggacgtatcttcaggggctcatgggcgagatagcgacggaccagcactggggtgtgtcggctgcggcggacggcaccaagtgggccctgaagaacgggtggctggcgcggagcacgaccggcctgtgggacatcaacagcatcggccgggtcacggtgaacggacacgcgtacctgatggcggtgctgtcgaacggcaacaccacgaaggcgaaggggatttcgctggtggaggcggcggcgcaggcggccctgtcggcgttcgaggacagcgccggg

SEQ ID NO: 6713 - DNA, 729 bp, Streptomyces avermitilis
  CDS (1)..(729)
gtggcgaacaagaacattcccgactccggcttctccgacgacgacggctccgccgacccccggctgagcgcggcgctcgccgcctgggccgaggaccgcacggccgtcggcccggtcctggacgcgctcaagggcgcccgcctgctcgtgcccgtggtggccgtgctcggcgaggtcgaggaggacgagaacgggctgcgccgcgagaagaccagcgacatggcggtgccgaccctgaaggccgggaaccgcaccgcactgccggccttcacctccaccgagtcgctggcccgctgggacccgcaggcccgccccgtcgccgtccccctgcaccaggcgctgcaggccgccgtgcacgagaaggcggacacgatcgtgctcgacctggccggccccgtcgcgtacgagctgacgggccccgcactgctcgccctcgccgagggacggacgacgacggacccgctcgcggaccccgccgtggtcgacgccgtacgcaccgccgtcgccgccgtgcccgcggtccggcgtgcccacctcggtcccgggcaggcggacggcaccctggctctcgtactggatccggccgcggcgccggccgaggcagcccgcgcggtcgccgagcggctggcggccgacacaacgctgagggcccgcctggtgcgcgggctcgacctggcacttctgccggccgaggccacgccgccgggcgagcccctcttcgtgcggagc

SEQ ID NO: 6714 - DNA, 354 bp, Streptomyces avermitilis
  CDS (1)..(354)
atgagtgacacccctccccagactcccgacttcgacaccatgacccgcgacatcgccgaggtccccgcggtcgaggtgatcgtgacggtcgcagtgaacctgatgagcgccgccgccgtgaagctcggtctgaccgaggagggcgacgagcacaaggacctggacgaggcccgcaagctggtgcacgccctggccggtctgctcgacgcgagcacgacggagatcagctccttccacgcggcgccgctgcgggacggcctgaagtcgctgcagctggcgttccgcgaggcgtcgctcgtcccggacgagccgggccaggggccgggcgagaagtacacgggcgcggtctacggc

SEQ ID NO: 6715 - DNA, 723 bp, Streptomyces avermitilis
  CDS (1)..(723)
gtgtggtgctaccgaggaggatccatcagcacagagccccgcatcaacgaccggattcgcgttcccgaggtgcgacttgtcggtcccagcggtgagcaggtcgggattgttccgcttgccaaggccctggagcttgcgcaggagtacgaccttgacctggtcgaggtggccgcgagcgcgcgcccgccggtctgcaagctcatggactacgggaagttcaagtacgagtcggccatgaaggcccgtgaggcgcgcaagaaccaggcgcacacggtcatcaaggagatgaagctccggccgaagatcgacccgcacgactatgacaccaagaagggtcacgtcgtccggttcctcaagcagggcgacaaggtcaagatcacgatcatgttccgtggtcgcgagcagtcccggccggaactcggctaccgactgctgcagcgtctcgccacggacgtcgaggacctcggattcgtcgagtcgagtccgaagcaggacggccgaaacatgatcatggttctcggtccgcacaagaagaagaccgaggcgatggccgaggcccgtgaggcccaggcggctcgcaaggccgaagcgaaggccaaccccggccgctcgcagaacgccgccgacgaagacatccccgagggcgagcttcccgagggcgaggtccccgaggccgagaccaccgaggccgccgaggccccggccgaggcttccaccgaggcc

SEQ ID NO: 6716 - DNA, 192 bp, Streptomyces avermitilis
  CDS (1)..(192)
atgccgaagaacaagtcgcacagcggtgccagcaagcgcttcaaggtcaccggctccggcaaggtgctccgtgagcgcgccggcaagcgccacctgctcgagcacaagtcgtcgcgcctgacgcgccgcctcaccggcaacgccgagatggccccgggcgacgccaagaagatcaagaagcttctcggcaag

SEQ ID NO: 6717 - DNA, 381 bp, Streptomyces avermitilis
  CDS (1)..(381)
gtggcacgcgtcaagcgggcagtcaacgcccacaagaagcgccgggcgatcctcgaggcggcctccggctaccgcggtcagcgttcgcgcctgtaccgcaaggccaaggagcaggtcacccactcgctggtctacaactacaacgaccgcaagaagcgcaagggcgacttccgtcagctgtggatccagcgcatcaacgccgctgcccgcgccaacggcatgacgtacaaccgcctcatccagggtctgaaggccgccaacatcgaggtggaccgcaagatcctcgcggagctggctgtcaacgacgcgggcgcgttcgccgcgctcgtcgaggtcgcgcagaaggccctgccgtcggacgtgaacgcgccgaaggctgcg

SEQ ID NO: 6718 - DNA, 924 bp, Streptomyces avermitilis
  CDS (1)..(924)
gtgtgcgttcccccgccgccgcggacagcagacccccacccccataaacccgaaggtgacgtaacccccatgtcggccgcccccgagctgatctccccgcgctctcctcgtgtctccgccgcgcggcggctcgccaagcggaacttccgggggaaggaacagctgtttctcgccgagggcccgcaggccgtgcgggaggcggcggcgcaccgcgccgcggacgccgccacgctcgtcgagctcttcgcgaccgccgaggcggcggagcggtacgccgacatcatcggggaggcccgggacgccggggcgcgcgtgcacctcgcggacgaggcggtgatcgccgacatctcgaccaccgtgaccccccaggggctcgtcgggatctgccgcttcctggacacccccttcgaggagatcctcgcggcccggccgaggctcgtcgccgtactcgcccatgtgcgcgacccggggaacgccggcaccgtgctgcgctgcgccgacgccgccggcgccgaggccgtcgtactgaccgacgcctccgtggacctctacaaccccaagtcggtgcgcgcctccgtcggctcgctgttccacctgcccgtcgccgtcggcgtgcccgtcgaccaggccgtcgccggactcaaggacgcaggcgtgcggatcctggccgcggacggcgcgggcgacgacgacctcgacgacgaactcgacaagggcaccatgggcgggcccaccgcctgggtgttcgggaacgaggcctgggggctcccggaggagacgcgtgcgctggccgacgccgtcgtgcgcgttcccatccacggaaaagccgagagcctgaacctcgccacggccgccgccgtatgtctctacgcgtccgcccgtgcacagcgcgcctccggagggtgccgctccgtcacggacagc

SEQ ID NO: 6719 - DNA, 1161 bp, Streptomyces avermitilis
  CDS (1)..(1161)
atgagtgtcggcacgagcggtgcacagaaggcgccgcgagcacaggacgtgcgcggcacacccgcgtcccggcgcggtgatctggccgaactcggcatcgaccccgacgaactgcccgacggactggtcgtggcggacgaacacgggcgggtgatctgcttcaacgccgcggcggcccgtatcaccgccgtgtccgccgccgacgccctcgggcagcggctggagcgcgccctgccgttggaggacctcgaaggccgccgctggtggcagctgaccgacccctacggcggcctcgcgatccgcgtcgcacagcccgagcgcaacctgctgctccccggcggccgggaagtcctcgtgtcggtgcgctacgtgcggacgaggcccaccgggccggtccgccgcctcgtcgtctccctgcgggacaccgaagcccgtcgtcgcaccgagcgcagccacgccgagctgatcgccaccgtcgcccacgaactgcgctccccgctcacctcggtcaagggcttcaccgccacgctgctcgccaagtgggagcgcttcaccgacgaccagaagaaactcatgctggagaccgtcgacgccgacgcgaaccgtgtgacgcggctcatcgccgagctgctcgacatctcccgcatcgactccggacgcctcgaggtgcgccgtcagcccgtcgacatcggcgcggccgtcgggcggcacatccaggcgtacgtcgccgcggggcagcccgccgaccggttcctgctccgcatagagcagcccctgcccgccctgtgggccgaccccgacaagatcgaccaggtgctcagcaacctcctcgaaaatgcggtgcggcacggcgagggaaccgtcacgatcgacgtaacgccctcggcgtccccgcgcgagcggacggacgacgagggcactgcgcacgctgccacgtcggtcacggtgagcgacgagggtcccggcatcccggaggagtccatgaaccgcgtcttcacccgcttctggcggggcagcaagcgcggcggcacgggcctcgggctctacatcgtcaagggcatcgtcgaggcccacggcggcggcatcacggtcggccgcgcccccggcggcggcgccgaattccgatttacgttgcccgtggccaccccggcgtatctgctg

SEQ ID NO: 6720 - DNA, 1080 bp, Streptomyces avermitilis
  CDS (1)..(1080)
ttgaaaccggaagagatcgagcgcatgcgggacgaggcgctcgccgccttcgcggccgccggcgacctcgacgcgctccaggaggccaaggtcgcccacaccggcggcacctcgccgctggccctcgccaaccgcgagatcggcgccctgcccccgcatgccaaggccgcggccggcaagctggtcggccaggcccgtggcgccgtgaacaaggccctcggcgcccgccaggccgagctggaggccgagcgcgacgcccgcgtgctggtcgaggaggcggtggacgtcacactgccgtacgaccgcgtaccggccggcgcccgccacccgctgaccacgttcatggagcgcgtcgcggatgtcttcgtggccatgggctacgagatcgcggaaggccccgaggtcgaggcggagtggttcaacttcgacgccctcaacttcaccccggaccacccggcccggcagatgcaggacaccttcttcgtcgagggcccgaagggcaccgaaggagacgagtccggtgtcgtgctgcgcacccacacctcgcccgtgcaggcccgcgccatgctcgaccgcgagccgcccgtctacatcgtctgccccggccgcgtctaccgcaccgacgagctggacgccacgcacaccccggtcttccaccagatcgagctgctcgccatcgacgagggcctgaccatggccgacctcaagggcaccctggaccacatggtccagacgctcttcggcgcggacatgaagacgcggctgcggccgaactacttcccgttcaccgagccgtccgccgagatggacatgctctgctacgtctgcaagggcgagtccgtcggcaaccccgaccgtccctgccgcacctgctccagcgagggctggatcgagctcggcggctgcggcatggtcaacccccgtgtcctcaccgcctgcggggtggacccggagaagtacagcggattcgccttcgggttcggcatcgagcggatgctgatgttccgccacaacgtcgaagacatgcgagacatggtcgagggtgacgtccggttcacccggccgttcgggatggagatc

SEQ ID NO: 6721 - DNA, 2499 bp, Streptomyces avermitilis
  CDS (1)..(2499)
atgcgggtcccgctttcctggctgcgggagtacgtcgacctccccgccaccgagaccggccgcgatgtgcaggccaagctcgtttccgccggcctcgaggtcgagagggtcgagcagctcggcgccgacctcaagggccccctggccgtcggccaggtgctgaccatcgaggagctggagggcttcaagaagccgatccgcttctgcaccgtcgacgtcggccaggccaacggcaccggtgagccccaggagatcgtctgcggcgcccgcaacttctccgtcggcgacaaggtcgtcgtggtcctgcccggcgccgtcctgcccggcaacttcgcgatcgccgcgcgcaagacgtacggcaggacctcgcacggcatgatctgctccggcgacgagctgggcatgggcgacgacggctccggcggcatcatcgtgctcccgccggagtacgaggtcggcaccgacgccatcgagctgctcgagctggtcgacgaggtcctcgacatcgccgtcacgcccgaccgcggctactgcctgtcgctgcgcggcatcgcccgcgagaccgccatcgcgtacggcctgccgctgcgcgacccggcgctgctcgacgtgccggccccgaacgcgttcggccacccggtgaagatctccgagccgctgggctgcgaccgcttcaccgcgcgcacggtgaccggcctcgaccccgaggcgcgctccccgatctggctccagcgtcggctccagaaggccggcatgcgctcgatctcgctggccgtcgacatcaccaactacgtgatgctggagctgggccagcccctgcacgcctacgaccgctcccgcatccagggcgcgatcggcgtgcgccgggcggagcagggcgagaagctcaccaccctcgacggcacccagcgcacgctggacgccgaggacctggtcatcaccgacgaccgcgggcccatcgggctcgcgggcgtcatgggcggcgcccacaccgagatcgacgacaccgagggcacgaccaccgaggtcgtcatcgaggccgcgcacttcgacccgatctccgtcgcccgcacggcccgccgccacaagctggcctccgaggcgtccaagcgcttcgagcgcggcgtcgacccgctggccgcctccgccgccgcccagcgcacggtcgacctgctggtgctcctcgccggcggcagcgccgacgcgggcgtcacggaggtcatcacgccctccgcgccgcacaccatcaccatcccggcgaaccacccggaccgggtggcaggagtcgagtacggccgcgagaccgtcgtacgccgtctccaggaggtcggctgcgacgtctacgggcaggacgagctgctcgtcaccgtgccgtcctggcggcccgacctgaccgacccgaacgacctggccgaggaggtcatccggctcgagggctacgagaacctgccctcgaccctgcccaagccccccgcgggccggggcctgaccgagcggcagcggctgcaccgccgcgtcggccgcgcgctggccggcgccggatacgtcgaggcgccgaactaccccttcatcggggagcacgtcttcgaccagttcggcctcgccgccgacgacccgaagcgccgggtcgtcaagctggtcaacccgctctccgaggaggagcccgcgctccgcacgacgctgctgccgggcctgctcggcgcgctgcgccgcaacgacgggcgcggttcgcacgacctggcgctcttcgagaccgggctggtcttccacccgcgcgcggagcagcgcatcgcggtccggctgcccgtcgaccgccgtcccacggacgaggagatcgcctccctcaccgccgcgctgcccgagcagccccggcacgccgccgtcgtcctcgcgggcgcccgcgagcaggccggctggtggggcaagggccgcccggccgactgggccgacgcggtcgaggccgcacgcaccctggcccgcgaggcggggaccgaactcctcgtgcgcgccggccagtacgggccgtggcacccgggccgctgcgccgagctcgccgtcgtcctcgacggcgaggagaaggtcatcgggtacgccggcgagctgcaccccggtgtcctgaagacgctgggtctgcccgcgcgcaccagcgcgatggagctgaacctggacgcgctggagcaggcgagcgcgggcgtcgtgaaggggccccggatctccacgttcccggtcgccacccaggacgtcgcgctggtcgtcgacaagacggttccgcacgcggacgtcgaggcggcactgcgcgagggtgcgggtgaactcctggagtccatccggctgttcgacgtgtacgagagcgagcagctcggcgcgggcaagaagtccctcgcctacgcgctgcgcttccgtgccgccgaccgcaccctgaccgtcgaggaggcctccacggcccgcgacgcggcggtggcgctggccgccgagcgcacaggggcggcactgcggagc

SEQ ID NO: 6722 - DNA, 1152 bp, Streptomyces avermitilis
  CDS (1)..(1152)
atgatccgtatcaaggctggggttccctgcggaccacggccccgcgctcgtcccggcgaaggattcagggcggtcgtcgcccgcgggatcccgcgtgaccgcatgctccggcgccgctcgcgccgggagtcccggcgtttccggcgggcgctgtcgatagcgctgcccaccgtctggggcacgacggcgatcacctacaaactggcctgcccgctcgcgcagcagaacgggctcggcgcgcggatcgtcaccagcgccgtgttcttcgccgtcggcaccgggctgatccttcaggtccgacacacactgctgcgggagttgcgacaggcccgcaaggtcgcgggcgccgcccagagcgtgctgctgcggccgctgccgtcgcggatcggcgggctgaacatcgcggcggcccagctctccgccgaccgcggcgccaccgtcggcggcgatctgtacgaggtgatcgccaccgagcacggcgtacgcgtggtgataggcgatgtacgggggcacgggctggcggccatcgggacggtcgccgccgtcctcggcagcttccgcgaggcggtgcacgacgaggccgaactcgccggtgtcctccaacggctcgaacgggccatggtccggcatctgcgggagcgggccagagccgagcccccctcggcgggcccggatccggacagcctggtcgccgaggagttcgtcaccgtgctgctgctggagatccgccacgacggggaggtgtacgccctcaactgcgggcacccctggccgtatctcctcagcggcagccgggtggaactgctcgcgcgcgccgaacccctgcccccgctcggaccgttcccgctgcccgccgagctgccgtccaccagctgtggcccgcttcagcccggggaggcgctgttcctgcacaccgacggcgccgaggacgcgcgcgatgcccgtggccggttctttccgctggccgccgtcctcggcgaggtcgtgcggatcccggcggtgtcgccgcaggccgtcctgaaggccgtcttcgccgggcttctgcgccacaccggcggcagaccgtcggacgacgtggccctgctggtcctgcacaacgacccgcaccgcacctccacgacggcgaaccacccgatggctcaccacgtgcag

SEQ ID NO: 6723 - DNA, 1338 bp, Streptomyces avermitilis
  CDS (1)..(1338)
atgcagcccaacactctgctcgacgcgatcctcgacgaggccgggatctcccacgcgggactcgccgcgcacgtcaaccaggtggggagggcgcgtggtgttgccctcaggtacgaacacaccgccgtggcacggtggttgaagggccagcggccgcgcggccaggtgcccgacctgatctgcgaagtgctcgcggccaggctgcaccgcccggtgacgctcgacgacatcggcctcggcgttcccggtgaaccgtccgccccccacgcttccacgctctccggcttcgtcgagcgggccaccgccctgtggcgctccgacgaacagcagcgcccgcacatcctcggcgcccccgccgtcaccggaacgcctgccgtgatgccggtctgggagtgggagaacccgcccgaggacgtggacgtctcgcgcggcggccggcaccgggtcaggatggccgacatcgagatgctgcgcgcggcccgcgcccactacgagcagatgtaccgcaaggcgggcggcatagcgacccgcacccgcatcgtcggcttcctcaactccgagacggcacccttactgcgcggcagttacaccgacgccaccggccgtcaactgcaccgggccaccggcggcctggtggccatcgcgggcatctgcgcgtacgactccgacgcccacggcctcgcccagcgctacttccaccaggcactccggctggcgaaggccagcggggaccggggactcggcgcctatgtcatagccctgctggtcaaccagtcgctgttcatgcgcgaacaccggcaggccgtcgccttcgccgaggccgcgctgcgcgccgcgggcaagcacatcactcccgcgctcgcctccgacctctacgcgatgcaggccaaggcgtacgcgcacctcggcgacggtacgagcgcgctgtcctgcatccggcgggccgagcaggcggccgagcgcatccggcgcggctacgagcccgacgagaccggttatgtccagcccggcctggtcaacgtccaggtggcggaggcgctgctcagcctcggcgacctggtggcggcgggcgagcacgcggcggccgccgtcgacacccccgcccatgaccgggggcgggtgcaccggctcgcgatgctcagtcagatcgagctccgccagggcaacgccgacaaggcggtcgccacggcggtcgaaatggcggaacaggcgcgcgggatggagtcccagcgcctgcgcgacagactgcgggcggtacgcgaacatctggcgcgcagcggctgcgcgggcacggccgaggccgccgaactgatcgacggggcactgcgcgtaccgctg

SEQ ID NO: 6724 - DNA, 543 bp, Streptomyces avermitilis
  CDS (1)..(543)
gtgcagtggacgaaacagaacgaacaaactgtgtatgaaaaccgctggttcagcgtcaatctcgcggatgtcgagctgccggacggccggcacctcgatcacttcttgatacggctgcggcccgtcgccgtggccaccgtcgtgaatgaggccaacgaagtgctgctcctgtggcggcaccgcttcatcaccgacagctgggggtgggagctcgcggcgggcgtcgtcgaggacggcgaggacatcgccgtggcggcggcccgtgaactcgaggaggagaccggctggcgaccgggacccctgcgccatctgatgagcgtcgagccctccaacgggctcaccgacgcccggcaccacatcttctgggccgacgaaggcgtgtacaccgggcaccctgtggacgacttcgagtcggaccgtcgggagtgggttcccctcaagctcgtacccgacatggtcgcccggggcgaggtcccggccgccaatatggcggccgcgctgctcctcctgcatcatctgaggctcgggcaggacgctttgccc

SEQ ID NO: 6725 - DNA, 309 bp, Streptomyces avermitilis
  CDS (1)..(309)
ttgactttccgtgcgtacacaagggatgtgacgactacggaaaggagcggacacgtgaccgccgaccccgagcatcccgtggtccacggagaagtcgcagagttacgccgtcgcctcgatgtggcacatgcccgcgtcgagggagggctggctctgctcagccatcgcgcggaacagaccgccaaggatgtcgacgacctgagcacacgggtcgtcacactggaacacacccgctggccactgcccgcggtcgcggccatcacggccgtgggcgcgctcgccgtggcggtctggcaggctctgggccac

SEQ ID NO: 6726 - DNA, 879 bp, Streptomyces avermitilis
  CDS (1)..(879)
atgatcagcgaaagggacgatgtgaccgacatcgaacgcgtcggagtggtcggctgcggccagatgggagcgggcatcgccgaggtgtgcgcccgcgccggtcttgacgtcaaggtcgccgagaccaccggcgaggccctggagatcggccggacccgtctgttcaactcgctgtccaaggcggccgagcgcggcaagatctccgaggaggagcgggacgcgacgcaggcccggctcagcttcaccaccgacctcggcgagttcgcggaccgcgatctggtgatcgaggccgtcgtcgagaacgagcaggtgaagacggagatcttccaggtgctcgaccaggtggtgacccggccagacgcgatcctcgcctccaacacctcctcgatcccgctggtgaagctcgccgtcgccacctcgcgccccgaccaggtcatcggcatccacttcttcaacccggccccggtgcagaagctcgtcgagctgatcccggccctcaccacctccgagggcaccctcagccgcgcgcaggggctcgtcgagaagatcctcggcaagcacgcgatccgcgcccaggaccgctccggcttcgtggtcaacgccctcctcatcccgtatctgctctccgcgatccggatgttcgagtcgggcatcgccagccgtgaggacatcgacaacggcatggagctgggctgcgcccatccgatgggcccgctcaagctgtccgacctgatcggcctggacacggtggcctcggtcgcgtcgtcgatgtacgaggagtacaaggaaccgctgtacgccgctcccccgctgctccagcgcatggtggacgcgggccggctgggccggaagtcgggctcgggcttctactcctacgcc

SEQ ID NO: 6727 - DNA, 1251 bp, Streptomyces avermitilis
  CDS (1)..(1251)
gtgcagatggggcgactgtcacgtcgggcgttcgcgatggccgcgctgacgactctcgggacggcgggcgacctggcggccgcgccacggggcggcccggcggccccgccgggccggcggcgcgcggccggcgagctgcggggcatgtggctggcgaccgtcgcgaaccgcgactggccctcccgcaccgggctcaccccggccgagcagcgcgccgaactgctggcccacctcgacaccgcggtccgtcgccggctgaacgcggtgttcttccaggtccgccccaccgccgacgcgctgtggccctcgccgtacgagccctggtcccagtacctgaccggcacccagggaaaggaccccggctgggacccgctcggcacggccgtcgcggaggcccatgcgcggggcctggagctgcacgcctggttcaacccgtaccggatcgccaaccacacggacccggccaggctggtcgcctcgcaccccgcccggctgcaccccgactgggccgtgccgtacggcgggaagctctactacaaccccgggctgcccgaggtccgcgccttcgtccaggacgcgatgctcgacgcggtgcgtcgataccgggtcgacggcgtgcacttcgacgactacttctacccgtatccggtcgcgggccagaccttcgacgacgacgcggcgtacgcggcccacggcgcggacttcccggaccgggcctcctggcggcgccacaacatcgaccggctcgtgagcgagaccgcggccctgatccggaaggtgcggcccgccgcacggttcgggatcagccccttcggggtgtggcgcaacgccgcgacggaccccctgggctcggacacacgggcgggcgtgcagacgtacgacgatctgtacgccgacacccgcacctgggtacgggagtgctggatcgactacatctgcccgcaggtctactggaacatcggcttcgccgcggccgactacgcgaagctcgtgccctggtgggcggcggtcgccaagggcaccggcgtacggctgtacgtcggcgaggccctgtacaaggccggggacccggcgcagcccgccgcctggcaggacccggtcgaactctcccggcacctcaccctcgccaagggttacccgcaggtgcgcgggcatgtcttcttctcggccaaggaggtcgcggcggaccggatcggcgcgctggcacgcgtggtcgccgaccactatcagcagccggcgaaacctccacgc

SEQ ID NO: 6728 - DNA, 198 bp, Streptomyces avermitilis
  CDS (1)..(198)
atgcatgcgactgagggcgaccagctcgtgcagcacggcagggtcgtcgggcagcacgacaagatcgcagagatcgtcgaagtaatgggcgccgagggcactcccccgtaccgcgtccgcttccaggacgggcacgaggcagtgtgttcaccgggcccggactccgaaatccgtcaccccaagcccctcgggtcgctc

SEQ ID NO: 6729 - DNA, 1017 bp, Streptomyces avermitilis
  CDS (1)..(1017)
atgagagcacaggatagcgctactgccgataccccgatagcggtgcccacccagcccaggagcacggcgcacacgcaccccgcggcccttccgcgggacaccaccggcgtggatcccgcttccctcccacgggacaccaccggcgcgggccccgcttccctcccccaccgctccggcacgctccaggccgctctcggagtcaccgccttctccctcacctttcccgccaccgcctggggcctggagggcttcggcccctggtcgctcgtcaccgtgcgcagcctgctggccgcggtcatcgcgggtggctgtctgctggcgctgcgcgtaccgctgcccgcccggcggcactgggcgggcctcgccgtcgtcgccgcgggcgtcgtgctcggcttcccgctgctgacgacgctcgcgttggagacggccaccacctcgcacgcggccgtggtcgtcgggctgctgcctttgacgactgccttgttctcggcgctgcgcaccggcgcacgcccttcccgcaccttctggatcgcggccctctccggcgccgccgccgtcatcgcgttcaccgtgcagcagagcggcggcgccctgaccagcgcggacgcctacctcttcggggcgctgctggtctgcgcggcgggctacaccgagggcggccggctcgcccgggtgatgcccggctggcaggtcatcggctgggccctggtgctgtgcctgccgctctcggtgccgggcgcgctggtcgccctggcgtacgagccggtacagctggcggcacacagtgtcgccgggctgctgtgggtggcggcgggttcgcagtttttggggctggtcgtctggtaccgcggtatggccgcgatcggcattccgaaggccagccagttgcagttggcccagccgctgctcacactggtgtggtcggtactgctcctcggcgagcacctcacaccggccgccccgctgacggccgcggccgtactggtctgcatcgcggtcacccagcgagcgcgaggc

SEQ ID NO: 6730 - DNA, 1308 bp, Streptomyces avermitilis
  CDS (1)..(1308)
gtgaccgtctcgcgggccctggcgcaactggtcgccgagggcttggtgatcacgcggccgggcgccggggccttccgggccgagccgcggcgggcccccgccaccgtgggggacaccgcctggcaggaggtcgccctcagcgccgacgccgccgccgaactcgtgccgcgcaccgtcgacgcctccggcgtgctcgtctcgctcgccgcaccaccggccggggtcgtcgagttcaacggcggctatctgcacccctccctccagcccgagcgggcgatgggcgcggcgctgtcccgggccgggcggcgccccggggtgtgggcgcggccgcccgtggaggggctcggggacctgcgcgagtggttcgcgcggggcatcggcggcgcgatcaccgcggccgaggtactgatcgcggcgggcggtcagtcggcgctgaccaccgccctgcgcgcactggccccgcccggcgccccggtcctggtcgaatcacccacgtaccccggcatgctggcgatcgcccgcgcggccgggcagcggccggtgcccgtccccgtggacgccgacggggtgaaacccgccctgctcgccgacgcgttccgggcgacgggtgcgcgcgtcttcgtctgccagccgctgttccagaatccgacgggcgccgtcctcgcacccgagcgccgtggtgaggtgctgcggatcgcgcgcgacgccggggcgttcgtggtcgaggacgacttcgtacgacacctggtgcacgaggacgccgggccgctgccgccgccgctggccgcggaggaccccgacggggttgtcgtacacgtccgttcgctgaccaaggtgacctcgcccagcttccgggtgagcgcgctggccgcgcgcggaccggtcctcgagcggctgcgcgccatccaggtcgtcgacaccttcttcgtgccgcgcccgctccaggaggccgcgctcgaactcgtcggatccccggcctggccccgccatctgcgctccgtcggcgtcgagttgaggaaccgtcgggacacgatgaccgccgcactgcgcctgcacctgcccgaactcgccctgccgcacatcccgtccggcggctaccacctgtggctgcggctgcccgacggcgcggacgagccctccgtggtcgcgggggccctgcgcgcgggcgtggcggtcacgcccggccgcccctacttcagcgccgaaccccccgccgcccacctgcggttgagcttcgcgggggtcgcgggaacgggagagatcacggagggggtgcgcaggctgcgtaccgcgtgtgacgcggtcctc

SEQ ID NO: 6731 - DNA, 438 bp, Streptomyces avermitilis
  CDS (1)..(438)
atgactgacgcacaacgcctgcccggcggctacgaactctccaccgaccccgcccggatcgacctcgaccgtgtccacggctggctgtcggccgacgcgtactgggcgatcgggcggccccgcgagaagcaggagcgcgcggtggccggctcgctcaacttcggggtgtacgcggcggcttcgggcgaacaggtggcgtacgcgcgcgtggtgaccgaccgggcgacgttcgcgtggctctgcgacgtctacgtcgacccctcggtacgcggcaaggggatcggcaccgcgctggtcggcggcgtacgcgcacacctcgaacccctcgggctgcggcgcgtcctgctcgccaccgaggacgcgcacggcgtctacgcgaagctcggcttcaagccgctcgacacgccgggccactggatggcgctcgcgttcgaacag

SEQ ID NO: 6732 - DNA, 582 bp, Streptomyces avermitilis
  CDS (1)..(582)
atgcatcttcgggtcacattcgtcgccaccgcgcgcagctcctcgctgctcgcggagcgcttcgaggaggaccggccgctggaccaggccggctgggacgcggtgcagcgggccgccgctgagctggtgccgctggcggccgccgagctgcgctactgctcgccgtccccgggcagccgggcgaccggtgacgcgctcggctatgccccgctcgcccagctcgcgctgcgcgactgcgacatgggccggtggcgcggtctgacgctgggcgaggcgatggcccgtgagccgtcggcggtcgacgcctggctcgcggatccgcgctccgctccgcacggcggtgagccgctgatgtccttcgtctcccgggtggggcagtggctcgacacccggcccgcggacgacggcagccagatcgtcgccgtggcggagccgtcggtggtgcgggcggccctggtccacgcgctgcgggcccatccgtcgacgtactggaacatcgacgtccgcccgttgtcgacggtcacgctcatcggcgccaacgggcgctggaacctccggctggaggccggactccagcgcgtc

SEQ ID NO: 6733 - DNA, 468 bp, Streptomyces avermitilis
  CDS (1)..(468)
atgggtgagttctggccggtggccgatgccctggggtatctgacgggaagctggcgcgtggagcgcaccgtgcgggatctcgcgggcggggccgaagggcacttcaccgggacgaccgtcttctcacccctggaggacggcggcggcgggctgctgcatcaggagtccgggacgttcgtgtggcagggcgccgcgagaccggccgagcgaacgctgtggttcctgcccggggagaccctcggcatgtcggacgtacggttcggtgacgggcgccccttccacgtcctcgacctgaccaccgggcaccatgtcgccgaccacccgtgcgccgcggacctctaccgcggcgagttcaccgtgtacgccgaggaccgctggcggacggtgtggcgggtcggcggaccggccaaggacctgatcctcacgaccgactacgcgcgcgaagaaccgactgggcgcgcgaccgtc

SEQ ID NO: 6734 - DNA, 2130 bp, Streptomyces avermitilis
  CDS (1)..(2130)
atgtcacccacccgcacccgctggagactcggactcacagccgccgcgttactggtggcctcggtcggcgttcccgcgcccgcccacgccgaagacatcaccgactacgcgatcgccgtcgatcccaagggatcgggggcgaagatcgacgacaccatgtacggggtgttcttcgaggacatcaacagggccgccgacggcgggctctacgcggaactcgtgcagaacaggtcgttcgagtacgcgaccgccgacaacacgtcgtacaccccgctcacctcctggaacacctccggtaccgcggacgtcgtcagcgacgacggacggctcaatgcccgcaaccgcagctatctggccctcggcggcgactcctcggtcaccaactccggctacaacaccggcatcgcggtcgagagcggcaaggtctacgacttctccgtctgggcccgcgccgaccaggccgaccccctcagcgtgaccctgcacgacacggacggtgacttggcccgggcccgccgcgtcaccgtgcgcggcggctgggccaagtacacggccaggttcaccgccggccgcaccagcaccaccggccggctcaccgtcgccgccgccggcgccgtcgcgctcgacatggtctcgctcatccctcatgacacctacatggggcacgggctgcgcaaggacctcgccgagaagatcgccgccctgcaccccggcttcgtccgcttccccggcggctgtctcgtcaacaccggttcgatgaggggatacgacgaggcgtcggggtacgagcgcaagcggtcgtaccagtggaaggacaccatcggacccgtcgagcagcgcgccaccaacgccaacttctggggctacaaccagagttacgggctcggctactacgagtacttccagttcgccgaggacacgggcgcgatgccgctgcccgtggtgcccgccctcgtcaccggctgcggccagaacaaggccgtcgacgacgacgctctcctcgagcgccacatccaggacacgctggacctcatcgagttcgccaacggcccggtgaccagcgaatggggcaggaagcgcgccaggatgggccatcccgagcccttccacctcacccacctcgaggtgggcaacgaggagaacctccccgacgagttcttcgcccgcttcacgcggttccgggccgccatcgaggcgaagtaccccgacgtcacggtcatctccaacgccggcccggacgacagcggtccgaccttcgacaccgcctggaagctcaaccgtgacgcggacgtcgacatggtcgacgagcactactacaacagcccccagtggttcctccagaacaacgaccgctacgacgcgtacgacaggaacggccccaaggtgtttctcggcgagtacgcgtcgggcggcaacaccttcaagaacgccctggccgaagccgcgtacatgaccggtctggagcgcaacgcggacgtcgtcaagctggcctcgtacgcaccgctgctcgccaacgaggactatgtgcagtggcgccccgacatgatctggttcgacaaccacgcctcctggggctccgccgactacgaggtccagaagctcttcatgacgaataccggcgaccgggtcgtgcccagcaccgcgagcggcacgcccgccctgagcgggccgatctccggtgcggtcggcctgtcgacgtgggcgaccaccgccgcgtacgacgatgtgcgggtcaccggcgaggacgggaccacgctgctcggcgacgacttcagcggtgacgcctcgcggtggacgcacacgggcggcggaagctggagcgtcgaggacgggcagtacgtgcagagcgacgtggccgccgagaacaccatggtctcggcgggcgacccggcctggcacgactacgacctgcgggtgaaggccaccaagaagtccggcaaggagggcttcctcgtcgcgttcggcgtcaaggacaccggcacctacacgctcgtcgccgcgcccgacgcggtgaactcgcggacggcgacgcctgtcgcaccggtgacgtccgtcttggagggggtggccgacaggttcacgtataccttcccggccaactccgtgacgttcctgcggatcaggcagagg

SEQ ID NO: 6735 - DNA, 435 bp, Streptomyces avermitilis
  CDS (1)..(435)
atgagcgacgccaccacccgcgaagagcgcttcgagcacggcctgcgggtcctgaagcaggtcgacggcgaggccggggagcgcgtcgtcgccgccttgggcgacatcaatcccgaactgggccaccagatcgtctcctgggccttcggcgacatctacgaccgccccggactcgccccgcgcgaccgccagttggtgacgctcggcatgctcaccgcgctcggcggctgtgaggttcagctggaggtgcacgtcaacgcggcgctgaacgtgggcctttcgccggacgagatcgtcgaggcgctgctgcactcggcggtgtactgcggcatacccaaggcgatgaacgcctccctcgtcgcgaagaaggtcttcgccgagcgtgggctgccgcccgccggacagcagcccacggccgccgcggctacctctgcc

SEQ ID NO: 6736 - DNA, 417 bp, Streptomyces avermitilis
  CDS (1)..(417)
atgaccagcggacagcccctcccgctccaccgggaaccgaccctcacgatcgctcaggtcgtcgagcgcaccggcctgtcgcacgacacactgcgctactacgagaaggccggtctgatcgaacgggtcggccggaccaccggcaaccaacgccgttacgaggcggcggacctggcctggctggagtttctgctccggctgcgcgagacgggcatgtcgatcgcggacatgcagcggttcgcgctgctgcgctcgcggggcgacgccacggtcccggaccggctcgtgatgctccgcgagcaccgcgccgagctggcggagcgcatccgcgccctgcgccgcaacgcggccgccctcgacgacaagatcgaccactatgaacggctgctcggccagccggaaccaggagaaccgaca

SEQ ID NO: 6737 - DNA, 636 bp, Streptomyces avermitilis
  CDS (1)..(636)
atgggcacaccgatcacaggcatcaatacggcgggcttcacccagcgggaggcggatctctggaccgacgagcggggactcgtcctgtcgctgcacttcttccccctcgtcccggacctgccggccccgctccacgaaccggaccggctgcggcgcggcctcgcggagggcgccgcacgggccggtgccggtctgatcgaagcggtgaccggcgacgtggccggtgtgccggccgtccggcagctgatcaaggtgcgccggccggacggtcacggccaggtcttcctcggctcctggacgataccgaaggctggttgcagcacggtcgtcaaggtgcaggccggggagggggccacgaccgggatgcgcgaggccgtcgtgctgaaccaggtcggcccggccgcctacttcaggccccatccgtacgcgtacgacctccagggcgccctgccgtaccacgtcgccgaccacgaggagtgggacgcgcacttcccggaccatccgctcacactggtgcgcgacgcgctgcgccggatcacgcccaccgtgacgttcgacccgcggttcacgtccctgccgcccttcggggcgcagccggcctgggcaccgccgatgccgccggcaccgccggcgctc

SEQ ID NO: 6738 - DNA, 1197 bp, Streptomyces avermitilis
  CDS (1)..(1197)
gtgacccaggacctggccgacttcaccgcaccgcacgccgagcggccgccggtgcccctcgccgtcgactgggcggcggtcgagaagtggctcgggctgcgcctgccgggcgagtacaagcggctgatcgaccgccacgggcccatggacttcggtgagtacgtgtggatccacggtccctgtgccgaggaaggacggttcgactacggggactggctgcgcgagaagcaccgcgcggcgcgcatcgagttgcgcgacctcccggaagacgagcggtacgccgtccatcccgcgcccggcgggctgctcgcctgggggtgcagccggggcagcgacgtcttcttctgggacacgtcgagttccgacgaccccgaccggtggaccgtggtcgtccggcactccgggtccgtgccgggcagcggactgcggaactggcacccgtacgacctcaccctcggcgcctatctgcggcacacggtccgcgacacctgggaactcccttcgccgccgggccccttgatcggccctctgcccggatccgtcgcccgcaccgcgttcctgccgacggccgcgccttggaccccgcccgcgcggaccgcgccccgcctcaccgagacgcagcgccgtgtcgcgctggagaccggcgccggcctcgctgcgctgcggctgctctgcccgccgcccgcgacgccgtatctcggcggcggtcggtgggcgtccctcttcgcggagctgggcacacggctgccgcgggagtacgtgacgctgatggacgagtacggcgcgggctgctggagcgagtggctgcgcttcctcaccccgctgcggaccggcgagcggcgctttcgcacgcacatcgagcagaccacgggcgggtatcggaagcacagggagagctacccggagcagtatccgctgcccgcttggcccgagccgggcggtttcctcccgttcgcctgttccatcgacggcgactacctcggctggctggccgagggcccggacccggacacctggcccctgatcgtctggccgcgccacgcgccgcaggggccgcgcctggagagcggcctggtcgacaccctggtcgcctggcagcgcggtctgctcaccgcgccgggcctggccggtctggacgaggacgacgacccggtcgagttcgcccgcttcgagtcctgggacgaccgggcctactgg

SEQ ID NO: 6739 - DNA, 441 bp, Streptomyces avermitilis
  CDS (1)..(441)
atgtcgtcgcggagggcacccggcaagcccttggccaagcagaatcgccagatgcccgagcacggcgcggatcagggctgcctgctggacaaccggcacgcggaggcggggatccggttcgacgccctcagcgagttgttcgatccggtgactttccggcacgtcgaccagctcgggatcggtgccggcatgcggtgccggaagatcggcgccggtggtccgtccgtacccctcgggccggccgagcggttcggcccctcggacggtgatcgccaccgacactccatgcccacagactctccccgacgtacggcggcatctcaacgggattcggcggcggagctggtagcgggatgcggcaacgacggccgcacgctccggacgcgggccggcgggacaatcgtcgtgcgccccgcccgctcacccccggaggaccacccg

SEQ ID NO: 6740 - DNA, 801 bp, Streptomyces avermitilis
  CDS (1)..(801)
gtgcgtcgcgacgacgagcgggcacaggcgctgcgcgcgaccggcgccgaggtcgtcatcggagacctgacgcgcgcaggcgatgtcgccgacgccctggccggctgcgcacgcatgtacttcggcatgagtgtctcggcgcagtatctggaggctgccgtgacggcggcggccgtcgcgcgtgcgtacgggcgcctggaagtgttcgtgaacatgtcgcagctgactgtctccgagatggacctcaccagcacctccgagtccgtgcagcaacggcagcagtggctggcggagcaggtcctcgactggtcgggcctgcccgttgtccaggtcaggcccaccgtgttcatggaaaacccgctgttccgtgtcggcttctcctcgatcgcgaagtacggaaccatcagattgcccttcggccgggcgaagtcctcccctgtggcggccggcgacgtcgccgcggtcgtggaggagatcctggccgacccggccccgcacatcggcaggatctatgagctgaccggcccgcgctcggaggacatcgccgccatggcggcggaggtctccacagttctgggccgaccggtcaggtacgccgacatccccttgcaggaatggatcgacgacgatctcaggccgctggggctgcccgatcacgtcttccagcacatctccaccatggctcgccttcatgcggagaatcgatacgaccgcaaggcggaaggggtcgagcaggtcaccgggcggcctccttcaggggtggccgattacgtccgggacaacctcagcctcttcagcccc

SEQ ID NO: 6741 - DNA, 1026 bp, Streptomyces avermitilis
  CDS (1)..(1026)
atggcggtacgagtggcagtggccggagcaagtgggtacgcgggcggagaagcgctgcggctgctcctcgcgcaccccgaggtcgagatcggcgccctgaccggaaactccaacgccggccagaagctcggcgcgctgcagccgcacctgctgccgctcgccgaccgggtgctccaggagacctcccccgacgtgctcgccgggcacgacgtcgtcttcctcgcgctgccgcacggccagtccgccgccgtcgccgaacagctcggcccggacgtcctcgtcgtggacatgggtgccgacttccggctcaggaaccccgccgactgggagaagttctacggctccccgcacgccgggacctggccctacgggctcccggagctgccgggcggccgcgccgcgctggaggggtccaagcgcatcgcggtgcccggctgctacccgacggccgtctcgctcgcgctcttccccgcgtacgcggccgcactcgccgaaccggaggccgtgatcgtcgccgcctccggcacctccggcgcgggcaaggcggccaagccgcacctgctgggcagcgaggtcatgggctccatgtccccgtacggcgtcggcggcgtccaccgccacacccccgagatgatccagaacctcggcgcggccgccggcgagcccgtctccgtctccttcacgccgaccctcgcgccgatgccccgcggcatcctcgccacctgcaccgcgaaggccagggccggcgtcaccgccgagtccgtacgggccgcgtacgagaaggccttcgccgacgaaccgtttgtgcacctgctccccgaggggcagtggcccgccacggcgtccgtctacggttccaacgccgttcaggtccaggtcgcgtacgacgcggccgcacagcggatcatcgcgatcagcgccatcgacaacctcaccaagggcaccgcgggcggcgccctccagagcatgaacatagccctcgggctccccgaggagctgggcctttccacgatcggagtcgcaccg

SEQ ID NO: 6742 - DNA, 1149 bp, Streptomyces avermitilis
  CDS (1)..(1149)
gtgagcgtcaccgctgcccagggcttcaccgcctccggcatcgcagcaggcatcaaggagaacggcaatcccgacctggccctcgtggtcaacaacgggccccgtctcgccgccgcgggcgtcttcacctccaaccgtgtgaaggccgcgccggtcctgtggtccgagcaggtgctgaagggcggcgtcgtctccgccgtcgtcctcaactccggtggcgccaacgcctgtacgggccccaagggcttccaggacacgcacgccaccgccgagaaggtcgccgagacgctggacctgaacgccggtgaggtcgccgtcgcttccaccgggctcatcggcgtactcctgccgatggacaagctcctgccgggagtcgagcgggccgtcgccgggctgtccgagcacggtggcgagaaggcggccatcgccatcaagaccaccgacaccgtgcacaagacgtccgtcgtgacgaaggacggctggaccgtcggcggcatggccaagggcgccggcatgctcgcccccggcctcgccaccatgctcgtcgtcctcaccacggacgccgacctcgaccgcgacgcactcgaccgggccctgcgcgccgccacccgcaccaccttcgaccgcgtcgactccgacggctgcatgtccaccaacgacaccgttctgctgctcgcctccggggcctccgaagtcaccccgaagcaggaggagttcgcggaggccgtccgtgcggtctgcgacgacctcggccagcagctcatccaggacgccgagggcgccagcaaggacatcaaggtcgaggtcgtgggcgccgcgacggaggacgacgccgtcgaggtgggccgctccatcgcccgcaacaacctcctgaagtgcgccatccacggcgaggaccccaactggggacgcgtcctctctgcgatcggcacgacccgggccgccttcgagcccgaccagctgaacgtcgccatcaacggcgtctgggtctgcaagaagggcggcgtcggcgaggaccgcgacctcgtcgacatgcgctaccgcgaggtccacatcgtcgccgacctcgccgccggcaccgagaccgccaccatctggaccaacgacctcaccgcggactacgtccacgagaacagcgcctactcctca

SEQ ID NO: 6743 - DNA, 912 bp, Streptomyces avermitilis
  CDS (1)..(912)
atgagccacggacccacgcggaaacacaccgcccttcccaaagcccagatcctcatcgaagcgctgccctggctgacccggcacaacggcaagaccgtcgtcgtcaagttcggcggcaacgcgatgatcgacgaggagctgaaggcggcgttcgcgcaggacatcgtgttcctgcaccacgccggtctgaagcccgtcgtcgtgcacggcgggggcccgcagatcagcgcggccctggaccggcacggcatcgtcagcgagttcaaggcgggcctcagggtgaccaccgaggacgccatggacgtcgtacgcatggtgctcgccgggcaggtgcagcgcgagctggtcgggctgctcaaccagcacggaccgctcgccgtcggactcaccggcgaggacgcgcacaccatcaccgccaccaagcaccagcccgagatcgacggggaactcgtcgacatcgggcgggtgggcgagatcaccgagatcgacacgggcgcgatcgaggcactgctcgccgacggccggatcccggtcgtctcctcgatcgcccgctcccaggacgacggacatgtctacaacgtcaatgctgatacggcggctgcggcactcgctgcggcattgggcgccgaaaccctcatggtcctcacggacgtcgagggcctctacgaggactggcccgacagcgacgaggtgatcagtcgcctcaccgcctccgaactggagaagctgctgcccgagctggccagcggcatggtgccgaagatggagggctgtctgcacgccgtacgcaacggcgtcaccacggcccgcgtcatcgacggccgggtccagcactcgatcctgctggagatcttcaccgacgaaggcatcggcacgatggtcgtgccggacgaggaagagggggatgccgta

SEQ ID NO: 6744 - DNA, 1209 bp, Streptomyces avermitilis
  CDS (1)..(1209)
atgaccggcaccgcgaccaacgccgagctgaccgagcggtggcagggcgccctcatgaacaactacggcaccccgcgcctgcccctcgtccgcggcgcgggcaccaggctgtgggacgccgacggcaaggagtacctggacttcgtcggcggcatcgcggtcaacgccctcggccacgcccaccccgcgatcgtcgaagcggtcagcacgcagatcgcctcgctcggccatgtctccaacctcttcgtcgccgagccgcccgtcgcgctcgccgaacggctgctccagctcttcgggcgcgacggccgggtctacttctgcaactccggggccgaggccaacgaggccgccttcaagatcgggcggctgaccgggcggtcccacatggtcgccacccagggcggcttccacggccgcaccatgggcgcgctcgccctcacgggccagcccggcaagcaggagccgttcctgccgttgcccggcgacgtcacgcacgtcccgtacggcgacgcgcaggccctggccgccgcggtcaccgaggagacggccctggtcgtcatcgaaccgatccagggcgagaacggggtcgtggtcccgcccgccggctatctgaaggccgcccgggcgatcaccgccgccaccgggtccctcctcgtcctcgacgaggtgcagaccggcatcggccgtaccgggcactggttcgagtaccaggcccacgagggcgtcctgcccgacgtcgtcacgctcgcgaagggactcggcggcgggctgccgctcggcgcgaccgtcgccttcggacgcgccgccgagctgcttcagccgggccaccacggcaccaccttcggcggcaacccgatcgcctgcgcggccggactcgccgtcctcgagaccatccaggccgagggcctgctggagaacgtgaagtccgcgagcgagaagctgcgcgacggaatcgagtcgctgggccacccgttgatcgcccacgtccggggctcgggcctcctcctgggtatcgtgctcaccgagccgctcgcgccccaggcgcagcaggcggctcaggacgccggtttcctggtgaacgcgcccgcccccgatgtcgtacggctgatgccgccgctgaacctcggcgacgacgaggtggacgctttcctccgggcgcttcccggcgtcctcgacgcggtcaccaacggggacggacgagccaaagaa

SEQ ID NO: 6745 - DNA, 534 bp, Streptomyces avermitilis
  CDS (1)..(534)
atgagtcaggcgcaggagaacgagcacgcagggcctgccgtgccgcagacccgcaccgcacgccaccgccggatcgtggacatcctcaaccggcaaccggtgcgttcccagagccagttggcgaagctcctcgccgacgacgggctgagcgtcacccaggcgacgctctcccgggacctggacgagctgaacgcggtgaagatccgcaacaacgacggcgacctcatctacgcggtaccgagcgagggcggcttccgcaccccgcgggtgccgctgggggagtcggcgaaggaagagcggatgcggaggctctccgcggagctgctgatctccgcggaggcctcggccaacctcgtcgttctgcgtactccgccgggggccgcgcagttcctcgcctcggcgatcgaccaggccgagctgcacgacatcctcgggacgatcgccggggacgacacgttgctgctgatcagccgtgaaccgacgggtgggcaggcgttggccgatcacctgttgcggttggctcagaaccatcat

SEQ ID NO: 6746 - DNA, 735 bp, Streptomyces avermitilis
  CDS (1)..(735)
atgggcaccgtcgtctccttcgacgtgcgcggcggcgacccccaggccgtggggaccgcgctggaggaggcggtcgccgggctccaccgggtggacgaggtgttcagcacctatcgcgagcagagccagatctcccggctcgcccgcggtgagctgaccgtcgaggagtgcgatccggaggtcgccgaggtgctcggtctgggcgccgaggcggagcgggtcagcgagggctggttcagtacgaggtacgaaggacgtctcgatccgaccgggatcgtgaagggctgggcggtcgagcgggcggcccggcacctcgtggcggccggggcgagcggagtgagcgtcaacggcggcggtgacgtccagctgtacggcgtccccgggccgcaccggccgtggcgggtcggcgtgtcggacccgctgcgcccgggagcactggccgccgtggtctccgccgccggggtcccggagctggccgtggccacctccgggaccgccgagcgcggtgcgcacatcgtggatccgcgcaccgggcggtccgcggtcaccgacctggtcgccgtgaccgtggtgggaccccggctgacctgggcggactcctgggcgacggctgccttcgcgatgggctcgcgggaggcgctggcctggctggagtcgctgccggacgtggaggcactgctcatcacggcgggcgacgaggtgcggtgcaccgggggcctcgctcaacggctcggc

SEQ ID NO: 6747 - DNA, 786 bp, Streptomyces avermitilis
  CDS (1)..(786)
atgaagaagagccaccccattcggcgtgtcatgctcgccaccgccgccaccgtgtccgggatcgtgctgctgctgtcgctgaagccggcgtccgatccggcgtccgcgtcggcggcgggcggcgcggcaccgcagcagacggccgcggcccaggaatcggcccagggcggtgccgcggccgctcagtccggcacggtcaccggagacgtggtcaagacccagtacgggcccgtccaggtgcgcctgaccatgagcggcgggaagatcagcaaggccgaggccgtgcaggcgcccagcggcgggaccagcagccagaagaccgagctggccgtgcccaggctcaaccaggaagcggtcgcggccggcagcgccgacatcgacgccgtctcgggcgccacctacaccagcgacggctacaagcagtccctgcagtccgcgctggacaaggccaaggccaccggcggcggggcgtcgtccgcgtcgccctccccgacgggcggcggatcgtccacccaggccaagacggtcaccgggagtgtggtcaagacccagtacgggcccgtccaggtgcgtgtcaccgtgagcggcgggaagatcagcaaggccgaggccgtgcaggcgcccagcggcgggaccagcagccagaagaccgagctggccgtgcccaggctcaaccaggaagcggtcgcggccggcagcgccgacatcgacaccgtctcgggcgccacctacaccagcgacggctacaagcagtccctgcagtcggccctggacaaggccggtggc

SEQ ID NO: 6748 - DNA, 1377 bp, Streptomyces avermitilis
  CDS (1)..(1377)
gtgtccacgatcgccggtggtcgcgccgcgcggcgccagaccatgcgccgcatccgcccgcgccgctcacccgccgtcccgctgctgctcgccgtctgggcgggcgcggccggggtcatctggctgtggtggagcaacaccccgtccatcgcggacgacaacagcaagatcctcaacgcgggacggatcaccggtctgctcgccggctatctgatggccctcgtcgtgctccagatggcgcgggtgcccgcgctggagcgccgggtcggctccgaccgggtcgcgcgctggcacgccatgagcggccggtacacgctctgcctggtcctcgcccacctcgtcctgacgatgtgggggtacgcgctccaggccggcaagacgttcaacgacatcgtccagcagaccatcgactccatcaaccaactgccggacatgggccaggccgcgatcggcaccggtctgctggtgttcatcgggctgatctcgatcggcgggatccgccgcaggatgccgtacgacgcctggtaccacatccacctgctcacctacgcggccgtgttcctgacgttctggcaccagctgtccaccggcaacgacttcgccgtccagccggccgcgaagaccgcctggtacgcgctgtacgggtcggtgaccgcgctggtgatctggtaccgcatcctcgcgccgatccggctgaacctgcgtcaccgcatgcgggtcgaggccgtgatcgaggagacgcccggcgtcgtgtcggtgctgatcagcgggcggaagctgcaccgcatgggcgcggaggccgggcagttcttccgctggcgcttcctcgcgccgggcatgcggttcagctcgcacccgtactcgctgtcggcggcgccccgccccaacatgctgcgcatcacggtgaaggcgatcggcgaccacagctccgcgctgcgcgaactggagcccggcacccgcgtgtgggccgagggcccctacggcgcgttgaccgcggacaagcgcagccgcggcaaggtgctgctggtggccggcggcgtcggcatcacgccgatgcgggcgctgttcgagacactgcccggcgcggccggcgacctcacgctgctctaccgggccaacaccacccaggacctggccctgtgggacgagctggcgacgatcgccgaggagcgcggcgcccggctgatgtacgcggtcaacagcccggaaggggagcgcccggacatctcggcggagaccctgacccggaagctgccggacatcgacgatcacgacgtcttcatgtgcgggccgcccggcttcgcgcagcaggtgttcgaagcactgcgcggcgcgggggtccccgcccgccgcatccatcacgagtcgttcgagatg

SEQ ID NO: 6749 - DNA, 495 bp, Streptomyces avermitilis
  CDS (1)..(495)
gtgcacgccctgaagaagaaccgtccgctgcgccgggtgacgctggcggccgccggtacggtcaccggtgtcgtcctgctgctctcgctgaagccgcacacgccaccggccgtggcccaggcgtcctcgccgtccggccagtcccagtcccagtcccagtcctccggcagctctcccggcggttcctccggaggctcctccggcggcacgaagagcacgggcaccaggaccgtgaccggtgacacggtccagacccgctggggccccgtccaggtgcgtgtcacggtgcggaacggcgtgatcaccgaggtgaccgcggtcgcctgtccccaggagaacccgaaggaccgggagatcaacagctacgcgatcccccagctcaggcgtgaggcgctggccgcgcagagcgcgcagatcgactccgtctccggtgccacgtacacgagcgacggatacaggcaatcactccagtcggcactggactcggcgggcctc

SEQ ID NO: 6750 - DNA, 1359 bp, Streptomyces avermitilis
  CDS (1)..(1359)
atgaccacggtgtacgagcgggccgctctcccgcgcccgacacaagggcgaaagcgcccccggccctcgcccgcggggccgccgctcgccctgctctgggcgggagccgccgcggtcgtcgccctgtggtggtacgacacgcggtcggtggtgggcctctccggatggctcacggacgccgggcggatcaccgggctgctgtgcggctacagctgcgcggtgctggtggcgctgatggcgcgggtcccgtttctggagcggcgcacaggctccgaccgggtggcccgctggcacgcgatggccggccggtacacggtctgtctgctggccgcgcacgtcacgctgatcctcttcgggtacgccgcccaggacggggcgggcatcgtgcgcgagacgctgagcgtggtgttcgactatccggacatgctcgaggccacgatcggcacgatcgtcctcgtcgccgtcgggatcacctcggcgcgtgcggcgcgccgccggatcagccacgagttctggtactacgtgcacctgctcacgtacgtggccgtgttcctcgccttcttccaccagctcgcgctgggctccgacctcgtcgggaactccgcggcccgggccgcctggtacgtgctctacctgggtacggccgcgctggtcgggtggttccggctgctcgcgccggtgcggctcaacctgcgtcacaggctgcgcgtggagtccgtgcaccgggaggcgcccggcgtcttctccatcgtcgtgcgcggggaacggctggacgaactggacgcccggcccgggcagttcttccgctggcggttcctcgcggacgggatgcggtggacctccacgccgtactcactgtcggcgccgccccgggccggcctgatgcggatcaccgtgaaggcgctcggcgaccacagtgccgccgtggggctgctgcggcccggcacccgggtgtgggccgagggcccgtacggctcgctgaccgccgaccggagcacggcgtccaaggcgctgctgatcgcggggggcgtcggcatcaccccgctgcgcgccctgttcgagaccctgcccggccaggtcaccctggtctaccgggcgcgcacggccgaggacctggcactcggcggtgagctggaggccatcgcgaagtggcgtggggcgcgcctcctgtacgcggtcaacggcgccgacggaacgcgtccgcggttcaccgccgagtccctgcgggagaccgtgccggacctcgccgagcacgacgtctacctgtgcgggccgcccgcgatggcgcgggacctctacgcggcgctgagcgcggcgggggtcccggaccgccgtatccaccacgagtcgttcgaactg

SEQ ID NO: 6751 - DNA, 786 bp, Streptomyces avermitilis
  CDS (1)..(786)
gtgcgggctccgcgaggggtgatgctggaggacgacatgaacattccccgctcccgaggcaacggccggcccgcgctcacccggcccgacggcacccctgtacgcgtcctcgtcgtcgacgacgacccggacctggccgaggtcctctccggggccctgcgctacgaaggctgggaggtccgcgcggcgggcgacggcgcccgcgcggtcgacgaggcgcgggacctgctgcccgacgccgtcgtcctcgacgtgatgctcccggacaccgacggcttcgccgtgctgcgcgagctgcgcaccgtgaggccggacgtctgcgtcctcttcctcaccgcgcgcgacgccgtcgaggaccgcatcgcgggcatcaccgcgggcggcgacgactatgtcaccaagccgttcagcctggaggaggtcgtcgcccggctgcgcggactgctgcgccgcgccggcatggcccggcagctggacgaagggccgcggctgatcgtcggcgacctcgtcatggacgaggaggcccgcgaggtgacccgcggcggcgagctgatcgagctgtcgccgaccgagttcgaactcctgcggttcctgctgcgcaacccgcgccgcgtgctcagcaaggcgcagatcctcgaccgcgtctggtcgtacgacttcggcgggcaggcccatgtcgtggagctctacatctcctacctgcgcaagaaggtggacgcgggccgcgaacccatgatccacacggtgcggggcgccgggtacgtgatcaagccggtggcggggcga

SEQ ID NO: 6752 - DNA, 1512 bp, Streptomyces avermitilis
  CDS (1)..(1512)
atgaggtcacggtggcggtcctgggcggggcgatggccacgggtgcgggcagtcgtgcgcgggctgccgcgtccgcgcacgatgcgggcgcggctcaccgccggactggtggtgctgctcgccgtcagctgcgccgccgtcggcgtcgccgccgtgtacgagctgaacggcttcctcaccggccgcctcgaccagcagctccacgacgtgggagtgcggttccccgcgagcctggagcacgggggcgacgcacccaggtcggaccacgacggagacgaacacggcgacacacgccggcagagcaccggcaccttcggcgcgcggctggtcggccgggacgtcaccaacgcggcggtcgtcccctccggcgcggacaccaccgacctcaacgtgaccctgaccaccgccgacgcgaaagccctggcccatgtcccggccgacggccggggacactccgtctgcctgtcggccctcggcgactaccgggtgatggcggcgcgcggactggaccgggacgtcctgatcaccgggctgcccatggagccggtcgacgccgccgtgcaccgcctggaactggtcgcctccggcgtgctcgccgtggccctcgcggtcgccggggtcgccggggccctgtgggtgcgctggtcgctgcgcccgctgaacagggtcgccgcgaccgccacgacggtcagcgaactcccgctcgccagcggcgaggtcgccctgccgccgcgcgctcccgaatccgacccgcgcagcgaggtgggccgcgtcgcgtccgccttcaaccgcatgctcggccatgtcgaggacgcgctgaccaaacggcacgcgagcgaggagcggctgcgcaccttcgccgccgacgccagccatgagctgcgcactccagtggcctcggtgcgcggtcacgcggaactggcgctgctgcatcccggcccggtcccgccgaaggtgacccgcgccctcgaacgcatcgccgccgagtccgcccgcatgggcgagatggtcgacgacctgctgctcctcgcccggctggacgcgggccgcccgctggagcggcttcccgtcgacctcacccgtctggtcctcgactcggtcacggacgcccgggccgcgggccccggccaccgctgggcgctgcgactgcccgaggaaccggtgacggtgccgggcgacgcccaccgcctccaccaggtgggggccaacctgttggccaacgcgcgtctgcacacgcctgtcggcaccaaggtgacggtggcgctggagtccgacggccggacggcggtcctgacggtgcacgacgacggccccggcgtccccgaggacatccagccgggcgtcttcgaacgcttcacccgcgcggaccgccgccgcacggacggcacgggcggcggcgccgggctgggcctgtcgatcgtggcggcggtggtggaggcccacggcggaagcgtcgcactggagagccgccccggcaccacgaccttcacggtccggctgcccgcccggtac

SEQ ID NO: 6753 - DNA, 699 bp, Streptomyces avermitilis
  CDS (1)..(699)
atgcgccctggtgtcgtcgccgccctcgcgtccgtctccctcctcaccctcggtggcgcgccgggcaccgcccgggccaccctgcccgagctgatggccgacaccggcggcggcacccagctgatcaccgcgcaggcgctccgcgcggacgcgaccaccggcacggtcacctggtgggaccggcaggacggacactgggtgaagcgcggctcggcggccgcccgcttcggcgcgaagggcctcgtcgagggcaccgcccgcaagcagggcacgaacaccacaccgaccggcctgtacgacctgccgtacgccttcggcatcaaggcggcgccgagcggtacgacggccacgtaccgccgggtgcaccaggactcctggtggtgccaggacaacgactccctgtcgtacaaccgctggaccgagccgcgccccgccgactgccgccccgccgagtccgagcacctcgtctcctacgaggcgcagtacgcgcacgccttcgtcatcggcttcaactacgcgcggccggtgcgggggcgcggcgcggggatcttcctgcacgtcaacgggagcggagccacggccggttgtgtgtcggtgcccgcggaggcgatgcggcagatcctcacctgggccgaacccccgaggctgccgcacatcgccatcgggacggcgagcgggacgaccgcgctcacccggtac

SEQ ID NO: 6754 - DNA, 585 bp, Streptomyces avermitilis
  CDS (1)..(585)
atgggaaagacttatgagcgcatagacggccggctgcgtacgttcatcgaggcgcagcacctcttcttcaccgcgaccgcgcccctgtccggcgacggcacggtcaacctctcccccaaggggctcacgggctccttcgccgtcatcgacgaactgaccgtggcctatctggacttcgccggcagcaacgccgagaccatcgcgcacctgcgcgagaacggccggatcaccctcatgtggtgcgccttccagggcccgccgaacatcgtccgggtgcacggccgcggcgagcccgtcttccgcgacgacccgcgcttcgggcagctgctcacccacttcccccgcatcgaccccgccccgcacggcctgcgcgcgatcatcgtggtgacggcggaactcgtccgggacacctgcggctacgcggtgcccttcatgtcgtacgacgaggaccgcgatctgcacggaaagcgcttcgcgcgcgaggacgacgactcgctgagcgcctacttccggaagaaggagcacgtggcgaccagcctggatggcctacccgggctgccgttgccgctgccgcccactacggtc

SEQ ID NO: 6755 - DNA, 903 bp, Streptomyces avermitilis
  CDS (1)..(903)
atgtccagggctcttccgaagtacaacaagcgtcgcgtcgcgctcatcggcggcgccgccgccgtggtgctgtccggtgcggtgatcgccggctccgccctcgccggggaaacatccaagagcaacggcacgagcgccaggacgctggccgacaccggcacgatcgcgtgcccggacgtcaagtcgcagctgcccagcgtcccggcctccgcgcaggccgaggtcgaccgcaacctggcgctcctggacacccagctcgccgaggccaacaagcggctcgtcgacaccgtcggccagggcggcgccaacttcgtccagaacgccatcctcggcccgctcgccgacaagcggaagtccacgatcgaccgcatcgccatctccatcggccgcaccgccgagaagccccagggcctcgacgcgctcgccgagtgcgcgctgagcacggacggcgcggccggtacgggcgacgaggcgggtgccggcgacgaggcgggcgcgggcgaggaggccggggccggcgaagaggccacggcggcgccgagcgcgacggccacggacgcggcggacgacggcgcgggcgaggcgggcgacaccggcgacgacgcgaccggcgtcgggaccatcagctgccccgacgtggcctcgcagctccccgcgatccccgccaccgcgcaggccgaggtcgaccgcaacctggcgctcctggacacccagatcgccgaggccaacaagcggctcgtcgacaccgtcggccagggcggcgccaacttcgtccagaacgccatcctgggcccgctggaggacaagcggatcgccaccgtcaaccgcatcgccacggccatcggccgcaccgcggagaagccgcagggcctcgactccctggccgcctgcacgctcaacgag

SEQ ID NO: 6756 - DNA, 1212 bp, Streptomyces avermitilis
  CDS (1)..(1212)
ttgcagtgtgaggagaagcccgtgaccgagcgcgtcgtactcgcctactcgggtggtctggacacctccgtcgccatcggctggatcgccgaggagacgggcgccgaggtcatcgccgtcgcggtcgacgtcggccagggcggcgaggacctggacgtcatccgcaagcgcgcgctcgcctgcggtgccgtcgaggccgaggtcgcggacgccaaggacgagttcgccgacgagtactgcctcccggcggtcaaggccaacgccctctacatggaccgctacccgctggtctccgccctctcccggccgaccatcgtcaagcacctcgtcgccgccgcccagaagcacggcgccaccacggtcgcccacggctgcaccggcaagggcaacgaccaggtgcggttcgaggccggcatcgtcgccctcgcccccggcctcaagtgcatcgccccggtccgtgactacgcgatgacccgggacaaggcgatcgccttctgcgaggagaagcggctcccgatcgccaccaccaagaagtccccgtactccatcgaccagaacgtcttcgggcgcgcggtcgagacgggcttcctggaggacatctggaacgcgccgatcgaggacatctacgagtacacctcgaacccggccgagccccgcgaggccgacgaggtcgtcatctccttcaaggagggcgtcccggtcgccatcgacggccggcccgtcaccgtgctccaggcgatccagcagctcaacgagcgcgccggcgcccagggcgtcggccggatcgacatggtcgaggaccggctcgtgggcatcaagtcccgcgaggtgtacgaggctccgggcgcgatcgctctcatcacggcccaccaggagctggagaacgtcaccgtcgagcgtgaactcgcccgctacaagcggcaggtcgagcagcgctggggcgagctggtctacgacggccagtggttctccccgctcaagcgcgccctggagggcttcatcgacgaggccaaccagcacgtcaacggcgacatccggatgaccctgcacggcggccgcgccgtcgtcaccggccggcgctccgagacgtcgctctacgacttcaacctcgccacgtacgacacgggcgacagcttcgaccaggccgcggccaagggcttcatcgacatctacagcctgtcgtcgaagatcgccgccaagcgcgacctggcg

SEQ ID NO: 6757 - DNA, 1431 bp, Streptomyces avermitilis
  CDS (1)..(1431)
gtgagcagcaacagcggtgacgtacggctctggggcggccgtttcgccgacggtcccgccgaggccctggcgaagctgtccgcgtccgtccacttcgactggcggctcgcgccctacgacatcgcaggttcgcgtgcccacgcgcgcgtgctgcacaaggcgaacctcctcacggacgacgagctggaccgtatgctcgcgggcctcgaccggctcgaagccgatgtcgcggacggcaccttcgtgggcaccatcgccgacgaggacgtccacaccgccctggagcgcggcctgctggagcgcctcggccccgacctcggcggcaagctccgcgccggccgctcccggaacgaccaggtcgcgaccctcttccgcatgtacctgcgcgaccacgcccgcgtcatcggcggcctcctcgccgacctccaggacgcgctgatcggactggcggaggcccacccggacgtggcgatgcccggccgcacgcacctccagcacgcccagccggtgctcttcgcccaccacgtcctcgcgcacgtccaggcgctgtcccgggacgccgagcggctgcgccagtgggacgagcgcacggccgtgtcgccgtacggctcgggtgccctcgccggttcctccctcggcctcgacccggagtcggtcgcgaaggacctcggcttcgagcacggctcggtcgccaactccatcgacggcacggcctcccgtgacttcgtcgccgagttcgccttcatcaccgcgatgattggggtgaacctctcccggatcgccgaggaggtcatcatctggaacacgaaggagttctccttcgtcaccctccacgacgccttctccaccggctcgtcgatcatgccgcagaagaagaacccggacatcgccgagctggcgcgcggcaagtcgggccgcctgatcggcaatctgaccggcctgatggcgacgctcaaggccctcccgctcgcgtacaaccgcgacctccaggaggacaaggagccggtcttcgactcctgcgaccagctcgaagtcctgctccccgccttcaccggcatgatggcgacgctgaccgtccaccgtgagcgcatggaggagctggccccggccgggttctcgctcgccaccgacatcgccgagtggctggtcaagcagggcgtgccgttccgggtcgcgcacgaggtcgcgggcgagtgcgtgaaggtcgccgagggcgagggcatcgagctggacggcctcaccgacgagcagttcgcgaagatctcgtcccacctcacccccgaggtgcgcggcgtcctcaacgtcccgggcgccctggcctcccgcgacggccgcggcggtacggcacccagcgcggtcgccgtccagctcgccgaggtcaggacggacgtggcggcacagcacgcctgggccaccgcgaagcagaagaac

SEQ ID NO: 6758 - DNA, 1011 bp, Streptomyces avermitilis
  CDS (1)..(1011)
ttggtccggagccgtagaggagccgaccgaacggagcccgcgatgcccttcgcccgcctgagcgcagcgacgactcccaccgcccacatcggcctcggcctggccgccgtcggccgccccggctacatcaacctcggccgcgaggacgaccttcccgccgtacgcagcgtcgaggccctgcgcgcccgcacccacgaactgctcgacgccgcctatgcccagggcgtccgttacttcgacgtggcgcgctcctacggccgctcggaggagttcctcgcggactggctgaacgcccggccgggcatcgacgacatcgtcgtcggcagcaaatggggctacacctacacggcggactggaccacggacgccgagcagcacgaggtcaaggaccacagtgccgccacctatgaacggcagcgcgccgagaccgccgggctgctcggcgagcggctcgacctctaccagatccactcggtgaccccggacagtccggccctcaccgacaaggaactccacgccgagctggccgaggccgcggccgagggactcaccgtcgggttctccaccagcggccccgcccaggccgacgccatccgtgccgcgctcgccgtgacggtcgacggcgcacccctcttccgcaccgtccagtccacgtacaacgtcctcgagacctcggccggacccgcgctcgccgaagcccaggacgccgggctcacggtgatcgtgaaggagggcatggccaacggccgtctggcgggcgggcacgcgcccggcccggtgcgggagatcgccgagcaggcgggcctcggcgccgacgccgtcgccctcgcgttcgtcctgcggcagccctgggccggagtcgtcctctccggtgcggccaccaccaaccagctcgcctcgaacctgcacgcggccgtcgtcgacctcgacgacgagcaggtcgcccgcctcgacgccctcgccgaggacccgcgcacgtactgggagcggcgcgggcagctgccctggcac

SEQ ID NO: 6759 - DNA, 576 bp, Streptomyces avermitilis
  CDS (1)..(576)
atgtctcacttggtctatgcttgtctcatggctgtcgatcgcgaacacgtgctgcgcagcgcagcggacctgctcacccggaagtccaccgccaccatggacgaggtcgccaaggcggccgggatcagccgggccacgctgcaccgccagttcgcggggcgggacgccctcgtccgggcgctcgaagagctgggcatccgggagtgcgaggcggcgctggacgcggcccggctggaagcgggcaccgcgaacgaggccgtacgccggctggtgagcgagatcgagcccgccgcccggctgctcgccttcctctacaccgagaaccagcttttcgagggcgacgcccagcacgagggctgggcccggctggacgcgcgcatcgccgcgctgttccggcgcggccaggagagcggcgagttccgcatcgacctcagcccggcctggctcaccgaggcgctctacggcctgatggcctcgggcgcctgggccgtgctggacggccgcgtggccgccaaggacttttcctatatgaccgtcgaactgctgctcggcggtgcgctacggagagaggaatca

SEQ ID NO: 6760 - DNA, 1515 bp, Streptomyces avermitilis
  CDS (1)..(1515)
atgaccagcaccctgcggccggcgtccgtggcggaggtggagcagcgcccgggccggtggctcgcgctctccgtcctcgtcctcgccgtgctgctcgtggccgtcgacgcgaccgtcctcggcctcgcgaccccgtacatcagcgaggacctgaagccctccggcacccagctcctgtggatcggtgacgtctactccttcgtcatcgccggcctgctcgtctccatgggcagcctcggcgaccgcatcggccgcaagaagctgctgctcatcggctccacggcgttcggcgcgatatccgtgctcaacgcctatgccaccacaccggagctgatgatcctggcgcgggcgctgctcggcgtcgcgggcgcgaccctgatgcccgccaccctcgccctcatccgcaacctcttccacgacccgcgcgaacgcagcttcgccatcggcgtctggggcgcgaccgcctccgccggcaccgcggtcggtccggtcgtcggcggtttcctgctcgggcacttctggtggggctcggtcttcctgatcaacctccccgtgatgatcgtcctcgtcctcgtcggcatcagactcctgcccgagtcgcggaatccggatcccggaccctgggacctgagcagtgtcgtcctctcgctcgtcggcatgatcggcatcgtgtacgcggtgaaggaggccgcttcgcacgggccttccctggacgcgctggccgccggagcgctcggcgccgccgccctcttcggcttcgtacgacgccaactcgtcatgcccaagcccctgctggacatgcggctgttccgcaaccgcggtttctccgcggccgtgctcgccgatctgctgaccgtgctcggcatgtccggactcatcttcttcctgtctcagtacctgcaactcgtccagggcaggcccccgttcgaggccggcctcgccgaagtccccgccgccgtcggcgcggtggcggccggcctggccgcggggcgggccgcccgccggtactcggtgcgggccgtggtctcgggcggtctcgccgccgtcggcctggcactcgccgcgctcaccctgctgagcgagtcgaccggctacccgctgctcgggaccgcgctgctcgtggtcggcgtgggcgccggcttctcgttcaccgtgaccgccgacgtgatcctctccagcgtgcccaaggaccaggcgggcgccgccgccgcggtctccgagacggcgtacgaactcggcgccgccctcggcatcgcactgctcggctcgatcgtcaccggcgtctaccgggacttccacggcccggcgggcaccccggcacaggcccacgaatccctcggtggtgccgtcgagtcgacggcggggctgcccgcgcacaccgcggaggccgtgctgtcctcggcccgcgccgccttcgtcgacgggctggcgctcgcggcgggcgccggcgcggcggtactgctcgcgacggcggtcgcggcctggttcctgctgcgcggccagaaactcgaggcg

SEQ ID NO: 6761 - DNA, 669 bp, Streptomyces avermitilis
  CDS (1)..(669)
ttgtcccgcttcgtgctcatcaaggcagtgctcggaccgatcatgcgcctgatgttccgcccacgggtggaaggtgcggagcacatcccgggcgaaggtccggtcatcctggccggcaaccacctcacgttcatcgactcgatgatcatgccgctcttctgcgaccgccaggtcttcttcatcggcaaggacgagtacgtcaccggcaagggcatcaagggtcggctgatggcctggttcttcaccggcaccgggatgatccccgtcgaccgtgacggcggccgcggcggtgtcgcggcgctgatgaccggccgccgggtgctggaggagggcaaggtcttcagcatctacccggagggcacccgctcccccgacggccggctctaccgcggtcgtaccggtatcgcccgcctcaccctgatgaccggcgccccggtcgtcccgttcgcgatgatcggcaccgacaagctccagccgggcggcgccggtttcccgcgccccggccgggtgacggtccgcttcggcgaggcgatggagttctcccgctacgagggcatggaccgcgaccgctatgtgctgcgcgccgtgaccgactccgtgatggccgaggtcatgcgcctttcgggtcaggagtacgtggacatgtacgccaccaaggcgaaggcggcg

SEQ ID NO: 6762 - DNA, 1179 bp, Streptomyces avermitilis
  CDS (1)..(1179)
atggggacgcaggaaacacgacggacacagcggtcggacgagccggggcgggggaccgggcggcgggcgctgctgggggccgcggtgctcggcgcgggcggagcggtcctcggactgcccgccgcggcgagagcggacgagcggcacgggggcggcggctaccggagtctgccgaagccgaccgtcatcggtcaccgcggggccagcggctaccggccggaacacaccttcggctcctacgagctggccctcgacctgggtgcgcacgtcgtcgaggccggcgatctggtgcccaccaaggacggccatctcgtatgccgtcacgagccggaaatcggcgggaccaccgatgtctcggcgcaccccgagttcgccgaccgcaggaccaccaagaccctcgacggggtcgccaccaccggctggttcaccgaggacttcacgctcgccgagctgaagaccctgcgcgccgtcgagcgcatccccgccacccgccagcgcaacacgatctacaacggccgctgggagatccccaccttcgaagaggtgctccggtggcaggacgagcagacccgcaagcgcggcaggcaggtgtggatctaccccgagaccaagcaccccacctacttccgcaagctgggcctcggcctggaggagcgggtcgccaagctgctgcgcaagtacggcaaggacaagaagaactcgcccgtcatcatccagtccttcgagccgagcagcatccagcgtctgaacaaactggtcggcaacccgctcgtcgtgctgctgtccgccgcgaacacccgcccctgggacttcgtcgaggcgggcgacccgcgcaccgtcgccgacctcgtcaagcccgagggcctggcgtggatcgcctcgtacgcgcagggcatcgggccgacgctcgacctggtcatcccgaaggacgcgagcggcaacctcaccacgccgaccacgctcgtcgccgacgcgcacgacgcgggcctgatcctgcacccgtacaccatgcgcaacgagaacaccttcctgccgaccaacttcaagaagggcaccgacgcgaacgcctacggcgatgtcttcggcgccttcaagacgtacttcgggacgggcatcgacggggtcttctcggacaacgcggacaccgcgctcctggcccgcgcggacttcctgaacggc

SEQ ID NO: 6763 - DNA, 504 bp, Streptomyces avermitilis
  CDS (1)..(504)
atgacccacgacatggttgccaccctgcgcccgctgctcgccgccgaggcctcggcggaggcatatgcggccggtaccgaccagagcgacctggaacaagccgtctggctgcgtctcctcgagcgcctcgaatccgacggccccctcgtcgatccgcaaggctgggtacgccgcgccgtccgctcggaggtgcgccgcagccgccgcaccgcccgtctcgagctgccgtacggctccgaacccgccgacgacggcgcggccggccccgaacagcaggcgctgaccgccgctcgccatcgtgccctgcacgccgccgtgcgtcggctgcccggccgctgcccacgcctcatggccgcactgctgtctccccaggacctcacgtatcgcgaaatcgcaggcgagttgggtatctcacagggcagtctgggcccggaacgttccagatgcctgggatgtctgcgcagattgctgtccgcggaggttgcggcccgtgaaccgcgggga

SEQ ID NO: 6764 - DNA, 516 bp, Streptomyces avermitilis
  CDS (1)..(516)
gtgagcgggaggcgtgcacacatgggcatgagcgtgaccatctctgtggcgaccgagcgggacgccgagcagatcttccggctgcagtacctctgcttccagagcgaggccgccctgtacggcaactaccgcatcgacccgctcgtccagtccctcgaatcggtccgcgcggaggtcgcgggcgactgcgtgttcgtggcgcggctgggcgacgaggtggtcggttcggtgcgcggcaccgtgaccgaggacggcgcggcgtccatcggcaaactctgtgtgcacccccgtctccaggggcacggcatcggcgcccggctgctgcgcgcggccgaggcggccctggccggggagcgcggcgccacccgcttccgcctccacacgggccaccgcagtgagggcaacctccgcctctaccggcgcgtgggctacgagacggtgggcacgtcgaagggcgccgacggagtcccgatgatcgtcctggagaagccggcgggcacctacgcgacaacggcg

SEQ ID NO: 6765 - DNA, 450 bp, Streptomyces avermitilis
  CDS (1)..(450)
atgacatctggggaagctgagatgacggccacgcaagagacgaagccggccaggacccggctgatcggcggcccgggcatgctgctcgtgtggctgtacggcgtcatggtggtcggcgccgtctcgcgctccgcggtgcagatctcgacggagttcgacaaggcgccgctcgcctactcgctctccgcggtggcgggcgtcgtctacggcttcatcacgtactcgctggtgcgcggcggcgagacggcccgccgggcggcgctggtgtgctgcgccgccgagctcgtgggcgtactgacggtcgggacgtggacgctggtcgagccgtccgcgttcccggacgcgaccgtgtggtccgactacggcatggggtatctgttcattcccgtgctgctgccgttgtcggccatgtactggctccggaagcgggagcgctccgccgggagccgg

SEQ ID NO: 6766 - DNA, 357 bp, Streptomyces avermitilis
  CDS (1)..(357)
atgcttgatgccctgaccgtggtgaccgccgtcgccgcgctgctgctcaccgcctggtgcggctgggccgcctaccgcgatcagccgaccaaggactggcacttcatcggcatggccgtggtgtcgctgctcgccgtggtccagctggtcgtcggcgtcgtccagctggcgcgcggccagcagccggagcagggcacgacgatcttcgtggcgtatctgctgggcgccttcgcctgcgttccggcggcgggcttcatgtcgctggcggagcgcacgcggtggggttcgatcaccgtcgccgccggtggcgtggtcctcgccgtgctggaggtgcggctctatgacatctggggaagc

SEQ ID NO: 6767 - DNA, 1098 bp, Streptomyces avermitilis
  CDS (1)..(1098)
atgcatccgtgcccggcgcacacccacgccctgcactcgacagtgacggaaaccccagtgatcacgacaacgggcctcaccaaggtctaccgctcgcgcggccgcgaggtcaccgccctcgacggcgtcgatctgcacgtccgcgaaggcgaggtctacggcgtcatcggccagtccggcgccggcaagtcctcgctcatccgctgcgtcaacctcctggagcgtcccacctccggcacggtcaccgtcgccggacaggacctcaccgccctcgccggccgcggcccgcgcgcgggcaaggagctccgcacggcgcgcagccacatcgggatggtcttccagcacttcaacctgctgtcctcgcgcaccgtccaggacaacgtcgagctgccgctcgaaatcctcggcgtctccggccgggagcgcggccgcaaggccctcgaactcctcgacctggtcggcctcaccgacaaggccaaggcctaccccgcccagctctccggcggccagaagcagcgcgtcggcatcgcccgcgccctggccggcgacccgaaggtgctgctctccgacgaggccaccagcgccctcgaccccgagaccacccgctccatcctccagctgctgcgcgacctgaaccggcagctgggcctgaccgtcctgctcatcacccatgagatgaacgtcgtcaagagcatctgcgactcggccgccctgatggagaagggccgcatcgtcgagtccggcaccgtcagcgaactcctcggtacccccggttccgaactggcgtcggcgctcttcccggtgaccggcgacgcctccggcgacgaccgcaccgtcgtcgacgtcaccttccacggcgaggccgcgacccagcccgtcatctcgcagctctcgcgcacgtacaacatcgacatctcgatcctcggcgccgcgatcgacaccgtcggcggcctccaggtcggccggatgcgcatcgaactgcccggccgttacgaggacaacgtggtgccgatcggcttcctgcgcgaacagggtctgcagatcgacgtcgtcgacaagtcggaccaggagtccgtactggtgaaggaaggtgccaag

SEQ ID NO: 6768 - DNA, 777 bp, Streptomyces avermitilis
  CDS (1)..(777)
gtgacctggtccgagatgcagccgctgctgtcccaggcgtgttgggacacgctctacatggtcggctggtccacgctcatagcgatcgtcggcggactcccgctcggcctcctgctcgtcctgaccgaccgcggcggactcctccagaacgtcgtggcgaacaaggtcgtcgggcagatcgtgaacgtcgcccgctcactgccgttcatcatcctgatggtggcgttgatgaacttcacccgcaccatcacggggacgaccatcggccgtgaggcggcgatcgtgccgctcgcgatcggcgcgatcccgttcttcgcgcgtctggtcgagacggctgtccgcgaagtggacggcggactcgtcgaggccgtgcagtccatgggcggcaacacctggaccgtcgtccgcagggtcctcgtgccggagtccctgccctcgctgatctcgtcggcgaccaccaccatcgtcgcgctcatcggctactccgcgatggccggcaccgtcggcgccggcggcctcggcgacatcgccatccgctacggctaccagcgcttcgagaccggcctgatgtggatcaccgtggcgatcctcgccgtcgtcatctccctcatccagttcgccggcgactacgcggcccgcggactgcaccgacgcggcggccggtccggtgtcgcgccgaagctcaggctgctgaaggacaaggcgcccgcggacaggacgcccgcggccgacgcccccaccggcgaggcggccacggccgacgtcggcaaggtcgcc

SEQ ID NO: 6769 - DNA, 825 bp, Streptomyces avermitilis
  CDS (1)..(825)
gtgcgtaacaccgccaagatcaccaccgctgtcctcgccgccggagccctcaccctcgggctctcggcctgcggctcggacaaggactccgcctccgacaccagtggcccgctgatcgtcgccgcgagtcccaccccgcacgccgagatactcgacttcgtcaagaagaacctggcgaagaaggcgggcctggacctggaggtcaaggaggtcaccgactacgtcacgccgaacacggcgaccgaggacggctccgtcggcgccaactacttccagaaccagccctacctcgacgacttcaacaagaagaagggcacccacatcgtgcccgtcgtcacggtgcacctggaaccgctcggcctctactcccacaaggtcaagaaggccgacgacctcaagagcggtgcgaccgtcgccatcccgaacgacacggtcaacgaggcgcgggcgctcaagctgctcgacgccaacgggatcatcacgctgaagagcggcgtgggcaacgaagcgaccccgggggacatcaccaagaaccccaagaacctcaagttcaaggagctggaggcggcccagaccccgcgctccctggacgacgtggacgccgcggtggtcaacggcaactacgccatctcctcgggcctcaagccggccaaggacgccgtcgtcctggagtccccgaaggacaacccctacggcaacttcctcgcggtcaagaagggcaacgagaaggacccgcgcgtcaagaagctcgcgaagctcctcacctcgcccgaggtgaagaagttcatcgaggacaagtacgccggctccgtcatcccgtccttc

SEQ ID NO: 6770 - DNA, 837 bp, Streptomyces avermitilis
  CDS (1)..(837)
atgcgtaagcccgtcatttccgcggcggcggccgcactcgccctcggactcggcctgaccgcctgcggctcgggctccgactccgactccgcgaagagcggtggcgacggcgacgcactcgtcgtcggcgccaccgccgtccccgccggcgaggtcctcgcgtacatcaagaaggacctcgccgagaaggcgggcctcgacctggagatcaaggagttcacggactacgtcctgccgaacaccgccctccaggaaggcgaactggacgcgaacctctaccagaaccagccctacctcgacgacttcaacaaggccaagggcaccgacctggtccccgtcgtcaaggcgtacctgccgcccatgggcgtgtactcgaagaaggtcaccgacgtcacgaagctcgccgacggagccaccgtcgccgtacccaacgacacgaccaacgagggccgcgccctcaagctcctcgcgtccaagggcgtcatcgcgctcaaggcgggcgccggcacggacgcgtcccccgcggacatcacgtccaaccccaagcacctgacgttcaaggagctggaacccgcccagctgccgcgctcgctcgacgacctggccgccgcggtgatcaacaacaactacgcccaggacgcgggtctcagcccgacgaaggacgccatccttctggagtcggcggagaacaacccgtacgccaacctcctggccgtgaagaagggcaacgaggacgacccgcgggtcgagaaactcgccaagctcctcacctcgcccgaggtgaagaagttcatcgaggacaagtaccgcggctcggtcctgccggtcgtctccggc

SEQ ID NO: 6771 - DNA, 636 bp, Streptomyces avermitilis
  CDS (1)..(636)
atgactagcaccttccccaacatctccatcagcacggagcggttggtactgcgccccctcgacgaggacgacgtccccgccctggccgagatgatgaacgacgagcaggtaggggcctggaccgacgtgccccagccctacaccgaggaccgggcccgccgctggatcaccgagtacgcgcccgcccaacgcaccgcgggccgcggcctcgacctcgccgtcaccgagttcctcacccagcgactggtcggcatcgtccagctcgacaagacgaactggcacatccggtccaccgaaatctcgtacgtcatcgccccctgggcccgcggcgagggctatgcctccgaggcggcgctcgccaccgcccaatggctcttcggggaccagaagttcgagcggatcgagctgcgcacggcggccgacaacaccgcctcccagcaggtcgcccagaagatcggctgcatcagcgagggcgtcctgcgcaacgcctgcatagcccacgtccggaccgaggacggcacgtggaccgacgtgcgcaccgacttcatcgtctggagcctcctcccggaggacctcgacggagtcggcgaggaactcgcggacaccggcggtttcacgtcgttctccgactggaac

SEQ ID NO: 6772 - DNA, 1209 bp, Streptomyces avermitilis
  CDS (1)..(1209)
atggccgaccgggtcacggtgatcggctgggacggctcgcccctgaccgcggccgcgcgttccgccctcggcgccgccaccctcgtcgccggcgcggcccaccacctgacactggcggaggtccccccggccgccgagcgcatccgcctgggcagcgtcgccctcgccgcccgccgtatcgccgcccaccgcggcaccgccgtcgtcctcgccgacggcgacccgggcttcttcggtgtcgtacgcacgctgcgcgcccccgagttcggcctggaggtcgaggtcgtgcccgcggtctcgtccgtcgccaccgccttcgcccgcgccggaatgccctgggacgacgcccaagtggtcgtcgcacaccgccgcaccctgcgacgggcggtgaatgtatgccgcgcccacaccaaagtcgccgtcctcacctcacccggcgccggacccgccgaactcggcctgctgctcgaaggagtccaccgcaccttcgtcatctgcgaggaactcggcaccgaacgcgaacaggtcaccgtcctgacctccgacaaggcggccgaccacacctggcgcgacccgaacgtcgtcatcgtcatcggcggtcccgtgaccgcggtcgagggcggcggctggatcgccggacgcgaaccgggcgcggaaccgcgcggctgggcgctgcccgccgaggcgtacggcggcgcactcggcgaaggcgaaacggatctgctgcgcgccgcccagctcgcccgcctggggccgcgcgcgggcgacctcgtctgggacatcggttccggcagcggggcgttcgccgcagaggcggcgcgctgcggcgccgccgtcatcgccgtcgaccgggaccaggacgcctgcggccgtacgacggtctccgcgcgccgcttcggcgtccagctccaggtcgtgcacggcgccgcgccgcacatactggagaacctccccgaacccgatgtcgtacgggtcgggggcgggggagccgcggtggtctcggccgtcgccgaccgccgcccgcagggcatcgtcacgcatgccgcgacccgcgacgcggcggaactcatcggcaggggtctgacggagcacggctacctggtcgagtgcgccctcctgcagtccgtcgagctggacacgagggcctggacggagaaggagcggagcgtcgcgttcctgctcagcggccgattgcccgaccgctccccg

SEQ ID NO: 6773 - DNA, 3858 bp, Streptomyces avermitilis
  CDS (1)..(3858)
atgaccgacaccggccaggtcccgggcgagggactgccggagaacgcaggcatggtggagcagccgggcgtccccgcgccgggcgcgtacacctacctcgacccctccgacaccgccgccgatgacgacgacctgctcctgatgcccggccagcagggtgcctggggcaatgagatgccgcaggcgatgccggccccggcgcccgtcgtccacgagccaggaccgcacgagacggacggacgcgacagcggctccgtggacctgagcgccgtccgtacgctgtcccaggcagccgcgccgcaggcgaccccgccgcgccgcccgctgcacctcggcccgccgaccccggacatctcgtcgagcccggtgcgttcgctggcggaccgcggcccggcggacgccccgctgcgccaggtgggaccgcccacgaccggacccgagtacctcgacgcgccgccgcagctcgcggagacccctccccagggcgcggtgccctggggcgctccgccgcagacacaggcggtgccaccggtgagccccgaggggccccccgcagaaacggtcgtcccggaggccgccccggccgccccggtcgtcccggaggccgcgccgggtctcgggaccgtgccggccgacgagccggcgccgttcgtcgagcccgagcaggcgtccgagatgccgcccttcgccgaggccgagacgccggacgcaccggccttcgtggaggcgccgcagcccccgcagacgccggacgcacccgcgttcaccgaggtgccgcacgcctcggacgagccgccggccgcggacgcgcagcacgccggggccgccgcacccacggacgttcctccggccgcggagacgccgttcgccgctcccgaggccgaggcgctctacgcggtggacggctcaccggacggtgtcacccacccgcaggtgcagtacgccgacgggaccggccccgtcccggacggctcgcccgaaccgcaggccccggacaccacgcccttccccgcggctcccgaccccgcgcagccgacgggcgacaccggacacatcgccgtgccgccggccgctccggacaccgcagtgcccgcgccggccgccgacttccccgtacccccgtatgacgccgccccggatccggcccaggccgccgccgcggaggcggtgccgcaggccgggaccgagcagcccgggcccgcgcaggacccgcaccaggcgccggaaatctccctcgacctgcatgcggcgccggacccggccctcgacccccagcaggcgccggacccggccctcgacccccaggccgcgcacgtgcccgagccgcagctcgccgccccggccgtccacatcacggacaccgcggtccagttcgcggacacggcactccccgacgaggacgcgcggcctgtcgccgacgaggtccagccgcaactcgtcgccgaagcaggggcccagggccacgcggaggccgagccggagccgcagtacgcggagcacgccgccgcggccctgcacggtgtgcccgtcggagtcggcgctcacgccgtggcgccccaggcgtccgcggggcaggcgcagcacggcgagcagcccgcgcacggtgacccggcaggcccgccgggcttctccccggagccccacgccgaccagtccctcgggcagttcgtgccggtggagggcgcggtgcccaccaccccgcacctggccccgaccccgtcgcacgccatgacggtgccgcccctccccgcggaggagcagccggtcgccgaggaggccgccccggccgtcgtggagccgtccgaggcgccgcacgagctgtcggaagaggcgccgcacgagctgtcggaagaggcgccgcacgagctgccggccgaggtgccgaccgaggcggaagccccggctccggtgatggccgcgcaggagacgcccgccgtgacggtgcccgccccccgcgaggccgaggcacccgtcgcggcgcagccccccgtatcgcaactccccaccccggagccgcccttggcggaccccgagcccgtagtcgcacagcacgcggatgacctggacacccaggtcgccgaccaggaagagagcacggccgcagtggaagacgtacgagagtccaccggcccggcggcccccggctacgacgaggccgagcgcgaggccgtactgcgtgtgatgcgcgagcgccgggacatccgcaacggcttccgcagcgacccgatcccgcacgaggtactgctgcgcgtcctcgaagcggcccacacggcgccgtccgtcggccactcccagccctgggacttcgtcgtcatccgctccgccgacacccggcgctcgatgcacgaactggccatgcgtcagcgcgacgcctacgcgaagtcgctgcccaagggccgggccaagcagttcaaggaactcaagatcgaggccatcctcgacaccccggtgaacatcgtcgtcaccgccgacccgacccgcggcggccgccacaccctcggccggcacacccagccgcagatggccccgtactcctccgcgctcgcggtcgagaacctgtggctcgcggcccgcgcggaaggcctcggcgtcggctgggtcagcttcttcgacgagcgcgagatggtgcgcgagctgggcctgcccgagcacctcgaagtcgtcgcctacctctgcgtgggctacgtcgacgagttcccggacgagcccgagctgatgcaggcgggctggtccaagcgccgcccgctgtcgtgggtcgtccacgaggagacgtacggccgccgcgccctgcccggcgaggagccgcacgacctgctcgccgagaccgtctccaacatccgcccgctcgacgccaaggcgctcggcgaggcgtgggagcggcagaagcggatgaccaagcccgccggcgcgctcggcatgctggagatcatctccgcgcagctgtccggcctgtcccgccagtgcccgccgccgatcccggagcccgcggccgtcgcgatcttcgcgggcgaccacggcgtgcacgcccagggcgtcaccccgtggccgcaggaggtcacggcccagatggtggccaacttcctcggcggcggcgcggtctgcaacgcgttcgccaaccaggtcggcgccgaggtctgcgtcatcgacgtcggcgtcgcctccgacctcccggcgacccccggcctgctgccccgcaaggtccgcgccggtacggccgacatgacgaccggtcccgcgctgacccgcgaggaggtcaaggcggccatcgaggtgggcatcgagaccgcccgcgacctcgtctcggcaggcaacaaggccctgctcaccggtgagatgggcatcgccaacaccacggcctctgcggccctgatctcggtctacaccggggcggacccggccgaggtgacgggccggggcaccggcatcaacgacgagaccctcgcccgcaagaccgaggtcgtccgccgagccctcgaactccaccagccggacccggccgacccgatcggcgtcctcgccgcgatcggcggcctcgaacacgcggcgatggtcggcctgctgctcggcggcgcgtccctgcggacgccggtgatcctggacggcgtgagcgccggcgccgcggccctggtggcccgcgccatcgcccccgaggtcctggccgcctgcatcgcgggccaccgcagcgcggaaccgggccacgtggccgcgctgaacaagctcggactgcgccccctggtcgacctggaccttcgcctgggcgagggcacgggcgcgctgctggcgctgcccgtggtccagagcgccgcgcgagcgatgcacgaggtggcgacgttcgactcggcgggagtcaccgagaag

SEQ ID NO: 6774 - DNA, 1230 bp, Streptomyces avermitilis
  CDS (1)..(1230)
atggccgaacaccccgcctaccccgtgggcctgcgcctcaccggccgccgcgtagtcgtcctcggcggcggccaggtcgcccagcgccgcctccccgcgctcatcgcggcgggcgcgaaggtccacctcgtgtctcccgaggcgaccccgtcggtcgaagccatggccgacacgggcgagatcacctggtcgaggcgccggtacgaggacggtgacctcgcggaggcctggtacgccctgatcgccaccagcgacgcggcggcgaacgtcgcggcctccgccgaagcggagcgcctccgtgtctggtgcgtccgctccgacgacgccgacgcggccaccgcctggaccccggccaccgggcacagcgagggcgtcacggtcgccgtcctcaccacgaacgccaagggccgcgacccgcgccacacggcggcgatccgggatgccgtggtcgagggcctgcgcgacggcaccctcgtcgccccccaccatcgcgtccgcacccccggcgtcgccctggtcggcggcggccccggcgaccccgacctcatcacggtgcgcggccgccgcctgctcgccgaggccgacgtggtcatcgcggaccgcctcggcccgcgcgatctgctcgccgaactcccgccgcacgtcgaggtgatcgacgcggcgaagatcccgtacggccgtttcatggcccaggaggccatcaacaacgcgctgatcgagcacgcccggcagggcaagtcggtcgtacggctgaagggcggcgaccccttcgtcttcggccgtggcatggaggaggcccaggcgctcgccgaggtgggcatcccctgcacggtcgtccccggtatctccagctcgatctcggttcccggcgcggccggcatcccggtcacccaccggggtgtcgcacacgagttcacggtggtcagcggccatgtggcccctgacgacgagcgctcgctggtcgactggccggccctcgcgaagctgcgcggcacgctcgtgatcctgatgggcgtcgacaagatcggaaagatcgccgacacgctcgtggcccacggcaagccggccggcacacccgtcgccctcgtccaggaaggcacgacggccgcccagcgccgtgtcgacgccacgctcgcgacggtcgcggagaccgtacgcgcccaggacgtgaagcccccggccgtcatcgtcatcggcgcggtcgtggacgtgggcccgcagactttcgag

SEQ ID NO: 6775 - DNA, 816 bp, Streptomyces avermitilis
  CDS (1)..(816)
gtggccgatctcatcaccgttgaggaccccgccgacccgcgtctgcgcgactacacgggcctgaccgacgtggagctgcgccgtaagcgcgaacccgccgagggcctgttcatcgccgagggcgagaaggtcatcagacgggccaaggacgcaggctacgagatgcgctccatgctgctgtccgccaagtgggtcgacgtcatgcgcgacgtcatcgacgaacttccggccccggtgtacgcggtcagcccggagctcgccgagcaggtcaccggctatcacgtgcaccgcggcgcgctcgcctcgatgcagcgcaagccgctgccgacggcggacgaactcctggcgaccgcccgccgggtcgtgatcatggaatccgtgaacgaccacaccaacatcggcgccatattccgttccgccgccgccctcggcatggacgccgtactgctctccccggactgtgccgacccgctctaccgacgcagcgtcaaggtctccatgggcgcggtcttctcggtgccgtacgcacgtctggacacctggcccaaggggctggagtcggtccgcgaggccggcttcaacctgctcgcgctcacccccgacgagaaggcgaagaccctcgacgagacggcaccgcacaagatggaccgggtcgcgctgatgctcggcgcggagggcgacggcctgtccacgcaggcactggtcgcggcggacgaatgggtccgcatccccatggcccacggcgtcgactccctcaacgtgggcgccgcggccgcggtcgccttctacgcggtggccaccggccggccccagtca

SEQ ID NO: 6776 - DNA, 393 bp, Streptomyces avermitilis
  CDS (1)..(393)
gtgagggaccagcgtgaggcgatcgtcgcggtgctgcgccgcggcgagcgggtgctcgtcatcaagcgcggtccgcaggcggcccgcccgggctactgggcacccctcagcggcaagctcgaaccaggcgagacccaggaggaagcgctggtcagagaggtgcgcgaggaggtcggcctggacgtctcgccgctgcggaaggtctgggagtgcccgaccgacgacggacacttccgcctccactggtggacggcggagtccggcacgggtgaggtggtccccgacccgggcgaggtggccgaggcgcgctgggtcaccccgggcgaattcctggcgatggaacccgtcttcgacggcgaccgggagttcttcgagcgcgtactgccggaactc

SEQ ID NO: 6777 - DNA, 1299 bp, Streptomyces avermitilis
  CDS (1)..(1299)
gtggctcgtcaaacggaccgggcagcggggatggacatggcgatgatgcgcctgaggcgcgaggacccgcgtgtcgtcggctcgttcaggcttcaccgacggctcggcgcgggcgggatgggcgttgtctacctgggctccgaccggcgtggccagcgggtcgcgctgaaggtgatccggccggacctggcggaggatcaggagttccggttccggttcgcccgcgaggtctcggcggcacggcggatcaggggcgggtgcacggcccggctggtggccgccgacctggacgcggaccggccgtggttcgccacgcagtacgtgcccgggccctccctgcacgacaaggtcgccgaggaggggccgctgtcggccgccgacgtggccgccgtgggcgccgccctctccgaggggctcgtcgccgtgcacgaggccggtgtcgtacaccgcgatctgaagccgtccaacatcctgttgtccccgaaggggccgcggatcatcgacttcggcatcgcctgggcgacgggggcctcgacgctcacgcacgtcggtacggccgtcgggtcgcccggcttcctcgcgcccgagcaggtgcgcggcgccgccgtcacgccggccacggacgtgttctccctcggcgccacgctcgcgtacgcggcgaccgccgactccccgttcgggcacggcagttccgaagtgatgctctaccgggtggtgcacgaggaggcgcatctgaacggtgtgccggacgcgctggcgccactggtgcgcgcgtgcctcgccaaggacccggaggagcggcccagcacgctccaactctcgctgcggctcaaggagatcgcggcccgtgaggctcagggcatcgcggacgtacggccgccggcccagcgcggtgaaccggaccggccctcggggcggctcgcggagcagtacgccgagcagcggacccagcgccggccgcagggtgcgcccgggactcccccgccccggaccgggggcgggccgcgctccggctcgcggccgacgccggccccgcgcaactccacccgctccggcagccggcccgcaccgcgcagcggcgccgggcgctcctcgccgcggaccaccgggaccggacggcggccggccaatccgcggctgctgcgccagcggctcttcgtgttcgtcgtcgtgaccctgctggtggcgctgggcatcgcggcggcccagggctgccaggggccggcgcgcgggctcgacgacggcggcgtacgcaaggacgtacgacaggagcagtcgtacgagccgtggcgggggatc

SEQ ID NO: 6778 - DNA, 207 bp, Streptomyces avermitilis
  CDS (1)..(207)
atggcccacacggcaccgcggacggcgatccgcacgcagggacgcagggcgtacaccgccgcgttcggcacccgccgcacgggccgtcgccaccccttggtggcgaccgcgatggcccttcccctggcggccctgctcctgctcgtcttcgacggctgggaaacagtggtcacacaagcgtcgtccgtgggtgtgatgttggggcgc

SEQ ID NO: 6779 - DNA, 933 bp, Streptomyces avermitilis
  CDS (1)..(933)
atgaccgcagacctgctgcccgggctgaccgcgcgggtgagagccatggcccacccggaagcggggccctgcggctgcgacgccgccggcacgctggcggaccgcgcggacggcaccgtcgtccggcatgccgacacggtggcgaaggcgcacgccccggacaccgatcccgccgagctggccctgcgcctggagatcgcctcgcggctcgccggcatcctgctgcccccgttgagtccgaccccggccgacctgcacggccgcccggtgaccttctggccgtacggcagccccgtgaaccccgactgtccgcgggccgccccctgggaggcggccgccaccctcctcgcccggctgcacaaggcgcccgcgccaaagggtctgccgccgatgcgcggtcccgccaaggcggcccgcgcgctcgcccgcctccacgcggccggcccgcaccccgccgccgccccgatcctgcgggcctgggccggtctgcccgcctgggcccgcgccgaagcgcccatgccgtcctcgaagaccctgtgccacggcgacctccacctcggccagctcgtccgccatcccgcgacgaccggtccctggctcctcatcgacgtggacgacctcggcgtgggcgagccggcctgggacctggcccgcccggccgcctggtacgcctgcgggctgctcccgccggacgagtggacccgattcctcgccgcgtaccgcgccgagggcggcccggcggttcccgccgacggcgacccctggcccgtgctggatgtcgccgcccgcgccctcaccgtgcagacggcggctgtggccgtcgccaaggccgtgaccgccgaccgtcccttggacgaggtggagcaggcggtgatcgacgcctgcgaccgaatgggcggagtcccgccggagttcatccacggaagtgccacg

SEQ ID NO: 6780 - DNA, 264 bp, Streptomyces avermitilis
  CDS (1)..(264)
atgcacacatacaaccgcaatggcgtccagatcgagcagtgcagcggctgccgcgggatattcctggactacggcgagctggagtcgctgacccagctggagtcccagtggtcgcagcccgcaccgccgcccccggccgccccgcaggcctacccggccgctcccgcctggggtgccccgcacggtgggcacggcggcggtcactacggcggccacggcggccaccagcggcacaagagcttcggtcacatgctcttctcgtcc

SEQ ID NO: 6781 - DNA, 1119 bp, Streptomyces avermitilis
  CDS (1)..(1119)
ttgtgcagcgtgctgcggtgcgcctgctcgaagacatggtcagggcatcctcaggtcacccgccatagactcgacggcgtgctcgacctccctcctctcgcccgcttcggcggcctcgtcgcgaccggtctcctcgacgtcaccagcgaccccgcggccctcgactccaccggtttctgggccgtttgcgccgacttcgagggccgtctgacctgcgcccgcttccggaacgtacaagaggaagcggtgcgagcgcccgagccggggcggtggcgaggccccgcggccggtgactggacgtcgtccctcgaccgcaccgcgtacacggcgggggtacgccgcatccgcgagcacatcgcggccggcgaggtctaccaggcgaacctctgccgggtgctctccgcgcccatcgcccccgacgccgacgtggacgcgctcaccgccctgctggcccgcggcaacccggcgccgtatgccggaacgattcgcctgccggggcacggcgtcgagatcgcgaccgcgtctcccgaactcttcctgcgccgcaccggcgccgccgtcgagtcgggaccgatcaagggcaccgggcgcaccgaggcggacctcctgacgaaggactacgccgagaacgtgatgatcgtggacctcgtccgcaacgacataggacgcgtctgcgccacggggacggtgaccgtcccggacctctgcgtcgtcgagaagcatccgggcctggtccacctcgtctccaccgtccacggcgaactgcgcgcggacgtcggctggccggaactcctcgccgcctccttcccgcccggctccgtgaccggcgcacccaagtcgagtgcgctgcggatcatcgaggccctggagacggcgccccgcggtccgtactgcggcggcatcggctgggtcgacgcggaccggcggaccgcggagctcgccgtcggcatccgcaccttctggatcgaccgccccgccggcctgctgcgcttcggcacgggcgcgggcatcacctggggctccgaccccgagggtgagtggcgggagaccgagctgaaggccgcccggctgctcgcggtagcgtcgggggagtacgaggaaagtggaaggaccctgacg

SEQ ID NO: 6782 - DNA, 819 bp, Streptomyces avermitilis
  CDS (1)..(819)
gtgaagatctggctcgacggcgggctgcaggactccgagaccgcccgcgtctccgtcttcgaccacgggctgaccgtgggtgacggcatcttcgagaccgtcaaggcggccgaggggcggccgttcgcgctgacccgccacctcgaccggctggcgcgttcggcgcggggcctcgggctgcccgagcccgacctggacgaggtacgccgcgcctgcgccgccgtcctggacgccaatccgatgccgctcggccggctgcgcatcacgtacaccggcggctacggtccgctcggctccgaccgcggcgagaaggggccgaccctggtcgtcgccgtcggcgagtccgcccgccgccccgattccaccgccgtgatcaccgtgccgtggacgcgcaacgagcgcggcgcgctcaccggtctcaagaccacctcgtacgccgagaacgtcgtcgccctcgcccgcgcgcgcgaacagggcgcgtccgaggcgctgttcgccaacacggtcggccggctgtgcgagggcaccgggtcgaacgtcttcgtcgtgctcgacggcgagatccacaccccgccggtcgactccggctgcctcgcgggcatcacccgcgcgctcaccgtcgagtggaccggcgccaaggagaccgacctgcccctcgacgtcctggacagcgccgaggaggtgttcctcacgtccacgctgcgcgatgtgcagggcgtgcaccgggtcgactcccgcgaactcccgggcgcgccgggcccggtgaccgccaaggccatgcggctcttcgacgagcaggccggggacgacctcgacccg

SEQ ID NO: 6783 - DNA, 852 bp, Streptomyces avermitilis
  CDS (1)..(852)
atgacggagggccgcagggcgggtagaactcccgtgatgaccaccaccctgcggccggtcgagccgcttcagcatgccgccgacgggacgcgttcgcgccgctaccacgtgtgcgtgaacagccgccccgtaggcgtgatccacctcgcgacgcaccctgttttcgggccgtccgtcgcccggatcgacgagctgcgcatcgaggagccggaccggcggcgcggccgcggcacggtcgccgcgctcgccgcggaggaggtggtgcgcggctggggctgcaagcggatcgaggtccaggtgcccggcgaggccggcctgcggctggccggcgcgctcggctacgtcctgcgcaaccgcggcatggagaagcggctcggcaccaccgccccgggacttcccgagggcagccgggggcggcccatgacggctgccgagttcggtccgtgggaggagcgtggcagggcgcactacgcgcagagctggatcgaccggggcgttcccgaggccgaggcacgggagaaggcggagaaggaccacgccaggcatctccccgacggcgtggacagtcccggaacactgctcaccgtcctggagcacgaaggggtgcccgtcggaacgctgtggctggcgctgtccgagggcagcacgttcgtcttcgacgtcgaggccgacgcacgccaccgcggccagggccacggacgttcgctgatgctgctggccgaggcccagtcggtggccgccggaaagagccggatcggcctcaacgtcttcgccggcaacacccccgcggagcgcctctacgagtcactgggctacgagccgacgcagtacgtcctgtacaaggagctgctc

SEQ ID NO: 6784 - DNA, 528 bp, Streptomyces avermitilis
  CDS (1)..(528)
atgaacgactcctcccccgcgcctctcgccgtccccgtgctggacgtctggtgcgaactccagtgccccgactgccgcagcgccctcgacgacctgcgcgcgctgcgcgcccgctacggcgatcgtctcgagctgcggctgcggcacttcccgctggagaagcacaagcacgccttcgccgcggcccaggccgccgaggaggccgcggagcaggggcagggctggccgtacgtcgaggcggtgctcggccgggtcgaggagctggaccgtaagggagaacccttcctggtcgaggtggcccgcgaactcggtctggacgcagaggagttcgacacggcgctgatcgacggccggcacatcctgatcgtcgacgcggaccaggccgagggcaaggcgatcggcgtgaccggcacccccacctatgtcatcggcggcgagcgcctcgacggcaacaagagccagaaggggctgcgcgagcgcgtcgaggaaatcgcggaccgcctcctggcggagcgtgaacaggaaggc

SEQ ID NO: 6785 - DNA, 441 bp, Streptomyces avermitilis
  CDS (1)..(441)
atgattgccgagaccgtctgttccgccgtctccgcggccggcctgggcatagccgtggtcacggcctaccgcaagcgcttcctcgcggccgcccgcatcgccgcgtactcgctggtgcccgtaggcctggtgatgacgggggtcgtcggctgggcggccgacaccactttcagcccgacggcatgggcgggcttcgccttgctcggcggtgcctggctgctgttcgcgaccacgcgtgccgtggagcgccgcagcggcggtacacgcaaggaacgcaaggcggccaaggccgcccagcgtgaagcagtggcccccgcggcctccgcgccctcactgggggagggcgcccgcccggcggcccggcccgcgaccaccccccgggcgaccggcgcctcggacgacttcagcgacatcgaggccatcctcaagaagcacggcata

SEQ ID NO: 6786 - DNA, 150 bp, Streptomyces avermitilis
  CDS (1)..(150)
atgctggacacaacccagagcgacaccgcggctcctcccgaggagcggcgaggttgtctcttcgcgctttcccagccaccgctgatgatcttccttgcggtgatcggctgccttctgctcatggcatcgctgcacgacctgctgctgctc

SEQ ID NO: 6787 - DNA, 558 bp, Streptomyces avermitilis
  CDS (1)..(558)
gtgctgatcacccacgacacccggtgcgcgctcgacgccgtggtcgatctggtgaacaccgcaccggaggacgacgacgcgagggacggtctctcggatgtcgcgtcgctcgcagatttcgtaggaaagcacgagatcagcgatgtcggcgtcctgtcggagttcgatctctcggcggtgcgcaagatccgcgaccggttcgccggggttttcgccgccgcggacgcccggatcgcggccggcctgatcaacgaactggtcgccgccgccggaaccaccccccggctcaccgatcacgacggctacgactggcatgtccactacttcgcgccgggcgcctccgtcgccgaccacctcgcggccgactgcgggatggcactggccttcttcgtggtggccggggagcaggagcggctgcgccggtgcgaggcgccggactgccgacgcgccttcgtcgacctctcccgcaaccgctcccgccgctactgcgacagtcgcacctgcggcaaccgcctccacgtggccgcctaccgggcgcgccgcaaggaagcggcgggc

SEQ ID NO: 6788 - DNA, 477 bp, Streptomyces avermitilis
  CDS (1)..(477)
gtggcatgtcgatttcgccgacgtgcgaatccccgagcgcacactgagcgaaaggccctggcgcttatgaacaccacggtcagctgcgagctgcacctgcgcctcgttgtgtcgagcgagtcctcactgcctgtacccgcaggactgcggtatgacacggccgatccctacgccgtgcacgccaccttccacaccggagccgaggaaaccgtcgagtgggtcttcgcccgcgacctcctcgccgagggcctgcaccggcccaccggcaccggcgacgtccgcgtctggccgtcccgcagccatggtcagggcgtcgtctgcatcgccctgagctctccggagggcgaagctctgctcgaggccccggcgcgggccctggagtcgttcctgaagcgaacggacgccgccgtgccccccggcacggagcatcgccatttcgatctcgacacggagctctcacacatcctggccgagagc

SEQ ID NO: 6789 - DNA, 432 bp, Streptomyces avermitilis
  CDS (1)..(432)
atgaatacggggagtgacgagccgggcgaggtcgccgtggccgctgacgaaacgaacgccgagcgggggctcggctcgagggcgccgaaattcatcaaggcgcgtcgcgcgctgcacctgagctggcaggtgggcgttttcatcgtggggctcgcggtcgtcgtcgcgggcgtgatcatgcttccgctgcccggtccgggctggctggtgatcttcggaggcatggcgatctgggcgacggagttcgtctgggcccagctggtgctccgctggacgaagcgcaaggtcaccgaggcgacccagcgtgcgctcgaccccagggtgcggcgccgcaacatcatcctcaccaccgtcgggctcgtgatcatcgccgctcttatggccgtctacgtctggaagttcggcttcgcgatgccctggaacatcaaggag

SEQ ID NO: 6790 - DNA, 1284 bp, Streptomyces avermitilis
  CDS (1)..(1284)
atgcagaaaaacgggaatgttgagaggcggacgatcctcaaggcggccggtgcgtcggcggccgtgctggggctggccgcgacgaccggctgtgggggcgacagtgactcgggggacgggacggtcacgatccgctacgcctggtggggtgccgaagagcgcgccaagcgtatcaaccagaccatcgcgctcttcgagaagaagtacccgaagatcaaggtgaagaccgacttccaggactacgtggccttttgggagaaattccagacgcaggccgcaggtggaaatcccccggacgttttccagaatgcggtggcctatctgcgcaagtatgacaagcggggcatcctgctcgatctcaagtcgcagatagacgccgggaatctgagcctggacggattccgggcgggggtcgagaaggtcgggcaggtcgacggaaagcagctcggaattccggtcggctccaacaccatgtccctcgtcatcgaccagaaggtcttcgacaaggccggcatcaagccggagcagggctggacctgggacgagtacttcaaggccctgaagaagatccacgacaccgagaagatctcgggggacaccggctacttcggtgtgatgtacctctacgacctctacctccgccagaacggcaaggccttcttcaccgaggacggactcggcttcgacgaggccgacctgacggagtggtgggccgacggctacaaccgcctcaaggccggcatcatcaccgaccccaagaagatccaacagctcaggcccaagtcggcgctcgcgtccggcgacgccgcctcggagttcacctgggacaacttcgcggtccggtacagcaccgagggcgacagcacgtacgcactcgccccgatccccaccaccgacggcaagcagaccggccagtacctcgcctcactcatgctgagtgcctccgcccgcaccgaacatccgaaggaagtggcccagttcatcgacttcatggtccatgacccggaggccgccaagatcatgggctacgaccgcggcatcctcgcgaccaccgagcagttcgacgccttcaagccgaccgacccggtcagcaaggagatcgcccagtacgaggaggacacctccgcggcaggcgtccttggtgccatcactccgcacccgtccggcgccgacaccgtcgaggccaccttcctgcgcatcgccgacgacatgtcccagggcaagacgaaggtcgccgacgcggtcaaacaattcttctccgaagcgaaggccgccctcgccgct

SEQ ID NO: 6791 - DNA, 969 bp, Streptomyces avermitilis
  CDS (1)..(969)
ttgatgggaacagcagtgacgctcgtcaaggactcaccgccccaggtacctgccgaacgccccgcccgccccgccgtcgtcaagcgtcggggccgccgggagaatctggccggctacctcttcatgtcgccgtggatcgccggtttcctgctgctgacggcaggcccgatggtcgcctcgctctatttcgcgttcaccgactacaacctcttcaattcaccgaagtggatcggtctcgacaacttcaccaagatgttcgacgacccccgctggcagaagtcggtggaggtgacggccaagtacgtgatcatcggcaccccgctgaagctgctgctcgccctcggcgtcgccctgctgctcgcgcagagccgccgcggccaggccttctaccgggccgcgttctacgcaccctcgctgatcggcgccagcgtctccgtgggcttcgtctggcgggcgctcttctccgacgacgccgtcgtggacaaagcgcagaccttcctcggcttccacaccggcggctgggtcggcgacgccgactgggttctctacagcctggtcgcgctcaccgtctggcagttcggcgcccccatggtcatcttcctggccggactaaagcaggtgccgcgtgagctgtacgaagcggcggaggtcgatggcgccggaccgttccggcggttctggaacatcacgctgccggtgatttctccggtgctgttcttcaacgtcctgctggagaccatccactccttccagatcttcggctcggcgtatgtcgtctccaacgggtactgcggtcccgccgacgccacgctggtctacacctgctacctgtaccagaagggcttcaaggaggcccaaatgggctttgcctccgcgatggcctggatgctgctgctcgccgtggcgctggtgacggccgtcctcttctggtcccagaaacggtgggtgcactacgaggaggacgctcga

SEQ ID NO: 6792 - DNA, 906 bp, Streptomyces avermitilis
  CDS (1)..(906)
gtgggtgcactacgaggaggacgctcgatgagcgctaccgcaaccaccgctcgcaagccgcgcgcgctcgggcggcgccggaagggttcgctcgcctggcacctcggcgccctgctggtcctcgcggtcgtgctctacccggtcgtctgggtcatcggcgcgtccttcaagcccagcaaagagatcatcggcagcctggagctgttcccgacggaaccgatcatctccaatttcaaggggctggcggacggtatcgccgacgtctcgatcgccacgttcttccagaactccctcgtctacgcgctcggttccgtcgtcggcatcctggtctcctgctcactgaccgcgtacgccttcgcccggatccggttcgccggccggaacctgatgttctcgctgatgatcggcacgctgctgctgccgtatcacgtgctgctgatcccgcagtacgtgatgttccagaagctggagctgatcaacacctacgtaccgttgctgatcggcaaatacctggccaccgaggcgttcttcgtcttcctgatggtgcagttcatgcggaacctgcccagggaactggacgaggcggcccgtctcgacggctgcgggcatctgcggatctactggtcgatcgtgctgccgctgtgccggtccgcgctcatcaccagcgcgatcttcaccttcatcaacgcctggaacgacttcatggggccgctgatctacctgaacgagcccggcaattacaccgtctcgctcggcctgatgctcttccgcgactcggacggcgtcacctccaactacggcggcatgatcgcgatgtcgctggtggcgctgctgcccgtcctgctcttcttcctcgccttccagcggcacttgatcgacggtatggcgacctccgggctgaagggc

SEQ ID NO: 6793 - DNA, 645 bp, Streptomyces avermitilis
  CDS (1)..(645)
gtgccgatgactcgtacggccgaagcccgtcgtgcccggccgtgggcgaaagcccgcaagccgccccgcaagccgccccgcgaatcggccctcgccgagcgcttcggtctcttcgccgagtgtctgctcacgggggtgtggatcgcggtggcctcgctgccgctgctcacctaccccgcggccttcgccgccggggcacggcatctgcgccggcgcacggctcacgagggcggcggcggacgggagttcgtcgccgacttccgtgcggccgtgcgcggcgggtggatcgcggggctcgccggctgggccgcggcggccgcggtctgggtggatgtgcaggccgcgcgtgcgggaatgccgggcggccccctcgtgggtgccgtcggcctcttcgcgctcatcggactggtcgtcgccgggctgcgggcggcggcggtctgggagccgggcgtgccatggcgggtgctgctcgcgggcgccggacgccgtacggtcctggatcccgccgggtccttcctgctcatcggcggactggcggtggtggtctgctcgggcctgttcatcgcaccgctcgcggttcccgtgctcggagccgtcgcggcggcggccgtcgccgtggaggagaggtatcggcggcgcgctcgc

SEQ ID NO: 6794 - DNA, 2469 bp, Streptomyces avermitilis
  CDS (1)..(2469)
gtgcagtcctggccgatcgcctactggccggacggctccctgaagtggaccgcgcacgccgtcggcacgggagccggcgccgggaagctcacgctcgccgccggttcgcccgccgcgcccgacaagaaggtgaccgtcgacaagcgcggcggcacgatcgacgtgtcgaccggcgtcatcacggcgaagctcggcaagtccggctccacgctggtcaagtcggtcacacgcggttccaccgagatcgccaagaacggccggctcgtgctgatccgccagcccgagctcgaggacggcgaccagggcacggaaaagtacgaacgcttcgagagcgccatctccgacgtcaccgtcgaacaggacggcccggtccgtgccgtcgtccgcatcgacggcaagcaccgcaagggcgaccgcagttggctgcccttctccgtccggctctatttctacgcgggcgccgagtccttccgcatggtgcacacgatcacgttcgacgggaagcaggagcccggcaaggcgagcggcgacttcatccgcgggctcggtgtgcgcttcaccgtgccgatgcgcgatgccgcgtacgaccggcacatccgcatcggcggtgacgacaccggtctgctgcgcgaggccgtcaagggcatcaccggactgcgccgcgacccgggcgcggccgtgcaggcggcccagttcgcgggcgagaggctgcccgacccggccacctgggaccagcgggtcaccacccgtctccagtacatccccgagtggggcgactacaccctcgcccagctctccgccgacggcttcaccctgcgcaagcgcaccaggaaggggtacggctggatcgccgcgggcggcggccgcagggcgagcggcttcggatacgtcggcggacccagcggcggattctccttcggcctgcgggacttctgggagaaacaccccgcccagctcgacatccgcgacgcccacaccgacgaggccgaggtcaccctctggctctggtcgcccgaggcgcagcccatggacctgcgcttctaccacgacggcatggaccaggacacctacgccgaacagctcgaaggcctcaacatcacctacgaggactacgaaccggagttcggcaccccctacggcatcgcccgcacctccgaactcctcttctgggccaacgagtcgacgcccacccccgagaagctcgccgaacaggtcgaggccgtccgggtgctcccgcagctcgccgccccgcccaagcacctcatcaaggccaaggtcttcggcggcctgttctccgagcccgaccgctccaccaccgcgaaggccaagatcgaggaccatctcgacttcctcttcacgtactacaaggaccaggtggagatgcggcgttggtacggcttctgggactacggcgacttcatgcactcgtacgacaccgtgcgccaccagtggcggtacgacgtcggcggctacgcctgggacaactccgagctgtcgccggacctgtggctgtggttcgcctatctgcgctcaggacgctcggacatcttccgcttcgccgaggcgctcacccggcacaccggcgaggtcgacgtctaccacctcggccagtgggcgggtctcggcacccggcacggcgtgcagcacttcgccgacagcgccaagcagcagcgcatcgccaacaccaactaccggcggtactactactacctcaccgcggacgagcgcgtcggtgacctcatgcacgccaacgtcgactccgacgagacgttcctcgtcctcgacccgatccgcaagatccgcaccgagccgtacacgcccgaccggcacgccctgtccatcggcttcggcacggactggagcgggctcgtctccgcgtggctgaccgagtgggagcgcaagggccccaagtgggcgaaggccaaggcccgcgtgctgtcgacgatggagaccatcgccgcccagcccaacggcttcgtccagggcaatggcctctacgacctcgacacgggcaagttcgccatcgcccccgcgcccgtcgtgtccgtctcgcacctctccgcggtgttcggcctcaacgagctgtgcgccgagctgatcgacctggtcgacatgccgaagttcaaggaggtctacctcgactactgccgctacttcaacgccagcaagaccgaacaggcggcacggtacggttccaacttcggctccctgctgctgttccagggccactcgcgcctcgacgcgtacgccgccgtacagaccggcgacgcgacactcgccaagcgcgcctggacgaagttctacagctccgacggctacatggagtcctcgccctggaagacggagaagctgagcggccccgtcaccctggtggcgggcagcgaggccaactgggtcagctcgaacgacaccgcgctgtacggcctcgccgccatcgagaacctggcgctgctgggcgacaagatgccc

SEQ ID NO: 6795 - DNA, 2388 bp, Streptomyces avermitilis
  CDS (1)..(2388)
atgacccatatcccgcccccggccgaggagttgcggatcctcgacggggagctgcggcaactcgacgcccgccgcgccctgctgctgacccgccgcgcctggctgatcggcgttctccactcggcccccgtaccgcccccgcctcccccgcggcggcccgagacgaccgccccgagcgtgcagaacgtgctcctggtgctcggcggcatcctgctgaccgtcgccgcgatcgcgttcacgctggtcagctgggggcatctggggatcaccgggcgggccgtggtgctcgcggcggtgacgctggcggcactcgccactcccgtcgcgctgctcaggcgcgggctgcgctcgaccgccgagtcggtggcgggcctcggcctcgcgctgacggtgctcgacgcctacgccctgcacgaggcggcgctccccggggcgaacggcacggcttacgcggcgctcgcctcggccgtcctggcgggggtctgggctgcgtacggccagggcctcggcgcgctgctcggccggcccgagcgggccgccgctcgtctcccgctgcggctgcctcttccggccgcgctggtcgccgtccaattcccgctcctgctctgggcgatcgcagcgggtgcgggtccgcacacgctcacgggcgcgctgttgacgacggccgcgttcgacacggttgtcgcgctccgggtgtccgtgagatccgtacgtctcgtcgccgccgtcggcgcgtacggcatgggcggctggggcgtgctggcggccggccggctctccttcgaggccaccggtccgagcgccgccgcccgtgcggcggcgctcctcgccttcgcggcggtgatcgcactgggcacggcctggcgggcaccgagggtggacctcgccgtcggcaccgcggtgaccggcggcctcctgctggtcgcgggcctcggcggcatcctgcgtgtgtcgctgccggccgactggacggtggtcgggtatctggtgtgcgccgtcgccctgctgacggtcgtacgcggcccgcttcccgagcccgtacgcctcggtctcgcctgggcctccggctccgtccaggcgctcgccgtggtctcggcgctgcccccggtcgccgtcgcgctgctgggtccggcgggctgggcggggcggatctggtcgggcgccccgtcggacatccgggccgcggtgaccgccggcacgccctggccgccggacgcggcgacggcaccgctcgtactggccgtcgtcgccggtgtctcggtctgggcgctgcgcaccacacagtggcggccgcaggccatgaccggcgccctggtgctgggatgggcgacggcgctcgtcctccccgcgacgctggaactcccctacgtcgtggggctgttcgcgctggggctgaccgcggcgacggcggtggccgtggcggcgtacgcacgtcgggcgccgacggcttacacggccaccgcgctcgccctgatcacgtccgtcagcctctccttcctctcgctgacctcccggcccgcgaccctcggcgtactggccgccctgaccgccctgttcgcggtcgccgccgtgaaggtgcggccggcctccgtctgggcgagcacgtccctcgccggtgccaccgcgctggcctgtgccgcgggagccgccgccgggtgggcgccggcgcacaccgcgctgctcgtcctggtcgtcccgtgcggggcggccctgcttgcggcgcggctcgacgagcccgggaccaccaccgccgtggaagtcaccggctccgtcgcgggcctggtggcggtcggtctcgccgtcaccgatcccccgctgctggcgctcgtcctcgccctgtgcggggtgatcgccgccggcaccgccgtccgggcggaccgcaggagcgtcggctacgcggccacggccctgttcgtgctggcgacgtgggtgcgcctggggtcctggggcgtcggcgccccggaggcgtacaccttgccggtgaccgtccccgcgctgctcgtgggggtcgtccggcggcgccgggatccgctcgcctcgtcctggacggcgtacggccccggcctcgcggcgacgctcgtgccgagtctgctgacggcatggggcgacgcgcactggctacgcccgctgctgctcggggcggcggcgctcctcgtcaccctgctgggcgcccgccaccgcctccgggcgcccctgctgctcggcggggccgtgctggcgctggacgcgctgcacgaactcgccccgtatctggtgcagttggccggtgtgctcccgcgctggctgcctcccgccctcgccgggctggtgctgctcgcggtcggggcgacgtacgagcagcggatccgggacgcccgacgggtgcgggaggtgctggggaggatgtac

SEQ ID NO: 6796 - DNA, 456 bp, Streptomyces avermitilis
  CDS (1)..(456)
atggactggagtcactaccgcttccgcagcctgtgggcgctgccggcaccgcccgcccgcgtgtatgccgcgctcgagcgggtcgaggactacccgcgctggtggccgcaggtgcgcgaggtgacgcggctcgacgaggactgcggagtgatcaggatccgctccctgcttccgtacgacatgacgttcaccgcgcgggacgtgcggcacgacacggcggccgggatcctggagatcaccatgaccggtgacatcgacggctgggcacgctggaccgtcaccgccggcggaccgggcaccctcgcccgctacgaccaggaagtcgacgtgcgcaagccgctgctgaggcggttcgccgtgccgggacggcccgtcttccgcgccaaccacgccctgatgatgcgggccggacaacgcggactcctcgcccacctggacggcggccggcaagcggtt

SEQ ID NO: 6797 - DNA, 723 bp, Streptomyces avermitilis
  CDS (1)..(723)
atgacgtgctggtacgaaggccccttggccgcgttcgacacggagaccacgggcgtggacgtcgagaccgaccggatcgtgtcggccgccgtcgtcgtccaggacgccccgggggcccgtccgcgggtgtcccggtggctggtgaaccccggagtgccggtgccggccggtgcgacggcggtgcacggactgaccgacgagcatcttcagcgcaacggccgctggccgtcgccggtgatggacgagatagccagggagctgggagaacaggccaccgcgggccggccgctcgtggtgatgaacgcgccgttcgatctcacgctcctggaccgggagttgcgccgtcatcgcgcctcctgcctcgaccactggttcgagtcggcgccgctgcgcgtgctcgatccccgggtactcgacaagcatctggaccgctaccgcaagggccgccgcacgctcaccgatctgtgcgcccactacgacgtcgcccttgagggcgcgcacgacgcggcggccgacgcgctggccgcgatggaggtcgtacgggcggtggggcgccgtttcgctacccggctggagcggctctcgccggccgagctgcacaccttgcaggcggtgtggcacgcggcacaggcgcgcgggcttcaggcgtggttcgcgcgcagcggtacgccggaggcggtggacccggcgtggccgctgcgtccggagctgccggcggcggcg

SEQ ID NO: 6798 - DNA, 564 bp, Streptomyces avermitilis
  CDS (1)..(564)
atggcgatagcgcagcccgaacggggcgggctgctgccccagcgcacggcaccccctcgcggcaccctcgccaccaccgcctgcatggagacactgcaggtgggctacctgcacgcggtcgcggcggccgcgggctgctcgctgtcccagccctttccggacaacggcatcgactggcacgtcagccacagcgcccccgggcacacggtcgacgacgaagtcaccatcaaggtgcagctcaagtgcacgtaccagatcccgccgaatccgccgggccccgccttctccttcacgctcgacaacgcgcacctggcgaagctcgcccgcaccccggtctcggtgcacaagatcctggtcgtgatgctcgtgccccgggcccaggacgactggctgcgcgccagccacgaccgcctcgacctgcggcactgctgctactggatcaacctcgccggacatgccgtcaccggccggcgcaggaccaccgtgcgcataccgacctcgcgcatcttcgacgaccgagcgctctgcgagatcatgacgcgggtcggaacgggaggcagaccg

SEQ ID NO: 6799 - DNA, 1218 bp, Streptomyces avermitilis
  CDS (1)..(1218)
gtgacgcaccgcccgacccacgaacccctacgccccgtgcggccccacccggtcgaggccctcccggagaaccagccgcccgacccgggccaggtcgaccccgccgtcctcagcgccctcctgcaccgccacggctggcagcggcgcggcggacccgccggacgctacggccgctggaccccaccgggacccggcagcggcggcacaagcctgctggtgcccgagagccgggccttccccgacagcgacgacctgctcggcgaagccctcgtcgcgctctcccgcagcggatccccctcagcccgggacgtcctgatcgcgctcgccgtgcccagcgacgagatccactggtggcgggacgtcccggccgggcccgcgggcgccgcgccctggcccgtcgaggaccagctgcgcaccgccgcccggcagatgctgctcgcgggcgcactcgccacgcgcgggcgggccggctaccacggcgcccggcaccggcggcccgccgccgcgtccctggagagcgtcctggtcggcgccgcccccgggggacaccggctcaccgcgttcgtgcccgtcgagacggagcgccccctcgccgtacgactgcaccaggccctgtactcggtccgcgaggccgtcgactaccggcgggccaccggcggcatggaagccttcgacgcggccgtccaggccggcgtcagccatgagctcaccgaggcgctggtcgccctcgtccgcggcacggagggcgcccggatcgccgtcgagtgggcgcccgccgccggtgtccccgaaggctgcgcggcgcccgccgaagccgtcgagttctcgcccggcgacctgcccttcctgcgcgaggcgggcgcccgctatctgcgcgaggagccctccgtgccggtgcggatcaccggcacggtcgtacggatgcgcaggtcggggccgcgcggcgcgggcgccgtacggctgcgggtcctggcgggggccgaggtgccgcacgtacggatgacgctggacgaggagtcgtaccggacagcgggccacgcccacctcgtcgggctgcccgtgctggtgcacgggcggctggagagccggggcggtttccggcggctcacggacgtgtccgaggtggcgccggtgcaggtcgacgaggcggagcgggaccggctgatgaagtcgctccaggagaacctggacttcttcgaggaggcgtgcagcggggac

SEQ ID NO: 6800 - DNA, 1974 bp, Streptomyces avermitilis
  CDS (1)..(1974)
gtgtcagacgtccgtgtgatcatccaacgcgattccgagcgggaagagcgcgtggtgacgacgggcactacggccgccgacctcttccccggcgagcgcaccgtcgtcgcggcccgtgtgggcggcgagctgaaggacctggcctacgaggtgaaggacggcgaggaggtcgagcccgtccagatctcctccgaggacggcctcaacatcctgcgccactccaccgcgcacgtcatggcccaggccgtgcaggagctgttccccgaggccaagctgggcatcggcccgccggtcaaggacggcttctactacgacttcgacgtcgcgaagccgttcacgcccgaggatctcaaggccatcgagaagaagatgcaggagatccagaagcgcggccagcgcttctcgcgccgcgtcgtcaccgatgaggcggcccgtgaggagctggcggacgagccgtacaagctggaactgatcggcatcaagggctccgcctccaacgacgacggggcgaatgtcgaggtcggctccggcgagctgaccatctacgacaacctcgacgccaagaccggtgacctgtgttggaaggacctctgccgcggtccccacctgcccaccacccggaacatcccggcgttcaagctgatgcgcaacgccgccgcgtactggcgcggcagcgagaagaacccgatgctccagcgcatctacggcaccgcctggccgtcgaaggacgagctgaaggcgcacctcgacttcctcgccgaggcggagaagcgcgaccaccgcaagctgggcaacgagctggacctgttctccatcccggaccagatcggctccggcctcgccgtcttccaccccaagggcggcatcgtccgccgggtgatggaggactactcgcggcgccgccacgaggaagagggctacgagttcgtctacaccccgcacgccaccaaggggaagctcttcgagacctcgggccacctggactggtacgccgacggcatgtacccgcccatgcagctcgacgagggcgtggactactacctcaagcccatgaactgcccgatgcacaacctgatcttcgacgcgcgcggccgctcgtaccgtgaactgccgctgcgcctcttcgagttcgggaccgtgtaccggtacgagaagtcgggcgtcgtgcacggcctcacccgggcccgcggcttcacccaggacgacgcgcacatctactgcacgcgcgagaagatggccgacgagcttgacaagacgctcaccttcgtgctgaacctgctgcgcgactacggcctgaccgacttctacctggagctgtccaccaaggacccggagaagttcgtcggctcggacgaggtctgggaggaggccaccgagacgctgcggcaggtggccgagaagcagggcctgccgctggtcccggacccgggcggcgccgcgttctacggcccgaagatctccgtccaggccaaggacgccatcggccgcacctggcagatgtcgaccgtgcagctcgacttcaacctgccggagcgcttcgacctggagtacacgggccccgacggctccaagcagcgtccggtcatgatccaccgcgccctgttcggctccatcgagcggttcttcgcggtgctcctcgagcactacgcgggcgcgttcccggcgtggctggcgcccgtccaggcggtcggcatcccgatcggcgacgcgcacgtcgagtacctgcagaagtttgccgccgaggcgaagaagaagggcctgcgggtcgaggtcgactcgtcctcggaccgtatgcagaagaagatccgcaacgcgcagaagcagaaggtgcccttcatggtcatcgcgggcgacgaggacatgacggccggcgccgtctccttccgctaccgcgacggctcgcaggagaacggcatcccgctcgacgaggccatcgccaagatcgcgaaggtcgtcgaggagcggacacaggtc

SEQ ID NO: 6801 - DNA, 561 bp, Streptomyces avermitilis
  CDS (1)..(561)
atgctgcacctcatgacgagtgagccggagcagcagatcggagtgggaacgcaggacgcgttccagcgcctgtggacgcctcatcggatggcgtacatccagggcgagaacaagcccaccggtccgggggccgacgacggctgtcccttctgctcgatcccggccaagtccgacgaggacgggctcatcgtccggcgcggcgagcaggtgtacgcggtgctcaacctgtacccgtacaacggcggccatctgatggtcgtgccctaccgccatgtcgccgactacacggacctcaccgagtcggagaccgccgaactcgccgagctgaccaagcaggcgatgaccgcgctgcgtacggcgtcgggagcgcacggcttcaacatcggcatgaaccagggcacggtggcgggtgcgggcatcgccgcccacctccaccagcacatcgtgccgcgctggggcggcgacaccaacttcatgccggtcgtcggccacaccaaggtgctgccgcagctcctcgcggacacccggaagatgctggcggaggcctggcccacggctgcc

SEQ ID NO: 6802 - DNA, 1659 bp, Streptomyces avermitilis
  CDS (1)..(1659)
gtggcggacgacggattcgatttcagcccgggggcgcaggtgcccctgtcgggctccgcgggccagacggcggcgaccttcgccctggcttcggcggcctaccgggacaacccggtcgaggagatcctcaaggccgacaacgagtggcaccagtcgacggtcaagggcccccgcagaggtgcgaagatcctgcggcccaacctcggcgaggccttctcccgagcggtgatcgaccgcatgctcggagtcggccgcaacccgctcatccagtccttcggcacggagccgcaggtcatcgtcgagcactgcctggcggcgcacaacatccgccgggagcgggacaactggctcacggcggtgatagtgctgtgcggcctgatcttcctgccgggcctcatcgtctggctgctggtcttccagatccggacggccatcgcccggcgcgaggacaagcgcgcctccgccctcggcaccaccctgctggtcgccgtgggcgccctcgccgtgatcttcctgatccgtatgcccttcacgggcttctggggctggtacgcgcgcgcggcggtcgtcgtcccggtcgtcggctggctgtgggccaagcagatctgcgaacgcacggccaaggatctgcgggagcgctgggacagcctgctggccggcggcgccatcggcgccaaggtcccggaggccgtgcccggcagccccggcgagaccgcggccgagcagctgcgccagtccctcgcccggctcagcgccgagcagcagtccaactccgtcttctacgcgggccccaagggcatactcggcatgggcacgcgctggggcagctggcagctcgccgaggacctggtgccgcgcgaggcgggcaaggagatccaccccttccgcagctgggacgtcatacggtccatccacgaccagctgcgcatgctggagcgcggccccctcaacaccggcggtttccccaagccgtcgatcaagcactgggtcgtcacaccgatcggtgagaacgccaaggcggtctcccgtccgggcggcacggacgtcgacgcgtaccaggtcaagaaccacgcgatacaggacatctgcaacaagcagcagttcggcagcggcgaccggcactacctcggggtccagtggacgctctgggacggccagctgatcatcaccatgctgatcaccgtgaccgtgctgcacgagacactgcgcatcgaggtcaccggccacgccctgggcccggtgaactccctgttcaccacgaagccggaggccccctcgaagcaggtcgccaagtcggtcaggttctgggagacccgcacggtcaagctcccgctggtcgacgccgacgaggtggtacgcctcgcggtccgcgcgcccctcacctggtatccgccgctgctcaactggctcggcggctcgctgacgctccccgagcccttcgggctgcggcacgcctgggcggaccagccgtggcggcaccgcttcatggccgacgacgcgctgcgggccgcgacgcccgtgctgcgcgtggtgcacgcggcggcgatcagggtgctggaggagaacggcgtggacacggagaagttcggcaaccgctcgtccttcctcagcaccgcggtccaggacccgacaccgaggaaggcggacgtgtacgacgcg

SEQ ID NO: 6803 - DNA, 2196 bp, Streptomyces avermitilis
  CDS (1)..(2196)
atgggcgacaaggcgaacgcacaccccggagccgccggcagggctacggcggccgaccaccccgcgtccgtacggaatgtggtgctggtcggccacagcggatcgggcaagacgactttggtggaagctctcgcgctgacggcgggagcagtgaaccgggcgggccgcgtcgaggacggcggcaccgtctccgactacgacgacatcgagcaccgccagaagcgctcggtgcagctctcgctcgtccccgtcgactgggacgggtacaagatcaacatcttggacacccccggatacgccgacttcgtcggtgaactcagggccggtctgcgagctgcggacgcggcccttttcgtggtctccgcctcggacggcgtggacggctcgacccgcatggtgtgggaggagtgcgcggcggtcggcatgccgcgcgccatcgtcgtcacgcatctggaggcggcccgggcggacttcgacgagatgacccggacctgcgcggaggccttcggcgccgacgaccccgacgccgtactgccgctgtatctgccgctccacggcgagcaggggcccgacgggcacgcgcccgtgaccggcctgaccggactgctctcccagcggctgttcgactactccaccggggagcgcaaggagtcggagcccggcccggaccagctgccgctcctggcgcaggcccgcaaccggctgatcgagggaatcatcgccgagagcgaggacgagaccctcatggaccgctatctcggcggcgaggagatcgacgtcaagacgctcgtgcaggacctggagcgggccgtggcgcgcgggaccttcttcccggtgctggccgccgcgcccgccgccgagggcgcccgtcagggcctcggcacggtcgagctcctcgagctgatcacgggcggcttcccgaccccgctggagcgcgccgcgcccaaggtcaccacgcccgacggcacggcgcgcgaggtcacggcctgcgacccgggcggaccgctggtggcggaggtcgtgaagaccgccagcgatccctatgtgggccgggtctccctcgtccgcgtcttctccggaaccctgcgcgccgacgacacggtgcacgtctccgggcacggcctggccgaccgcgggcacgaggaccacgatgtcgacgagcgcatcggcgccctgtccacgccgttcggaaagcagcagcgctccctcacgcactgcatcgcgggcgatctggcctgcgtggcgaagctgaatcgcgcggagaccggcgacaccctctccgccaaggacgacccgctgctgatggcgccgtgggagatgcccgatccgctgctgccgctggccatccaggcgcacagcaaggcggacgaggacaaactcagccagggtctgggcaggctggtggccgaggatccgaccatgcgcctggaacagaaccagcacacccaccaggtggtgctctggtgcctgggcgaggcacacgcggacgtcgcactggagcggctgcgcaaccggtacggcgtccaggtcgacgtgatcccgcacaaggtcgccctgcgggagacgttcgcgggcagggccgccgggcgcggccgccatgtgaaacagtccggcggccacgggcagtacgcgatctgcgagatcgaggtcgagccgctgccaggcggcgccggcatcgagttcgtggacaaggtcgtcggcggtgccgtgccccggcagttcatcccgtccgtggagaagggtgtacgggcccaggcggccaggggtgtcgcggccggctatccgctcatcgacgtacgggtcacgctgctcgacggcaaggcgcactccgtggactcctccgacgcggccttccagacggcgggcgcgctggccctgcgcgaggcggcggccgacgccaggatccatctcctggagccggtggccgaggtgaccgtcctggtcggcgacgactacgtgggcaccgtgatgagcgatctgtccgggcggcgcgggcgcgtggtcggcaccgagcaggcgggcggcgggcgcacgctcgtacgggccgaggtgccggagatcgagatcggccggtacgccgtcgatctgcgctccctctcgcacggcaccgcccgtttcagccgcgcctacgcacggcacgaaccgatgccccctcaggttgcggagcggctccgcgaacagacgcggcaggcctcg

SEQ ID NO: 6804 - DNA, 732 bp, Streptomyces avermitilis
  CDS (1)..(732)
atgggccagccggtggccagcaggggccgcgcggcgacaccgaccatcgggaaggccatgctgaacaagtacgcgcgtgcattcttcacgcgtgtcctcacaccgttcgccgcgtttctcatccgccggggcgtgagccccgacacggtcacgctcctcggcaccgccggagtgatcgcgggcgcgctggtcttctacccccggggggagttcttctggggcacgatcgtcatcacgctgttcgtcttctcggacctcgtcgacggcaacatggcccgccagctcggccgcaccagccgctggggcgcgttcctggactccaccctggaccgggtcgccgacggcgcgatcttcggcggcttcgccctctggtacgcgggcggcggtgacaacaacgtgctgtgcgccgtctcgatcttctgtctggccagtggccaggtggtctcgtacaccaaggcgcgtggcgagtcgatcggtctgccggtcgccgtcaacggtctggtcgagcgcgccgaacgcctggtgatctcgctggtcgcggccggtttcgccgggctgcacaagttcggcgtgcccggcatccaggtgctgctgccgatcgctctgtggatcgtcgccgtcggcagcctggtcacgctgatccagcgtgtcgtcacggtccgccgcgagtccgcggaggcggacgccgcgaccgccgccgagaacgcctcgcaggggagcggagccgcgtcg

SEQ ID NO: 6805 - DNA, 924 bp, Streptomyces avermitilis
  CDS (1)..(924)
gtgagcagtctgcaggagcggctgacggacggggcctacgcgctcggctggagcaccgtcaggaagctccccgagccggtcgccgcgcggctcggacaaaccgtcgcggacctcacctggaagcggcgcggcaagggcgtacgacgtctggagagcaactacgcgcgcgtggtgcccgacgcgacccccgagcggctcgccgagctgtccagggcggggatgcgttcctatctgcgttactggatggagtccttccggctgcccgcgtggagcgcggagcgggtgaagaacggcttcgacccgaaggacctgcaccacctcaccgacgggctggcctccggccggggcgtcgtcctcgcgctgccgcacctgggcaactgggacctggccggcgcctgggtcaccaccaagctggagacgccgttcacgacggtcgcggagcgcctcaggcccgagtccctgtacgaccggttcgtcgcctaccgcgagggcctcggcatggaggtgctgccgcacagcgggggctccgctttcggcacgctggcgcgccggctgcgcgacggcggcctcgtctgtctggtcgcggaccgtgacctgtccgcgtcgggcgtcgaggtcgacttcttcggcgcgaccacccggatgccggccggaccggcgctgctcgcccagcagaccggcgccgtcctgctggcggcgacgctctggtacgacgagtcacccgtgatgaagggccggcttcatccgccggtcgaggtgcccgagacaggtacgcgggccgagaagacgtctgtcatgacacaggcgctggccgatgccttcgccacggggatcgccgaccatccggaggactggcacatgctgcaacggctgtggctcgccgacctggaacctcgcacggagtccaccgacgggggacggctg

SEQ ID NO: 6806 - DNA, 1158 bp, Streptomyces avermitilis
  CDS (1)..(1158)
gtgaggatcggcatcgtctgcccgtactcctgggacgtgccgggcggcgtccagttccacatccgggatctggccgagcacctcatccgtctcgggcacgaggtgtccgtcctcgctccggcggacgacgacacccccctgccgccgtacgtcgtctcggcgggccgcgcggttccggtgccctacaacggctcggtggcccgcctgaacttcgggttcctgtccgcggcccgggtgcggcgctggctgcacgacggcgagttcgacgtgatccacatccacgagccgacctcgccgtcgctcggcctgctgacgtgctgggcggcgcagggcccgatcgtggccaccttccacacgtccaacccgcgctcccgggcgatgatcgccgcgtacccgatcctgcagcccgcgctggagaagatcagcgcgcgcatcgcggtgagcgagtacgcgcgtcgcaccctggtcgaacacctgggcggggacgccgtcgtcatcccgaacggcgtggacgtggacttcttcgcgcgggccaagcccgaccccgagtggcagggggacacgctcggcttcatcggccgtatcgacgagccccgcaagggcctgccggtgctcatgaaggccctgccgaagatcctcgccgagcgcccgggaacccggctcctggtcgccgggcgcggcgacgaggaggaggccgtggagacgctgcccaaggagatgcgcgagcacgtccggttcctcggcatggtcagcgacgaggacaaggcgcgcttcctgcgcagcgtcgacgtgtacgtggcccccaacaccggcggcgagagcttcgggatcatcctggtcgaggcgatgtcggcgggcgctccggtgctcgcgtcggacctggacgccttcgcccaggtgctcgaccagggggcggcgggggaactgttcgccaacgaggacgccgacgcgctggccgagtcggcgctgcgactgctcggcgacccagggcgccgggccgagctgcgcgagcgggggagcgcccatgtgcggcgcttcgactggtcgaccgtgggcgccgacatcctgtccgtgtacgagacggtgacggacggagcggccgccgtggccgccgacgaacggaccgggctgcgggcgcggttcggactggcacgggac

SEQ ID NO: 6807 - DNA, 552 bp, Streptomyces avermitilis
  CDS (1)..(552)
ttgccgcccgtgaccgcaaccctcatctggatcctcgtcggcctcttcgcgatcggcctctacctcagctggaccgcggggcggctcgaccggctgcacgcccggatcgacgccgcccgcgccgcgttggacgcccaactgttgcgccgtgcctccgtcgcccaggaactggcgactgccggggtgctcgatccggccgcctcgatcgtgctgtacgaggcggcccacgcggcccggcaggccgaggaggagcagcgcgaggtcgccgagagcgagctgagccaggcgttgcgggccgtcttcggggagcagcagcaggtggaggtggtccgggaggccccggggggcgaggaggcggcgaacgagctggcgcaggcggtgcggcgggtgccgatggcccggcgcttccacaacgactccgtacgcgccgctcgtgcgctgcgccgccatcgcaaggtgcggtggttccggctggccgggcacgcgccgttcccgatggccttcgaaatggacgacgagccgccggtggccctggccgaccgcccgacgaca

SEQ ID NO: 6808 - DNA, 912 bp, Streptomyces avermitilis
  CDS (1)..(912)
gtgtccagcacgctctccgtccccgcacaggcccccgagaccggcaccgcccgagtgaagcgcggcatggccgagcagctcaagggcggcgtgatcatggacgttgtcacgcccgagcaggcgaagatcgccgaggatgcgggcgccgtcgccgtcatggccctggagcgggtcccggccgacatccgcaaggacggcggcgtggcccgcatgtccgaccccgacatgatcgagggcatcatcagcgcggtgtccatcccggtcatggccaagtcccgcatcggccacttcgtcgaggcccaggtgctccagtccctcggcgtcgactacatcgacgagtccgaggtcctcaccccggccgacgaggtcaaccactccgacaagtgggcgttcaccacgccgttcgtgtgtggtgccaccaacctcggtgaggccctgcgccgcatcgccgagggtgccgccatgatccgctccaagggcgaggccggcaccggcaacgtcgtcgaggccgtgcgccacctgcgccagatcaagaacgagatcgccaggctgcgcggctacgacaacaacgagctgtacgccgccgccaaggagctgcgcgccccgtacgagatcgtcaaggaggtcgccgagctcggcaagctgccggtcgtgctgttctccgccggtggcgtcgccaccccggccgacgccgcgctgatgcgccagctcggtgccgagggcgtcttcgtcggctccggcatcttcaagtccggcgacccggccaagcgcgccgccgccatcgtgaaggccaccaccttctacgacgaccccaagatcatcgcggacgcgtcgcgcaacctgggcgaggccatggtcggcatcaactgcgacaccctccccgaggccgagcgctacgccaaccgcggctgg

SEQ ID NO: 6809 - DNA, 603 bp, Streptomyces avermitilis
  CDS (1)..(603)
atgaacacccccgtgataggcgtcctggctctgcagggcgacgtacgggagcacctgatcgccctggccgcggccgacgccgtggccagggaggtgaggcgccccgaggaactcgccgaggtcgacggcctcgtcatacccggcggcgagtccaccaccatctccaagctggcccatctcttcggcatgatggaacccctccgcgcgcgcgtgcgcggcggcatgcccgtctacggcacctgcgccggcatgatcatgctcgccgacaagatcctcgacccgcgctcgggtcaggagaccatcggcggcatcgacatgatcgtgcgccgcaacgccttcggacgtcagaacgagtccttcgaggcgacggtcgacgtcaagggcgtcgggggcgatcctgtcgagggcgtcttcatccgcgccccctgggtcgagtccgtgggtgccgaggccgaggtgctcgccgagcacggcggccacatcgtcgccgtacgccagggcaacgcgctcgccacgtcgttccacccggaactgaccggcgaccaccgcgtgcacggcctcttcgtcgacatggtgcgcgcgaaccggacaccggagtccttg

SEQ ID NO: 6810 - DNA, 750 bp, Streptomyces avermitilis
  CDS (1)..(750)
atgtccggccactctaaatgggctacgacgaagcacaagaaggccgtgatcgacgccaagcgcggcaagctcttcgcgaagatgatcaagaacatcgaggtcgcggcccgtacgggcggcgccgacccggccggcaatccgacgctgttcgacgccattcagaaggccaagaagagctcggtcccgaacaagaacatcgactccgcggtcaagcgtggtgccggtctcgaggccggcggcgccgactacgagacgatcatgtacgagggttacggcccgaacggtgtcgcggtgctcatcgagtgtctcaccgacaaccgcaaccgcgccgcctcggacgtccgcgtcgccatgacccgcaacggcggcaacatggccgacccgggctccgtctcgtacctcttcaaccgcaagggcgtcgtgatcgtccccaagggcgagctgagcgaggacgacgtcctgggtgccgtgctcgacgcgggcgccgaggaggtcaacgacctcggtgagtccttcgaggtcgtctccgaggccaccgacctggtcgcggtccgcaccgccctccaggacgccgggatcgactacgactcggcggacgccaacttcgtcccgaccatgcaggtcgagctcgacgaggagggcgcccggaagatcttcaagctgatcgacgcgctcgaggacagcgacgacgtgcagaacgtcttcgccaacttcgatgtcagcgacgaggtcatggagaaggtcgacgcc

SEQ ID NO: 6811 - DNA, 528 bp, Streptomyces avermitilis
  CDS (1)..(528)
gtgcgggtactgggcgttgaccccgggttgacccggtgcggtgtcggcgtggtcgaaggagtcgccggccggcccctgaccatgcgcggtgtcggcgtcgtacggaccccggcggacgccgagttgggcctgcggctcgtggccatcgagcagggcatcgagcagtggctcgacgagtaccggcccgaatgcgtcgccgtggagcgggtgttcagccagcacaacgtgcgtacggtgatgggcacggcccaggccagcgcggtcgccatgctctgcgcggcccgccgcggcatccccgtcgccctgcacacccccagcgaggtcaaggccgccgtcaccggcagcggacgcgccgacaaggcccaggtcggcgcgatggtgacccgcctgctgcggctcgacgcgccgcccaagcccgccgacgccgccgacgccctcgcgctcgccatctgccacatctggcgagcccccgcccagaacagacttcagcaggccgtcgccctgcacgcatcgaaagggcgtaccgca

SEQ ID NO: 6812 - DNA, 609 bp, Streptomyces avermitilis
  CDS (1)..(609)
atgatcgccttcgtcagcggcccggtcgccgccctcgcccccgactccgccgtggtcgaggtcggcggcatcggcatcgccgtccagtgcacccccaacacgctctccgggctgcgcatgggccgggaggccaagctcgccacctccctcgtcgtacgcgaggactcactgaccctgtacggcttcgtggacgacgacgagcgccaggtcttcgaactgctgcagaccgcgagcggtgtcggaccgcgtctcgcccaggcgatgctcgccgtgcacacgcctgacgcgctgcgccgagccgtctccaccggcgacgagaaggccctcgtcgccgttcccggcatcggcaagaagggcgcccagaagctgctgctggagctgaaggaccggctcggcgagcccctcggcaccggtggcccggcgatcggcagggccgtcaccaccggctggcgcgagcagctgcacgccgcgctgatcggcctcgggtacgcgacccgggaggccgacgaggcggtcgccgcggtcgccccccaggccgaggccgccgggggcacaccccaggtgggacagctgctgaaggccgccctgcagaccctgaaccggacccgc

SEQ ID NO: 6813 - DNA, 1068 bp, Streptomyces avermitilis
  CDS (1)..(1068)
gtgaactgggacgacacgaccgacgcgaccgccgacgagcggctcgtcggcgcgtccgccgaccgtgaggaccaggccgtcgaggccgccctgcggcccaaggacctggacgagttcatcggccaggagaaggtccgcgagcaactcgacctcgtcctgcgggccgcacgcgcgcgtggcgcgacctccgaccacgtactgctctccggcgctcccggcctcggcaagaccaccctctccatgatcatcgcggccgagatgggcgccccgatccgcatcaccagcggccccgccatccagcacgccggcgacctcgcggcgatcctctcctccctccaggagggcgaggtcctcttcctcgacgagatccaccgcatgtcccggcccgccgaggagatgctgtacatggccatggaggacttccgcgtcgacgtcatcgtcggcaagggccccggcgccaccgccatccccctcgaactgcccccgttcaccctggtcggcgccaccacgcgcgcgggtctgctgccgcccccgctgcgtgaccgcttcggcttcacggcacacatggagttctacgagccccacgagctggagcgcgtgatccaccgctcggccggcctgctcgacgtcgagatcgactctcgtggcgcggccgagatcgcgggccgctcccggggcacgccccgtatcgccaaccgtctgctgcgccgcgtacgggactacgcccaggtcaaggcggacggcgtcatcacccgtgagatcgcggcggccgcgctgaaggtctacgaggtggacgcccgcggcctcgaccgcctggaccgcggcgtcctcgaagccctgctgaagctgttcggcggcggcccggtcggcctgtccacgctcgccgtcgcggtgggggaggagcgcgagaccgtcgaggaggtcgccgagcccttcctggtacgggagggactgctcgcccgcacaccccgtggccgggtcgcgacaccggccgcctgggcccacctcggcctcaccccgccccctcgggctaccgggggaaacggacaaggggacctgttcggggcg

SEQ ID NO: 6814 - DNA, 501 bp, Streptomyces avermitilis
  CDS (1)..(501)
gtgaataccttgaccctcctcccgttcatcgtgcttatcggggccatgttcctgatgacccgctcggccaagcgcaagcagcagcaggccgcgtcgatgcgtaatgagatgcagcccggcgccggcgtccgcacgatcgggggcctgtacgcgacggtgaaggaggtcaacgaggacacggtcctccttgacgccgccccgggcgtcgacctgctcttcgcgaagaactccatcggcgccgtcctgaccgacgacgagtacaaccgcatcgtccacggcatcgagcacgacctgaagaccgacggcacggtcgtgccggacgacgcctcctccctcaccgagaccgacgagcccgccgccgacgcctcttccgacgcctccgacgacaagcccatcgacctcggcaagaaggacgcggcggacgacaccgccgacgagccgggcaaggcgaagtccgacgaagcagagccgaagaagaccgacggcgagaccgacgcgaag

SEQ ID NO: 6815 - DNA, 1752 bp, Streptomyces avermitilis
  CDS (1)..(1752)
gtggcagcaccgaagaagggccggagcgcgagcgcccagagcaggccggggcgctcgctggccctcatcctgatcgccatcgcggcgctcaccgggggaatgttcgcctccggaaacaccactccgcgtctcggcatcgacctcgccggcggaacgagcatcacgctcgaggcgaagagcggccaggaatccgcgatcaacaagaccaacatgaacaccgcggtcgacatcatgaaccgccgtgtcaacggtcttggcgtttcggaggcggaggtccagacccagggcgatcgcaacatcatcgtcaacatccccaagggcacgaactccgagcaggcccggaagcaggtcggcaccaccgccaagctctacttccgccccgtcctcgcgaccgaggtctccggtgcggccgcggccagcccgacgcccagcgcctccaacagctcctccaagaaggccaccgacaaggccaccgagaaggcgacgtcctccggcaccccgtcggccaccgccacctcgcagggccgcgcggtcaccgacgcgctgaaggacgaccccacgccgtccgcgagcaactcggcgtccgcctccgccaaggcatcctccagcccctccccgtccgcgagcagtggcgccgaggccgaggccgccaagctccaggccgcgtacaccgcgctcgactgccgcaaggaggggcagcgcgccaaggccggtgagggcgccaagcccaccgacaccaccctggcctgcggcacgaactcggggggccagtggcagaagtacgtgctcggcccggccgaggtcgccggcaccgacgtgaagaaggcctcggcggtctacgacacccaaagtggcgcgggctggaaggtcaccatggacttcacgtccggggggtccaagaagttcgcgagcatcacgggcaagctggcgaagaaccaggaaccgcagaaccagttcgccatcgtcctcgacggctcggtcgtctccgacccgcgtgtcagcgaggcgctgaccggcggtaacgcggagatctccggcagcttcgaccagacggaggccaaggacctggccaacgtgctgtcctacggcgcgctcccgctctcgttccgggagcagagcgtcaccaccgtcaccgccgcgctcggcggcgagcagctgcacgccggcctgatcgcgggcgcgatcggcctggccctggtcgtcatctacctggtgctctactaccggggcctgtcgctcatcgccatcgcctcgctgctggtctccgcggccctgacctacgcgatcatgaccctgctcggcccgacgatccacttcgcgctgaacctgccggcggtctgcggtgcgatcgtcgccatcggtatcacagcggactcgttcatcgtgttcttcgaacgcatcagggacgagatccgtgagggccgtacgctgcggcccgccgtcgagcgagcctggccgcgtgcccggcgcaccatcctggtctccgacttcgtgtcgttcctcgccgccgcggtgctgttcatcgtgaccgtcggcaaggtccagggcttcgcgttcacgctgggtctgaccaccgtgctcgacgtggtcgtcgtcttcctcttcaccaagccgctgatgacgatcctcgcccgcaagcagttcttcgcgaacggtcacagctggtccggcctcgacccgaagcgcctcggtgcccagccgccattgcggcgcacccgacgtccttccgcccccgccgacccgaaggaggcg

SEQ ID NO: 6816 - DNA, 1104 bp, Streptomyces avermitilis
  CDS (1)..(1104)
atgtcgaagctcggcaacctcggcgcccggctccaccgaggcgaggtcggctacgacttcgtcggcaaccgcaagatctggtacggcatctcgatcctgatcaccatcacggccatcctcggcctgacggtgcgcggcctgaacatgggcatcgagttccagggcggagcggtcttcaccacccccaagaccagcgtctccgtgtcgcaggccgagaggtacgcggaggaggcgtccggccacgacgcgatcgtgcagaagctcggctcgggcggtctgcgcgtgcagatcgccggtgtggacaccggcaagtccgaccagatcaaggccgagctctcccagaacctgaaggtcgactcggagaagatcaacgccgacctggtcggccccagctggggtgagcagatcgccaacaaggcctggcaaggcctggtgatcttcatgatcctggtcgtgatctacctggcgatcgccttcgagtggcggatggcggtcgcggccctggtcgcgctgatccacgacatcaccatcacggtcggcatctacgccctcgtcggcttcgaggtgacgcccggtacggtcatcggtctgctcacgatcctcggttactcgctctatgacacggtcgtcgtcttcgacagcctcaaggagcagacgaaggacctcaccaagcagactcgctggacctacagcgatgtcgccaaccgctcgatcaacagcactctggtccgctccatcaacaccacggtggtcgcgcttctgccggtcgcgggcctgctgttcatcggcggtggcgtgctcggcgcgggcacgctcaacgacatctcgctgtcgctgttcgtcggtctcgcggccggcgcgtactcctcgatcttcatcgccacgccgctcgtcgccgacctcaaggagcgcgagccgcagatgaaggccctcaggaagcgcgtcctggccaagcgggcccaggccgccgccaagggcgaggacgccgaggtcgtcggtcagtcctgcgacgagccggacgacgccgcccccgcggtcgtgggtccgcgcaaccagcccgcgtcccgcaaccggggccgcggccgaccctcggggaagcgccga

SEQ ID NO: 6817 - DNA, 546 bp, Streptomyces avermitilis
  CDS (1)..(546)
atgaccgagctcgtcaacatcacggagctgctgctcagccgtatccgtgacgttcgtgactacccggagccgggcgtggtgttcaaggacatcacgccgctgctggccgacccggcggcgttcaccgcgctgaccggtgcgctggccgagctcaccgtgcggcacggcgccacgaagatcgtcggcctggaggcccgcggcttcattctgggcgccccggccgccgttcaggcgggtgtcggcttcatccccgtacgcaaggcgggcaagctccccggagcgaccctcagccagtcgtacgacctggagtacggctccgccgagatcgaggtgcacgccgaggacctggtcgcgggcgaccgcgtcatggtcgtcgacgacgtcctcgccaccggcggcaccgccgaggcctcgctccagctcatccgccgggcgggcgccgaggtcgcgggcgtctccgtgctcatggagctgggcttcctgggcggccgggcacggctggagccggccctggccggcgccccgctggaagcactgctccagatc

SEQ ID NO: 6818 - DNA, 2535 bp, Streptomyces avermitilis
  CDS (1)..(2535)
ttgccagacgaggcccagccactcaccgccgccaagcccgaccagacttcgggccccgcggccacgcccgcgaagaacgccgcgcaggggccggtcgagcgtgccccgtccgcgcccggcgacaaggcggcagagcagccccgccccaagtccgccacccccgctcctcccgagcgccccgcagccacgcccgcggcgcgtgccaccacaggccagccggcccgctccggcggctcctccaaccgcgtacgcgcccgcctcgcccgtctcggcgtccagcgctccaacccgtacaacccggttctggagccgttgctgcggatagtgcgcagcaacgacccgaagatcgagacgtcgacgctgcgccagatcgagcgcgcctaccaggtcgccgagcgctggcaccgcggccagaagcgcaagagcggcgacccgtacatcacgcacccgctcgccgtcaccaccatcctcgccgagctgggcatggacccggcgaccctcatggcgggcctgctgcacgacaccgtcgaggacaccgagtacggcctcgacaccctccgccgtgacttcggcgaccaggtcgccctcctggtcgacggcgtcaccaagctggacaaggtcaagttcggcgaggccgcgcaggccgagaccgtgcgcaagatggtcgtcgccatggccaaggacccgcgcgtcctggtcatcaagctcgccgaccgcctgcacaacatgcgcaccatgcgctacctcaagcgcgagaagcaggagaagaaggcgcgcgagaccctcgagatctacgcgccgctcgcccaccgcctgggcatgaacaccatcaagtgggagctggaggacctcgccttcgcgatcctctaccccaagatgtacgacgagatcgtccgcctggtcgccgagcgcgcccccaagcgcgacgagtacctcgccatagtgaccgacgaggtccagtccgacctgcgcgcggcccgcatcaaggcgacggtcaccggccgcccgaagcactactacagcgtctaccagaagatgatcgtccgcggccgtgacttcgcggagatctacgacctggtgggcatccgcgtcctcgtggacaccgtccgcgactgctacgcggcgctcggcacggtgcacgcgcgatggaacccggtccccggccggttcaaggactacatcgcgatgcccaagttcaacatgtaccagtcgctgcacacgacggtcatcgggcccaacggcaagcccgtcgaactccagatccgtacgttcgacatgcaccgccgcgccgagtacggcatcgccgcgcactggaagtacaagcaggagccctccgccggcgcctccaaggtgcgcacggacgccccgaagagcgtgggcaaggacaaggacgccgtcaacgacatggcgtggctgcgccagttgctcgactggcagaaggagaccgaggacccgagcgagttcctggagtccctgcgcttcgacctgtcgcgcaacgaggtcttcgtcttcaccccgaagggcgacgtcatagcgctgccggccggagcgacgccggttgacttcgcgtacgccgtccatacggaggtcggccaccggaccataggagcgagggtcaacggacgcctcgtacccctcgagtccaccctggacaacggcgacctggtggaggtcttcacctcgaaggcggccggagcgggcccgtcccgcgactggctgggcttcgtgaagtcgccgcgcgcccgcaacaagatccgcgcctggttctccaaggagcggcgcgacgaggcgatcgagcagggcaaggacgcgatcgcgcgggcgatgcgcaagcagaacctgccgatccagcgcatcctcaccggggactcgctggtgacgctcgcgcacgagatgcgctaccccgacatctcgtccctctacgcggccatcggcgagggccacgtcgccgcgcagagcgtcgtgcagaagctggtgcaggcgctcggcggcgaggaagcggccaccgaggagatcgacgagagcgtcccgccggcccgtggccgcggccgcaagcgccgctccaacgccgacccgggtgtcgtcgtcaagggcgtcgacgacgtgtgggtcaagctggcccgctgttgcacgcccgtccccggcgaccccatcatcggcttcgtcacccgcggtagcggcgtatcggttcaccgcaacgactgcgtgaacattgagtcactgtcccgcgagcccgagcgcatcctcgaggtcgagtgggcgccgacccagtcctcggtcttcctggtcgccatccaggtggaggcgctggaccgctcccggctcctgtcggacgtcacccgcgtcctgtccgaccagcacgtcaacatcctgtcggcggccgttcagacgtcccgcgaccgggtcgccacgtcccgcttcaccttcgagatgggcgacccgaagcacctgggacacgtcctgaaggcggtcaggggcgtggagggcgtgtacgacgtgtaccgggtgacctcggcccggaggccctccgacgcc

SEQ ID NO: 6819 - DNA, 1227 bp, Streptomyces avermitilis
  CDS (1)..(1227)
gtgagcagcgacccgtggggccgcgtcgacgagacggggaccgtgtacgtgcgtacggccgacggcgagcaggtcgtcggttcctggcaggccggctcccctgatgaggcactggcctacttcgagcgcaagtacgagggcttggttgtcgagatcggcctcctcgaaaagcgagtgaagaccaccgacctgtcggcgaaggacgcccagaccgccatcgaccatattcgcgaacaggtggacgcccaccacgcggtcggcgatctggacgtactgcgcaagcggctggacaagctcgtcgagaccgtcgcggcacgccgtgaggagcgcaaggcgcagcgggcgaagcagtccgacgaggcgcggcacgccaaggagtcgctggtcgtcgaggcggaggagctggcccagtccgaccagtggcgggccgccggtgagcggctgcgttcgctggtggacacctggaaggggctgccgcggctcgatcgcaagtcggacgacgagttgtggcaccgcttctcgcacgcccgctcggcgttctccaagcgccgcaaggcgcacttcgcctcgctggacgcgcagcgggaggacgcccgcaaggccaaggagaagctggtcgcggaggccgaggcgctgtccggctcgacggactggggtccgacggcggcacgctaccgcgagctgatgggcgactggaaggccgcgggccgggcccagcgcgagcacgaggacgacctgtggaaccgcttccgcggtgcccaggacgtgttcttcgcggctcgtagctcggtcttcgcggagcgggacgccgagcagtccgagaacctgaagctcaaggaggagctggccgaggaggcggagaagttgctgccgatctcggacctgaaggcggcccgcgcggccttccgctccctcaacgagcggtgggaggccatcggccatgtgccgcgggacgcccgcccgaaggtggagggccggatgcatgcggtggagcgtgccctccaggagtccgaggaggtggagtggcgccggacgaacccggaggcacgcgcgcgtgccgagggtctgaccggtcagctccaggccgccgtggacaagctccagggccagatcgaggcggcgcgctccgcgggcaacaacgccaaggccgacaagctccagaaggagctggacggccgccaggcgctgctggaccaggcgctgaagggtctgcacgagttcggcggc

SEQ ID NO: 6820 - DNA, 831 bp, Streptomyces avermitilis
  CDS (1)..(831)
atgaggagaaacccggtggtcacccaggaacagcggcgacgtcagctcgcccgggagaagttcttgcggcagcagcagcggcgtacggccgcgcggcgcaagacacggatgcgcaacacggtggtcgcctcggtcctgggcgtcgtcgtggtgggcagcgtggtgtcgtacgcgaccggggtcttcaaggacgacggcaaaaaggccaacgcgggcgcggaggtgtccccgagcccctcgccgagcaaggcgccggacccgtgcgagaaggccgccgcgggcaaggtgaagtcgctgagctggaagaaggagccggcggtcaccatcgacaagtccgccgactacacgatgaagatggcgacgacctgcggcgacatagacatcgccctgaagacggcgcaggccccgcacacggtgaactccttcagcttcctcgcgggcaaggggttcttcgaccacaccaagtgccaccggctcaccacgaacggcatctacgtgctgcagtgcggtgacccgaagggcaccggaagcggcggccccggctacacgatcccggacgagaacctcaaggacaaaaccctgaagggcggcatgtacccggcgggcacggtggccatggccaacaccggccagaagcacacgggcggcagccagttcttcctcgtctaccaggacagtcagctgccggccagctacacccccttcgggacgatctccacgtcgggcatgaaggtgctgaagaagatcgccgcggccggtgagagcactggccagggcgacggggcgcccaacgcgacggtcgtggtcaacagggcgaccgtgacgaaatcc

SEQ ID NO: 6821 - DNA, 705 bp, Streptomyces avermitilis
  CDS (1)..(705)
gtgctcattgccgggttccccgccggggcctgggggaccaactgttatctggtcgcccccgccgcgggtgaggagtgcgtgatcatcgacccgggccatcaggccgcccagggagtcgaggacgcgctcaagaagcatcggctcaagcccgtcgccgtcgtcctcacccatggccacatcgaccatgtggcctcggtcgtcccggtgtgcggcgcgcacgacgtaccggcctggatccatcccgcggaccggtacatgatgagcgaccccgagaaggcgctcggccgttccatcggcatgccgctcatgggcgaactgaccgtgggggagccggacgacgtgcgggaactggccgacggcgccgggctgaagctcgcgggcctcgacctctccgtcgcgcacgcgcccggccataccaaggggtcggtgaccttcacgatgcccgagagcgcggacattccgtccgtgttcttctccggggatctgctgttcgccggctccatcggacgcaccgacctgcccggcggcgacatggacgacatgctcggctcgctgacccgcgtgtgcctgccgctcgacgactcgaccgtggtgctgtccggccacggcccccagacgaccatcggccaggagcgcgccaccaacccctatctgcggcaggtggccgccggcctcgggagcgtggacgctccccgacgaggaatg

SEQ ID NO: 6822 - DNA, 1260 bp, Streptomyces avermitilis
  CDS (1)..(1260)
gtgagcaccttcaaggcccccaagggcacgtacgacctgattcctccggacagcgcgaagtacctcgccgtgcgcgaggccatcgccgccccgctgcgcaactccggttacggctacatcgagacgcccggcttcgagaacgtcgagctgttcgcgcgcggtgtcggtgagtccaccgacatcgtgaccaaggagatgtacgccttcgagaccaagggcggcgacaggctggccctgcgccccgagggcaccgcctccgtgctgcgcgcggccctggaggccaacctgcacaaggcgggcaacctgccggtcaagctctggtactcgggttcgtactaccgctacgagcgcccccagaagggccgctacaggcacttctcgcaggtcggcgccgaggcgatcggcgccgaggacccggcgctcgacgccgaactgatcatcctggcggaccagtcgtaccgctcgctgggtctgcgcaacttccggatcctcctcaactccctgggcgacaaggagtgccgcccggtctaccgggccgcgctgcaggacttcctgcgcggcctcgacctggacgaggacaccctccgccgcgccgagatcaacccgctgcgggtcctcgacgacaagcgggaggacgtccagaagcagctcgggggcgctccgctgctgcgggactacctgtgcgacgcgtgcaaggcgtaccacgaggaggtgcgcgagctgatcactgcggcgggtgtctccttcgaggacgacgcgaagctggtgcgcggtctggactactacacgcgtacgaccttcgagttcgtccacgacggtctgggctcccagtccgcggtgggcggcggcggccgctacgacggactgtcggagatgatcggcggccccgcgctgccgtccgtcggctgggcgctgggcgtcgaccgcacggtcctcgccctggaggcggagggcgtcgagctcgaactcccctcgtccaccagcgtgttcgcggtgccgctcggggaggaggcccggcggatcctgttcgccaaggtcaccgagctgcggaaggtgggcatcgcggcggacttcgcgtacggcgggaagggcctgaagggcgcgatgaagaacgcgaaccggagcggggcgcggtacacggtcgtggcgggggagcgggatctcgccgagggtgtcgtgcagctcaaggacatggagtccggcgagcagacggcggtcggggtgaacgagatcgtggcggagctcgaggcacggctcggc

SEQ ID NO: 6823 - DNA, 636 bp, Streptomyces avermitilis
  CDS (1)..(636)
gtgatgagcaagacgcgagtcaagaacgtctccaccgagccggaagctgccgacacaccacggacggtgggcggcagtcgcgcgttcggtctgctgctggtgatcaccggtgcggccgggctgctcgccgcatgggtcatcacgatcgacaagttcaagctgctggagaacccgaacttcgttcccggctgcagcctgaacccggtcgtctcctgcggcaacatcatgaagagcgagcaggcctccgccttcgggttccccaacccgatgctggggctcgtcgcctacggcatggtgatctgcgtcggtgtgagcctgctcgcgcgggccaccttcccgcgctggtactggctgaccttcaacgccggcacgctgttcggcgtcggcttctgcacctggctgcagttccagtcgctgtaccggatcaactcgctgtgcctgtggtgctcgctggcgtgggtcgccacgatcctcatgttctggtacgtgacctcgttcaacgtccgcaacgacttcctgcccgcgccccgctggctgaagagcttcttcggcgagttcacctgggtgctgccggtcatgcacatcgggatcatcggcatgctgatcctgacgcgctggtgggacttctggaccggc

SEQ ID NO: 6824 - DNA, 1359 bp, Streptomyces avermitilis
  CDS (1)..(1359)
ttgcgagtggagcccgacctgtttaccgccgcagcagaagaacgccaggagaaggacccgtccagcagccccctggcggtgcggatgcgcccgcgcaccctcgacgaggtcgtgggtcagcagcatctgctgaagccgggctcacccctgcgcagactggtcggggaaggcagtggaggcccggccggaccgtcctcggtgatcctctggggcccgcccggcaccggcaagacgaccttggcgtacgtggtctccaaggccaccaacaagcgcttcgtggagctgtcggcgatcaccgcgggcgtgaaggaggtgcgcgcggtcatcgacggcgcccgccgcgccaccggcggcttcggcaaggagaccgtcctcttcctcgacgagatccaccgcttcagcaaggcccagcaggactccctgctcccggccgtcgagaaccgctgggtgacgctgatcgccgcgaccacggagaacccgtacttctcggtgatctccccgctcctgtcccgctccctgctcctcaccctcgaaccgctcaccgacgacgacctgcgcggactgctgcgccgggcgctcaccgacgagcgcggtctcaaggaggccgtcaccctccccgccgacaccgaggaacacctgctccggatcgccggcggagacgcccgccgcgcgttgaccgccctggaggccgcggccggcgcggcactcgacaagggcgagccggagatcggcctccagaccctggaggagaccgtcgaccgcgccgccgtgaagtacgaccgcgacggcgaccagcactacgacgtggcgagcgcgctgatcaagtccatccgcggctcggacgtggacgccgcgctgcattatctggcccggatgatcgaggccggcgaggacccccgcttcatcgcccggcgcctgatgatctccgccagtgaggacatcggcctgaccgatccccacgcgctgccgacggcggtcgccgccgcccaggccgtcgccatgatcggcttcccggaggccgccctcaccctcagccacgcgacgatcgccctcgccctggcgccgaagtccaacgccgcgaccatggcgatcggcgccgccatggaggacgtacgcaagggccatgcgggacccgtgccgctccacctgcgggacgggcactacaagggcgcggccaagctcgggcacgcccaggggtacgtgtacccgcacgacctgcccgagggcatcgccgcccagcagtacgccccggaggagctcaaggaccgggagtactacacacccacccggcacggcgccgaggcgcgctacgcggacgcggtggagtggaccaggaagcacctcggtcgaggacggccc

SEQ ID NO: 6825 - DNA, 612 bp, Streptomyces avermitilis
  CDS (1)..(612)
gtggcgaatcagtcccgccccaaggtcaagaagtcgcgtgccctcggcatcgcgctgaccccgaaggccgtcaagtacttcgaggcccgcccctacccgccgggcgagcacggccgcggccgcaagcagaactcggactacaaggtccgtctgctcgagaagcagcgtctgcgcgcgcagtacgacgtgtccgagcgccagctcgtccgcgcctacgagcgtgccgccaagacgcagggcaagaccggtgaggccctggtcatcgagctcgagcgccgtctcgacgcgctggtcctgcgttcgggcatcgcccgcacgatctaccaggcccgccagatggtcgtccacggccacatcgaggtcaacggccagaaggtcgacaagccgtccttccgcgtcaagccggacgacgtcgtcatggtgcgtgagcgcagccgtcagaagccgctgttcgaggttgcccgtgagggtggcttcgcccccgacggcgagaccccgcgctacctccaggtgaacctccgcgccctggccttccgcctggaccgcgagccgaaccgcaaggagatcccggtgatctgcgacgagcagctcgtcgtcgagtactacgcccgc

SEQ ID NO: 6826 - DNA, 453 bp, Streptomyces avermitilis
  CDS (1)..(453)
gtgcacacagtgtccggtggagaggtggccgggatcctggtggccgtcttctgggcgatcctggtctccttcctcgccgtcgcgctggcgaggctggcccagacgctcaaggcgaccaccaaactcgtcgcggacgtgaccgaccaggcggtgccgctcctcgcggacgcctcgacggccgtgcgctccgcccagacccagatcgagcgggtcgacgccatcgcctcggacgtccaggaggtcacgtcgaacgcgtcggcgctgtcgaccaccgtcgcctccaccttcggcggccccctggtcaaggtcgcggcgttcggctacggcgtgcgccgggcgctcggcagccgccgcgagaacgtgccccccaagacgccccggcgtaccgtgatcgtgggccgccccgtcccgtccgcgcgacgcgagaagcgggacaaccggaataagagggac

SEQ ID NO: 6827 - DNA, 348 bp, Streptomyces avermitilis
  CDS (1)..(348)
atgttccgccgtacgttctggttcaccgcgggcgctgccgccggtgtgtgggccaccaccaaggtcaaccgcaagctcaagcagctgacgcccgagagcctcgccgcgcaggccgcgaacaaggcgatcgaggcgggccacaaactcagggacttcgcactcgacgtccgcgacggcatggcccagcgggaggccgagctcggcgaggtgctcgggatcgacgcggaccccgaactcccgggcccgcggcgcatcgccgccatcgagaacagcaacaacccgaagtacagcaaggacccgaggtacgtcgagaggtcgacgtactcgcacaaccggaatgaggaccac

SEQ ID NO: 6828 - DNA, 2670 bp, Streptomyces avermitilis
  CDS (1)..(2670)
atggagtcggccgagattcgccgccgctggttgagcttctacgaggagcgcggtcacaccgtcgtcccctcggcgtcgctcatcgcggacgacccgactctgctcctggttcccgcgggcatggtccccttcaagccgtatttcctcggtgaggtcaagccgccgtggccgcgcgccaccagcgtgcagaagtgcgtgcgcacgcccgacatcgaagaggtcggcaagaccacgcgccacggcacgttcttccagatgtgcggcaacttctccttcggcgactacttcaaggaaggcgccatcacctacgcctgggagctgctcaccacgccccaggacaagggtggttacgggctcgacccggagcgcctgtggatcacggtctacctcgacgacgacgaggccgagaccatctggcgcgacaagatcggcgtcccggccgagcgcatccagcgcctcggcaagaaggacaactactggtccatgggcgtccccggcccctgcggcccgtgctccgagatcaactacgaccgcggccccgagttcggcgtcgagggcggcccggccgtcaacgacgagcggtacgtggagatctggaacctggtcttcatgcagtacgagcgcggcgagggcacctcgaaggacgacttcgagatcctcggcgacctgccgcagaagaacatcgacaccggcctcggcatggaacgcctcgccatgattctgcagggtgtgcagaacatgtacgagatcgacacctccatggccgtcatccagaaggccaccgagctgaccggcgtcgagtacggtgccgcccacggctccgacgtctcgctgcgcgtggtcaccgaccacatgcgtacgtccgtgatgctcatcggtgacggcgtcacgccgggcaacgagggccgtggttacgtgctgcgccgcatcatgcgccgcgccatccgcaacatgcgtctgctcggcgccaccggtccggtcgtcaaggacctcgtcgacgtcgtgatcgcgatgatgggccagcagtacccggagctcatctccgaccgtcagcgcatcgagacggtggccctcgccgaggaggccgccttcctcaagacgctgaaggccggcacgaacatcctcgacaccgccgtcacggagaccaaggcctccggcggccaggtcctgcccggcgacaaggccttcctgctccacgacacctggggcttcccgatcgacctcaccctcgaaatggccgccgaacagggcctttccgtggacgaggacggcttccgccgcctgatgaaggagcagcgggagcgcgccaaggccgacgcccagtccaagaagaccggccacgccgacctcggtgcctaccgcgagatcgccgacgccgccggcgagaccgacttcatcggctacacgcagaccgagggcgagtccacgatcgtcggcatcctcgtcgacggtgtctcctcgcccgccgccaccgagggcgacgaggtcgagatcgtcctggaccgcaccccgttctacgccgagggcggtggccagatcggcgacaccggccgcatcaaggtggagagcggcgcgatcatcgaggtccgcgactgccagaagccggtcccgggcgtgtacgtccacaagggcgtcgtccaggtcggcgaagtcaccgtcggagccaaggcccaggtctccatcgacgtccgccgtcgcaaggccatcgcccgcgcccactcggccacgcacctcacgcaccaggccctgcgcgacgccctcggcccgacggccgcccaggccggttccgagaaccagcccggccgcttccgcttcgacttcggctccccgtcggcggtacccacgaccgtgatgaccgacgtcgagcagcagatcaacgaggtgctcgcccgcgacctggacgtccaggccgaggtcatgagcatcgacgaggccaagaagcagggcgccatcgccgagttcggcgagaagtacggcgagcgcgtgcgggtcgtcaccatcggcgacttctccaaggagctgtgcggcggtacgcacgtccacaacaccgctcagctgggcctggtgaagctgctcggcgaatcctccatcggctccggtgtgcgccgtatcgaagccctggtcggcgtcgacgcgtacaacttcctcgcccgggagcacacggtcgtcgcccagatccaggagctggtcaagggccgtccggaggagctgccggagaaggtctccgccatgctcggcaagctgaaggacgccgagaaggagatcgagaggttccgcgcggagaaggtgctccaggccgccgccggtctcgtcgactccgccaaggacgtccgcggaatcgcgctggtcaccggccaggtcccggacggcacgaccgccgacgacctgcgcaggctggtcctcgacgtgcgcggccgcatccagggcggacggcccgccgtggtcgccctgttcaccacggtgggcgggaagccgctgacggtcatcgccaccaacgaggccgcccgtgagcgcggtctcaaggccggcgacctggtccgtgcggccgccaagacccttggcggcggcggtggcggcaagccggacgtagcccagggcggcggccagaaccccgccgccatcggggaggccatcgacgccgtcgagcgcctggtcaccgagaccgccaag

SEQ ID NO: 6829 - DNA, 468 bp, Streptomyces avermitilis
  CDS (1)..(468)
gtgggtatgcgcagaggacgtcggctcgcggtcgacgtcggggacgcccgcatcggggtcgcctcgtgcgaccccgacgggatcctcgcgacgccggtggagacggtcccggggcgtgacgttccggccgctcatcgccggttgaagcaactcgtcgaggagtacgaaccgatcgaggtcgtcctcgggctccctcgctccctcaaggggggcgagggcccggccgcggtcaaggtccgcgccttcgcccaggagctcgcccgcgtgatcgcaccggtcccggtgcggctcatggacgagaggatgaccacagtgacggccagtcagggactgcgcgcctcgggcgtgaagtccaagaagggcaggtccgtcatcgatcaggcggccgctgtgatcattcttcagcaggcgttggaatccgaacgggtgtcaggtaaagctcccggtgagggcgtcgaagtggtcatc

SEQ ID NO: 6830 - DNA, 1815 bp, Streptomyces avermitilis
  CDS (1)..(1815)
atgactgagtatggccggggcccaggctccgaaccgtggcatccggaggacccgttgtacggggacggcggatggggaggacaggagccccacgcggcccagtccgcctacggcggccagccgcagcactatccgcagcagccgcagcagcagtacggcgactggggcaacggccagcaggccgggtacgaccagggcgggcagcagtacgagcagcagtacgcggaccaggggcagcagtacccccagcagaacgcggcccagcagcagtaccagcagcacgccgcccaggggcagcagcacaacccccagaatcaccagcagcacgaccctcaaggtcagcagcagcacaacccccaaggtcagcagcagtatgccgaccagactcatcagcagtacggcaacggcggctgggagaccggggcgcacccccaggtcccgtatgccgccgatccggccgacccgtacggggggcagcccgccgcgtacagcggtgagcagcccgacttctacggcacgcccgacgcctacccgcccccggagccgcccggtcggcgccgcgccgagcccaagcccgagcccgagccggagaccgactgggacccgggccccgatgagggagaacacgccttcttcgcgggcggcggcgacgatgacgacgacctcgacgacgaggccaagggccgcggcggacgaggtgaccgccgtggccgtggcgatggcaaggcaaagaagcgccgcaacggatgcgcctgcctggtggtcgtgctggtgttcggcggtggcctcggcggtgtcgggtactacggctggcagttctaccaaaatcgtttcggcgcggcacccgactacgcgggggacgggacgggcgagcaggtgaccgtcgtcatcccgaagggtgccttcgggtcggtgatcggccagaagctggaggaggccggggtcgtcaagagcgccggggccttcgtctccgctcaggcgacgaatcccgacggggacaagatccagccgggcgcgtacacgctcaagaaggaaatgtccgcgaagagcgccgtcgagctcatgctcagccccaagagcaagaacaacctgacggtctacgagggccagcgcaacgcgcgggtctacaccgcgatcgacacgcgtctcggagtcaaaaagggaaccaccaagggcgtcgccgagaaggaatggtcgaccctcgggctcccggactgggcgaacaccgacaaggacatcaaggacccgctggagggattcctctacccgtccacctatccggtctccaagggcatgaagcccaaggacgtcctgaaggaaatggtcaacctggccaaggacaagtacgccgcactgggcatccaggcgaaggccaaggacctgaacctgaagaatccgctccaggtcctgacggtcgcgagcctcgtccagtccgaaggaaactccaagaacgacttcgaaaaggtcgcgcgggtcgtctacaaccgtctgaagccggacaacaccgagacctacggcctcctcgacttcgactccacggtgaattacctgcgcggcgaatccaagctcgccaccggttcggtcaacgacctgcggaagatcaacgacccgtacaacacctacaagatcaagggtctgccgcccggaccgatcagcaaccccggtgatgtggcgatcaacgcggccctcaatccggccaagggcaactggtactacttcgtttcgatcagcgcggacaagacgcttttcgccgagaccaacgaagagcagaaccgcaatcgcgagaagtacctcgaagagcagaagaacggacaa

SEQ ID NO: 6831 - DNA, 834 bp, Streptomyces avermitilis
  CDS (1)..(834)
atgacgggcaccgacagcaagcgccgagccgccgtactcgggtcccccatcgcccactccctctccccggtgctgcaccgcgccgcgtacgccgagttgaggctgagcgactggtcgtacgaccggttcgacgtggacgaggaggcgctgcccgccttcttcgggaagctcgggcccgagtgggcggggctgtcgctgaccatgccgctgaagcgggccgtcatcccgctgctcgacgagatcaccgagaccgccgcgtcggtggaggccgtgaacaccgtggtgtgcacgcgggacgggcggcgcgtcggcgacaacaccgacatcccggggatggttgcggccctgcgtgagcggggcatcgagcaggtcgactccgccgcgatcctcggcgcgggcgccaccgcctcgtccgcgctggccgcgctcgcccggatctgcaccggtgaggtcgtcgcgtacgtccgcagcgaggcgcgcgccgccgagatgcggcagtggggcgaacggctcgacgtcgaggtgcgtaccgaggactgggcgcaggcggccgaggcactgcgggccccgctggtcgtcgccaccaccccggccggtgcgacggacgcgctggccgccgccgttccggagcggcccgccacgctgttcgacgtgctgtacgacccctggcccaccgacctggccgcgcgctggtccgcgtacggcggcgccgtcgtcagcgggctggacctcctggtccaccaggcggtgctccaggtcgagcagatgacggggcgctcgccggctccgctggacgccatgcggcgggcgggggagcacgcgctggcggcccgg

SEQ ID NO: 6832 - DNA, 1182 bp, Streptomyces avermitilis
  CDS (1)..(1182)
ttgagcaggttgcgctggctgaccgcgggggagtcccacggtcccgcacttgtcgcgacgctggagggccttcccgccggcgtgcctatcaccacggacatggtggcggaccacctggcccggcggcgcctgggctacgggcgcggtgcccgcatgaagttcgagcgcgacgaggtcaccttcctgggcggcgtccgtcacggtctcaccctcggctcgccggtcgcgatcatggtcggcaacaccgagtggcccaagtgggaacaggtcatggcggccgacccggtggatccggccatcctcgccgacctcgcgcgcaacgcgccgctgacccggccccggcccggtcacgccgacctcgccggcatgcagaagtacggcttcgacgaggcccgcccgatcctggagcgcgcctccgcccgcgagaccgcggcccgtgtcgcgctcggcgcggtggcccggtcgtacctgaaggagacggccgggatcgagatcgtctcgcacgtggtcgagctggccgccgccaaggccccgtacggcgtctacccgacccccgccgacgtcgagaagctcgacgccgacccggtgcgctgcctcgacgccgacgcgtcgaaggcgatggtcgcggagatcgaccaggcccacaaggacggcgacaccctcggcggtgtggtcgaggtcctcgcgtacgacgtaccggtgggcctcggctcgcacgtgcactgggaccggcgtctggacgcccggctcgcggccgcgctcatgggcatccaggcgatcaagggcgtcgaggtcggcgacggcttcgagctggcccgggtgccgggctccaaggcgcacgacgagatcgtgcagaccgccgacggcgtcaggcgtaccaccggccgctccggcggcaccgagggcgggctgaccaccggtgagctgctgcgggtgcgcgccgcgatgaagccgatcgcgaccgtgccgcgcgcgctggccaccatcgacgtggccaccggcgaggccaccaaggcccaccaccagcgctccgacgtgtgcgcggtcccggccgccggcatcgtcgccgaagccatggtggcgctggtcctggccgacgcggtggccgagaagttcggcggcgacagcgtcccggagacccggcgcaacgtccgctcgtacctcgacaacctggtcgtgcgg

SEQ ID NO: 6833 - DNA, 513 bp, Streptomyces avermitilis
  CDS (1)..(513)
gtgaccgttccgcgcgtcgtcctcgtcggccccatgggcgtcggcaagtccacggtgggcgcgctcgtcgccgagcggctcggctgcgcctaccgggacacggacgacgacatcgtgaccgccgagggccgcaccatcgccgacatcttcgtcgacgagggcgagccggtcttccgtgccatcgagaagcgggcggtgcacacggcgctcgccgagcacgacggcgtactggcgctcggcggcggcgcgatcctcgacgcggacacccgcgcgctgctcgccgggcaccgtgtcgtctacctctcgatggaggtcgacgaggccgtcaagcgcaccggcctcaacgcggcccggccgctgctcgccgtcaacccgcgccggcagtggcgggagctgatggaggcgcgccgccacctgtacaccgaagtcgcccgcgcggtggtcgccaccgacggccgcggccccgaagaggtcgcccaagccgtcctcgacgcactggagttgaaggaagca

SEQ ID NO: 6834 - DNA, 1089 bp, Streptomyces avermitilis
  CDS (1)..(1089)
atgagcgaggcagtcacccggatccacgtcggcggtaccgcggggacggacccgtacgaggtgctggtcggccgacagctcctgggcgaactcgccggtctgatcggggacagggtcaagcgcgtcgccgtcgtccaccccgaggcgctcgccgagaccggtgaggcgctgcgggccgacctggccgagcaggggtacgaggccgtcgccatccaggtgccgaacgcggaggaggccaagaccgtcgaggtcgccgcctactgctggaaggcgctcggccagtccgggttcacgcgcaccgacgtgatcgtcggcgtgggcggcggcgccaccaccgacctcgccggattcgtcgccgccacctggctgcgcggcgtgcgctggatcgccgtccccaccaccgtcctcggcatggtcgacgcggccgtcggcggcaagaccggtatcaacaccgccgagggcaagaacctcgtcggcgcgttccacccgcccgcgggcgtcctgtgcgacctcgcggcgctggactcgctgccggtcaacgactacgtctccgggctcgccgagatcatcaaggccggcttcatcgccgacccggcgatcctggagctcatcgaggccgacccgcaagcggcccgcactcccgcgggaccgcacaccgccgagctgatcgagcgctccatcaaggtcaaggccgaggtcgtctccggcgacctcaaggagtcgggcctgcgcgagatcctcaactacggccacaccctcgcgcacgccatcgagaagaacgagcgctacaagtggcggcacggcgcggccgtctccgtaggcatgcacttcgccgccgaactcggccgtctggcaggccggttggacgacgcgacggcggaccggcaccgcacggtcctggaatcggtcgggctgccgctgcactaccgctacgaccagtggcccaagctgctcgagaccatgaaggtcgacaagaagtcacgcggcgacctgctccgcttcatcgtcctcgacgggctcgccaagcccaccgtcctcgagggcccggacccggccgtcctgctcgccgcgtacggcgaagtgggggag

SEQ ID NO: 6835 - DNA, 888 bp, Streptomyces avermitilis
  CDS (1)..(888)
atgcagcacgcagtgggaggtccgctgccgccgccccaccacgcggggcaccaaccggcgaccggttggttgtcggccgcacatcacccgggcgcgcacccgggtcccgcgccggcgcccccgccaggtccggcaccggcgcccccgcccggtttcgcgggcgcgccggtgcctccggggccgccgcacacgcaggtcccgcagcatcacgcgcccccgcagcacgtccccgtgccgcccgcgccggacaccacgggccatgtgcagctaccgcccggcggcccggtccccatgccgagcaccccgcccgccgtgggtccggccgacgccacgtccaccacactcgccgtgctgctcatcggccccgcgggcgccggaaagacgagcgtcgccaagtactgggcggaccaccgccgggtccccaccgcgcacatcagcctcgacgacgtacgcgaatgggtgcgctcgggcttcgccgacccgcagtccgggtggaacgaccattcggaggcgcagtatcgtctcgcccgccgcacctgcggcttcgcggcccgcaacttcctggccaacggcatctcgtgcatcctcgacgacgcggtgttcccggaccgcccggtcgtcggcctcggtggctggaagcgacatgtcggtccggggctgctgcccgtggtgctcctcccgggcctcgagatagtcctggagcgcaacgccgagcgctccggaaaccgccgtctcaccgacgaagaggtcgcccgtatccacggccggatggccggctggtacggatccgggctgccgatcatcgacaattcccagctcgacgtaccggcgacggcccgtgtcctcgacgaggtgctggcccgctccatcgcgagcccgccgcagtgg

SEQ ID NO: 6836 - DNA, 1104 bp, Streptomyces avermitilis
  CDS (1)..(1104)
atgtcagaggtgtacgcggcccgccgggagcggctacgggaacggtgtacggcgggtggcagcgcggcggcgttgatctcccgtcccgccaatgtccgctatctcgcgggcgccgcgccgcagggcgccgtactgctgctgggcaagggcgaggacctgctgctgtgcacgggtccgcccggcgaccagcccgcccagggccggctcgacgaggcgctgcgggtgcagctgctggagcggcccggcggtgatccggcggtcgcggcggcggactgcgccggtgcgcagggcgccgagtcgctggcggtcgaggagcaccacctcaccgtcgcccggcaccgggccatcagatcggtggcgccccggctgcgccttgccgatgtcgggggcgcggtcgagcagctgcgcgtggtgaaggacgaggaggagatctccttcctgcggatcggcgcggagatcgccgaccaggccctcggtgaactgctcgaatcgatcctcgtcggccgcaccgagcgccatctcgctctcgaactggaacgccggctcgtggaccacggggccgacgggcccgccttcccgacctccgtcgccaccggcccgaactccggccggcgcggtcaccggcccaccgaccggcgggtggaggagggcgacttcctctccgtctgcctcggcgcgacgtaccacggctaccgctgtgagatcggccggaccttcgtcatcggcacctcgcccgccgaatggcagatcgagctgtacgacctggtcttcgccgcccagcgggccggacgtgaggcgctggcacccggcgccgcctaccgtgatgtggaccgcgcggcccgccaggcgctggagtccacgggccatgcggaaggccttccgccgctgaccggacacggtgtggggctcgaaatcgacgaggacccgcagctggcccccgcggccatgggtaaactggacgcttgcgtgccggtcaccgtcgaaccgggggtccacctcccgggccggggcggtgtcaggatcgatgacacgctcgtcgtacgccccgaggcggacggcggacccgagctactcaccatcacgaccaaggaactgctcgcgctc

SEQ ID NO: 6837 - DNA, 564 bp, Streptomyces avermitilis
  CDS (1)..(564)
gtggcttccacgaacgacctcaagaacggcctggtgctcaagctcgacggaggccagctctggtccgtcgtcgagttccagcacgtcaagcccggcaagggcccggccttcgtgcgcaccaagctgaagaacgtgctctccggcaaggtcgtcgacaagacgttcaacgccggcgtcaaggtcgagacggccacgatcgacaagcgcgacatgcagttctcgtacatggacggcgagtacttcgtcttcatggacatggacacgtacgaccagctgatggtcgaccgcaagtccgtcggcgacgccgccaacttcctgatcgagggcttcacggccaccgtcgcgcagcacgagggcgaggtgctcttcgtcgagctgccggccgccgtcgagctcgtcatccaggagaccgagccgggcgtccagggcgaccgctccaccggcggcaccaagcccgccacgctggagaccggtcaccagatccaggtcccgctcttcatcaccaccggtgagaagatcaaggtcgacacccgcacgagcgactacctcggccgggtgaacagc

SEQ ID NO: 6838 - DNA, 432 bp, Streptomyces avermitilis
  CDS (1)..(432)
gtggctgcccgcaacacggcccgcaagcgcgccttccagatcctcttcgagggcgaccagcgcggcgtggacgtcctgacggtcctggcggactggatccggcactcccggaccgacaccaggcagccgccggtgagcgagtacacgatgcagctggtcgagggttacgccaaaaaggtgaaccggatcgacgagctcatctcgcagtacgccgtcggctggacgctcgaccgcatgccggtcgtcgaccgcaacattctgcgtctcggcacctacgagctgctctgggtcgacgagacgccggacgccgtggtgctcgacgaggcggtccagctcgccaaggagttctccacggacgactccccggccttcgtgaacggcctgctgggccgtctgaaggagctgaagccgtcgcttcgccgcgaggaggcg

SEQ ID NO: 6839 - DNA, 522 bp, Streptomyces avermitilis
  CDS (1)..(522)
atgttccagcgtccggggagctatatgtccagcgaatacgccaaacagctcggggccaagctccgggcgatccgcacccagcagggcctttccctccacggtgtcgaggagaagtcccagggacgctggaaggcggtcgtggtcggttcgtacgagcgcggcgaccgcgccgtcaccgtacagcgtcttgccgagctggcggatttctacggggttccggtgcaggagctgctgccgggcaccacaccgggcggggccgccgagccgccgccgaagctggtcctggacttggagcgcctggcccacgtcccggccgagaaggcgggccccctccagcggtacgccgcgacgatccagtcccagcgcggcgactacaacggcaaggtgctgtcgatccgccaggacgacctgcgcacactcgccgtcatttacgaccagtcgccctcggtcctcaccgagcagctgatcagctggggcgtcctggacgcggacgcgcgccgcgccgtctcccacgaagagggc

SEQ ID NO: 6840 - DNA, 576 bp, Streptomyces avermitilis
  CDS (1)..(576)
atggacacccagcagtacgagtccgatgcgcggcccgttctcgaaggctccgacatcgcgcgggtactgacccgcatcgcccacgagatcgtcgagcgcgccaagggcgccgacgacgtggtgctcctcggcattccgacccgaggcgtcttcctcgcccagcggctcgccgccaagctcgaggagatcaccgaccgcaaagtgccggtcggctcgctcgacatcaccatgtaccgcgacgacctgcgcatgcatccgccgcgtgcgctggcccgcacggacatccccggtgacggcatcgacggccgcctggtcgtcctcgtcgacgacgtcctcttctccggccgcaccatccgcgccgccctcgacgcgctgaacgacatcggccgcccgcgcgccgtacagctcgcggtcctcgtcgaccgcggtcaccgcgaactgcccatccgcgccgactacgtcggcaagaacctccccacgtcgttgcgggagacggtcaaggtcctgctcgccgaggaggacggtcgcgacaccgtgctgctcggtgcgaagcggacctcctcgggcgcgcagcag

SEQ ID NO: 6841 - DNA, 975 bp, Streptomyces avermitilis
  CDS (1)..(975)
atgcagcgtcatctcatctcggccgccgacctcacccgcgacgacgccgtccatctcctcgacaccgccgaggagatggcccgggtggcggaccggccgatcaagaaactgccgaccctgcgcggccgcaccgtcgtcaacctcttcttcgaggactccacccgcacccggatctccttcgaggccgccgagaagcgcctctccgcggacgtcatcaacttcaccgccaagggatccagcgtctccaagggcgagtcgctcaaggacaccgcccagaccctggaggcgatgggcgtcgacgccgtcgtcatccggcacggcgcttccggagccccgtaccggctcgccacctccggctggatcgacgcggtcgtcatcaacgccggcgacggcacccatcagcaccccacgcaggccctgctcgacgccttcaccatgcgccgccggctcgtcggccgggacgccgggctcggccgggacctggccggcaagcgcatcacgctcgtcggtgacatcctgcacagccgcgtcgcccgctcgaacgtggacctgctgcacaccctcggcgccgaggtcaccctggtcgccccgcccaccctgctgccggtcggcatcgagtcctggccctgcgaggtcgcgtacgacctcgacagcacgctgcccaagtccgacgcggtgatgatgctccgcgtccagcgcgagcggatgaacgccgcgttcttcccgaccgagcgcgagtactcccggcgctacggcctcaacggcgaccgcatggcgaagatgcccgagcacgccatcgtgatgcaccccggtcccatggtccgcggcatggagatcaccgccgaggtcgccgactccgaccgctgcaccgcgatcgaacaggtcaccaacggcgtctcgatccggatggccgttctgtatctgctccttggcggcaacgaacccgccgtcagccacacccgtatcgaggagaag

SEQ ID NO: 6842 - DNA, 1284 bp, Streptomyces avermitilis
  CDS (1)..(1284)
atgagcaagatcctgatccgtggtgcgaaggtactcggcggcgagccgcaggacgtcctgatcgacggcgacacgatcgccgaggtgggcacggggctcagcgcggaaggcgccgaggtcgtcgacgccgccggcaaggtgctcctgccggggctcgtcgacctgcacacccatctgcgcgagcccggccgcgaggactccgagaccgtgctgaccggtacgcgggccgccgcgagcggcggctacacggccgtgttcgccatggccaacaccttcccggtcgccgacaccgccggtgtcgtcgagcaggtctaccggctcggccaggagcacggctactgcgacgtgcagcccatcggcgccgtcaccgtcggcctcgagggcaagaagctcgccgagctcggcgccatgcacgagtccgcggccggcgtcaccgtcttctcggacgacggcaagtgcgtcgacgacgccgtgatcatgcgccgcgcgctggagtacgtgaaggccttcggcggagtcgtcgcccagcacgcgcaggagccccggctgaccgagggcgcccagatgaacgagggcgtcgtctccgcagagcttggactcggcggctggcccgcggtggccgaggaatcgatcatcgcccgggacgtcctgctcgccgagcacgtcggctcccgcgtccacatctgccacctgtcgaccgccggctcggtcgagatcgtgcgctgggccaagtcccgcggcatcgacgtcaccgccgaggtcaccccgcaccacctgctcctcaccgacgagctggtgcggtcgtacaacccggtctacaaggtcaacccgccgctgcgcaccgagcgcgacgtcatggccctgcgcgaggcgctcgccgacggcacgatcgacatcgtcgccaccgaccatgccccgcacccgcacgaggacaaggactgcgagtgggccgccgccgccatgggcatggtgggcctggagaccgcgctgtccgtcgtgcagcagaccatggtcgagaccgggctgctcgactgggccggcgtcgccgaccgcatgtccgtgaagcccgcgcggatcggccgcgccaccggccacggccgccccgtctcggcaggtgagcccgccaacctcacgctcgtcgacacggcataccgtggggcggtggaccccgcgggcttcgcctcgcgcagccgcaacaccccgtacgagggccgtgagctgccgggccgtgtcacgcacacctggctgcggggcaaggccacgctcgtcgacgggaagctcgcg

SEQ ID NO: 6843 - DNA, 618 bp, Streptomyces avermitilis
  CDS (1)..(618)
gtgacatcactgcatcagacgtaccttgccgccggacagaagtcggcggaggtgaccgactggtccgcccgcatcggctggctcgtgggcctcgccctgttcatcgcgctcgtctactggctgatgcgcgagggctggaagtggcgcggcacccttcagagcgacctgcccgagctgcccgcccgcccgtctcccaccaccaccctcaacggaggcggcaagccgccgccggctggaatgccggacgagccggaccgggtgaaactgacgatgagcggccgctaccacggctccaccaccgccgggcagtggctggaccgcatcgtcgcgcacggcctgggcacccgtagccgggtcgagctcacgctgacggacgcgggactggacgtcgtacgccccggtgcggccgacttcttcgtcccggccgcacagctgcgtgaggcccggctcgacaagggcatcgcgggcaaggtcctcaccgagggcggtctgctcgtcgtcacctgggcacacggcgacaagctgatcgactccggcttccgctccgacgtctcggccgagcacaacgagtgggcctacaccctgaacaacatgatcaacaacacggaaggcgcacga

SEQ ID NO: 6844 - DNA, 1140 bp, Streptomyces avermitilis
  CDS (1)..(1140)
atgacgacctccaccaggggagctgccaaggttcccgccgtactcgtcctggaggacggccggacgttccgcggccgcgcctacggggccgtgggggtgaccttcggcgaggccgtgttctccaccgggatgaccggctaccaggagaccctcaccgacccgtcgtaccaccgccaggtcgtcgtgatgaccgccccgcacgtcggcaacaccggcgtcaacgacgaggaccccgagtcgaagcggatctgggtctccggctacgtcgtacgcgaccccgcgcgcgtgccctccaactggcgctcccggcgctcgctggacgaggagctgcgccaccagggtgtcgtcggcatcagcggcatcgacacccgtgcgctcacccgccacctgcgcgagagcggcgccatgcgcgtcggcatcttctccggcagcgcgctgccggacgagggcacgatgctcgccgaggtgcgccaggcgcccgagatgaagggcgcgaacctcgccgccgaggtcgccaccaaggagacgtacgtcgtccccgcgatcggcgcgaagcgcttcaccgtcgccgccgtcgacctgggcatcaagggcatgaccccgcaccgcatggccgagcgcggcatcgaggtgcacgtcctgcccgcgacggccacggccgaggacgtgtacgccgtgaaccccgacggcgtgttcttctccaacggccccggcgacccggcgaccgcagacggcccggtggccgtcatgcgggaagtgctcgcccgtaagacccccctcttcggcatctgcttcggcaaccagatcctgggccgcgcgctcggcttcggcacctacaagctgaagtacggccaccgcgggatcaaccagccggtgcaggaccgtacgaccggcaaggtcgaggtcaccgcgcacaaccacggcttcgccgtcgacgccccgctcgaccaggtgtccgacaccccctacggccgcgccgaggtctcccacgtctgcctcaatgacaacgtggtggagggcctccagctgctcgaccagccggccttcagcgtccagtaccaccccgaagcggcagcgggcccgcacgacgccgcctacctgttcgaccgcttcgtatccctgatggagggccagcgtgcc

SEQ ID NO: 6845 - DNA, 3306 bp, Streptomyces avermitilis
  CDS (1)..(3306)
gtgcctaagcgcaccgatatccagtccgtcctggtcatcggctccggcccgatcgtcatcggccaggccgccgagttcgactactccggcacccaggcgtgccgcatcctgcgcgccgagggcctcagggtcatcctggtcaactccaacccggcgacgatcatgaccgacccggagatcgccgacgccacctacgtcgagccgatcaccccggagttcgtcgagaagatcatcgccaaggagcggccggacgcgctgctgcccaccctcggtggtcagacggccctgaacaccgccatctccatgcacgagcagggtgtgctggagaagtacggtgtcgagctgatcggcgccaacgtcgaggcgatcaacaagggcgaggaccgcgacctgttcaagggcgtcgtcgaggccgtccgcgcgaagatcgggcacggcgaatccgcccgctcggtcatctgccactccatggacgacgtgctcgagggcgtcgagaccctcggcggttaccccgtcgtcgtccgtccctccttcaccatgggcggcgccggctccggcttcgcgcacgacgaggaggagctgcgccgcatcgcgggtcagggcctgacgctctccccgaccaccgaggtgctcctggaggagtccatcctcggctggaaggagtacgagctggagctgatgcgcgacaagaacgacaacgtcgtggtcgtctgctccatcgagaacttcgacccgatgggcgtgcacaccggtgactcgatcaccgtcgcgccctcgatgacgctgaccgaccgcgagtaccagcgcctgcgcgacatcggtatcgcgatcatccgtgaggtcggtgtcgacaccggcggctgcaacatccagttcgcggtgaaccccgacgacggccggatcatcgtcatcgagatgaacccgcgcgtgtcccggtcgtccgcgctcgcctccaaggcgaccggcttcccgatcgcgaagatcgccgcgaagctcgccgtcggctacacgctcgacgagatccccaacgacatcaccgagaagaccccggcctccttcgagccgacgctcgactacgtggtcgtgaaggccccgcgcttcgccttcgagaagttcccgagcgccgactcgaccctcaccaccaccatgaagtcggtcggcgaggccatggcgatcggccggaacttcaccgaggcgctgcagaaggcgctgcggtccctggagaagaagggctcgcagttcacgttcgtcggcgagccgggcgacaaggccctcctcctggaggaggccgtccgtcccaccgacgggcgcatcaactcggtcatgcaggccatccgcgcgggcgcgacgcccgaggaggtcttcgaggcgacgaagatcgacccctggttcgtcgaccagctcttcctgatcaaggaactcgcggacgagctggccgccgccgacaagctggacccggagctgctcgccgaggccaagcggcacggcttctccgacgtccagatcgccgagatccgcgggctgcgcgaggacgtcgtgcgcgaggtgcggcacgcgctgggcgtgcgcccggtgtacaagacggtcgacacctgcgccgccgagttcgcggcgaagacgccgtacttctactcctcctacgacgaggagagcgaggtcgcgccccgcgagaagcccgcggtcatcatcctgggctccggtcccaaccgcatcggccagggcatcgagttcgactactcctgcgtccacgcctccttcgcgctgagcgaggcgggctacgagaccgtgatggtcaactgcaacccggagaccgtctccacggactacgacacctccgaccgcctgtacttcgagccgctgacgctcgaggacgtgctggagatcgtccacgcggagacgctggcgggcccggtcgcgggcgtgatcgtgcagctcggcggacagacgccgctgggtctgtcgcaggcgctcaaggacaacggcgtaccggtcgtgggcacgcccccggaggcgatccacgccgccgaggaccgcggcgccttcggccaggtcctcgcggaagcgggcctgcccgccccgaagcacggcaccgcgaccaccttcgcgggcgccaaggccatcgccgacgagatcggctacccggtcctcgtccggccgtcgtacgtcctcggcggccgcggcatggagatcgtgtacgacgagacgcgcctggagtcgtacatcgccgagtccaccgagatcagcccctcccggccggtcctggtcgaccgtttcctcgacgacgcgatcgagatcgacgtcgacgccctctacgacggcgaggagctgtacctcggcggcgtcatggagcacatcgaggaggccggcatccactccggcgactcggcgtgcgccctgccgccgatcacgctcggcggcttcgacatcaagcgcctgcgcgcctcgaccgaggccatcgccaagggcgtcggcgtccgcggactgatcaacatccagttcgccatggccggggacatcctgtacgtcctcgaagccaacccgcgcgcctcccgcaccgtccccttcacctcgaaggcgaccgcggtgccgctcgccaaggccgccgcccggatctcgctcggcgcgaccatcgccgaactgcgggccgagaggctgctgcccgcgaacggcgacgggggcacgctcccgctcgacgcgccgatctccgtgaaggaggcggtcatgccgtggtcgcggttccgcgacatccacggacgcggcgtcgacacggtcctcggcccggagatgcgctccaccggcgaggtcatgggcatcgactccgtcttcggcacggcgtacgccaagtcgcaggcgggcgcgtacggaccgctgcccaccaagggccgcgccttcatctccgtcgccaaccgcgacaagcgctcgatgatcttcccggcgcgcgagctggtggcccacggcttcgagctgctcgccacgtccggcacggccgaggtgctcaagcgcaacggcatcaacgccaccgtcgtccgcaagcagagcgagggcgagggcccgggcggcgagaagaccatcgtccagctcatccacgacggccaggtcgacctcatcgtcaacacgccctacggcaccggaggccgcctcgacggctacgagatccgtacggcggcggtggcccggtccgttccctgcctgacgacggtccaggcgctcgccgccgccgtccagggcatcgacgcgctcacccacggagacgtgggcgtgcgctcgctccaggaacacgccgagcatctgaccgcggcccgcgac

SEQ ID NO: 6846 - DNA, 1104 bp, Streptomyces avermitilis
  CDS (1)..(1104)
atgtacaagcttttcttccggctggtgttcaagcggatggacccggagcaggcgcactacctggccttccggtggatccgcctcgccgcccgtatccccgtgctgcgcacgttcgtcgccgccgcgctcgcaccccgcttcaaggagctgcgtaccgaggcgttcgggctgcgcatgcacggcccgttcgggctcgcggccggcttcgacaagaacgccgtcgccgtcgacgggatgtcgatgctcggcttcgaccacgtggagatcggcacggtcacgggggagccgcagccgggcaaccccaaaaagcggctgttccgccttgtgccggaccgggcgctgatcaaccgcatgggcttcaacaacgagggctcggcggccgtggcggcccgcctggccgctcgtgaggcggtcttcaggacggtcgtgggcgtcaacatcggcaagaccaaggtcgtaccggaggaggaggccgccgacgactacgtgaagtcgaccgagcggctcgcccggcacgccgactacctggtcgtgaacgtctcctcgccgaacacccccggtctgcgcaacctccaggccaccgaggcgctgcgccccctgctgagcgccgtccgcgaggccgccgaccgcaccgtgacggagcgccgcgtcccgctgctggtgaagatcgcgccggacctcgccgacgacgacatcgacgcggtcgccgacctcgccgtggagctgggcctggacgggatcatcgccacgaacaccaccatcgcgcgcgaggggctcggcctgaagtccgaacccaccctcgtcaaggagaccggcggcctgtccggcgcgccgctgaaggcacgctccctggaggtcctgagccgcctctacgcgcgcgtgggcgaccggatcaccctggtgggcgtgggcggcatcgagaacgccgaggacgcctggcagcgcatcctggccggcgccacgctggtccagggctacagcgccttcatttacgagggccccttctggggccgcgccatccacaaggggctcgccgcacgtctgcggacgagcccgtacgccacccttgccgacgcggtcggcgccgacgtgaggaagtccgca

SEQ ID NO: 6847 - DNA, 840 bp, Streptomyces avermitilis
  CDS (1)..(840)
atgagtctggaacccttcggcgcgcgcctgagccgggccatggacgaccgaggccccctgtgcgtcggtatcgacccgcacgcctccctgctggccgactggggcctgagcgacgacgtggcgggcctggagcggttcagccgcaccgtcgtcgaggcgctgggcgagcacgtcgcggtcttcaagccgcagagcgcgttcttcgagcgcttcgggtcccggggtgtcgccgtcctggagaagacggtcgcggaggcgcgggcggccggtgccctggtcgtgatggacgccaagcgcggcgacatcggctcgacgatggccgcgtacgcggaagccttcctccggaaggactccccgctgttctcggacgcgctgaccgtgtcgccgtatctgggctacggatcgctgcggccggccgtggagctggcgcgcgagagcggggccggactgttcgtgctggcgctgacctccaacccggagggcggcgaggtgcagcacgcggtgcgtacggacggccgtgacgtcgcggcgaccatgctggcgcacctggcggccgagaacgcgggggaggagcccctggggtccttcggggcggtcgtcggcgccacgctgggcgacctgtcctcgtacgacctggacatcaacggaccgctcctcgcgcccggcatcggcgcccagggggccgcaccggccgatctccccggggtcttcggggcggcggtgcgcaatgtcgtgccgaacgtcagccggggtgttctgcgtcacggtcccgatgtccgcgccctgcggacggccgcggaccgtttcgcggaggagatcagggccgccgtggccgccgtc

SEQ ID NO: 6848 - DNA, 321 bp, Streptomyces avermitilis
  CDS (1)..(321)
gtggctcttccgccccttacccctgaacagcgcgcagccgcgctcgaaaaggccgccgcggctcgccgggagcgggccgaggtcaaaaatcgactcaagcactccggcgcctcccttcacgaggtcatcaagcagggtcaggagaacgacgtcatcggcaagatgaaggtctccgctctcctcgagtccctgccgggcgtgggcaaggtccgcgccaagcagatcatggagcgactcgggatctccgagagccgtcgcgtacgcggcctcggttcgaaccagatcgcctccctggagcgtgagttcggcagcaccgccggc

SEQ ID NO: 6849 - DNA, 591 bp, Streptomyces avermitilis
  CDS (1)..(591)
atggcagtaacaccccgggggacgtcccccgtacccccggacgcacgtccgcggctgaccgtgctctccggcccctccggggtcggcaagagcacggtcgtcgcccatatgcgcaaggaacaccccgaggtctggctctcggtgtcggcgacgacccgcaagccgcgccccggtgagaagcacggagtccactacttcttcgtctccgacgacgagatggacaagctgatcgccaacggcgagctgctcgagtgggccgagttcgccggcaaccgctacgggacgccgcgccaggccgtgctggagcggctggagcggggtgagccggtcctcctggagatcgacctccagggcgcccggcaggtccgcgagtccatgcccgaggccctgctggtgttcctggcccctccctcctgggaggagctggtacgcaggctcaccggacggggcaccgagccgcccgaggtgatcgagcgccgcctggacgcggccaaggtcgaactggcggcggagcccgagttcgatgtgacccttgtcaacacctccgtcgaggacgtagcgcgcgagctgctagccttggtggacgttgtg

SEQ ID NO: 6850 - DNA, 270 bp, Streptomyces avermitilis
  CDS (1)..(270)
gtgtcctcttccatcaccgcgcccgagggcatcatcaaccccccgatcgacgagctcctcgaggccactgactcgaagtacagcctcgtgatctacgcggccaagcgggcccgtcagatcaacgcgtactactcgcagctcggtgagggcctcctcgagtacgtcggtcccctcgtcgacacccacgtccacgagaagccgctctcgatcgccctgcgcgagatcaacgccggtctgctgacctccgagcccgtcgagggcccggcgcag

SEQ ID NO: 6851 - DNA, 1215 bp, Streptomyces avermitilis
  CDS (1)..(1215)
gtgtggggagacccggtggacaagccgaaggtcgtgctgggagtcagtggcggcatcgccgcctacaaggcctgtgagctgctgcggaggctgacggagtcgggacacgacgtccgcgtcgtgcccaccggctcggcgctgcacttcgtcggcgccgccacctggtccgcgctctccggcaacccggtctccaccgaggtctgggacgacgtccacgaggtgccgcacgtccgcatcggccagcacgccgacctggtcgtcgtcgcccccgccaccgccgacatgctcgccaaggcggcccacggcctcgccgacgacctgctcacgaacacgctgctgaccgcacgctgtccggtcgtcttcgcacccgccatgcacaccgagatgtgggaacacccggccacccaggagaacgtcgcgacgctgcgccgccgcggcgccctcgtcatcgagcccgcggtgggccggctgaccggcgtcgacaccggcaagggccgcctgcccgaccccacggagatcttcgaggtctgccgccgggtgctcgcgcgcggcgccgcacggccggacctcgccggccggcacgtggtcgtcagcgccggcggtacgcgcgagccgctcgacccggtccgcttcctcggcaaccgctcctccggcaagcaggggtacgccctcgcccgcaccgccgccgcgcgcggcgcccgggtcaccctggtcgccgcgaacaccgggctgcccgacctggcgggtgtcgacgtcgtccaggtcgggacggccgtgcaactgcgcgaggcggtgctgaaggcggcctcggacgccgacgccgtggtgatggcggcggccgtggcggacttccgtccggcgacgtacgcgaccggaaagatcaagaagaaggacggccaggagccggaagcgatcgttctggtccgtaatccggacattctcgcggagatctcggccgaccggccgcgccccggtcaggtggtcgtcggcttcgccgccgagacggacgacgtcctggccaacggccgtacgaagctggcacgcaagggctgcgacctcctcgtggtgaacgaggtgggggagcgcaggacgttcggctcggaggagaacgaggccgtggtgctcggcgcggacggaagcgagatcccggtgccgtacgggcccaaggaggccttggccgagaccgtgtgggatctggtcgtgccccggctcggg

SEQ ID NO: 6852 - DNA, 1206 bp, Streptomyces avermitilis
  CDS (1)..(1206)
gtgtcccgtcgcctgttcacctcggagtccgtgaccgagggccaccccgacaagatcgctgaccagatcagcgacaccattcttgatgcgcttctgcgtgaggacccgacatcccgggtcgccgtggagacgttgatcacgaccggcctggtgcacgtggccggcgaggtcaccaccaaggcgtacgcaccgatcgcccagctggtccgcgacaagatcctggagatcggctacgactcgtcgaagaagggcttcgacggagcttcctgcggcgtgtcggtgtcgatcggctcgcagtccccggacatcgcgcagggtgtcgacacggcgtacgagaaccgggtcgagggcgacgaggacgagctggaccggcagggcgcgggcgaccagggcctgatgttcggctacgcgacggacgagacgccgacgctgatgccgctgccgatccacctcgcgcaccgtctgtcgcaccgcctgtccgaggtccgcaagaacggcacgatcccgtacctgcgtcccgacggaaagacccaggtcaccatcgagtacgacggcgacaaggcggtccgtctggacaccgtggtcgtctcctcgcagcacgcctcggacatcgacctggactcgctcctcgcccccgacatccgcgagttcgtggtggagccggagctgaaggcgctcctcgacgacggcatcaagctggagaccgagggctaccgcctcctggtcaaccccaccggccgcttcgagatcggcggcccgatgggtgacgccggtctcaccggccgcaagatcatcatcgacacgtacggcggcatggcccgccacggcggcggtgccttctccggcaaggacccgtccaaggtcgaccgctccgccgcgtacgcgatgcgctgggtcgcgaagaacgtggtcgccgcgggtctggcgtcccgctgcgaggtccaggtggcgtacgcgatcggcaaggccgagccggtgggcctgttcgtcgagaccttcggcaccgccaaggtcgaggccgacaagatcgagcaggccatcgcgacggtcttcgacctgcgcccggccgcgatcatccgcgacctcgacctgctccgcccgatctactcccagacggcggcgtacggccacttcggccgcgagctccccgacttcacgtgggagcggacggaccgggtggacgcgctgcggacggctgtggggctg

SEQ ID NO: 6853 - DNA, 2160 bp, Streptomyces avermitilis
  CDS (1)..(2160)
gtgagcagcgagaacgggcaggggggcggcggtggcgaagaggcgccgccggagcagcttgcgttgatccgtgaggccgtgcggaaggccaaggtgcccaaggccaagccgcggacgtggcggggagccgcgctggccaaggagttgcccgtcgcgcgtgtgctggtcgacaagggcgtacttcatcttgatcggtacttcgactatgccgtgcccgaggaactggctgccgtcgctcagccgggagtgcgcgtccgtgtgcggttcggagccggcgggcgcaccgtgcgggacggcaggcgggagggcggctcactgatcgacggcttcctcgtcgagcgggtcgccgagtccgactacggcgggccgctggccgcgctcgcgcaggtcgtgtcccccgagcccgtgctcggccctgagctgctcgggctcgcccgggccgtcgccgaccggtacgccgggagcctcgccgatgtgctccagctggccgttccgcccaggcacgggcgggccgaggccggcaagacggccgagccgctgccggctcctcccgcgcccgaacccggctcctggcggcggtacgcgcgcggggcggagtttgtgaagtccctcgccgccgggggttcgccccgggccgtgtggaccgcgttgccggggcccgactgggccgaggagatcgcccgggccgtgcaggccacgctcgcctcggggcgcggcgcgctcgtcgtcgtgccggccggacggcccgccgcgcgcgtcgacgcggcgctccgcgcgctgatgggtgaggggcggcatgcactgctgaccgccgacgcggggcaggagcggcgctaccgggagtggctggccgtgcggcggggggccgtgcaggcggtggtcgggacgcgggccgcgatgttcgcgcccgtgcggaatctcgggctcgttgtcgtgtgggacgacggggatgcttcccacagcgacgacaacgcgccgtttccccatgtgcgggaggtgctggagcttcgggcgacccgggacaagtgcgggtttctgctggggagctggagctgcacggtggaggccgcgcagcttgtcgagagcgggtgggcggcaccgctcgtggccgagcgggaacaggtacgggcggctgctcctctcgtgcgcaccgtgggggacggggatctcgcgcgggacgaggcggcccgggccgcgcggctgccgaccctcgcctggcaggccgtgcgggaggggctgcgccacggacccgtgctggtgcaggtgccccggcggggttacgtgccccggatggcctgcgcgcagtgccgggcgcccgcgcggtgccggcactgcgcggggccgctggaggcgcacgacgccggggcgctgcggtgcggttggtgcggacgggaggacgcggcttggcactgtccggagtgcggtgggttccggttgcgggcgcaggtcgtgggggcgcggcggaccgccgaggagctgggtcgtgcgttcccggccgtgccggtgcgcacctccgggcgtgagcaggtgctcgacaccgtctcgggggcgcccgcgctcgtggtgagtacgccgggggccgagccggtcgccgagggcgggtacgcggctgccctgctcctcgacgggtgggccatgctcggccggccggatctgcgggccggggaggaggcgctgcggaggtggatcggggcggccgcgctcgtccgggggcaggcggccggcgggaccgtggtcgtggtcgccgagccgacgttgcggcctgtgcaggcgctggtgcgctgggatcccgtcggacacgcggtgcgcgaactcgccgagcgggccgagctggggtttccaccggtgtcgcggatggccgccgtgtcggggacggccgaggcggtcgcggggtttctgagcggggtcgaactaccctcggacgccgaggtgttggggccggtgccgttgccggtcacggaggccggacggcctcggcgcgtgggcgggccgccgccgggggagcggtgggagcgagcgctcgtccgggtgccgccggggagcggggccgcgctggccggcgcgttgaagaccgcgcaggcggctcggatggcgcgtgggggcggggggaacgggagcgaggccccggtgcggattcggatcgatccgccggacatcggg

SEQ ID NO: 6854 - DNA, 540 bp, Streptomyces avermitilis
  CDS (1)..(540)
atggccgaccacgcaacccacgacgcccaggctcgggccagcctgcacttgctggtgcgggacatcgagcgggtccgccggcaggtggacgcactgcgcacgctcaccgcccagttgggcaacgtctaccgcccacgccgctccggcccgtccacgggcttcgtcgtctacggacgcgctcccgctccgaccgtccgcctcgcccaggaactgcgcgacagtgtcgagaccctggtcacggccgccgtggacttcgaccgctccctgggcttctcgtgggacgcggtgggctccgcgctcggagtcaccaagcaggcggtgcaccgccgttacggcgcgcggcgcgccgccgcccaggcagccgcggacgccgagcgcgcgaccgagccgacggccgctcgtacggtgagcgtcaacaccggcatccccacggtgccgacggtccccgcggcccgctccatgccgacccagccgacggcgggcagccccacgctccgcgacgaggccaggccgacggccttcccgggcccgcgcaacggc

SEQ ID NO: 6855 - DNA, 930 bp, Streptomyces avermitilis
  CDS (1)..(930)
atgaagctcgtctttgcaggtactcccgaggtcgccgttcccgccctggacgctctgatcgcctccgggcggcatgaggtggccgccgtcgtgacgcggcccgacgccccggccgggcggggacggcggctggtcgcgagtcccgttgcccagcgggcggaggaggccgggatcgaggtgctcaagccggtcaagccgcgggacgaggagttcctggcgcggctgcgggagatcgcgccggactgctgtcccgtcgtcgcctacggcgcgctgctgccgcgggtcgccctcgacattccggcgcacggctgggtcaatctgcacttctcgctgctgcccgcctggcgcggtgccgctcccgtgcagcactccatcatggccggggacgagatcaccggagcgtccaccttcctcatcgaggagggactcgactccgggcccgtcttcggcaccgtcaccgaggagatccggcccaccgacaccagcggcgacctgctcacacggctcgccttcgccggttccgggctgctcgtcgcgaccatggacggtgtcgaggagggcaagctgaaggccgtgccgcagcccgccgacggcatcactctcgcgccgaagatcaccgtcgagaacgcgcacgtcgactggtctacgccggcgctgcgggtcgaccgggtggtgcgcgggtgcacgcccgcgcccggtgcctggaccgtgttccgcggcgagcggctcaagctcatccaggtcgtcccggtgcccgagcggaccgatctcgccccgggcgcgctgtccgtcggcaagaacaacgtgtacgtcggcaccggttcgtacgccgtcgagctgctgtgggtgcaggcccagggcaagaagccgatgcgggccgccgactgggcacgcggcgtacgcatcacggacggcgagcccctcggcgcg

SEQ ID NO: 6856 - DNA, 1428 bp, Streptomyces avermitilis
  CDS (1)..(1428)
gtgagcgagcagtcccgtcagccccgtaagccgggcaagccccaccgtcgtccccagaaggaccccgtccgcttcctcgccttcgaggcgctgagggcggtggacgagcgggacgcgtacgcgaacctcgtcctgccgccgctgctgcggaaggcgcgccagaagggcgacttcgacgggcgggacgcggcgctcgcgaccgagctggtgtacgggacgctgcgccggcaggggacgtacgacgcggtgatcgcggcctgtgtcgaccggccgctgcgcgaggtcgatccgccggtgctcgatgtactgagcctcggtgtgcatcagctgctcggcacccggattcccacccacgccgcggtgtccgcctccgtcgagctcgcccgcgtggtgctcggcgacgggcgcgccaagttcgtcaacgccgtactgcgcaaggtcgcccagcacgacctcgacggctggctggagcagatcgcgccgccgtacgacgacgacgccgaggaccatctcgccgtcgtgcactcgcatccgcggtgggtcgtctccgcgctgtgggacgcgctgggcggcgggcgcgccgggatcgaggacctgctggaggccgacaacgagcggcccgaggtgaccctcgtcgcccgcccggggcgctccaccgccggtgaactcctcggcgtactcggcgaggagtccgcgctgccgggccgctggtcgccctacgccgtccgcctcacggagggcggcgagcccggtgccatcgacgccgtgcgggaaggccgtgccggcgtacaggacgagggcagccaactcgtcgcgctggcgctcgccaacgcccccctcgacgggcccgaccaggcctggctggacggctgcgccgggcccggcggcaaggcggccatgctcgccggtctcgccgccgagcgcggtgccgtgctgctcgcctccgagaagcagccgcaccgggccgggctggtggcgaaggccctcgccgggaacccggggccgtatcaggtgatcgcggccgacggcatccgtccgccgtggcggcccggcaccttcgaccgggtgctgatggacgtgccctgcacggggctcggcgccctgcgccgtcggcccgaggcccgctggcggcggcggcccgaggacctggacggcttcgcgccgctgcagcgcggcctgctgcgcaccgccctcgactccgtgcgggtcggcggtgtcgtcggctatgccacctgctcgccgcacctcgccgagacccgcgcggtcgtcgacgacgtcctcaagcaccacacggtcgcggccgagctgatcgacgcccgcccgctgctgccgggcgtaccggcgctgggcgagggccccgacgtacagctctggccgcacctgcacggcaccgacgccatgtatctggcgctcatccgccggactgcc

SEQ ID NO: 6857 - DNA, 2154 bp, Streptomyces avermitilis
  CDS (1)..(2154)
gtgctgccccggggactcgtcggatgcgtgtgcggacggcgcggcaagtggctgatcgtcgcgctgtggctggtgctgctggtggtcgcggcaccgctcgcgtcgaagctcaccggcgcccaggacaacgacgcggcgtcctggctgccgggctcggccgagtccacccaagtcctggtcacgtccggcacgttcaggccggagcagatccccgcggtcgtcgtgtacgcgcgcgagggcgggctgaccgcgcaggacaagcggcggatcgcccgggacgccgaccggatcaagggactcacggcgcacggggtacgcggcgacgagagccgcgggcccgcctacgacaccccgtcggcgcccgaggccgcccagatccacgtgcccatcaccatggacgagaagggctggcaggagctcgccccggccgtcgactccctccgcgaccaggtgggcgggggcggcggcgggctcgccgtgcacatcacggggcccgggggcacctcggcggacttctccaaggccttcgagggcatcgactcgacgctgctgctctccgcgatgggcgtcgtgatcgtgatgctgctggtcacctaccgcagcatcaccctgatcttcgtcccgctgaccggtgtggtcgccgcgctgttcaccgcccaggcgctgatctatctcctcgccgaacacacgggtctgaccgtcaacgggcagagcgcgggcatcctcaccgtgctcgtcttcggcgcgggcacggactacgcgctgctgctggtcgcccgctaccgggaggggctgcgccgccacgaggaccgccacgaggcgatggcactcgccctgaaccgggcgggcccggccgtgctcgcttccggcgcgaccgtcgtcctgagcatgctggtgctgctcgccgccgagatgaactcgacgcgcggcctgggtccggtggccgccatcggggtggcgatcgcgctgctggcgatgctgacgctcttccccgccctgctgttggtcttcggccgctggatcttctggcccgcgatcccgcacttcggcgcggccgaccccacggaacggggcctgtgggcgcgcatgggccgccgtatcgcccaccgtccgcgcctcgtgtggagcggcacggcgctcgtcctcgcggcgctctccctgggcctgctccagctccgcgcgagcggcatcggcaacgcggacgccttcaccggcaggcccgactccatcgtcggccaggaggtgtcggcgcggtacttcccggcgggcaccggcgatccgctggtcgtcgtcgcggatcaggcgcggggcgaccaggtacggaaggcggtcgcggggacgaagggcgtggtggcggacagcgtcaccgtgccgccggggacgaaaccgtcgtccgggggcaaggtgctgttcgaggcgaccctcaccgacccgtccgacagcgacgccgcgaaacggaccgtggagcgggtgcgcgacgccgtgcacgccgtgcccgacgcccgggcgcgggtgggcggcggcagcgcggcgctgctcgacatggacgcggcgacgacgcacgacaacctggtggtcatcccggcggtcctggtggtcgtcctgctgatcctggggttgctgctgcgtgccctggtggcaccgctgctgctgatcgggacggtcgtgctgtccttcgcggcggcgctgggcgcgagcgcgctcgccttccggcacctcttcgactacgccggcgagcagacggacttcccgctgttcgtcttcgtgttcctggtggccctcggcatcgactacaacatcttcctgaccacccgcatccgcgaggaggcggcccgccggggcacccggcccggcgtcgtgacgggcctcgccgcgaccggcgcggtgatcacctcggcggggctggtgctggccggcacgttcgccgctctcggcacactcccgatggtcgccttcgcggagatcggcttcgcggtggcgctgggcgtgctcctggacacgttcgtcgtgcggtcggtgctggtcacggcgctgttcctggacgggggccccaaggtgtggtggccgcaccggttgtcgcacgaggacggcggcgacgccggcgccgccgccaccgtggcggcgcccgacgcggaggtcaggcagtccggcgga

SEQ ID NO: 6858 - DNA, 684 bp, Streptomyces avermitilis
  CDS (1)..(684)
atggccgtgcagatcaaccccagcatcctgtccgccgatttcgcccgtctcgccgaggaggccaaggcggtcgaaggcgccgactggctccatgtcgacgtgatggacaaccatttcgtaccgaacctcacgctcggcgtgccgatcgtagaggcgctggcgcgggcgacggacactccgctggactgccatctgatgatcgaggacgccgatcggtgggcgccgcagtacgtggaagcgggtgccggttccgtcaccttccacgccgaggcggccgccgcgccggtgcggctcgcccgcgagatccgggccaagggggcccgtgcctccatggcgctcaagcccgcgacgcccatcgagccgtacgaggacctgctgcccgagctcgacatgctgctgatcatgacggtcgagccgggcttcggtggccaggcgtttcttgacatcatgcttccgaagatccgccgcacccgtgagctgatcagcaagcacgggctcgaactctggctccaggtcgacggcggagtctcggcttccaccatcgagcggtgtgcggaggcgggcgcggacgtcttcgtcgcggggtcggcggtgtacggggcggcggaccccgcagacgcggtacgtgcattgcgcacccaagccgagggggcgacggccctcgcctcctgggcgtgcgaccac

SEQ ID NO: 6859 - DNA, 1041 bp, Streptomyces avermitilis
  CDS (1)..(1041)
gtgaacagcagtgaggagatggccgtgtctggtatgtcggcgggccggtcagcgatgcggatgggacccgctgagctggtgcaggcggcggccatggcccgccgcttctacctcgagggcaagtccaagatccagatcgccgaggagttcggcgtcagccgcttcaaggtggcaagggtcctggagaccgctctcgaacgggatctcgtgcgtatcgagatccgcgtgcccgccgagctggacgcggagcgctccgacgcgctgcgcgcccgctacggcctcaggcacgccgttgtggtcgagtccccggccgaggccgaggagtcgcccgacccggagaacctcggtgaggtggccgctgacctgctcggcgagctggtcaccgagggcgatgtgctgggtctggcctggggccggtccaccatccacatggcggcggccctcgaccggctgccaccctgcacggtggtgcagctgacgggcgtgtacgacgccgggaccgccgagcgcggctcggtggaagcggtgcgacgtgccgcgcaggtgtccggcggggacgcccaccccatctacgcgccgatgctgctgccggacgtggccaccaccgcggcactgcgcaaccagacggggatcgcgcgggccttcgagtacttcgacaaggtcacggtcgcctgtgtctccatcggctcctgggagcccggcatctcgacggtgcacgacatgctcagcgacgaggagcgcgcccactacgcgtccctcggggtcgccgccgagatgtccgcgcacctcttcgacgccgacggccgccgggtcgggcgggacctgggggagcggtgcatcaccgtcaaggcggaccagctgcgccgtgtccccgaggtcgtcgcgatcgcgggcggacagcgcaaggcggcggcgatcgacgcggtgctgcggtccggtctggtcaccagcctggtcacggacacatcggcggcggactacctgatggcggcgggtcccacgcccaggcccgcactcaaccgggcggacccggacggcccc

SEQ ID NO: 6860 - DNA, 405 bp, Streptomyces avermitilis
  CDS (1)..(405)
atgctgctgcggtccgtcccccgtgtgctcgcggggctgttcgtctgtctggccgttctgctcaccggctgttcgccgaccgggccgaccaaggcgcccgcctcgtccgcgcgtccttcatgggccgccggcatggccacggtcaaggagtcccagctccccgccgaggcccggcagaccctcgcccgcatcgaccggggcggccccttcccgtacgccatggacggcgcggtcttcgggaacttcgagcggctgctgccccggcaccagcggggttactaccacgagtacacggtgaagacgcccggctcgcgcgatcgcggggcccggcgcattgtcacggggcagagcgacgagatctactacaccgatgatcactacaaatcgttcagggcggtgctgaga

SEQ ID NO: 6861 - DNA, 375 bp, Streptomyces avermitilis
  CDS (1)..(375)
atgaccgacggcacgctcgccgacgtactgcgcgcctgcggctggacccctatcgagctggacctcggcggggtcaccaccaagcccgccttcatggaccgtgtcgccctcgccctcggcctgcccgactggttcgggcgcaactgggacgccctcgccgactgcctcgccgacctgtcgtgggcaccgcccgcccggggacggctgctcgtcatcaccggatggcaggagtacgcgctggcggcgccgcacgactggggtatcgcccaggaagtgttcggcgaggccagtgaccgcgggcgtggcaccggcaccgaactccatgtcgtactggctctcggaggatcctcccaaggcacctctgaccagcctgga

SEQ ID NO: 6862 - DNA, 1449 bp, Streptomyces avermitilis
  CDS (1)..(1449)
gtgcagcacgtgcgtttcctcaacgacatcaagcccccgtacgacctgacgtacgacgacgtcttcatggtgccgagccgctccgcggtcggctcccggcagggcgtggacctcacctccccggacggcacgggcaccaccatcccgctggtcgtcgccaacatgaccgcgatcgccggccgccgcatggccgagaccgtggcccgccgcggcggcctcgtcgtcattccgcaggacatcccgatcgaggtcgtcaccgaggtcgtctcctgggtcaaggggcgtcatctggtcctggacacgccgatcgtgctcgtcccgcaccagaccgtcgcggacgcgctggccctgctgccgaagcgggcgcacaacgcgggtgtcgtagtggacgaggacggccgcccggtcggtgtggtcaccgacaccgacctgaccggcgtcgaccgcttcactcagctgtccgaggtcatgtcgagggatctgctgctgctcgacgcggacatcgaaccgcgcgaggccttcaacaagctcgacggcgccaaccgccgctacgcgcccgccgtcgaccgcgacggcaggctggcgggcatcctgacccgcaagggcgccctgcgcgccacgctgtacacgcccgccaccgacgccgacggcaggctgcgcatcgccgccgcggtcggtatcaacggcgatgtcgcgggcaaggccaagcagctgctcgacgcgggtgtcgacacgctcgtcatcgacacggcgcacggccaccaggagtcgatgatcagcgcgatcaggaccgtgcgcgcgctcgacccccaggtgccgatcgccgcaggcaacatcgtcgccgccgatggtgtgaaggacctggtcgaggcgggcgcggacatcatcaaggtcggggtcggccccggcgccatgtgcaccacccgcatgatgacgggtgtgggccggccgcagttctcggccgtcatggagtgcgccgccgaggcgaagaagtacggcaagcacgtgtgggccgacggcggtgtccgtcacccgcgcgacgtcgcgatggcgctcgccgccggcgcgtccaacgtgatgatcggctcctggttcgcaggcacgtacgagtcgccgggcgaccttcagcaggatgccgacgggcgcctgtacaaggagtcgttcggcatggcgtcggcgcgtgcggtgcgcaatcgcacgtcggaggagtcggcgtacgaccgcgcccgcaagggcctgttcgaggagggcatctccacctcgcgcatgttcctcgacccgggccgcccgggcgtcgaggacctgatcgactcgatcatcgcgggcgtccgctcctcgtgcacctacgccggcgccaactccctggaggagttcaccgagaaggccgtggtcggcatccagagcgcggccggctacgccgagggcaagccgctgcacgccagctggagc

SEQ ID NO: 6863 - DNA, 498 bp, Streptomyces avermitilis
  CDS (1)..(498)
atgaagatcgccatgtgcagggccgccgatgtcgcgctcctcgaccagtacatcggctccgccggcgtcacgtcctcccacgcccgccgttttgcctgccaggaggcgggagagagcacctacctcgtcgcctggctcgacgaccggcccgtcgggcacgcggaggtgcgctggaccggctgcgccgctgccgaggtgcgggccgcccgccccgggtgtcccgagatcaacgggctgggcgtctggcccggggaactgcgttcgcgcggcatcgggagcgccttgatccgcgcggctgaggagctgacccgggagcgcggcctcgacgtcatcggtctgggggtgggtacggacaatccgcgcgcggccgagctgtacgcgcggctcgggtaccggcccctgaccgggtacgtcgaccgctggtcgtacgagggcggggacgggacgacccacgagtgcgccgacccgtgcaccttcctggtcaaggagctgccgcgc

SEQ ID NO: 6864 - DNA, 1476 bp, Streptomyces avermitilis
  CDS (1)..(1476)
gtgctcgaccaaggcgcacccccgcagtcccgcagtcatccctcggccccgggcctcggcgcccgcctgatgcgccgtaagccggtggaaaacctggtcgccgagggcggccagggcgagggtggcactttgcgccgctccctcggcctctggcagctgaccatgatcagcatcggtgccaccctcggcaccggaatcttcgtggtgctcggcgaggcggtgccgaaggcgggccccgccgtgaccctgtccttcgtgatcgccggtctcaccgcgctcttctcggccctctcctacgccgagctcgcgggcaccatcccggtctccgggtcctcgtactcgtatgcgtacgcaacgatgggtgagctgatcgcctggatctgcggctggtgtctcgtcctggagtacggcgtctcggtcgccgccgtcgcggtcggctggggcgagtacctcaacgaactcctcgacggcaccatcggcgtcaccatcccggacgcgctctccgcgccgcccggcgacggcggcatcttcaatctgcccgcgctgatcgtcgtcctgctcgcgatggcgttcctgctgggcggcgcgaaggagtccgcgcgcgccaacacgatcatggtgatcgtgaagatcgccgcgctgctgatgttctgcgcgatcggcatccagggcttcaagtccggcaactacgagaacttcatgccgctgggcatggcgggcgtcagcgccgccggggccacgctcttcttctcgtacatcggcttcgacgcggcctccacggccggcgaggaggcgaagaacgcgcagcgcgacctgccgcgcgcgatcatgctctcgctcgtcatcgtgaccgcgctgtacgtgctcgtcgccgccgtcgccgtgggtgccaagccctggaaggggttcaacgactccgaggccgcgctcgccgggatcatgaaggacgtcaccggacagaccttctggggcaccctgctcgccgcctgtgccgtcatcgccatcgccagtgtcgtcctgaccgtgctctacggacagacccgcatcctcttcgcgatggcccgggacggcctcgtgcccaaggtgttcgcgcgcgtccaccccaagacgggggcgccccgcgccaacaccgtcatcgtgtcgctcttctgtggtgtcctcgccgccgcgatcccgctcgggcagctcgccgacgccaccagcatcggcaccctcttcgccttcgggctggtcaacatcgcggtcgtggtgctgcgccggacccgcccggacatgcggcgcaccttccgggtgccgctgtccccggtgctgccggcgatcggcttcgcgctctgcgtctggatgatgggcagtctctcggccgtcacctgggtggtcttcggagtctggatggccgtcgggctcgtgttctacttcagttacggccaccgccgttcccggctggccacggcagacaccgcagtatccgcacagaag

SEQ ID NO: 6865 - DNA, 450 bp, Streptomyces avermitilis
  CDS (1)..(450)
ttgctgaacgatctcgacgaacgcatcgtgcacgccctcgccgaggatgcccgccgctcctatgccgacatcggccaggaggtcggtctgtccgcgcccgccgtgaagcggcgcgtggaccggctgcgcgcgaccggcgccatcaccggattcaccgtacgggtggacccggcggcgctcggctgggagaccgaggggttcgtcgagatctactgccgccgcaacacctcgccggagaccatccagcggggtctggagcgctaccaggaggtcgtggccgcctccaccgtcaccggtgaggcggacgcggtcgtccaggtcttcgcctccgacatgcgccacttcgagcgagtcctggagcggatcgccggggagtcgttcgtggagcgtacgaagtccgtgctggtgctctctcccctgctgcgacggttctcctcggggtcgcccacc

SEQ ID NO: 6866 - DNA, 195 bp, Streptomyces avermitilis
  CDS (1)..(195)
gtggcggcaagtgcgcgggacgccggaccgctcggcgtgcgccgcaccagcccgccgctgcgcgtccgccgggtcaccacggcacgcgaagggcgcccggcggagcggtcggacgaccactaccgctcggacgccgtgagcttcggcgcgcaccactcgacggggaacaacgcgctggcccgcaagcccgcgggc

SEQ ID NO: 6867 - DNA, 2475 bp, Streptomyces avermitilis
  CDS (1)..(2475)
gtgggcaacgccggggggaccgaccaacgcccggccacccgaccgttccgccgtcctggggagaccatgcgctggcccatcggccgtcccaccacggtccgtgcgcggatcgtggcgctggcgctcgcgccggtgatcgccctgatggcgctgtggagcttcgccatggtgtccgtcaccggcgaactgcgcgcgctcgtccgggtccagggtgtgtacgaggacttcggcacacccgtcgacacggcgatcgggcagatccagatcgaacggcggctctcggccgggtacctgggcgccgaccaccgtacggcgcgggcccccgacctgatggaacagcagcaccgcaccgacctggccctgaccgccctgcgcgacgcggtccgggacggggaccggggccggctctccgaccggcagcggcatgccctcgacgccatgctcgactccaccggccggctggagaagctgcgcgatcgcgtgctgtcccgggacatcacctgggaccgcgcggtggccgagtacagcggcctggtggagccgggcttcgacgtccagtccaccctcaccgcgctccaggccgggcagctggcacgcgaggcgcaggtcgtcatcgagctggtgcgggtgcgggagttcgtgtcgcgcgaggacgcgctcgtcgccggggcgcgggccgccggaacgctcaccgaccgccagtacgacgcgctcaccgcgacgatcgaggaccgccgggtcttcgagcggacgtatgtgccggaccttccttccgactcgcgggcgctgttcgaggagttccagcgcggcgccgtccaccgcgcgttgacgaggggcgaggacgccctgctgcgggcgggggcggaccgggcgggcgaggccgtggcggccgactcctggcgcactaccaccgaccgtgccgtcaagcgctacatgcggctgtgtacgcggtcggccgtcaactccgccgaccggggacgggcgttcgcctaccgggagctggccaaggccgcggtcgtcggggtcctcgggctggccgccgtgggcctgtccctgtggttcgcggtgcgcggcgcccggcgcatctcgcgccggctggagctgctgcgggacgccgccgatctgctgaccaaccaccaactgcccgacgtgatgacgcggttgagcgcgggcgaggacgtggacgcggtggccgaggcgccgccgctcgccgatggggagctgcggcccgacgagatcggccaggtcggccgctccttcaacaccgcacgcctcgcggccgtcgaggccgccgtcaagcaggccggcctgcggcgcgggctcttcgcggtgctcctcaacatcgcccgccgcaaccaggcgctcgtgcaccgtcagctgaagctcgtcgacacgctggagcggcgtacggacgacccggacgtcctggaagagctgttccggatcgaccatctgaccacccggatgcggcgccacgcggagagcctgatcatcctctccggcgcggcgcccggccgcagatggcggcggcccgtgcccgtcgcggacgtcgtggcctccgcggtgggcgagatcgaggactacgcccgcgtggtggttccgccgatgccggaggtgggcgtcgcggcggacgccgtcgcggacgtcgtccatctgatcgccgaactcgccgagaacgccaccgtgttctcgccgccccacacccgggtcaccatgcgctgcggccgggcgcagggcggcttcgtcctggagatcgacgaccggggcctcggcctcggacccgaccagatcgaagaggcccaccgcaccctcaccgggcccgacgacttcgaccccacccagcacgaccggctcgggttctacgtggtggggcgactcgccgcgcggcacggcatcgaggtcacgctgtgccggtcgccgtacggcggcacgaccgccgtcgtgctgctgccggaggcggtgctcgcgaccgtggagcccgcggcggcggacgcggagcctcgcgccgcgcggcgggagccggcctcgcggagcggcaccgcgccggccgcccgcgagcaggcgtcggacggtcctcgcgagccggcgtcggagcgtcctcgtgagccggcgtcgcagcgtccccctgagcaggcgctggaccgtcctcgtgagcaggcgctggaccgtcctcgtgaggtgagcgtggagcgcgaccgagagtggctgcggcgccgtacggcggacaccggcccggacccgggcgcgcccgccctgcccacccgcacacgtcagtcctcgctcgcccccggcctgcgcaccgaaggcccggccgccgacgagacgccggaacgtgcggtgacccccgaggaggtgcgcgcggtgttcggggccttccagcgcggcctcgaccgtggccgtaaggggatcccggcgcaggccggcccccaggagcgaaccgacaccgaggaaggaacggaccccgacgatgcaccg

SEQ ID NO: 6868 - DNA, 537 bp, Streptomyces avermitilis
  CDS (1)..(537)
atgcaccgtgagcaggcccccgagcaccgtgatcgaacctccgagcaccgcgatcggacccccgagcgccgtgaccggacccccgaaccgcccggccgggcttccgggccggccgcccccgcccccgcttccgagccgcccggcacggacctcggctggctgctcgaggacctcgtggccagaaccgaccatgtccgccaggccgtcctcctcaccgcggacggcctcccgctcagtgcctcggacggcatgcgcgcccgggacatcgagcacctcgccgccgtctgctccggtttccacagcctggcccggtcggcgggggagcggttcgccgccggcgacgtacggcagaccatggtgatgctcgacgacgcctacctcttcatcaccccggcgggcgacggctcccggctggcagtgctgagcgaggtgcagacggacgtcggtcagctggcccacgagatggcgctgctggtccgccgggtcgggcgccacatggacgccgccgtgcggtcggccgtccacagcgccggttcc

SEQ ID NO: 6869 - DNA, 375 bp, Streptomyces avermitilis
  CDS (1)..(375)
gtgaccgacgaccactggtacgaggacgagaccgggccgatggtgcgcccctacaccgtgacgcggggccggacccggccctccgaccggcacaccatcgacctgatgtcccaggtcacagccctggagacggatcaggggcggccaggcgtcgatcacgcccgcgcgtccctgctcgacctggtgcgccgcgggccgcggccggtcgtcgagctggccgcggacgccgacctgcccctgaccgtcgtacgcgtgctgctcggcgacctcgccgaggccggtctgctgcgcatcgacgcgccgcggcggatggtgccgggcggcaccgtcgacccggagctgctgcgcgagatcgtggagaggctgcgcgagctg

SEQ ID NO: 6870 - DNA, 786 bp, Streptomyces avermitilis
  CDS (1)..(786)
atgcgcacagccctgctccagagctccggccgccccggctcgatcgccgagaacctcaaggtcctcgacgaggccgcgggccgtgccgcggccgccggtgccgggctcgtggtcgcgccggagatgttcctcaccgggtacgcgatcggcgacgacgtcccgcgcctcgccgagcccgccgacggagactccgccgacgcggtcgccgagaccgcctcccgccacggtgtcgcgatcgcctacggctaccccgagcgcgcgggcgagcaggtcttcaactccgcccagctgatctcggccgacggcacccggctcgccaactaccgcaagacccacctcttcggctgcttcgagcgcgaccacttcacgccgggcgaccagccggtggtgcagacggagctgaacggcctccgcgtcggcctcatgatctgctacgacgtcgagttcccggagaacgtccgcgcgcacgccctggccggcaccgacctcctcgtggtgcccacggcccagatgcacccgttccagttcgtcgcccagtccgtcatcccggtgcgcgccttcgagaaccagatgtacgtggcgtacgtgaaccgggtcggccaggaaggggagttcgagttcgtcggactgtccacgctggccggacccgacggagtggcgcgcgcccgggccggacacggcgaggaactggtcttcgccgacgccgaccccgccgccctcgccgcctcgcgcgaggcgaacccgtatctgaaggaccgccgcccggacctctacgggtccctcgtc

SEQ ID NO: 6871 - DNA, 1695 bp, Streptomyces avermitilis
  CDS (1)..(1695)
atgacgtccacggtgcccaacgccgtccagcacgccgacgcgcagcagccgccgatcaccatgttcggcccggacttcccgtacgcgtacgacgacttcctcgcccacccggcgggcctcggccagatacccgcgaccgagcacggcacggaggtcgccgtcatcggcggcggtctgtccggcatcgtggccgcgtacgagctgatgaagatgggcctcaagcccgtcgtctacgaggccgaccagatcggcggccggctgcggaccgtcggcttcgacggctgcgaccccgcgctgagcgccgagatgggcgcgatgcgcttcccgccgtcctccacggccctccagcactacatcgacctggtgggactggagacccggccgttccccaaccccctcgccgagacgacgccttcgacggtcgtcgacctcaagggcgagtcgcactacgcgaccaccgtcgacgacctgccgcaggtctaccgcgacgtgatgaacgcctggaacgcctgtctcgaagagggcgccgacttctccgacatgaaccgggcgatgcgtgagcgcgacgtcccgcgcatccgcgagatctgggcgaagctcgtcgagaagctcgacaaccagaccttctacggcttcctctgcgagtcggagtccttcaagtccttccggcaccgcgagatcttcggccaggtcggcttcggaacgggcggctgggacacggacttcccgaactccatcctcgaaatcctccgcgtcgtctacaccgaggccgacgaccaccaccgcggcatcgtcggcggctcccagcagctgccgctgcggctgtgggagcgcgagccggagaagatcgttcactggccgtacggcacgtcgctgaagtcgctccacgtgaacggcgagccgcgccccgccgtgacccgcctcaaccggacctcgggcaaccggatcacggtgaccgacgccaacggcgacatccgtacgtaccggtcggcgatcttcaccgcccagtcctggatgctgctctcgaagatcgcctgcgacgactcgctcttcccgatcgaccactggacggcgatcgagcggacccactacatggagtcgagcaagctcttcgtgcccgtcgaccggccgttctggctggacaaggacgagcagacgggccgggacgtcatgtcgatgacgctcaccgactgcatgacccgcgggacctacctcctggacgacggcccggacaagcccgccgtcatctgcctctcgtacacctggtgcgacgacagcctgaagtggctgccgctgtccgcgagcgagcggatggaggtcatgctgaagtcgctcggcgagatctacccgaacgtcgacatcaggaagcacatcatcggcaacccggtgaccgtctcctgggagaacgagccctacttcatgggcgcgttcaaggcgaacctgccgggccactaccgctaccagcggcgcctgttcacgcacttcgtgcaggaccggctgcccgaggacaagcggggcatcttcctcgcgggcgacgacatctcctggacggccggctgggccgagggcgccgtccagaccgcactgaacgcggtctggggcgtcatgcaccagctcggcggcacgaccgacgcgaccaacccgggccccggtgacgtctacgacgagatcgcccccgtggaactcccggaggac

SEQ ID NO: 6872 - DNA, 927 bp, Streptomyces avermitilis
  CDS (1)..(927)
atggcgacgaagctcggactcggccttccccagaacaagcagtacgacctcggtcgggacgtgcccgacgtggcacgcaccgccgaggagatcggttacgagagcctctgggtgtacgagcggctcctcgtccccgaccccgccacccagggtctgtacggcatcgagggcctcccctggccggacgggtaccgcggggtggccgagccgctcgtcacgctcacgctcgccgccgcggccaccgagcgggtccggctgggcagcagcgtgctggtcgcaccgctgcacgtgccgttccagctcgccaaggcccttgccacgctggacgcggcgagcggcggccgggtgatcgcgggcttcggcacgggctggtcgcacgacgagtacgcggccgcgtcggtgcgcccgttcgaggagcgcggcgcgggactggacgagctgatcggcgtgtgccgcgcggtctggggcccggacccggtgtcgtacgacgggcgggtcacgaagatcgccccggcggtcgtcggccccaagcccgcccggccgatccccatcctcctggcggcgggctccgggaaggcccagcgccgcctggtcgaccacgccgacggctggctgccggtgggcatgggcgccgaggcgctcgccgcacagtggcgcgggctccgggaactggccgccgaacgcgggcgcacggaaccgatccggacggtgctgcgcaccaacgcccagtacctggccaagggccacgccggggccggccggtcccccttcgagggcagcgccgaccagatcgtcgaggacctcgccgcgcacgccgaggtcggtctcgacgagatcctcgtcgaccttcagtccggcacgcgggacgcgcaggagctcaaggaggtcgccgccgaggtgtacgagaaggcgcgcgcggccgggatc

SEQ ID NO: 6873 - DNA, 672 bp, Streptomyces avermitilis
  CDS (1)..(672)
atggtgcggtcggaacagttcacgactcccgtcgacacggtcgtctcccgcatgcgcgcgctgtgcgaggtcttgccggagcgcgacggcgtagcggtcttcaaccgtgtctacctcgctgtcaccgaggagttcgaccggcggctggacgccggggggttcccggacccgcaggccgcgatcacgctggacgtgcggttcgccgagcgctatctgacggtggcggaggacgggcccgggcccgcgtgctggcggccgctgctgcagttccggcggcatccgggagtacggccgttgcagttcgcgctctcgggcatcaatgcgcacatcgggcacgatctcgcgctggcggtcgtggacgcctgccgtacgctcggctgcgaacccgccgatctggaagacgagttcgagcgtgtgggtgatctcctcatcacgctggaggagcggatccgcgaagatctgatgccgggccccgacctgctccagatcgccgacccgctcacgcatctgctgggctcctggagcctggagcgggcccgggacgccgcctggtcggcggcgcgggcgctgtgggcgctgcgccggctgccggacctggccggggagttcaccgagcgcctggacgcggcggtcggatgcgcgggtcgcatgctgctgaccccgctgccggac

SEQ ID NO: 6874 - DNA, 1110 bp, Streptomyces avermitilis
  CDS (1)..(1110)
atggtggcggtggcctcgttcgtggtcgccgtcggcaccgcgacggggatgatgtcggcgttcgacgacggccgtacgcccgaccaggcccgcccgcaagtgaccggcccgcccagccgccggccgctgcccgccgtcccgtccccgtcgcccgccacgacgtccgcgaggccgagtccggccaccccgtcggccgggcccggcccgaagtcctccccgagcaagagggagccgaccactgcggccgcccccgcccagctctatcgccaccccgaatcccaggtcctcgactgggtcggcgcgcatccggacgacgcccggcgcgcggtcatcgagtcccgcatcgccgaccggcccgccgcggtctggttcgccgacttcgctccgtcgaccatcaccgcccgggtcagggcggtcacggcggccgccgccgcgcaggaccgggtcccggtcgtcgtgccgtacacgatcccggaccgcgactgcggcggggcgtcgcagggcggcgcgcccgatctcgccgcttacgacgcctggatcgacaagttcgccgccgggctcggctccggcgaggtcatcgtcatactggagcccgactcggtcgcccagtccgactgtctgtccgaggggcggcaggccgaccgcttcgcctcgctggctcgcgcgggccgggtcctcaaggccgcgaaccccggggtccgggtctacttcgacggcgggcactccgagtggaatccggccgccaaacaggcctcgctgctcgaccaggcgggcgccgcctcgcccgccgcctccgacggcatcttcacgaacgtgtccaacttccaccgtacgagcgacgagatcgcgtacgcccggcaggtgctggccggcctcggcggccccgcgagcctgggcgccgtcatcgacaccagccgcaacggcaacggcgcgccggccggcggcgagtggtgcgatccggcgggccggaagatcggccgggcgccgaccctgacgaccggggaggccgggatcgacgcctacctgtgggtgaagctgccgggcgagtccgacgggtgcaagggcacgcccgggaccttctcgcccgcctacgcctatgaactggcgcgc

SEQ ID NO: 6875 - DNA, 1437 bp, Streptomyces avermitilis
  CDS (1)..(1437)
atggacctcggcgtgcgctggaaactgcacggcgacgggcggacgcccgcgccaggagcggtagtccgccccgacgaacggctgtcctggccccgcacggtcgggctcggcgcccagcacgtggtggccatgttcggggcatcgttcgtcgcacccgttctgatgggcctggacccgaatctcgccatcatgatgtccggcgtcgcgacggtcatcttcctgctcgccacccgcggccgcgtcccgagctacctcggctgctcgctctccttcgtgggcgtcgccgcggtgatccgcgcgcagggcggtaccagcgcgacggtgacgggcgcggtcttcgtggtcggcgtcgcgctgtttttggtggggctcgcggtgcagcggttcggggcgcggatcatccatgccgcgatgccgccgatcgtcaccggcgcggtcgtcatgctgatcggcttcaacctcgcgccggtgaccgcgtccacgtactggccgcaggaccagtggacggcgctgctggtgatggcgttcaccggtctggccgtggtgtgcctgcgcggattctggtcacggatcgcgatcttcctggggctggtcttcgggtacgggatctcgtgggcctccgaccggatcttcggcaagatccactcggtggacgcgagcggcaagctcaccgaccactggcgactcgatctgtccggcgtcggcaaggcggactggatcggcctgccgtccttccacggcccgtccttccagtggtcggcgattctcgtggcgctgccggtcgtgatcgcgctggtcgccgagaacgcgggtcacgtcaaggccgtcggcgagatgacgggtgatccgctggacgacaagctgggcaccgcgatctccgcggacggcgtcgcctcgatgctctccacggcggtcggcggcccgcccaacaccacgtactccgagaacatcggtgtgatggccgcgacccgcgtctactccacggccgcctactgggccgccgccggtttcgcgctcctcttcggcctctcccccaagttcggcgcggtcgtggcggcgatcccgggcggcgtgctcggcggcatcaccgtcatcctgtacggcatgatcgggctgctcggcgcccagatctggctcaacgccagggtcgacctgcgcaacccgctgaacctggtgccggccgccgcgggcatcatcatcggcgtcggcggcgtcagcctgaagttcacggacaacttctcgctgagcggcatcgcgctcggcacgctcgtcgtgatcatcgggtaccacgggctgcgagcgatggctccggcgcacctcaagacgcaggagccgctgctggattcgggcacctcgtcgtacgacgaggccgagggcgacaaggccggggtcagcgaggccggggacgacaaggccgaggatcagcgcgccagttca

SEQ ID NO: 6876 - DNA, 1263 bp, Streptomyces avermitilis
  CDS (1)..(1263)
atgagtgcacgcccccgtctggctgtcctcctcgcggccgcggccacgctcgccgcggtcgtcgttccctccgcctcggcccatacgcccccgaaggctccccggaccgccgttctcgacggcacccggctccagcagacccgactgcgactcgaccgcggcgacccccgactccggcgcacgctcgaggacttgaccgcccgcgccgacaactggctgaaccagggcccctggacggtcgtcgacaagccgaagcccgcccccggcggcgacgtccacgactacctcagccaggccccgtactggtggccctcgcagcccaagtccgccgacaatccctggggttgcccctacgtccagcgcgacggccaacgcaatcccgaggtcgacaccggcaccgaccgccaggacgtcgagaaggtcttcgactcggcgtacgacctctcgctggcctggtactacacgggcaggaagcagtacgccgagaaggccgccaccgtcctgcgcacctggttcctcgcgccggccacccggatgaacccccacctgaaccacgggcagttcatcccctgcaagtacgacggccgggccatcggcatcatcgacttctcgcagtcctacacgagcgtcctggacgcgctcgcgatcctggacacgggcgcccccggttggtccagggccgaccgcaccgcgatgcgcgcgtggaacgtcgactaccgcgactggctggtgaacagcgccttcggtgccgaggagggcgccgccaagaacaaccacggcaccttctacgacatgcagctcgccgccctggcgtacgcgaccggcgacacggacctcgcccggcggaccgtcctcggcgcgcgggcggggcgcatagccccgcagatcgccgccgacggcagccagccccaggagctcacccgcacccgcagctggcactactcgaccttcgacctggtcgcctacacgcgcctcgcggccatcggcaggcacgtcggcgtggacctgtgggcgtacgagggaccggacggtcagagcctgttcaaggcggtcgactatctgctgcccgcggcgacgggggccgcgccctggccgcacccggagctggagttccaccggttcgcggcgagcgacgtcgtgcacgcggcggccgatgcgggggaccgggcggcgcgggcggcggtcccgaagctggaggcgccgcccggcggcgacctgtgggcgctgcggcccgccgccgagcaactggactcgatcgcgggc

SEQ ID NO: 6877 - DNA, 468 bp, Streptomyces avermitilis
  CDS (1)..(468)
gtgaccgccgaagccgccgaagccccgaccgcgcccgctccgtcctacggccggctgatccccgtcaccgtccacttcgacgacctggacgcgctcggactcctccacaacgcccgctacctggtcatggccgagcgcgcctggaccagcctgtggaacgagcgcggcttcggcggcttcgagggtgactgggaggcggccggcgacttctgcaacgccgtcaaggagcagcggatcagctacgaggccccggtcacccggccgggcgcgtacgccgtgcacctgtggctggagcggctcgggaacaccggactgacgttcggcttccggttctgctcggcggacggcgcgctgacgtacgcgcacggcacgcgggtcctcgtccggctcgacgccggcaccctgcgtcccgcgccgtggagcgagccgttcagggtcgtggggcgggagctgctgcgctcggcggac

SEQ ID NO: 6878 - DNA, 1209 bp, Streptomyces avermitilis
  CDS (1)..(1209)
atgggtgaagtggttgacgacgtgcgtgagttgaagcgcgcccggtatgccgtggccgccgtgttcgcggtgcacggcgcggtgaccggttcgttcgccacgcgggtcccgtggatccaggaccatgcctcgatcggcgcgggacagctcgggctcgcgctcgccttcccggcgatcggcgcgtccgtggcgatgccgctcgcgggccggatcagccaccgtttcggttcccgcaccgcgctgcgcgggctgatcagcctgtggacgctggcgctggtcctgccctcgctcgcgccgaacctgtacacgctctgcctggcgctgttcacgtacggcgccacggcgggcatggcggacgtggcgatgaacgcgctcggcgtcgaggtcgagaaccgcctcgacaagtcgatcatgtccgggctgcacggcatgtggagcgcgggcgccctggtcggctcggcggccggcaccctcgccgcccacctgggctccgacgcgcggatgcaccatgtgctggcggccggggtcctgacggttctcggcctggtcgcctgccgatgggtgctcgacctgaagcccaccgaggacgaggagccgcccccgcggttcgcgctgccgcccaggtcggcgctgctgatcggcgcggtcggcttctgcgcggtgttcgcggagggcgcgagcctggactggtcggcggtctatctgcgcgaccggctggacagctcggccggcctggcggcggcgtccaccacggccttcacgctcaccatggccgtcgcgcggatcgcgggcgacgcggtggtggaccgcttcggcgcggtgcgcaccgtacgcgtcggcggggtgctcgccacgctcggcgggctgctcgtcgtgagcgcctggcacccggcggtggcgatggtcgggttcgcgctgatgggcctcggcatcgcggtggtcgtcccgctggcgttcgctgcggccggccgcagcgggcccaacccgagccaggccatcgcgggcgtcgccaccatcacgtacacctcggggctggtcgccccgagcgcgatcggcacgctggcgcaggccaccagcctgatggtctccttcggcctggtgaccgtgctggcctgcgggctcgtggtcttcgcgggcgtgctgcgcgcgggcgaccgaagccgtccgacggtcagtccgccgagcgcagcagctcccgccccacgaccc

SEQ ID NO: 6879 - DNA, 1185 bp, Streptomyces avermitilis
  CDS (1)..(1185)
atgcccgcatctccgagcaccgccagggccatcaacgaccggctcgcgctgcgcctgctgcaacaggaaggccccctgacggcggggcagctgaagcagctcaccggactgtcccggccgaccgtggccgacctcgtcgaacgcctcaccgccgccgggctgatcgcggtcgtgggggagtcgggcgagcagcggcgcggcccgaacgcacggctgtacgggatcgtcgccgaccgcgcgcacctcgcggccctcgacgtacgcaccgagggcgtctccgtcgtcgtgtccgacctgctgggcgcggaactcgcccgggcgtcggtcccgatcgccgacgacacggggacgggaccggccgtcgagcaggcggtggcgctggtggagcgcgccgcgaaggaggccggagccgagcgcctgcacacggtcgggatcggcgcgcccggcctgatcgaccccgccaccggcgaactccgcgactcctccggtctgccggagtggcaccgccgcctggtcgccgccctccaggagcggctcccggcccgggtgaccgtcgagaacgagaccaacctcgccgccctggccgaacagcgcgagggcgccgcccgcgaccgggacacgttcgtgctgctgtggctgggccacggcaccggcgcggccgtcgtcctcgacggcagactccgccgtggcgcctcgggcggcaccggcgagatcggcttcctgccggtaccgggtacgggcgcactgccctcggcgacggactgcgagggcggcttccactcactggcggggtcggcggcgatcgcccggctggcgagggagcacgggctcgtggcggccgggccggcccatgagccgcaggcggcggcgctggtgcgggcggcggccgcgaccccgagctccccgcgttccgcccgcttcctcgacgtcctcgccgaccgcctcgccatcggcgccgccgccgtcgtggccgtcctggaccccggctgtgtggtcctggccggcgaggtcgggcaggccggcggggacgtcctcgccgcacgggtcgaggagcggctcgtccggatgtcaccgctgccggccgaggtgcgggcgagcaccctgggcggcgacgcggtgctgcgcggcgccctgctgaccgcgcgggacggcgcacaggacgaactgttcgggccctcgccccgg

SEQ ID NO: 6880 - DNA, 606 bp, Streptomyces avermitilis
  CDS (1)..(606)
gtgttcaccggaatcgtcgaagagctgggtgaagtcaccgccgtcgagaacctcggcgacgcctcccgcttccgtctccgtggacccgtcgtcaccgagaacgcgcagcacggcgactccatcgccgtcaacggcgtctgtctcacggtcgtcgagcacgagggcgacgaattcaccgccgacgtcatggcggagaccctcgaccgctccagcctcggcgctctcgccgtcggctcccgcgtcaacctggaacgtcccatggccgtgggcgcgcgcctcggcgggcacatcgtgcagggacacgtcgacggcacgggcgcggtcatcgagcgcaggccgtcggagaactgggagatcgtcaaggtctcgctcccggccgacctctcccggtacgtcgtggagaagggctccatcaccgtcgacggcatcagcctcacggtcgtcgacgcgggcccggactacttcaccgtcagcctcatcccgaccaccctcgcgctgaccaccctgggccgcaagcagcccggggacccggtcaacctcgaggtcgacgtcgtcgccaagtacgtcgagcgcctcctcggcgaccgcaccagggagaccgcgaag

SEQ ID NO: 6881 - DNA, 642 bp, Streptomyces avermitilis
  CDS (1)..(642)
gtgaactggctcaactccgaagccttcacggtcctcgaccagcacatcatctggtccgacatgatcggcaacaccgtcggtctgatcgccctggccctcggctggctgcgcaacataggaacctggcccgcccaactcctgtccggtgccgtcctcgtggccgccaacctctccgtgcaccagggcggcggcgtcggcaagcaactcgtcgtcatcgtcgtggccctctacggctggtacgcctggacccgcggcaggcagcaggcccaggacggcaccatcgccgtacggttcgccacctggcgggagcgcgcctacctcgtcggcggcgccgcgatcggcaccctcgccgtcggcggcctgttcaccgcctacccctcgctctcctggagcccgtgggccgacgcgtacatcttcgtcggcaccctcgccgcgatgtacgcccaggcgcgcggcatggtcgagttctggttcgcctggctgctggtcgacctggtcggcgtaccgctcaacttccgcagtgggctcgccttctcgggcctcatctacatcgtgtacggcgcactcgtcctgtggggcatgcgcgactggtggctgcgctcccgcaaggccgggcagcccgttctggaaggagccccggca

SEQ ID NO: 6882 - DNA, 1287 bp, Streptomyces avermitilis
  CDS (1)..(1287)
atgaccacggcgccgatcctgtacagcacggacaacatcgaggacttcgcgctcgacccggtcgagcgggccatcgccgacatcgcggccggccgcccggtcgtggtcgtcgacgacgaggaccgggagaacgagggcgacctcgtcatcgccgccgagaaggcgacccccgaaatcgtcgccttcatgatgagcgagtgccgcggcctgatctgcgcgcccatggagggcggcgaactggaccgcctccagctgccgcagatggtcgaccacaacaccgagtcgatgcggacggcgttcaccgtgtcggtcgacgcgagcggcgcgcacggggtcaccaccgggatctccgccgccgaccgcgcgaccacgctccggctgctcgcccagggagaggcgggggccgccgacttcgtccgccccggccacatcttcccgctgcgcgccaagcccggcggggtcctcgtccgcaacggccacaccgaggccgccgtcgacctcgcccgcctcgcgggtctgcgaccggccggcgcgatcgtcgagatcgccggcgaggacggccacatgctgcggctgccggagctgatcccgttcgcccgcaagcacggcctgacgatcatctccatcgaggacctgatcgcctaccgccagagctccgagcccaccgtccggcgcgaggccgaggtccatctgcccaccgccttcggcgagttcacggcctacggctaccgctccaccgtcgacggcgtcgaacacgtcgccctggtccacggcgagatcggcgacggcgagggcgtactcgtccgcgtccactccgaatgcctcaccggcgacgtcttccactcgctgcgctgcgactgcggcccccagctggaggcctccctggagcgcatccgcagcgagggccgcggcgtcgtggtctacctccgcggacacgagggacgcggcatcgggctggtgtccaagctgcgcgcgtacgagctccaggagcgcggccgcgacaccctcgacgccaacctggaactcggcctgcccgccgacgcccgcgactacgcggccggtgcgcagatcctggaggacctcggcgtccgcagcctgcggctgatgaccaacaaccccgacaagaccgacgcgctcctgaggcacggcctcaaggtcaccgggcgcgagccgatgcccgtacaggcgggcgagcacaacctccggtacctgaccaccaagcgggaccggatgggccacgatctgccctggctggacacggtccccgtgtccacctgcggcaaccag

SEQ ID NO: 6883 - DNA, 483 bp, Streptomyces avermitilis
  CDS (1)..(483)
gtgagcggcaagggtgcacccgaactgtccgtacgcaactgcggcgacctgcgcgtcgcggtcatcgcggcacagtggcacgaaaaggtgatggacggtctggtggacggcgcgctgcgcgccctgcacgaactgggaatcgacgagccgaccctcctcagggtccccgggagcttcgagctgccggtcgtcgccaaggtcctcgcgggccggggttacgacgcgatcgtcgccctcggcgtcgtcatccgcggcggcaccccccacttcgacttcgtgtgccagggcgtcacccagggcctcacccaggtctccgtggacaccggcgtccccgtcggcttcggcgtactgacgtgcgacaccgaggagcaggccctggaccgcgcgggcatcgagggctcccacgaggacaaggggcacgaggcggtgaccgccgccgtggcgaccgcggccacgctgcgctcagtatccgaaccctggcgc

SEQ ID NO: 6884 - DNA, 270 bp, Streptomyces avermitilis
  CDS (1)..(270)
atgtccaagaagacgttcgaggagctcttcaccgagctccagcacaaggccgccaacggcgacccctccacttcgcgcaccgccgagctggtcggcaagggcgtccatgccatcggcaagaaagtcgtcgaggaggccgccgaagtctggatggccgccgagtacgagggcaaggacgccgccgccgaggagatctcgcagctcctgtaccacgtccaggtgatgatggtcgcccgcggaatctccctcgacgacgtgtacgcccacctg

SEQ ID NO: 6885 - DNA, 855 bp, Streptomyces avermitilis
  CDS (1)..(855)
atgctgcgcatcgccgtccccaacaagggttccctgtcaggccctgcggcggagatgctccatgaggccggctaccagcagcggcgggagtccaaggaactgcggatcgtcgacccggagaacgaggtggagttcttctacctccgcccccgcgacatcgcgatctatgtctcctccgggcgcctcgacatcggcctcacgggccgcgacctgctcatcgactccggggccaacgcggaggagatcctcccgctcggcttcgcccgctccaccttccgtttcgccggcaagcccggcaccgccaagggcatcgaggacctcgcgggtctcactgtcgccacctcgtacgagggcatcgtcgccaagcacctcgccgacagcggcatcgacgcctccgtcgtgcacctcgacggcgccgtcgagaccgccatcgaactcggtgtcgccgaggtcatcgcggacgtcgtcgagaccggcacctcgctgcgcaacgcgggcctggaagtgttcggcgagccgatcatgaagtccgaggccgtcgtcatccgccgcgtcggagccggcaccgacgaggccgccgagtcgaaggtgcagcagttcctgcgccgcctccagggcgtcctggtcgcgcggacgtacgtgatgatggactacgactgccgcgccgagcacctggagaaggccgtcgcgctcaccccgggcctggagtcgccgaccatctcgccgctgcacaacgagggctgggtcgccgtacgggcgatggttccggccaaggaggcccagcgaatcatggacgacctgtacgcgctcggcgcacgggccatcctgaccacggccatccacgcctgccgcctc

SEQ ID NO: 6886 - DNA, 462 bp, Streptomyces avermitilis
  CDS (1)..(462)
atgcccgatctgtctgctttgcctgccctgcctgtcaccttccggccgggccgtacccgtgccgtcctgctgaccgccggcgtcaccatctttgtggttctcaccacggtcgtgatgctcctcgaaaccctcaccccggcggaacgcctcagcttcgtcttcaccgcggcgctgctctgcggcgtgctcgtcctcctctcccggcccaaggtcgtcgccgacgagagtggcgtcaccgtcgtcaacatcaccagcaggcggcacctggcctgggcggaaatcctccaggtcaacctgcgtcccggtgatccctgggtgttcctcgacctcagcgacggcaccagcctgcccgcgctcggcatccagccgggcatcgccaaacagcgtgcgatcgccgacgcgcggacgctgcgggcgctcgccgaggcgcgttccgcacgggaccccgaggaacatcagggc

SEQ ID NO: 6887 - DNA, 1419 bp, Streptomyces avermitilis
  CDS (1)..(1419)
atgaccgactctctgctgctcctcggggcggcattcctgctcattctggccaacggcttcttcgtggccgccgagttcggactcgtcacggtcgaacggccggaggccgagaaggccgcggccgagggcgaccgacgggccggtacggtcgtcgagtcgctgaaggagctgtccttccagctctccggcacccagctcggcatcaccatcacctcgctggtcgtcggcatgctcgccgaaccggcgctcgccgacctgctgcacggcccgttcaccgccatcggcctccccgaaggagccgtccccgggatcgccgtggtcgtcggcatgctgctggcctcggccgtgcagatggtgatcggcgaactcgtgcccaagaactgggcgatctccaagcccttgcaggtggcccgcttcgtcgcgggcccgcagcatgtgttctcgcgtctgttccggccggtgatcgcggcactcaacacggtcgccaaccggctggtgcgcgccctgggcgtggagcccgccgaggagatggcctccgcccgcacccccggcgaactcgtctccctcgcccggcactcggcccaggccggcgcgctggagcaggacacggccgatctgttcgtacggacgctgtcgctcggcgagctgaccgcacagcacgtcatgaccccgcgcgtgcgggtcagcgcgctccagtcctcggcgaccgccgaggacgtggtcaacctcacccgtgccaccggcctgtcccgcttccccgtctaccgggaccggatcgacgagatcgtcggcatggtccacctcaaggacgccctcgcgatcccctcccgcgaccggctgcgcacccccgtcggccggatcgcccagccgccgctgctcgtcccggagacgctgcccgtgcagcccctcctggcgcggctgcgcagcgagcagcccatcgccgtcgtcgtcgacgagtacggcggtacggcgggcgtcgtcaccctggaggacatcgtcgaggaactcgtcggcgaggtccgcgacgagcacgacgggcaggacctgcccgaactcgccgtcgcaccgcccgaggacgggcggcccgcatgggacgcggacggcagctgccgcgtcgacatcctccagcgcataggcctcgacgtgcccgaggggccctacgagaccgtggccggcctcgtcgccgatctgctcggccgcatccccgcccccggggaccgggccgagctccccggctggcggctgtcggtgcgccaggtcgggcactaccgcgccgagcgggtccgtctggtgaagaccgcggacaccacagacaccacagacaccacaggcattgcggacatcgcggatgcctcggtcacagcgggcgcgggcaccagggacaccgcggcttccgcgcctgccgcggaggctgtccga

SEQ ID NO: 6888 - DNA, 1092 bp, Streptomyces avermitilis
  CDS (1)..(1092)
atgaccctgctccagctactgttggccgccctgctggtgctcgccaacggcttcttcgtcggcgccgagttcgcgctcgtctccgtacggcgcagccagatcgagccactggggacggcacgggcccgccaggtgctgtacggcctggagcggctgccgcagatgatggccgcggcccagttcggcatcaccatctgctcgctgacgctgggcgcggtcgccgaaccgacggtcgcgcatctgctcgagcccggcttcgaggcggcccgtctgcccgacgggatgatccaccccctcggatacgtcatcgcgctggccctcgtcgtcttcttccacctggtcatcggcgagatggtgccgaagaacctggcgatggccgcgcccgagaggacggcgctgtggctcagcccgggcctggtcgccttcgcccggctgtgccggccggtcacggtcgcgctgagcgcctgcgcacgggtgatcctgatgctcttccgggtggagcccaaggacgaggtcgaggcggtcttcaccagcgagcagctcaaccagctggtggaggactccggccaggccggtctcctcgacccggaggagcaggagcgcctggaggacgcgctggaactgggctcgcgcccggtcacggacgtcctgctggaccgcgactcactggtgaccgtgggcccctcggtcacgcccggcgaggtggtggcgctgaccgcgcgcaccgggtactcccgctttcccgtcgccgcggagaccggcgccttcatgggctatctccatgtgaaggacgtactcgatctggaggagtccgagcgggcggtgccgcagcagatctggcggccgatgaccacgctcggcgcggagctgccgctggacgacgcgctgaccgtgatgcgccgggccgccacgcacctcgcgcaggtcgccgacgggtccgggcgggtgctcggcctggtcaccatggaggacgtcctggagctgctggtgggcgaggtcagggacccggcccaccgggacgcgcagccgccgagccgggtgacggaacaacgcgccgagacgcccggcgaggcactggcgagccagcttcgg

SEQ ID NO: 6889 - DNA, 1860 bp, Streptomyces avermitilis
  CDS (1)..(1860)
atggacttcggcacgcggggccccgaggctccggccgacctcgcctggctgcgaggtgtggatgcctacacgatgggcgcctatccgcaggcggaggaggagttccgcaccgcggtgcggatggatccgggcatggccgacggctggctcggactgcacgcgctgcgcgtcgacacgacgaccgcgctgctccggatgttccggcaccgggaccgcttcggggagcagcgcacccggcaccggcgcaccctcaactcctggtactggctgggctggtgggtgcagccggtgctggagagtccgcgcgatctgctgctcgcgcacgcctcccactggctggacggacgccatgtccccgacctggaccgggcgctcgcgagcctgccgccggtggacacggacccgcaggtgcgcttcctgcacgcctgccgggcctatctggtcaaggactgggagcagctggtccggcacacggatccgctgatcgacgacgccatgctgggtatcgaggccgggctgttcggcggcatggcccgggtccggctggagatgttcggacaggccgagcccctgctgtccgccgcgctgatgcgctgccgcagcgagcagccgcagcgcaaggagctgcgctactggctggcacgggcgcacgagggcacgggccgcagcgccgccgccctgcccctgtaccgggcggtgcaccgggtggaccccgccttcatggacacctccgcacggctcgcggcgatctccgacggcgacgggtacgacgaggcggtcgacctcgcggcgatcacgctcaccgggatcggacaggacctgatcgacgggccggacggggtggatcccctcttcggcggcgaggggcgggagctgaagctctccgagcccgaaccggcaccgcccggcgccctgccacaggaggccgacgcggtacgggagaagaccgtggtgccggtgcagccgctgccggccgggcccacggaccccgagctcctcgaggaggcgctggcggagctggagcggatggtcgggctcgaaccggtgaagcgccaggtcaaggcgctgtcggcgcagttgaacatggcgcggctgcgggccggccagggcttacccgtacagcctcccaaacgccacttcgtcttctccggaccctccggcaccggcaagaccacggtggcgcggatcctgggccgggtcttctacgcgctcgggctgctcggcggcgaccatctggtggaggcccagcgggcggacctggtcggcgagtacctgggccagacggccgtgaaggccaacgagctgatcgactcggcgatcggtggcgtcctgttcgtggacgaggcgtacgcgctgtcgaactccggctacggcaagggcgacgcgtacggcgacgaggcgctccaggtgctgctgaaacgggccgaggacaaccgggaccacctggtggtgatcctcgcgggctacccggagggcatggaccgcctgctggccgcgaaccccggtctctcctcccgcttcaccacccgcgtggacttcccctcgtaccgcccgctcgaactcacctcgatcggcgaggtgctggccgcggagaacggcgacgtgtgggacgaggaggcgctcgacgagctgcgctccatcagcgggcacgtcatcgaccagggctggatcgacgagctcggcaacggccgcttcctgcgcaccctgtacgagaagagctgcgcgtaccgggatctgcggctgacgggctatccgaggaccccgtcgcgggacgatctctccacgctgcggctgccggatctgatgcaggcgtacggcgaggtgctgtcggggcggggaccgcaggatccttcggcactg

SEQ ID NO: 6890 - DNA, 651 bp, Streptomyces avermitilis
  CDS (1)..(651)
atgcccacaccccgccgaccccgaggaacgaccattcacgacctcgcctcccgcctgcgacgactgccgccctcgtgcggccccgtccggctcgtcggcgtcgacgggcacgcgggctccggaaagtccacgttcgccgggcggttggccgcggcactcgacggcgcgcccgtgctgcacctcgacgacatcgccacgcacgaggagctgttcgcgtggacggaccgtctgctgcgcgaggtggtggcaccgctcggccgcggcgagcccgcgcactaccgcccctacaactggcacacccgcgacttcgacccggcccgcgccctgccgcccgcgcccgtggtcctcgtcgagggcgtcggcgcgggccgccgggcgctgcgtccgtatctcgcgcggctgctgtggatggagctgccgcacgaggcgtcctggacgcgcgggcgggagagggacggcgaggcgcagcgcgagttctgggccgggtgggtcgaggcggagcgccggcacttcgccggggacccgtccaggcccttcgccgaccttctggtacagcagtgtccggaggggtacgaggtgctgccggggcctgctgggacgccaggaccggaccaggatctcacgcacagtgagggaccatccgcaatgtgc

SEQ ID NO: 6891 - DNA, 996 bp, Streptomyces avermitilis
  CDS (1)..(996)
gtgcgcaacggcgtggcatcggacggggatggacaggggagcatggccgcggggttattcgaggggcagtacgtatggcatccggcggccgacgaccgcacgctcgcgagcgtatgcgtggatgtgcgcgccgggcgttatcggagcgcgcgcgaagcgctcgccgacacgcgcgacgatttcggactgcgtgcccatcgctcgctggtcctcgcctcggaggcggccgactccgacctcgcggagcgctggctggccgaggagcccactcccgaggccgcactgctgtgggcgcgggtcgcggtgctgcggacgctgcgtgccgccgccgcccacgacgagcgcgccgaggcgctggagcgcatcgcgctcaccgcgtgcgagcgggcctcgacggcggccccgcacgatcccacgccctgggtggccaagctgacgatggcccggctgcacgacatccgcgagccggccccgcaggggctgctcaccgcgccggccggcccctggcggctgttctcgcacgtcctgcggctcgacccgtggaaccgtgaggcccaccaccgcttcctcgcctgcttcttcacgcggtacggcggctcggtgaacgcggcctgggacgtcgccgcctttctgggccagcgggcccccgccacctcaccgctgcgcctgctgcccctggtcgccctcgtggagagctacaaccccgcgcaactgctggccgaccgggtctgggagcagccccagtggcgcgccaccgccctcgccatctaccagaactggctgcccgagaccgcgggctaccgcttcacgccggtgctcgacctcgcgtatctcgcgcacgccctgttgatggcccagcgcgagttcgaggcgcgcgccgtcttcatggccatggggccctacgcctcccgtatgccctggagcgtcttcggcgaccccgaggagcagctctcccgcgcccgccgttcctgcggactgcccgtacccggagccgcc

SEQ ID NO: 6892 - DNA, 1548 bp, Streptomyces avermitilis
  CDS (1)..(1548)
gtgtcagaacggatatcagcgcccggtacgtcacatgcgagaggacgtgcgggtgcggatcccggcgcactcgacgacgatgcgacgctgcatgcgatgggctatccgcgcaagctcacccgacgatttcaggcgttcgacaatttcgccatctccttcaccatcatcaacatcatctcgggcatcttctcgtccttcggattcggtatgaacgcgggcgggccgcgcattctcgtcttcggctggatcggcgtttccgtcatggtgctgttcatcggggccgcgatggccgaggtcgcctccgcatatccgacgagcggggcgctctatttctccgccggaaagctcgccaagcggcacaagggcgcctggtcctggtacacgggctggctcaatttcgtggggcaggtgggcggtacggccgccaccggatacgcggccgccaccttcatccaggcgttcatcgccctgcaatggtcctcgtacgagccgaccgctcaccagacggtcctgatcacggcgctgatcatcgcgctccaggggctggccaacacctacaccgtgcagctcgtcgccgtcctcaaccggatctccgtgtggtggctcctgatcgggctcgtggtgatcgtgagcaccttgaccgtcatgcccgacgaccatcagtcggcctcgttcgtgacgcatttcgcgaacaacaccggtttcacgaacgggatttacggcgggatgctcggtctgctggtcaccagttggaccttcaccggcttcgacggcagtttccacatgtccgaggaaacggtccgggccacggtcaacgcccccaagggcatcacacgtgccatcggctattcggcgatcaccggactgatcctcatgctcgccctcgtctacagcattcacgactatgaccaggtggccggctcctcggcgccgcccgtgcagattctcatcgatgggcttggcatgggcactgcaaaggtgctgttgctgatcgtcatcggcgccatgctcttctgcggactggccaatctgaccagcaacacccggcagatcttcgccttctcccgggacggcgcgatgcccggctcccgctggtggcacacggtctcgccgcgcacccgtacgcccgtcaaggccgtctggctggcggtcggctgctcgctcgcgctggtgctgccgggctggtggtcccacaccgccttcaccgccatcgtcagcgtcaacgtcgtaggcctcttcctcgcctacgccgtgccgatcttcctcaggctgcggctcggcgacgagttccgggccggcccgtggaacctgggccgctggagcaggcccgtcggcatcctcgccgtgacctggatcctgctcagcagcgtcctgttcatgctgccgcaggcctcgccgatcaccgtcgactccttcaactacgccccgatcgcgctggccgtggtgctggtcgtcgccacggtgtggtggttcgccaccgcgcggcgccgcttccaggggccggtcagctacggccggccggacgaggtcgcggcgatggacctcgtc

SEQ ID NO: 6893 - DNA, 1350 bp, Streptomyces avermitilis
  CDS (1)..(1350)
atgaccagagcttcagagccgtcccgcagaaccgtcatcgccgcggcggtcgccgtggcagcggtcggcgccgcgggcccggcggccgcggcgccgaccgcccggccgacgaaagcatccccgaacctcgtggacaaccgcgcctggacctcgtactccgactggcgcgggggcaccgcgaagggcacccgggccgtcgcgggcgcccgccccggcctggcgatcgccacccccgcgggccgcaccgactacaccgacccgcacaccggcaggaccgccacctgggagtacgcgacctggacgtccccggtgcaccggctcgccgtcccctccaccgaggtgatcgcctcctggaacgcgcacaccccggccggcacctggctccaggtcgagctgacgggcacctactccgacggcaccgccacgccctggtacgtgatgggccgctgggcggccggcgaccaggacatccggcggacctcggtcgacggccagagcgacggcaagagcagcatctggacggacaccttcgccatcgacgacaccgcctcgggcctgcgcctggtctcctaccggctgcggctcacgctgtaccgcaccccgggcggcgggatcacgccgaccgtgtggcgcctcggcgccatgggctccgacatcccggaccgcttcaccgtgcccgcctcggcgccggggctcgcccaggagctgagggtcccgcgctactcgcaggagatccacgccggccagtaccccgagtacgacaacggcggcgaggcctggtgcagccccacctcctcacagatgatcatcgagtactggggccgccggcccacacccgggcagctggcctgggtcgacccctcgtacgccgacccgcaggtgtgccacgcggcccgcttcacctacgactaccagtacgcgggctgcggcaactggcccttcaacgcggcctacgccgcgacgtacaaggacctccagggcgtggtgacccggctcggctccctcggtgatctggagacgctgatcgcggcgggcatcccggtcatcacgtcccagtcgttcctcaagacggagctgacgggggcgggctacggcacctcgggccacctgatgaccgtgatcggcttcaccgccgacggcgacgtgatcgccaacgaccccgcgtcgcccggcgacgacgcggtccggcgggtctaccagcggcgcgagttcgagaacatctggctgcgcaccaagcggtacaacgcctccggcaaggtcgtctccggcacgggcggcgtctgctacctgtacttcccggcccatccctccgcgcgccggcgcaaggcgctcgcggcggtgggcgtccgc

SEQ ID NO: 6894 - DNA, 138 bp, Streptomyces avermitilis
  CDS (1)..(138)
atgaccgcaacctctgccaccgcaccccgcgtccgcacgggcggccccaaggaagacggcccgaagatcctggagcacgtcatgggctggaccctcgtggtggtcctcgcgatgctcgtcacccagctcggcctgctg

SEQ ID NO: 6895 - DNA, 657 bp, Streptomyces avermitilis
  CDS (1)..(657)
ttgaacaacagtcaacagcgcggcgtggtgcgccccggggcacggggcacggaccgctctgccgcgcgtcgcgccgaactcatcgccatcggacggaagctgttcgccgacacgtcgtacgacgcgttgtcgatggacgacatcgcccgccaggcgcacgtcgccaaagggctgatctactactacttcaagtcgaaacgcggctactacctggcgatcatcgaggactcggtgaccggcctggtcacccgcgccgccgaggggctggagctgccgcccgaccagcgggtgcaccgcaccatcgacggttacctccgctacgccgagcacaaccaggcggcgtaccgcgcgatcatcagcggtggcgtcggcttcgacgccgaggtgcaggccatacgggacggcgtgcggcaggcgatggtcgacgcgatcgccgaaggcgcttacgggcgccacgagatcgcgccgctcgcccgcatgggcctgctcggctggctgtgcagcgtcgagggtgccaccctcgactggaccggccgcccggagctgccccgcgacatcatgcgcaaactgctggtcaagatgctcggcggcaccctgcgcgccatcgaggagctcgacccggcgtatccggcaccgccggccgcccgccgggacacc

SEQ ID NO: 6896 - DNA, 1281 bp, Streptomyces avermitilis
  CDS (1)..(1281)
atgctcagtccgcaccgcccccgcgtcctcccccaaacccgcaaacctgttcgaacagggggcgcctccctgcgggcgctcctgtccgccgcatgttgcgccgtcctcggcgcggggctgctcgccggcgcgggcaccgcgaccgccacggaggcccaggcccccgccagggcggccgccgccggctccaaggtcgtcgggtacttcaccgaatggggcacctacgaccgcaagtactacgtcaagaacatcgagacctccggctcgggcgccaagctcacgcacatcaactacgccttcggcaacgtcacgggcggcaagtgcgcgatgggcgacgcgtacgcggcgaccgaccgggcgtacaccgcggccgaatccgtggacggcgtcgccgacacctgggaccagccgctgaggggcaacttcaaccagctgcgcaagctcaagaagctccacccgaacctcaaggtcctctggtccttcggcggctggacctggtcgagcggtttcggcgaggccgccaagaacccggccgcgttcgcccagtcctgctacgacctggtcgagaactccaagtgggcggacgtcttcgacggcatcgacatcgactgggagtaccccaacgcctgcggcaacacctgcgacaccagcggcaaggcggcgtacaagaacctgatgggagcgctgcgttcgaagttcggcagcggcaacctcgtcacctcggcgatcaccgcggacgccaccagcggcggcaagatcgacgcggccgactacgcgggggccgcgcagtacgtcgactggtacaacccgatgacgtacgacttcttcggcgcctgggacgcgaccggccccacggctccgcactcgccgctgaactcgtactccggcattcccaaggcgggttaccacacctcggcgaccatcgcgaagctcaggggcctcggcgtcccggcctcgaagctgctgctcggcatcgggttctacggccgcggctggacgggcgtcacgcaggcggcgccgggcggcagcgccacgggcccggcggcgggcacgtacgagcagggcatcgacgactacaaggtcctcaagacgaagtgcccggcgaccggcacggtcggcggcaccgcctacgccaagtgcggcagcaactggtggagttacgacaccccgtcgaccatcgccgggaagatgacgtacaagaacgcgcagggtttgggaggcaccttcttctgggagctgagcggcgacacctcgaacggtgaactgatcaaggcgatcaac

SEQ ID NO: 6897 - DNA, 1170 bp, Streptomyces avermitilis
  CDS (1)..(1170)
atgcccgaccgcgccccgcagccggtggaccgtcagctgcccacggatgaggcccgggatctgatctcgctcgtccgcgacatcgcgcagcgtgagatcgcccccgaggcggccgagggggaggacgccgggcacttcccgcgcgaagtcttcggactgctctcggaatcaggactcctcggcctgccctacgactccgagtacggaggcggcgaccagccgtacgaggtctacctccaggccctcgaagagctcgctgcggcccgcctcaccgtcggcctcggtgtcagcgtccacaccctcgcctgccatgcgctcgcccagtacggcaccaaggaacagcaggtcgagcacctgcccgcgatgctcggtggcggactgctcggcgcctactgtctctccgagccgtcatcgggatcggacgcggcctcgcttcgcacgaaggcggtgcgggacggcgacgactgggtgatcaccggcaccaaggcgtggatcacacacggcggcatcgccgacttctacaccgtcatggcgcgtaccggcggcgagggtgcccgcggcatcacggccttcctggtgccgggcgacgccgagggcctgcacgcggcgctgcccgagaagaagatgggcatgaagggctcccccaccgcgcaggtccacttcgacggcgtgcgggtgtccgacgagcggcgcatcggcgacgaggggcagggcttcgcgatcgccctgtccgcgctcgactccgggcggctcggcatcgcggcctgcgccgtcggcgtcgcccaggcggccctcgacgaggcggtcgcgtacgccaccgggcggcagcagttcgggcggccgatcgccgacttccaggggctgcgcttcatgctcgccgacatggccacgcagatcgaggcgggccgggcgctctacctggccgccgcccggctgcgcgacgcgggccgaccgttctccaagcaggcggccatggccaagctgctgtgcacggacgcggccatgaaggtgaccacggacgcggtccaggtgctcggcggctatggctacaccgcggacttcccggtcgagcgctatatgcgtgaggccaaggtcctgcagatcgtcgaggggacgaatcagatccagcggatggtcatcgcccggcacgtcgcgggtcccgactcgcgc

SEQ ID NO: 6898 - DNA, 426 bp, Streptomyces avermitilis
  CDS (1)..(426)
atgcagagtcttaagcgcccaggtcgtaccgcacccaagcggcagcagctcgtcatcgagcccgagccggagggtgtcgaacccggcgaggacgagttcgacgcctacgacaccttcgagatgtaccgggtcgtctgcccggactgcgcgcaaccgatcgcgctcctggcggacgaggaggtcctgcccgagcacgcgctgtgcgcgaccccgtggaacccgttcgggctgacggtctgcgccggtacgggccgccaggccgccgacgcccggccggcggacgagtccgtcgaaccccaggagcaggacaccgccctgctgttgacgctccctcagggcctcgactggcggacgcagccgttctcgcacgtcggcggccccggttcgcgcccgatgcgggtgccggacatgcggcgcgaggccgcc

SEQ ID NO: 6899 - DNA, 495 bp, Streptomyces avermitilis
  CDS (1)..(495)
atgacctgcgcggctcaggtatccgaggagatcagacgcactgtaggttcttgcgccatggaggagctcgaccgacagatcgtgcagctgctcgtcgccgatgggcggatgagctacaccgacctgggcaaggccaccggcctgtccacgtcggccgtgcaccagcgggtacgtcgcctggaacagcgcggcgtcatccgcggctacgccgcggtcgtggactcggaggccgtcgggttgcccctgaccgccttcatctcggtgaaaccgttcgacccgagcgcccccgacgacatcgcggaacgcctggccggcgtcccggagatcgaggcgtgccacagcgtggccggcgacgagaactacatcctcaaggtccgcgtctcgaccccgcacgagctggaggagctcctcgcccgggtgcggacgctcgcgggcgtctcgacgcgtacgacggtggtgctgtcgacgccgtacgaggcacgcccgccgcggatc

SEQ ID NO: 6900 - DNA, 1620 bp, Streptomyces avermitilis
  CDS (1)..(1620)
atgagtgagagcaccgccccgtcggacaccgtgctgctgcgcggtggagaagtccacagccccgccgaccccttcgcgaccgcgatggtcgtggaacgcggacaggtcgcctgggtcggctcggaaggcgccgcggacgccttctcggccggtgtcgacgaggtcgtggacctcgaaggcgccctggtcacccccgcattcaccgacgcgcatgtgcacaccacctccaccgggctcgcgctcaccggcctcgacctgtccggcgcaccctccctggaggcggccctcgccctcgtacgcgacttcgccgcggcccgcccggacgaccgggtcctgctcggccacggctgggacacggcccgctggcccggcggacgccccccgacacgcgccgaactcgacgaggcggccgacgggcgtccgctgtacctctcccggatcgacgtccactcggcggtcgtcagcaccgccctgctcgacctggtgcccggcatcaccggccgcgccggatacctggacggcccgctgacccgcgacgcccatcacgccgtccgcggcgccgcgctcggcgccgtctccccggcccagcgcaccgaggcccagcgtgccgccctcgcgcacgccgcctcgctcggcatcggttccgtccacgagtgcgcgggccccgagatctcctccgaggacgacttcaccggcctgctgcgcctcgccgccgaggagacgggcccccgggtcgtcggctactgggccgagtggggcgaagagggcatcgacagggcgcgtgccctcggagcggtcggcgccgccggtgacctcttcgtcgacggcgcgctcggctcgcacaccgcctgcctgcaccagccgtacagcgacgccgggcacacgggtacggcctatctggacgacgacgccgtcgccgcccacgtgatcgcctgcaccgaggcgggcctccaggcgggcttccacgccatcggcgacgccgccgtgacctccgtggtcgagggcgtgcgcgccgccgccgagaaggtcggcctcgcccgcgtccgcgccgcccggcaccgcgtcgaacacgccgagatgctcacccccgagaccatcgcggccttcgcggaactcggcctcaccgcctccgtgcagcccgccttcgacgcgctgtggggcggcgcggacggcatgtacgcgcagcgcctgggcgccgagcgggcccgtacgctcaaccccttcgccgccctcctgcgggccggcgtaccccttgccttcggctccgacagtcccgtcaccccgctcgacccgtggggcaccgtccgcgcggcggccttccaccgcacgccggagcaccgtgtctccgtgcgcgccgcgttcacggcgcatacgcgtggcggatggcgggcgatcggacgggacgacgcgggggtcctggtgccgggcgcgcccgccgactatgccgtgtggcgcaccgaggaactggtcgtgcaggcccccgacgaccgcgtcgcccgctggtccaccgacccgcgctcgggcaccccgggactgcccgacctgacccccggcggagacctgcccgtctgcctgcggaccgtggtgggcgggcggacggtattcgtacggcccaacgag

SEQ ID NO: 6901 - DNA, 795 bp, Streptomyces avermitilis
  CDS (1)..(795)
gtgaacgacggcgacgagaccctcacggcaggagctcaggggagacagttcggcccgctcggcaccgccttggtgatcattccgacctacaacgaggcggagaacatcaagtcgatcgtcggccgggtacgggcctccgtgcccgaggcgcacgtcctcgtggccgacgacaacagccccgacggcacgggcaagctcgcggacgagctggccgtcgaggacgaccaggtgcatgtgctgcaccgcaagggcaaggaagggctcggcgccgcgtacctcgcgggcttccgctggggcctggacaacggctacggcgtactggtcgagatggatgccgacggctcgcaccggccggaggagctgccccggctgctcaccgcgctcaagggcgccgacctcgtgctcgggtcccgctgggtgccgggcggccgggtcgtgaactggccgaagtcccgcgagttcatctcccgcggcggcagcctctactcgcgcctcgccctcgacctgccgcagcgcgacatcacgggcggctaccgggccttccgccgcgagaccctggaagggctcggcctcgacgaggtcgcctcccaggggtactgcttccaggtggacctggcacgccgcaccgtcaaggccggctaccacgtcgtcgaggtgcccatcaccttcgtcgagcgggagttcggcgactccaagatgagccgcgacatcctcgtcgaggcgctgtggcgcgtcacgacgtggggcgtcggggaacgggtcggacggatcacgggccgggggcccaagtcctcg

SEQ ID NO: 6902 - DNA, 570 bp, Streptomyces avermitilis
  CDS (1)..(570)
atgacgactggcgctccgactccgacgtaccccgcccgcccccggcgctctcggctgcgcacgttcctgccgctgggtgtggccgcatggctggtgctggagatctggctgctcacgctggtcgccggtgcggccggcgggttcacggtcttcctgctgctggtcgccgggttcgtcctcggctccgtggtgatcaagcgtgccgggcgccgggccttccgcaacctcagcgagacgctgcaacagcagcagtcggacgcgccggtgacccgcggcagaagcgacggcaacgggctgatgatgctcggcgggctgctgctgatgctgccgggcctgatctccgacgccctgggcctcctgctcctgatcccgccggtccagaaggccgtgagccggtacgcggagcgcaccttcgaccgcaagatccgcgaggcgacccccggcacgctgggcgacgccttccagcaggtccgcatccaccgccccgacggcaaggtggtccagggcgaggtcatcaggcaggacggcccccaggacccggagccgggcccgcgcccgccgctgaaccgc

SEQ ID NO: 6903 - DNA, 372 bp, Streptomyces avermitilis
  CDS (1)..(372)
atgagtgagcgagctcttcgcggcacgcgcctcgtggtgaccagctacgagacggaccgcggcatcgacctggccccgcgccaggccgtggagtacgcatgcgagaaggggcaccggtttgagatgcccttctcggtcgaggcggagatcccgccggagtgggagtgcaaggtctgcggggcccaggcactcctggtggacggcgacggccctgaggaaaagaaggccaagcccgcgcgtacgcattgggacatgctgatggagcggcgcacccgtgaggagctcgaagaggtcctcgaggagcgcctggcggttctgcgatccggcgcgatgaacatcgcggttcatccccgggacagccgcaagtccgcg

SEQ ID NO: 6904 - DNA, 1344 bp, Streptomyces avermitilis
  CDS (1)..(1344)
gtgggcaccgacaccgcgcaggcacggccgaccgacgaggccgccgagcgacggcgcgaacaacgcggctggtacttctacgactgggcctgctccgtctactcgacgagcgtgctgaccgtgttcctcggcccctatctgacgtcggtcgcgaagtcggcggcggacgcggacggctatgtgcatccgctgggcgtcccggtgcgcgccgggtcgttcttcgcgtactccgtgtccctgtccgtgatcgtcgccgtcgtggtgatgcccctggtgggcgcggccgccgaccgcacgggccgtaagaagccgctgctcgcggtgacggcctacgtgggcgctgcggcgacggcgggcatgttcttcctggacggcgaccgctatctgctgggcggcgtgctcctgttggtcgccaacgccgcgcaggccgtctcgatgatgctctacaactcctatctgccacagatcgccccgcccgaggagcgcgacgccgtctcgtcccgcggctgggcgttcgggtacgcggcgggagccctcgtcctcatcgcgaacctggtgctgttcctcgcccacgactccttcggtgtctcggagagcaccgcggtccggatctgtctggcctcggcgggtctgtggtggggcgccttcaccctcataccgctgaagcggctgcgcgaccgcgggtcgcccgtcaaggagatcaccgcccccggaccgcgccggctcgcggcgaccgtccgcgacatgcgccgccacccgctcacgctctcgttcctgctcgcctacctgatctacaacgacggcatccagacggtgatctcccaggcgtcggtgtacggctccgaggaactgggcctgagccagtccacgctcatcgtcgccgtgctgctcgtccaggtgctcgcggtgggcggcgccctgggcatggggcggctggcccggacgtacggcgcccggcgcacgatcctcggctcactggtggcctggacggtcacgctgggcgccggctacttcctgccggccggcgcgcccttctggttcttcgtcctggcgtccgggatcggtctcgtcctcggcggcagccaggccctgtcccgctccctcttctcgcatctggtgcccgccggcaaggaggccgagtacttctcggcgtacgagatgagcgaccgcggcatgagctggctgggcccgctcctgttcggcctgacctaccagctgaccggaagctaccgggacgcgatcatctcgctggtggccttcttcgtggtcggattcgtgctgctcgccagggttccggtacggcaggcggtgcgcgacgcggggaactccgttcccgaaaggatt

SEQ ID NO: 6905 - DNA, 765 bp, Streptomyces avermitilis
  CDS (1)..(765)
gtgaccgcgcacatacgccacccctacctcgaccatccgggcccgatcgccttcgcccaccggggcggggcggcggacggcctggagaacaccatggtccagttccggcgcgcggtggcggcgggctaccgctacatcgagacggacgtgcacacgacgtccgacgggaaactcgtcgccttccacgactcgaccctcgaccgggtcaccgacggagcgggccggatcgccgatctcccctgggcggacgtgcgccacgcgcgcgtggcgggcagcgagccggtgcccctcttcgaggaactgctcgaaaccttccccggggtgcgctggaacgtcgacgtcaaggccgagccggccctgcgcccgctgctcgacctgatcgagcgcacggacgcctgggaccgcgtctgcgtcggttcgttctccgaggcgcgggtggttcgcgcccagcgcctggccggaccgcggctggcgacgtcgtacggcatccgcggtgtcctgagcctgcggctgcgctcctggggcataccggccgcgctgcgccgctcggcgatcgccgcccaggtgcccatgtcccagtcgggcgttcccgtggccgaccaccggttcgtgcgcgccgcccacgcccgcggactccaggtgcatgtgtggaccgtgaacgatccgcaccagatgcaccagctcctggacctgggcgtcgatggcatcatgaccgatcacatcgacacgctgcgcaaggtcctggaagaccggggcacctggatc

SEQ ID NO: 6906 - DNA, 1497 bp, Streptomyces avermitilis
  CDS (1)..(1497)
atggctcagtggacttcggcagtgggcgccgcgcagctcgcccggctgctcaactcccagcaggaacgccccgcgggccccggcacccgccgccccccggcctatcgcgcactcgccgacggtatccggctgctggtcctggaaggacgcgtgcccgtcgccgcccggctgcccgccgagcgggaactggcgctgtccctgtccgtcagccgtacgacggtcgccgccgcctatgaagcgctgcgtgccgagggcttcctggagtcccgccgcggagcgggcagctggaccgccgtgccggccgggaacccgctgcccgcgcgcggcctggagccgctgccgcccgagtcgctcggttcgatgatcgatctgggcaccgcggcgctgcccgcccccgagccgtggctcacccgcgccgttcaaggagccctggaggagctgccgccgtacgcgcacacgcacggcgactacccggccgggctgcccgcgctgcgctcgatgctcgccgaccggtacaccgcgcgcggcatcccgaccatgcccgagcagatcatggtgacgaccggcgcgatgggcgcgatggacgccatctgccatctcttcgcggggcgcggcgagcgcatcgccgtcgagtcgccctcctacgccaacatcctccagctgatgcgcgaggcgggggcccggctggtgccggtcgcgatggccgaggggctcatgggctgggacatggaccgttggcggcaggtgctgcgggacgcggcgccacgcctggcgtacgtcgtggccgacttccacaatccgaccggtgcgctggccgacgaggaccagcggcgccggctggtggacgcggcccgatcggccgggaccgtgctggtcgtcgacgagacgatgaccgagctgcacctcgacgacggtgtggagatgccgcgcccggtgtgcggcttcgaccccggcgggtcgacggtgatcacggtcgggtccgcgagcaaggccttctgggcgggcatgcgcatcggctgggtgcgggcggctcccgacgtgatccgcagcctggtctcggcccgtgcctacgcggacctgggcacaccggtggtggaacagctggccgtgaactggctgctcagcacggggggatgggagcaggcggtggaggtgcgccgggcccaggcccgcgagaaccgtgacgcgctggtcgccgccgtgcgccgggagctgccctcctgggagttctcggtaccgcagggcgggctgacgctgtgggtgcgtaccggcggtctgtccggctcccgcctcgccgaggcgggggagcgggtcggggtacgcgtcccctccggaccccgcttcggggtggacggcgcgttcgaggggtatgtgcggctgccgttcacggtcggcggcgcggtggcggaggaggcggcggcacggctggcggccgcggcgcggctcgtggagacgggcgcgtcgggagccggggagtcgccgcggaccttcgtggcc

SEQ ID NO: 6907 - DNA, 765 bp, Streptomyces avermitilis
  CDS (1)..(765)
atggttgccagtccaccttcccggaattggccatggatggcttctctttccaagccacagagtgacacgggtcagtccacaaccaccacaggggggcacgtcttgtccggcgtcctgtccacacagaaccgtcgcgggcgacggttgatccagttgtacgtcggcctggcgctgtacggcgcgagctccgcgctcctcgtcgagtcgggactcgggctcgagccctggaacgtgctgcaccagggactcgcggagctgaccggtctgacgatcggtgtggtgtccatcatcgtgggcgcggcggtcctgctcctgtggatcccgctgcgccagcgccccggactcggcaccgtctccaacgtcttcgtcgtcggcatcgccatggacggcacgctcgccctgcttcccggggcacacaccctgtccgtccgcatccccctgctcgcggcgggcatcgtgctcaacggagtggcgaccggcctctacatcgcggccggcttcggaccgggtccacgcgacggcctcatgacgggcctgcaccggcgcaccggacgctcgatccggctggtgcgcacggtcatcgaagtggcggtcgtggcgacgggcttcgcgctcggcgggaccgtgggcgccgggaccgtcctgtacgcggtggcgatcggccccctcgcccagctcttcctgcgtttgttcgccccctccggggcgtcgggcggcagcacggtcgttgccgaggggccacccccgcgggcgatacttcgacgg

SEQ ID NO: 6908 - DNA, 1665 bp, Streptomyces avermitilis
  CDS (1)..(1665)
gtggcccggcgccccctcccccgcattctgagcaacggcagcgcgcagctcgcccggagccgggagctggcccggacggcggccgacagcgccaccgacgtcctccatccgctgatcacgatcacccgtggactgcgccggctggcggcggccggacggcgcaggtgggccgacacaccgaaggaccggcgcgggccgctcctctttctcctctcctcggtgatcctggtcgtcgccctggcaccgtacggaccactgctcgccgccgtggccctgatggcggcggcagcctggatgggccgcgaccccggggcgaagcgacccgccggccccgacgagtcgcagaccaagcgcctgcggtcgctgtacgaggcgctggtcccgtacttctcgaccgccgaggacccggctcccctgtacgcccacggcggcgagtgggaggaggcgttccccgcgtacgacttcgacggcacgggccgcatctcgcgcctgctcatccgctacccggcctacttcacggacggcgaggcggagtcccgtgcccggatcgagcagctcctgcacgccaagtcgggccggggccgcgagtaccacttcacctgggacgaggagggcaacgagctcacggtcaccgttctcggcccgctgcccaccgacatcgccgcccagcgcttcgtgacggcacccggcgagacggtcctcggcttcaccgacccgaccggcgtccagcgcacgctccccctgacctacggcgaggaacagcgggacgtgcctccggtggtctggcgcacgggcgtccgttccacggaaccgcacctgctggtcgtgggcgagcccggcagcggtacgacgaccctggtgcgctccatcgcgctccaggccctccagcacggcgacgtcgtgatcgtcgagggcggcggcaccggcgagtacgcgtgcctgaccggccgggacggcgtgctggcggtcgaatgcgggccggcgggcgcggtggcgagcctggagtgggccacccacgagacggaacggcgcctgatcgcggcgaaccgtgcccgccaggaggggtatccggcgccggaggacatcaagcgtccgctctggctccttctcgaccggccgagcgcactgggccacctcgcggcggcggaggggcgcaaggatccccagtcgctgctccaggtgccgctgcggcacggtcgcgcggcgaacgtcacggtcgtcgtggcggagcagttcgacggcctcgacggcctgtccgaggcggtacgtcagcacacacgcgcgcgcgtggtgctcggccccgcgactccggaccggctggcggagatcctgggggcgccgccgcacacgacgcccgcgaaggacgtacctccggggcggggttacgcccggctcggcggcgggccggtgcaccggctccaggtgccggcgaccccggacccgtacgacgacgcgacgagcgagacccaccggcgggcggtgctcgacctgctgccggggcggagcactccggcggacgcggcggagccggtccccacggtgaccgtggccgcgaagaccgtgcccgctgaggccgtgaccgctgaggccgtcgtcccggaaaccgtggccacgaaggccgtggtcacagaggccgtggccgcggaagccgtgcccgcggagggc

SEQ ID NO: 6909 - DNA, 192 bp, Streptomyces avermitilis
  CDS (1)..(192)
atgattctgtccatgtcaggcgtcgtcctgctcggcatcgtcgtcttcctcttcttccgcaaggacggcctcaagggcacgcacgcgtgcacgtgcgcgctgttcggcttctacctctccagcaccgccatcgccccgagcatcaaggccggcggcgcgagcctggcgagtctcctcggcgggatcaggttc

SEQ ID NO: 6910 - DNA, 402 bp, Streptomyces avermitilis
  CDS (1)..(402)
gtggtccggccgatgagcgaagcccccgaccccgaggtcgtggagctggcgaccaagatcttcgatctggcgcgccgtggcgagaccgagccgcttgtggcgtatgtcgacgcgggggttccggccaacctcaccaacgaccggggcgacaccctggtgatgctggccgcatatcacggccatgccgaagcggtgcgcgccctgctggagcgtggcgccgaggccgaccgggtcaacgaccgaggccagacaccgctcgcgggggcggttttcaagggcgaggaagcggtgatccgggtccttctggacggcggtgccgacccggccgcgggcacgccctcggccgtcgacacggcccggatgttcggcaaggcgaacctgctcgaactgttcggcgcacgc

SEQ ID NO: 6911 - DNA, 1416 bp, Streptomyces avermitilis
  CDS (1)..(1416)
atgttcgatccggtcatagcgcccagcggtacgctgctcggcctgctccagcggggccgcggcgacggcacactccacgcgctcaccgcaccgcgggccgaggcgctcgcggccctgaatcactgtgtgctgcgtgacccccgccacgactggcaggtggagaaccgctccctgtactacgcccgtctctacctcgacctgagcggtgagctcgacgagatcgagcggcacctcttcgacgccgaggacgttctcgacacggacgagtcccgcacggggctcgccctcgcggtcctcgggcacctcgcctcgtacggcaggctcgacgcgctcgcgctgctgcgcaggtacgcggccgtcggcaccaactgggcctgggccctcgacgagctggcgctgcgcgacgacgacgcgggcctgcgcgccctcgccgctcccgtgctggcccgcttcccggtcgatgccgagggcgaggccgagctcgccgccgccgtgcgcgacgccttcgaaccccggccctggcggctgtgggccgaggatccgcgcgaatccatcggcacgcgcgtgcgcggcgcccaggagaccggctccttcgaccgctggcagcgccagatgcgaccggccgggccccggcccgggtggagcgtgcaggccgtcttcgactgggcccagcagggactcgaacgcggagcgctgctccacgttccggccgcccgctgcctcacggccgtcgcgggccccgaggaccggcccgagatcgtcgaggccgcccgttccggcggcgacggcgcccgctgcaccgccctgcgctatctcaccgacggcaacgatccggacgccctcgacctcgtcgagggggccgtggccaccgggtccgcggtcgtcgtggaggccgcgctggacgccttcgaacgtatgtgcagtgtcgccgccgtggaccgcgcgcgtggctgggcccaccggcccgaccctctgggcgccgccgccgggcgcatgctcgcctgccggggcggtgcgcaggacagcgaactggtgctgggcgccctgcgggaggccgtacgcggagagggccccgacgcgcccacgctgtggacgctcgtcgacggcaccgggcggctcggcatcgcgtgcgcggcgcccgtgctgcgtcatatctaccgcgagaccgcgtcatcccatctccgcggccgggccgcccgcgccctggccgccaccgatccctccttcgccgccggtttcgccgtcgaatgcctgtgggactgcgaggagttcactcgcgaagtcgccgcccggcacgccgagaccggcgacgcgcgcgtggtcgaccagctccgccgcctggccgcggacccggccgaggaggcagaggtccagacggccgtacgcagccggatcgggcccgacatgcccgccgta

SEQ ID NO: 6912 - DNA, 1161 bp, Streptomyces avermitilis
  CDS (1)..(1161)
atgcgtgtcgtcatcgtgaccgagtcctttccccccgatgtgaacggcgtggcccactgcgccctccagaccgcccggcaccttgtcgagcgcggtcacgcccccctcgtcgtcgcccccgcctcccccaagtccccgacatcgctcgggcagggcggtgcccccttcgccgggcaggggcccgacgccctcgcgccgtgccgcgtcatccgggtgccctccctcccgctccccggctacccccaggtccgcgtcgccctccccagccgccgcgtcgccgcggcgatcaccgaacaccgcgccgacatcgtccacctggccggccccttcgtcctcggtgtccgcggcatggcggccgccgcccggctcggcatccccgccgtcgccgtctaccagaccgacctcgccggatacgcccgcacgtacatgggtgcgggcgaggccacggcctggcggcgcatacgctccgtccacgccgccgccgaccgcaccctcgccccgtccaccgcggccctgcacgacctggaggcacacggggtgccccgggtgcggctgtggccgcgcggtgtcgacaccgtccgtttccgccccgagcaccgggacgagtcgctgcgccgcgaactcgccccgaacggcgaaccgatcgtcggctacgtcggccggctcgcccccgagaagcaggtcgaactcctcgccggagcctgcggtctgaggggcgtgcgggtcgtcgtcgtgggcgacggcccgagcgaggtgacgctgcggggcgcgctgcccggcgccgtcttcctggggcgccgcacgggtgacgaactcgcccggatcttcgcctcgctggacgtcttcgtgcacaccggccccttcgaaaccttctgccagaccgtccaggaggccatggcgagcggtgtgccggtcgtcgcgcccgccgcgggcggcccgctggacctggtggcgcacggccgtacggggctgctggtcccgccgcgtgacgccggcgccgtgcgcgacgcggtgtggtccctggccgccgaccccgcgctgcgggccgcgtacggagcggccgggcgggccaccgtcgagggccgtacctgggcggccgtcggcgaccagctcatcgggcactacgccgaggtgctgtccgcgcggacggcggtggcggca

SEQ ID NO: 6913 - DNA, 1206 bp, Streptomyces avermitilis
  CDS (1)..(1206)
atgagcccgcgaagcgacgagggcggcgtgcacgagccgccgcggaccggcgggccggccggggcgctgcggatcgtccggctcgccaacttcgtggcccccgcctccgggggactgcgtaccgccctgcgcgagctgggcaagggcttcaaggaggccgggcacgagcccgtgctcatcgtgcccggcgagcgccacaccgaccgcgagaccgggcagggccgcgtgatcaccctgcccgggccgctgctgcccggcaccggcggctaccgcgtgctcaccgacaagcggcgcgtcgccgccctcctggccgagctggcccccgaccgtctggaggtctccgaccgtacgacgctgcggtggaccggcaagtgggcgcggcgcgcccgcgtccccgccgtgatggtctcccacgagaccgcggacggcgtcctgcgcacctggggcctgtcggagaacgtgtcccggcgcgccgccgacgccctcaacacccgtacggcacacacctatgcgcgcgtggtgtgcaccacggagttcgcggagcgggagttcgtccgcatcggggcccgcaatgtcgtacgcgctcccctgggcgtcgacctggagcagcgccgccccgcgctgcgggacccggggctgcgcgagcgccacgcgcgcgtggacgagacgctgctcgtcatgtgctcccggctgtccgtcgagaagcggcccggcaccgccctggacgcgctggaggcgctggtgcggcgcgggcggcgcgcggtgctcgtcgtcgccggggacggcccgctgcgggcccggctcgaacagcgggcgcgggagcggaggctgcccgtgaccttcctcggccatgtcggcgaccgggcgctgctcggcgcgttgcaggcctccgccgatgtgtgcctggctcctgggccggccgagacgttcgggctcgccgccctggaggcgatggcctgcggtacgcccgtggtcgccagtgcctcgtccgcgctgtcggaggtcgtcggctccgccggagtcacagccgcggatcacggcgacgccttcgcggacgccgtcgcatcgctcctggaacgccccgagtacgagcgccggcagaccgcacgcgcgcgtgcggagtgtttcggttggaagaccgcggtcgacgcgttcctcgccgcgcacgacgcgggggcgccggctcccgctcgggagggcgtccga

SEQ ID NO: 6914 - DNA, 852 bp, Streptomyces avermitilis
  CDS (1)..(852)
atgagaccgccgcgcttcgtggcgctcggcgactcgctgaccgaaggcgtgggcgaccccgtcggggacacctggcgggggtgggccgcactcctcgccgccgggctcgcccccgcggacgcgcccgccgagttcaccaacctcgccgtcagcggcgcccagacgcgcgacgtcctggaacggcagaccccggccgggctcaccctgcgcccggacatcgtgtcggtcgtcatcggcgtcaacgacacactgcggtgcaccttcgacatccacgccgtcgccgcacggctcgaccaggtgtacgcggcgttccgggcgcgggacgcggtgctggtcacggcgtgcctgcccgaccccggggcgatgttcgggctgcccggggcgctggcccgtccgctggcccgccggcagcgggctgtgaacacggtcgtgcacgccctgtccgagaggtacggggcggtgcatctgcacgcggcggaagaggagtggctgaccgatcgcgcgctgtggagcgcggaccggctgcacccgggggagcgaggccaccggcagctggcggtccgcttccacgcgctgctcgctcaggagggcctcgtgaccgggaccgcgcccgcggccgagcccgagttccccgcgcccacccggtcggcgagcctctggtggctggccaccgcggggaccggctgggtggcccggcggtgcaccgacctgctgccgcagctgctcaccctggccgcctccgaggtacgccaccgggcacgcggcaccagcgcccggctcgacctgagcgcctcgcacgcggcggcgtccgcgctggccgccctgtcggggacggagcagccggacgcggcc

SEQ ID NO: 6915 - DNA, 867 bp, Streptomyces avermitilis
  CDS (1)..(867)
atgacggatcgggcgctcgccgtcgtacgggccggggcgctgaccaccgtgcaggacctggggcgccccgggtacgcccacctcggagtgccgcgctccggtgcgctggacccgcccgcggcggcgctggtcaaccggctggtcggcaatccgccggaagcggccgtcctggagacgacgctcaacggctgtgctctgcgcccccgttcggcggtcaccgtggcggtgggaggcgcgccctgcgcggtgaccgtgggcggccgccccgcgccctggggagcgcccgtacgcgtccccggcggcaccttgctcgacatcggacccgcgcagtccggagtacgcggttacgtggccgtctccggcggagtcgccgtcgaaccggtgctcggcagccgctccacggatctgctgtccgggctcggtcccgcacccctcaccgacgggacggtgctccccctggggcacccggtcggcccccacgcgcgcgtggacgccgttccccagccgggcccgccggccgaactggtgctgcgggtgacgccgggcccccgcgacgactggttcacggcgacggccgtccgcacgctcgtcacccgcgcgtaccgcgtgtccaccgcgagcaaccgcatcggactgcgtacggaagggcccgcgctggaacggtcccggacgggcgaactgcccagtgagggcatggtgtggggggcggtgcaggtgccgcccgacggccggccggtcgtctttctcgccgaccacccgaccaccgggggctacccggtgatcgcggtcgtccggcccgccgacctcccggcggccgcccaggcggttcccggcacccccgtccgcttcgtggccgtacgccgccgc

SEQ ID NO: 6916 - DNA, 615 bp, Streptomyces avermitilis
  CDS (1)..(615)
atgagggcactgccggtcggcgaccgggccctgctcgtcgaactcgcctcgggtgacgaggcgcaggccctgcacgccgagctgctgcgccgcagggcggccggaaccctgacggtacgggaggtcgtgcccgcggcccgcacggtcctcctggacggcctggaggagccctcccggctcgcggcccagctcgcggactggacagtgccgccggtacccccgcgcgcggaggaggccatcgagatccccgtacggtacgacggccccgacctggccgaggtcgccgccctgtggggcgtaccggaggacgaggtggcgcgcatccactcggcggccgaattccgggtcgcgttctgcgggttcgcgcccgggttcggctatctcaccgggcttcccgcgcgctacgacgtggcgcgccgggcgaccccgcgcacgtccgttccggcgggctccgtggcgctcgcgggcccgtacaccggggtgtacccgcgtgcgtcgccgggcgggtggcagctgatcggcaccacggaccgcgtcctgtgggaccacgcgcgcgtaccggccgccctgctcgcgcccggcgcccgcgtccgcttcgtcgcggtggggtccgta

SEQ ID NO: 6917 - DNA, 750 bp, Streptomyces avermitilis
  CDS (1)..(750)
atgatcgatctgaacgccgacctcggcgagggcttcggccgctgggagctcaccgacgacgaacggctgctgtccgtcgtcaccagcgccaacgtggcctgcggcttccacgccggggacgcggccaccatgcggcgggtgtgcgagctggcggccgagcgcggcgtacggatcggcgcccaggtctcctaccgggacctggccgggttcgggcgacgcgcgatggacgtgccgcccgcggaactggcggccgaagtggcgtaccagatcggcgccctggaggtgttcgcccgcgcggcgggcacgcgcgtgtcgtacgtgaagccgcacggcgcgctctacaaccgggtggtgcacgacgaagggcaggccggcgccgtggtcgacggggtgcggctcgccgacgcctcgctcccggtgctcgggctgcccggctcgcgcttgctggaggtggccgagaaggccgggctgccggtcgtcacggaggcgttcgcggaccgcgcgtacaccgaggagggcacgctggtgccgcggggcgaggacggagcggtggtcaccgaccccgacgcggtcgtcgaacgctcggtgaacctcgcccgcctcggggtggtcgacgcgcactccgggcgccggatcccggtacgggcacgctccttgtgcctgcacggcgacacgcccggcgcggtggagctggcccgccgggtcaggtcgcggctggaggcctcgggcgtccgcgtggcggccttcgca

SEQ ID NO: 6918 - DNA, 822 bp, Streptomyces avermitilis
  CDS (1)..(822)
gtgaaccgcgtcaccccggaccgccccctgagccggatcgacggccacgcgcacgcgtggaccccccgcaaggcgcgggcccgcttccgctggggcgtcttcggacccacggccggggtcgccgcgggacacacccaggcgaacctgatctcgctccccgccgactgggcgtacgacatgctgctgttctgccagcgcaaccccaagccgtgtccggtcctcgacgtcaccgacgccggttcctggaccactccgctcgcggagggagcggatctgcgcacggatctgccgcgctaccgggtgtgggagaacggcgagctggtggccgagcccacggatgtcgtcgcgtactggagggacgatctggtgtcgttcctcatcgggtgcagcttcaccttcgagtgggcactgagcgaggcgggcgtcccgatgcgccacatcgagcagggccgcaacgtctccatgtacgtcaccagccgcgcctgccgcccggcaggccggctgcacggccccatggtggtgtcgatgcgtcccgttccgcccgagcacctggcggcggcgatccgggagagcacgatgctcccggcggtgcacggcagccccgtacactgcggcgatccgtcgggcctcggcatcgatgacctcggccgccccgacttcggtgatccggtggacgccgaaccggacgacatcccggtgttctgggcctgcggcgtgaccccgcaggccgcggtgatggcgtcccgtccgccgttcgccatcacccacgccccgggccagatgttcctcaccgacgcccgcgacgagcagtaccgcgtggcc

SEQ ID NO: 6919 - DNA, 1317 bp, Streptomyces avermitilis
  CDS (1)..(1317)
atgagcacgacccctccctctccacaactgaccgccgccaccgcgcccggcgcgggtgaacccgcctccgaagacggcgccttcggcttcctgcgcgcgctcggtccgcgcggccggcgtgccttcgccggcgcgttcggcggctatgccctggactcgtacgactacttcacgctgccgctgagcatggtcgcgctcgcggcctacttcggcctggacagcggtcagaccggactgttcacgacggtcaccctggtcgtctcggcgatcggcggcgccgtcgcgggtgtggtcgcggaccgcatcgggcgcgtcaaggccctgatgatcaccgtgatcacctacgccgtcttcacggtggcctgcggcttcgcgcccaactacgagaccctgctggtcttccgcgcccttcaagggctcggtttcggcggcgagtgggcggtcggcgcgatcctggtcgccgagtacgcgagcgcccggcaccggggccggacgctcggcgcgatccagagttcctgggccgtcggctgggcgctggccgccgtcgtctacacgctggtcttctccttcgtgggcgacgacctcgcatggcgtgtgatgttctggaccggcgcgctgcccgcgctgctggtcgtgtgggtgcgacgcagggtgcacgacgccccggaggcggccgtcgagcgccagaagagcgctcacaagggttcgttcacggcgatcttcaggcccgggacggccgacgcgcccggtctgctgcggatcacggtcttcgcgggcctgctctcgaccggcgtccagggcggctactacacgctggccacctgggtgccgacgtacctcaagacggagcgcggactgtccgtcgtcggcaccggcggctatctcacgttcctgatctccggtgccttcatcggctacctcaccggcggctacctgaccgacaaactgggccgcaagcgcaacatcctgctcttcgcggtgctctccgcgatctgtgtcctggtgtacgccaacatcccgagcggcgccgacaccctcctcctggtgctcggtttcccgctcggcttctgcatgtcggcgatcttcagcggcttcggctcgttcctgagcgagctgtacccgacggccgtgcgcggcaccggacagggcttcacctacaacaccggacgcgccgtcggcgccgtcttccccaccctggtcggcttcctggccgacagctggggtgtgggcggcgcgctggtcttcggtgcgatcggctacgccctggcggcgctggcgctgctcgggcttccggagacccgcgggaaggagctccgg

SEQ ID NO: 6920 - DNA, 699 bp, Streptomyces avermitilis
  CDS (1)..(699)
atggcagatcagctgacgggactggccgacgaccgcgctctgctggggcgcaccagcaccgccgagcgggtctcggacatcctcaggggccgtatcgccgagggctacttcccgcccggcacccggctgtcggaggacagcatcggcggcgcgctcggggtctcccgcaacacgctgcgcgaggcgttccggctgctcacccatgaacggctgctcgtccacgagctgaaccgcggggtcttcgtacgggtgctgaccgtcgaggacgtgcaggacatctaccgcacccgctccctcgtcgagtgcgccgtcgtacgcggtctcggtgagccgccgtacgccctggagggcctcgcggaagccgtcgcggaggggcagcggacggtgcgcgaaggtgactggaaaggactgggcacggccaacatccacttccaccgggaactggtcgcgctcgccggcagcgcccgcaccgacgaactgatgcgcagcgtcttcgccgaactccgcctcgccttccacgtcgtggacgacccgcggcggctgcacgagccgtatctcgcgcgcaaccggcagatcctccaggccctggagacgggcgaccgcgacaaggcggagggactgctcgcggtctatctcgacgactcgctggagcgggtcgtggaggtctaccggcggcgcgtgggcgacgacgggcaactg

SEQ ID NO: 6921 - DNA, 1515 bp, Streptomyces avermitilis
  CDS (1)..(1515)
gtgacttcgcctgcatcgacggacagcgttccgccccagctcagcgcggggccgcgcccttctccgggcccggccgccgacgagggactggcgcggcggctgcgcgcgctcgcctgcacggcgccgctgcacgacctcgatgcgcgcaaggccaacctcgccggtgagtacgcggtgtacgggatggcggaggtggccctcgccgccatcgacctggtcacactgaacatggacttcgacacgggcgcggaccacgaccagatagtggcccgcctcatcccgcgcatcgccgcccaggccccccggcggcccgtcgccgagcacgagcgggtggcccgctgggtcctggagaacctgatcaacgtcggcagcgtcgaccgaggtttccgcgccgtctacggcacgttcgcgcccgacggctcctatgtgcgccgcgactacgacttcaagctgatcgaggaggtccccgggtacggaggaagcgtctacctccgtacgacggacgaggcggtcaacgtcctcgtgggcgccctcgacaccgatgtcaccagcgcgcagatcgccgccgaggtcaagctggaggtgctgatcagccgcggtcggctcgcggacgcgcagctcgccgccgagcaggcgcgctaccggaccgtccagtactcggagacgttgcgcaaggcactggacgcgacccggcgcaatgtgcgggccgtcgactggctgaactcggtgccggacatgatcgccgaggccctcgaccacgtcgccgaccgctaccggcacgagaacgcgatcctgaccaacatccgcaaggcacgcgacgagtccgaggaccccgagcagaagcggcgcgccgccgagctggtcgacatcgtcaaggactgcatccgccggcacacgctgctccagtcccggctcctggaggcgggcccgctgttccgcgccgagcaggaccggcaggccttcgcgacccccatgacgacgtccgggatcgatctctacgggcatctcgtcgcccccgtgctgccgctgcccgtggagcaggccctgcgcgtcacggacgccttcttcgcgcgcggcaccgggctgcgcacacccgcgtccgtgcgggtcggggacctcgtcgacctgctgctgacaccgcccgtggagcgggagcacctcggcgcggagatgccggagccagacctgatcgccactcccgacgacagccggttcagcgaggagcagctggccgccgccatggagctgctcgacctgccggcggacgcgccgcggcggttgtcgggactgctcgcggaagcgcgccgccaggattccgaactgccgtaccttgtcgccctgctggccgtgcacgcggccagcccgccggtgggcaccgcctaccggcagggggaggagaagctgctgttcgccgtggacgacggggtcgaactggacgacgacgagttcggcggggccgatctcatcgtgggcatggcgatgctcgacgcgatggggatggcggcggaccggaag

SEQ ID NO: 6922 - DNA, 876 bp, Streptomyces avermitilis
  CDS (1)..(876)
gtgaccgagcacgtcgagtggagtgagccggaagtcgccgccacgccggtgaacgccgccgtcacccccgccgacgccgccgacgcggcgcggctcgtggccttcgggctccagcccaagctccagcccgcccgcgaccaggagtacacggagttgctgcgccgctaccgcgaggacccgcccttcgcgcggctcgcggacgccgtggccaccgggctcggcctggtcgtcctggaggtgtccccgcgtgccggtatggccgtcaccgccgccgaggactccgtgttcgccgtccgcatgggcgactacgcgcggcgcacggcggccgactccggcgaccgcttcctgcatgggctcgcccatctcgccgtcgccgccatggcgttcccgcgccccgaggacctcgcggacgacggctacatcgggcgcgtctcggtcaacggcgtcgacgccttcgtacgccaggcctgccgccgcctggaggagcgggccgaggagcagggcgagaacaccgacccggccacggacgcgcccggcctggaggcggcctggcggatctgggccagacgcagcgccgccggggccaccaaggacgcgcgccggctcgccggttcgaccaccgggatcgtcggcaaggccgtcgtcttcctcaccgactccggctttctccagcggaccggcgacgactccggcggcacctaccgcaccaccgcccgctatcagctccaggtgcgcgacatggccggcagcgccgccctggccgagctgctcgagctgggcatcgtcccggtgaccgacggcaccgcgagcctgctgccccccgaggacaccgacgacctggaactggtcgccgacgccggactgccgttccactcc

SEQ ID NO: 6923 - DNA, 4698 bp, Streptomyces avermitilis
  CDS (1)..(4698)
atgtacgagctgtcccgggtccgcctctactccatcgggccggccggtgcgcgctacgccgacaccgtgctggacctgcggggtgtcggcgcgcccgtgcccgaccccgcgcccacccaggcggagttcttcgaggacgagcccgtcggcccgccgcgccggcccgcgcccgccggcgtgctcttcctggagaacggcggcggcaagtccgtactgctcaagctgatcttctcggtgatgctgccgggccaccggaacacgctcggcggcgccagctccggtgtgctgcggaagttcctgctcgccgacgactgcgggcatgtggcgctggagtggcagcacacgctgaccggcgagtgcgtcgtggtcggcaaggtgagcgagtggcgggggcggcaggtctccaacgacccgcggaagttcgccgaggcctggtactccttccggcccggccccggactcagcctcgacaacctgcccgtcgccgaggccacctccgtacggccgcaggccgagggcgtgtccggtgcgcaggggcggcgccgcaccatgaagggcttccgggacgccctcaccgacgcgggcaaggcgtatccgcacctcgaagtgcactgggaggagatccacgaccgctggaacgagcacctcggggacctcggtctggaccccgaactcttccgctaccagcgggagatgaacgccgacgagggcgaggccgccggtctcttcgcggtcaagaaggactccgacttcacggatctgctgctgcgcgccgtcaccgacacccgcgacacggacggcctcgccgacctggtcggaggcttcggcaacaagctggggcggcgcgccgagctgatggccgagcgggacttcacggccggatccgtggacctgctgggccggatcgtcgacgccgccgacgctcgggcacgcgcgcgtgacatccacgccgccgccgagcggcgcacccggacgctggcccgccggctgtccgcgcgcggcgtgcgggagcgcgtgcgggccgccgacctcgcgcagcgggtgaccgccgcagcgtacgccgtcacgcacgccgagggcgcccgcgagcgcagcgccctgatcgcggccgaactcgcctaccggcacgcctcgttggcgctcgccggagccgagaagtccgcggccgcgcagaagcgcgagctggccgacgcgcgcacgctgcactccgcctggcaggctgccgaggccgtgctgcggcaccgggccgccgccgaccgctccgcgcgcgtggccgtcgcgatccgcgaggccgagcgggacgccgcgccggcgctcgccgcccgcgccaaggccgccgtcgacctcgtacgtgccctgcacggtgccgccgagagcgcggagaacctcgccaacgaggaggaggagcggtccgcagggctccaggacgtgggcgagagggcgtaccgggactcgacctccgccgccacggaggcgcagcgcgcccgcagcgaggccgggcatctgcgccagcggctcagcgaggtagcgcaggagaccgccgaggcggtgcgcgcggggtggctggacgacagcgcgcccgacgcggaccccgcacgcgcggcgctggccgcgagcgacgccgagaagacggccgtcgccgcctgggacaccgcgcgtgaggcgtccggccgggcctccgagcacgccagggaggcggcgtccaccgagtcccgcgcggagctgacggcggcccgcgcggcggacgcggcgacggcggccgagcgcgcgtacgaggcggagttccgtaccgccgagtccctggcgggggaggagcgtttggcggacctgctgagcctgccggcctccagcaggcagggggcggtaccgacgccccggcgcgagggcacagcgggtgcgacggccgaccgccagggcggtgcgcacagcgcggccgagggttttgccgcgccccgccctggcgccccgcggcccgcgagcgaaggccccctcacccccgaggagctggaccgcttcgccgacgaactgcgtgagctgctcgacgactcggtcggctccgccgagcggcagctgttcgagttgcagaccggcgccgccgacgactcccggatcctcggcgccctcggcgacggcggcctgctgccgcccggcccggacgtgctgtccaccgtcgagtacctgggcgagcacggcattcccgccctccccggctggcgctacctcgcgcaggccgtcgaccccgccgatcacgcgcgcgtgctggcggcccgccccgagctggtcgacggtgtcatcatcacggaccccgacacgcacacgcgggcccgcgaagccctgagcgaggccgcgctgctgccccgctccgcggtcgccgtcggtacggccgccgcgctcctcgcccccacgccggcgcccgaggcgggcgacagcggcgtgttcctcgtaccgccgaacccggccatgcacgacgaacacgccgccgacgaggaacggcaggccctgcgcgcgcgagcggcccggcgggacgaggagatccgggccctcgcggcccggctcggcaaggaccgggagctggccgcacggctctcgtcctggcgcaccggatgcccggcggggcggctcgtcgaactcgccaccgccgcacgggacgcgcgcggtttcgccgaggaaaccgaggccgagctggccgaggcgcggaccgtccgggcggaggccgacgaagccgccgccgaggccgcgcacgtacgggacgagcggcaggaggccgcccagaaggcgcgccgcgccgccgacgcgctcgccggactcgccttccggctgcgtgagcgtgccggctggcaggtcaagctccgcgaactcgccgacgaggcggccgagtcggaggcccgcgcccagacctgcctggagcgcgcccgcgccgccgacgaggaccggcgcgccgcccagcgcgccgccgacgacgcccgccgcacggcccgcgcgctgcgcgccgagcgcgcggagatcgcgggcgcccccgacgacgtacccgaggacgagcccggagcggcgaagtcgtccctgcccgccctccgcgaggcctaccgggccgcctcccagctgtacgagaaggtcggcgtcggcgccgatctgcgggccgaacaggcgcgcgccgagagcgacgagagcgccgcgctcaccgagctgaaccggctcagcaacaaggtgcggacccgcgcggcccagctcctggagtccccggacggctccgacgggccgtcccggcaggccgcggccgcccgtgtcgaggagctggtgcagctcctggagacccggatgtccaccgcgagcgagcagctcggccggctgcgcggcgaggccgagcggcacgcgcccgagaacggcgaggcccacaccgagctgtccgacgagctggtccccgagaacgccgagcacgcgcagaccctgctgcgcaccgcgaccggtgaactggccgcccgcgccgatgcgctgggccaggcgcgcgaggcccacgcggagctgctcgacgcgcaccgggccgccgaggacgcggccggcggcttcgacgagaccgccgcgctgctccgtgacctcctgcgtgagcagcaggccgaggacgagcaggaggaatccgaggcctaccccggtaccctggaggaggcccggcactccgccgccgaggcccgccggtccctgcgcggctgcgccgccgacctgtccgccgccgaggcggccgtgcgcgaggcgagcgacatcctcgtccggcacgccaactccacccgctacgagcaggtgcgcacccccgcccggcagcagatccgcgagctgcccgcgtccgcgctgcccgagcacgcccagaagtgggcggacgccttcgccccccggctccgcgtcctcaccgacgagttggcgcagctggagcgcaaccgggactcgatcgtggaccggctgcgcgggctcgtggagtcggcgctggccaccctgcgggccgcgcagcggctgtcccggctgccggaagggctcggcgagtggtccgggcaggagttcctgcgcatccgcttcgaggagcccgaccaggccacgctcaccgagcggctcggcgaggtcgtcgacgaggccacccgggcggccgtcaagaagaactccgacctgcggcgcgacggcatgtccctgctgctgcgcggagtcggtgccgcactcgagccgaagggcgtcgccgtcgagatcctcaagccggacgccgtactgcgcgccgagcgcgtgcccgtcggacagatgggcgacgtgttctccggtggtcagctgctcaccgcggccatcgccctgtactgcaccatggccgcgctgcgcagcaacgaccggggccgggacaggcaccggcacgcgggcacgctgttcctggacaaccccatcgggcgcgccaacgcgacgtatctgctggagctccagcgggccgtctcggacgcgctcggcgtccagctcctctacaccaccggcctgttcgacaccacggcgctcgccgagttccccctggtcatcaggttgcgcaacgacgccgacctgcgcgccggactgaagtacatcagcgtggaggaacacctccggccgggactgccgcgtgaggctcccgccggggaggccgggtacagcgagatcacggcgacacggatgtacaagcgcccggcgccgagcgcctca

SEQ ID NO: 6924 - DNA, 1548 bp, Streptomyces avermitilis
  CDS (1)..(1548)
atgagtatcgacgagttcgactatgtcgtggtcggcggcggcaccgcgggcaacgtggtcgccgcccggctttccgagaacccgtccgtcacggtgtgcgtcctggaggcggggcccagcgacgtcggcgacgacgacgtcctcagactggaccgctggatgggtctgctggagtccggctacgactgggactacccggtcgaaccgcaggccttgggcaacagcttcatgcggcacgcccgcgccaaggtcctcggcggctgttcctcgcacaactcctgtatcgccttctgggccccggccgaggacctggacgactgggcggcggcgggctgtaccggctggagcgcggccgaactcttcccgctctaccggcggttggagtccaacgacgcgcccggcgaccaccacggccgcaccggcccggtgaagctgcgcacgctcaagggcgaggacccctgcggcacggccctgttggaggcgtgcgcccaggccgggatccccaccacggccttcaacaccgggaagaccgtggtccggggcgccaactggttccagatcaactccgacgagaacaacatccggcagtcctcgtcggtggcgtacctccacccgatcatcggcaagcggcccaatctggaggtacgcacgggcgtacgggccaagaagctcgtgctcgacgggcggcggtgcgtgggcgccgagtacctggacccggacctgatccacacgcggacggtactcgcccgccgcgaggtgatcgtgtcctgtggctccatcgacacgcccaagctcctgatgctgtcgggcatcgggcccgccgagcagctgcgcgaggtcggggtcgacgtggtcgtggactcggcaggcgtcggcgagaacctccaggaccaccccgagggcgtcatcatgtgggaggccaggcagccgatgaccaccacgtccagccagtggtgggaggcgggcatcttctacgacaccgaaccgggcctggaccggccggacctgatgttccactacggctcggtgccgttcgacatgaacaccgcccgccacggcttcccgacctccgagaacgccttctgcctcacgccgaacgtgacccgcgccaagtcccgcggcacggtgcggctgcgtacccgcgactaccgcgacaagcccagggtcgatccgcgctacttcacgcacgagcacgacgtgcgcgtgatgacgtacggcctgaagctggcgcggaggatcgcgtcacagcccgcactgagcggctgggcgggggcggagctctcccccggaccggacatccggaccgacgacgagctgctcgactacatccacaagacccacaacaccgtctaccacccgtcctgcaccgtgaagatgggcgcggacgacgacgcctcggccccgctcgacgcgcggctgcgggtcaagggggtcgagggtctgcgggtcgcggacggctcggtgatgccggagctgatctccgtcaatccgtgcatcacgacgatgatgatcggcgagaagtgcgccgatctcctgaaggaggacgcg

SEQ ID NO: 6925 - DNA, 1566 bp, Streptomyces avermitilis
  CDS (1)..(1566)
atgacgacaaccgagcaaccgtccggcccacagagtcaccacgacgacaccgaactcgccgagttcggctacaagcccgaactcaagcgcaccctcggcaacttccacaccttcgcggccgggatcagctacatctcgatcctgaccggcaccttccagctgttctacttcggctacggcagcggcggccccgcgtactggtggtcgtggccgatggtcttcgtcggccagttcatggtcgccctgtgcttcgcggagctggccgcccgctatcccgtcgcgggctccgtgtacaactggtccaagaagataggcaatccgcacctcggctggctcgccggctggatgatgctcatcgcctccatcgtgtcgatctcggctgtggcgctcgcctaccagctcacgctgccgcagatctcgtcgacgttccagttcatcggggacggcaccgggaagtacgacgtggcgacgaacgcggtcgtcctggccgcggtgctgatcctgttcacgaccctggtgaacgccttcggcgtgaagctgatggcgaccatcaacagcgcgggcgtgttcatcgagctggtcgcgaccgtcgtcctcatcgtgctgttcgccgtccacatcacgcggggaccgcaggtcgtcaccgagaccgccggcaccggcgccgggcacacgaccggctacctgggcgcgttcctcgtggcctcgctggcgtcggcgtacgtcatgtacggcttcgacacggccgcctcgctgggtgaggagtccctggacccgtcccgcaacgcaccgcgggcgatcatccgcgcgatcgtcgcctcgttcgtcctcggcgggctcgtgctgctgctcgccctgatgagcgtctccagcctgaagggcgacaagctgtccacggacggcctccagtacatcgtgctcgacgtgctcggcccgacggccggcaaggcgatgctgtggtgcgtgctcatcgcggtcaccgtctgcgcgctcgccgtgcacacggcggcgatccggctggccttcgcgatggcccgcgacaacaacctgcccgcgtcctccctgatcgcccgggtcagcccgcgcttccagaccccggtgctccccgcggtgatcatcggcgtcctcgccgtggcgatcctcgtcgtcaacatccgccagccgcagatcttcaccgtcgtcaccagcatcggcatcatcatgatctacctcgcctatctcggcgtcaccggcccgatgctggtggcccggctgcgtgggaagtggcagcccgcgggcgacggcagattctcactgggccgctgggggctgctggtcaacatcgtcgccgtgctgtggggcgcggccatgacgctcaacctgatctggccgcggtccgaggtctacaacgccgccgccccgttccactggtacctgcgctggggtgcggtcctgttcgtcgcggtcatcgccggcggcggcttcgcctactactggttcatccagcggcacaagaccggcgtgctcgccgaacaccgcctccagaccaccgccgcgcccgctcccctcgccgctcccacggccgac

SEQ ID NO: 6926 - DNA, 1521 bp, Streptomyces avermitilis
  CDS (1)..(1521)
gtggctgctcgggcagctgggaggcgaccatgcctgacccgtacgacaccccaggaggccatcgtgcccgacctgttcattgacggcgagtggagagccgcgctcgacgggcgcacgcgggagatccgctgccccgccgacggctccctcgtcggagtcgtcgacgaggcgggcggcaaggacaccgccgaggcgatcgccgcggcgcgccgcgccttcgacgagggcccgtggccctggctgcccgccgccgaccgcggtgacctgctgctgcgcgtcgccgatctcctcgtacgcgacagggcgaagctggcccgcgccgagtcgctcgacaccggcaagcggttcgtcgagagcgagtacgacatcgacgacatcgtgaactgtttccgctacttcggccgcctggccgcggccgagtccggccgggtgatcgacaccggatcggcgagtacggacagccgggtcgtgtacgagccggtcggggtctgcgcgctgatcacgccctggaactatccgctcctccagacggcttggaaggtcgccccggcgctcgcggcgggcaacaccttcgtcctcaagccgagcgagctgaccccgcacaccgcgatccatctgatgcggctcctccaagaggccgaactcccgccgggcgtcgccaacctggtcctgggcgccggcccggaggcgggcgcgccgctcgccgaccatccggacgtcgacctcgtctccttcaccggcggtctgcacacaggcaggcggctgatggccgccgcggccggcacggtgaagaaggtggcactcgaactcggcggcaagaatcccaatatcgtcttcgccgacgccgacttcgacacggcggtcgacatggcgctgaccgccgtgttcctgcactccgggcaggtctgctcggcgggggcgcggctgctggtcgaggactcgctgcacgaccggttcgtcgacgaggtggtgcggcgggccgcggagatccggctcggggggccgttcgacgagcgggcgcagaccggggcgctgatctcggccgcgcaccgggcgaaggtcgaggcctacgtcgcgaaggggctggacgagggcgcggtgctgcgctgcggcggcaggcgtcctgaggggctggacgagggcttcttctacctgcccaccgtcctcgacgagtgcaccagcgggatgtccgtgatccaggacgagtccttcggaccggtgctgaccgtcgagcgcttcaccggcgaggccgaggccgtgcgcctggccaacgacaccgtctacgggctcgccggcgccgtctggaccaccgacgaggccaaggcccagcgggtggtgtcccggctgcggatcggcacggtgtggatcaacgactaccacccgtacgtaccgcaggccgagtggggcggctacaagcagtccggcttcgggcgcgagctggggccctcggggctcgccgagtaccgggaggcgaagcacatctggcgtaacacggatccgtcaccacagggctggttcgcg

SEQ ID NO: 6927 - DNA, 1146 bp, Streptomyces avermitilis
  CDS (1)..(1146)
gtgacgacgacccccgtctcccccctctccgccctcccgccgagcctcctggcgacgctgccggggcactactacaccgacccggagatcttccggcaggagcaggccgacctgttcgagtcgatgtggttctgcgcggtccgcggcgccgacctgggcaggcccggcgccttccgcaccgtccaggtcggccgggagaacgtcctgatcacccgctcgcgcaccggtgagctgcgcgccttcctcaacatctgccgccaccgcggcgcccggctgtgcacggaggagtccggcgaggtccgccgcaacctccagtgcccgtatcacgcctggacctacgacctggacggcaagctggtcgccgcgcccaacctggtccggatgccggacgtggaccgggtcgagtacggcctggtcaaggtcgcgctgcgcgagtggctcggctacgcctgggtgtgcctggccgacgagccgccctccttcgaggagacggtgatgggcgcggccgtggaacggctcggcgacgcggcggccatcgagcactacggcaccgagaacctcgccctcggcaagcgcatcacctacgacgtgcgagcgaactggaagctgatcgtcgagaacttcatggagtgctatcactgcgcgacgatccaccccgaactcaccgacgtcctcccggagttcgccgagggctacgccgcgcagtactacgtcgggcacggtgccgagttcggccaggacgtcaaggggttcacggtcgacggcagcgagggcttcgcgaagctgcccgccgtcgacgacgaccaggaccgccgctactacgcgatcaccgtgaagccgacggtgttcatcaatctcgtcccggaccatgtgatcctgcaccgcatgttcccgctcgccgaggaccgcacgatcgtcgagtgcgactggctgtacgctccggaggtcgtcgagtccggcgccgacgtgtccaagtcggtcgagctgttccaccgggtgaacgtgcaggacttcgacgcctgtgaacggacgcagccggccatggcgtcgcgggcgtaccggaagggtggtgtgctggtgcccaccgagcaccacatcgggatcttccacgagtggctgctcgggcagctgggaggcgaccatgcc

SEQ ID NO: 6928 - DNA, 1152 bp, Streptomyces avermitilis
  CDS (1)..(1152)
gtgtcccccacgtatgacgtgatcgtgatcggtctcggcggcatgggcagcgccgccgcccatcatctgtccgcgcgcggcgcccgcgtgctcggcctggagaagttcggcccggtccacaaccgcggctccagccacggcggttcgcgcatcacccggcagtcgtacttcgaggacccggcgtacgtaccgctgctgctgcgctcgtacgagttgtacgaggaggtggagcggtcgaccgggcgcgaggtcgccaccctcagcggcggcgtgatggtcggccgccccgactcgctgaccgtcgccggttcactgcgctcggccacccagtgggacctgccccacgagatgctcgacgcgaaggagatccgccgccgcttcccgacgctgaacccgagcaacgacgaggtggcgctctacgagaagaaggccggcctggtccgccccgagaacatggtcgccgcgcacctccagctggccacccggcagggtgcggagctgcacttcgaggagccgatgacgcgctgggagccgtaccgggacggcgtacgcgtccacacggccgagaacacctacacggcgggccagttggtgatctgcccgggtgcgtgggcgccgcagctgctcacggatctcggagtgccgttcaccatcgagcggcaggtcatgtactggttccagccgaggcacggcgtggggcccttccgccccgagaaccacccgatctacatctgggaggacgccgaaggagtccaggtctacggcttcccgtcgatcgacgggccggacctcggcgccaaggtcgccttcttccgcaagggcgtggtctgcactccggagacgatcgaccggaccgtgcacgaccacgaggtccaggccatggcggaccatatgtcccgctgcatcccggatctgcccggcaccttcctcaaggccgccacctgcatgtactccaacacccccgacgagcacttcgtcatcgcccgccaccccgcgcacccggactccgtgaccgtggcctgcgggttctccgggcacggcttcaaattcgtgccggtggtcggagagatcgtcgccgacctcgccctgaccggcaccaccgcccatccgatcgggctgttcgacccccgccgcctcgccgccgcgcccgcc

SEQ ID NO: 6929 - DNA, 2454 bp, Streptomyces avermitilis
  CDS (1)..(2454)
atgtccagcacgcccgaaacccgcccgcgcggtcctcaggtcgtcatcatcggcgccggcatcgtcggctgctccctggccgacgagctgaccgcccgcggctggaccgacgtcaccgtcctcgagcagggacccctgcccgctccgggcggctccacctcgcacgcgccgggcctggtgttccagaccggcccctccaggatgctcacgtcgttcgcccagtacacggtggagaagttcaactccctcgaggcggacggagtgccctgcttcgacccggtcggcggtctggagctcgcgaccacccccgagcgcctcgccgacctgcaccgcaaggccggctacgccgcctcctggggcgtacgcggcgagatcgtgagcaccgcccgctgcaaggaactctggcccctcatcgacgagtcggtcgtcctcggcggcttccacacccccgacgacggtctggcccgcgccctgctcgccgcccgcgcccagatggagcgggccaccagccgcggcgccgtcttcctggaccgccacaccgtcacgggcatcgagcggcaggacggcagggtcaccgcggtcgtcaccgaccggggcaccttcgccgcccaccacgtcgtgtccgccgccggcttctggggccccgtcatcggccgcatggccggaatcgacgtccccctccagccgctcgcacaccagtacgcgaagactccgaagctccccgaactggccggcgccacggccgaagcctcgaagcccatcctccgcttccaggaccgcgacctctacttccgcgagcacaccgaccgtatcggcatcggcagctacgcccaccggccgctcaccgtcgacgcgttcgcgatccccgcctacgacgaggcgcgcgcgaacgacatggagatgccgtcctcgtaccccttcaccgcggaggactgggcgccgagctgggaggactgccgccgcctgttcccggccctgcgtgacacggagatcgaggagggtttcaacggcgtcttctccttcaccccggacggcatgccggtactcggcgagtcgcgggccctcaggggcttctggctggccgaggcggtctgggtgacgcactccgccggtgtcgccaaggcggtcgccgagtggatggtcgacgggcggccgtccatcgacgtccacgaggccgacctcacccgcttcgaggacgcacagcgctcgccgtcgtacgtcagggagcgcggtgcgcaacagttcgtcgaggtgtacgacatcctgcaccccctccagccgatggagcggccgcgcccgctgcgcgtcagccccttccacgcccgccagcaggccctcggcgcctgcttcctggagggcggcggctgggagcgcccgcactggtacgaggcgaacgccccgctcgtcgacgccctcggcccgctccccgagcgcgacgcctggtcggcccgctactggtcgccgatcgcggcggccgaggcgcgggcgacccgcgagaaggtcgccctgtacgacatgaccccgctgcgcaggctcgaggtcagcggccccggcgccctcgacttcctgcaccgcatgaccaccaacaacctccgcaagaagcccggcgcggtcacctacaccctgctcctggaccacacgggcggcatacgctccgacctcaccgtcgcgcgcctcggccccgaccgcttccaggtcggcgccaactcccccgccgacctggactggctgacccggcatgcccccgacggcgtgcacatccgggacatcacgtccggcacctgctgcatcggcgtctggggcccgctcgcccgcgacctggtccagccgctgacccgcgacgacttctcgcacgagggcttcggctacttccgcgcgaaggagacgtacctcgggcacgtcccggtgaccgcgatgcggctgagttacgtcggtgagctgggctgggagctgtacaccacggccgacctgggcctgcggctctgggacacgctgtgggaggcgggccggaagcacggcgtgatcgcggccgggcgctcggccttcaactccctccgtctggagaaggggtaccgcgcctggggcaccgacatgaccgacgagcacgaccctttcgaggcgggcgtcggcttcgcggtgcgcatggacaaggagttcgtgggccgggaggcgctcgacgcggccgcgcccccgacgcgcaggctgaccccgctcctcctcgacgaccccgccgccaacgtcctcggcaaggagccggtgtacgtcgacggcgtcccgtccggctatgtcaccagcgcctcgtacggctacacgctgggccgctgcgtcgcgtacgcctggctgccgccgctcgcgaccggcacgggcgtgcacatcgagtacttcggcgagaaggtccccgcgaccgtcgccgaagagccgctcttcgaccccaagatgacccgcatccgccga

SEQ ID NO: 6930 - DNA, 624 bp, Streptomyces avermitilis
  CDS (1)..(624)
gtgaccgcgcggggcaccgtacgggtcgaacgcgtcgtcacctccggcaccttcagcctcgacggcgacaccttcgacgtcgacaacaacgtctggctgatcggcgacgacgaggaggttctgatcgtcgacgccgcccacgacgcccgtacgatccacgaggccgtcgccggccgtcatgtcacggcgatcgtctgcacccacgcacacgacgaccacatcgacgcggcggccgagctctccgtcctgaccggcgcccccgtactcctgcaccccggcgacaacgagctgtggtcgctcacccaccccggtcgcaagccggacggcgagctgagcgacggccgagtcctgacggtcgccggcatcgagctccaggtgatccacagccccggtcacacctggggcagttgctcgctccacgccccgttcctgaacgccgtcttcaccggcgacaccctcttccacggcggccccggcgccaccggccgctcgtactcggaccggcccaccatcgaggcctccctgcgcaaccggatcctcacgctgcccggcggcaccgtcgtacacaccgggcacggcgaggacacgacgatcgccgccgaacggctcaacgtccctgccgtg

SEQ ID NO: 6931 - DNA, 1089 bp, Streptomyces avermitilis
  CDS (1)..(1089)
ttggtcgtgccacacgaggtccgtgccgtagtcgctgtcaaaaagggcgcacccgtcgaggtgcagacgatcgtcgtccccgatcccggcccgggcgaggtgctcgtcgccgtccaggcctgcggggtctgccacacggatctgcactaccgggagggcgcgatcaccgacgacttcccgttccttctggggcatgaggcggccggcacggtcgaggcggtcggcgcgggcgtcaccgacctggcccccggcgactacgtggtcctcgcctggcgcgcgccctgcggctcctgtcgttcctgtcgccgcggccgcccctggtactgcttcgactcccgcaacgccacccagccgatgacgctgctcgacggcaccccgctcagcaacgccctcggcatcggggccttcgccgagaagaccctggtcgccgcgggacaggcggtgaagatcgacccggccgcccgcccggaggccgcgggcctgatcggctgcggggtcatggccggatacggcgccgccgtcaacaccggcaaggtcggccgcggcgacacggtcgccgtgatcggctgcggcggcgtcggcaacgcggcgatcgcgggcgcgtgcctcaacggcgccatgaaggtgatcgccgtcgacatcgacgacaagaagctcgatcaggcggagaagttcggcgcgacccacaccgtcaactcccgtggtacggacccggtcgaggcggtccgcgcgctcaccgacgggttcggggtcgacatcgccatcgacgcggtgggccgcccggagacgtacaagcaggccttctacatgcgcgaccacgccggcacgctggtccaggtcggggtccccgaccccgagatgaagatcgaccttcccctcatcgacctgttctcgcgcggcggcgccctcaagtcgtcctggtacggggactgcctgccgagccgcgacttcccgttcctcatcgaccagtacctgtacggtctgctggacctcaacgccttcgtcagtgagaccatctccctcgaacaggtcgaggaggcgttcgcgaagatgcaccgcggggaggtacttcggtcggtggtggtcctg

SEQ ID NO: 6932 - DNA, 828 bp, Streptomyces avermitilis
  CDS (1)..(828)
atgacccgcacgcagaagcaggctgagcgcagcgacgagcactccggaaactcagcgaagcagaacggcaggggcacggccagtgcggtccagtcggtcgaccgcgccgtgagcgtcctggagatcctcgcccggcacggtgaggcgggcgtcaccgagatcgccgaggaactggacgtgcacaagtccaccgccttccggctgctcggcgtcctggagaaccgcggcctggtggcccaggccaaggaccgcgggaagtactacctgggcgccggcgtactacgcctggcgggggcggcggcagtacggctggacatctcgcaggagggcgtgccggtctgccgtgaactcgccgacgagctgggcgagaccgtcaacatcgcggtcttcgacgacgacgcggcggtcaacatcatgcaggcccgcggcaccgcctccgtgacggcgcagaactggctgggcagacgcaccccgctgcacgccacctccagcggcaaggtgctgctcgcccatctgccgcccaccctgcgcgagggcctgctcgcgcgctcgctgccgcgcttcacggagcgcacgatcaccggcgcgacggtgttgcgcggcgaactggaggcggtgatcgagcagggctgcggagtcaccatcgaggagctggagctgggccttgccgccgtggccgccccggtccgcgcccacgacggcaaggtgatcgcggcgatcagcgtctcggggccggtgtaccggatgggcccggaccggctgcccgagctgaccaagcggacggtggcggccggcgccgagctgtcccggcggatgggctacggcttc

SEQ ID NO: 6933 - DNA, 318 bp, Streptomyces avermitilis
  CDS (1)..(318)
gtgattcccgtctgccgccttgaagacctccccgcgggcgagtccgtccgtgtcgacaccacaccacccatcgccgtcttcaacgccgacggcgagctgtacgccattgacgacacctgcacccaccaggacgcgtctctgtccgagggctggctggagggctgtctggtcgaatgcccgctccacgcggcctcattcgatctccgcaccggcctgccgacctgtctcccggcccgccgcgccgtccgcacccaccgcgtcacggtcgacgacggcgtgatccacgtgcatctcgcgctggaggaggggaacgccgca

SEQ ID NO: 6934 - DNA, 1239 bp, Streptomyces avermitilis
  CDS (1)..(1239)
atgaggaccgtgaccgtcgtcggggcctcgctggccgggttgtacgcggcccgggaactgcgtgcccagggcttcgacggacgactcgtgatcgtcggggaggaaccccacccgccgtacgaccgcccgcccttgtccaaggacttcctgaccggccgggccgaccaggaccgactcgcgctcgccgacgccgaggagaccgccgaactgggcgccgagtggctgctcggcgtgcgcgcccgcggcctcgacccccgcggccgcaccgtgctgctcgacgacggccgcacggtgtccacggacggcgtggtcatcgccaccggcgcctcggcccggcgccttccgggcgacgacctctccggcgtgcacaccctgcgcaccctcgacgacgcccgcgccctgcgcgacgaactctcccggggagcacgccgggtcgtcgtcatcggcggcggtttcatcggcgccgagaccgcgtcctcctgcgcggcactcggccacgacgtcacggtcgtcgaggccgccccgctgcccctcgtcccccaactcggggcagagatggccgccgtgtgtgccgcgctgcaccgccgaggcggtgccggcctcgtcaccggcacgggggtcgccgggctgcgcggccgggcgggcgccggggcggagaggagcggccaccagggggcgggcgccgccggtccgcgtcgtagcgtcacggccgtcgaactctccgacggtcgcctcctgcccgccgacggcgtcatcgtcggcataggagccacccccaacacaggctggctcgcgggctccacgctcgccctgcacgacggcgtgctgtgcgacgacggctgtgcgaccgccctgccgcaggtggtcgccgtcggagatgtcgcacgcgtcggcggcacccgcgccgagcactggacctcggccaccgagcagccccgggtggccgtgcgcaacctgctggccggacgcaccacggagaccgtccgctcggtgccctacttctggtccgaccagtacggcgcgcgtatccagttcgcggggcgtcggcacgacggcgacaccgtacggatcaccgagggcgcgatcgagcgcggcgggcccgcggagggcggactcctcgccctgtacgaacgcgacggccgcaccaccgcggtgctctccgtcgaccgcccgcgccccttcatgcgggcccgacgcgaactctcccgcgctgccgacccggtggagccggcggcgctg

SEQ ID NO: 6935 - DNA, 615 bp, Streptomyces avermitilis
  CDS (1)..(615)
atgggcacggcggagttgcgcgcgacgaccgggaacggcgtcgcggcgcccacggtggcgcgaccggacgcccaggcaccggatcgcgacgttccggcgtccggacgccggttgccggcacagaagtccgaggcggcggacgggcggcgcgttccatccggtgggcatgacgcgggcgccgagcggcgcgccgcggcggccgagaccgaggaggaacagggggcgtattaccgggcgttgtgggtcgaggagcccgcgcgccgacgcaggctgccggatccggtgcgtacggcggccgtgcgggcggtgctcatcatcgccgtgacgctgatccaggcggtggtggcgttcctgtgcacgatggccggttcctggctggccttccccatggtgctgagcagcctggtgagtacggtcgtggcgacctggggcgtgctggacgtatgggtgacacaccaggtgtggaaccagcggaacggggtggtgtcggcccccagcagcacggcacgggcactgcggcgcgagcggcgccggatacgccggcagacgcgggtggcggagcgggcgcaggagcggatacgccggcggggcggcagcgggcagttgtcgcacccc

SEQ ID NO: 6936 - DNA, 2838 bp, Streptomyces avermitilis
  CDS (1)..(2838)
atgcgctttcgcgggaagtccatccgccggaagatcgtggcgctgctcctcgtgccgctgttgtccctcaccgccatctggtgctttgcgaccgtactcacgggccgggcggcccagtcgctgttcagcgtgtcgtacatcgtggagaaggccgcctaccccaccgaggacaccgtccacgtcctccagcaggagcgccgccagaccctcgtctacctcgccgatccccgcgcctccgacgcgctctccgccctcaggcgcagccgtgccgccaccgacaaggccgtggcgaagatccgcaagaacgccaaggacgagaagttgcgcgaggagacgggcgaggccaccgccgagcgcctcacctccatcctggacgccctggacggaatcgattcgctgcgccgcagcgtcggcgacggcaccgtcaaccgctcccaggccctcgacctctacaaccgcctggtcgacccctgctacgcgctgctggccaacctccacgtcctcgacaacgtggaaatggacaagcagagccgtgccctcgtcaacgtctcccgcgcgcatgagctgctctcccgcgaggacgccctgctgggttccgcactcgtcgccgggcggatcacccgcgacgagatccgtgacgtctccgacctcgtcgcccagcgcagcctgatgtacgacgtcagcctgccgctgctgccctcctccgagcgggaacgcttcacgcgcttctggaagaacgccgacacggcgccgctgcgcgtcgccgaacagtccgtcatcaatgcctcccccggcacccccagcggtgtgagcgccaagcactgggacagcgcggccggtcaagtcctcgaccggctcggcgagatgtccacccaggcgggcgaccgctaccaggaccgcgtccgccccgtcgccgtcggcgtcatcgccaaggcggccgtcgcgggcgttctcggcctgatcgccctgctcgtctccctgatcatgtccgtacgcatcggccgcagcctcatccgcgacttgcgccggctgcgtctggacgcccacgaggcatccggagtgcggctgcccagcgtcatgcgacgtctgtccgcgggcgaacaggtcgacgtcgagaccgaagtcccgcgcctcgagtacgacaagaacgagatcggcgaggtcggccaggccctcaacaccctccagcgcgccgccgtcgaagccgccgtcaaacaggccgagctgcgcgaaggcgtctccgaggtcttcgtcaacctcgcccgccgcagccaggtcctgctgcacaagcagctcaccctgctcgacaccatggagcgcaggaccgaggacaccgacgaactcgccgacctgttccgcctcgaccacctgaccacgcgcatgcgccggcacgccgagggcctggtcatcctgtccggcgccgccccctcccggcagtggcgcaaacccatccagctcatggacgtcgtccgcgccgccgtcgccgaggtcgaggactacgagcgcatcgaggtacgccggctgccccgcgtcgccatcaccggccccgcggtcgccgacctgacccacctcgtggccgaactcctggagaacgccacggtgttctcgcccccgcacaccgccgtccaggtcatcggcgagcgcgtcgccaacggcttcaccctggagatccacgaccgcggactcggtatggcggccgaggccctcctcgacgccaacctgcggctcgccgagaccccggagttcgaactctccgacaccgaccggctcggcctcttcgtggtcagccggctcgcccagcggcagaacgtccgggtctcactgcaaccctccccctacggcggcaccaccgccgtcgtcttcatccccgacgcgctgctcaccgacgacgtgcccgacaccaacggcatcggattccgcctcgaccgcgcgctccccgccaaggagccggcgctggacgaggaccgcacggcggcgctctcccaggtgcccgtgcagttcctcggcctgcccacgtcgatcctggacgggcccgtcgagctggaggcaccggtcgacctggacgccctcgacgacttccccggcgccctgagcgacgaggacagcgaacgcggcggcctgttccggccccggccctccatcgccggcgtccccggcccgcagcatcagcagccccgcgacggccgcggcgagccgggccgctcgggcgacaccgaccaccccgatgccccggttccgctgccccgacgccggacccccaagctcgtcagctcgcacggccgcccggtcacggggacacggtccaggagcgcgggagcggacgaggggcccgtggagggcatggacccgatggaaccgggcgtggccgcgttcgacgaacgcaggtcgaagccgtcggcagcccgcctggccgaccggcgtgagtcctcgaaacgcccgcgcggcgaccgcgagatcccgaaccgcccgcagggcgagcgcagcgacgctcccgccctcccccagcgacgccgaagccgcccctccgccggcacggaggagaccaccccgcgtctcggggccgcggcagggaaggcagaatcgggtgcggggccgctgccccggcgcgtacgacaggccagcctggccccgcagctgaaggacggccccgagcggcgcgccgaacgcgacaaggcccgcaccgcgagccgggcggacctcgccgagcgcgacgccgacgaggtacgcagccggatggcctcgctccagcggggctggcagcgcggccgcgaggagaacgccgtgggcgacgatgcccaggacggctcagtacgaggaacgacaaggggggacggtcga

SEQ ID NO: 6937 - DNA, 438 bp, Streptomyces avermitilis
  CDS (1)..(438)
atgaccgcaccgaaggccgcagggcccaccgcgagcagcacggcgtcgggggagctgaactggctcctcgacgacctggtggagcgcgtcgccagcatccacaaggcgctcgtgctctccggcgacggcttgcccaccggcgtctccaaggacctgagccgcgaggacagcgagcacctcgccgccgttgcctccggattccacagtctcgccaagggcgtcggccgccacttcgaggcgggcagcgtccgccagaccgtcgtcgaactcgacgaggccttcctgttcgtcacggccgccggcgacggcagttgcctcgccgtgctggcggacgcggatgccgacatcggtcaggtcgcgtacgagatgacgctcctggtcaagcgggtcggcgtacatctggggtccgctccgcgcaccgatctgccctcgggcggg

SEQ ID NO: 6938 - DNA, 393 bp, Streptomyces avermitilis
  CDS (1)..(393)
atgagcggagacggtcagggaagaagccactggttcgacgacgacgccggaccggtggtccgtccgtacgccatgacgcggggccgcaccagccatgcggcccagcaccgcctcgacctgatcgcggtggtcgtcgcggaatcgcacgcggacgaacccgaggcggaccacatgctgtccccggagcatgtggacatcgtcggactctgccgtcacaccccccagtcggtcgccgagctcgccgcggaactcgatctccccatcggagtggtacgtgtcctcatcggggacctcgtggacgaggaactcgtccatgtgacacgtcccgtacccccggccgagctcgtcgacgagagtattctgcgcgacgtgatcagcggcctccgggcgctc

SEQ ID NO: 6939 - DNA, 3612 bp, Streptomyces avermitilis
  CDS (1)..(3612)
gtgacaggctggcagttctgggtcgaccgaggcggcaccttcaccgacatcgtcgcgcggcgcccggacggccgcctgctcacgcacaagctcctctcggacaacccggcgagatacgcggacgcggccgtcgcgggcgtgcgggaactcctcgaggacggcgcgcggatcgatgccgtccgcatgggcacgaccgtcgccaccaacgccctcctggagcgcaagggcgaacgcaccctcctggtcgtcacccgcggcttccgcgacgccctgcgcatcgcctaccagaaccgcccgcacatcttcgcccgccaaatcgaactgcccgaactgttgtacgagtgcgtcgtcgaggcggacgaacggatcgccgccgacggcacggtcctgcgcgcccccgacctggacgccctggccgggccgctccagcaggcgtacgacgacgggatccgcgcgatcgccgtggtctgtatgcacagtcacctccaccccgcccacgaacaggccatcggcacgctcgccgcccgcgtcggcttcccgcagatctcgctctccagcgaggtcagccccctgatgaagctgatcccgcgcggggacacggccgtcgtcgacgcctacctctcgcccgtgctgcgccgctacgtccagcacgtcgccggcgaactccacggcgtgcggctgatgttcatgcagtccaacggaggcctcgccgaagccggtcagttccgcggcaaggacgccatcctgtccgggcccgcgggcggcatcgtcggcatggcccgtatgtcgcagctcgccggcttcgaacgggtcatcgggttcgacatgggcggcacctccaccgacgtctcgcacttcgcgggcgagtacgaacgggtcttcaccacgcagctcgccggggtccggctgcgtgcacccatgctggacatccacacggtggcggccggcggcggttccgtcctccacttcgacggctcccgctaccgcgtcggccccgactccgcgggtgccgccccgggccccgcctgctaccggggcggcggtccgctcaccgtcaccgacgccaacgtggcgctcggccgcatccaacccgcccatttcccgcgtgtgttcggaccccggggcgaccagcccctggacgccggactggtccgcgagcgcttcgccgccctcgcgcgcgacatccgcgacaggacgggcgacgaccgcacacccgagcaggtcgccgagggctacctgcagatcgccgtcgccaacatcgccaacgccgtgaagcggatctccgtccagaagggccatgacgtcacccggtacgcgctcaccaccttcggtggagcgggcggccagcacgcgtgcagggtggccgactcgctcggcatccacacggtcctcgtaccgcccatggcaggcgtcctctccgccctcggcatcgggctcgccgacaccacggccatgcgtgagcagtccgtggaggcgcccctggagcgggcctcgatgccgcacatcctgaagacagccgacgacctggagggcgccacccgggccgaactcctcgccgaggacgtccccgaggaccgcatccgggtcacccgcagggcacagctccgctacgacggtacggacaccgcactcaccgtcgagctgaccgagcccgacaccatgatccgcgccttcgaagaacgccatcgcgccacctactccttcaccctcgaccgcccggtcgtcgtcgaagccctctccgtggaagccaccggtctcaccgaaccccccgatctctccgccctcgccgcattcgagggccgctccgccacccctgagacggtcagcctgcacaccggcggcgcctggcgcgacgtgcccctgcaccgccgtgaggcactgccgccgagcgagaccgtgaccggaccggcggtcatcgccgaggccggcgccaccacagtcgtcgacgacggctggcaggcggtcatcacgggcgacggccacctgatcatggaacgggtggcggttacggagagttccgatctcggcacggaggcggacccggttctcctggaggtcttcaacaacctcttcatgtccatcgccgaacagatgggcgcgcgcctggagtccaccgcccagtcggtgaacatcaaggagcgcctggacttctcctgcgcgctcttcgacccggacggcagcctggtcgccaacgccccgcacatcccggtccacctgggctcgatgggcaccagcgtcaaggaggtcatccgacggcgcggcgacggcatgcgtcccggggacacctacgcggtcaacgacccgtaccacggcggcacccacctgcccgacgtcaccgtcatcactccggtgttcgacacggagggcgagcgggtgctcttctacgtcgcttcgcgcggccaccacgcggagatcggcggcatcgcgcccggctccatgcccgcgaacagccgcaccctcgaggaggagggcatcctcttcgacgactggctgctcgccgaggacggccgcttccgcgaggcggagaccctcagcctgctcaccgaagcgcgctacccgtcccgtaatccgaacaccaacctcgccgacctgcgcgcccagatcgccgccaaccagaagggcgtcggcgaagtcgcccgcatgatcgagaacttcggcctcgacgtcgtccaggcgtatatgaagcacgtccaggacaacgccgaagacagcgtacgacgggtcatcgacacccttgaagacggtgagttcgcctacgagaccgactccggcgcggtgatccgggtgcgggtcctggtggaccgcgagaaacgctccgcgaccgtcgacttcaccgggacgtcgccgcagctccccaccaacttcaacgctcccttctcggtcgtcaacgccgcggtcctgtacgtcttccgcacgctggtcgccgacgacatcccgctcaacgacggctgtctgcgccccctcgacatcgtcgtaccgcccggctcgatgctcgcccccgagccgccggccgcggtcgtcgcgggcaacgtcgagacctcccaggcgatcaccggggccctgtacgcggctctcggcgtgcaggccgagggctccggcacgatgaacaacgtcaccttcggcaacgagaagtaccagtactacgagaccgtggcctccggctccggcgcgggcgacggcttcccgggcgcatccgtcgtgcagacccacatgaccaactcgcggctcaccgaccccgaggtcctggagtggcgcctgcccgtcgaactcgacgagttcgcggtgcggcacggaagcggcggcgcggggcgctggcgtggcggagacggcgccgtacgccgcatccggttccgtgagcccatgaccgtctccacgctctcccagcaccgcagggtcccgccctacggcatggcgggcggcgagccgggagcgctcggcgccaaccgtgtggagcgggccgacggcacggtcaccgaacttggcggaagtgatacggccgatgtcggccccggcgacgtactggtcgtcgaaacccccggcggcgggggctacggcccaccgccgcgcgacaacgatcaagcaggagaagagaccgatgatcttcgggcgcac

SEQ ID NO: 6940 - DNA, 603 bp, Streptomyces avermitilis
  CDS (1)..(603)
atgatcttcgggcgcactgagcgcggcaagcccccggtcgagcccgtcacgctcaagatccttgtggccggcggcttcggcgtgggcaagacgacccttgtcggcgcggtcagcgagatcaggccactgcgcaccgaggaggtcctcaccgaggccggccgcccggtcgacgacatcagcggcgtggagggcaagcacaccaccaccgtcgccatggacttcggccgcatcacgctccgcgaggacctggtgctgtacctcttcgggacgccgggacaggaccgcttctggttcctgtgggacgaactcgccaccggtgccctgggtgcagtcgtcctcgccgacacccgccggctggaggactgcttcgccgccgtcgactacttcgaacgccgctccatccccttcgtgatgggcgtcaactgctttgaagaggccgcccgttacccggtggaggacgtccgccgggccctcgacctcgacgacgacgtgcccgtcgtgctgtgcgacgcccgggaccgcgagtcggtcaaggaggtcctgatcgacgtcgtccggcacgcgatggcccacgcggccgagcgccgcgagaccgtgagcggc

SEQ ID NO: 6941 - DNA, 1521 bp, Streptomyces avermitilis
  CDS (1)..(1521)
atgccggacaacgcccagaagtacgtcgccgccatcgaccagggcaccacctcgagccgctgcatcatcttcgaccacggcggcgcgatcgtcgccgtcgaccagcgtgaacaccgccagatcttccccaagcccggctgggtggagcacgacgccaccgagatctggtccaaggtgcaggcggtggtcgcgggggcgatcgccaaggccggactgcgcgccgaccagctcagcgcgctcggcatcaccaaccagcgcgagacgacggtcctgtgggaccgcgccaccggcaagcccgtgcacaacgcgatcgtgtggcaggacacgcgtacgtccgcgctctgccacgaattgggcggctcggacgggcaggaccgtttccgcgagcagaccgggctgccgctggccagctacttctccgggcccaaggcggcctggctgctcgacaacgtgcctgggctcagggcccgtgccgagcgcggcgagatcgccttcggcaccatcgactcctggctcatctggaacctcacgggcggcacggacggcggccggcacgtcaccgatgtgaccaacgcaggccgcacgatgctgatgaacctggagacgctccagtgggaccgttccatcctgtccgcgatgaacgtccccgaggcggtcctccccgagatcaggtcctcgtccgaggtgtacgggacggccgtgggccagctttcgggcgtgcccgtcgcgtcggcgctcggcgaccagcaggcggccgtgttcggacaggcctgctacgacgtgggtacggcgaagaacacctacggcacgggcagcttcctgctgctcaacaccggcaaccggcccgtgccgtcgaagaacggcctgctgacgaccatgggctacaagatcggtggcgaggcgccggtctactgcctcgaagggtcgatcgcgatcacgggcgcgctggtgcagtggttccgcgaccaactcggcatcatccgtacggcggacgagatcgagacccttgcggcgagcgtcgacgacaacggcggggcgtacatcgtgcccgcgttctccggcctgttcgcgccgtactggcgctccgacgcacgcggtgtcgtcaccggcctcacccggtacgtcacgaaggcacacctggcgcgcgcggtactggaggccacgagctggcagacgcgtgaggtcgtcgacgccatgtaccaggactccggggtgcggatcaccaccctgaaggtcgacggcggcatgaccaagaacaatctgctgatgcagcaccaggcggatgtgctcggcgtgccggtcatccgccccagggtctccgagaccacctgcctgggcgccgcctacgcggccgggctcgcgaccggcgtgtggaacgacctcgacgagctgaagtcgcactggcagaaggacgtcgagtggacgccctccatggaggcgtcggagcgcgaccgcgagtaccacaactggcgcaaggcggtggagaagagcttcggctggcacgaggaggacggcgtgaac

SEQ ID NO: 6942 - DNA, 747 bp, Streptomyces avermitilis
  CDS (1)..(747)
atgagcaacggagacatattcgtcggtgagatcatcggcaccgcgatcctcattctcttcggcgcgggagtctgcgccgccgtcacactcagatactcgaaagcacgtgcctcgggctgggtcgtcatcgcgttcggctggggtttcggagtgctggcgggcgcgtacaccgccgcaccgctctccggtgggcacctcaacccggccgtgaccatcgggatcgccatcgacacgggcacctggggcaaggtctggatctatctgctgggccagctcgtcggcgccgtgctgggtgccgtcctcgcgtacctcgtgtacctcgcccagttccaggcgaacgtgcgcaaggagggcaccacggagggcacggcggacgagccggtgcctacgctcggcatcttctccaccatcccggagatccggaatccggtcgccaacctgatcacggagatcatcgcgacgatcgctctcgtcctgccgatcctcgctttcggactcaccaaggggctcggtgagtccggtatcacggtgctgatcgtctcgctgctcgtcgtcggcatcggtctctccctcggcgggccgacgggttacgccatcaacccggcgcgtgacctcggcccccgtatcgtgcacaccttcctgccgatcccgaacaagggcacctccgactggggttacgcctggatcccggtcgtcggcccgctgatcggaggagcgctcgcaggcctcatctaccacgtagccttc

SEQ ID NO: 6943 - DNA, 1623 bp, Streptomyces avermitilis
  CDS (1)..(1623)
gtgccctcctggatggatactctccgcttcgctttccaaccggtggtcaatctgacgaccggaggggtcgcggcgctggagatactcgctcgcccggagaccggcgacgtgctggcacaggcccgccgggacccggaactcgacggcaggctggccgcgtcggggatccgtgccgcagcgctcaaggagacgctgctgccactgcatgtgaacgtgttcgcgggaacgccggccgacctcggcggtctcgccgcgctgcgggacgccgtgcgcgaggcggggcgactgccctgggaggtgacggtcgacatctgcccgccgtacacacacgtcccgcaccaggcgctgctggaggcggtcgccgcaatcaggagcgagggtttccggatctgcgcggacggcatcggcgacggcgacgtaccgctgcggctgctcacggacatggcgccggatctgctgaagctggacgtgtcgctgctgacgcggccggccgcggtgcgggcgatgcggacactgtgcgagcagttgggcgcgctgctctccgtcgagggcgtcgagacggagtcgcagtgcgcggcggccctcgcggcgggggcccagctggcgcagggcgagttgttcgcgccgccctcgcggctgcctgtggcggatgtataccttccgacgctctcccccgccgccgtgccggccccgcgcaccggaccgccggtacggcagttcgtacggcctgccgccctgctgcccgccatggcctcggcggcacaggtgcgggcgctgctcaccggatcgcccgacgtgtccggggtgctgctggtggacgcgggcggggtgccggtccgttcggtgcaccggtcgcgcttcctgctgtcgatgtccgggcgctacggacatgcgctgtatgccgaccggccggcggcgaagctcagtgatccgccgcgaacggtcggggtcgacgccacggcgtgggaggtgctcgacgtggtggcggtcgggggcccggaccgcacctccgacgacgtcgcggtcgtcgaccggcacggccggtgcgtgggggtcgtacggctcgcggatctcgtacgggcgctggccgagagccgggtcgaagaggccgcggggctcaatccgctgacgcggctgcccggttcggacgcgatcaccggagaggtggaccggtggatcgcggacggccggatgttcgcgctgagctggctggacgtcgaccgcttcaagcaggtcaacgacggtgccgggttcgccgcgggcgacgagctgatccgggccgtggggcgggcgttgcagcgcgcggcgtccggagccacgcgggtggggcacatcggcggcgacgacttcctggtcctggccgatgcggacgcactcgatccggtggcggcttcggtgctcgacgctccctggtcggcgggtggacgcaccgtcacgctgtccctggccaccgtcctgtgcccgccgggcagtgtgaccgaccaccggcaggcggcggcctgtctcgcacccctcaagcaggcggcgaaggcgctcagcggcgccagttgggtactcggccgcgcgggcctgccgggccatgagatccgtcgcggctcgggcgcggccgcggcccatgcgggg

SEQ ID NO: 6944 - DNA, 1188 bp, Streptomyces avermitilis
  CDS (1)..(1188)
atgacggacgatgtggcggtgctcggcgcggggatgcacccgtggggcaagtgggggcgcggcttcgtcgagtacggggtcgcggcggcgcgcgccgccttggccgatgccggggtggactggcgggaggtcggctcgatcgtcggcgcggacaccgtgcgcggcggctacccgggctacgtggccggggcgacgttcgcgaaggccctcgggtggcagggcgcgcgggtgacgagcgtgtacgcggcttgcgcatcgggcgcgcaggccgtcagcgcggcgcgggcgcagatcctgtcggggctcgccgacgtggtgctcgtggtgggcgccgactcggcgcccaaggggttcttccgcccggcgggcggcgaccggcccgacgacccggactggctgcggttccgggtcctcggggcgaccaatccgacgtacttcgggctgtacgcgcgccggaggatggccgtccacggagacactgtggaggatttcgcgcaggtcaaggtgaagaacgccgcctcgggggcgttgaatccgaacgcccgctaccgcaagcgcgtcaccgccgaggaggtcgccgcctccgcggtggtcgccgatccgctgcggctgctcgacatctgcgcgacctcggacggcggcgcggcgctcgtgctgtccagcatggagttcgcgcggcgccgcggagcaccggacccggtgcggatccgggcggtgtccaccgtgagcccgcgctatccccggaccgtgctcgacctgccggacatcgcgacggactcggcggtggcggtcgagcccccggccgagacgttccgtacgtcgatcgcgcgggtcgcgtacgaggaggccggggtcgggcctgaggacctctccctggccgaggtgtacgacctgtccaccgccctggagttgcagtggtacgaggacctggggctgtgcagcgagggcgaggcggccaagctcctgcgggagggcgcgacggcgcccggcgggcgcatacctgtgaacgtcagcggtggcctggcctccttcggagaggcggttccggcacaggccatcgcccaggtgtgcgagctgacatggcagctgcggggtgatgcgggtgatcggcaggtcccgggggcgcgggtggggatcaccgcgaaccaggggctgttcgggcacgggtcgtcggtgatcgcggtccga

SEQ ID NO: 6945 - DNA, 444 bp, Streptomyces avermitilis
  CDS (1)..(444)
ttgtcgcgtacccgcactcctgtggtctccggatggttcgccggggacgggaacgacttccggctcctcggcacacgctgctcggcgtgcgcttccgtcttcttccctcgcgaggacgcccactgccgcaatccgggctgccccggcggcgaactggccgaggtcgccctgtccgggcgtgggcgcgtctggtcgtacacggacagccggtaccgaccgccgtcaccgtatgtgacggatccggaactctcgtgggagcctcgcgcgttgatcgctgtggagctcgcagcggagcggatcgtggtgctcggacagtcggttcccggggtcaccgtcgccgatctgacggtgggcatggaggtggaggtcgtccccggcgtgctgaacgaggacgcggggacgacctggacgacctggcactggcggccgacgggggtgacggca

SEQ ID NO: 6946 - DNA, 534 bp, Streptomyces avermitilis
  CDS (1)..(534)
gtgtccgcatcccgtcaccccaccgccaactgcgtgccggactcccactgttcgagctgcggagcgccctacggagagggcgtctccggctggccccgcagctgccccgtgtgcggcacggtggcctaccgcaatccgctgcccgtcgcggtggccctgctgcccgtgtacgacgccagaggcaccgccctggtcgtcatcacccgaaccatccctcccgcgcgcggggccgtcgcgctgcccggagggttcatcgaccatcgggaggactggcggcacgccgtcgtccgtgaactcaaggaggagacgggcatcgacgccgcgagccgcgatgtacggctcgccgacgccatgagctcgcccgacggccatctgctgctgttcggactcctcccggagcgcccggccgccgaccttccgccgtcgacgggcacggacgagaccgagggctggcagctgctgcgccggccggccgagctcgccttccccctgcacaccctggcggtacggggatggttcgagggccggtacgtc

SEQ ID NO: 6947 - DNA, 2364 bp, Streptomyces avermitilis
  CDS (1)..(2364)
atggacggtcgtgacctggtgcgttcggtgaaagcggtcggctcggggggtgcggcgggcgggttgcgcacggtacgggccgcgtggcgcaggaggcgtgccgacgcctccgggctgccgaggcgcggtgccgagcgcgcccgggtgcccggcccggtgcagggcgtggtgcccggcccgggcggtggcgtcatccggttcgcgcggtccgagctgcgcatcacggtcgccgtgaacggcgccgtgttctggggctgggacggggccgggccggagccgtcgtacgccctcgcgggccgctgtcccgaacccgacccccgggccgttctggagcccgacaaggacggtggctggcaggtcgtggccgagcgcggcacggtcatggtgtcgcggcacggcgcggtcgaggtgcgtacgcccggcggagtgacgctgcgccgggatctgccgccccgctggtgggagccggccgacggtggcgccgcccactggatgcagcggtcggaagtcgcggctgacgcgcggttcttcggtctgggcggccgcgccgccgggccgcggctgcgcggcgggacctaccggctgtggaacacggatcccggtcacgctgtcggaccgggcgacgacccgctgtacctcacgatgccggtgcagctggtggtcgccgacgcggccacgcatctcgtgttccacgacacctcgtgggacggcacggtgacgctgcgcgaaggcgaggagggggcgggctcggggcacgaccgggcggggacgagcgagctgcggatggacggtggtccgctgcgctgctgggtgatgatgggcacccccgcgcgcgtgctgcacacctgggcgtcgctgaccggggcgcccgcgctgccgccggcgtgggcgctgggacaccatcacgcgcgccggggatccggcagcgagcaggaggtgcggggggtcgtctcgggttatcaggagcgcgggcttccgctcgacgcggtccatctggacaacgatcactacgacgcgcaccaggtgttcacggtggaccgggaccgcttcccgaagctgccggtgctcgcagaggagctgcgccgcgacgggatacgtctggtgtcggtcgtcgacccggcggtcagggccgagccgggtaacgccgtgtacgacgccgggagtgcgcaggacgccttcgtacgggacgccgccgggcgggtcgtggagggagtcgtgtggcccggcgagtcggtctatccggacttcacgcacgcgcgcgtgcgcaagtggtggggcggcctctacgaggagcggctggctcagggcttcgcgggcttctggcacgacctgaacgagccggtgtcgttcacggccttcggggagaacaccctcccccggtcggcccggcaccttttggagggccgcggcggcgaccaccgggaggcccacaacgtgtacgccctgggcatggcccgcgccgggtacgaggggctgcgggaactgtccccccaggagaggcccttcatcttctcgcgctccggctggagcggaatgcagcgctacggaggggcgtggtccggcgacgtgaccaccggctggcccggtctgcgcgcgtccctgtcgctggtgataggcctgggtctgtgcggggtgccctactccggaccggatgtgggcggtttcgacgggagtccgtcgccggagctgtatctgcggtggttccagctcggttcgtaccttcccctgttccgtacccgtgcgggcctgcgggcggggcgcagggagctctgggagttcggcgaggacgtcctcgagcacgcgcgcgtggcgctcgtcgaacggcggcggctgctgccgtacttcatgacgctggcgcatctggcgcgccgtacgggagcgccctatgtgcggcccgtgtggtggggcgcgcccgaggaccgggcgctgcgcgactgcgaggacgccttcctgctcggtgacagcctcctggtggcaccggtcctggacccgggggcggaccggcgtgcggtgcagctgccgcgcgggcgctggtacgacacggtcaccgagaaggcgtacgacggaccgggccaggtgctgatcggcgcccccctgtcgcggattccggtgctcgcgcgcgcgggtgccgtcctgccggtgcggggcgacggtggccgtctggagttggaggtgtggaggccggcgcgcgggcgcaccgggggcggactcgtcgtgccggactcgggggacggctgggacgagccggagatcgagcagtatgtgacacgcctgcgggggcagcgggtggtcgtcgagcgggacggcgacgagggcccgggcgagccctcgtatccggtgcgtgtgcgaggactgccccaggcg

SEQ ID NO: 6948 - DNA, 1965 bp, Streptomyces avermitilis
  CDS (1)..(1965)
atgaccccagcgaacccctcgccgctctggcgacccgacgaggaacgcatcgcccaggcacagatcaccaggttccagtcctgggcggccgaacaccacggagcacccgccgacggcggctacgcggcattgcaccgctggtccgtcgacgagctggacaccttctggaaagccgtcaccgaatggttcgacgtacggttttccaccccctacgcgcgcgtgctcggcgaccgctccatgcccggtgccgcatggttccccggagcgaccctgaactacgccgaacacgccctgcgcgccgccgacacgcgcgcggacgaaccggctctcctgcacgtcgacgagacccacgagccccgcccggtcacctggtccgaactgcgccgccaggtcggctccctggccgccgaactgcgctccctcggcgtacgccccggagaccgcgtcagcggctatctccccaacattccgcaggccgtggtcgccctcctcgccacggccgcggtgggcggcgtctggacgtcctgcgcccccgacttcggcgcccgcagcgtcctcgaccgcttccagcaggtcgagccggtcgtgctgttcacggtcgacggctaccggtacggaggcaaggagcacgaccgccgtgaaacggtcgccgagctgcgccgcgaactgcccaccctgcgtgccgtcgtccatatccccgtgctcggcaccgaggcccccgagggcgccctggagtggtccgccctgacctcctccgacgtggcgcccgagttcgagcaggtcccgttcgaccaccccctgtgggtcctgtactcctccggcacgaccggcctgccaaaggccatcgtccagtcccagggcggcatcctcgtcgagcacctcaagcagctcggcctgcactgcgacctcggccccgaggaccggttcttctggtacacgtccacgggctggatgatgtggaacttcctcgtctccggcctcctcaccggcaccacgatcgtcctgtacgacggcagcccgggctttccggacaccgccgcccagtggcgcatcgccgaacgcaccggcgcgaccctctacggcacctccgccgcgtacgtcatggcctgccgcaaggcgggcgtgcacccctcgcgcgacttcgacctcgcgcgcgtgcggtgcgtggcgacaaccggctcgccgctgccgccggacggcttcagctggctgcacgacgaggtccgcgccgacctctggatcgcctcggtcagcgggggcaccgacgtgtgctcctgcttcgcgggagccgttcccaccctgccggtgtacatcggcgaactccaggccccgggcctcggcaccgacctccagtcctgggacccgagcggcaagcccctggtcgacgaggtcggcgagctggtggtcaccaatccgatgccctccatgccgatccgcttctggaacgacccggacggcagccgctaccacggcagttacttcgacacgtatccgggagtgtggcgccacggcgactggatcaccgtcacctcccgcggctccgtggtcatccacggccgctccgactccacgctcaaccgccagggcgtccgcatgggctcggccgacatctacgaagcggtcgaacgccttccggagatcaaggaatccctcgtcatcggcgtcgaacagcccgacggcggctactggatgcctctcttcgtccacctcgccccgggagccaccctcgacgacgccctcctgggccgcatcaagcagaccatccgcgaacagctttcgccccggcacgtccccgacgagatcatcgaggtcccggccatcccgcacacgctcaccggcaaacgcatcgaggtcccggtcaaacgcctgctccagggcaccccgctggagaaggcggtcaatccgggctccatcgacaacctcgacctgctgggcttctacgaggacctggcccgcaagcgcgcc

SEQ ID NO: 6949 - DNA, 1317 bp, Streptomyces avermitilis
  CDS (1)..(1317)
gtggcaacacaatatgggatcagtggtacgacggccaaggggattgcctcgtccgtcgaacgaggcgtgagtgaaggcgcgttgggcccgggggcggcgctgcctccggtgcgtcggctcgccgatgagctcggggtgagcccggggaccgtggcgacggcctacaaggagctgcggcggcgcggcatcgtcgtcacgcgcgggcgtggcggaaccgtggtcgcggcggccccggcagtggcctcacgacggccgcccagagttccggacgggctgcgcgacctggcgggcggtcacccggatcccgcactgctcccccgtctggtgccgccctcgcacctgtcccccggtgcgcggtcccatcggtcgacgccccggctggcgcggctcgaggacgcggtgcgcgactggttgcggcccgacggcgtgcccacggagtacgtgaccttcgcacacggggcgctggatctgatcgggcggctgctctcggtggagctgcggccgggtgacgccgtcgcgatggaggatcccggctaccaccatctgctcgacctggtcacggcgctggggttgcgtacggtttcggtggccgtggacgacgaaggggtacgtccggacgccctgcggggtgcgttgcgggccggcgtacgggcggtcgtgtgcagtccgcgggcacagaacccgtacggcgggcgcttctccacggagcgccgggacgcgctggtcgaggtgctccgggaggagcccgaggtgttggtcgtggagaacgaccatgcgtccgccgtcgcggatgcgcccctacacacgctgaccgcgggcggactgacccgctgggtgcatgtgcggacggtgagcaagttcctcgggacggacctgcgctgggctgccgcggcctgtgatccgaccacgctggcacggcacgacggacggctgctgctcacgtcggggtgggtcagccatctccttcaggagaccgtgtacgggctgctgacggacgacggcacgcgcgcgttggtgacacgggcgcgggagacgtacgcgctgcggcgcggtgctctcctccaagagctcgaaaagcacggactcgagggtcacgcgacgagtgggatgaacgtgtgggtgcccgtgcgggacgagtcggccgtggtgaacgggctgcggtcgtacgggtggtgggtcgcggcgggggcccggttccggctcgtcgccgggcccggtgtgcggatctcggtcgccgagctcgaacctgtcgacgcggcgcggctggcctcggacttcgcggtcgtgctgggtgagtccgaggccacctacggaggt

SEQ ID NO: 6950 - DNA, 1272 bp, Streptomyces avermitilis
  CDS (1)..(1272)
gtgaatccgaagcgccgcgcagccgcctggtcgacccgtattccaggaggtcgcgacgggcgcagaatgctctggatcgccctcgtcgaccggatcggcagcggcctgtgggcatccgtctccgtcctgtacttcacctacgtcaccggcctctccgctgcccaggtcggcaccctggccgccgtctccggagccatcggcatcgccggcgcccccctcggcggccgcatcgccgaccgcctgcccctcacccgcgtcctgatcgccctgcaactcctgcgcgccctggcctccttcgccctcctcaccaccggcaactacgccctgctgctggccttctctgccgtcggcagcctcggcgaccgggccgcgaacgtgctgaccaagctctacgcgacgcgggtctccggccccgaccgggtccgctaccaggccgtcaaccggaccgtcgccaacgccggctgggccgtcggcggactcgccgccgccgcggccctcggcctcggcacctccaccgcctaccaggcgctgctggccggcgacgccctctccttcctcggcgccgcgctcctcaccgtccgctgcggcgaaccaccctcgccgacccgcaccgtggtcacatcgaaggacccgctccccacgacgaagccggcgaaaccctggcgcgaccgcacctacctcgcatacgtcgccaccgagaccgccctctgcctccacgacgcggtgttcaaagtcggcctgcccctgtggatcgtccacggaagcaacgcaccccacggcctcgcgccgctgctcctggtcctcaacaacgtgctcgtggtggccctccaggtacccctggcccgattcggcgccaccacgaccgcggcacgcgccctgttgctgcccctcgctgccttcttcgcgctgggcggcgtggccatggccctttcgtccgccggcggcacccctatcgcgaccggttgcctcaccgccgcagccgtctccttcacgatggccgagatgctctacgccaccgtctcctgggaactctccgtcgcactggcaccggccaccgcgcagggcgcctacctcggcgtccacggcctcgcccagtccgtccagcgcagcgtcgggccactcgccgtcacagcggccatcgcgaccggaccggccggctggaccgtcttcggcgccaccatcgccgtgacctgcctgatccagcaccggctggtgcgcgaccgcctggccggaccgtcgttgtcagtgccgccagttactgtgagtgagcat

SEQ ID NO: 6951 - DNA, 891 bp, Streptomyces avermitilis
  CDS (1)..(891)
atggcgcacaccgagcaccagaccatgcgacgcgtactgcgccgcgaaatcgccggcaccatcggcttgttgaccgacgaacacgacttcactgcgatgctgcgctaccgcaccttcgccttcgacgaccacgcgacctacctccagcaggtggaagccctgctgaggaccctcgccgcccagggcggccacaccacggtggccctcttcgaccccgaggagtacgcggagttctgcgccgagacaggcctggaaccggacgcgccgtccagccgcacccgcttcaccgcggaactcgccgcgaccggcccgaccgtcccgtacgagggccaaccgctggccgacctggtcccgaacctcatcgacgaagcggtccgacgagccacctggcagtacgcgacgaccgtcctcacccgcatcggctcctgcgcctcctgcggcgaggacatcggccgggccgccttcgcccgcgcgtcccacctcctcgcccgcgtcctcgacaccgcggacccgggccaccgccacctcgtgtgcagtgtctccaccacccctgaaggagtcatcgcggtgctccacgccgatgacgacgcggacggcacagcccgcctcgacgagaccgaggccctcgagttcacgacggtcctcgccctcggcatcgcgacccggagcgcgggcggcctcgtcatgcgcaccagcgcccccggcaggaccgaccgtgtctacggctggcgcctgcgcggcgaaggcctgcaccccctcaccgcgggggaggtcttcgacgcctactgcaccgacatcgcatccggagagatcgtctcgccggaatccggcgtcgactacagcgaaccgcccgacctcggcgacgcggaacaccccacaggccacacccac

SEQ ID NO: 6952 - DNA, 1668 bp, Streptomyces avermitilis
  CDS (1)..(1668)
atggagacaacgctgcgaggcgtcggcgtgagccacggtgtggcgatcggcgaggttcggcacatggggacggcggtgctggaaccgcctgccaagcagattccggcggaggacgcggagcgcgaacaggggcgcgcccacaaggccgtggacgctgtggcggccgacctgattgcgcgcggcaacctggcggggggcgaagcacaggcggtgctcgaggctcaggcactgatggcccaggaccccgagttgatggcggacgtggagcgtcgcatcgccgtcggcagcaccgcggagcgcgcggtgtacgacgccttcgcctcgtaccgtgccctgctggccggcgcgggtgagtacctggccgggcgtgtggccgacctcgacgacgtgcggaaccgtatcgtcgcccggctgttgggggtgcccatgccgggtgtcccggacagcgacgagccctacgtcctcatcgcgcgtgacctcgcgcccgccgacaccgctctgctggacccgaccctggttctcggtttcgtgaccgaggagggcgggccgaccagccacagcgcgattctggcgcgggcgttgggtgtgcccgccgtggttgcgctgccgggtgcgggtgagatcggcgaaggcatagtgatcgccgtggacggcagcaccggtgagatcttcgtgaatccgagtccggagaagaaggaacagctggaggccgcggccgccgagcgcaaggccgcgctgtccgcgtccaccgggccgggcgccacctccgacgggcacaaggtgccgctgctggccaatgtcggcggtcccgctgacgtgcctgccgccgtcgaggcgggggccgagggtgtcggtctgttccgtaccgagttcctcttcctcgatgacagcaagaacgcgccgagcgaggagaagcaggtcgaggcgtaccgccaggttctcgaggcgttccccgagggccgtgtcgtcgtgcgagtgctcgacgcgggcgcggacaagccgctggagttcctgactccggcggacgagccgaacccggcgctgggcgtgcgcggtctgcggattctgctcgaacaccccgacgtgctgcgcacgcagctgaccgcactggccaaggcggcggagggactgcccgtctacctcgaggtcatggctccgatggtggcggaccgtaccgacgccaaggcgttcgcggacgcgtgccgggaggccgggctgcaggcgaagttcggcgcgatggtggagattccgtcggccgcgctgcgggcgcgctcgatcctccaggaggtcgagttcctttcgctggggaccaacgacctcgcccagtacaccttcgccgccgaccggcaggtgggtgccgtgtcgcggctgcaggacccgtggcagcccgctctgctcgacctggtcgcgctgtccgccgaggcggcgaaggccgagggcaagagctgtggcgtctgtggcgaggccgcgtcggacccgctgctcgcgtgtgtgctgaccggtctgggtgtcacctccctgtcgatgggtgcggcgtcgattccttatgtacgggcgacgctggcgaagtacacgctggcccagtgcgagcgggccgcggccgccgcacgtgccgcggacacggccgaagaggcgcgcaacgcggctcaggcggtgctgtccggcgaa

SEQ ID NO: 6953 - DNA, 447 bp, Streptomyces avermitilis
  CDS (1)..(447)
atgaccaccgtgacgtcccctcttgcaggacgcgccatcggactcgccgcagtgccggaccccgtcttctccggggcgatggtcggccccggcacggcgatcgaccccgtgcgcgagccctcggaggctgtcgcccctgtggacggagtcatcgtctcgcttcatccgcacgccttcgtggtcgtcgacggtgagggacacggggtgctgacgcacctcggcatcgacaccgtccagctcaacggcgagggcttcgagctgctcgtcaacaagggtgacaccgtgacgcgcgggcaggccgtggtccgttggaacccggccgccgtcgaggaagccggcaagtccccggtgtgcccggtcgtggcactcgaggccacggtcgattcgctgggcgatgtccgtgacgagggcgacgtgaaggccggcgacccgctcttctcctggcag

SEQ ID NO: 6954 - DNA, 606 bp, Streptomyces avermitilis
  CDS (1)..(606)
gtggaggtccaggagacccgcgtccagacagaccgggtcctcaccatcccgaacatcctcagcatggcgcggctcgtcggcgtacccgtcttcctgtggctgatcctccggcccgagttcggcggcccgaagagcgatggctgggcgcttctggtcctggcgctgagcggcatcagtgactacctggacggcaagctcgcccggcgctggaaccagatcagcagcctcggccggctcctcgaccccgcggctgaccggctctacattctctcgactttggtgggtctcacctggcgcgagattctgccaatctggttgaccgccgcactgctggcgcgagagctggttctgctggtgatggtgggtatcctcaggcgccacggctatccgccaccccaggtgaacttcctcgggaaggccgccaccttcaacctgatgtacgccttccccttgctgcttctgagtgactcaagtggatggatcgggtcactcgctgctattttcggatgggcgttcgccggatggggtacaacgctgtattggtgggcaggagtcctctacatggttcaggtccgccgacttgtcagggcggacgccgtagccgat

SEQ ID NO: 6955 - DNA, 2493 bp, Streptomyces avermitilis
  CDS (1)..(2493)
atgaaggccgtcgtgatggccggaggcgaaggcacacgccttcgcccgatgacctcgagtatgcccaagccgctcctgccggtggtaaaccggccgatcatggagcatgtcctgcggctactcaaaaggcatgggctcaacgagaccgtcgtaactgtgcagttcttggcgtctctcgtcaagaactacttcggtgacggcgaagagctcggcatggagctcacttatgccaatgaggagaagccactcggtaccgccgggagcgtcaagaacgccgaggaagcgctgaaggacgacactttcctcgtcatctccggtgatgccctgaccgacttcgatctcaccgagctgatcaatttccacaaggaaaagggtgcgctggtcaccgtctgtctgacgcgcgtgcccaatcctctggaattcggcatcaccatcgtcgacgaagaaggcaaggtcgagcgcttcctcgagaagcccacctggggacaggtcttctcggacaccgtgaacacgggcatctatgtcatggagcccgaagtcttcaactacgtcgaggccgacgtctccgtcgactggtccggcgatgtcttcccgcagctgatgaaggacggcaagccggtctacggctatgtcgccgagggctactgggaggacgtgggcacccacgagagctatgtgaaggcccaagccgacgtcctggagggcaaggtcgacgtcgagatcgacggcttcgagatctccccgggcgtatgggtcgcggagggtgccgaagtgcaccccgacgccgtgctgcgcgggccgctctacatcggtgactacgccaaggtcgaggctgacgtcgaaatccgcgagcacaccgtcgtcgggtcgaatgtcgtcgtgaagagcggggcctttctgcacagggccgtggtccacgacaacgtgtacatcgggcagcacagcaatctgcgtggttgcgtcatcggcaagaacaccgacatcatgcgggccgcccggatcgaggacggcgccgtcatcggcgacgagtgtctcgtcggtgaagaatcgatcatccaggggaatgtgcgggtctacccgttcaagaccatcgaggccggcgcgttcgtcaacacctcggtgatctgggagtcgcgggggcaggcgcatctgttcggcgcccgtggcgtgaccgggatcctgaacgtggagatcacgccggaactcgtcgtgcggctcgcgggagcgtatgcgaccacgctcaagaagggctcgaccgtcaccacggcccgtgaccactcccgaggcgcgcgtgcgctgaagcgggcggtcatctcggcgctgcagaccagcgccatcgacgtacgcgacctggagaacgtaccgctgcccgtcgcgcgacagcagaccgcgagaggcagcgccggcgggatcatgatccgtacgacgcccggggtgccggactccgtggacatcatgttcttcgacgggcagggtgccgacctctcgcagggcagtcagcggaagctggaccgagtgttcgcgcggcaggagtaccggcgagccttcccgggagagatcggggacctgcacttcccggcgagcgtcttcgactcgtacaccgggtcgctgctgcggaacgtcgacacgaccggtatctccgagtcggggctcaaggtcgtcgtggacgcgtcgaacggcagtgcggggcttgtgctgcccagtctgctcggcaagctgggtgtcgacgcgctcaccatcaaccccggcctcgacgagtcccggcccacggagacggccgatgcgcggcgctccgggctggtgcggctcggtgagatcgtcgcatccgcgagggccgcgttcggcgtgcgcttcgaccccgtcggtgagcgactgtcgctcgtcgacgagaaggggcggatcgtcgaggacgaccgggcactgctcgtcatgctcgacctggtggccgcggagcgacgcagcggccgcgtggcgctgccggtgacgacgaccaggatcgctgagcaggtggcggcttatcacgggacgcaggtcgagtggacgaccacgtcgcccgatgatctgacgcgggtgggaggcgacgaatcgaccatcttcggtggtgacgggcgcggcgggttcatcatccccgagttcagcagtgtcttcgacggtacggcggccttcgtgcggctgatcggtctggtggcgcggacacagctcacgctcagccagatcgatgcgcggatcccgcgggcccacgtgctgaagcgtgacctggcgactccttgggccgtcaaggggctggtgatgcggcgggtcgtcgaggcggccggcgatcgctttgtcgacacgacggacggcgtgcgggtcgtcgagtccgacgggcgttgggtgatggtgctgcccgatcccgccgaggcggtcacacatctgtgggccgaggggcccgacgacgcctccgcggaggccctgctcgacgaatgggcggcggtcgtggacagcgccggccgc

SEQ ID NO: 6956 - DNA, 903 bp, Streptomyces avermitilis
  CDS (1)..(903)
atgtgcggcatgccgcagccgccccccgttcggagcacccctacgcgccccccgcgcccggacgcctccatgtcgctgctcaccaacgtcatggatcacagcctcgacgacggatatgccgaggccgccgcccggaagaaggccgagggcaccggcggcatgccgaagaccgtgcgggccaagctaggtctcgcggccggactggtcctggcggcgctggtggtgaccgtgggtgcggcgcaggcgcggatagcggccccgacgatcgccaaggagcgtcaggagctcgtcgaccgcatcgggcgtgagaccacggtcgcggacaagctcgagagcagcgtcgacactttgcgggacgacgtgagcgcgcggcagcgcgaggcactgaagaagtacggcggcggcgaccaggccgacgtagtgggcatcctgtcgggtgccgtcgcagtccacggccccggggtgaagctcgtcgtggacgacgccaaggaagccagcaccggcggcaacggtgatccgcgagagacctccgggttctccgacaccggacgcgtccgggaccgcgacatgcagcgtgtggtgaacggactgtgggagtccggcgccgaagccgttgcgatcaacgggcagcggttgacggccctgtcggccatccgggccgcgggtgacgcgatactggtcgacaacaagccgctcgtaccgccgtacacggtgctcgcggtgggggacggcaagcacctcagcaccgggttccagaacagccccgacgggctgtatctgcacgcgttgcaggagaactacggcatccggaccggcatctccgtccagggtgacgtccggctgcccgccgcaccgagtgtgatcgtacgtacagcacagccgagcacagagaagggcacatcg

SEQ ID NO: 6957 - DNA, 330 bp, Streptomyces avermitilis
  CDS (1)..(330)
gtgatcgccgtactgggcctcgtcgtgggagtcgtggctggattgttggtccggcccgaggttccggcggtcgtggagccttaccttcccattgccgtcgtggccgcactcgatgccgtgttcggcggtctgcgtgccatgctcgacggcatcttcgacgacaaggtcttcgtggtgtcgttcctgtcgaacgtcgtcgtcgccgcgctgatcgtcttcctgggcgacaagctgggtgtcggcgcccagctgtccaccggtgtcgtggtcgtcctcggcatccgcatcttctccaacgccgcggcgatccgtcggcacgtcttcagggcg

SEQ ID NO: 6958 - DNA, 873 bp, Streptomyces avermitilis
  CDS (1)..(873)
gtgagacagatgagccatgaggacgagacgcccaagggaccggacacgccggaggccgccgagcaccggctgcgcagagagctgccggaagaggtgcccgagacggccgcggagaccgcgaacgaggacgccaccaagggctccgggcctgggttgaccggccgtcagcgcctggtgcagggactgtggccgccgcgcgtcagccgtgcgcaactcattgtcgcgctgctgctgttcggcctcggcttcggtctggccgtgcaggtggcgtccaacagtgacagcggcaacgccttgcgcggggcgcgccaggaggatctcgtacgcatcctcgatgaactcgacaaccgcacacagcgtcttgcggacgagaagcaaggtctcgaggaccagcggtccgagctggagaacagctcgaaccaggccgaggaggcccgtaagcagacggtcgagaaggagaagcaactcggcattctggcgggcacggtcgcggcacagggacctggcatcacgatgaccatcgacgacccgaaggggacggtccgggcggacatgctgctcgacgcggtccaggagttgcgcgcggccggcgcggaggcgatccaggtgaacggtgtgagggtcgtcgccaacacctatctgacggactccggcaagagtgtgagtgtcgacgggaacaagatcagccagccgtatcgtttcaaggtcatcggcaagtcgcaggacctcgagccggcgctcaacatcccgggtggcgtggtgcagactcttgagaaggagcaggccaccgtcgcggtggagcgttcgacgaagatcattgtggacgccttgcgagcggcgaagcggcctgactacgctcggtcgtcctccgag

SEQ ID NO: 6959 - DNA, 972 bp, Streptomyces avermitilis
  CDS (1)..(972)
atgggtggtgcgtggtggaaactgtctggtggatacggacgttgtgaggatgtccgggtcgaccggtgtgttcaatcagggttcgtcctgccccacgggcgggtctgtttcggtcaaggggaatcgcccgtgaagttgtttgcgaagttgttcggcaagagctctcgagagggcagcgacaacgccactgcccgccatcgcgcgccgcgctccggggatgcggaggcacagggcggcgagcgcccgctgttccgcgatcaggtcggtggacccggtggcgacatttccggtggtcagggcgcgtcgtctgttgaccctgcccagtccggccgcataggtttcggggatccgtcaacctcaggtgcgggtggagggttcggctccgacccgtatgcgtccaatgccccggcggggcagccgcggcaggaggatccgtcgatgtcggccctggtgtgtacgaggtgcggtaaccgcaacgcggaaaacagccgtttctgctccaactgcggtgctccgctgcggggcggggcggctccggagcggccgtccgagacgacctccacgatctccatctcgggtctcgaggcctacgatgccgaggtcaccggccagacggcgatgcccacgctgtcccccgaggcgcaggcggccgtcgacgcgttgccgctcggctcggcgctcctggtggtgcgccgcggccccaactcgggcagccgcttcctgctggacggtgagctgaccacggcggggcgccacccgcagagcgacatcttcttggacgacgtgaccgtgtcacgccgccatgtcgagttccgtcgcggtgcggacggcacgttcacggtggccgacgtcggcagcctgaacggcacctatgtcaaccgggagcgcatcgaccaggtcgctctctccaacggtgacgaggtgcagatcggcaagtaccggctggtcttctacgcgagccagcggggcatc

SEQ ID NO: 6960 - DNA, 753 bp, Streptomyces avermitilis
  CDS (1)..(753)
atgcttcacacaccgagcggcggtgccggcagtggcaccgccgccacggacggcgagctgatgagcatcggcacggtgctcaacgctctgcgtgacgagttccccgacatcacgatctccaagatcagatttctggagtcggagggcctcatcgagccgcagcggaccccctcggggtatcgcaagttcagcgccggcgacatcgagcgtctcggtcacgtgctccggatgcagcgggaccactatctgcccctgaaggtcatccgagagcatctggacgccctggagcgcggtgaggaagtgcggctgccctccatggggcgccaacgcgacccgggcgagggagaaagcctggtcgacctcttcggggagcccgaggcgcccacggcggcccgggtggggcgcgccgagctgctggccgccgccgagatcggggagcaggagctcgaggagtgggagtcgtacgggctcatcgcaccgctgccggacggggcgtacgacgcggagacggtcactgtcgccaccctcgtggtcgagctggggcgcttcgggatcgagccgaggcatctgcgtgtgatgaaggccgccgcggaccgtgaggcggggctggtggaccaggtggtggctccgctgaggcggcaccgcaatccgcagaccagggcccacgcggaggctcgtacgaaggaactggcggggctcgcggtgaagctgcacgccgcgctggtgcagaccgcgctgggcgtacgcctgccc

SEQ ID NO: 6961 - DNA, 471 bp, Streptomyces avermitilis
  CDS (1)..(471)
gtgaacgagctcgatgtcgtaggtgtccgggtggaaatgccctccaaccaaccgatcgtgctcctgcgtgaagtgggaggcgaccgttacctccctatctggatcgggcccggggaggcgacggcgatcgccttcgcccagcagggcatggcccccgcacgaccgctgacccacgacctgttcaaggacgtgctggaggccgtcggccaggagctcacggaagtgcgcatcacggatctgcgtgaaggcgtcttctacgcggagctggtgttcgccagcggcgtcgaggtgagcgcgcggccgtccgacgccatagcgctggcactgcgtaccggaacgccgatctatggcagcgacggggtcctcgacgacgcaggtatcgcgatccccgacgagcaggaggacgaggtcgagaagttccgcgagttcctcgaccagatctcgcccgaggacttcggtacgaacagccag

SEQ ID NO: 6962 - DNA, 633 bp, Streptomyces avermitilis
  CDS (1)..(633)
gtgagaagcagcggcgacggtacggctgggggtgcccccggacgcagtctgggggagagcggcccgtacccgcttcacggcagcgcggccggccccgctcatcagcggccgacggcagtagcgggcgacgaagaggcggcttccgaggaagtcggctatcgcggtcccacggcatgcgctgccgcgggcatcacctaccggcagcttgactactgggccaggaccggcctcgtcgagccgagcgtgcggcccgcctacgggtcggggacgcagcgcctctacagcttccgggacgtggtcgtcctgaagatcgtcaagcggttcctcgacaccggagtgtcgctgcagaacatccgcaccaccgtccagcacctcagggagcgcggcttccgggacctggaacggatgacgttgatgagcgacggagcgacggtctacgagtgcacgtcccccgacgaggtccatgccctgctccagggcggccagggcatcttcggcatcgccgtgggcgtggtctggcgggacgtggagagcgcgctttcgcaactgcacggggagcgggtcgacacgggggagaccctggtaggccacaaccccaccgacgaactggcgcgacggcgcaaccgggcggtc

SEQ ID NO: 6963 - DNA, 1707 bp, Streptomyces avermitilis
  CDS (1)..(1707)
gtgagaaacgcgcccacgatcctgcatctcgacatggatgccttctacgcctcggcggagcaggcagccaagccgagcctgcgcgggaaggccgtcgtcgtgggtgggctcggaccacgcggggtggtggccacggcctcgtacgaggcacgggttttcggggtgcactcggcgatgcccatggcccaggcgcgacggctggcgccgaacgccgcgtatctcgtgccgcgcttcggtctgtaccgggaggtcagtgagcaggtgatggggctgctgcggggcctgtcgccgctggtggagccgctgagcctggacgaggcgttcgtggatctggaggccggaggagtggcctgggacgcggagtcggcgcggctggtcggggtgaagctgcgcgcggacatcaggaccgtcaccgggctgacggggtcggtggggctcgccgcctccaagatgctcgcgaagatcgcctccgaggaggcgaagcccgatgggctggtgctgatagagccgggcacggagcgggccatgctcgggccgatgtccgtgcggacgctgcccggcgtggggcccgccacgggggaccatctgcgccgggccgggatcaccacggtcgaggagctcgccgaggcgggcgaggacgagctcgtacggctgctgggcaaggctcacgggcatgcgctgtacgccatggcgctggcgcgcgacgagcggccggtggtggccgagcgggaggccaagtcggtgtcggtcgaggacacctacgacgtggacatccatgacaggacccgggtcgggatggaggtgcagcggctcgcggatcggtgtgtgcagcggctgcgcggtgcggggctgtccgggcggaccatcgtcctcaaagtgcggcggtacgacttctccacgctgacccgctccgagacgctcagggggcccacggacgaccccgcggtggtacgggaggcggcggcccggctgctggactccgtggacaccacgggcggcgtacggctgctcggggtgggtgtcagcgggctcgccgactacacacaggaggatctgttcgcgcaggcgcatgtgggggcggccgagtcggtggcgcaggagcagccggagacggtgggggccgtggtgtcggacgagccggcaggggaggaaccggctgtggccgagcggcactggcgtgccgggcacgacgtacggcatgccgagtacgggcacgggtgggtgcagggcagcggcctcggccgggtgacggtgcggttcgagacgcccgactcggagcctggacgggtacgcacgttccggaccgacgatccgaatctggaaccggtggatccgctgccgttggtggcgcgaagaccggaggccgccggggccggggcctccggggcggaggaaaccgggcccgaggtcggtgtggccggctcttcgggtggggcgggcgagtgttcggccgggagggaggggtctgagggtgggacggaggagtcttcggcggtgagggacggtgcttcgagtgggacgggcggccctgcggcccgggcggccggttccgtggcggtgccggcaggttctggggtaggcggggccggcgtggccgacggggtcgactccgagggcgcggggccggggggtcaggcttcgtccgttcccgccaggcggccgaagtcgtggtccggcagcggggggaggggggccacgtcgaggccg

SEQ ID NO: 6964 - DNA, 420 bp, Streptomyces avermitilis
  CDS (1)..(420)
atgtgctctttcgtagtgcttacggatgagttgcgaccaagaggagggcccgtgcagaccgacatcgatccgcgcaacctgatcggccgcaaggcgttcgactgccatggcgcgaagatcggcacgatcgacgagatctacctcgacgacgcgaccggagtggcggagtgggcggccatacgcacgggcctgttcagcagggacgccttcgtgcccttggagcccagcgagctggtcgagggcaccctccggatccccttcgaccgcgccctgatcaaggacgcccccgacttcggcgtggggcgacacctttccccggaacaggaattgcagctctaccaccactacggcctcgacgtggcccccctccccccgctgccggaccacgacttcggccgcctggcgggaacggacgaagcc

SEQ ID NO: 6965 - DNA, 2961 bp, Streptomyces avermitilis
  CDS (1)..(2961)
atgacagagggggaggccgtcggggtacccgcgcaggggtgcccctcgaaggtcgcgtcagaccaggaggcctccgcaatgaccgcccatcgcattccgctctccgatctcgaacagggaatccccttcgagcagcgccacatcggccccgattccgaagcccgggccaagatgctcgcccaggtcggctacgggtcgctcgacgagctgaccgcgaccgccgtcccggacgtcatcaagaacgccgaggcgctggagctgccgggcgcgcgcaccgaggccgaggtgcttgccgaactgcgctccctcgccgaccgcaaccaggtcctcggttccatgatcggcctcggctactacggcaccttcacaccgccggtgatcctccggaacgtgatggagaacccggcctggtacaccgcgtacacgccgtaccagccggagatctcgcagggccggctggaggcgctgctgaacttccagaccgtcgtcgccgagctgaccgggctgccgacctccggcgcctcgctgctcgacgagggcaccgcggccgcggaggccatggcgctgtcccggcggatgggcaagaacaagaagggcctgttcctggtcgacgcggacgcgctgccgcagaccatcgccgtcatcgagacccgtgccgagccgaccggcgtcgaggtcgtcgtcgccgacctgagcgaaggcatccccgccgggatcgccgagcgcgagatcaacggcgtgctgatccagtacccgggcgcctccggtgccgtacgcgacatcaagccgctcgtcgagcaggcgcacgagctgggcgcggtcgtcaccgtcgccgccgatctgctcgcgctcacgctgctcacctcgccgggtgagctgggtgccgacatcgcggtcggtacgacgcagcggttcggtgtgccgatgggcttcggcgggccgcacgccggttacatggccgtgcgtgagaagttcgcgcgcagcctgcccggccggctcgtgggcgtgtccgtggacgccgacgggcacaaggcgtaccggctcgccctgcagacgcgggagcagcacatccgccgcgagaaggcgaccagcaacatctgtacggcccaggtgctgctcgccgtgatggccggcatgtacgccgtgtaccacgggcccgacggactgaggacgatcgcgcggcgtacgcaccggtacgccacgatcctcgccgaagggctgaaggccggcggcgtcgaggtcgtgcacggcgcgtacttcgacacgctgaccgcgcgggtgccgggccgggccgccgagatcgtcgccgccgcgcgtgagggcggggtcaacctgcacctcgtcgacgcggacctcgtgtcgatctcctgtgacgagaccaccacgcgggcccaactgggcgccgtctggaccgcgttcggcgtcgagggcgacatcgaggcgttggacgcggcggccgaggacacactgccggccgcgctcctgcgtaccgacgactacctgacccacccggtcttccaccagtaccgttccgagaccgcgatgctgcgctacctgcgcaggctctccgaccgcgactacgcgctcgaccgcggcatgatcccgctgggctcctgcaccatgaagctcaacgcgaccaccgagatggagccggtcacctggcccgagttcgggcagctgcaccccttcgcgcccgccgagcaggcgcagggctacctcacgctcatccgggaactggaggagcggctcgccgaggtcaccggctacgacaaggtgtcgctccagccgaacgccggctcccagggcgagctggccgggctgctcgccgtacgtgggtaccaccgcgccaatggcgacgagcagcgcacggtctgcctgatcccgtcctccgcgcacggcacgaacgcggcgagcgccgtgatggccggcatgaaggtcgtcgtggtgaagacggccgacgacggtgagatcgacgtcgaggacctgcgcgccaagatcgagcagtaccgcgacgagctgtcggtgctgatgatcacgtacccctcgacgcacggtgtgttcgaggagcacgtcgccgacatctgcgcccaggtgcacgaggcgggcggccaggtgtacgtcgacggagccaacctcaacgcgctggtcgggctcgccaagccgggccacttcggcggtgacgtctcgcacctcaacctgcacaagacgttctgcatcccgcacggcgggggcggtccgggcgtcgggccggtcggtgtgcgcgcccacctggcgccgtatctgccgaaccacccgctccagcccgaggccggccccgcgacgggcgtcggcccgatctcggccgcgccctggggctccgcgggcatcctgcccatctcctggtcgtacgtccggctgatgggcggcgagggcctcaagcgcgccacgcaggtggcggtgctgtccgccaactacatcgccaagcggctggagccgcactacccggtgctctacaccggtcctggcgggctcgtcgcgcacgagtgcatcatcgatctgcgtccgctgaccaaggcgaccggcgtgagtgtcgacgacatcgccaagcggctgatcgactacggcttccacgcgccgacgatgtcgttcccggtggcggggacgctgatgatcgagccgaccgagtccgaggacctgggcgagctcgaccggttctgcgaggccatgatcgccattcgtgcggaggtcgagaaggtcggctcgggcgagtggccggcggaggacaacccgctgcggaacgcgccgcacaccgcggccgcgctcggcggagagtgggagcacgcctacagccgtgaggaggccgtcttcccggcgggtgtctcggccgcggacaagtactggccgccggtgcgccgtatcgaccaggccttcggcgaccgcaacctggtctgctcctgcccgccgctggacgcttacgacgac

SEQ ID NO: 6966 - DNA, 204 bp, Streptomyces avermitilis
  CDS (1)..(204)
atgtgccagcaccagccactctgtccgacagccgcatccgccgaccgggagtccgcccgtctcatggcgcaccacccggagcagggatggagcctgctctgcaacggcgttctgctcttcgaggacaccggtgagctgctgccggacggccggatcatcgccccgcaccgcccactgggcaccgaccaggtgatgacggccgcc

SEQ ID NO: 6967 - DNA, 582 bp, Streptomyces avermitilis
  CDS (1)..(582)
atgccgctgcatgtccccccggctcccgcgcccgccctgcgcaccgttctcacggcactcggttcccccaccgcggtccgcgaggctcgtaccccgtccctgcgcaacgcccagggacccgtcactcccgaactcccgctacccgtacacgtcctggaccggatcacccccgcgggcgcctctgccacccggctcgccggatggcgcttcctcatccgctgcggcgatcgcgcggtggccgccgccgagacgatgctgacccccgacggctgggctttctcccacttcttcgaaggcccgtacatcaccgccacggagcgcgccctgcgccaggcggagaccatgaaacagccctaccaggcccggctgctgtccgtgcccgagctatacatgctcaccctctggctgcacggcgactccacggccgacggcgcgacgggccacccggccgccaccgacctgctcgtcccgctggctccggcgccgcccggcatcgcggcacaccgcccgcaccgggtcgcggaactgcttccggtcctgaccacccgggtgactcccgcacccctgctcggctcacccgcc

SEQ ID NO: 6968 - DNA, 1683 bp, Streptomyces avermitilis
  CDS (1)..(1683)
gtgctgctccatgcccggcgaatgtgccgcatggcagttgcattcagcgtagcgggcgccgggtcgacgcggggcgttatggatcgcgttgcctgggcatcatcacccgtgacccggggacaccagcggccggatcgtcggcctgcccatccgaggagggacacgtcgatgggggagaaggtcgtggcggggtcgttcgacctgtccgatcgccagcgctaccgcggcaagctccggcagtgcctggcggggctggcgcgactgttggaggagaagcggttcgatcgccccaagaacctcatgggtctggagatcgagctgaatctcgcaggtgcggacggcctgccaaaaatgatgaatgagcaagtactcgaaaggattgcgagccgcgatttccaaacagaactcgccatgttcaatctggaagtcaacattgccccacatcgattgggcggccgggtattcgaccggctcgccgaggagctgcgcacctcactcgcctacgcgcaccgcaaggcgaacgaggtcgacgccggaatcgtgatgatcggcatcctgccgacgctcggccgcgacgacctgatctcctcgaatctctccggcggcgaccgctacaccctgctcaacgagcagatcgtggccgcgcgcggcgaggacttcgtgctggacatcgacggcatcgaccggctcgtgtgcacctcgaagtcgatcgtgcccgaagcggcctgtacgtccgtgcagttgcatctccaggtcacgccgggccgcttcgccgacgtgtggaacgcggcgcaggcggtggccgccgcgcaggtcgccatcggcgccaactcgccgttcctgttcggtcatgagctgtggcgtgagtcgcggcccccgctgttccagcagtccaccgacaccaggccgccggagctgcaggcccagggcgtgcggccgcgcacgtggttcggcgaacggtggatctcctccgcgtacgacctgttcgaggagaacctgcgctacttcccggcgctgctgccgatctgcgacgacgaggatccgctgcgggtcctcgacgacggaggcataccgaagctcgccgaactcgtcctgcacaacggcaccgtgtaccgctggaaccggcccgtctacggcatcgccgacggcgtcccgcatctgcgcgtcgagaaccgtgtgctgccggccgggcccaccgtcagtgacgtgatcgccaacgcggccttctactacggtgtcgtacgcgcgctcgccgaggaaccgcggcccgtgtggacgcggctgccgttcgagtcggcggccgccaacttcgacgccgcgtgccgggacggcatcgacgcccgcctggagtggccgcggcgcgggcggtacggcgggaccacgcaggtcgatgccgtgcacctcgtacgcgacgaactgctgccgctcgccgaggcgggcctcgacgcgtggggtgtcgaacccgcggaccgggacttctacctcggcatcatcgaggagcggtgcaggcgccgggtcaacggtgcgagctggcaggccgccaccttccaccgggcgctggaggcggggctggaccgggacgccgcgctggccgcgacgacgcggcggtacagcgagctgatgcacgtcggggagccggtgcacacctggccggtggggctgccggagccggtgccgctgggg

SEQ ID NO: 6969 - DNA, 1869 bp, Streptomyces avermitilis
  CDS (1)..(1869)
gtgcgcgacaggccgctgggggacggacgccgtacgggcgtacctccccctcgcgttctgccatacgtccgcctcacggctcacggctcaacagggagggccaccgtcatgggacgtcacagcttgcccgacggctacggggcgggcggcgtcgacccccgtacgcgggcgcgtcgccgcaccgtggccatcgcgacggctctcgtactcaccgtcgcggccggcaccgcggcggcggtccgcggcggactgctgtccttcggctcctcctgccaggaccacgccgtacgcctcaagatcgccgcctccccggacgtggcccccgccctccgtgcggcggccgacgaggcccgtaggaagaacatcacctccgacggccactgcctggacatacacgtgaccgcacgcgatgcctaccaggtcaccgaatcgctgctgtcgggccggaagtccgacatccaggcgtgggtaccggacgcggacctgtgggtgcggcgcgtcaccgccgatgccagggcgacccaggtcacccaggccggcaacatcgcctcgtcccccgtcgggatggccgtggttccgacggcggcgaagtccctggggtggccggacaagacgtacacctggaccgaactggccggcgcgaccctgcgggaggaccggccgaaactcggcacggccgacccctcgcgcagcgcgaccgggctgctcgccctcacccggctgaccggcgccaccgccaaggtgaaggaaggcgacacccggacggcggccatggcgaaggcgctctcccagcgcacagccgacagcgacagccaggtcctggagacgctgccgcgcgactcctcgggcaccgagcagggcgacccgaagcgcaaccaggcgctgatcctctccgagcaggcggcgttcacgcacaacacctcggccgacagcgacctgaagctcgacctcttctaccccaaggacggatcaccgcggctcgactacccgttcacactcgtcgaccagccgcgactgtccaccgacgagagccgcgccgccctccggttcatgacgctgctggagcagccgaagggcaccaggatccttcagaagcacggcttccgcatcgacgacgaggacgtctccgccacggtcgtgacggcggcgggcggccgctccccgcagccgtacgaggagcccgcacccgaaccggcctccgagaagacgctccaggagtcgctcggcacgtggacgatcacggtgcagagcgcccggatcaccaccgtcgtggacatctcggcctcgatgtccgaggccgtgccgggcagcagccggtcgcgaatggacgtcaccaaggcgtcgctgctccagaccctcaccacgttcacgccggatgacgagatcgggctgtggaacttctccgcgaagctcgacggggacaaggactaccgcgtgctcgtaccgaccgggcggctcggagaccgcgggggccgcgacacgcagcgggacagactgtcggcggcgttcagcgcgctggagccggtgcggggcggtgccaccggtctgtacgacacgacgctcgccgcgtacaaggcggccaccgcctcatatgtgaaggggaagttcaacgcactggtcatcctgaccgacggcgtcaacgaggacccgggaagcatctcccgctccaccctgctcacccaactgcggaaactggccgacccgcgacacccggtgccgctgatcatgatcgccgtgggaccggaggcccaccggcaggaggccgagcggatcgccggggcgaccggcggctcgggccaccaggtcgacagccccgcccagatccactcggtgatcctcaaagcgatcatggaggccggcaaccagagc

SEQ ID NO: 6970 - DNA, 798 bp, Streptomyces avermitilis
  CDS (1)..(798)
tgcaggtggaggcggggtcgatggccgattcttttccgaaggagcggctgacacgacggattctccgggacgagacgctgctcgtcctggggctctcactcggtgcgagcggggtgtccgcgctgatcagctttgtcggctcggtcaccaaacccgggggtctcaaggaccaggcggccaccctcaatgcctcggccgcgcccggtcgtccctggctcgatctggcgtggcagctgttcggtatcgcgtccgcgctggtgccggtcgcgctcgtggcgcattttctgctgcgtgagggggaggggctgaggacgctcggcttcgaccgcacgcggccgtggccggacctcgggcgcggcgcggcgatcgcggcggtgatcggcagtacggggatcgccttctacctggcggcccgagggctgggcttcaacctcaccgtggtgcccgaggcgttgcccgacgtgtggtggaagtaccccgtactgatcctttcggcggtgcagaacgccgtcctggaggaggtcatcgtcgtcggctatctgctgcggcgcctgggccagttggggtggacgccgggcacggcgctggtggccagctccgtgctgcgtggctcgtaccacctctatcagggcatcggcgggttcatcggcaacatggtgatgggcgtggccttcgtctacctgtaccggcgctggggacgggtgggccccctggtggtggcccactcgctgctcgacatcggggcgttcgtggggtacgcgctgctggcggggaaggtgggctggctgcctacggcgt

SEQ ID NO: 6971 - DNA, 816 bp, Streptomyces avermitilis
  CDS (1)..(816)
atgcggattcgaatcgtcgacgccttcaccgaccgccccttcgccggcaacccggccggggtcctcctcctcgacgccttcccggacgacgcctggctccaggacgtggcccgcgaggtcaatcacgccgagacggcgttcgcccatcgcctgcccaggggcgagggcggcgaggcggactgggcgctgcgctggttcacgcccgccaccgaggtcgcgatgtgcggtcacgcgaccctggccaccgcgcacgtgctgcacacctcgggtacccacgagggcccggtacggttcgccacccgcagcggcgtcctcatcgcgacgccccgcgaggacggctcgatcacactggacttcccgaccgccccgctcaccccggtcgagatccccgagggcgtcgccgaggccctcggcgccgagccgctcacggcctgcgacaccggcccgaacgtcggcgacctgctgatcgaactggccgacgagaagacggtccggggcctcgcccccgacctcagggccctcgcccgctactccgagcgcggcatcatcgccaccgcccgggccgaagaccccgcccagggccacgacttcgtgtcccgctgcttcttcccgaacgtcggcatcgacgaggacccggtcaccggcagcgcccacacggccctcgcgcccttctggtcgcagcgcctcggccgccccgacctcaccggcctccaggcctcgccccgctccggccacgtccgtacggaactccgcgacgaccgcacgctgcttaccggccgcgcggtcaccgtcatcgacggcgagctgctcacgccg

SEQ ID NO: 6972 - DNA, 651 bp, Streptomyces avermitilis
  CDS (1)..(651)
gtgatggcgatgcgttcccgtggagaagacttcggatacgaacacggacatggacaccacggcggccccggccctcggggtcggggcggcttcgaggggcggcgcggggccttcgggcccttcgggccggggggtcccggtgggcccggcttcggcggaccgggcttcgggccgggcccctggggcgggcgcggccggggcggaccgcggggcagggcgcggcgcggcgacgtacgcgcgtcgatcctggccctgctcaaggaccgtcccatgcacggctacgagatgatccaggagatcgccgagcgcagcggcggggcatggaagcccagcccgggttcggtctaccccacccttcagctgctggaggacgaggggctgatcgccaacgagtccgagggcggcaagaagctgttctcgctcaccgagtcgggtcgcgcggcagccgccgagggtcccgaggcgccttgggaagaggcctcgcgcggggtcgactgggaggcgctgagcgagatccggcaggccggcttcggtctcatggaggcgttcggccaggtctggaagaccggcagcaaggagcagcgcgacaaggcgctgacggtcatcaacgaagcccgcaagaagctgtatctgatcctcgccgacgagggc

SEQ ID NO: 6973 - DNA, 504 bp, Streptomyces avermitilis
  CDS (1)..(504)
atgttgcaggcgctgcggctacgttccgcgacaccgtggctgcgccgggcgcagcacccgacacgaaggggtggtcgcatggccgaagtcagcgcggaagcgcgcatcgaggcgcccgccgagaaggtctgggcccagctcaccgactggtccgcgtacggcgagtggaacgcgacccacaccggtttcccgaagggcggccccgagaccctggaggtgggcgggaccttcgcggagaacatgaagctcatgggcttcccggccgaggtcgactggaccatcgaccaactggagcccgtccgcgtcctcgccatcagcggcaagggcccgatggcggtgaacgtcgccacgcgctacacgctcaccccggacggggacgcgacgacgttgcgcatcgacggcgagttcaccggtgccgccgtgtccatcatggcgggcaagctgaaggactcggcgacggccgccctcaacgagtcgctgcgcaagctgagcgcactggtggcc

SEQ ID NO: 6974 - DNA, 750 bp, Streptomyces avermitilis
  CDS (1)..(750)
gtgccgtgtcgctcaccgccggagcgccgggggtgcctgcggcgtgaggcaaggcggcgcgcatcccatcggggaaacggcgcgatgtcattcgtaaggaggaggggccgtgtacgcctccccaacctgcgccggacgcgggaatggttcccggcggggatgacctccgtggacgaggctgatgaggtgggggatgtgccatcccgtactccccgacagccggccgccgaatccggctcgcgccgcgccgaactcgacgccgggctcaccgcagagctggcctcggcggtggccggtgcgcgcagacgggcggtgcgggacggggaccggcaggtcgacacggcccatctgctgcacacgctcctcgagacggacccccaggtgcatgccgtcttcgacggcggcccgcaggtcgcccggctgctcggctatctcgtgcagcgcagcatcggctacgggctgcgctggcggagccgcgtcgaggactccgccgccgggccgaccgtgggggagccggagggctggtcgccggtggcggccggcgccatgggggccgcccatgagcgggcggcgcgccgcggcgaggaccgggcgcgcggtgtggatctgctggccgcgatcgccgcggaccccgagtcccgggccgtggaggtgctcgggcgggcgggagtcgacgtccgtgtgctgctgacgcgcatcgaggcgtggctcgagttcgaggacctggtcgggggtggcgaggtcgcgccc

SEQ ID NO: 6975 - DNA, 1005 bp, Streptomyces avermitilis
  CDS (1)..(1005)
gtgccggtgcgtacgtctcaggccagtcagggcaatcgtggaaaaggcgtcggcctggggcttgccctggcgtcggcggtcgccttcggtggatcaggtgtcgcggccaagccgctgatcgaggcagggctcgacccgcttcacgtggtgtggctgcgcgtctcgggcgccgccctggtgatgctgccgctcgccgtacgccaccgcgccctgctgcgccggcggcccgcgctgctcatcgggttcgggctgctcgccgtggccggtgtccaggcctgctacttcgccgcgatctcgcggatccccgtcggggtcgccctgctcgtcgaatatctcgcccccgcgctggtcctgggctgggtcaggttcgtccagcggcggccggtgacacgtgccgcggctctcggagtcgtcctcgcggtcggcggcctcgcctgcgtcgtcgaggtgtggtcggggctcggcttcgacgccctcgggctgctgctcgcgctcgccgccgcctgctgccaggtcggctacttcgttctgtccgaccagggcagcgagacgggggaggacgcccccgacccgctgggcgtcatcgcgttcggcctgctcataggcgccctcgtgctcaccgtcgtggcgcggccctggaccatggactggtcggtgctcgggggccgcgcggacatgaacggggactcggtccccgccgcactgctcctcggctggatcgtgctgatcgcaaccgttgtcgcgtacgtgaccggagtgctctccgtgcgccggctctccccgcaggtcgcgggcgtggtggcttgtctcgaagcggtcatcgcgaccgtgctcgcctgggtgctgctcggcgagcacctgtcggcgccgcagatcatcggcggcgcggtggtgctggtgggcgcgttcatcgcgcagtcgtcggcgcccgcgaaaccgtcggacgggcccgtcaccggtgggggcggggccgaaaggcagttgtcggcccgtggcaccgccgca

SEQ ID NO: 6976 - DNA, 990 bp, Streptomyces avermitilis
  CDS (1)..(990)
gtgtcgaatgctgtttccggcctgcccatcgggcgaggcctgctctatctgaccgtcgccggtgccgcctggggcaccgcgggcgcggccgcgtcgctcgtctaccgcgccggcgacatggggccggtcgccctgtcgttctggcgctgcgccggcgggctcgtcctgctgctcggtgcccggctgctgcgctcgcggggccggcgggccgcgctccggccgctgggccggtgcgagccgaccgagccgcgtgagtcaccggcgcgcaaggcgctgcggatcggcgccacgggcctcgggctcgccgtcttccagaccgcgtacttcgccgccgtcgaggcgaccggcctggcggtggccaccgtcgtcacgctgggcgccgggcccgtgatcatcgcgctcggggcgcggttgaccctgggggagcggctcgggcggggcgggatcaccgccgtcgccggagcgctcgccgggctggccgtcctggtgctcggcagtgggggcgcgacggtgcgtccctggggcgtgctgctcgcggtcgtctccgcggccgggtactccgcgatgaccctgctcacccggtggtgggggcgcgacggcagggccgacgcgtccgccacgacggtgggggcgttcgcggtgaccacgctctgtctgttgccggcggccctggccgaagggctgctgccgtacacggctgaaccggtccacgtcctgggcctgctggtgtacatcgccgccgtccccacggccctcgcgtacgccctgtacttcgcgggtgcggccgtggtccggtcggccaccgtgtcggtgatcatgctcctcgagccggtgagcgcggcggtcctggccgtgggcctgctcggtgagcgcctgacggcggcaacgctggtgggcacgctgctgatgctcggttccgtcgcggggcttgcggcggcggagacacgggccgcggcggcgggcgttccgcagggggagccgacgctcgtc

SEQ ID NO: 6977 - DNA, 699 bp, Streptomyces avermitilis
  CDS (1)..(699)
atggagagcgcaatgccggagacgagcacccagccagggacgacgcagcccgctgcctacaccccgaccgaccgcaccgtccccacccgttcccgtgagcgtgccgcgtacgaccacgagctggtgcacgcgatcctcgacgagggatacgtctgccacctcggcttcgtccgcgacggcgccccggtggtactgcccacgctgtacgggcgggtcggcaggcgcctctacgtccacggttcgaccggctcacgccccttgcggatgaccggtcaggccgatccgggactcccggtgtgcctgaccgtcacccacgtcgacggtctggtgctggcccggtccgccttccaccactcgctcaactaccgttcggtggtggtgcacggcatcgcccaccaggtgaccgaccccgatgagaagcgggaggccctggacgccctggtcgaccacgtcgtacccggccgctcgtacgactcccggccggccaacgccaaggaactggccgcgaccgccgtgatcagcctcgacctggacgaggtctccgccaagctccgcaccggcggccccaacgacgagcccgaggacctgacgctcccccactggaccggcgtcctgccgctgacccggggctacggcgccccggtcccggccgccgacctggcacccgggatcgaactgcccgactatctcgcggctctg

SEQ ID NO: 6978 - DNA, 1329 bp, Streptomyces avermitilis
  CDS (1)..(1329)
gtgctaggagagtatcggatcgaagggcgtcgtgcggcggagattgccgccagtgtcgagcgcgcggtgggctcgggggagctggagccgggtcaactgctcccgccgatgcgggagttggcgctcgacctcggggtgaatcccaataccgtcgcggccgcctaccggaccctgcgcgagcgcggagtcatcgagacctccggccgccggggcagtcgtgtgcgccccaagccggccacgacgggacgcgaggacatccgggtcgaggtgccggccggcgtacgggacgtcgccgacggcaacccggacccggcactgcttccgggcctcgccgaggcgttcgcgggggccgccggggaggcggaccgggcgccggtgatgtacggagaggacgccgtcgaaccggagctggcacggctggcgcgcgcggccctggacgccgacggtgtgccggacgggcccctcgtcgtcacctccgggtcgctcgacgccatcgagcgtgtcctggcggcccatctgaagccgggggacgcggtcgccgtcgaggaccccggctggggcagcctgctcgacctcgtgccggcgctcgggctgcgcaccgtcccggttcgggtcgacggcgaaggaccgctccccgacgacgtgcgaagcgccctggaggccggcgcgcgcgccctcgtcgtcaccgaccgggcgcagaaccccacgggcggcgcggtgagcgccccacgcgcgcgtgccctgcgcgcggtgctcgcccagcacccccagacgctgctcatcgaggacgaccacggccacgcgatcgtcgacctgcccctgcatcccctgagcggtacgacccggcactgggccttcgtccgctccgtggccaaggcctacgggcccgacctgcggctcgccgtcctcgccggggacccggtcacggtcgaccgcgtgcacgggcggcagcggctcggccccgggtgggtgagccggctggtgcagcgggccgtcgtgcggctgtgggtgagcgacgcggtggacgtaccggccgtgtcggcggcgtacgggcggcgccgggacgcgctcatcggcgcccttgcggagcggggcgtggaggcgtccgggcgcagcgggctgaacgtgtgggtgcccgtcccggacgagaccggggcggtggcgcggctgctgcacgccgggtgggccgtcgcgcccgggtcccgtttccggatgagcgcgccgccgggcatccggatcaccgtctccaccctcacccccgacgacgtcgggccgttggcggacgccgtcgcctccgccgtccgccccgcgcccgcgcgccggtacgtg

SEQ ID NO: 6979 - DNA, 933 bp, Streptomyces avermitilis
  CDS (1)..(933)
atgagcaccgtcgccacttctcgacccgtcaccccgaccgggtccacgccccgccgccgcaccgccctcgactggcggatccgcttcggtgtcctctccctgatctggggcttcagcttcctgctcatcaaggtcggcacggcggggtacgcaccgttccacgtcacgctcgggcggctggtgttcgggaccgcggtgctcgctgtggcgatggccgtgaagcgggagcgtctgccgcgcggcgcgcgcacctgggggcatctggcggtcgcggcgttcttcctcaacgccctgccgttctcgctcttcgcctactcggagctgacgattccgtcgacgctcgcgggtatctgcaacgcgacctcacctctgtggggcatggccctctccctggtcgccctctccgaggaccggccgacccggcgcagggtggccggtctgggcatcggcttcctgggcgtgctgacggtgctcggcgcctggcagggcttccacggcctggacgcgacgggcacggccatggccctgctcgcttccctcagctacccgatcggctggatctacgtccgccgcaccctggccggctccagccactcgcacctgtcgatgaccggcgcccagttgctcctggccaccgcgcaactcgccttcgtcaccccgctgttcaccaccctgccgagccacttcccggtcgtcccgctgctcgccatagccgccctgggcgccctcggcaccgggctcgccgtcctcctccagtacggcctggtcgccgaggtcggtccgaccacggcccagatggtcacgtacttcatcccggtcatcgccaccgcggcgggcgtcgccatcctcggcgagtcgctcacctggtcgaccccggtcggcgcggcgatcgttctggcgggtgcggcgctcactcaggccagggcgcggcgc

SEQ ID NO: 6980 - DNA, 897 bp, Streptomyces avermitilis
  CDS (1)..(897)
ttgaacctggagcgcctgcgcacgctcgacgccctcgcccgccatggctccgtcagcggtgccgccgaggggctgcacgtcacgacatcggccgtgtcccagcagatgtcgaagctggagcgcgaggtcggacagcgactcctcgcgaggaacggacgcggggtgcgtctcaccgacgcggggcggctgctcgccgaccatgccgcgcgcatcctgtcgcaggtcgagctggcccagtccgacctggaggcgcagcgcggtcaggtggtgggggagctgcgcctgtccgcgttcccgacggccgcgcgcgggctgttcccgaccgcactcgccgccctgcgcgccgagcacccggcgctgcgcgtgcgctccagcgagctggagcccgaggccggggtcgccggagtggtgcgcggtgatctcgacctcgcggtggtgctcgactggtacaacaagccgatgccgttgcccgacggcctggtcaaggcggcgatcctcgacgaccccgccgacgtcgccctgccggcggaccaccggctggccggcagggcggaggtggacctcggcgagttcgccgacgacgagtggatcacctggggcgagggcgagttctgtcatgagtggctgatgttcacgctgcgctccaagggcgtggagccgtgcgtcggccaccgcgcggcggagacccatacccagctcgggctggtcgccgcggggctgggggtgtgcatcgtgccgctgctggggcgccatccgatgcccgccggagtcgtcaccgtgccggtgcggcagcgtgtgcggcggcatgtgtacgtcgtctggcgggcggacgccgaccgccgcccgtcgatccgggcggcggtgggggcgctgcgggcggccggcgaggccatcggc

SEQ ID NO: 6981 - DNA, 465 bp, Streptomyces avermitilis
  CDS (1)..(465)
atggccgtcactcagcgcaggggtcggaagatcatgatgacgcccggcgagctggacgagttcctcacgacccagcgcacctgccgcgtggccaccgtcgcgaaggacggcgccccgcatgtgagcaccctctggttcgtctgggacagcacgtcgctgtggctgtactcggtggtgcgcagcaagcgctggacggagctgcgccgggacccgcggatcgccgtggtgatcgacaccggcgaggagtacggggagctgcggggcgtggagctgtccggcacggtggaattcgtgggcgaggttccccgcaccggggaactgtgtgccgaactcgacgccccggagaccttgttcgcgcgcaagaacttcggcctggaggagatgccgcacgacggccgccacgcctgggcccggctgacaccgacggcgatcgcctcgtgggacttccgcaagctggggccgatg

SEQ ID NO: 6982 - DNA, 720 bp, Streptomyces avermitilis
  CDS (1)..(720)
atgcgccgtcttccgtccccacgcaatgctcgttactctcgcccgctccggcttcgacgacaaggggacaccgtggcgtcgtacgaacagctcagcgaactcctcgaccccgcgaccaccgtgctgctcaccgtcgagtgccagcagggcgtcgtcggcccggacagcgcgctgcccgaactcgccaaggaggcgcgctcgtcgggagcgctcgccaacgtggccaggctggtggcggccgcgcacgagagcgggctccaggtgatccacgcgatcgccgagcggcgcccggacggccggggtgccggccgtaacgcccgtcttttccgcgccgccgagcggctgcccgtgcagcagttgtcggggaccacggcggtacgcgtcgcggccccgatcgaggtggcggagcaggacctcgtcgtacggcgactgcacggcctgtcgccgatcacgggcaccgacgtcgacgcgctgctgcgcaatctcggctgccgcacactgatcgtcaccggagtctccgccaacgtggccatcccgaacaccgtgttcgacgccgtcaaccggggctacacggccgtcgtgcccgccgatgccatcgcgggagtgccctccgactacacccccgtgatgatccgcaacaccctcgccctggtcgccaccatcgcgaccacggacgaggtgctggcctgcgtcacgcgtccgcgcagggcggggcggccc

SEQ ID NO: 6983 - DNA, 489 bp, Streptomyces avermitilis
  CDS (1)..(489)
atgaccagcgaatcgcttcaccccgtctcggcaccggctcgccgcacggtcgtagcggcggtcggcgcggcgggactcgccgtcgcgctgaccgcctgcgggggttcggacgacaagtcgtccggctcctccgatgtgcaggacaacagcagtgcgagcggcggcggtacggccggcggcgacagcgcggcggccggctcggacggcaccgtgctggccaagaccgccgacattcccgagggcggcggcaaggtcttcgcggaccagggcgtcgtcgtgacccagccgaccgcgggcacgtacaaggccttctcgtccaagtgcacccaccaggggtgtgcggtgaagggcatcgccgacggcgtcatcacctgtccctgccacaacagccagttctccgccaccgacggcagcgtgaagaaggggccggcgacgcaggccctggccgcggccaagatcaccgtcgacggggactcgatcaagctcgcg

SEQ ID NO: 6984 - DNA, 753 bp, Streptomyces avermitilis
  CDS (1)..(753)
atgctcaaggaagtcatcgcgacgcgctacatcgcgccgctgcgtgagggcggctcgctgccggggctcgtcgaggccgacgatctcggtacgtacgtcatgaagttcaccggcgccggacagggccgcaagacgctcgtcgcggaggtcgtctgcggcggactcgcgcgccggctcggtctgcgggtgcccggcctggtgacgatcgccctcgacccggtgctggggctcggtgagccggaccaggaggtgcaggagctgctcaagtcgagcggtggcctgaacctcggaatggacttcctctcacgcgcgctcggcttcgactccctcgccttcggggtgagccgcgaggaggccggccgggtcgtctggttcgacgcgctggtcaacaacgtggaccgctcctggcgcaaccccaacctgctcgtgcggcagggcgaactgtggctcatcgaccacggcgccacgatgatctggcaccacaactggcccggcgcacaggcctcggccgcgaagccgtacgacgcctccgaccacgccctcgcacccttcgggccggacgtcgcgggcgccgccgccgagctcgcgccccgggtcaccgaggaactgctggccgaggtgaccgccgagatccccgacgagtggctgacggacgagcccggcttcgagtcgccggacgagctccggcgggcctacgcggagccgctgctcgcgcgcgccgccgtcatccacgagcgcatcaagggggcacag

SEQ ID NO: 6985 - DNA, 381 bp, Streptomyces avermitilis
  CDS (1)..(381)
gtgaccgagcgggacgtcttcgagtacgcgctgctgcgggtcgtaccgcgagcggagcgcggtgagtgcttcaacgcgggcgttctggtgtactgccgcgccaagtccttcgtggccgcccggacgtatctggacgagaccaagttgctggccctcgacccggaggcggacgtggcgggtgtacgggccgcgctgcgggccgtggagggggtctgcacgggtggagaagccgcaggtcaggccgcgcaggacgacgccggacggcgttttcgctggctgatcgctccccgctcgacggtggtgcggccgggtcccgtgcacacgggactcaccacggatccggaagccgaggcggagcggctgctcggcctgctggtgagg

SEQ ID NO: 6986 - DNA, 759 bp, Streptomyces avermitilis
  CDS (1)..(759)
atgtccaccactgagcagcgcgtcgcggtcgtcaccggtgccgcgcgcggcatcggcgccgccactgccgtacgactggccgccgagggccgcgccgtcgcggtgatcgacctcgacgaggccgcgtgcaaggacaccgtggagaagatcaccgccgccggtggcaaggccatcgcggtcggctgtgacgtgtccgacgaggcccaggtcgaggccgcggtcgcgcggatcgccgaggagctcggggcgccgacgatcctggtgaacaacgcgggcgtgctccgcgacaacctgctgttcaagatgagcgcgtccgactgggacacggtcatgaacgtgcatctgcgcggcgccttcctgatggccaaggcctgtcagaagcacatggtggacgcgaagttcggccggatcgtcaacctgtcctcctcctccgcgctgggcaaccgcggccaggccaactactccaccgccaaggccggtctccagggcctcaccaagaccctcgccatcgagctcggcaagttcggcgtcaccgcgaacgccgtcgcgcccggcttcatcgtcaccgacatgaccgccgccaccgccgcccgcgtcggcatgggcttcgaggagttccaggccgcggccgccacccagatcccggtgcagcgtgtgggccagccggcggacatcgccaacgccatcgccttcttcacgggcgaggaggccgggttcgtctccggccaggtgatgtacgtcgccggcggaccgctcaac

SEQ ID NO: 6987 - DNA, 759 bp, Streptomyces avermitilis
  CDS (1)..(759)
atgactgcacttcccgaactttccggcaaggtcgcgctcatcacgggcgcgagccgcggcatcggctacggcgtcgcggaggccctggtcgcccgcggtgaccgcgtctgcatcaccggccgcaacgaggacgccctcaaggaggccgtcgaggcgctcggtgccgagcgcgtcatcggcgtcgccggcaaggcccacgacgaggcccaccaggccgccgccgtcgagcgcaccatggaggccttcggccgcgtcgactacctggtcaacaacgctggtacgaacccggtgttcgggccgatcgccgatctcgacctcaatgtggcgcgcaaggtgttcgagaccaacgtcgtctcggccctcggcttcgcccagcagacctggaaggcctggcagggcgagaacggcggcgcgatcgtcaacatcgcctccgtcgccggcgtctccgcctcgccgttcatcggcgcgtacggcatcagcaaggccgcgatgatcaacctgaccctccagctggcgcacgagttcgcgcccaaggtgcgggtcaacgcgatcgcgcccgccgtcgtcaagaccaagttcgcgcaggccctgtacgagggccgggaggcggaggccgccgcgtcctacccgctcggccggctcggggtgccctccgacatcggtggcgccgccgcgttcctgacctcggcgcagtccgactggatcacgggccagacgctcgtggtcgacggcggcatcttcctgaacgccggggtcggc

SEQ ID NO: 6988 - DNA, 1620 bp, Streptomyces avermitilis
  CDS (1)..(1620)
atggtctgccgaccttggtacggcagatcgaggagcgagcgcgtgtccaaccggtacagagccctgcgtcaggtggcggcggtcacgtccatatccctggtggccggctgcggtgtcctcggctccggctccgccgacgacgagggaccgattgtcgtgggcaccaccagcgcgcccagcacactggatccggccgcttcctgggacggttcctgggagctgttccgcaacatctaccagaccctgctgagctacccctccggtgcggccgcgcccgagcccgacgccgcggagagctgcgggttcaccaacagctcgaatctcgcgtaccgctgtgtgctgcgcaccggcatgaagttctccgacggggacacgctcgacgcgcgggccgtgaagtactccatcgaccggatcaggaggatcgacctgtccggtggccccgccggcctgctgggcagcctcgaccggatctcgacgcgaggcgaccgcgagatcgtcttccatctcaacaagcccgacgccaccttcccgttcgtgctggccacccccgccatgtcgatcgtcgaccccgacgactacccggcccgctccctgcgcaaggacggcaaggtcttcgggtccggtccctacagcctgcgctcgtacgaggacggcaaacaggccgaactcgtcaagaacgatcactacaagggcttcgccgagcgcaagaacgacgcggtcaccatccggtacttccagaactccgccgccatggtcaaagccctcagggacaagaagatcgacgccacctaccgtggactggccgcctccgacatcgtctccctgcagagcaagcagtccgaggaggacctccagctcgtcgagggcgcgggcaccgagatcagctacctggtgttcaacccgaaggacccgtgggccggcaaggccgcggtccgcaaggccgtcgcgcagatcgtcgatcgcgcggcgatcgcgcacaaggtctacaaggacaccgtcgacccgctgtactccatggttcccaaggggctgacggggcacaccacgggcttcttcgacgacttcggcgaacccagttcgtccaaggcccgcaagatccttctggaggcgggcatctctcagcgcgtcccgctcaccctctggtacacgaccgaccgctacggatccgagaccgcacccgagttcgaggagctcaagagccagctcaacgactccgggctcttcagcgtcaagatcgagggccgcccctggaagacgttcgaagcgggctaccgcaagggcgagtaccccgcgttcgggcgcggctggttccccgacttcccggacgccgagaacttcatcgcgcccttcgtcggtgagcagaacgccctcggtacgccctacccgacgcgggagatcaccggcgtgctgctgccccagtcgcggcggcagagcgaccgcggggccgtggtgaaggagttcgagcaggcccagcagatcctcgtcgacgacgcacggctgctgccgctgtggcagggcaagcagttcgtcgcggcgagcgaggacatctcgggcggcgagcgggccctggacccctcgacgatcatgatgatgtgggagctgtatcggaaaaccagctgg

SEQ ID NO: 6989 - DNA, 681 bp, Streptomyces avermitilis
  CDS (1)..(681)
gtgaccgacaccgccatgctgcccgagtcctggcgcggcgtcctgggcgacgagctgcagcagccctacttcaaggaactcaccgagttcgtcgaggaggagcgcgccaggggtcctgtctaccctccgcgtgaggaggtcttcgccgcgctcgcggcgacgccgtacgagcgggtgaaggtgctggtcctcggccaggacccgtatcacggcgagggccaggggcacggtctgtgcttctccgtccggccgggcgtgaagacgccgccctcgctccgcaacatctacaaggagatgaaggaggagctgggcaccccgatcccggacaacggctatctgatgccgtgggccgagcagggtgtgctgctgctcaacgcggtgctgacggtgcgctccggcgaggcgaactcgcacaagggcaagggctgggagaagttcacggacgccgtgatccgcgcggtcgcggaccggcccgacccggcggtcttcgtgctgtggggcaactacgcgcagaagaagctgccgctcatcgacgaggagcggcacgtggtggtgaagggcgcgcatccctctccgctgtccgcgaagaagttcttcggttcgcgtcccttcacgcagatcaacgaggcggtcgcggagcaggggcacaccccgatcgactggacgattcccaacctcggc

SEQ ID NO: 6990 - DNA, 648 bp, Streptomyces avermitilis
  CDS (1)..(648)
atgtcagtggctgcggttagcgtcgtggggggatgggcgacgaccttggaggacgtggtggcggagcgacaggagcaggtggcgccggacgccatgatgacccgcatcgggcaggtcgcgatgttgcaccacgccggtgaccgcgaggaggcccggggccgcttcctgggcctgtgggcggagatcggcgacggcggcgaccccctccaccgctgcaccctggcccactacctggcggacacacaggacgacccggtggatgaactcgcctgggatctgcgggcgttgtcggcggccgaggagctcaccgacgagcgcgtcgccgagcacgagcacgaggacgcgctcgcggtgcgtgcgttctacccgtccctgcacctcaatctcgccgcggactatgtgaagctcggtcgctccgacgccgcccgcagtcatctgcgccgggcccgcggcgcggtgggcgtgctcggcgacgacagctacggggacggcgtccgggcggcgatcggacgcctggagctgaggctcgacggcgacgggccggcgggcggcggatcggaccccgcgggcggcgccgggccgttcgggggtccgggcccgttcgacggccccggaggggagaggccggggccgcccagacagcggccg

SEQ ID NO: 6991 - DNA, 462 bp, Streptomyces avermitilis
  CDS (1)..(462)
gtgcatcgaaccacgaccaccgcgacgctcctggtcaccgcggctgtcaccgtcctctccggctgtgtgaccgtccagcggctgcctgccccggctccctcggtggcaccgccccacccgtcggtgccacgtccggacggcagcggggatccccaagtcgtccaggctccggcgcgggaggcactggagctcatcgagccctcccaccgcccgtcgccgaccgccgccgcgccgcaccggacgcctcctccggcgcgcgccgccgcaccggtgacggttccgcgccgtccgcacgcggacccgcccgcgaagccggcgcatcccgaaccccgggacgcggtaccgacgtccgtgtccaagctggtcccgaaggacggggacgtgtgcgcgctcgggcgcaagtacgggggatggcagccggacagccctgaggcgaccatctgcaaaaacgcgtacgggcgt

SEQ ID NO: 6992 - DNA, 510 bp, Streptomyces avermitilis
  CDS (1)..(510)
atgacgacacagcgcaccgaacccgcgaccgacgccgacgagcgatccatgctggaggggtggctcgactaccaccgccggacgcttgaggtgaagtgcgaggggctcgacgacgctcagctcagaaccgcctcggtgccgccctccgaactctccctgctcggcctggtgcggcacatggcggaggtggaacggggctggttccgcaaggtgttggcgaacgacgatcctgggccgatctactacagcgacgaggaccgcgacggcgagttccacctcaccgaggccgacacctgggcggaggcctacggcacctggcaggcggagatcgggatcgcccggcacaacgcggcacgcttcggcctggacgacgtctgcgagggcacgagcaagttcaccgacagccccatcaacctgcggtggatctacacccacatgatcgaggagtacgcccgtcacaacggtcacgccgacctgatcagggagcgcgtcgacggcacgaccggagag

SEQ ID NO: 6993 - DNA, 903 bp, Streptomyces avermitilis
  CDS (1)..(903)
gtgaaggtcggctgcatcggactcggtgacatcgcgcagaaggcgtaccttccggtgctcggtgtccagccgggagtcgaactgcacctccagacacggactcccgccaccctcgcccgggtggccgacagcctccgtctgccaccggcgcaacgtcacaccgacctgtcggagctgctggcccaggacctcgacgccgccttcgtgcatgcgcccaccgccgtgcaccccgagatcgtcgagcggctcctcgcggccggcgtaccgacgtacgtcgacaagcccctcgcgtacgaactcgccgactcggagcggctggtacggctcgccgaggagcggggcgtcagcctggccgtcggcttcaacaggcgttacgcgcccgggtacgcccagtgcgccgaccatccgcgtgagctgatcctgatgcagaagaaccgggtcgggctgcccgaggagccccgcacgatgatcctcgacgacttcatccatgtcgtggacaccctgcggttcctggtgccggggccggtcgacgacgtgacggtacgcgcccgcaccgggggcggtctgctgcaccacgtggtgctccagctgtccggtgagggcttcaccgcgctgggcgtcatgaaccggctgagcggctccgccgaggagatcctcgaagtctccgggcaggacaccaagcgccaggtgctcaacctcgccgaggtcgtcgaccacaaggggcagccgaccgtacggcgacgcggcgactgggtgccggtggcccggcagcgcggcatcgagcaggcggtcctcgtcttcctggacgccgtacgcgcgggcaaggtgctcagcgcccgggacgcgctggcgactcacgaactgtgcgagcgggtggtacgcgcggtgacggaacggtccgcc

SEQ ID NO: 6994 - DNA, 1572 bp, Streptomyces avermitilis
  CDS (1)..(1572)
atgaggatgcccgaggactggctgggctcccgctggtggcgcggcgcggcggccgtgctggccggtgccctgcccatgctcgccttcccggcaccgtcctggtggtggttcgcgtacgtcgccctggtcccctggatcctgctcgcccgcaccgccccgaccggcggacgcgccgcgtacgacggctggctgggcgggctcggcttcatgctggccgtgcaccactggctgctgccgagcctgcatgtgttcacggtcctgatagccgcgctgctcggcgcgctgtgggcgccgtggggctggctggtgcgccgcttcctggccggggtgccctcgccggggcgggtcgcggcggcgatgctcgtcctgccgtcgggctggctcatggtcgaactcgtccgttcctggcaggggctgggcggcccctgggggctgctcgggtccagccagtggcaggtggaacccgcgctgcggctggcctcggtcggcggggtgtggctgctgagcttcctggtggtgacggtcaacatcgcggtcgcggtgctcgtctcggtgcgcgcgtcccgtatgcctgccctcgccggactggtcgccacggccgccgcgacctcggcggcctgggcgtggtcaccgcgccccgaccatgacggggacatgcggatcgccatcgtccagccgggcgtgatcgacggaaccggcagcgctgacaggcggttcgaccgcgaggagcagctgacccgggaactcgccgggcagaacgtcgacctggtggtctggggcgagagcagcgtcggcttcgacctcgcggaccgtcccgacctggcccggcggatcgccggtctctcggagcgggtcggcgcggacatcctcgtcaacgtcgacgcccgccgctccgaccggcccggcatctacaagagttccgtgctcgtcggcccgcacggcccgaccggggaccgctacgacaagatgcggctcgtgccgttcggcgagtacataccggcgcgctccctgctcggctgggccacctccgtcggcaaggcggccggcgaggaccgcaggcgcggcagcgagcaggtggtgatgaacgccgggcacgggctgcgcatcggcccgatggtgtgcttcgagaccgcgttccccgacatgagccgccatctcgccgaggacggcgccgaggtgctgctcgcgcagtcgtcgacctcgaccttccagcagagctgggccccggaacagcacgcctcgctcgccgcgctgcgggccgcggagaccggccgcccgatggtgcacgcgacactcaccggcgtctccgccgtctacggcccgagcggcgagcgcgtcggctcctggctcggcaccgggaagagcacgtcagcggtgtacgacgtgccgttggcccgcggtgtcactccgtacgtccgcttcggcgactggccggtgcacgcggcgctgctgatcctcgcggcgctgtgcaccgctgagggcgtacgggagttccggctcaggcggaccgttccgtcaccgcgcgtaccacccgctcgcacagttcgtgagtcgccagcgcgtcccgggcgc

SEQ ID NO: 6995 - DNA, 465 bp, Streptomyces avermitilis
  CDS (1)..(465)
atggaccgcctcggcatcgacgaactgatcaccgaatacgcggtggccgtggacgacggcgactgggaggcgtaccgagggctgttcacggcggacgggcgcgccgactaccgctcggccggcgggatcgagggcgacgcccggcaggtcgccgcgtggctcgccgagaacatgcggctgttcccgatgcggcagcacctgatcgtgaaccgacgggtgcggttcggcgtacgggaacaggacatcggcgacacggcgcgggtccaggccgactacgtcaatccgatgcgcttcgccggatccgacggcggcccggacggcggctcgggcgaaccggacttcgtctgcgggggccggtacgcgttcgcgttcgcgcgcacgtatgacggctggcggctgcgcgaggtggtcgtccaggagaagtggcgccgcatgcaaccggcgcgcgaggggaacgcgaccccc

SEQ ID NO: 6996 - DNA, 1014 bp, Streptomyces avermitilis
  CDS (1)..(1014)
gtggacgattcctatactgaccggatgatcaccgttccgctcagcgcgctcgaagtggccatggtccaagcgggcgcccgagccgcagacacgttacgagacaccaccgagttcgccctgcgcctcgaagacctcggctacctgcgactctggtacgccgagcatcaccattccccggccatcggagcgttcccgcccgtcgtcctgaccgcccacgcggccgcgttgacgtcgtccatccggctcggctccgggggcgttctcgctcccaaccacgctccgatcatgctggcggagcagttcggcacgctgtccgcactgcacgcgggccggatcgacctgggcatgggccgtgggccgggtaccttcgacgattccacggcgcgggccctgcgccgtggggccggtccgacaacggacgtcgagtaccgcgacgatgtgtcatcgactctgggtttcttggtggacgaggtcgcgctcggcccgctcccggagccatggctgctgtcctcgagcacggccggtgccgcgctcgctgcggaactcggactgccgatcgccttcgcccatcacattcgccctgacaacaccctggccgcgctcagccactaccgagagcgtttctccccctcccgttggtgcgagcgcccgcgcgtgctgatctgcgtggaaacggtatgcgccgagacgcaggaggaggcggcccggctcgccggtccgatggatgtcgtcaaggccggactcctcaaggggcgaggcgacatccccttccccacgcccgaagaggcggcgacccactcgttcaccgcggaagaggcgcaggcgctgacggccttccgtgcccaacaggcacacggctcacccgagaccgtggcgaagcacctgacggacctggtggacctgacgggtgcggacgaactcatgctggtgacgcccatctacgcgctggccgaccggttgaggtcgtacgagctcgtcaggcagcacgtcatgatgccgacggcgtcctggcaa

SEQ ID NO: 6997 - DNA, 858 bp, Streptomyces avermitilis
  CDS (1)..(858)
gtgggtttcgaccgctcgatggctctggcatccagtgctctcaccaccctgctcccgctcgcagtcctcggcggcaccgtcgtgagcagtttcgcgcactacgacgcggcggagcgggtcatcaagcgctacggcctgaccggagcaggcgccgaggcagtcgagtccctcttctcccccgcccagcacacaagcgcgagcgtgggcatcttcggagtcgtcttcctgaccatctcggtactgagcttcgcgcgagccacgcagcggctcttcgagcagacatgggagctcaagccgctcagcatgcgcaatacgcgcaacgggttgtggtggatcctcacactcggcggctacacggtggtcaccgggtggctctccgccgtcttgggcgggggccggctgggtctggcggccctggtgtgcgacgtaccggtgaccgccgctttcctcgtctggagcggctggatcctgtccgcgaagcggatcaaccggccggacctgctccccttcggcatcgcagcggccctcctggaggcggcctactccgtgggcacgaccgtctacctaccgcgcctcttcaactcctacgccgcacgatacggagcgctcggtgccgtcttcgcgatgatctcggccctcttcggggggatgctcgtcatcgtcgcgtcggcggcactgggccgagaggtacgcgacgagctcacccggatccgccacggccaccgcccgtccgaccatgacgtccgccgccaatgggacagcgtggtcgaacagacgcggtcacgttggcgtaccgcacgggaacaggtctctcaccgccgccccaaggacgcgaaccgtcgcgaccgttccaaggca

SEQ ID NO: 6998 - DNA, 297 bp, Streptomyces avermitilis
  CDS (1)..(297)
atgcgcgacgtgacctctgtccgcctcgcggtctccgcgcgtgacctcgcgaacacggtgccgctgctgccggccggtgggttcgtcacccaggccgtggcggacggtggcatcgttgcgcggcgcgggggcaccacgatccgattcgacgccgttccgcgcgaccaggtgggcttgcggcaggtcgagctgtcgctcaaccggcccgtggagtaccggcacgaggaacggctcggccggtcgaccctcgtcgtcggcccgggcgcccgcgccgtgtggactttcggcaccgcggag

SEQ ID NO: 6999 - DNA, 873 bp, Streptomyces avermitilis
  CDS (1)..(873)
atgtcttggtttgaatccctcatcctcggactcgtccaggggctgaccgagttccttcccgtctcctccagcgcgcatctgcggctgacggcggccttcgccggctgggaggacccgggagcggctttcaccgcgatcacccagatcggcacggaagccgcggtgctgatctacttccgcaaggacatcgcgcgcatcatctcggcgtggttccgctccctggtgaacaaggagatgcggcacgaccacgacgcgcagatgggctggctggtgatcgtcggctcgatcccgatcggcgtgctcggcgtgacgctcaaggaccagatcgagggcccgttccgcgatctgcggatcaccgcgaccatgctgatcgtcatgggcgtgatcctgggcatagccgaccggctcgcggcgcgtgacgagacgggcggcaagcaccgcgcggcgaaggagcgcaagaagctccaggacctgaacatcagggacggtctggtcttcggcgcctgccaggcgatggccctgatcccgggcgtctcccgctcgggcgccacgatcagcggcggtctgctcatcggctacacccgtgagtccgcggcccgttactcgttcctcctcgccatccccgccgtcctcgcctccggcgtgttcgagctcaaggacgcggccgcgagcggacatgtcgcgtggggaccgacggtcttcgccacggtcatcgcgttcgtgtccggttacgccgtcatcgcgtggttcatgaagttcatctccaacaagagcttcatgccgttcgtctggtatcgcatcgcgctcggcatcgccatcatcgcgctggtcgcgacgggtgcgctcagcccgcacgcggcggagtcggcgggc

SEQ ID NO: 7000 - DNA, 1440 bp, Streptomyces avermitilis
  CDS (1)..(1440)
gtgctgatcacgtccatgcccacagcccgcaccgcgtccacgtccacagccaacaccgcgtccgcgtccacagcccgcaccgcgcccacgtccacggctcacgacacgtccacgtccacggctcacgacacgtccacgcccacagcacgcgacgcaaccagcccggaaccctcctcgcccccggactcgaggccgaaccccaccccgtacccgaaccgcccggcggccccgctcgccggccgccggatcagggccgccctcatcggcacgggtgccatcgggggcggcagccatctgcccgcgctcgccacgctcgccgaggagggcgagacggagatcgtcgccgcggtcgacatcaacgccgacgcgatcaccgcgttctgcgcggagcacggcatcccgcacgcgtacaccgacctcgaccggatgctccaggagcagcggcccgacctggtctccatctgcaccccgcccaccctgcaccgcgaacagaccctcgccgcgctgcgggccggtgcctgggtgtggtgcgagaagccgcccgtcccgacgctggcggacttcgacgccatcgagtcgcaggagggcacggacggcggtccgtacgccgcgatcgtgttccagcaccgcttcggctcgggcgcccggcacgtccggcggctgctcgccgaacaggccctggggcggccgctcgtggcgcactgccagaccacctggtaccgcaacaccgcctactacgccgtgccgtggcgcggacgctggcagaccgagggcggcggccccgcgatggggcacggcatccaccagatggatctcctcctcgatctgctcgggccgtggagcgaagtgcgggcgatggccggacgcctggtccacgacgtggagacggaggacgtctcgaccgccctcgtacgcttcgagaacggcgcgatggccaccgtggtcaacagcgttctgagtccggacgaggtcagccggatccgcatcgactgcgagcgcgccaccgtcgagctgacccacctctacggccacagcaacgccaactggcgcatcacgcccgctcccgacgtgccggaggaggaggccgcggcctggcgtgacttcggcgcggacgtgccgagctcacacctggcgcaactgcgggaactggtcgcgagcatgcgggcccaggcgcgtccgcgcagcagcggcgcggacgggcggaccagcctcgagctgatcaccgccctgtacaagtcggcgttcaccgatacgaccgtgcgggccggggcgatcggcccgggagacccctattacacggctctgcacgggggcgcgccgggctgggcgcccgtcgggttcaccggcagccagtctgccgacagccagtccgccggaagccggcccgctggaaccggatccaccgtgaacgactccgcatcgagcaaggaggtgccggca

SEQ ID NO: 7001 - DNA, 933 bp, Streptomyces avermitilis
  CDS (1)..(933)
atgagcgaggccaccggtctgcgcatcgtgcacgcccacggtgaccgcatcacgatcaccgaacggtccaccggcgtcgatctgctgagctatgtctacgctcccgaggcggcctgggaggctccgaagccgtatctgcatcccctccggacgctcgccggtgacgtcgtcaccgactaccggcccaacgaccaccgctggcacaagggcctccagatgacggcctcgcatctgtccgggcagaacctgtggggcggcaacacatacgttcatggaaaggggtatctcgcgctcccggagcgggtcgggtcgatggcgcacgtcggctttgacgcggtcgacgccgacggtgcccgtgccgtgatcgccgagcggctcacctggcacccgtacagcggcgagctgtgggccgaggaggagcgtcgtgtggaggtgcacgacgtcgaccccgagtccggttcgtgggcgctgacctggaccagcgccgtcaccaaccggcgggacgaaccgctgctcttcggcagcccgaccaccgccgggcgtgaactggcgggatacacgggcctcttctggcgcggcccgcgagccttccgggacggccggatcatcggacccgactccgaagggcacgagctgatggggcggcaggcgccctggctcgcgtactcgggcgaacacgatggcgccgacggacacgccacgctcgtgttcgcgcatgcccccgagaacgaccatgacggctcccaaggagcgcaccccgcccactggttcgtgcgcaacgagcccttcgcggctgtcgctccctcgtgggcgttccacgacgagctggagctggggcccggcgatacgctcacccgtcgctaccgggtcgtcgtggccgacggcgcctgggagcgcgaggaggtcgccaagtaccttcaggagcacccgtgg

SEQ ID NO: 7002 - DNA, 762 bp, Streptomyces avermitilis
  CDS (1)..(762)
gtggtgagcccgggggaattcgccggactgccgggggaattcgccggactgccgggagtgttcaccgggctgcccggggcggtcgccgtctcgcacctgtccgtctacgactggcccgcggtcgacggagtgtgcggcggaactccccatatgcatctgacctgttcggaggcgtacgtcgtcaccggcggccgcggcgcggtgcagacgctgacgacgtccgggtacgaggtcacacccctcgcgcccggaacggtcgcgtggttcacgcccggcaccatccaccggctcgtcaacgaggacgatctgcgcatcaccgtcctcatgcagaacaacggcttgccggaggccggagacgcggtgctcacgctgcctccggagtacctcaccgatcccgggacgtacgccgccgcgaccgtcatcccggccgacgcgtccgaagaggagcaggcgcgggtcgccctggcccggcgcgacctcgccgtgcgcggctaccgcgcgctgcgcgacgccgacgggcccgagccgctcgccgcgttccaccgggccgcggccgctctggtgcggccgcgtgtcgccgcgtggcgcgagcggtggcggcgcggggccgaggctgccaccgcggccaccggggaccagctggaccggttggagcacggcgacgcgtcccatctcgcggacgccctcgtacgcgccgaacagccttccacgtacggcaggttcgggatgtgcgggcggctcgacgtctaccaggggacgtcc

SEQ ID NO: 7003 - DNA, 468 bp, Streptomyces avermitilis
  CDS (1)..(468)
atggccgccaccaaagacccgcgcccctgctcgatcgccgacaccctggcgctcgtgggcgagaagtactcgctgctcgtcctgcgcgaggtgtgcctcggcaacgggcgcttcgaccagctcgtacgcaacatcggcgccccgcgcgacatcctggccacgcgtctgaggcggctggtcgacgcgggcatgctgaagaagaccgtctacagcgagcgcccgcagcgcttcgagtaccggcccaccgaggcgggtctggaactggaaccggtcctgatgacgctcatggcctggggcgaccggcatctgcgcaaggacgacgaccgccccatggtgatcgagcacatctgcggcaatgaactgattccgctcgtgacctgctcggtctgcggtgaggaggtccaccacgaggacctgacggcgcacccgcaggcgccgggctggacggtgaaggggccggcggcggcg

SEQ ID NO: 7004 - DNA, 1167 bp, Streptomyces avermitilis
  CDS (1)..(1167)
atgcgtgatgccgtcatcgtcgaagccgtacgcacccccatcggcaagggcaagccgaacggctcccttgcccacgtccaccccgtcgaactgctcgcgcacacgctgcgcaccctcgtcgagcgctccggagtcgacccggcactgatcgacgacgtcatcggcggcaccgtcgaccaggtcggcgagcaggccatgaacaccacccgctacgccgtcctgtcggcgggcttcccggagacggtgcccgcgaccacggtggaccgccagtgcggctcctcgcagcaggccgtgcacttcgcggcgcagggcgtcatgtccggggcgtacgacctggtggtcgcctgcggtgtcgagtccatgagccgcgtcccgatgtggtcgaacgtgccggccggccaggaccccttcgggcccggagtcgcccggcgctatcccgagggcctggtcccgcagggcatcagcgccgaactgatcgccgccaagtggtccatcacccgggaccagatggacgccttcgcggtgtcctcgcaccagaaggcggccgcggcctgggcgggcggtctgttcgacgccgaggtcacgccgctggagggggtgaggcgcgacgagtgcgtacggcccgccagcaccaccgagatcctcgccggactcaaacccgcctactacgacccgaacttcgccgagcgcttcccgggcatcgagtggaacgtcaccgcgggcaacgcgagccccgtcaacgacggcgcgtcggccgtgctcatcacctcgagcgagaccgcggcccgcctcgggctgcgcccgatcgcccgtctgcacagcttcgccgtcaccggctccgacccgctgctgatgctcacgggagtcgtcccggccaccgagaaggtgctccgcaaggcgggactcacgatcgacgacatcgacctcttcgaggtcaacgaggccttctccagtgtcgtcctggcctggcggcaggagacgggagccgacctgagccgggtgaacgtccacggtggcgcgatcgcgatcgggcacccgctgggtgcgagcggtacgcgtctgacgaccacgctggtgcacgccatgcgcgcgcgtggagcccgctacgccctccagacgatgtgcgaggcgggcgggctcgcgaacgcgatggtgctggagaccgtc

SEQ ID NO: 7005 - DNA, 807 bp, Streptomyces avermitilis
  CDS (1)..(807)
atgctcgatgccaccacccgctctgggggcaccgccacggccactccccgggccaccgccacagacctcaccgtcgccacggccgccgccgcggccggcgtcacggcccctggggccgccgtcgccgtaccgacgggcttcaccgcccgctgcacgagagtgctcctctcgccgtggtcgcggctgtccctgctggtggcgctgctcgcggcggccgcgtcgagcgtgctgctgttcgagccgcagaagctgctggcccatggctggccgccccagctcggcggcgccgcggcggccgtggtgttcgcggtggcgtacgggctgtgcacggtcgcgttcgtgccacggccgctgctcaacctcgcggcgggcgccctcttcggctcgcagtggggcacgggtaccgcactcgcgggtacggtgctcggcgccggggtcgccttcggcctcggccggatgctcgggcaggacgcgctccgcccgctgctgcgggggcgctggctgaaggcggtggacggacagctgagcaggcacgccttccgctcgatgatggcggcccggctgtttcccggcgtgccgttctgggcggccaactactgcgccgccgtctcccggatgcgctgggtcccgttcctcgtcgcgacggcgctcggctccattccgaataccgccgcgtacgccgtcgccggcgcccgtgcctcgaggccgacctcgcccgccttcctgatcgcgatgggcttcatcgccgtgccggccctggtcggggcggtggtggcctggcgcaagcgccaccacctgcgcggcaac

SEQ ID NO: 7006 - DNA, 1170 bp, Streptomyces avermitilis
  CDS (1)..(1170)
atgcccaagacggcttacgtgcgcaccaaaccgcacctgaacatcggcaccatgggtcacgtcgaccacggcaagaccaccctgaccgccgccatcaccaaggtcctcgccgagcgcggctccggcacgttcgtcccgttcgaccgcatcgaccgggcgccggaggaggcggcccgcggcatcaccatcaacatcgcgcacgtcgagtacgagacggacacccggcactacgcgcacgtggacatgccgggccatgccgactacgtcaagaacatggtcaccggcgccgcgcagctcgacggggcgatcctcgtcgtctccgcgctcgacgggatcatgccgcagaccgccgaacacgtgctgctcgcccggcaggtgggcgtcgaccacatcgtcgtcgccctgaacaaggccgacgcgggcgacgaggagctgaccgacctggtcgagctggaggtccgcgaactgctcaccgcgcacggctacgggggcgactccgtaccggtcgtacgcgtctccgggctgaaggccctcgagggggacccccggtggacggcggcgatcgacgcactgctggacgccgtggacacctatgtgcccatgcccgagcggtacgtcgacgcgccgttcctgttgccggtcgagaacgtgctcacgatcaccggccggggaacggtcgtcacgggagccgtcgagcgcggcacgatccgtgtcggcgaccgcgtcgacgtgctcggcgcctccgtggagacggtggtgaccggcctggagaccttcggcaagcccatggaggaggcgcaggccggggacaacgtggcgctgctgctgcgcggggtgccgcgtgacgcggtgcgccgcgggcacatcgtggcggcgcccggcagcgtcgtacccagccgccgcttctccgcccgggtgtacgtcctgtcgacgcgcgagggcggtcgtacgaccccggtcgccaccggctaccggccgcagttctacatccgcaccgcggacgtggtcggcgacgtcgacctcggcgagacggcggtcgcccggcccggcgacacggtcacgatgacggtctccctggggcgtgacgtcccgctggagcccggcctcggcttcgcgatccgtgagggcggccggacggtcggtgccggcacggtgacgaccgtggaggac

SEQ ID NO: 7007 - DNA, 843 bp, Streptomyces avermitilis
  CDS (1)..(843)
gtggacgagccgatacccgtgacacgggacgtggatcacgggaccgccaagctgatgcccgacgtcgaccggcggcgggcctggctgctgaccgtcgacggggccccgcagtcgtatgtcgatctggacgcgccgacgcatctggagttcgagtacgcgcggcggctcggccatgcgctggacacggtcgccgagccggggcgggccctggacgtgctgcatctcggcgggggcgcgctcaccctgccgcgctatctcgccgccacccggccgggatcgcggcaggacgtgatcgaggccgaccacggcctgctggacctcgtcgtcgagcagctgcccctgcccgccgacgccgggatcgcgctgcaccgcgccgacgcccgcgcctggctggaagcagccgtgcccgactccgccgatgtcgtgatcgccgacgtcttcggcggctcacgcgtcccggcgcacctgacgtcggtggcgtacgcgcgcgccgccgagcgggcactgcgcgacggcggcgtctacctcgccaacctcgccgacgcggcgcccttcgcctttctgcggtcccaactggccacgttcgcgacggtcttcggggagctcgccgtcatcgccgaacccgccgtcctgcgcggccgccgcttcggcaacgccgtgctcctcgcctcccaccgtccgctcgacacggccaccctcgcccgccgcaccgcctccgacgccttccccgcccgggtcgaacacggcgccgcgctccgggacttcatgggcgccgccgagcccgtgcacgacgagaacgccgtaccgtcacccgagccgcccgacggagccttcggcatcggc

SEQ ID NO: 7008 - DNA, 1341 bp, Streptomyces avermitilis
  CDS (1)..(1341)
gtgacctctgccgccgactccgccggacgccctcgccgcacacgccgccctcgccgccccgactgggcggaccgcaactacaccctgctggccgccgccgcggtcgtcacgaacctgggcagccacggcgccctgatcgcggccgcgttcgcggtgctcgacacgggcggcgacggaggcgacgtcggactggtggcggcggcgcgcacgctgcccctggtgctcttcctgctgatcgggggcgcggtcgccgaccggctgccgcgacaccgcgtgatggtcgcggccaacgccctcaacttcctctcgcagggcgccttcgcggcactcgtcctcggcggcgaaccgcgcctgtggcagatgatgctgctggccgcgctcggcggcaccggacaggcgttcttcagcccggcggccgagggcatgctgatgtcctcggtcagcggcgagcaggcgagcagggccttcgccctcttccggatggcgatgcagggagcggctctcggcggcgcggccctcggcggggcgatggtcgccgcgatcggtcccggctgggtgctcgccgtggacgcggtggcgttcgcggtcgccggctcgctgcggtccttcctcgatgtgagccacattccgccgcgcgagccgggcggcggactgctggccgatctgcgcgacggccgacgggagttcaccggccggccctggctgtggacgatcgtcgcgcagttctccgtggtggtcgcggtggtcggcgccgccgagtcggtgtacggcccgctggtcgcccgcgacagcctgggcggcgcggggccctggggtctggccctgggtgctttcggggcgggcacggtcggcggcgcgctgctgatgacgcgctggaaaccccgccggctgctgctcgcgggcaccctctgcgtcttcccactggccgcgccctccgccgcgctggcggtgcccctgccggtgggcggcctgtgcgcggtcatgttcgtgaccggcgtggccatcgaggtcttcggcgtttcctggatgaccgcgctccatcaggagatccccgaggagaagctctcccgcgtctccgcgtacgactggttcggctccgtcgccatggtccccctcgccacggcgctggcgggaccggcggaacgggccgtcgggcgtacgaccgcgctgtggggctgcgcgacgctggtcgtggtggtcaccgtggcggtgctgttcgtgccggacgtacggaatctgacgcgccggacgaaggcggtggcgcaggaagtgccggagagcggggcggccgacgccgggcgcgggtcagccgatgccgaaggctccgtcgggcggctcggg

SEQ ID NO: 7009 - DNA, 1038 bp, Streptomyces avermitilis
  CDS (1)..(1038)
atgtggccaggacagcagccgcccgggggcgagcagaacccgcaggaccagaacccctaccagcagccggggtaccagcagccgaatccgtaccagcagcctgaataccagcagccgcccggattccagcagccgaacgcctacccgcagcagcccggtcagccggggcagccggggtggggcaccccggcacccgcgggcgcgccgcagtcacccggcggcggtggcggcggtggcggaaaccggaccaaggtcgtcgcgatcgtcgcggccacggccgtggtcgtggccgctggtgtcaccggtttcctggtcctgggcaacaagaaggacgacaaggctgacggcggcaaggacgcgaaggcctcggggagcgcgtccaaggacccgagtccgtccgtctccgccgacaacccgcgcggcggcgacgacgagaagccgaccatcaagggctggaaggtcgtcgtcaaccccaagtggggcacggcgttcgacgtgccggcggactgggaagtgcagtcgcccggcgtgttcatcgccttcgaggacgagtcgggcgagagcaccaagcccctcgtcaccatgaccggtaccgccgtcctcaaagagcagtggtgctcgtccgacgaggacaaggacggcaggaccgaggacacgtcccttgcggcggcgggcaccaagggcgccaacggcgccaagaacaccgacgaggtcgccgtgaaccaggtggcctggtgggtgtacggcggttacacgcagcccgacaagaagagcctgaccttcgacgagaaggcgaagccgtacaagacggcggcgggcatcgagggcagcatcgcctgggcccgttccaagaacacgccccggaaggggaagtgcgcgagcgacggcaaggccatcaccttcgggttcaagaactccgcgggtgactacgtcgcgtggaacttcttcggagccacgggcgtgaacgaggaagtccccgacgcgacgatcatgaaggtcctcagcaccgtgcgactgcacggcgacccgtcggagagc

SEQ ID NO: 7010 - DNA, 966 bp, Streptomyces avermitilis
  CDS (1)..(966)
atgtggccaggagagcagccgcccgggggcgggcagaatccgcagcagccgccggcggacgcggcgcagccgaatccgtaccagcagcccggataccaccagacgaatccgtatgagcaacagccgcagccgcagccgtggaacgcccccacgcagccggcgggtgcgccggtgcctgcgcctgcgggcggcgggaaccggaccaaggtcgtcgcgatcgtcgcggcggcggccgtcgtgatcgccgccgcggtcacgggattcgtcctgctcggcggaggcaaggacgacagggcggaccccgaccccacgaagtccggttccccgcggcccagttcgagcgacccgcgcggcgcggacaccgaccgggccacgatcaagggctggaaggtcgtgaagaacccgcagcggcacatcgcgttcgacgtgccggcccagtgggccctcaaggcgagcagctgggtcacgtacgtgtcggagaacgacgaccccgacgacacgcccctcatcggcatgtccgctccggcgtacctcgaggagcagtggtgcggctccgacgacgacagggacggcaccaaggagtacgcaccgctcgccggcgccgggagccgccgcagcaacggcgcgaagacgcccgcggaagccgcccgcgacgacgcggcgacctgggtctacggcgcctatacccagccggacaagaagctggtcacgtccggtgcggtggagtcgtacacgaccaagtccggcatcacgggcagtctggccaccgcgtcgtcgtcgggtgtggagaaatcgaaaaaatgcaggaccgacggcaaggccacggtgttcgccttcaaggacgacgccggtgacatcgtgtcgtgggcgttcttcggcgccaggggcgtatccgacgaggtaccggacgcgacggtgaagcggatcctcggcaccgtccgcctctacaaggacccgtcggactcc

SEQ ID NO: 7011 - DNA, 435 bp, Streptomyces avermitilis
  CDS (1)..(435)
atgtcgatcggcgagatgctcgccgccaccgtgccgatggccaggaccctgaacctcgagttcctggagacctcgccggagaaggcagtggtggccctgccggaccagagcgactatcacaaccacgtcggcgggccgcacgccggagcgatgttcacgctgggcgagtcggcgagcggggcgatcgtgctggccgcgttcggggagcagctcgcgcgcgccgtaccgctcgccgtcagcgccgagatcgcgtacaagaagctcgcgatggggccggtcaccgccaccgccacgctcggtcgccccgccaccgaggtggtggccgaactcgacgccggccggcgccccgagttccccgtccacatcgccatccagcgcgcggacggcgccgtgaccggcgagatgaccgtcgtgtggaccctgcgccccaacggc

SEQ ID NO: 7012 - DNA, 543 bp, Streptomyces avermitilis
  CDS (1)..(543)
atgcacaggcgcacgtcgaagaagtggccgcgcgtcgtggccgcgggagtcaccgccacggccttcctcgtcctcttcggctccaccggacacgccacgcccaccgccgggcccgtctcctccgcgcccgccccggccaccaccgcactggaccccaccgcctaccggtggaagaacgcgcacggcacccgggaactcgacgggcacggctatttcaagcgctcctgcgtctccttcgccgcctgggcgatccgcgccgacggccacccccacaccgagtcccccgactttctgggtgacgccgggcactggaggggcgccgccaccagctccgtgccccacgtcggcgacatcgcgcagtgggaccccggcgtgcacggcaccggccgccggggccatgtggcgtacgtcgccgcggtgcgcgacgacggccgggtcacgctgtacgagtacaactaccgcagcgagttcaacgaccagcggcccgacgtcctcagcgtccgcgccgccgcggcttccgacgccagccggtatctgcggttc

SEQ ID NO: 7013 - DNA, 1629 bp, Streptomyces avermitilis
  CDS (1)..(1629)
gtgaccgactccgccgctgccgtcttctcctccggtgtcgtcgtctcctccggtgtgatcgacgagttcaccctgcggctcacgctcgtactcttcgtctcggtcgtcgtggtgacgctgttcgcggcgctgctgacggccccacagcgcgacgagatcagcgagttctacctgggcaaccggaacatgtccccgctgcgcaacggcctcgcgatgtgcggggactatgtgtcggccgcgaccctgctgggcagcaccggcctggtcgccctcaccggctacgacggcctgctctacctcggcgggacgaccgtcgcgtgggtcctggtcctgctggtgatcgccgaacccctgcgcaactccggcaggttcacgctcggcgacaccctcgccctgcgtctgccgcaccaccagcggccggtccggctggcgctggccgtcaccaccctcgtcgtcaccaccctctacctcgtggcccagctcgtcggcagcgtcgccctgctgacacagttcgtgggcgagcccagcggcaccacccgcaccctgtgcgtggtcgccatcggcaccgtcgtcgtggtgtacgcctccctcggcggcatgcccggcgcgaccttcatccaggtcgtcaaggcggtgatgctcgtgtccggagtggcgatcacggccttcatggtgctgcaccactaccgctggaacgtcgacgcgctcctcgcggccgccgcggacaacagcggagtcggcgagcgcttcctggcgtcgggactgcgctacgggggcgggacgaccagcaagctggacttcttcagcctgcaactggcgatcgtgctgggcctcgccgccctcccccacgtggcgatgcggctcctggcaccgcgcaccggccgggtcctgcgcgcctcggtcgtctgggccatgggcctggtcgggttcgtctgcctggcggcgggcgtactcggtctgggcgccacggccgtcgtgggccgggacgccatcgcgaggatcgacccgaagggcgacgcggccgtgctgctgctcgcccagtccctcggcggcggtgtcctgaccgcgctgatctccagcctggccttcgtcaccctgctggcggtcgcggccgggctcaccctcgccgcggcctcctcgctcgcccacgacctctacggccaggtgatccgcaagggccgggccacccaggcggaggaactgggcgtcgcccggctgtccggcgtggtcgtcggtgtcctcggcatgctgctcgccctggtgtcctgggagatcagcacggccacactggcgttcctcgccttcgccatcgccgcctcggccatcctgccggtcctggtctacagcctgttctggcggcgcttcaccgggcggggcgcgctgctcagcctctacggcggactgatctgctccgtgctcctggtggtgttctcccccgtggtgtcctccacaccggcctccctctaccccgatgtggacttcgcctggttcccgctgcagaaccccggcatcgtctcgatcccggcaggctttctcctcggctggctgggcagtgttccgggccggcaccaggactccgcccgctacgccgacttcgaagtgcgcgccctcgtcggcaccgaccacgaa

SEQ ID NO: 7014 - DNA, 408 bp, Streptomyces avermitilis
  CDS (1)..(408)
atgtcctggcactccgtaccacaagacagtcttcgtccaccgccccccgccgacccggaactcctgcccacacaggcgatacacgaccaccccgaattccgtgccatgcgccgcgctcaccgaagcttcggggccagggcggcgacgctcggcgtgggcggctatctgctgtacgtcctgctgtccggcttcgcccccggtgcgctgaaccagccgctggcgggccgtatgactgtcggcctcgctctcggcctcgtgcagttcgtcgtcctggccctggtcgcatggcgccacacggtgcacatgcgcaggcgcgtcgacccggtggcgcgcggcctgcgcgcccagctggaccggcgccgggccgagcagccccctctccccggcccgcggcggtaccgctcgtgg

SEQ ID NO: 7015 - DNA, 648 bp, Streptomyces avermitilis
  CDS (1)..(648)
ttgcacgtccaggaatggctcgagacggtgcccgcggtcagcatctacgcgctggtgggcctggtcatcggcctggagagcctgggcatcccgctgcccggcgagatcgtcctgatctcggccgcgctgctgtcctcgcagcacggcggcatcaatccggtgatcctcggcatctgcgccacggttggtgccgtggtcggtgactccatcggctacgccatcggccgcaagggcggacggccgctgctcgcctggctcggcaacaagttccccaggcacttcggcgaagggcatatcgcgaccgccgaacggtccttcgagaagtggggcatgtgggccgtcttcttcggccgcttcgtcgccctgctccggatcttcgcgggcccgctcgccggtgtgctgcggatgccgtactggaagttcctgatcgccaacgtcctcggcggcatcatctgggccggcggcaccaccgccgtcatctactacgtcggtgtcgtcgccgagtcctggctcaagcgcttctcctatctcggcctggtcgcggccgtgctgatcggcctcgcctcgatgctcgtcatcaagcggaaggccaagaaggccgcggccgagcgggaggcggccgagccggagaccgtcccggccgcggac

SEQ ID NO: 7016 - DNA, 534 bp, Streptomyces avermitilis
  CDS (1)..(534)
atgacgcacaaggcgctgatcacgggcatcggcggcaaggatccgaaggtggatcaggaggcgttcacggcgcccacgtccgtggtgatcggcgaggtgacgctgcacgcgggcgcgagcctctggtacggcgcggtgctgcgcgccgactgcggtccgatcgtcgtcggcgcggacagcaacatccaggacaactgcacgctccacgtcgaccccggctttccgatctccatcggcgagcgggtctcggtcggacacaacgccgtggtgcacggcgccacggtggaggacgactgtctggtcgggatgggcgccaccgtcctcaacggggccgtgatcggcgcgggttccctggtcgcggcgcaggcgctggtcccacagggcatgcgggtgcccccgggctcgctcgtcgcgggcgtacccgcgaaggtcaagcggccgctgaccgacgaggagcgcgagggcatcaagctgaacggcacgtactacgtcgaactggcgaagtcgcaccgcgcggtgcacgcgcaggaggac

SEQ ID NO: 7017 - DNA, 762 bp, Streptomyces avermitilis
  CDS (1)..(762)
gtgcccaggagcaagaacacgttctcatcatggcggcgccgcctcgcgcagcgcgccgtccacgcgggctgggcctgggcacaacgaacaggggccgtgagcgccgagcaccccggacggctccgtttcggcgcgatgggaacagctaccagactcgccttcccgcagggcaccgtcttcggtgagccctggatccacctcggctcgcactgcatcatcgccgaacaggtcaccttgaccgccggtctgatgcccgacctcgacctcggccccgacccgatcctgcgcatcggcgacggggtcgtcctcggtcgtggcagtcacgtcatcgccgacaccacggtcacgatcggcagcgactgctacttcggtccctacgtctacgtgacctccacgaaccactcgtacgacgatcctcacgagcccatcggcaagcagtggccccgtatggaacccgtgtcgatcgggtccggctgctggatcgggacgggcgcggtgatcctgccgggcgcccggatcgggcggaacgtcgtggtggccgccggagcggtggtgcgcggtgtggtgcccgaccacgccgtggtggccggggcgcccgcgcgggtcgtacgacgctggacccccgccgacggctggcagccgccgctgcggacgccggcgccggtgccgatccccgaaggggtcacccccgagcagttgctggcgctgtccgaactcgacgacgagagtgccgcccggctcgcggaactcgacgtcgagtcc

SEQ ID NO: 7018 - DNA, 864 bp, Streptomyces avermitilis
  CDS (1)..(864)
atggccgcactgccggcactcttcgccctggccaccagcctgctgtggggcctggccgacttcggcggcggactgctgacccgacgtacacccgcgctgacggtggtcgtcgtctcgcagtcgatcgcggtggtcgtgctcggcgccgtcgtcgtcgccaccggcggctggagcgaggcgggtccgcagctctggttcgccgtcgccgccggactggtcggaccggtcgcgatgctctccttctacaaggcgctggcgctcggcccgatgggcgtggtgtcgccgctcggctccctcggcgtggccgtgccggtgggcgtcggtctcgtcctcggcgagcgcccgggactgttgcagttcgcgggcgtcgcggtcgccgtcaccggtgtcgtgctcgcgggcgggccccagctgaagggcgcgcccgtgcagcgccgggccgtcttcctcaccctgctggcggcggtgggcttcggcgcggtcatgtcgctgatctcggaggcctcgacgacggtcaccggtctcttcctggcgctgttcgtgcagcgcgtgaccaatgtggccgcgggcggcgccgcgctgttcatcgccgtgcggcgcggcgcccccgcccttcctgagagcggcttcccctggcgtgcgctgcccgcgctcggcttcgtcggcctggccgatgtcgccgccaacggcacgtactcgatcgccgcccagcacggcccggtcaccgtggccgccgttctcgcctcgctctacccggtgatcacggccctggccgcacgcggcttcctcagcgaacggctgcgcggcgtgcaggcggcgggcgcgggcctcgcactggtcggcacactgctgctcgcgacgggc

SEQ ID NO: 7019 - DNA, 603 bp, Streptomyces avermitilis
  CDS (1)..(603)
ttgaactctgtcatccagaatattggacggaatgtgtcggacctcgacctgctgactcagtccctggcgcgcaatgtgaagcgctggcgcaccgagcgcggcttcaccctggacacgctcgccgcgcgggccggggtcagccgcggcatgctcatccagatcgagcaggccaggaccaaccccagcatcggcaccgtcgtcaagatcggtgacgcgctcggtgtcagcgtcacgacgctgctcgactacgagcaggggccgaaggtccgtatcgtcccggccgaccaggccgtacggctgtggcacaccgacgccggcagctacaaccggctgctcgcgggcaccgaggcgcccggcccgctggagatgtgggactggctgctgatgccgggcgagggcagcccctccgacccgcacccgaacggctcggtggagctcgtccatgtgacggccggggagctgaccctcaccgtggacggcgtggtgcaccacgttccgacgggcgcgagcgtctccttcgaggccaacgtgccgcacaggtacgcgaattcgggtgacgcgccactggagatgatcatgacggtgtcggtcccgccggtgcgc

SEQ ID NO: 7020 - DNA, 552 bp, Streptomyces avermitilis
  CDS (1)..(552)
atgcgcgcacccatcggagacttcgaccacgccacgcccgccccggacagcctcgacgaactcacccgcccggtcgccgacgccgtacgccactggcgcggcagcgtccccgccgaccggatcgtgtacgtcgacaccgaaccggagtgggccgacacggccgtcttcctggagcactacggcaaggacctgctcgaccggtcggccaactgcgtggtcgtcgcgggcaggcggggcggcgagaccgtgctggccgcatgcgtggtcctctccgccacgcgcgtggacgtgaacggcgcggtccgccgccgactcggcgcgcgcaaggcctcgttcgccccgatggacacggcgacgggggagaccgggatggagtacggcggcatcaccccgatcggactgccgggcggctggccggtgttggtggactcggcggtcgtcgatcttccctacgtcctggtcggcagcgggcggcggagggggaagctgctggtgcccggcaaggcgttcgcggagcttccgaacgcggtggtgctggaggggctcgggatc

SEQ ID NO: 7021 - DNA, 1173 bp, Streptomyces avermitilis
  CDS (1)..(1173)
gtgaccgaccggcaccaagcccacagccacggccccgatcacggaccggaccgggcacacacgcacgcacacgcacacccccacgcacaccccgacgcacagccccacgaccgttcccgcgaccacggaccggaccgggcacccgcccacgaccacgctcaccaccacagacccaccaccctcctcccgcgtctgcgccacctcctcaccccccactcccacgaaaccgccgacaagctcgactccgccctggagtcctcggcccgtggcatgcgggcgctctgggtctcgctggccgtgctcggggtgacggcggccgcccaggcggtcgtggtggtgctctccgggtcggtcgcgctgctcggcgacacggtgcacaacgccgccgacgcgctgaccgccgtaccgctcggcatcgccttcgtcctgggccggcgagcggcgacgcgccggttcacctacggctacggtcgcgcggaggacctggcgggcatcgcgatcgtactgaccatcgcggcgtcggcggtcttcaccgcgtgggcggccatcgaccggctgctggagccgcgaccgctgaaccatctgcccgtcgtcgccctcgcggccgtcatcggcttcgcgggcaacgagtgggtcgcccgccaccgcatccgtgtgggccgcgcgatcggctcggccgccctcgtcgcggacgggctgcacgcgcgtacggacggattcacctcgctcgccgtgctcgtgggcgcgggcggcgccgcgctcggctggccggcggccgacccgctggtggggctggccatcacggcggcgatcgcgctggtgctgcgggacgcggcgcgcgaggtgttccggcgggtgatggacgccgtcgacccggcgctggtggaccgggccgagcgggcactggaggaggtgcccggcgtacgcgacgtcggtgagctgcggttgcgctggatcgggcaccggctgcgggccgaggtggccgtcgtcgtcgacggcgaggtgagcgtgcgccaggcgcatcacatcgcggtcgaggcggaacacgccctcctgcacgccgttccgagactcaccgccgccctggtgcacgccgatccggcaccgctgccgggcgagacggacccccatctggcgctcgcccaccacaccgatccctcggtgacggcggcc

SEQ ID NO: 7022 - DNA, 375 bp, Streptomyces avermitilis
  CDS (1)..(375)
atgcacctaccacctgcgcatggtgcgcactcgcgcacgggcggcgagcccgaggcgcacccacgaacccccggcgaggagcagttcgtactcgccgccgaactcctcgccctgctcgcggaccgcacccgtctcgccctcctgcacgccctgactggtggggaggcggacgtctcgacgctcacgcaggtgtgcggcgcggcgcgtcccgccgtgagccagcacctggcccggctccggctcgcgggtctggtgaacacgcgcaaggagggccgccgcgtgatctactccctgcgcgacggtcatctgcgccgggtcgtggacgaggcgctgagcctcgccgaccaccgcctcagcgaccggcccgcgcatgac

SEQ ID NO: 7023 - DNA, 558 bp, Streptomyces avermitilis
  CDS (1)..(558)
atgtccgtacgtatcctcgcgctcgtcggcagccttcgcgccggttcgcacaaccgccagctcgccgaggccgccgtcaagcacgcccccgagggcgtcgagatcgagctcttcgagggcctggccgacgtgccgttctacaacgaggacctcgacgtcgagggcgacgtgcccgcggccgccgcccggctgcgtgccgcggccggcgcgaccgacgccttcctgctcgtgtcgcccgagtacaacggcacgatcccggccgtcctgaagaacgccatcgactggctgtcccgcccgtacggcgccggtgcgctgtccggcaagccggtcgccgtggtcggcacggccttcggccagttcggcggcgtgtgggcgcaggacgacacccgcaaggccgcgggcatcgcgggcggcacggtcctggaggacgtcaagctgtccatccccggctccgtgacccgcttcgcagagctccacccggccgacgacgccgaggtcgtcgagggcctgaccaaggtcatcgagcagctcagctcgcaggccgcgcccgccgcggcc

SEQ ID NO: 7024 - DNA, 669 bp, Streptomyces avermitilis
  CDS (1)..(669)
atgacccagctgctcccgcccttccccgcaccgcaggacgaccccggcgggcgaacggacctcaccctgacgcccggtggcgagacgccgcagctcagggcggacgccgcccgcaaccgcagccgtctgctggaggtcgccgcccgcctggcggccgagcgcggcgccgcgaacgtgaccatggaggccgtcgcctgcggcgcgggcgtcggcaagggcacggtcttcaggcggttcggcgaccgcacgggactcctcgaggccctcctcgaccaccacgagaagcagctccaggccgccttcctcaccggcccgccgccgctcggcccggacgcccctccggtcgagcggctgcgcgccttcggctcggcggtgatccgccgcgaacacacgcacagcgacctgtacctggccgcccacgcggaggcggcgcgacgccacacggctccgccgtaccagctccggctcacccacgtctgcctgctgctgcgccaggcgcggacggagggcgacatcgaactcgtcgcgcacacgctgctgggctacctggacaccatcctcgtcgaccatctgctcacccggcgcggcatgaccctggagcgggtcgaggccggctggtacgacctcgtcgaccgatgtacgggcgggcagagccgatgtagtacgggg

SEQ ID NO: 7025 - DNA, 549 bp, Streptomyces avermitilis
  CDS (1)..(549)
atgaccaccccgggcagaagagccgagatgttcgtcgccgccgaccgcgatccccgcgtcctcggccccgcgaccggtaccgaacgcaccctgctcgtcgacttcctggccgcccagcgcgcgacgcttgagctcaagtgctcaggcctggaggcggagttgtcgcaacgctccgtggcaccctccaccctctcgctgctcggtctgctgcgccatctcgccgacgtcgaacgccgctggttccgtcaggtcatggccgcacaggacgcgccgccccgcttctcctcgccgtccgaccccgacggcgacttcaccggcgccgtccccgacctgtccgtggtcgccgaggcctggcgggcctggcgctccgaggtcgccttcgccgaggactacgtcgccgaggcgccccacctcgacgtcgagggccacgactcctggcgcggcaccgtctccctgcgctgggtcctcgtgcacatggtcgaggagtacgcccgccacaacggccacgcggacctgctgcgcgagcggatcgacggggcgaccggagtg

SEQ ID NO: 7026 - DNA, 1113 bp, Streptomyces avermitilis
  CDS (1)..(1113)
gtgcagcctttgccgatcagcaccgcgatgcgtttgactgcggtggaggcacccgacgcgagggggaaggcgcacgacatgagcgaccacggccatgaccacggcccgcacggccataccgggcactccgggcactccgggcacgccggtcactcccacggagtgtcggcggacgccgaccgccggtggctggggatcgcgctcgctctgatcaccctgttcatggcggccgaggtggtcgtcggtgtcgtcgcgagctcgctggccctcatctcggacgcggcgcacatgctcaccgacgccgcctcgatcgtgctcgcgctgatcgcgatgcgactggccgcgcgcccggccaagggcggcttcacctacggactcaaacgcgcggagatcctctccgcccaggccaacgggctgacgctgctcctgctgggtgtctggctggcgtacgaggccgtacgacggctcgtcgagccgcccgacgtcgagggcggcctgatgctgatcaccgcgctcgccgggatcgtcgtgaacgtggccgccgcctggtgcatctccaaggccaaccgcacctcgctcaatgtcgagggcgcctaccagcacatcctcaacgacctgttcgccttcatcggtaccgcgatcgccggcctggtcgtcgtcgtgacgggcttcgcccgcgccgacgccatcgccacgctcgtggtcgtggtcctcatggtcaaggccggctacgggttgctgcgcgactccggccggatcttcctggaggccgcaccggccgacgtggacccggacgcgctcggcgacaagctcgtcgcgcaggcggccgtcgtcgaggtccacgacctgcacgtctggcagatcacctcggggcaggccgccctgtcggcccacgtcctggtgcagcccggcagcgactgccacgcggtccgccgcgacctcgaggaactgctgcgccaggactacggcatcacccacacgacacttcaggtcgaccacatcccggaacagctcctccaggtggccctgcgcggcgaccggatcccgccggacggcgcgccgcactgcgaggacgcccacgggccggtccaccgggaggagccgcacggacac

SEQ ID NO: 7027 - DNA, 405 bp, Streptomyces avermitilis
  CDS (1)..(405)
gtgtacggcgactcagcaacgacccgcaagatcctgaccgagctcggtgacacctgggcgatcgtcggcctgtcctcgaaccggcatcgggtggcgtacggggtggcggacgtccttcagcgcttcggcaagcgcatcgtgccggtgcatccgaaggccgagacggtccacggcgagcagggctacccgtccctggaggcgatcccgttcccggtcgacgtggtcgatgtgttcgtcaacagcgatctggcggggcccgtcgccgacgaggccgtgacgatcggcgccaaggccgtgtggtaccaactcggggtcgtcgacgaggcggcgtacgagcggacgcgggaagcgggcctggacatggtgatggaccggtgcccggcgatcgagatcgggcgcctgcgt

SEQ ID NO: 7028 - DNA, 810 bp, Streptomyces avermitilis
  CDS (1)..(810)
gtgtcggaggcgcacacgggcgcgccggtgggacgcgcgcgcgagcttggacggcgtacgcatgtccggaacggtccccacctccctgcgcccgagggccctggcgcctacgctcaccccgtgctgcgtatcaccgacgccggaaccggcgagcccaccgacgtccgaccaggcctgaccaggatccacgcgcatgtggcgcgggccgacacgtccgccctgcgcgtgctgctcgtcgccgacgtgctcgcccgtgccctcgaactcggcgggacccccgtcgtcatggtcgccgacccgcccgccgaactccgggcgcgcgccgacgcgctcggcatccggcgcgcggagaccgacaccctgggcggcgggcggatcctgcacgtgctcggtcccgaggaccccgtcgtggacggcatccgcgtcgaggtcgccccggcgggcggtccggccgactccgccgagtctgccgggtcctcctccgccgtacgcctcgccctgctcgcccacccccgcagcagccccgccgacctcgacagcggcgcgctgaccgaggctcaggagacgctcgcacgctggcgcaagaccgtcgccctgtgggcgaaccacccctccaagcccatccccgaacacgtacggcaggaactgcgcgccgcctgggaggacgacctcgacctcccggcggtcctggacgtgctgcgacgactggagggcgccgacgacgtgccggacggcgcccgattcgagtcgtacgcctacgcggaccggctcctcgggctcgaactcacccgggagatcggggcatgggca

SEQ ID NO: 7029 - DNA, 546 bp, Streptomyces avermitilis
  CDS (1)..(546)
atgaacgcgccgcgccccggcacggggccgctgcgcagactcgtggtgcttcggcacgccaagtccgcctggcccgccggggttgccgaccacgacagaccgctcgcaccgcgcggccgccgggacgccccggccgccggacgtgtgctcgccgaggccgacctcctgcccgacctcgccctgtgctccaccgccgtacgcgcccgccagacctgggagctggccgcggcgcagtggggcaccccgccggccgtacggctcgacgcgcggctgtacgcggccgacgcgccggacctgctcgcggcggtgcgcgaagtgcccggccaggtggggacgttgctgctgatcgggcacaacccggggctcgaggaactggtcctcgaactggccggggacggcgtcgacgacacactggaccgcctcggcgtcaagttcccgacctcggcgatcgcggtcctggcctggcacggcgagtcctggcagaccctggcccccggcacggcactcctgacggagctgaccgtcccccgaggccacaagcaccgc

SEQ ID NO: 7030 - DNA, 1974 bp, Streptomyces avermitilis
  CDS (1)..(1974)
gtggacagtaaggacaccgccgagcccgacgaaccagggccctccgccgccacgccccgctggcgggcctggctcctggagggcctgagcgagcagacggcccggcacccgggcccgcacgccacgaccgacgaggggcacgcggggcaccggtggtggcgggtcatgtgtctgaccggtgtggactacttctccacgctcggctaccagcccggcatcgcggcgctcgcggccggcctgctgtcgccgctggcgacgctcgtgctggtcgcgctgaccctgctcggcgcgctgccggtctaccgccgggtcgcgcacgagagtccgcacggcgagggttccatcgccatgctggagcggctgctgccctggtgggcggggaagatcttcgtcctggtgctgctcgggttcgcggccaccgacttcctgatcacgatcacgctctccggcgccgacgccgcggcgcacgtcgtggagaatccgttcgctccgcactggctgcacggcgcgaacacctggatcacgctcgtcctcgtcacggccctgggggcggtcttcctcaagggcttccgtgaggccatgggcatcgccgtgacgctggtggcgacctatctcacactcaatgtcgtcgttctggccgtctcggcgtgggaggtgctgagccacccggtcaagatcggcgactggaccgacgcgatgacgacggaacactcctctccgctcgcgatggccgccgtggcgctgctcgtcttcccgaagctggcgctcggcatgtccggcttcgagacgggcgtcgcggtgatgccgcaggtcgagggcgaccccacggacacctacgagaagccgacgggccggatccgcgacacccgcaagctgctcaccacggccgccgtgatcatgagctgcttcctgctgctctccagtctggcgacgacgatcctgatcccgcaggacgagttcaggagcggcggcgccgcgaacggccgcgcgctggcgtatctcgcgcaccagcacctgggcgaggccttcggcacggtctacgacgtcgcgaccatcgcgatcctctggttcgcgggcgcctccgcgctcgccggactgctcaatctcgtgccgcgctatctgccgcggtacggcatggccccggaatggacccgggcggtccgccccctggtgctggtcttcatggcggccgcggtcttcatcacgctgtggttcaacgcgaacgtcgacgaccagagcggcgcgtacgcgaccggcgtcctggtcctgatgctctccgcgtccttcgcgtcgacggtcgccgtgcacaagcgcggccaccggggcgccgcgaccgggttcggtgccatcaccgcggtcttcgcctacacgctggtcacgaacgtgatcgagcggccggacggcatcaagatcgcggcgatcttcatcctggccatcctgatcacctcgttcgcctcccgtgtgcgccgggccttcgaactgcgggccgccgccgtcacgttcgacgagacggcctcccggttcctcgacgaggccgcggcgagcgggcctctccggctgatcgccaacgagccgcaggaacacagcacgcgcgagtaccgcgccaaggagtacagccagcgcgagcagacccacatcccggacgggcgtccggtgctcttcctggaggtcttcgtcacggactcctcggacttcaccgccgatctggccgtccacggcgacgagaagcacggggtgcgcaggctgcgcgtggagggcgcgaccgtgcccaacaccatcgcggccgtcctgatgcagctgcgggaccgcaccggtgaggtcccgcacgcctacttcaactggaccgagggcaacccgttcagccaactgctgcgcttcctcgtcttcggcgacggagaggtcgccccggtcacccgggaggtcctgcgccgcgcggaacccgatccgcaacgccggccccgggtccacgtgggc

SEQ ID NO: 7031 - DNA, 624 bp, Streptomyces avermitilis
  CDS (1)..(624)
atgcaggacgagtaccgcacagtcgcccacgcgggcgtgcacgagaccgagatcaaccgctcccgcttcctgtgcgccctcgccccggcggccaccgagcaggaggcccaggacttcatcgcggccgtccgcaaggagcacgcggacgccacgcacaactgctacgcgtacgtcatcggcgccggtgccgccgtccagaaggcgagcgacgacggggaaccgggcggcaccgcgggcgtccccatgctgcagatgctgctgcgccgggacatgcggtacgtcgtcgccgtcgtcacccgctactacggcggggtcaagctcggcgcgggcgggctcatcagggcgtacgggggagcggtgggcgaggcgctggacgtgctcggaaccctcacgcgcaaacgcttccggctcgccacggtgaccgtcgaccaccagcgggccggcaaggtgcagaacgacctgcggtcgaccggacgcacggtgcgtgacgtgcgttacggggaggcggtcacgatcgagatcggcctcccggacgccgacgtggacgccttccgctcgtggctcgccgacgccaccgccggcacggccggcttcgaactgggcggcgaggcatacggggacgcc

SEQ ID NO: 7032 - DNA, 1494 bp, Streptomyces avermitilis
  CDS (1)..(1494)
atgaaccgttcagctcgcacgaacgaccgcttctccaacacccgtaagaaggatggctccgccggttccggccggggcgcccgctcgggtggcaacgggcgccgtccctccacaccgcagggggagttcgcgttgccggtcaccgtcacgccggccctccccgcggctgcgacgttcggcgagctggacctccccgccgagttgctgaagacgctcaccagcctcggcgtgaacgagccgttcccgatccaggccgccaccctgccgaactccctggcgggccgcgacgtcctgggccgcgggcggaccggatcgggcaagacgctcgccttcggcctggcgctactcgtgcgcacggccggacagcgtgccgaggcccggaagccgctggccctgatcctcgtccccacgcgcgagctggcccagcaggtcaccgacgcgctcactccgtacgcccagttgctgaagctgcggctggccaccgtggtcggcggcatgtcgatcggccggcaggcgagcgcactgcgcgccggggccgaggtcgtcgtcgcgactccaggccgcctcgccgatctcatcgagcgcaaggactgccggctggaccgggtgagcatcaccgtcctggacgaggccgaccagatggccgacatgggcttcatgccccaggtcaccgaactgctcgaccaggtacgccccgacggccagcggatgctgttctcggccacgctggaccgcaacatcgacctcctggtccgtcgctacctccatgacccggtggtccactcggtcgacccgtcggcgggcacggtcaccacgatggagcatcacgtgctgcatgtgcacggcaccgacaagttcgccaccgccaccgagatcgccgcccgcgacgggcgcgtgctcatgttcctggacaccaagcacgccgtcgaccagttcaccaagcacctgctgggcagcggcgtgaaggccgccgccctgcacggcggcaagtcgcagccccagcgcacccgcaccctggcgcagttcaggaccggcgacatcacggcgctcgtggcgaccaatgtcgcggcccgcggcattcatgtggacgatctcgacctcgtcgtcaacgtcgacccgccgagcgaccacaaggactacctgcaccgcggcggccgtaccgcgcgcgccggtgagtccggcagtgtcgtcaccctggtcctgcccaaccagcgccgtgagatggcgcggctgatgtccgatgccggcatcaggccgcagatcactcaggtccgctcgggtgaggccgagctgagccgtatcaccggcgcccaggcgccctccggtgtccccatcgccggcagcgggccggtcacggagcgccccaagcgcggcggtgcccccttccggggtatgggcactcgcccgggccgcgccggtggtgagtcccgccggtccgccgaggcccggcagacggccgaggcccgcaaggccgcccggatccgtcgcggcgcg

SEQ ID NO: 7033 - DNA, 1161 bp, Streptomyces avermitilis
  CDS (1)..(1161)
ttgaggattctgcacacgtccgactggcatctgggccgggcgttccaccgggtgaacatgctcggtgcccaggccggtttcatcggccatctcgtcacgaccgtgcgtgagcgcggcgtggacgcggtggtcgtgtcgggggacgtgtacgaccgggcggtgccgccgctggccgcggtcgagctcttcgacgacgccctgcaccggctggcggacctgggcgtgcccacggtgatgatctccgggaaccacgactcggcgcgccgactgggcgtgggcgccggcctcatcggccgcgccggcatccatctgcggaccgaggtctcggcgtgcggtacgcccgtgctgctgtccgacaccttcggcgacgtcgcgttctacgggctgccgtatcttgaaccggccctggtgagggaccagttcggggtggagaaagcggcccacgaggccgtgctcgccgccgccatggaccgggtccgggccgacctcgccacgcgcccgccgggcacccgttccgtcgtcctcgcccatgccttcgtcaccggcggcgaggccagtgacagtgagcgggacatcacggtcggcggggtggccgccgtgcccgccggggtcttcgacggcgtcgactacgcggcgctgggacatctgcacggcagccagaccatcaccgagcgcgtgcgctactcgggctccccgctgccctactccttctccgaggccgagcaccgcaagagcatgtggctcgtggacctgggggccgacggctcgatcgaggcggagcgggtcgactgcccggtgccccgcccgctcgccaggatccgtgggccactggaggaactgctcgccgaccccgggctgacgcgccacgaggaggcgtgggtcgaggccacgctcaccgacccggtgcgccccgccgagcccatggcgcgactgaccgagcgtttcccgcacacgctcagcctcgtcttcgacccggagcgggcaccggaggacccggacgtctcgtacgcgcggcgcctggctggccgcagcgaccagcagatcgcggaggacttcgtggcccatgtgcgcggcgccggacccgacgcgcgcgaacaggccgtgctgcaggacgcgttcgacgccgtccgcgccgacgaggcggtccgggaggtcgcccgc

SEQ ID NO: 7034 - DNA, 2997 bp, Streptomyces avermitilis
  CDS (1)..(2997)
atgaggctgcaccgcctggacatcaccgccttcggccccttcggcggcgcccagaccgtcgacttcgacgacctctcggccgccgggctcttcctgctgcacggaccgaccggggcgggcaagacgtccgtcctggacgccgtctgctacgcgctgtacggggccgtgccgggcgcccgccagagcggccagggcatgaccctgcgcagcgaccacgccgcgccgtccacccgtaccgagatccggctcgaactcaccgtcgccggacgccggctggagatcacccggcagccgccctgggcgcgccccaagaagcgcggcgccggtacgacgaccgacaaggcccagagccggctgcgcgaacacgacgcggcggcgggctcctggaaggacctcagccgctcccaccaggagatcggtgaggagatcacccagctgctcggcatgagccgggagcagttctgccaggtcgtgctgttgccccagggcgacttcgcacgcttcctgcgcgccgacgcggaggcgcgcggcaaactgctcggccgcctcttcgacacccaccgcttcgcggaggtcgagaagcggctcgccgagcggcggcgggcggtcgaggccgaggtgcgggccggggacgccacgctgctcgccgacgcgcaccgcatgcagcaggccgtcggggacgtcgtcgaggtgccgctgcccgacctcgcgcccggcgacccaggactcgccgagaccgtcctcacctgggccgccgtcgcccgctccaccgcccgcgagcggctgaccctggcccactgcgcgcgtacggcggcggagtccgcgcaggccgccgccgaccgcgtactcgacgacgtacgcgaagtggcacgccttcagcgcaggtacaccgaggcgcgcgagcgcgccgcgctgctggaggagcgctccgacgcccaccgggaggcgcagacgcggatggagcgtggccgcaaggccgaggcggtggcccccgcgctcgatctgcgcgacgccgccgaggccgagcaccggcgcgcggccacggacgaggcacgcgcgcgcaccgccctgcccgagacgttcgccgacgccggcgcgcccggcctcgcggcggcggcccgcaaggcggccgaggaactgggcggcctggaatccgcccgccgggccgagcgccggctcggtgaactcaccgaggagcgtgcctccctggaccgccaggagcgcgccgacgacgacgtcctccaggacgccgagagctggctcgccacctgggaggcgacccgcgccgacctccaggccggcatcgagtccgcgcaggaggccgcgacgcgcgccgagcagctcgccgtgcgccgcgaccccgcccaggcccgcctcgcggccgcccgtcggcgcgaccggctctcccaggacacggacgaggcccgggcccgtgccctcgccgcccgcgagcacgcgacggacgcccgggtccactggctcgacctgaaggaacagtgccttcagggcatcgccgcggaactcgccgccggtctcgtcgacggcgctccctgcgccgtgtgcggctccctcgaccatccggcgcccgcgcggaagatcaccgggcatgtcgaccgggagaccgaggagcgggccctcaccgcctaccagcgcgccgacgagacggccaccgtggacgagcggcgactcggctccgtacgcgaggagctggccgccgcgaccgcggaagcgggcgacgcgccgaccgcccacctcgcccaggaggcagcggagctggagcggcagcatgccgaggcgcgcgccgccgcctccgggctgcacaccgcgcggcagcggctcgcacaggccgagctcgaacacgaacggcgggtcgccgaccagcagcaggccgccctgcgcgccgccgcccgggtctcccaccgggacacgatcgaccgggaaagggcctcgctggaggaggagttggcaaaggcccggggcgccgccgacagcgtcgccgcgcgtgccgcgcagctggagcgccggaccgccctgctcacggacgccgcggacgccgtgcgcacggccgaggacaccgcgcagcgcctcaaggacgccgacgcgcgcctggccgacgcggccttccgcgccgggttcgacaccccgggggacgcggccgccgcgctcctcgacgacgcggcccaccgcgacctccaacggcgcctcgacgcctggcagtccgaggaggccgccgtacgcgcggtgctcgccgaggccgacacggccgccgccgcgcggcagccggccgccggcctggccgccgccgaagagaccgccgagctggccgcccggcggctgcgggacaccgcctccgcccaggacgcggccgctcggcgctgcgccgaactggaccggctgtccacgcgcgcgctcacgtccgtacgccggctggcgccgctgcgcgaggagcacgaccgggtggcccgtatggccggactggccgcgggtacctccgcggacaacgagcggaagatgcgcctggagtcctacgtcctcgccgcccgtctggaacaggtggcggcggccgcgaccgcgcgcctgcgacgcatgtcgtcggggcgctacacgctcgtccactccgacgaccgggccggacgcggacgcagcggtctcgggctgcatgtcgtggacgcctggaccggccgcgagcgggacacggcgacgctctccggcggcgagaccttcttcgcgtcgctggctctcgccctcggcctcgcggacgtcgtcaccgacgaggccggcggggtgcgcctggacaccctgttcatcgacgagggattcggcagcctcgacgaccagaccctcgacgaggtcctcgacgtactcgactccctgcgggagcgggaccgcagcgtcggcatcgtcagccatgtcgcggatctacgacggcgcatcaccgcgcagctggagatcgtgaaggggcggacgggttcggtggtacgacagcggggcgggctg

SEQ ID NO: 7035 - DNA, 444 bp, Streptomyces avermitilis
  CDS (1)..(444)
atgaccacgtattccccggacgccaccgactggcgcatcctcgatgtcctccagcgcgagggacgggccagcttcgccgagctggcccgtgccgtctccatgtcctcgagcgcggtcaccgagcgggtgcggcggctggaggaggccggcgtgatccagggatacgcggcggtcgtcgacccggacagcctgggcctgccgatcctggccttcgtccggctgcgctacccgaacgggaactacaagcccttccacgacctcgtcgccgtgacgcccgagatcctggaggcgcaccacgtcaccggcgacgactgcttcgtcatcaaggtcgccgcgcgctcgatgcgccatctggaagaggtgtcgggcaagatcggcgctctggggtccgtgacgacgagcgtcgtgtactcgtcaccgctgccccgacgcccgctgggtcgc

SEQ ID NO: 7036 - DNA, 684 bp, Streptomyces avermitilis
  CDS (1)..(684)
gtgaatcactccttcaggacggggatcaccggccgtagattctcagccatgagggtcccgtacggccggagcaggcgaacgcaccggaacggcggggcagggagggaaggcaccacgatgaccaccacgacgacgcccaccacgacgacccccacatcgcccccgaccgtgaaggccccgaccgtgaaggcccccaccgcgaagaccgccaccgcgaagaccgccgacaaccccgtactccgcgtcgcccccgcctccccggccgcggccgccgcctacttcggcgcgagcctcgccttccacgccgacgtgtccgatgtcgccaccgcactggcggccggcggcgaccccggcttcgtggttctcgactcgcgctccaccgcgtcctgggaccagggccatgtgcccggcgccgtccatctgcccaccgcgctcatcccggagcaggccgagcagctcctggacaggtccgtaccggtcgtcacgtactgctggggccccggctgcaacggcgcgacccgggccgccctggccctcgccgaactcggcttccaggtcaaggagatgctgggcggcttcgagtactgggtgcgcgagggcttcgagtacgagacctgggagggccgcgaccaccgcgtcgccgacccgctgacggcgccggtggacgcggacgactgcggctgc

SEQ ID NO: 7037 - DNA, 222 bp, Streptomyces avermitilis
  CDS (1)..(222)
atggccagttgcacggatgcgggtgtcggcgcggtcgcgtgggtggagtcgggcggcggcccgctcatcgccgtacccgaggtggtgctcccgttctgggcgggggcggacggcgacgaactgtccaccgactacgaccgcgcctgcgacgtcgacgcgttcatcggcctcgtccctgtcggcgacacccgggccctggtcctcggcgacgaccccgggtcg

SEQ ID NO: 7038 - DNA, 1689 bp, Streptomyces avermitilis
  CDS (1)..(1689)
atgtcagagacgaagagcccgctgccccgcgaggtcgccgacgcgtatgtcgacgacctcatcgccctcgatccggtcacgggtacgtatctcggtgacaaggcaagcgccggcaagctgccggacttctcgcccgcgggccacgaggccctggcgaagctgacgcggaccacgctggcacgtctcgacgaggcggagcggcagcccggcgcggacagcgacatcgagcgccgctgcgcccggctgctgcgtgagcgcctcaccgcggaactcgccgtccacgaggccgacgaggggctgcgggcggtcggcaacatggactcgcccgcgcactcggtgcgcgaggtcttcacgatcactcccacggacacggacgaggactgggcctcggtcgccgagcggctgcgcgccgtgcccgccgccctggcgggctaccgggagtcactcgccctcggcctggagcgcaagctgtacgcggggccgcgccccaccgcgacgttcatcgggcagctcaccgagtggtcggacacggacgggcagggccgcggctggtacgaggacttcgtggcgtcgggccccgagtcgctgcgcacggagctggacgcggccgcgcgcaccgcgaccggggccctggtgtccctgcgggactggatgcgcgacgtctacgcgccgacgatcgagggcgcgccggacacggtcggccgtgaacggtacgcgcgctggtcgcgctactacaacggtacggacctcgacctcgacgaggcgtacgcgtacggctgggccgagtaccaccgcctcctcgccgagatgaagaccgaggccgagaagatcctgccgggcgccgagaccccgtgggtggcgctcgcgcacctcgacgagcacggcgcgcacatcgagggcgtcgacgaggtacgcgactggctccaggcactgatggaccaggcgatcgaggcgctcgacggcacgcacttcgaactcgccgagcgggtacggaaggtggagtcccgcatcgcgccgcccggcagtgcggcggcgccgtactacacggccccctcggaggacttctcgcgccccgggcgtacctggctgccgacgatgggcctgacccgcttcccggtgtacgacctcgtgtcgacctggtaccacgagggcgtccccggccaccacctccagctcgcccagtgggcgcacgtcgcggagaacctctcgcgctaccaggccacggtcggcggggtcagcgccaactgcgagggctgggcgctgtacgcggagcggctgatggacgagctgggcttcctcacggacgcggagcagcggctcggctatctggacgcccagatgatgcgcgcggcccgcgtcatcgtcgacatcggcatgcatctggagctggagatcccggcggactcgccgttccacccgggtgggcgctggactcccgagctggcggaggagttcttcgccgcgcacagcagccgcccggcggactacgtggagagcgagctcacccgctatctctccatcccgggtcaggccatcggctacaagctcggcgagcgggcctggctgctgggccgcgagaacgcgaagaagcgtcatggcgacgccttcgacgcgaaggcatggcacatggcggccctgtcccagggctcgctgggcctggacgacctggtcgacgaactgtcgcggctg

SEQ ID NO: 7039 - DNA, 462 bp, Streptomyces avermitilis
  CDS (1)..(462)
ttgttgcggctgttgcagaacgacgcccggacgacgtaccgcgacctcgcggcgcaggtcggggtggcgccctcgacctgtctcgaccgggtgacgcggctgcgccgcgcgggagtcattctcggccatcaactgcgactggacccggcgaaactggggcgggggctggaagcgctgctgtcggtgcaggtcaggccgcatcggcgggagttggtgggccccttcgtggaccggatccgggcgctgcccgagtcgcgtaccgtcttccacctcaccggccccgacgactacctcgtccatgtcgcggtcgccgacatggcggatctgcagaggctggtcctcgacgagttcacgtcgcagcgcgaagtggcccgggtcgagacccggttgatcttccagcagtgggactgcggtccgctgctgccgcccgggccgcaggtcacgccctcggcgaaatcaggc

SEQ ID NO: 7040 - DNA, 1239 bp, Streptomyces avermitilis
  CDS (1)..(1239)
gtggacgacggccggggcgccggcggcttcgggggcgggcccgcggtgcgggcgctggacaccgaggccgtgcacgccgggcgggacgacctcgcccggcagggtctgcacgccgcgccgatcgacctgtccacgacctacccctcgtacgacagccgtgcggaggcggcccgcatcgacgccttcgccgccgacggcgcggagccggccgggccgcccgtctacggccggctgggcaacccgaccgtggcccgcttcgagaccgccctcgcccggctcgagggcacggacagcgcggtcgcgttcgcgagcggcatggcggcgctgagcgcggtgctgctcgtacggaacgccatgggcctgcggcatgtcgtcgccgtacggcccctgtacggctgtagcgaccatctgctgaccgccggactgctcggctccgaggtgacctgggtcgacccggcgggcgtcgcggacgccctgcgccccgacaccggtcttgtcatggtggagtcaccggccaacccgacgctggccgaactcgatctgcgggcgctcgcccacgcctgcggctccgtaccgctgctggcggacaacaccttcgccacccccgtgctgcaacgccccgccgaacacggcgcccggctcgtgctgcacagcgccaccaaatacctgggcggccacggggacgtgatggccggagtggtggcctgcgacgaggagttcgcccgggggctgcgccagatccgcttcgcgacgggcggggtgctccatccgctcgccggctatctgctgctgcgcggtctctcgacgctcccgatacgtgtacgggccgcctcctcgaacgccgccgaactcgcccgtcggctcgccgccgacccgcgggtcgcccgcgtccactatccccgcatcggcggcgccatgatcgccttcgaggtgtacggcgatccccatgaggtcatcgccggggtccgcctgatcacccccgccgtgagcctcggcagcgtcgacagcctcatccagcacccggcgtccatcagccatcgcatcgtggacgcggcggaccgccggggtgccggagtgagcgaccggctgctgcggctgtcggtgggcctcgaggacgtcgaggacctgtgggcggacctggacggggcgctggggacggaccggctccccgagacggcgggagcgggccgcgaaccgtcgcggaccgcgctccggctcccggagcgggccgcggaccga

SEQ ID NO: 7041 - DNA, 1431 bp, Streptomyces avermitilis
  CDS (1)..(1431)
atgactccagacatgtctgatgtgacccgtgcgaagcacgggcgtccggtccaccactggcggcgggacgtcgtcgaactcgccgcgctgttcacggcggtggcggtggcggacgcggtggccaatctgatcgggcacgcccccgacggccccgccctgctggtgatcacggctgtcgtgctcgccgcgacggccggattccacacatggtgggcacggcgccctgggcacgccccgccggtggacgataccggcccccggccgcccgccgagaggcagcaggccgggccgtccgacgcgaacgcggtcgcgggcgcgaccgtgctgtggcggatgcggacgacggtgcaggacgagccgggctcgctggccgcgctgtgcacggcgctggccggacagcgggtggacatcctcagcctgcagacgcatccgctggcgcagggcacggtcgacgagttcctgctgcgtgctccggcgcagctggccggggcggaggtcacgtacgccatctcgcgggccggcggcaccgggacctggatcgagcgcgcggacgcgcacgacctggtggacgcgccgacacgcgtgctcggactggccacccgcacggcgctggacgcggcggaactcccgctcgcactgcggcagttgctcggccggtgcacgatccgctcgctgcccgccgcctcccccggctccggccgcgtgaacgagggcgcgcccgtcgagggggccctggagggcacggtgctgcggctacgggcgccggaaggcggagtgatcacggtggagcggccgtatctgccgttcaccccgacggagttcgcgcgggcgcgggcgctggtggaactggacgcgcggctcggtccgcgcattccgcgcagccacgacgtactacagcttcccgagggcagcgcgatcaccgtgcgccgggccgacgtctcggacctcgcagcggcgaaggcgatgcacgagcgctgctcgccgcgcacgctgagcatgcgctatcacggcccgctcggcgacgtggaccgttacctcaaccacctgctcagtccgcgtttcgggcgcacgctcgccgtgcagaccgcgtcgggccgcatcgtcgggctcggccatctcctctgggacggcgacgagaccgagatcgcgctgctcgtcgaggacgactggcagcggcgcggcatcggcgctgaactgctcggccgtctggtggcgatggcggtcgaggcgggctgcgagaacgtgtacgcggtcacgcaggcgtccaacaccggcatggtcgccgcgatgcgcggcctcgacctgcccctcgactaccagatcgaggagggcaccctggtgatcacggcccgcctggacgcggccgcggtgcccccgcagccgccgtacgacccggcgctggggcagcacaccgggcacggcacgagggac

SEQ ID NO: 7042 - DNA, 1665 bp, Streptomyces avermitilis
  CDS (1)..(1665)
ttgtggtttccatgtgcgctgcggcgcaccagtagttgtggcgttgcacaccggccggaatccgtccctggaggctcatcgatgtcactactcccgttgccgggccgtcgcagcgtgctgcgcggctccctcgccgcgtcggcggccctgactctgcccgccatgcccggctcggcaccggcgttcgccctctcggggcggccgaaggcggggtggggcgtccaggccggagacgtgacggcccattccggtctcgtctgggtacggtccgaccgcccggcccggatgatcgtcgagacctccgcgaccgaggcgttccgcagcccgcgcaggtggcagggcccgctcgtcggcgcgaacacggacttcaccggcacgacgcggctgcacgggctgcccgcgggcgagcagatccactaccgggtgctcctcgccgacccggacgatccgcggcgcaccggtgagccggtcaccggcaccttccgcacgacgccgcccgggcggcgcggcggggtgcgcttcctgtggtcgggcgacctggcggggcagggctggggcatcaacccggacctggggggttaccggatctacgacgcgatggccgggctcgacccggacttcttcctgtgcagcggcgacagcatctacgccgacgggccgatctcggccaccgccgcgctgccgggcggcggcacctggcggaacatcaccaccgaggagaagtccaaggtggccgagaccctggccgagttccgcggcaacttccggtacaacctgctcgacgagaacctcaagcggttcaacgcccaggtcccctcgatcatccagtgggacgaccacgaggtgcggaacaactggtacccgggcgaggtgatcgcggactcggacacccgttacacggagaagagcgtcgacgtcctggccggccgtgcccgccgggcgttcagcgagtacttccccatctcgacgctgcaccccggcgccggtgaagggcgggtgaaccgggtcgtgcggcacggtccgctgctggacgtcttcgtgctggacatgcgtacgtaccgcaacgcgaactcgcccggccggcagaccaccgacccgcagggcatcctcggcgccgagcagctcgggtggctcaagcgggagctggcgacgtcgcgcgcggtgtggaaggtgatcgccgcggacatgccgctgggcctggtcgtgcccgacacgaccgaggggaagccgaacatcgaagccgtggcccagggcgacccgggcgcgccgctcggccgggagctccagatcgccgagctgctgcggttcatcaagcaccggcgggtcaccggcacggtctggctgacggccgatgtgcaccacacctcggcacagcactaccagccgtcacgggccgcgttcacggacttcgagccgttctgggagttcgtctcgggcccgttgaacgccggtgcgttcccggcgagcgcgctggacgacacgttcggtccggagcgggtgttcgtgaaggcgccgaccgcgtcgaacgtctctcccgccggcggataccagttcttcggcgaggtcgacatcgacggcgacagcggggagctgacggtccggctgcgcgagcaggacgggacggtgctgttcacacaggtgttgcagccggggcgcgtggggcag

SEQ ID NO: 7043 - DNA, 1485 bp, Streptomyces avermitilis
  CDS (1)..(1485)
gtgccgggcgggctcggggcggtgccgggcgagtccgggccggcgccgtccggacaggtgtctggggcgggcgagtccgtgtcgtccgggtccgcaccgtgggccgccgcctgggagttgctcctgccggccgccgcggcgccggcacgcgcgcgtgggcgcggtctccaggccgccctgcgtacggccgtccgctccgggaggctcgcgcccgggacccggctgccgtcgagccgtgaactcgccgcggacctcggcgtgtcccggggcctggtgacggaggcgtacgagcagttgaccgcggaggggtatctgcgcagcggccggggcgccggaacctgggtgggcggcgcagcccgcgccgcccacccacgcgcgcgtgacttcgccccgcgctcccccggtgcccgcgcggacttcctgcccggcactccggacctgtccctgtttccccgtacggcctgggcggccgcacaccgcgccgtgctcgcggagctcccccaccacgcgctgggctacccggatccgcgcggcctggcccggttgcgtaccgcccttgccgagctgctggcacggcgcaggggcgtcgtcgcggaccccgagcggatcgtggtcgtctccggagtggcgcaggcgaccaccctgctcggattcgtgctgcacgcgcgcgggacgacgaccgtgggcgtcgaggatcccggaagcccggaacacagtgccctctacgcgtcggccggcatcggcaccgtaccgctgcccctggacgaggaggggctggccaccgggccgctgcgcgactcgggcgtacgagcggtcgtgaccacgcccgcccaccagttcccctcgggaatcgcctactcggcgcgccgccgcgccgaactgctggactgggcacgctcggtgaacgggctggtggtcgaggacgactacgacggggacttccgttacgaccgtgcccccgtgggcgccctccagggactcgatcccgagcatgtcgcgtacacgggttcgatcagtaagtcgctcgcccccggactgcggctcggctggctgctcgtccccgcctcgatcgccgaggaggtcgtggagcggaagcggaccatggacctcgggaacccggtcgtcgatcaggcgctcctggcccggttcgtggaaggcggcgactacgaccgccagctgcgccgctgccagcgcgcctacaaggagcggcgcgacactctcgtatccgctctggaggagcactttccgggggcggaggtctccgggatcgcggcgggcctgcatgtcatcgcctcgctgcccgatcggtacgggccggtggaccggttcctgaagcgggcggccgcggccggagtcgcggtgcggccgctggcgtcgtacgggacggcaccggacgacgcggtacggctggtgctgggctacgcgcatctgccgcccgcgcggatccgtgcgggggtacggctgatgtcggacgcggtgcgcggc

SEQ ID NO: 7044 - DNA, 1164 bp, Streptomyces avermitilis
  CDS (1)..(1164)
atgaacgcgaccaccacccgcggggctctgctcgccgccctcgcctgtgtcctcgtcggaggctccttcaccgccaacagcgtcctcggccactacccgtacgcgggcggccagttcctgcgctacggcctcgcctgcctgctgctcctgcccctggtcggccggggcggcacggcgccgctgcgctgcctcacgtcccgtcagtgggtacgtctggccgccctcgcggccgtcggcatggtcggcttcaacctctccgtgatcgccgccgagcgctccgcggagccggcggtgccgggcgtcttcgtgggctgtgccccggtggtcgtggcggtcgtcatgccccttgtggagggacgccgtccgcaacgcctcgtcctgtgcggtgcgtcgctcgtggccgtcggcgccttcaccgtgcagggctggggtcgtgcggacggtgcggggatcgccttctccttgagcgcgctggccggtgaagtcgggttcgccgtgctcgccgtgcccgtgctgcgtccgctcggcccgaggctgctgtcggccgtcgtctgcgcgatggccgcggccgagtccgcggcggtgggactcgtcgtggacggcacggcatggctgcgcaccccggaccgcaccgaggccgccgcactgctgtggcaggcggcggtcgtcacggtcgtcggcttcgtctgctggtacatgggcatgcagcgcatcggcgccgagcgcgcgaccctcttctccggcctcatccccgtcgcggcggcctgcacggcgcccctggtcggcaccggctcgtacggcgccgtccaggccgcgggcagcgggctggtcggagccggagtcgccctgggttcgggcgcgttgcggcgcggcgccgggcgctcagcgactgccgtccaggacgacccgcgcgaccagcgccggatcgtcgttcatcgggacgtgcccgcaaccgggcagccgcaccagccgggccctggggatgatctgcttcgcccgcaccccctggcggcggaccaggagccggtccttggtaccccacgccacggtgaccggcacggcggggatgtcgtccgtgaactggacggtggtgcccgccttgagggtctcggagaacgccgcggcgttggccagggcgagcgtctcggcgacgaccgcctcggg

SEQ ID NO: 7045 - DNA, 921 bp, Streptomyces avermitilis
  CDS (1)..(921)
ttgacggtgaccgggggctacccgtcggtagcagttgctgacaagctgtctacgaaagcgtccgtcagtgcgtccccagacaaggagcggcccatgtccgccacggtctcgttcagtgtcccctctccgcgcggcccgcggaccgcgaccgtctcctacgcgcgcgtgggcgccggcgagccgctgcttctgttgcacggcatcggccaccaccggcaggcctgggacccggtcgtcgacatcctggcgacggagcgggacgtcatcgcggtcgacctccccggcttcggcgagtcccccgcgctgcccgacgggctcaggcacgacctgtcgacggtggtgcccgtgctcggcgccctgtgcgaggcactggggatcgagcgtccgcatgtggcgggcaactccctgggcggtctgctggccctggagttgggccgggagaagctcgtgcggtccgtgacggcgctctcgcccgccggcttctggacgccggtcgagcggcggtacgccttcggggtgctgatggcgatgcgacagggcgcacggcagctgccgcttccggtggtcgagcggctgtcccgtacggcggtcggccgcgccgcgctgacgagcaccatctacgcccgcccggggcgccgttcacccgaggcggtcgtcgccgagacgctcgccctggccaacgccgcggcgttctccgagaccctcaaggcgggcaccaccgtccagttcacggacgacatccccgccgtgccggtcaccgtggcgtggggtaccaaggaccggctcctggtccgccgccagggggtgcgggcgaagcagatcatccccagggcccggctggtgcggctgcccggttgcgggcacgtcccgatgaacgacgatccggcgctggtcgcgcgggtcgtcctggacggcagtcgc

SEQ ID NO: 7046 - DNA, 882 bp, Streptomyces avermitilis
  CDS (1)..(882)
gtgaccaccgacgccgcgaccgaggtcttcgtagagcaccgccccgtcctgatgggtgtcgcctaccgcatgctcggacgggtggccgacgccgaggacgtggtgcaggaagcctggctgcgctggtcgggcgccgaccgctccgatgtgcgcgagccgcgccgctacctggtgcgcatcaccacccggctggccatcgaccggctgcgccagttgcggtcgcgcaacgaggcgtacgtggggccgtggctgcccgagccctacctgaccgacttcggcgacaccgtgccggacgcggcggagcgggccgtgctcgcggactccgtctccctggccgttctcgtcgtcctggagtcgctgtcgccgctggagcgcgcggtcttcgtgctgagggaggccttcgggttccccttcgcggacatcgcggtcaccctggagcgcagcgaggccgcggtacggcagctcgccggacgcgcccgcaaacacgtggacgaggggcggccgcggtacgaggtcgaccccgccgagcgccgcgacctgaccgagcggttcctcgccgccgcggccgagggcgatctcgaggggctcatgtcgatgctcgccccggacgtccgactggtcggcgacagcggcggccgcgcccgggcaccccggcgggtcctggagtccgccgacaaggtcgggcgcttcctcgtcggcgtcacccggaagggcgtcgcggacgtgtcgttccgctcccttgaggtcaacggcggtccggcgctgctggtcctgtccgcgggcaagcccgacagtgttttccagctggacgtggccgacggccgtatccagtgcgtctacatcatccgcaatcccgagaagctggtgtccctctccgccggc

SEQ ID NO: 7047 - DNA, 759 bp, Streptomyces avermitilis
  CDS (1)..(759)
gtggggaccacgcagctggaatcggtaccggagcctaagtactggcatctcaagaccgtgctcagtgaggcactcgactccgagttctcggtgggcgagatcctgccgaacgagcgtgacctcgcggcccgcttcggcgtcgcccgcgccacgctccgccaggctctggaacagctcgaactggaaggccggctccagcgccgccggggtgtgggcaccacggtcgccccgccccgcatgggggtggccgtcgggtccgagcagcacacctggccgggcgcggccggtgacgcctggcagcccgtggactgcacggtggcggccccgccccccgcggtcgccggcgtcctggagaccggccggaacgagcaggtgcacaccgtacgccgctcccgcgtcactcacggacaccccgtcgccgccgaactgctctacatcccggacttttcggtgcccgacctgtcggccatcgacgcaccctccggcgccgcacgcgcgcgtgccgtgctgcgcgagttgcagcgcctggagctggagggccaggaccgggccgtggagctgggctcggcccgcgccgaggacgccaaggaactcgaccggctgcccggcgcgcccgtcctcgtcgtcacgacccgcttcttcgccgagggccgtgcggcggcggtctccgtcgccacgtatcgcgctgacacatgccgactgaccttcggtgactcggggggcgtggagatacaccacgacccggagcgccgggcttcc

SEQ ID NO: 7048 - DNA, 1155 bp, Streptomyces avermitilis
  CDS (1)..(1155)
ttggggcggctgaccggcggggacccctctctgcttcgaaggatcaattccgcggtggtgctgcacgcgctgcgtgccgccgactgcgcgacgctcaccgaggtcacccgggtgaccggactgtcccggcccaccgtcgagggtgtcgtggaggggttgatcgaggccgggctcgtggtcgagaaggccgccgaggaaggtgccgcccggcgccaggggcggcccgcccgccgcttccggttccgggccgaggcgggtcatctgctgggtctggagatcggcccgcaccgggtggccgcgctcctcgcggacctggacggccgggtcctgggcgccatggccaaggacgtcgacgagaccgcctcggcggacgagcggctggagcggctgcgtacggcggtcgccgagctgctgcgccgggcaggcgtcgcccgcagctccctgcgcgccgtcggggtcggcagcccgggcatcatcgaggcggacggcaccgtacggctggggacggcgctgccggagtggacggggctgcgtctcggcgagcggctgaaccgttccttcaagtgcccggtgctggtggagaacgacgccaacgcggcggcggtcgccgagcactggaagggcgcggcgaccgagtccgacgacctcgtgttcgtgctggccgggctgagcccgggggccggcgcactgatcggcgggcggctgcaccggggctacgggggcgcggccggggagatcggcgcgctgcatctgctgggccgcggggcgaccccggagacgctgttgtcgaccaccgacgagcccctgcatccgctcgacgagcgggcggtcgccgaggtcttcgcgcacgcgcgcgagggggatcagcgggcccgtgcggccgtcgaccgcttcatccagcgccttgtgcacgacgtggcggccctcgccctggccctcgaccccgaactggtcgtgatcggcggctgggcggcgggcctggacggcgtgctggacccgctgcggcgcgagctggcccgctactgtctgcgcccgccgaaggtgaccctgtcgatgctgggcgaggcggcggtggcgaccggggcgctgcgtctggccctcgaccacgtggaggagcagctgttcgcggtggagggcacggtgacggcgcggcgc

SEQ ID NO: 7049 - DNA, 660 bp, Streptomyces avermitilis
  CDS (1)..(660)
gtgccggtcaccgttctgctcgtcgacgacgagcccctcgtccgcgcgggtctgcgcgccgtcctggaggcgcagcccgacatcgaggtcgtcggcgaggcggcggacggtgcggcggtgattcccctggtgcggcagttgcggcccgacgtcgtcgccatggacgtacgcatgccgttgatggacgggatcgaggccacccgcgccgtgctgcgcaccgtcgaccggccgccgaagatcctcgtggtgacgaccttcgagaacgacgagtacgtgtacgaggcgctgcgcgcgggagcggacggttttctgctgaagcgggcgcggccggccgagatcgtgcacgcggtgcggctggtcgccgagggcgagtccctgctgttcccggcctcggtacggcagttggccgccgagcacggggacggcggcgggaaccgggcggcccgcgcggtgatggagcgggccgcgctgaccgaccgtgaaggggaggtactccggctgatggcccgggggctgtcgaacgcggagatcgccgggcagctggtcgtcgggacggagacggtgaagtcgcatgtgagcgccgtcctggccaagctgggggcgcgcgatcgtacccaggcggtgatcgcggcgtacgagtcggggttcgtggcgccgggc

SEQ ID NO: 7050 - DNA, 1176 bp, Streptomyces avermitilis
  CDS (1)..(1176)
atgggccgcttcctgcgccccctgagccgggggaccacgtacacgcgcttgctgcacctgtgggtgccgatgctgttcgaaagcgtgtggctgttcatcgacatgcggcggtggtggatgcccgcgctcgtgctcattccgctgggcctgatcccggcggtgcggctgggcgagggcgtgcaggcgcagttgctgctggctccgggcgaccggggcggccggaacgccgccatctcggccgcgccctcggcgacttggggcgaccggctgcggacggtgctgtggctcgaggtgcgtatggcgctcggagcggtgaccttgggagcgaccgtctggttgccgacgatcgccgtggatctggtcaggtccgccaccggcccggcaccggtcgacaaccctttgttccgggtgtcggatccccactgggcgtacgcgctgctgatcccgttgacgttgctcgtcctgtacggggcggtggtgggcctgggtgagctgatcaccgccgtggcacgcggtctgctcggcccctcggccggtgagcgactcgccgccctcgaggagcgcaccgagcacctcctggagcgcacgcgtatcgcccgcgagctgcacgactccatcggtcacgccctgaccgtggcggtggtgcaggcgggcgccgcgcgcgcggcgggcgatccgcggttcaccgaccgggcgctggacgccatcgaggagaccgggcgggccgcgctggaggacctggagcgggtgctcggcgtgctgcgcgaggcggagcggcccgcgagcagccgcccgacgctggccgaggccgaccggctcctcgagtcggcgcgcgcctcgggagcgaaggtcgaggccgagtggtccggccccgtggagtcggtcccgggcccggtctcccgcgagggctaccgcatcctccaggagtccctgaccaatgtgatccggcacgcgggcggcgtcccggtgcacgtccgtatcgcggtccaggacgccgacgtcaccctggagatccgcaatccgctcaccacgaggccgcccgggcccggcccgggcggcggactgcggggcagcgggctgcggggcatacgggagcgggccgcactgctcggcggccgggcccggacgggtccggccgacggtgactggcaggtgcatgtcgagctgccgctgcgc

SEQ ID NO: 7051 - DNA, 924 bp, Streptomyces avermitilis
  CDS (1)..(924)
atgaccagcatcgacgtccaagacctcaccaaggagtacggcaccggacgagccgtggaccggctcaccttccaggtgcttccggggcgcgtcaccggcttcctcggccccaacggcgcaggcaagtccaccaccatgaggctcgtgctcggactcgaccgtcccacgtccggcaccgccaccgtcggtggccgcccctacgccgcgctccatgaacccctgcgtcaggtgggagcgttgctcgacgcacgggccgcccacgggtcacgtaccgcccgggcccacctgagggcactggccgcgagcaaccgcatccccgaccgccgcgtcgacgaggtgctggaggagaccgggctcgcgtcggtggcgcggcgccgggtgaagacgtactcgctgggcatgcggcagcggctcggcatcgccgcagccctcctcggcgacccgcccgtcgtgctgctcgacgaaccgtccaacggcctcgaccccgaaggcatcatctggatccgcgagctgctgcgccgcctcgcccgcgagggccgcaccgtgctggtctccagccatctgatgaacgagaccgcgtccttcgccgaccagctcgtcgtcctgggacgcggccggctgctcgccgacctgccgatgcgggagttcatcgacgcgcgcgtgcagccccgggtacgggtgcgcaccagcgacggcgccgtgctgggcgcactgctcgcccggcacggatacgaggcggccgaggccgaggacggacggtggaccgtgcggcacgcgcgcgtggcggacatcgggcgcctcgcctcggacgcgggcgtctccatcctcgaactcgccgcggaagagggcaccttggagcaggcctatctcgacctgacggccgccgaggccgagttcacgaccccgacgcagccgcaggaggcc

SEQ ID NO: 7052 - DNA, 720 bp, Streptomyces avermitilis
  CDS (1)..(720)
atgcccttcgcacccgcactccacgccgagtggatcaagatccgtacgctgcggtcactggtcggcggactgctcgccgtcttcctggtgaccgtcctcttctccgcgctcgccgggctcgactccgaaggcccggacttcgaccccctgttctcggcgttcttcggcgtcaacttcgggcagatcgccgcgatcgcgttcggtacgacggccgtttcggccgagttcgagggcggggcccttcaggtgtcgctggccgcgatgccccgtcgcggccgctggttcgcggccaaggccgtcgcgatcggcgtccccgtcctcgccgtcggcctggtcacggggttcgtgagcctcgcggtgggcaaggccgtcctcggggccgaggcgagcgggctgacctgggacgaagggctgcgtggagctctcggctgcgccctctacctcacgttgatggcgctgttcgccgcgggactcgcggccctgctgcgcagcggagtcgccacgctgagcgtgctcgtcccgttccttctcatcgtgtcgttcgtggtcgggggagcctcgggcaccgccgccgacctgctgcccgaccaggcgggccggctcgtcctccacgagacgtccgacagcgtcctcggaccctggaccggtctggcggtgaccgcgctgtgggcggcggccgcgctgttcgccggggcatggagcgtacgccgccgggacgcc

SEQ ID NO: 7053 - DNA, 438 bp, Streptomyces avermitilis
  CDS (1)..(438)
atgaccatcgagcagtgcctcgccacgatcgacctgctgtgcgcccgcccgttcccggcggagcacggcaggacggacgtgggctcggggggaccgggctatcacatcgccgagttagggacgagcgacggttacggggcggaggactgctgggaccgggccgagacggcggaggagtgctacgagcgcggagaggaggtacgcgatcagctgaccggccggtgggggccgtccgaccacatcggcctccagaccgtccaactgcgcacggagaccgaggacatacccgagccctgggtgcacctcagcgcacgcgtgggcgacatccacctctggcggacggaggggaacggccgctggatcgccctcggagtcgccgaccgcgacgaggcggacgagatacggctcctggtcgtcgtcacggagatcgaccctccc

SEQ ID NO: 7054 - DNA, 438 bp, Streptomyces avermitilis
  CDS (1)..(438)
atgacggcggcgacgggccatcacttcgcccgccccggcaaccgcttctggcccgtgctgcacctgtccggcttcaccccgcggctcttgaagccttcggaacagggcgagttgctctcgtacggcctcgggatcacgaacgtggtggcgcgcgcgaccgcgcgtgccgacgagctgaccgcgcaggagtaccgggagggcgggcggctgctcggtgccaaggtggagcggctgcgtcctcggtggctcgcggtggtgggggtgaccgcgtaccgggcggccttcgacgaccggaaggcgcgggtgggaccgcaggagcggacgatcggcgccagtcgggtgtgggtgctgcccaaccccagcgggctgaacgcgcattggacggcggcgacgatggcggaggagttcggacggttgcgggaggccgcgcgggacgcg

SEQ ID NO: 7055 - DNA, 1437 bp, Streptomyces avermitilis
  CDS (1)..(1437)
gtgactgcgcctgccaagccccgtatccccaacgtcctcgccggacgctacgcctccgccgagctcgccacgctatggtcccccgagcagaaggtgaagctggagcgacagctctggctcgccgtactgcgggcccagaaggacctggggatcgaggtgccggacgcggcgatcgccgactacgagcgcgtcctcgaccaggtcgacctcgcctcgatcgcggagcgcgagaaggtcacccggcatgacgtcaaggcgcggatcgaggagttcaacgacctcgccgggcacgagcacgtgcacaagggcatgacgtcccgtgacctcaccgagaacgtggagcagctgcagatccggctctcgctggagctgatgcgcgaccgcacggtgtccgtcctcgcccggctcggcaagctctcgggcgagtacgccgagctggtcatggccggccggtcgcacaatgtcgccgcgcaggccaccaccctcggcaagcgtttcgcgaccgctgccgacgagctgctcgtcgcgtacggccgcgtcgaggagctcctcggccgctacccgctgcgcggcatcaagggcccggtcggcaccgctcaggacatgctcgacctgctcggcggcgacgcggccaagctcgcggagctggagcagcggatcgcccgccacctgggcttctcccaggcgttcacctcggtcggccaggtctacccgcgctcgctcgactacgaggtcgtgaccgcgctggtgcagctggccgcggcgccttcgtcgctggcgaagacgatccggctgatggccgggcacgagctggtgaccgagggcttcaagccgggccaggtcggttcctccgcgatgccgcacaagatgaacacccgctcctgcgagcgcgtcaacggcctcatggtcatcctgcgcggctacgcctcgatgacgggcgagctggcgggcgaccagtggaacgagggcgacgtgtcctgctcggtggtgcgccgggtcgcgctgcccgacgcgttcttcgcgctcgacggtctgctggagacgttcttgacggtgctcgacgagttcggcgcgttcccggcggtcgtcgcccgtgagctggaccgctacctgccgttcctcgcgaccaccaaggtgctgatgggcgcggtgcgtgcgggtgtcggccgtgaggtcgcgcacgaggccatcaaggagaacgccgtggcctccgccctcgccatgcgcgagcagggcgccgagcgcaacgagctgctggacaagctcgccgccgacgggcgcatcccgctggaccgtgcccagctcgacgagctgatggcggacaagctgtccttcacgggcgccgccgccgaccaggtcgccgtggtcgtcggccgcatcgaggagatcgtgaagcagcaccccgaggcggcggcctacaccccgggggcgatcctc

SEQ ID NO: 7056 - DNA, 348 bp, Streptomyces avermitilis
  CDS (1)..(348)
gtgaccaccgtggtgatcaacctgaagggccgcatccacgacttcggcccccggctggaggacgcgcccgaggacctggtgtacatcggccgccgctggaccatgggccactgggacctgccgcagcacccgctgtacaacccgttcgcccctgacacccccacgcggaagcgcgacggcacccgcgccgaagtgatggccaagtaccgggcgtacctcgtggagcaccccgagctgctggcccaggtgccggcgctgcggggcaggacgctggcgtgctggtgcgcacccgagctgtgccacggggacgtgctggcggagatcgcggacggggccgcgccgccttcg

SEQ ID NO: 7057 - DNA, 780 bp, Streptomyces avermitilis
  CDS (1)..(780)
atgcagacgaacgccaaccacaccagtcttgtcgcgatcggcgactccttcaccgagggcatgtcggacctgctgcccgacggctcctaccgcggctgggccgatgtcctcgccggccggatggccgcgcggacgcccggtttccgctatgccaacctcgccgtgcggggcaagctgatcggccagatcgtcgccgagcaggtggacgtggcggccgccatgcagcccgatgtgatcacgctggtcggcggcctcaacgacacgctgcggcccaagtgcgacatgggccgcgtacgcggtctcctggaggaggccgtcgagcggctggccccctcctgcaagcagctggtcctgatgcgcagcccggcccgccagggcccggtcctcgagcgcttccggcctcgcatggaggagctgttcgcgtgcgtcgacgacctcgcggcccgacacggcgcactcgtcgtcgacctctacggagcgccctcgctcgccgatccccgcctgtgggacttcgaccggctgcacctcacggccgaggggcaccggcgggtcgccgaggccgtgtggcagaccctcgggtacgaggcggaggatacggagtggcacacacccatgccggccacactgccgccgggatgggccgcgcgccggatcgtggacgtccgcttcgcccggcagcatctgctgccgtggatcgtacggcggctgacggggcgctcgtccggtgacgggctcccggccaagcgggccgagctgctgccgtacgagggaccggcggca

SEQ ID NO: 7058 - DNA, 1011 bp, Streptomyces avermitilis
  CDS (1)..(1011)
atgactgccgtacagctgctgatcggcctgctgaccctggtcgtgaacgccttcttcgtgggggccgagttcgcgctgatctccgtgcgccgcagccagatcgagccgtacgccgaggagggcgaccggcgggcccgcagcgtgctgtgggggctggagcacgtgtcggcgctgatggcggcggcgcagctgggtatcaccctgtgcaccctggtcctcggtgtcgtcgcggagcctgcgatcgcgcatctgctggagccggtgttccacgcggtgggcgtgccggccggtgcgggccacgcggtgtcgttcgtcatcgcgctcaccctggcgacctatctgcacatgctgctgggcgagatggtgccgaagaacatcgcgctcgccgagccggtgcgctccgcgctgctgctcggcccgccgctggtcaccctggcccggacgctgcgaccggtgatcttcgccgtgaacgccttcgcgaacgggctgctcaagctgctgcgtgtggagacgagggacgaggtcacggcgaccttctcggacgacgaactggcccggctggtcaaggactccgtcgacgccgggctcctcgacgaccgcgcccaggagcgcctgcacgacgcactggagctgggccgccggcccgtgcgcgacgtcgtgcttccgctggagcgcgtggtctacgcgcgcgtgggcatcacgcccgagcagttggagcggctctcggccgagtccggcttctcgcgttttcccgtggtggacgagggccgccggatcgtcggctatctgcatgtgaaggacgcgctggacgccacgccccgcgatgtgccgttcgcggtgcgggacatgcggccgatcgcccgcgtccgggagaccacgccgctggacgacgtactcacggcgatgcgcggcagccgtacgcatctggcggcggtcctcgggtcggacggacggctggcggggatggtgacgatggaggacgtgctgcggcagctgttcgggcagcccgcg

SEQ ID NO: 7059 - DNA, 1344 bp, Streptomyces avermitilis
  CDS (1)..(1344)
atgaccgaagtgctcctcctgctggtggcgatcctgctctcggtggcctgcggcgccttcgtagcggcggagttctcgctgaccacggtcgagcgcagcgagctggagcgggccgcggagcgcggcgagcgcggcgcggcgggcgccctcaaggccgtacgcaacctgacgttccagttgtccggggcacagctcgggatcaccgtcaccaacctggtggtcggcatgctctcggagtcgtcgatcgcgaaactgatcgcgggcccgctggagtcggtcggcgtctcgccctccgtgtccaactcggtggccctggtcatcggtacggccctgtcgacggtgttcctgatggtggtcggcgagctggtgcccaagaactgggcgatctcctcgccgctggccgtggccaagcgggtgggaactccgcagcgcttgttcagctccgcgttccgcccgttcatcacgcatctcaacaacacggcgaaccacgtcgtacgccgcttcggactcgaaccggcggaggagctcgcctccgcgcgcgggccgcaggagctggtggcactcgcccggcactccgcgaaggcgggcgcgctggaggccgacaccgccgagctgttcgtccgcaccctcaatctcgccgacctgaccgcggagaacgtgatgaccccgcgtgtccaggtcgtcgcgctcgacgtccaggcgacctgcgaggacgtggcgaacgcgacccgggcgaccgggctgtcccgcttccccgtctaccgcggcaacctcgactcggtcgtcggtatcgcgcacatcaaggacgtcgtggccgtccccgccgaagagcggacccgccgccctgtctcacgcgtgatgcgcgagcccctcttcgtaccggagtccctcaccgtcgaccggctcctcgaccgcctcggcgggaaacggaccatggccatcgtcatcgacgagtacggcggcacggccggggtcgcgacgctggaggacatcgtcgaagaggtggtcggcgaggtccgcgacgaacacgacccgcacgagacaccggacctggccccggccggcacggacgacgacggccgcgcgctgtactcggccgacggcgcgacccgcatcgaccagctcgcgcgggtggggctgcgggcgccggacgggccgtacgagacactcgccggcctgatcgcggccgagctgggccgtatcccggccgagggcgacaccgtcgaggtcgccggctggcggctcgacgtggtggacgcgtcggggcggcgggcggcgcgggtactgctgcacgcgcccggcgcgcaggacgaagcctcttcggtgtcccatgagagggagcga

SEQ ID NO: 7060 - DNA, 423 bp, Streptomyces avermitilis
  CDS (1)..(423)
atgactgagctgcgcatgcgggccgccgcccccgaggacctctccgccgtgctggccttctggaagacggcggccgagggcacgagcatcagcgacgaccgggacggggtgcagcgactggtcgcccgcgacccggaggcgctgatcctcgccgagcgggacggggagctggtcggcacggtgatcgcgggcttcgacggatggcgctgccatctgtaccggctggcggtccatcctcagcgccgccgcctcggcatcgggtccgcgctgctcgccgccgcggaggaacggttcgtacggctcggggggcgccgcggggacgcgatggtgctgcgccggaacgagaccgcgcaccatgcctggcgggcggcggggtacacgcccgaggagcagtggcgacggtgggtgaagccgctcgccgac

SEQ ID NO: 7061 - DNA, 888 bp, Streptomyces avermitilis
  CDS (1)..(888)
atggcacgcccgttccgtttcggcgtcaacctgctcgaccccgcacccgccgaggagtggcgcgccaagtgccgccgggccgaggaactcggctacgacgtgatcctggtccccgaccacctcggcatgccggcgccgttccccgcgctcgtcgcggcggccgaggccacggagcgggtgcgcctcggcacattcgtgctcaacgccggcttctggaaccctgcgttgctggcgcgcgaggtggcgaccaccgacgcgctgacgggcggacgcctcgaactcggtctcggcaccgggtacgtacaggcggaacacgacacggcgggccttccctacggttcgccgcgcgagcgggtggaccatctcgtgcgcacggtcgaggagttggagcggctgctcggctccccggagcaccggccggggatcgtgcagaagccccgggtgccgctgctgatcggcggcaacggcgaccggatgctgcggctcaccgccgagcacgccgacatcgcggctttcgcgggcgcgcatctggtaccgggcagcacgacggggaagctggcgccggtcacggccggggaactggacgagcgggtcgccagataccggcggctggcggcggaccgcgcggagccggccgagctgaacctgctggtgcagatggtcgccgtcaccgaggaccgcgccgccgccgtccagggcctgcgcgagcgcgtaccgcagctgaccgaggagcaggtactggagctgccgatcgtcctggtcgggacgccggcgcagatcacggcgcaggtgctggcacaacgggagcggtacgggttctcgtatctgacggtcctggagccgtacatggaggcgttcgcgccggtgatcgaggcgttgcggggcgcg

SEQ ID NO: 7062 - DNA, 2565 bp, Streptomyces avermitilis
  CDS (1)..(2565)
gtgctcaaagcgactctccgcagcttcctcgcgcacaaggggcggctgctcctgtcggcgctggccgtcgtcctgtccgtggcgttcgtcgcgggcagcctgatcttctcggacacggtcacccgcaccttcgaccggctgttcgcctcgacagcggccgatgtcaccgtgcagcccaaggaggacctcacctcgcaggtcccgaccggggcgaccgagaccgtgcccgccgcgctcgcggagcgcctgaagagcgtcgacggcgtggccgccacccatgtggacgcggcggtccagaacatcacggtcgtggacgtcaggaacgagccggtcgggtccaccacaggcgcccccaccatcgccaccaactgggaccccaccgaccgcagcccggtgcggctgacctcaggacacgccccgcacggcagcggtgaggcactcctggacgcggacaccgccgagaagaagcacgtacgcatcggcgacacgctgaccgtgctggcgcagcccgggtcgttcaaggtgcggatcgtcggcatcgccacgttcaccaccaccaaccccggggccgcgctcgtcttcctcgacaccccgaccgcgcagaccaaactgctcggcagggccgacgccgccacgagcatctccgtggacgccgccaagggggtgagcgacgcccagctcaaacggcgcatcgccgccgaactcggctccggtacctacgacgtgcagaccgcggacgaacaggccacctccgacgcggccgacctcggcggattcctcgacgtgatcaagtacgtgatgctcggcttcgccggaatcgccgtcctggtcggcgtcttcctcatcgtcaacaccttctcgatgctgatcgcccaacgcacccgcgaactcggcctgttgcgtgccctcggcgccgaccggcggcaggtgcgccgctccgtgctcaccgaagcgctgctgctcgggctggtcggctcgacgctcgggctcgccgcgggcatcgggctcgcggccggactcatcaagctcatgggcgcgttcggcatgaacctcaagtccaccgagatggtcatcggctgggcgacgcccgtcacggcctacgtcgtcggggtcggcgtcaccttcctcgcggcgtacctcccggccaggcgcgccgccggggtctccccgatggcggccctcgcggacgccgagatcgccggggtggggcggccgttgaaggtgcgcggcgtggtgggcaccgtcgtcggcgtgctcggggcggccgcgctcgcggggtgcgcgacctcgtcgaagaccgcgtcggcggcgtccctgctgggactcggcgtcgtcctcacgctcatcgcgaccgtgatcgcgggcccgctgctggtgcggccggtgatccgggtgctgggcgcggccttccccgcgctgttcggcccggtcggacggatgagtcagcgcaacgccctgcgcaatccgcgccgcaccggtgccacggcggccgccctgatggtcggcctcgcgctggtcggcgggatgtcggtggcgagcgcgtccatgtccgcgtccttcgaccagcagatcgacaagacgctgggcgccgacttcgtggtgcagaacagcaacttcctgccgttcccgcaggaggtcaccgacaaggtgcgggccaccgacggcgtcggactcgtcgtacggcagcggttcacccccgtcgcggtccggctgccggacgacaagcgcgtcgagacgaccgccgcgggctacgacaaccggctcgacgacgtcgcccacatcacgtacacccagggcgatacggcggcggcgctcgcgggcggcggcatcgccatggacgcggacttcgcgaagaagcacgacgcacggatcggcagcacggtcgccgtcgagttcccgggcggccgaaagaccgaactgaaggttgccgcgctcaccgaccaggagggctccgacggcttcggcatgcagggcgggctgtacttcgggatcgcgacggtcgagaagtacctgcccggcggccaggactccgcgctgtacgtgaacgccgggtcgggcaccggcgcggaccggttgcgcccgcggctggagcggaccctcgacccgtatccgcaggtccaggtccgcgaccaggccgactacaagaagctcgtgcacgaccagatcgccgtcctgctctacctcgtgtacgcgctgctcggcctcgcgatcgtcatcgcggtgctcggcgtggtcaacaccctggccctgtcggtcgtggagcgcacccgggagatcgggctgctgcgcgcgatcgggctcgcccggcggcagctgcgccggatgatccgcctggagtcggtggtgatcgccgtgttcggcgcggttctgggccttgcgctggggctggtgtggggcgtgtgcgtgcagcaggtgctcgccctccagggcatgcgggtactcgcgatcccgtggacgacgatcgtggcggtcgtggtgggctcggcggtcgtgggcatcgtggcggcactgctcccggcgttgcgtgcatcccgcatgaatgtgctggcggccatagcgcacgac

SEQ ID NO: 7063 - DNA, 882 bp, Streptomyces avermitilis
  CDS (1)..(882)
ttgtccacacctgctgcggagcacgcccccggccgcccggaggcggacgggttcgccgcccgcacccgcggcctgacgaaggcgtacggctcgggcgagacgaccgtgctcgccctcgactcggtcgacgtggacatcgcgcgcggccgcttcaccgcggtgatggggccctcgggctccggaaagtccaccctcatgcactgtctggccgggctcgacagcgtctcggccggacaggtgtggctcggcaacaccgagatcacggggctgaaggacggcgagctgacccggctgcggcgggaccggatcggcttcatgttccagtcgttcaatctgatcccgacgctcaacgcggtcgagaacatcaccctgcccatggacatcgccggccagaagcccgaccagaagtggctggaccaggtgatcgacaccctcggcctgcgggaccggctgaggcaccggcccgcgcagctgtccggcgggcagcagcagcgcgtcgcctgcgcccgggccctggcctcccgccccgagctgatcttcgccgacgagccgaccggcaacctcgactcccgggcgggcctcgaagtgctgggcttcctgcgcgaggcggtcgacgaactggggcagaccgtcgtcatggtcacgcacgaccccggcgcggccgcccactccgacctggtgctcttcctcggggacgggcggatcgtggacgagatggcacggccgacggcggaggcggtgctggagcggatgcgcctcttctccgggggaccctcccagacgcccgagtccgacacgaaccacgccgcctccgacggcgccgtcccgcccggcgccgtcccgcccggcggcgactccgccgacggcacccccgaccaggac

SEQ ID NO: 7064 - DNA, 237 bp, Streptomyces avermitilis
  CDS (1)..(237)
atggcgaagactcagctgaacgtgagggtcgacgagggcaccgcccgcgccgcccgcgagcgagccctggagcgcggcatgagcgtgaaccgttacatcgaagaactggtccgacaggacaccggggaagcgggccacaccttcgtggaggccgccgcagacttcatgaagcagtacgagaccgtcttcgccgaggagttcggcgcggaccgcgagggcacgcgcgaaagtcgtcgt

SEQ ID NO: 7065 - DNA, 372 bp, Streptomyces avermitilis
  CDS (1)..(372)
ttggagaatctcagaatcgacctcgcctggctcctcatgatcgccgagcagaagacgcccggagatccccaggtcaccgactggggagccctcgtcgccgccgtcagccggcacgaggcggagatattcggcatccccgtctacgacacgccgcacgcccgcgccgccgccctgctccagctgctgttgcacgtgccggccctcgaacgctccaacgccctgttcgcgtccgccgtcgcctacgcctatctcgtcgcgggcggcgccaaggtcgtcacctcgcccgagcaggtgcgcgagctcgcccggctggtgaagagcggggaggccggcgtcgacgacatcgcgcgcgaactgcggcaatggagcctg

SEQ ID NO: 7066 - DNA, 684 bp, Streptomyces avermitilis
  CDS (1)..(684)
atgccgctgcggtccgccggatcgggcaaggcgtcgcgggacgccgtgcaccatccgctgttcgcccgctcctacgcccggatcagcgtcaccgccgagacccggctcgggatgggcggcgtacgcgaccggctgctggccgggctcagcggccgggtcatcgagatcggcgcgggcaacggtctcaacttcgcgcactatcccggggccgtctcggaggtcgtcgcgatcgaacccgagcggctgctgcggcagttggcggtcgaggcggcgctgcgctgcgatgtgccggtcgacgtggtgccgggtgcggcggaggcgctgccggtcaagagcgaggccttcgacgcggccgtcgtctccctggtgctgtgcagcgtccgggacgtgtcgcgggcgctcggcgagttgcggcgggtgctgcggcccgggggcacgctgcggttcttcgagcacggcgcgggcggcgggcgcgcgatggccgcaacccagcgcgccctcgaccgcacggtgtggccgcgtctcaacggcggctgtcacctcacgcgggacgccgtcagcgcggtgcgcgaggccgggttcgagctgggcccctaccggcggatgctgctgccggagaaggggccgcggctgcccacctcgtactgcgtcctcggcaccgcgtggcggcccgggtccgcggac

SEQ ID NO: 7067 - DNA, 684 bp, Streptomyces avermitilis
  CDS (1)..(684)
atgcaacgccgcgtgcggcgcgtcaccgcggtcttctcggccgcggtcgcttcgatccttctgtcgctctccctggccgcggtccccgctcgagccgcgacccacgaccccgtcatcttcgtccacggcatcagcagttcggcgagcagttgggacgactggatcgccgacttcgaggccgacggctacaccgcctccgagctggacgcgtggtcgtacgactggtcccagtcgaatgtgacgaccgcgcagcaactggccaccgaggtcaggagcgtgctcgcgaggaccggcgcgtccaaggtcgacctggtcgtgcactccatgggcgcgctgagtgcccgttactacctcaagaacctcggcgggacgtcgtacgtcgacgacttcgtctccaccgccggggtgaaccacgggacgaccgtcgcctcgtggtgcaagtggctctacacgtcctgttcggagatgtacaccggaagctcgttcctgacctccctcaactccggtgacgagacgccgggcggcgtggcgtacgccagttactggtcgaactgcgacgacctgctcaccccggacaccagcgcgatcctgagcggcgcgaccaatgtcgaggtcgggtgcgtctcgcacaccgacatgaacaacgactacggcgtctaccagcaggtgcggaccttcgtcggc

SEQ ID NO: 7068 - DNA, 2223 bp, Streptomyces avermitilis
  CDS (1)..(2223)
gtggtgacttcggtgaacccctcgccccttccgcggacttcgacaccgcaggtcacgcacgcgtggccgcgcctggacccgccccttcccgaaggcgtacgggtacgggtgctgcgcgccgcccacggagacccgcgcgccgccctggaactcgcctccgtactgagcacccgtcagctgaccggcctcgacccgctcccggccgaccccgcctccctcgtccccgcaactctgcgggcccaccgccgggagatccgcgccctgcccgacgacacccggctgctgctcctgctcgccgccgccgaccagtacccggtcgccacccacgccttcctgcgggcggtcgccgcggcccggctcgacacccggcccctggacgccgccgagaccgcgcagctcgcgcacaccacgcccggcgggatcgtcttccgcgacccgtggaccaggatcgccgcatacgagaccgcctccgcggcggaccggcgcgaggcccaccagctgctgggccgggtcctgagcggcgcgggtgaggcaccccgccggttctggcaccggggcgccgccgcgctcggccccagcagacggctcgcggcgcagctgggaccggccgcggcccaggcgcgccgggccggcgaacacgccctggcctgcgccctcgcggaacgcgccgccgcactcaccccggacccgcacgagcggccccggctgctcgcccgcgcggcggccgacgcctggcagtccggcgacggcgaccgggcccgccggctgatcgcggccacggacaacgacgcgctgggcggtctgctggcgctccgcgcggggaacgccggcgacgccttcgacgcgctgctcgcggcggcggcccggcacgcggccgccgcccacgccctgccaccgggcgcccccgaccccgccgtccacctcctcgcccgcgccaccgaagccgccatctacaccggggacctgcgccgctgccgggaggcggccgccgtggcggaccggctcgggatcgtgccatcgggcacgctcggcggactggcggccgcgttcgagggccgctacgccgacgcccgcgacctgctccaggccgccgccgggcgctgcggtcccggcggcgatcccaccctgctcatccattccggcatcgccgcgctgctcctcggcgaccacaccggcgccgccaccgccaccgcgcgggcggccgcctccgcccgcaccaggggcgagacggtcaccgtcccgcaggccatggagttccgggcctacgccgagttctggaccgggcgcccgcgggccgccgaggcgggcgccctggagtcgctgcgccaggcgtacaccaccgggcaggacaacggcgcctgccatctgcaggccgccctcgccatgttcgccgccctcaccggcgacgcggaggtgtgccgcgaccgggccgaggccgcccgctcctacgccctgccacgcggcctcggtctgccggccgccctcgccctgttcgccctggccttcctcgacctcagtaccggccgcttcgccgccgccgcggcccggctgcgcgccctggccgctttcggccccggccacggccaccgcgccatccggcacctggccaccccccactacgtggaggcggccgtccgcaccggcgacacccgggtcgcccgcgccgcccacgccgactacgaccactgggcgcgcaccatccgcaaccccgacgagctggccctgagcgcccgctgccgagcccttttggccggcggccccgaggccgtggaccactaccgcacggccctcgacctgcacgcctgcggtacccgggacttcgaacgcgcccgtacggagctgctgttcggcggcgcactgcgccggctgcgccgccgggcggaggcgcgtgaccgcctgcacagcgccctggcggccttcgagcacttcggcgccccgcagtgcgcggcgcaggcccgggcggaactccgtgttctcggcggtctgggcggtctcggcgaaccgtccgcacccgcccgcggcgcggacgacctggccgcccggttgaccgcccagcagctgatggtcgcccgcatggccgccgagggagccaccaaccgggagatcgccgcccgcctgctcctcagcccacgcaccatcgaccaccacctccggggcgtcttcgcccggctggggatccggtcgcgcatcgagctggtacggctcctgggcgagacggacgtg

SEQ ID NO: 7069 - DNA, 714 bp, Streptomyces avermitilis
  CDS (1)..(714)
atgtcggtactggtgatcacggggaccggcacggaggtcggcaagacggtcacgacggccgccgtcgcggcggtcgccgtcgcggccgggcggtccgtggccgtgctcaagcccgcgcagacgggcgtacggcccgacgagcgcggggacgccgacgaggtggcccgtctcgcgggtgcggtgacgacgctcgaactcgcccgctatcccgagccgttggcgcccgcgaccgccgcccggcgggccggtctgccgcccgtggggccgcacgaggtggccgaggccgcggcgaagctggcggtggagcacgatctcgtgctggtcgagggggcgggcgggctgctcgtgcgcttcgacgacgcggacggcaccctggcggatgcggcccggctgctggacgcgccggtgctggtcgtggcgtcggcgggactgggcacgctgaacaccacggagctgacggcacgtgaactgcggcgccgggagatcggcttcgcgggtgtcgtcatcgggagctggcccgagtcgcccgacctcgcctcccgttgcaacctcgccgacctgccggccgtggccggagccggtctgctcggcgcgattccggcgggggccggcgcgcactcgcccgtcggcttccgtgcgggggcgccgggttggctggcgccccgactgggcggaacgtgggacgcggacacgttcgcctcggcgttcgtgccg

SEQ ID NO: 7070 - DNA, 1311 bp, Streptomyces avermitilis
  CDS (1)..(1311)
gtgccggaacggacctcgcgcccaatgcctgacctgtccctggccgagctgctcgacctcgatcggcggcacgtctggcacccgtacgggccgatgcccggccgtcaggaaccgctcgtcgtcgaggcggcgagcggggtgcggctgcgcatggccgacggaacgggcgaactgatcgacggcatgtcgtcgtggtggtcggcgatccacggctacaaccaccccgtgctcaacgaagcggcgcgcgagcagctgtcgcggatgagccatgtcatgttcggcgggctcacccacgagcccgccgtgcgcctcgcgaagcgtcttgtcgacatctcgcccgagggtctggagcacgtcttcctcgccgactccggctcggtctcggtcgaggtcgcggtcaagatgtgcctccagtactggcggtcgctcggccgtcccggcaagcagcggctgctgacctggcgcggcggctaccacggcgacacctggcagccgatgtccgtgtgcgacccccagggcgggatgcacgagctgtggcagggcgtgctccagcgccaggtgttcgccgacgcgccgccggtcgcctacgaggagtcgtacgcggatcagctgcgcgaactgatcgagcggcacgccgacgaactggccgcggtgatcgtggagccggtggtgcagggcgcgggcgggatgcggttccactcccccgcctatctgcgggtgctgcgcgaggcgtgcgacgcgcacgacgtgctgctcgtgttcgacgagatcgccaccggtttcgggcgcaccggcgcgctgttcgcggcggaccacgtcggggtgacgccggacgtgatgtgtctgggcaaggcgctgaccggcggctatctgacgctggcggcgacgctgtgcacggcgcgggtggccgacgggatctcccggggggaggtgccggtgctcgcgcacgggcccaccttcatgggcaacccgctcgccgccgcggtggcgaacgcctcgatcgacctgctgctcgggcaggactggcagaccgaggtcaagcggatcgagacggggttgcgcgaggggctcgccgccgcggccgacctgcccggagtgcgggacgtacgggtcctcggggccatcggtgtcgttcagctcgaccgccccctcgacgaggcggccatggcggccgcgacacgggccgccgtgcgcgagggcgtgtggctgcggccgttccgcgacctcgtctacacgatgccgccgtacgtcacgggtgacgcggatgtggcacggatcgccggcgcggtgtgcgcggcggcaagggaaggg

SEQ ID NO: 7071 - DNA, 1164 bp, Streptomyces avermitilis
  CDS (1)..(1164)
atggacctgctgaacacgctggtggaaaaggggcttcggcgcgagctgccgagccgagccgaggcgctcgccgtccttgccacctccgacgacgacgtgctcgatgtggtggccgcggccggcaaggtgcgcaggcactggttcggccgacgggtgaaactcaactatctcgtcaacctcaagtcgggcctgtgccccgaggactgctcctactgctcccagcggctcggctccaaggccgagatcctgaagtacacctggctcaagccggacgaggcctcgcaggccgcggcggccgggctggccggcggcgccaagcgggtctgcctggtggccagcggccgcggcccgacggaccgggacgtggaccgggtctccgacaccatcaaggcgatcaaggaccagaacgagggcgtcgaggtgtgcgcctgcctcggtctgctctccgacggccaggccgaccggctgcgcgaggcgggcgcggacgcctacaaccacaacctcaacacgtccgaggggacgtacggggacatcacgaccacccacacgtacgccgaccgggtggagaccgtacagaaggcgcacgcggcgggcctgtcggcctgctcggggctgatcgccggcatgggcgagacggacgaggacctggtcgacgtggtctactcgctgcgcgagctggacccggactccgttccggtcaacttcctgatcccgttcgagggcaccccgctcgccaaggagtggaacctgacgcctcagcggtgtctgcgcatcctcgcgatggtccggttcgtctgcccggacgtcgaggtccgcatcgcgggcggccgcgaggtccacctccgtacgatgcagccgctcgcgctgcacctcgccaactcgatcttcctcggcgactacctcaccagcgagggccaggcgggcaaggcggacctggagatgatcgcggacgccgggttcgaggtggagggggccgaccaggtgacgctgccggagcaccgggcgccggccggcggctgcgggtctgagcagagcgcggggtgcgggtcgcacgagggcggcggagcctgcggttccgctcccgcgccgcggaccgacgaggcccgtacggacctggtcgccgtacgccgccggggtgccggaacggacctcgcgcccaatgcc

SEQ ID NO: 7072 - DNA, 1155 bp, Streptomyces avermitilis
  CDS (1)..(1155)
tggcgttcggctggatcgacgagcaggcgcacacgcgccgccgggccggtctcgtacgcaccctgcgcccgcgccccgccgactcgcccctcctcgatctcgcgagcaacgactacctcggcctcgcccgccatcccgagatcaccgagggcgcggccgaggcggccaggacgtggggcggcggcgccaccggctcccgcctcgtcaccggcaccacggaactgcacggcgaactcgaacgcgagctggccgacttctgcggcttcgaggcggccctggtcttctcctccgggtacgcggccaatctcgccgcggtcaccgcgctcgccccgcacggctccctgatcgtctccgacgcgggcaaccacgcctggctcatcgacggctgccggctggcgcggggcaccacccaggtcgtcgcgcacgccgatccggacgccgtgcgcaaggcgctggggacgcacgagggccaggccgtcgccgtctcggacacggtcttctcggtggacggcgacgcggccccgttggcggacctcgccgaagcctgccggcagtacggtgcggggctggtgatcgacgacgcgcacgggctcggcgtcctcggcgacggcggccggggcgccccctgggcggcggggctcgcgggcgcgccggacgtggtcgtgacggtcacgctgtccaagtcgctcggcagccagggcggcgccgtgctcggtccggcccgggtgatcgaccacctgatcaacgcggcccgtacgttcatcttcgacaccgggctggccccggcggcggcgggcgcggccctcgcggcgctgcggctgctgcgccgcgaaccggagcgtgccgcacgggcccgtacggtggcgaaggaactgcacacccggctgacggcggagggccacgaagcggtacggccggacgccgccgtcgtctccgtgcgggcgccctcccccgagcaggcggtgcggtgggcggcggactgccgggcggcgggtctcgccgtcggctgtttccgcccaccgtccgtgcccgacggcatctcccggctgaggctgaccgctcgcgcggacctcaccgacggtcagatcgaccgtgccgtgcgggtgatcggcgagacgcggccatacgtcggcgtaacggccgtgcatcgcacct

SEQ ID NO: 7073 - DNA, 1155 bp, Streptomyces avermitilis
  CDS (1)..(1155)
cggcggccggggcgccccctgggcggcggggctcgcgggcgcgccggacgtggtcgtgacggtcacgctgtccaagtcgctcggcagccagggcggcgccgtgctcggtccggcccgggtgatcgaccacctgatcaacgcggcccgtacgttcatcttcgacaccgggctggccccggcggcggcgggcgcggccctcgcggcgctgcggctgctgcgccgcgaaccggagcgtgccgcacgggcccgtacggtggcgaaggaactgcacacccggctgacggcggagggccacgaagcggtacggccggacgccgccgtcgtctccgtgcgggcgccctcccccgagcaggcggtgcggtgggcggcggactgccgggcggcgggtctcgccgtcggctgtttccgcccaccgtccgtgcccgacggcatctcccggctgaggctgaccgctcgcgcggacctcaccgacggtcagatcgaccgtgccgtgcgggtgatcggcgagacgcggccatacgtcggcgtaacggccgtgcatcgcacctagtgcgggacgagcggtcggctgtcagtccagtccggcgacgaatccctcccaggcctcgggggcgaacagcagggcggggccgctcacgttcttcgagtcgcggacggcgaccaggccggcccaggggccggggcccggccgggccgtctcgacgcagttgttcattccccgtgctgcggctgctgcgcagccaccgcacacctggcagagaggtacttgaggatacgcaccgaggcagtgcagtcatggtgcctccttacgagccgtcacctaatgcggcgcatgtaatccaacgtgtccttgggtgaaagggcgtggaaccgaagggtgtcgaaggcctcgctgtaggcctggaggtcttctttccgctcgagatagaggctactcgtcaggtggtcgagaacaaccacatccagatcagatctgctcggaaaggagaagataacgaaaggcccggtgattccgatgtgggcccccgcggcgaacggcagtacctgaagccgcacttgaggcagcttggccgcctccagcagccgttccagctgctgcgtcatgacctccgggccgccgacctcccggcgcagcaccgcctcgtcgaggaccgc

SEQ ID NO: 7074 - DNA, 177 bp, Streptomyces avermitilis
  CDS (1)..(177)
gtgtgcggtggctgcgcagcagccgcagcacggggaatgaacaactgcgtcgagacggcccggccgggccccggcccctgggccggcctggtcgccgtccgcgactcgaagaacgtgagcggccccgccctgctgttcgcccccgaggcctgggagggattcgtcgccggactggac

SEQ ID NO: 7075 - DNA, 849 bp, Streptomyces avermitilis
  CDS (1)..(849)
atgcagtacggaccagcagtgcgccgccgcaaactcggcgccgaattacgctccctacgcgcccgggcgggcctcaccagtggccaggcggccggtctcgtcggctggcaccagtccaaggtgagccggatcgagacgggctccagcggggtgaaaccgcccgacgtacggctgcttttggacgtatacggcgtcgaggatcccgaactgcgcgagctgctgctggtgttggcgggctccgacgacggcggcgtccggcagaactggtggcatgcctatcgcggggtgctgccgccgacgtaccgcgacttcatcagtctggagtcgcaggccagcgcgatgcgcacgctggagacctcggtggtgccgggcctgctccagacgcccgagtacgcccgggcggtgacccgggccgcggtcggcagcgcggaggacgccaagctggacactctggtggaggtgcggctggcccggcaggacgtcctgcgttcgaacccgccgctggaactgaccgcggtcctcgacgaggcggtgctgcgccgggaggtcggcggcccggaggtcatgacgcagcagctggaacggctgctggaggcggccaagctgcctcaagtgcggcttcaggtactgccgttcgccgcgggggcccacatcggaatcaccgggcctttcgttatcttctcctttccgagcagatctgatctggatgtggttgttctcgaccacctgacgagtagcctctatctcgagcggaaagaagacctccaggcctacagcgaggccttcgacacccttcggttccacgccctttcacccaaggacacgttggattacatgcgccgcattagg

SEQ ID NO: 7076 - DNA, 456 bp, Streptomyces avermitilis
  CDS (1)..(456)
atggcagatcaccaggaagcatccgtcactctgccgagcgatcccgcctcggtctccgccgcccgaaaatacgtcgcgagtgtgctggccgaatggggcctgccgggcgacgcggaagtcgcggacaccgtgcgcctgatcgtgtccgagctcgccaccaacgcggtccagcacaccttcgggcagtcacccacgttcacggttgacatcgcgctcgaccgcgacgaacacctgcacatcggtgtcaccgacagccatccacgcttcccgaaacgactgcccgcggccgtccagcaggacaacggccgcggaatggtcatcatccgctggctgaccgccgagtgcggcggcaggatgcgggtccggcccacccgggagggcggcaagacggtactgatcgaactcccgtgggcggtgtccgcgcagccggtgacggcaggggggcagcaagaaccc

SEQ ID NO: 7077 - DNA, 552 bp, Streptomyces avermitilis
  CDS (1)..(552)
gtgacacgggccgaaacggttactcgttcacccatggccgaccgacctgcccgagcgttgcgcgacgagacatccctggaacgcgccgaccgcaacttcgcggagctgctccaggaactgcgggtcacccagacgggcgtccagatcctgttcgccttcctgctgaccctggccttcaccccccgcttcccggccctcgacacggtgcagcgcgccacgtacgtcaccacgctgctgctctccatgctggccgcggcgctgttcacggcgcccgccgcggtgcaccgggggctgttccagcagaacgccaagcccaccatcgtgcggctctcctcccgcctggcctcgatcggcctcggagtgctgatgctggccttcaccgggtcggtgctgctcgtggtggacgtggccctgggccggggtgccggcatcgccgccggcgcggggacgctggccgtgtgcgtggccctgtgggtcgtactgccgctgatggcgcagcgttcggctctcgcgcggccggccggcccggaagcagaaccacgccgagaaccc

SEQ ID NO: 7078 - DNA, 471 bp, Streptomyces avermitilis
  CDS (1)..(471)
atgtctgcgctcaatcgtgtcccctcgctgctgaccagggccggtacggcctcagctctcacccttgctgccgtgggcggcagcatcgcggtcccgggcgtcgcctccgacgccgcggccgcgacaccagcgacgaaggcactccagatcgcggcgtccaagaagggctccccctacaagtggggcgccgcggggccgcgccgcttcgactgctccgggctcacgctctacgcgttcaagaaggcgggcaagagcctgccccgtacggctgcggcgcagtacaacaagacccaccatgtctccgcgtcccaccgcaaggcaggggacctggtgttcttccactcgggccggagcgtgtaccacgtcggcatctacgccgggaagggaaagatctggcactccccgaagaccggggaagtggtgaagctccagaagatctggacgaagagcgtgtggtacggccgggtcagc

SEQ ID NO: 7079 - DNA, 306 bp, Streptomyces avermitilis
  CDS (1)..(306)
atgctgccgcccgaactgcctccgctgcccgcactgacccgcgccgaggccgagctgatcgaccgttacctcgacgtggtcgacctcctcggccgtatcaaccccgcgcgcccgggagacacctaccgcggactgcgcgccgcccaggcactggtgggcaaggcgaccgcgctgcgcgacgcgctgacgctgatgcaccagcgcggcgagagcgagctgcacgccccgaccctcgcgcaggccctgcgcgtcctcgacggcgagcggcgcgcggcccgggtcaccgtgccgccgcgatccgacagt

SEQ ID NO: 7080 - DNA, 633 bp, Streptomyces avermitilis
  CDS (1)..(633)
atgaaccgaccgtccgcccgctacgccctgcccgagttcaccgagcgcctcagtaccgggctccggacactggatccgtactcgaagctgctggacgaacggatcgtgtttctcgggacaccgatcgacgacacgtcggcgaacgatgtgatggcccagttcatgcacctcgaacacctggccccggaccgggacatctcgctgtacatcaactcccccggcggctcgttcagcgcgatgaccgcggtctacgacacgatgcagttcgtcagctgcgacgtggagaccatctgcctggggcaggcggcatcggccgccgccgtgctgctggccggtggcacaccgggcaagcggctcgcgctgcccggcgcacgcgtgctgatccaccagccgtcgctgcccgcgccggtccagggccaggcgagcgatctggtcatccaggccgcggaattggcgcgtacccgcgagcagttggaggaactgctcgtacggcacaccgggcagagccccgagcgcgtcgccgccgacatcgagcgggacaagatcctggacgcgccggcggccgtggcgtacggcctggtcgaccgggtcgtcccgagccgcaagtcgtccgccgccgcgcccggcgcgagg

SEQ ID NO: 7081 - DNA, 273 bp, Streptomyces avermitilis
  CDS (1)..(273)
atggcctacgagattcccgtgacgcaagccagggctgagctcgccgatctgatcaaccgtgtggtgtacggcggcgagcgcgtcgtcgtgacgcggcacgggaagcccctcgtcgccctggtctccgcggccgatctggagcggctcgacaagctggacgcggcggaggagcaggtggtcagcgcggtgtccagcgtccgcgaggtcgccgccgcaccccgcgagcgacagcgcttcggcatcgcggccgagcatcggggcccgaatgcctcg

SEQ ID NO: 7082 - DNA, 279 bp, Streptomyces avermitilis
  CDS (1)..(279)
atgaccgcgccgtatacggtccggtcctcgaccacctctcgcgccgtgcccacatgggggtggcggtcggtctcgaacgcgccctcgtgccgctcccgttgccgccgcatgcggccggtcgcggccgccgggcccggcatgccgagcgggaggccgccgggcggacacggcaggcgggtgcgggtggcggggcggccgacggcgacgggggcaccgttctccccggtgcgggaccccggggctggaggtcaccaaaaagagcgggcgttcgggccgtca

SEQ ID NO: 7083 - DNA, 300 bp, Streptomyces avermitilis
  CDS (1)..(300)
gtgcaactgaccccgcacgagcaagagaggctgctgatccatgtggcagccgacgtggccgagaagcgccgggcccgcgggctcaagctcaaccaccccgaggcggtcgcgctcatcacgtcgcacatcctcgaaggcgcgcgtgacggccgtacggtcgccgaactcatgtcctccgggcgcaagctgctcacccgggacgacgtcatggagggcatccccgagatgatccacgacgtccaggtcgaggcgaccttcccggacggcaccaagctcgtcaccgtccacgacccgatcgtc

SEQ ID NO: 7084 - DNA, 309 bp, Streptomyces avermitilis
  CDS (1)..(309)
atgattcccggagagatcctcttcgccgacggacccgtcgcctacaacgagggccgcgaggtcacccggctgaccgtcctcaacgccgccgaccggcccgtccaggtcggctcccactaccacttcgccgaggccaaccccggtctggacttcgaccgcgccgccgcccgcggcaagcggctcaacgtcgccgccggcaccgccgtgcgcttcgaacccggaatccccgtcgacgtcgaactcgttccgctcgccggcgcccgcgtggtgcccgggctgcgcggggagaccggaggtgccctcgatgcc

SEQ ID NO: 7085 - DNA, 1719 bp, Streptomyces avermitilis
  CDS (1)..(1719)
atgcctgagatctcgcgtcccgcctacgccgacctgttcggcccgaccaccggcgaccgcatccggctcgccgacaccgatctgctgatcgagatcgaggaggatcgttccggcggtcccggactcgccggtgacgaggccgtcttcggcggcggcaaggtcatccgcgaatccatgggccaggcgcgcgccacgcgtgcggacggcaccccggacacggtcatcaccggtgtcgtcatcgtcgaccactggggcatcgtcaaggccgacgtcggcatgcgcgacggccggatcaccggcatcggcaaagcgggcaacccggacaccatggacggtgtgcaccccgacctggtcatcggtccggagaccgagatcatcgcgggcaacggccggatcctcaccgcgggcgccatcgacgcgcatgtgcacctgatctgcccgcagatcgccgacgaggcgctcggctccgggatcaccaccctcgtcggcggtggcaccggccccgccgagggctccaaggccaccaccgtcacacccggcccctggcacctggcgcggatgctggaggcgatggaggagtacccgctcaacttcgggctcctcggcaagggcaacaccgtctcgcacgacgcgatgctgtcgcagatccgcggcggagcactcggtctcaagctgcacgaggactggggatccacgccggccgtcatcgacgccgcgctgaccgtcgccgaccggaccggcgtccagatcgccatccacacggacacgctgaacgaggccggcttcgtgggcgacacgctcgccgcgatcggcggccgcggcatccacgcctaccacaccgagggtgcgggcggcgggcacgcgccggacatcatgagcgtggtctccgagccgcacgtgctgcccagctccaccaacccgacccggccgttcaccgtcaacaccgccgaggaacacctcgacatgctgatggtctgccaccacctcaacccggcggtccccgaggacctcgccttcgccgagtcccgcatccggccgtcgacgatcggggcggaggacatcctgcacgacctgggcgccatctcgatcatctcgtccgacgcccaggccatgggacgcgtgggcgaggtcatcatgcggacgtggcagacggcccatgtcatgaagcggcggcgcggcgcgctccccggtgacggccgcgcggacaaccaccgcgtacgtcgctatgtcgccaagtacacgatcaacccggcactcgcgcagggcctcgcccgcgagatcggctccgtcgagacgggcaaactcgccgacctggtgctgtgggagcccgcgttcttcggggtcaagccgcacctcgtcatcaagggcggacagatcgcgtacgcgcagatgggcgatgccaacgcgtccatccccacgccgcagccgattctgccccggccgatgttcggggcgatcgggcgcgcgccggcctcgaactcgttcaacttcgtggcgccgctcgccatcgaggacgggctgccggagcggctctcgctcgggaagcggttcgtggcgatcgagtcgacgcgcggtgtgaccaaggcggacatgcgggagaacgacgcacggccgcgggtacggatcgaccccgacagcttcgccgtgcacatcgacggggagctggtcgaggccactccggccgccgaactgcccatggcccagcgctacttcctcttc

SEQ ID NO: 7086 - DNA, 672 bp, Streptomyces avermitilis
  CDS (1)..(672)
atgtcccgcgcagcactgctcgtcctggccgacggccgcttccccgccggagggcacgcccactccggcggcgccgaggcggccgtcaaggccgggcgcatcacggacgcggcgagtctggagaacttctgccgggggcggttgcacacggcggggctggtctcggccgcactcgccgccgcggccgccctcgggatcgatccggtgacgctggactcggccgcggatgcccgtacgccctcgcccgccctgcgggttgccgcgcgcaggctcgggcggcagctgatgcgggccgcccgggcgacctggccgtccaccgaactggacgcgctggcaagggagttccccaagggagcccatcaacccgtggtactcggaatggccgcccgcgccgccggcctcgcgcccgacgacgccgcgtactgctcggtgtacgagagcgtcagcggtccggcgaccgcgacggtacgcctgctgagcctcgaccccttcgacgccacggccgttctggcccggctcgcgcccgagctggaccgcatcgcacaccaggcggccggagccgctcgccaggcactcgacgacggcgtcgacatgctgcccgcggcctccgctccgctgctggagatcagcgcggaggcacacgcggcctggccggtgcgcctcttcgcctca

SEQ ID NO: 7087 - DNA, 681 bp, Streptomyces avermitilis
  CDS (1)..(681)
atgcatctcgaccacgcccacacccatgacggcccctccgccgtgagcgcggacgcccaccggcccgacggcacccggcgtgccctgcggatcggcctcggcggaccggtcgggtccgggaagaccgcgaccgttgccgcgctgtgccgtgccctgcgcgacgcgttctccctcgccgtcgtcaccaacgacatctacacccgcgaggacgccgagttcctgctgcgggaggccgtgctgccgcccgagcggatcaccgccgtggagaccggcgcctgcccgcacaccgccatccgcgacgacatctccgccaacctggaagccgtggaggacctggaggacgaagtcgggccgctcgatctcgtcctcgtcgagtccgggggcgacaacctcaccgccaccttctccaaggggctcgtcgacgcgcagatctttgtcatcgacgtggccggcggggacgacattccgcgcaagggcggccccggggtcaccaccgccgacctgctcgtcgtcaacaagaccgacctcgcgccgtacgtcggctccgatctggggcggatggccgccgacgccaaggcgcagcgcgccgaactgcccgtcgtcttccagtcgctccgcaccgagcccggggtcgcccccgtggccgactgggtgcgggcgcggctcgccgcgtgggcggca

SEQ ID NO: 7088 - DNA, 756 bp, Streptomyces avermitilis
  CDS (1)..(756)
atgaccgcggcaggggtgcgggcgaccgcgcggatcggggcccggggcgacggacgcggcggtacgtcgctgcccgtactggagggtgaggggccgctcgcgctgcggcgcacccgggcgagcggctccgaggcgcgggtcatgctcgtcggggcgatgagcggcccgctgggcggcgaccacttcaccgtcgaggcgacggtcgccgcaggtgcccggctgcacgtcgggtcggcggccgccaccatcgcgctgcccggccaggccaagggcgaggcccgttacgacgtgctgctcgacgtcgccgcagggggcgagctgcgctggctgcccgagcagttgatctcggcgggcggcagcgagctgtatgtctccacgcgcatcgatctcgaacccggcgcccggctcgtcttccgcgaggaacaggtgctcgggcgcgtcggcgaggaacccgggcgcctcaccagccgtctcaccctgcgcatcggggggcgtgcggtgctcgaccaggagctggcctgcggaccgggggcgcccggcggctgggacgggcccgccgtgctcggaggacatcgcgctctgggacaactcgtcgtcgtgcggccggagttcgagcgggagccggtgcgggcccggctgcttggggagtccgccgcgctgaccccgctcggcggggccgcggcgctcgtgaccgcgctcgccccggacgcgcttttgctgcgccgcgtgctggacgaggcactgagcagcctcggc

SEQ ID NO: 7089 - DNA, 1593 bp, Streptomyces avermitilis
  CDS (1)..(1593)
ttgaggggtatgagaccgacgagacgggtcacggcactgggttcggccggagcgctcgtgacggcgactctgatagccggtgccatggcggcaccgtcggccaccgccgactcgcgtcacggtcaggaccgggaggcccgcggcgccgcgatcgccgccgcgcgggccgccaaggccgggatcgactggcaggactgtccggccgactggggcttcgccaagccgatccagtgcggctgggtcaccgtcccgctcgactacgcccgcccgaacggcaagaagatcaagcttgccgtcgaccgcatcgggaacacgggtaccaaggaggagcgccagggcgccctcgtctacaacccgggcggccccggcggctccggcatgcgcttcccgacccgggtcaccaacaagaacccgatctggaccaacgtcgccaaggcgtacgacttcgtgggcttcgacccgcgcggtgtcggccactcggcgcccatctcctgcatcgacccgcaggagttcgtgaaggcgcccaaggccgatccggtcccgggctccgaggcggacaagcgtgcccagcgcaagctcgccgccgagtacgcggacggctgcgccgagcgcagcggcgacatgctgccgcagatgaccacgcccaacaccgcgcgcgacctggacgtcatccgcgccgccctcggtgagaagaagctcaactacctgggcgtctcgtacggcacctacctcggtgccgtctacggcacgctcttcccgggccacgtccgccgcatgatcgtggacagcgtcgtcaacccgtcgcgggagaagatctggtacgaggccaacctcgaccaggacgtcgccttcgagggacgctggaaggactgggaggactgggtcgccaagaacgacgcgaccttccacctcggcgacacccgtgccaaggtgcagaagcagtggctgacgctgcgcgccacggccaagaagagccccctcggcggtgtggtcggtccggccgagctgatctccttcttccagagcgctccgtactacgactcctcgtgggtgccggtcgcgacgacgttcagcaagtacgtcgccggtgacacgcaggcgctcgtggacgcggccgcaccggacctgtcggacaccgcgggcaacatcgcctcggagaacagcaacgcggtctacacggccgtcgagtgcaccgacgccaagtggcccaccagctggaagaagtgggacaaggacaacacgcggctcaacaaggactacccgttcatgacgtgggccaacgcgtggatgaacctgccctgcgccacctggccggccaagcagcacacgccggtgaacgtgaagacccacaagggcctgcccgccgtgctgatcgtgcagtccgagaatgacgccgccaccccgtacgacggcgccgtcgagctgcacaagcgcttcaagggctcccgcctgatcaccgagaaggacgcgggctcgcacggtgtcaccggtctgctcaacccctgcgtcaacgaccgggtgaacacctacctgctcacgggcgggacggacggcgccgacgtgacgtgcgccccgcacgccacgcccaagccg

SEQ ID NO: 7090 - DNA, 723 bp, Streptomyces avermitilis
  CDS (1)..(723)
gtgttttattacgtgctcaaatacgtgattctcggaccgctgttgaagctggtgttccggcctcggatcgagggtctcgaacacgtaccgtcgtcgggcccggccatcgtggcgggcaaccatctgtcgttctcggaccacttcctgatgcccgcgatcctcaaacggcgcatcaccttcctggcgaaggccgagtacttcacgggccccggcatcaagggccggctcacggccgcgttcttccgcagcgccggacagatcccggtggaccgctccggcaaggacgcgggccaggccgcgatccgcgaaggcctcggcgtgctgcgcaaggacgagctgctcggcatctacccggagggcacgcgctcgcacgacggccgcctctacaagggcaaggtgggcgtcgcggtgatggccctgcgggccggggtcccggtgattccctgcgcgatgatcggcaccttcgaggcccagccgccgggcaaggtcatcccgaacatccaccccgtcgtgatccgcttcggcaagcccctggagttctcccgctacgccggtatggagaacgagaaggcggtcctgcgcgccatcaccgacgagatcatgtacgccatcctcacgctctccgaacaggagtacgtcgaccggtacgcggcggtcgtcaaggccgaggaggccgccgagaaggcggcgaaggcccgcaagtttccccggatcccgctgagt

SEQ ID NO: 7091 - DNA, 1224 bp, Streptomyces avermitilis
  CDS (1)..(1224)
atgaccgctcccgcccgtacgcgttcgtccgccgacctgatccgtgccgaggcgccggtcctcgcgcacaactaccacccgctgcccgtggtcgtggccagggccgagggcacctgggtggaggacgtcgagggccgccgctatctcgacatgctggcgggctactcggccctgaacttcggccaccgtcacccggtgctgatcgaggccgcacaccgccagctcgaccagctgaccctgacctcccgcgccttccacaacgaccgactggcccaattcgccgagtccctggccgagttgacgggcctggacatggtgctgccgatgaacacgggcgccgaggcggtggagagcgccatcaaggtggcccgcaaatgggcgtacgaggtgaagggcgtcgccccggaccaggcgacgatcgtcgtggccgccgacaacttccacggccgtacgacgacgatcgtcagcttctccacggacgacaccgcccgtacggggttcggccccttcacgccgggcttccggatcgtcccgtacaacgacctggccgcgctcgaggccgccgtggacgagacgacggcggccgtgctgatcgagccgatccagggcgaggctggcgtcgtcatcccggacgacggctatctggccggcgtacgcgagctcacccgccgcaccgggtgtctgttcatcgcggacgagatccagtcgggcctcgggcgcaccggccgcacgctggccgtggagcacgagagtgtcgtcccggacatgctgctgctcggcaaggcgctcggcggcggcatcgtgccggtgtccgcggtggtcgcccgccgggacgtcctcgcggtactgcggcccggggagcacggctcgacgttcggcggcaatccgctggccgccgcggtcggctcggcggtggtcgggctgctggagaccggtgaattccagcgcggggcggccgagctgggtgtggtgctgcgggacggactcgccgccctcgtcggcaagggcgtcgtgggcttccgggcgcgcgggctgtgggcgggcgtcgacatcgaccccgcgatcggcaccgggcgcgagatcagcgaacgcctcatgcgcgaggggatcctggtcaaggacacccacggttcgacgatccggctggccccgccgctcacgatcaccggcgaggaactggcgtcggctctggggaccctggagaaggtgttgacgcaagaggcc

SEQ ID NO: 7092 - DNA, 867 bp, Streptomyces avermitilis
  CDS (1)..(867)
ttggtgtcaacccccagtcgacaccgcaggaagcggaggtacccctctgtggccgaaagccgtgtgccgcgcccccggcgctttctcgtctgcgagccgagccacttcggcgtgcagtacgccatcaacccctggatgcatcccgacacctcggtggacgtcgatctcgcccgcggccagtggcaggcgctgatcaacgcctaccgcgcccacggccacaccgtggacaccgtgcagccggtcgcggacctcccggacatggtgttcgcggcgaactccgccctcgtcctcgcgggccgtgtcttcggctcgtacttccacgcgccccagcgccgccccgagtccaccgtgtacgactcctggttcaaggcggcgggcttcgacgtgtaccgcccggagtcggtgtgcgagggcgagggcgacctcgtcccggcgggccgctacgtcctggcgggcaccggcttccgtacgacggtcgaggcgcaccgcgaggtgcaggagttcttcggcgtcccggtgatcagcctgcggctggtggacccgtacttctaccacctggacaccgcgctgttcgtcctcgacgacggccacgaggcgaacatcgtgtactacccggaggcgttctcgcccggcagccgcgaggtgctccagcggctcttccccaacgcggtgctcgccacccgcgaggacgcgctggccttcggcctcaactccgtctccgacggccgtcacgtcttcatctcaccgggggcgacggccctcgccgaccagctcgtacgccacggatacgtccccgtccccgtcgacctctcggagttcttcaaggccggcggcggcatcaagtgctgcactcaggagatccgttca

SEQ ID NO: 7093 - DNA, 501 bp, Streptomyces avermitilis
  CDS (1)..(501)
atgaacagcaagccgacgacgttcgacgacctcgaccgcaagatcatcaccgctctgacggcacatgcccggagcagtttcgccgagatcggcgcggcgatcgggctgtcggccacggcggtcaagcgccgggtggaccgactgcgcgagaccggggtgatcacggggttcacggccacggtgaagccgtcggcgctgggttggcgcacggaggcgtacgtcgaggtgtactgcgagggcgcggcgccgccccggcggctcgcggaggtcgtgcgcaaccatccggagatcaccgcggcgatgacggtgacgggcggcgcggatgccctgctgcacgtgcgggcgacggacgtggagcacttcgaggaggtgctggagcggatccgggcggagcccttcatccggaagacggtcagctacatggtgctgtcccacctcctcccggaaagccccgaagcgggcgcgagccagccggcaccgcaggacgcatcagacctgcgc

SEQ ID NO: 7094 - DNA, 753 bp, Streptomyces avermitilis
  CDS (1)..(753)
atgctgcgcgcgctcgccgtcgacgacgaacaaccctccctcgaggaactcctctatctgctgaacgccgacccacgggtcagcagtgccgagggcgcgagcgacgccaccgaggcgctgcgccggatcaaccgggcactggagtccgggcccggcgggcccgaggcgatcgacgtcgtcttcctcgacatccacatgccgggtctcgacggactcgacctggcccggctgctcaccgggttcgccaagccaccgctcgtcgtgttcgtcaccgcccacgaaggcttcgccgtgcaggccttcgacctcaaggccgtggactacgtgctgaagcccgtccgcagggagcggctcgccgaggccgtccgccgggccgcccagctgacggacaccgctccgctgataccggtgcacgagcccgaccccgaccacatgtccgtcgaactcggcggagtgacccggttcgtccccgtcgaggacatcacgcacgtcgaggcgcacggcgactacgcccgcctgcacaccgcccagggcagccacctcgtccgcatcccgctgtccaccctggaggagcgctggcgcgcccgcgggttcgtccgcatccaccgccgccacctggtcgccctgcgccacatcgacgaactccgcctggacacgggcacggtgagcgtcctggtcgactccgtcgaactccaggtcagccgacggcacgcccgcgaactgcgcgacctgctgatgcgccggaccacgagc

SEQ ID NO: 7095 - DNA, 357 bp, Streptomyces avermitilis
  CDS (1)..(357)
gtgccccaggatccgacggaacggcgcgtggtcgtcaccggaccgccccggcgcgcccgccgggcctttgactactaccgcccgcgtaccgagatcgacgaacagaccaccctcggccacacctatgtccgctccctgatgcgctcccaactgcgcgccggactcgccgtgttcgcggtcctcgtgctgctcgtcggcccgctgcccctggtgttcgcggcgatcccggacgcccgccgcctcacctgggcggtgctcggcttctgcctctacgcgccgctggtgctgctcgcccgctggtacgtgcggcgcgccgaacgcaacgagcgggacttcgtccgtctcgtcgaggaccgc

SEQ ID NO: 7096 - DNA, 1725 bp, Streptomyces avermitilis
  CDS (1)..(1725)
gtgaactccagctacgccgttcccgcggtcgccctcgtcgtcctggcgaccgtcctcgtcggcgcgttcggcctgcgcatctcccggaccacctccgacttctacgtggcctcccgcacggtcggcccccggctcaacgcggccgcgatcagcggcgagtacctgtccgccgcctcgttcctgggcatcgccggactcgtcctggtccagggccccgacatgctctggtaccccgtcgggtacacggccggccatctggtgctgctgctgttcgtggccgccccgctgcgccgctccggcgcgtacaccctgcccgacttcgcggaggcgcggctcgcctcgcaggccgtacgacggctcgccggggccttcgtcgtcggggtcggctggctgtacctcctgccccaactccagggcgccgggctcaccctggccgtgctgaccggcgcgcccgactcgctcggcggagtcatcgtcgcggtcgtcgtggtcgcgaccgtcgccgcgggcggcatgcgcagcatcaccttcgtccaggccttccagtactggctcaagctcaccgccctcctggtccccgcgctcttcctggtcctcgcctggcagggcgcgggcgcaccgcgcaccgccttcgacgaaccggcggccttccgcgaacagcgggtcgtgacggtcgacgagagcctcgacctcaagctgtcccgcccgctcgacgtcacggcgagcggcacggtcgacgggcggcggtacagggggaagcgggtggccctcgcccccggcgtgcaccgcgtcgagggcggcacccggctgaccttcgccgagggcgatcccgtcccggccgccgaccgcggcggcaacggcggcatgtcgacctccctggcggccggccgcgaggaacgtccgctgtacgccacgtacggactgatcctcgccaccttcctcggcaccatgggactcccgcacgtcgtcgtccgcttctacaccagcccgcacggagtggccgcccgccgtaccaccgtcgccgtgctcggcctgatcggcgccttctatctgctgccgccggtctatggggcgctcggccggctgtacgcgcccgaactcggcctcgccggcgacgccgacgccgccgtactgctgctgcccgaccggctgatcggcgggctcggcggcgatctgctcggcgcgctgctggcgggcggcgccttcgccgcgttcctgtccacggcctccgggctgaccatggcggtggccggggtgctcacccaggacgtgctgccctcgcgaggcgtacggcacttccggctcggtacggtgctcgcgatggccgttccgctggcggcgagcgcgctggtgggcgggctgccggtcgccgacgccgtggggctcgcgttcgccgtgtccgcctcgtccttctgcccgttgctggtgctgggcatctggtggcggcggctgactccgccgggtgcggcggccgggatgctggtcgggggcggttcggcgctggtggcggtcggcgcgaccatggcgggctacccgcggggcggggcgctgcacgcgctgctggcgtggcccgcgttgtggtcggtgccgctcggctttctgacgatgacgctggtgtccctggcgacaccggggcgggtaccggcggggacggcggcgatcctggcacggttccatctgccggaggaactgtccggcggaccggtgcgggcggaggccaaggcg

SEQ ID NO: 7097 - DNA, 1203 bp, Streptomyces avermitilis
  CDS (1)..(1203)
gtgagcggatttctggcggggctgtgcgtggccgtcctgcccctgctcgccgccggcttctggctcggccggcggaccgcgcgccccgagagcctcggcgggctcggcacgcccgtggagcacgccaccttccagaccctgcacaccgcctcgctcgccgcgccgccactgcgcgcgggtctcaccgaggagacggcccgcaagtccacgcggcggctgcgcaccctgctcggcacggacgcgctgtgcctcaccgacccggagacggtcctcgcctgggacggcgtgggggagcaccaccgcaccgagatcatggaacggctcgccgggcccctggagtccggccgcggcgaggccttccggctgacctgcgacatcccggactgccccctgcgctgggccgtcgtcgcgcccctcaccgtcgacgagcgggtgcacggcgcgctcgtcgcctgcgcgccccgcgaatcggccgtactcgtccgcgcggccggcgaggtcgcccgctgggtctccgtccaactcgagctcgcggacctcgaccggtcccgtacacggctgatcgaggccgagatcagggcgctgcgcgcgcagatctccccgcacttcatcttcaactcgctcgcggtgatcgcgtcgttcgtccgcaccgaccccgagcgggcccgcgaactgctcctggaattcgcggacttcacccgctactcgttccgccggcacggcgacttcaccacgctcgccgacgaactccacgccatcgaccactacttggcgctcgtcagggcccgcttcggcgaccgcctctcggtcaccctgcagatcgcgcccgaggtgctcccggtcgccctgccgttcctctgtctccagcccctcgtggagaacgccgtcaagcacggcctggagggcaccgccgacaagcggcacatcagtatcaccgcgcaggacgccggcgccgaggcgtgggtcgtcatcgaggacgacggcgcgggcatggaccccgaggtgctgcgccgcatcctcgccggagaggtcagcccgtcgggcggcatcgggctctccaacgtcgacgaccggctgcgccaggtctacggggacgaccacggcctcgtcatcgagaccgcggtcggggcgggtatgaagatcaccgcccggctgccgaagtaccagccgggcgtgcactcggcgggccggctgccccgggaa

SEQ ID NO: 7098 - DNA, 735 bp, Streptomyces avermitilis
  CDS (1)..(735)
gtggcgcatctgccgcccggcggcggcgacgcgaagccttacggagcggccgtggccctcgccgcgccgctcaaggacggcgactgcgtcgtcgccgactggcccggcgccgccttccagggcacgccgaagctggccgtggacccgacctgcgccgagaaggtgccggacggccaggtcatggcggtcgtcgcggcgacgtccgccgaggcggcgcggcagcacggtccggccgcgtgcgagcagcgcacgcaggagatccgggagaagctcgccgacgtgcgcagctacgccgtggtgccgacgcgggcgggattcgaggcggccgggcggcgcaccgcctgtctggtgctgggcgcgcacggtgcggtgtacgggccgctcgaccgtcaccgcacgcccggcatgtggttcgtggacacggcgaacatgcagaagcgggactgtctggacgccccttccctccgcagggcccagctggtctcctgtgccggaccgcacgatcagcaagtgctcggcttcacccggctcagcgccggcaccacccttaagaaggcggccgctcaatcggacgccgcctgcgcgcgggacgtgccgccggcccagtacgggtacgacccgggggtctacgaagcggcttcgtgggccgcaaagggagcgtggcactccggcacacatctcgtcgtgtgcagcgtccagcggcagaacgggggcaccatggaggggaccgaacca

SEQ ID NO: 7099 - DNA, 2076 bp, Streptomyces avermitilis
  CDS (1)..(2076)
atgccatcaggatcaccgcagtcgggagtgggccgggtcatcgccggccggtacctcctgctgaaccggctcggcagcggcggcatgggccatgtctggctcgcccatgaccagcggctggcctgcgaggtcgcgctcaaggagatcgtgttccgcagtccggcggaggccgggcaggagcgcacggcccgggtcgcacgtgcccgggccgaggcccggcacgccgccgggctgcgcggccatccgcatgtggtgaccgtgcacgacgtactggagcacgagggcctgccctggatcgtgatggagtacgtggcgggcgcgctcgacctgcgggacctcgtgcgccggcgcggcccgctggcgcccgccgagtgcgcccgcatcgggctcgccgtgctcgacgcgctcaccgcggggcacgagcgcggcatcatgcaccgggacgtgaagccggcgaacatcctgctggcgccggaccgcacgggggcggcgtacgcgcgcgtgctgctcaccgactacggcatctccgtgcaaccggacgcgggcgagacccggtacaccctcacgtcggcgctggtcggcacgcccggctatctggcgccggagcgggcgaccggcgggccgccgaccgcgaccgccgacctgttctcgctggggtgcacgctgtacttcggggtcgaggggtgcgggcccttcgagcgggacacgcatctcgccgaggtcaccgccgtggtgctggaggagccgcgcccgccggtgcgggcgggggcgctggaaccggtgctcgccgcgatgctcgcgaaggaccccgggcagcggatcacggcggaggacacggaggccgcgctgtcggcgatcgtcacgccccagccccatccgcgcacccagttcgacctggggtcgcagccgccgtgggcggaggccgggtggaccaccgagaccgggtatccggggcacgggccgggggccggtcccggcgggaacggaacgtcgggcgcgtacggaccgggcggcacggggtccggggcggggagcgcgccggggtcaccgccaccgggggcgaccgcgggaacggcggggcggggcacgccctcggagccggggccggtgcgggggccggccgccggaccgtccgggcaggacccgaacgccgccccgtacgcccacgaccccgccaccccctcgtacggccaggagccgggcgcgccacgacccggacccggccccaccgcctcgccgtacggccgcagccccaccgccccctcgtacggccagagcccggccgcgaccccgtacgcccacgaccccaccgcgtcgccgtacggccagagcccggccgcgacccgtacggctaggcctcagtgcctcctcgtacggttcggatgtcatcggccggcccgccggagcggcgttcggtgccgctggtttcggttccggtcggcggcgtcgcaagcgccctcgtgtccttcagtccgtcatcgccttcaccctcggcctcgtcctcgcgctgggcggtgtctggtacgcggtggcgcatctgccgcccggcggcggcgacgcgaagccttacggagcggccgtggccctcgccgcgccgctcaaggacggcgactgcgtcgtcgccgactggcccggcgccgccttccagggcacgccgaagctggccgtggacccgacctgcgccgagaaggtgccggacggccaggtcatggcggtcgtcgcggcgacgtccgccgaggcggcgcggcagcacggtccggccgcgtgcgagcagcgcacgcaggagatccgggagaagctcgccgacgtgcgcagctacgccgtggtgccgacgcgggcgggattcgaggcggccgggcggcgcaccgcctgtctggtgctgggcgcgcacggtgcggtgtacgggccgctcgaccgtcaccgcacgcccggcatgtggttcgtggacacggcgaacatgcagaagcgggactgtctggacgccccttccctccgcagggcccagctggtctcctgtgccggaccgcacgatcagcaagtgctcggcttcacccggctcagcgccggcaccaccct

SEQ ID NO: 7100 - DNA, 1458 bp, Streptomyces avermitilis
  CDS (1)..(1458)
atgacattttgcatgcccatgcaaagggcaggaaaatcggtggtccgcaggcttggcattctgctggtctgcgctctggtcctgagcgggtgcgacagaggcccgcagctgttgacggtgaaagccgtcgccgcgcgagttccttcactcgcacctttcttcgatgaggaaagtggcctcggccacgactccacggtccgtcgccaacagccgcacagcggcctacaggccggcaacacgccaggcctgtacgggggcacacggaagccgacgatctgcgacgtcaaccgtctcaagaaattcctcaccgatcccaggaacgaccgaaaggcacatgtctgggcgcaggtgctcaagatttcccaggacgagattcccgcctacctcgacaggctcacaccggtcctgctgcgtcacgacactctcgtgcagaaccacgactacaaaaagggcagggcagcccctttcaactccttgctcgaggcgggcatcgcgatattggtggatgagcagggacttcccgcggtgaagtgttcctgcggaaatccgctgcggcccttcgcgggtgacgcatcgaggatttcggtcaagttcgagaacggcaacaagaagtgggacggctacgaccgtgcctctctggtggccgtcaagcccgccccgcggcgcatcgagcaactcgcgctcgtcgacgtcgacaacccggaccgggggatcacccggccggccggcaccaccggcgcacacgactccccgttcgacacccacgagcggcacaaggtgcccgaagtggccggtatggggttcggcgacgcgagtcagcgactggcggacaagggcctcgcagcggcgtacggcgaaaagggaccgccacccgacgacgcccgggtcaccggctccgacccggcgccgggcaccgagctggagttcggggagtacgtgacgctgtccgtggagcgggggacggccggcaagacgggcagggggagcggcgacgggaccaccggcgaaaccggcgaggggcgcacgggtggtacgagcgctcccccggcatcgggctcgacgacgcccggggggagcggccagccgcctccgtcctccggtggcgctacgacctcgtccccgccgcccgcttcgtctccgccctcgtccgcgacgagcggtggccctcctggcgcctcgaggagttccgggagttccgagagttccgagccgccgccggcgagcagcgcgtccgcgtccaggccgccgcctgccgtgagcagcccgccgcctgccgtgagcagttcgccgcccacgagccggccggtcaccagcgcgcccgtgacgtccgctccggtgacgtccgctccggtgacgagtgccccggcgaccgcccagccggtcacgtcggatccggtcgcctccgatccggtcgcctccggtcccgtggccggcgaagcgacctccaccaccacggcc

SEQ ID NO: 7101 - DNA, 951 bp, Streptomyces avermitilis
  CDS (1)..(951)
atggatcacagcggcgggcacggcatgaccacggatctgccgccgttcacgctggggcgggggctcgagtggtccgcggacccgttcttcctcgtcgcctgcctgctggggctcggcctgtacggctggggtgtggtgcgcctggtgcggcgcggcgacaagtggccggtgggccggaccgtcgcgtacgtcatcggcgtactgaccgtcatgctgatgatgtgcaccaggctgaacgactacggcatggtcatgttcagcgtgcacatggtgcagcacatggtgatcagcatgctgtcaccgatcctgattctgctcggcgcgccgatcacgctggcgctgcgcgcgctgccgacggccggccgtgaccggacggggccgcgcgagctgctcctgatgctgctgcacagccgctacctgcggatcgtcacccatccggcgttcacgatcccgctgttcatcgcgagcctgtacgcgctgtacttctcggcgctcttcgacttcctgatgggatccaaggtcgggcacatcgggatgatggtgcacttcctcgccgtcggcgtggtcttcttctggccgatcatgggtgtcgacccgggcccgcaccgccccggctatctcctgcggatgctggagctgttcgcgggcatgccgttccacgcgttcttcggcatcgcgttgatgatggcgtccgagccgatggtcaactcgtacaagaacccccccgcctcgctcgccgtcgacgcgctcaccgaccagaacgcggccggcggcatcgcctgggcgttcagcgagatcccctccgtgctcgtcctgctcgcgctgctcttccagtggtacaactccgagcagcgccaggcccgccgcacggaccgggccgcggaccgggacggcgacaaggaactcgaggcgtacaacgcctatctggcctcactcaacgcacgcggcaac

SEQ ID NO: 7102 - DNA, 1023 bp, Streptomyces avermitilis
  CDS (1)..(1023)
atgcgcattggtgtcctcacgtccggtggcgactgccccggcctgaacgccgtcatccggtccgtcgtgcaccgggccgtcgtcgaccacggcgacgaggtcatcggcttccgggacggctggaagggcctcctggagtgcgactacctcaagctcgacctcgacgcggtgagcggaatcctggctcgcggcggcaccatcctcggctcctcccgggtccagccggcgcatctgcgtgacggcgtggagcgggccaggggccatgtcgcggagctcggcctcgacgcgatcatcccgatcggcggcgagggcacgctcaaggcggcccgcctcctgtcggacgccggcctgccgatcgtcggcgtgccgaagaccatcgacaacgacatcgcggtcaccgacgtgaccttcggtttcgacaccgccgtgggcgtcgcgaccgaggcgctcgaccggctgaagaccaccgccgagtcccaccagcgcgtcctcatcgtggaggtcatgggccgccacaccggctggatcgcgctgcactcgggcatggcggcgggcgcccacgccatcgtcgtaccggaacgccccttcgacatcgaggaactggccgccaaggtcggcgagcgcttcgaggcgggcaagcggttcgcgatcgtggtggccgccgagggcgccaagccccgtgcgggctcgatggacttcgacgagggcaagaaggacgtctacggccacgagcgcttcgccggcatcgcccgccagctctccctggagctggaggagcgcctcggcaaggaggcccggccggtgatcctcggacatgtccagcgcggcggcactccgacggcgtacgaccgcgtcctcgcgacccgtttcggctggcatgccgtggaggccgtgcaccggggcgagttcggcaagatgaccgcgctgcgcggcaccgacatcgtgatggtctcgctcgccgaggcggtcgagacgctgaagacggtccccgaggagcggtacgccgaggcggagtgcgtcctg

SEQ ID NO: 7103 - DNA, 726 bp, Streptomyces avermitilis
  CDS (1)..(726)
atgacagacaaccaactgcggctggtgtggatctacccggacctgctgagcacctacggcgaccagggcaacgcgctcgtcgtggagcgccgggcccgccagcgcggcctcgacgtggcccgcctcgacgtgcgcagcgaccagccgatccccacctccggcgacatctacctgatcggcggcggcgaggaccgtccgcagcggctcgcggccgagcggctgcgccgtgacggcggtctgcaccgcgcggtgggcaacggcgcgatcgtcttctcggtgtgcgccggctaccagatcctcggccacgagttcatcaacgacctcggccagcgcgagccgggcctcggcctgctcgacgtggtgtccacgcgcggcgagggcgagcggtgcgtcggcgacgtcctcggggacatcgacccgcgcctcggcctgccccagctgaccggcttcgagaaccaccagggcgtcacgcacctcggcccctccgcccgccccttggcccaggtgcggctcggcaagggcaacggcacgggtgacggcacggagggcgcgtacaacgacacggtcttcggtacgtacatgcacggtcccgtgctcgcccgcaacccgctgatcgcggacctgctgctgaagctggccctcgatgtgaacgcgctgccgccgatcgacgaccggtggtacgaggcgctgcggggcgagcgcatcgccgcggcgcagcagcccgcg

SEQ ID NO: 7104 - DNA, 1236 bp, Streptomyces avermitilis
  CDS (1)..(1236)
atggcaggcaactcggacccgctgacgccgcgggccaagctggccgtgacggcgggcaaggcggtcgcggcggcatcgagggccgcgggacgcgggagcggatcggtgatcggcggccgggtggcactcaagctcgaccccgacctcctcgcccggctcgcccagcacctggacgtgatcctggtgtcggccaccaacggcaagaccaccacgacccggctgatcgcggaggcgctgcgcgccgcgggcccggtcgtgtccaacgcgctcggcgccaacatgccggccggcatcacctcggcgctcgcgggcggctcggacgccaagtacgcggtgatcgaggtcgacgagaagtacctcgccggtgtggcccgggacacggacccgaagtgcatcgcgctgctcaacctctcgcgtgaccagctcgaccgcgccgccgagacccggatgctcgccgagcactggcgtgagggcctggccggttccaaggccgtcgtcatcgccaacgcggacgacccgctggtcgtgtgggccgcgtcgtcctccgccaatgtgatctgggtcgcagccggccagatgtggaaggacgacgcctggtcctgcccgtcctgcggcggtgtgatgcagcgccccggcgacgactggttctgcggcgagtgcggtttccgccggccgacgcccagctgggcgctgtccggcgaccacgtcctcgacccgcacggctccgcctggccgatccacctccagctgccgggccgcgccaacaaggcgaacgccgcctcctcggccgccgtcgccgccgtcttcggcgtgcccccgcaggtcgccctggagcgcatgtacgcggtccaggcggtggccgggcgctatgacgtcgtccagttcatgcagcgcgacctgcgcctgctgctcgccaagaacccggcgggctggctggagacgttctcgctgatcgacccgccgccgaccccggtgatcctgtcggtgaacgcgcgcggcgccgacggcaccgacacctcctggctgtgggacgtcgactacacacggctgaccggccacccgatcttcgtcatcggagaccgcaagctggacctggccgtgcgtctggaggtcgccaaccagtccttccaggtctgcgagaacctcgaccagtgcgtccagcaggccccgccgggccgcatcgaggtcatcgcgaactacaccgccttccaggacctgcggcgccgtgtcggcaac

SEQ ID NO: 7105 - DNA, 558 bp, Streptomyces avermitilis
  CDS (1)..(558)
atgcgacacggctccatcccgggcacccgagggcacgtcagacccctcgctctgctcggcgaccccgtcctgcacgcaccgtgcgaggaggtgaccgaccacggccccgaactggcccgcctcgtcgaggacatgttcgccacgatgtacgcggcgaacggggtgggcctcgccgcgaaccagatcggcgtgccgctacgggtcttcgtctacgactgtcccgacgacgaggatgtccgtcatgtcggacatgtggtgaatccgcgtctgatcgaggcggacggtgtggtgttgcgggggccggagggctgtctgtcgctgcctggcctggaggcgggcaccgagcggtacgaccgtgccgtcgtcgagggcttcacgacggacggcgagccggtgcgggtgctcgggacggggtggttcgcccggtgcctgcaacacgagtgcgatcacctcgacggcggggtgtatgtggaccgggtctccggctggcgacaccgaagggtgatgcgacaggcggcacgggccccgtggaatcgccaaagagccccggagccccgc

SEQ ID NO: 7106 - DNA, 696 bp, Streptomyces avermitilis
  CDS (1)..(696)
gtgttagtttgcgcaggcgtcaccgaaaacagcacgggtggggagaggctcatggacaccacgcagcagcggaccgatcaacagcggtccgccgatcgccgtcggcgcgagctgctggaggccgccgacagagtggtgctccgcgacggccccggggcctcgatgaacgccatcgccgcggaggccggcatcaccaagccgatcctctaccgccacttcggcgacaagagcggcctgtacgccgccctcgccaagcgccacaccgacgccctgctcgactcgctgcgggccgcgctcgacgcacccgcggaacgcagggagcgcgtcgagtccacactcgacacctacctcgccgcgatcgaggcacggccgcaggtgtaccggttcctgatgcacccgtcggagggcggctcgcagagcgaccagggcttcgacacgggcaagaactccgttcccgtgctgcggcgcatgggcgaggaactggcacaggtcatcgaggaacggctcgacctcgggcccggcagccagcagctcgcgcgggtgtgggggcacgggatcgtcggcatgatgcatgcggcgggcgactggtggctgggcgaacggccgtgctcgcgggccgagttggtgcggagtctggccgacctgctgtggggacggctcgccgcggcgggcgacaagatcggcggccctgggttc

SEQ ID NO: 7107 - DNA, 1227 bp, Streptomyces avermitilis
  CDS (1)..(1227)
atggccgagttcaccatggagctcaacgacgaacagaaggaggtcagggactggctgcacggcttcgccgccgatgtgatccgccccgcggccgccgaatgggacgagcgtgaagagacgccgtggccggtcatccaggaggccgcgaaggtcggcatctactccctggacttctacgcccagcagtacttcgaccccaccggcctcggcatacccatggcgatggaggagctgttctggggcgacgcgggcatcgccctgtccatcgtcggcaccggcctcgccgccgtgggcgtcctcgccaacggcaccgaggagcagatcggcacctggatcccccagatgtacggcgatgccaacgatgtcaaggtcgcggcgttctgctcctccgagcccgacgccggctccgacgtgtcttcgatgcgcacccgtgccgtgtacgacgaggccaaggacgagtgggtcctcaacggcacgaagacctgggcgaccaacggcggcatcgccaatgtccacgtcgtggtcgcggtcgtcgactcggagctgggctccaagggccacgcctccttcatcgtcccgccgaacacgccgggcctgtcccaggggcagaagttcaagaagcacggcatccgcgcctcgcacaccgccgaggtcgtcctggagaacgcgcggattcccggttcctgcctgctcggcggcaaggagaagctggacgagcgtctggcccgggcccgcgagcgggccagggcggggggcggcgagcgcgtgaagaacgccgcgatggccacgttcgaggcgtcccgcccggcggtcggcgccatggcggtgggcacggcccgggccgcgtacgaggaggccctggagtacgcgaagacgcgcgagcagttcggccggccgatcatcgacaaccagggtgtcgccttccagctggccgacatgcgtacgtccatcgacgcggcgcggctgctggtgtggcgggcctcctggatggcggtcaacggcaagccgttcaccgcggccgaggggtccatgtcgaagctgttcgccagcgagaccgcgaagaaggtgaccgcccaggcggtccagatcctcggtggcaacggtttcacccgggagtacccggtggagcggatgcaccgggatgccgcgatttatacaatcttcgaggggacgagcgagatccagcggctggtgatcgcccgcaccctgtcggggatgccgatccgt

SEQ ID NO: 7108 - DNA, 525 bp, Streptomyces avermitilis
  CDS (1)..(525)
atgacggccaccgaaggactcctcgtgccgccggggcacggccgcgtcgtccggacgcccgcccagcacgtgacgttcaaggtgaccggcacgcactcacggatggcgtcgagcttcgaggtggtcgtaccgcccggcttcgacgtgggcgcgcatgtgcacacccgcagcgaggagctgttctacgtgctcgaaggcgagctggacgtgctcgccttcgagccgcgggtccgcacgcccgacaactggaagcactgggagtcccgttcgggcacccgggtggtacgggccactcccggcacggtcatcgtcgtaccgcccggctgcccgcacgccttcgcgaaccccaccgacaccccggcgaagatgttcttccaggcgtccccgccaccggaccacgaacggtacttcgacgaactcctggagatcctgggcagcggcggcccgccggaccacgcggcgatcgaggaactgcgggcgagatacgacatccagcagctcacaccgctgaggctgaagcaccac

SEQ ID NO: 7109 - DNA, 1212 bp, Streptomyces avermitilis
  CDS (1)..(1212)
atgaccgagaaaacgatcaccgaggccctgccgcccgtccgccactggcccgcgctcaacctgacgggcgtggagttcgacccggtgctgtcccagctgatgagcgagggtccggtcagccggatccagctgcccaacggcgagggctgggcgtggctggtgacccgctacgacgacgtacgcatggtcgccaacgacccccggttcagccgcgcggcggtcatggggcggcaggtcacccggctcgccccgcacttcattcccacggcgggcgcggtcgggttcctcgacccgcccgaccacacccggctgcgccgctcggtggcggccgccttcacggcgcgcggggtggagcgggtgcgggagaagtcccgccggatgctcgacgagctgatcgacgagctgctccggggcgggccgcccgccgacctcgtcgagacggtcctgagccccttcccgatcgcggtcgtctgcgagctgatgggcgtgccggccgccgaccggcacagcatgcacacctggacccagctgatcctgtcctccgcgcacggcgccgaggtcagcgagaaggccaggaacgacatgggcgcgcatttcgagcggctcatcggcgagcggcgcggcagcacgggcgaggatgtcacttcgctgctcggcgccgccgtgggcagcggcgagatcaccctcgacgaggccgtcgggctcgccgtgctcatccagatcggcggcgaggcggtcaccaacaacagcgggcagctgttctacatcctgctgacccgccccgacctcgcggaacggctgcgcgccgagccgaagatccgtccgcagggcatcgacgagctgctgcgctacatcccgcaccgcaacgcggtcggcctctcgcggatcgcgacggaggacatcgagatccggggcgtacgcatccgggagggcgacacggtgtacgtgtcgtacctggccgccaaccgcgacccggacgtcttcccggatcccgaacggatcgacctcacgcgcagcccgaacccgcatgtgtcgttcggcttcggaccgcattactgcgtgggcgggatgctggcccggctggagtccgagctgctggtcgaggcgctgctcgaccgggtgccggggctgcggctcgcggtcccgccgggcctggtgcccttcaagaagggtgcgttgatccgcgggcccgaagccctgcccgtgacctgg

SEQ ID NO: 7110 - DNA, 1056 bp, Streptomyces avermitilis
  CDS (1)..(1056)
atggcgacgctgtgcaaacccgcggtctctgtcccggaacacgtgatcacaatggaggagacgctcgaactggcgcgctcccgacaccccgatcacccccaactcccgctcgcgctgcggctgatcgagaacacgggggtccacacccggcacatcgtgcagccgatcgaggagacgctgaagcatcctggcttcgaggagcgcaaccacgtctacgaggccgaggccaaggcccgtgtccccgcggtggtgcagcgggcgctggacgaggccgagctgctcaccaccgacatcgacgtgatcatctacgtgtcgtgcacggggttcatgatgccctcgctgacggcctacctgatcaactcgatggacttcagctccgacacccggcagatacccatagcccagctgggctgtgccgcgggcggctcggcgatcaaccgggcacacgacttctgcacggcctacccccaggccaacgcgctcatcgtggcctgcgagttctgctccctgtgctaccagcccaccgacctgggcgtcggctcactcctgtcgaacgggctgttcggcgacggcatcgccgccgcggccgtccgcggcaagggcggcaccggcatcacgctggagcgcaacgcgtcgtacctgatccccaagaccgacgagtggatcagttacgacgtccgcgccaccggcttccacttcctgctggacaagcgggtgcctggcacgatggagccgctcgctccggcactccaggagctggcgagccagcacggctgggacgcctccgacctggacttctacatcatccacgcgggcggtccgcgcatcctggacgacctgagcaagttcctgcgagtgccgccggaggccttccggttcagccgggccacgctcaccgagtacggcaacatcgcgagcgccgtcgtcctggacgcgctgcgccggctcttcgacgagggcggcgccgagcacgcggcgcgcggcatgctcgccggcttcgggcccggcatcaccgccgagatgtcgctgggccgctggcaccgcaccgacgaggcg

SEQ ID NO: 7111 - DNA, 714 bp, Streptomyces avermitilis
  CDS (1)..(714)
gtgggagggcaacagagcagcgaagccgaaggagtggcggcgatggcgcggacagcaagggaactgctggagacgaccaccggaagactcgcccccgacccccatgccaaccggctgctgccgctgatcgcccggggtgccgcccggcgcaccacactcgcggcgctcgccctcgaacagcgccatgtgatcgcggcggaccgccaggcgttcctgcatctggcacagcggtcggtgaacgaaccggagtgcgccgcgttcttcgacattctcacggagagtgaggatctggccggggaccggctcgcggcgtacgccgccgcctgcggggtggacgaggcgtggaccgccgcgtacgagcccctcgcggactgccagacctatccggcgtacgtcgcctggctcgcgctgaacggctcgccggccgacgtggtgctcgcgctgagcgccaacttcgccacgtggggcggctactgcgcgacgatcgccgaagccctgcgccgccactacggcttcgacgacgcggcctgcggcttcttcgacctcttcgccgagcccgcgccggagctggaacagaaggcgcaggccgccgtgcaggcaggcctggactacgggctggtcgacgaggacgaggcccagcgctacgggcggctgctccagggctacgaggcgaggttctggcacgccctgtgggagctggaccagcgcacggcc

SEQ ID NO: 7112 - DNA, 237 bp, Streptomyces avermitilis
  CDS (1)..(237)
gtgaaccgcgaagtgaccctgcctctgatcgtcgacgaccgcggcacgttgcaggtctcggccgccgacgtcagcaagctgctgcgcacggtgggcggccggtggctgcatctggtggaggccggtcaggacgggctggacgaggacacggtggcgacgctcaccatcgaactcgccaagctcgccgaccgcatcgacgtggcctgcatcgcccacagcagcgggacgacggccggc

SEQ ID NO: 7113 - DNA, 1392 bp, Streptomyces avermitilis
  CDS (1)..(1392)
atgcccatcgcgacggtgaacccggcgaccggcgagacgctcaagacgtacgaagccctggacgccgaggcgatcgagcgcaggctcgcggcggcacagagcgcgttccggacccatcgcacgaccacgttcgccgagcgggcgcggctgctgcacagggcggcggacctgctcgacgaggaccagcgggacatcgcccgggtgatgacgaccgagatgggcaagccggtcaagcaggcccgcgccgaggccgcgaagtgcgcgaaggcgatgcactggtatgccgaccacgccgaggagctgctcgcggacgaggaaccggccgattccgatgtgaaggactccggggcctcgcgcgccctggtccgctatcggccgctgggcccggtgctggccgtgatgccgtggaacttccccctgtggcaggtggtccggttcgccgcgcccgcgctgatggcgggcaacgtgggcctgctcaagcactcctcgaacgtcccgcagaccgccctctacctggaggacctgttccgccgggccggcttccccgacggctgcttccagacgctgctcatcggctccggcgccgtcgagggcatcctgcgcgacccgcgcgtccgggcggccacgctgaccggcagcgaaccggccggccgggccgtggcctcggtcgccggggaccaggtcaagaagacggtcctggagctcggcggcagcgacccgttcgtcgtgatgccgtccgccgacatcgaccgggccgcgaagaccgcggtgaccgcgcgggtccagaacaacgggcagtcgtgcatcgccgcgaagcggttcatcgtgcacacggacgtgttcgacgccttcgccgagcgcttcacggcgggcatggcggcgctgaaggtcggcgacccgctggacgaggacacggaggtcgggccgctctccaccgagcagggccgcaccgatctggaggagctggtcgacgacgcggtcgagaacggcgcgacggtgctgtgcggcggcgagcgccccgaggggtacacggagcgcggctactactacgcgccgaccgtcctcaccgacatcacccccgagatgcgcatccacctcgaggaggcgttcggcccggtcgccacgctctaccgggcggccgatctcgacgaggcggtggccatcgccaacgacacgccgttcggactgagttccaacgtctggacgcgcgaggacgccgaggtcgaccggttcgtacgcgacctggaggccggtggcgtgttcgtcaacgggatgacggcatcccatcccgcgttccccttcggcggggtcaagcggtcgggttacggtcgtgagctgtccggacacggaatccgcgagttctgcaacatcaccaccgtatggcacggagcg

SEQ ID NO: 7114 - DNA, 462 bp, Streptomyces avermitilis
  CDS (1)..(462)
gtgagcgggaagcgcagcgcggggctgctgttgttccggcacaccgacgacggtatcgaggtgttgctcggccatatgggcggcccgttcttcgcccgccgtgacgccggggcgtggtccgtcccgaagggcgagtacgagcccgacgagccggcctgggacgccgcgcgccgggagttccaggaggagctggggctcgcgccgcccgacgggcaggccgtgccgctcggcgaggtccggcaggcgaacggcaagatcgtcaccgcgtgggcgatcgaggcggacctcgacccggcgaccgtggtgcccggcaccttcacgatggagtggccgccgaagtcgggccgaagtcaggagttccccgagctggaccgggtggagtggttcggcctggaccgggcgcgcgccgtgatcgtgaaggggcagacggggtttctcgaccggctggcggagcactcgggc

SEQ ID NO: 7115 - DNA, 1536 bp, Streptomyces avermitilis
  CDS (1)..(1536)
atgctgctgagccgcctcgcccatgtgtcccgggaggtcgccgccacctcggcgcggtcccggaagatcgcgctgctcgccgagctgttccgggacgccgacgcggacgacgtgccgatcgtgatcccgtatctggccggacgccttccgcaggggcggctcggcatcggctggaagctcctcggccggccggtcacgcccgcgtcggagccgtcgctcaccgtgcgggacgtggacgcccggctgacagcggtcggcgccgtcacgggcaccggctcgcaggccgggcgcgggcgcctgatgggcgagctgatggcggcggccaccgacgtcgagcaggccttcctgcgcgggctgctcaccggcgaggtgcggcagggcgcgctggacgcggtcgcggtcgaggggctggccgaggcgaccggcgcgccccccgccgacgtacgacgggcggtgatgctcgccggatcgctccagacggtggcgcgggcgctgctcgcggagggcccgggggccctggacggcttccggctcaccgtcggccgcccggtgctgccgatgctggcgcacacggcgggatccgtggccgaggccgtcggcaagctgggcgcgtgtgccgtcgaggagaagctcgacggcatccgcgtccagctccaccgcgacggcgaccacgtacggatctacacccgcaccctcgacgacatcaccgaccggttgcccgaactcaccgccgccgccctggagttgaagggcgaccggttcattctggacggtgaggtcatcgcgctggacgggaacgggcggccgcgctccttccaggagatcgccgggcgcgtgggctcgcgcgtggacgtggccgcggccgccgcgtcggtgcccgtctcccccgtgttcttcgacgcgctgtccgtcgacggacgggatctgctcgacctgccgttcaccgagcggcacgcggagctggcccggctggtgcccgagccgctgcgcgtgcggcgcgcgctcgtgtccggtcccgacgatggcgccgccgccgagacgttcctcgccgacacgctcgcgcgcggccacgagggcgtcgtggtcaaagccctcgacgccccctacagcgcgggccggcgcggcgcctcctggctgaaggtcaagcccgtgcacaccctcgacctggtggtgctcgcggccgagtggggccacgggcggcgcaccggcaagctgtccaacctgcacctcggggcgcgcgccgcggacgggtccttcgcgatgctcggcaagacgttcaagggcatgaccgacgcgatgctgacctggcagaccgagcggctgacggagctggccgtcgaggagaacggctccgtggtgaccgtacggccggaactcgtcgtcgagatcgcgtacgacggtctccagaagtccacccgctacccggccggcgtcaccctccgcttcgcccgcgtcgtccggtaccgcgaggacaagaccccggccgaggccgacacggtcgagaccttgctcgccgcgcacccggaggtgacccgg

SEQ ID NO: 7116 - DNA, 987 bp, Streptomyces avermitilis
  CDS (1)..(987)
gtggaggtggtcaccatgaccgagaggtacgaagtggttgtcgtcggcggcggcgcggcggggctgtccgcggcgctggtcctcggccgggcccggcgtcacacgctcgtcgtcgacgccggcgagccgcgcaacgcgcccgccgcgcatctgcagggctttctgacccgggacggcatgccgcccgccgagttcctcgccgaggggcggcgggagatcgggcggtacggcgtcgagctggtccaaggccgcgtggtggacgtggtccgaggcggcgtcggcgcgttcgaggtgacgctcgcgggcgggcgtacggtgcacgcgcgccggctggtcctcgccaccggcctggtcgacgagctgccgccggtgccgggcgtcgccgagcgcttcgggcgggacgtgctgcactgcccgtactgccacggctgggaggtccgcgacgaggccttcggcgtgctggccagtacgccgatgagcgtgcaccaggcgctgatggtcagccagtggtccaaggacgtgaccctcttcctgcacacggtcggcgaggacgagctcacgcacgacgaccggcgccggctcgccgcggccggggtcaccctggtgtccggcgaggtcgcgggcctggaggtggacgaggaccggctcaccggggtgcggctcgcggacggcacgacgcgggaccgctcggtgctgttcgtcgcgccccgcgccgtcccgcgcaccgacctgttcgaccggctgggcgccgagctgcgggagacaccgttcggcacgtatccggtggtcgacgagacgggcctgacgaccgtgcccggcgtgtgggcggcgggaaacgcgatcggattcgcggagcagctggtgaacgcggcgagcggcggctaccgggcgggcgccgtgatcaacggagacctgctcttcgcggacctcgacgccgccgcgggtcccgccgcttcgggcgaggccgagaacgcggctgagcgggtg

SEQ ID NO: 7117 - DNA, 618 bp, Streptomyces avermitilis
  CDS (1)..(618)
atgggcatgagcgaggaagagcagagcgaggaagagcagagcgaagaagtgcagacggacgcggttctggccgaagtcgggccgcggctgcggcggatccggaaggaacggggtgccacgctcgcggggctgtccgaggcgaccggcatctccgtgagcacgctctcgcgcctggagtccgggctgcgcaagcccagcctggagctgctgctgcccatcgcccgcgctcaccaggtgcccctcgacgagctggtcggggcgccgccggtgagcgacccgcgcgtgcgggccaaaccgatcgtgcggcacggccgcacccactggccgctcacccggcagcccggcggtctacaggcgttcaaggtgctcgaaccccagcgcaagctcgaaccggatctgcggacacacgagggctacgagtggctctatgtgctctccgggcggctgcgcctggtcctcggcgagcacgacgtggtgctcggaccgggggaggccgccgagttcgacacgcgggtgccgcactggttcgggtccacgggtgagggcccggcggagtttctgagtctgttcgggccgcagggggagcggatgcacgtacgggcccgtcccacccgttcg

SEQ ID NO: 7118 - DNA, 1041 bp, Streptomyces avermitilis
  CDS (1)..(1041)
atgggcaagcgaccgcttagtatgcgatcgaccccggtcagacgagcagtcccgtggaggccccgcatgcaggcatggcaagtgcaccagaacggcgagccgagcgaggtgatgcgcctcgaggatgtggagcggccggtgcccggcgagggccaggtgctcctcaaggtgcgggcggcgaacatcaacttcccggacgccctgctgtgccgcgggcagtaccaggtcaggccgccgctgccgttcacgcccggggtggagatctgtggcgagaccgaggacggacggcgcgtcctcgcgaaccccgtgctgccgttcggcggtttcgccgagtacgccgtcgccgatgccgcggccctgctgcccgcgcccgacgcgctggacgacgccgaggccgccgccctgcacatcggctaccagaccggctggttcggtctgcaccgccgggcgcacctggaggcgggggagaccctgctcgtgcacgctgccgcgggaggggtcggcagcgcggcggtgcagctcggcaaggccgcgggcgccacggtgatcggcgtcgtcggcggggccgacaaggccgccgtggcccgcgagctgggctgcgacgtcgtcgtggaccgacggaccgaggatgtcatcggcgccgtgaaggaagcgaccggcggccgcggcgcggacgtgatctacgaccccgtcggcggggcggcgtacacgcagtccaccaaggtcgtcgctttcgaggggcgcatcgtggtggtcggcttcgcgagcggcaccatcccgagccccgccctgaaccacgccctggtgaagaactacgcgatcctcggcctgcactggggcctctacaacaccaagaatcccaagctggtccagcactgccacgagcagctcaccgaactggcgacgcgcggtgcgatcaagccgctggtcagtgagcgggtgccgctcggcggcgccgccgccgccgtgcagcgggtcgccgacggcgtcacgacgggccgtgtcgccgtggtcccctcgctcgagaacggagcaaccgca

SEQ ID NO: 7119 - DNA, 1179 bp, Streptomyces avermitilis
  CDS (1)..(1179)
atgaccgacgctgccgaactgcgccgcctcacccaggagttgctggccgcacatccgccggagaccacggaccggctcgacttcctcaaggaccgtttcgacgccggactcgcctgggtgcactacccggagggactcggcgggctcggggtgccgcgcacgctccaggccgtcgtggacgccgaactggaggccgcgggcgcccccgacaacgacccccggcgtatcggcatcggcctcggcatggccgcgccgacgatcctcggctacggcaccgaggagcagaagcggcgctatctgcgcccgctgtgggccggcgaggaggtctggtgccagctcttcagcgagccgggcgccgggtccgacctggccgcgctgggcacgcgcgccgtccgtgaaggcgacgagtgggtggtcaacgggcagaaggtgtggacgtccagcgcccacgtcgcccgctgggccatcctcatcgcccgcaccgacccggacgtgcccaagcaccggggcatcacctacttcatctgcgacatgaccgacccgggcgtcgaggtccggccgctgcgccagatcaccggcgaggccgagttcaacgaggtgttcctcaccgacgtccgcatccccgactcccgccggctcggcgacgtcggtgacggctggcgggtcgcgcagaccacgctgaacaacgaacgcgtcgccatcggcggcatgcggctgccccgcgaaggcggcatgatcggcccggtcgccgggacctggcgcgagcgccccgaactgcgcacccacgatctgcaccagcggctgctgaagctgtgggtcgaggccgaggtcgcccgtctcaccggcgagcggctgcgccagcagctcgtggcgggccagcccggccccgagggcgccggcatgaagctgtcgttcgcccgcctcaaccaggagatcagcgggctggaggtcgaactcctcggcgaggaaggcctgttgtacgacgactggacgatgcgccgacccgaactggtcgacttcaccggccgcgacgcgggctaccgctacctccgctcgaagggcaacagcatcgagggcgggaccagcgaggtcctgctcaacatcgtcgccgaacgcgtcctgggcctgccgtccgagccgcgcaccgacaaggacgtcgcatggaaggacctcgcccga

SEQ ID NO: 7120 - DNA, 1128 bp, Streptomyces avermitilis
  CDS (1)..(1128)
atggaaggacctcgcccgatgaccacgcggagcacgcagccggatctgctgtactcggaggaggaagaggcactgcgcgccgtcgtccgcgacctcctccgcgatcactgcggggcggcggacgtcatcgcccgcacggagtcggacgccccgcacgaccgcgccctgtggaaggccctggcggacggcatgggactcgcgggtctcctggtgcccgaggcgcagggcggccagggtgcctcgcaccgtgaagccgccgtggtcctcgaggagttgggccgcgcggtcgcccccgtgccctacctcaccagtgccgtcgtcgccaccgaggcactgctggccggtgagggcgacgaggccgcgaagctgctggccgcgctcgcgtcggggcggacggtgggcgcgctcgccgtcgcgctgtccgtcgcgccgggcggagcctaccgggccgtacgccatgaagacggcgcgctgcatggcgagttgaccggcatcgcggacgcggcggccgccgatgtgctgctggtgcccgcagaggacggcgggctgtacgcggtgaacgccgacgacacggccaccgtcacgatcactccgcaggtctccttcgacctcaccaggccggtcgccacggtcaccttcgagggagcgccggcgcgtcgcgtgggcgccgccgagcccgccgtacgccgggccctgcgcgccggtgccggactgctcgcctccgagcaactcggcgtggccgactggtgcttgacggaaacggtgcgctacttgaaggagcgcaagcagttcaaccggcccgtcggcggcttccaggcgctcaagcaccggctcgcgcagctgtggctggaagtcgtcagcctgcgggcggcggcgcggaacgcggccgacgcgctcgccaccggcagcgcggacagcgacgtggcggtcgccgtcgcccaggcgtacgcggccccggtcgccgtccgcaccgcggaggaggccctccagctgcacggcggcctcggcatgacctgggaacacccggtccacctctacctcaagcgggcgaaggcggactcgatcgcgtacggcacggcgggcggtcaccgcgaggcgctggccgaactggtcgacctccgggccccc

SEQ ID NO: 7121 - DNA, 858 bp, Streptomyces avermitilis
  CDS (1)..(858)
atggccctcaccacccgtcgcagagccctcaccaccctcggcgccgccctcgccggctccgtcgcgctgcccgcgcacgcacgagcgagcgagcgggggcacggcccgcgcccgctgcggcgcgcccacgcgcacaacgactacgagcacccgcggcccctgttcgacgccctcggccatcgtttcggcagcgtcgaggccgacatctacctcgtcggcgaccagctcctcgtggcccacgacccggcggacctcgacccggcccgcaccctcgaatccctctacctcgatccgctggccgcccgcgtcagggccaaccacggctccgtgtaccgggggtggcgcacgcccctgcaacttctcatcgacatcaagaccgagggctcgtccacctacctcgaactcgaccgccatctacggcgctaccgcaacctgttcaccacgtacgcgcacggccgcgtgcaccccggcccggtcacggccgtgatctccggcgaccgcgcggcccgtacgccgatggaggcgcagagcgtgcgccgcgccttctacgacggtcgcctcaccgatctcggcagctcagccccggcctccctcatcccgctgatcagcgacaactggacgctcaacttcagctggctcggggcgggcccgttcccgggcgccgagcggcagaagctgcggggcatcgtcgcggcggcgcacgcacgccggcagaaggtgcggttgtgggccacgcccgatcgggcgggcccggaccgggacgcgctgtgggccgagctgctcgccgcggacgtcgactacgtcaacacggacgacctcgcgggcctggaggcgttcctcgacgcccacgagcggccg

SEQ ID NO: 7122 - DNA, 192 bp, Streptomyces avermitilis
  CDS (1)..(192)
atggccatttccatctctgtggtgctgctgcttctgatccttgtggtggtcttcgtgcgcaacggggcactgaagttgtcgcactgcctgatctgcgtgttgctcgggttcttcctggccggctccagcatggccccgaccatccacaacggcctgctggcgacggcggacatcgtcagcagcctgcacccc

SEQ ID NO: 7123 - DNA, 1227 bp, Streptomyces avermitilis
  CDS (1)..(1227)
gtgacgcgtcgcggcggacggctcagaacggtactgacggtactcacggcctggagcgcgctggccggtgcggccctggcgggagcggcgccggccggcggcgcgccgaggagcgtcccgctcgcgccgggcgtcgagtacacgcagttcgacatcccggcggaccgaggagtgacgcacgcccatctcctgagcgtcgatctcgccgatccgcgggtgcgggtcggcctcctgcacccgggcgccgtcgcggcccgcgccccggtctcacggctcgccgactcgcagggcgcgctcgcgggcatcaacggcgacttcttcaacatcaccgagacccagcacccgggggtcgaggcgaccggttcgaccgacggtccggcgatcgcggacgggcacacactcaaggcagccgtgccgaacggccagcgcttcgggccggcgctgccgcccggtacgaccaccgaggacgtgctcggcgtcggcgacgaccgccgggcccggctcgaccgcctggccctcgaaggatccgtggacaccgcggcgggagagctgccgctccgcgggctcaaccagtacgcgctgccggagggttcggtcggcgcgtacaccgcggactggggcagtgtctcgcgcgcccgggccgtgtgcggcacggacaccgaccgggcggcgccgtgcagtacggacacctacgaagtgacggtcagggacggccaggtggtgtccttcgccgactcccccggcagcggaccgatcgccgccggcaccacggtgctggtcggccgcgaggcaggcgcgcagcagttgcggaagctgtccacgggcgaggaggtgtcggtggagcaccgtctggtggcggccgggtcgcaggtcgcgtacagcttcgcgatcggcggatacccggtgctgaggcaggggaagccgctgccgggcctcgacaccgtcacctcggccgtacgcaccgcggtgggcatcaaggacgccggccgccgtctgctgctcctcgcgatcgacggcgccgccgcctaccgcagcggcctgaccatcgccgaagtcgcctcggtcatgcgcggcttgggtgccaccgaggccttcagcctcgacggcggcggctcgaccacgctggtcgcccgcgctcccggggcgacctccgtgaccgtacgcaaccacccgagcggcggcgccgaacggccggtcccgaacggcatcggggtgttcacccggacg

SEQ ID NO: 7124 - DNA, 366 bp, Streptomyces avermitilis
  CDS (1)..(366)
atggatccgaccgtggagatggtcccgcgcgtggagctcacccctgccgccgccgagctggtgcggcggctgcgggcggcccacggaccgctgatgttccatcagtcaggcggctgctgcgacggcagcgcgcccatgtgctatccggacggcgagttccgcaccggcggctccgacgtgctgctcgcggagctggaggtcgagggcgtcgacgaggcggtgggcttctggatgtcgaggaaccagtacgaggtgtggagccacacccggctgatcgtcgatgtcgtacccggccgaggcagcggcttctccctcgaagcacccgaaggagtgcgttttctgatccgttcccgcgtcgtcgacgcc

SEQ ID NO: 7125 - DNA, 765 bp, Streptomyces avermitilis
  CDS (1)..(765)
atgtcccgtcacaggaaccccgccacccccgtacgcctcgacttcgcactcgaccgcaacagtccggtgccgctctactaccagctcgcccagcagctggagcatgcgatcgagcacggcgcgctgggcccgggcagcctcctcggcaacgagatcgagttcgccgggcggctcggtctgtcccggcccaccgtgcgccaggccatccagtcgctggtcgacaaggggctgctcgtgcgccgccggggcatcggcacccaggtggtgcacagtcaggtcaagcgcccgctggagctcagcagcctgtacgacgacctggaggccgccggccagaaccccgcgacgcgggtgctgcgcaacgaggtccagccggcgtccgccgaggtcgcggccgccctgggcctcgccgagggcggcgatgtgcaccacatcgaacggctgcgcctcgcccacggccagccggtggcgttcctgtccaaccacgtgccggccggcctgctggacctcggcaccgcccggctggaggcgaccggcctgtaccggatgatgcgcgccgtcggcatcaccctgcacagcgcccgccagtccgtgagcgcccgcggcgcgaccgcccaggaggccgagcggctggacgagcacgagggcgccgccctgctcaccatgcggcgcaccgcctacgacgacaccggccgcgccgtcgaatacggcacccacatctaccgcgcgtcacggtacgccttcgagttccagctcctcgtacggccc

SEQ ID NO: 7126 - DNA, 1887 bp, Streptomyces avermitilis
  CDS (1)..(1887)
atgagccaggtccccatggaccagtccacccgccgcctgaccgtcgcccaggcgctggtgcgtttcctgtccgcgcagtacaccgagcgcgacggcgtacggcaccgcctgatcgccggcacctggggcatcttcggccacggcaacgtggcgggcatcggccaggcgctcctcgaagccggcgagcaggccatgccgttccaccagggccgcaacgagcaggcgatggtgcacgcggcggtcggctacgcccgccagctgggccgcctctccgcccaggccgtcaccacgtccatcggccccggcgccaccaacctggtcaccggcgccgccctggccacgatcaaccgtctcccggtgctgctcctgcccggcgactacttcgcgacgcgcgccgcggacccgctgctccagcagctggaacacccggtggaggcagacctgtcggtgaacgacaccctgcgcccggtctcccgctacttcgaccggatcacccgcccggagacgctcgtcccgtccgcgctcgccgccatgcgggtcctcgccgacccggccgagaccggcgcggtcaccctcgccctgccgcaggacgtgcaggccgaggcgtacgactggcccgaggagttcttcgccgagcgcgtctggcgcgtacgccgccccgcgcccgacccggtcgaactggccgaggcggcccgggcgatccgcggcgccgagcggccgctgatcgtcgcgggcggcggcgtccaccacagcgaggcggagacggcgctgcgcgagctggtggacgccaccggcatccccgtcgcctccacccaggcgggcaagggctcgctgcgccacgaccaccccgccgacctcggcggcatcggccacaccggcaccgcggtcagcgacgacctcgcgcgcaccgccgacctggtcatcggtgtcggcacccgctacaccgacttcaccacggcctccgccaccctgttccgcaaccccggagtgcggttcgtcaacctcaacatcaccgccttcgacgcccacaagctcgccgcccggcccctggtcgccgacgcgcgggcgggcctggaggcgctcgccgaggcgttggcgggccatcgtgtggacgcggcgtacgaggccgagtaccgctcgggcaaggagcgttgggagcgggtcgtggccgacgccttccgcgccgacgacgagaacgccgtgccgacccagacccaggtgctcggcgcccttgactccgtcgtgggcgacgcggacgtggtcatcaacgcggccggctctctccccggcgacctgcacaaactgtggcgagcccgctcgccgcgccagtaccacctggagtacggctactcctgcatgggctacgagatcccggccggtatcggtgtccagcaggccgcccccggcacgcccgtgtggtcgctggtcggtgacgggacgtatctgatgatgccgaccgagatcgtcaccgccgtccaggagtcgctgcccgtcaacctggtcctgatccagaaccacggctacgcctccatcggcggcctgtccgagagcgtgggcggcgagcgcttcggcaccgcctaccgctaccgggccgcggacggcaccttctccggcgcgccgctgccggtggacctcgccgccaacgcggccagcctcggcatggacgtcatccgggccaagaccgtacgggaactgcgcgacgccctcgccgaggcccgcgcctcggaccggccgacctgcgtgtacgtcgaaactgacccggcgcccaccgctcccccggcacaggcgtggtgggacgtgcccgtcgccgaggtggcctcccgcgaggccgcggtggacgcccgcgcgacctacgacgggcacaccgccgaacgccgccgacacctc

SEQ ID NO: 7127 - DNA, 903 bp, Streptomyces avermitilis
  CDS (1)..(903)
atgacgaccacgcaccacctccccgcgggcaaggcggcgaacggcccctacacggtggacatctcccccgagtcggccggctggggccactccagtctgcgcgtgctggaactgcccgccggcggatggcactccttcgacaccggcgacagcgagtggatcgtgctgccgctggcggggtcctgcacggtggccgtcggcggcgagaccttccgcctggccgggcgcgagagcgtcttcagcggggtcagcgacttcgcctatgtgccgcgcgacgcccaggtctccctcgcctcgcgcggcggcggccgcttcgcgctgaccggcgcccgctgcaccgagcggctgcccgcccgctacgggcccgccgccgccgtcccggtcgagctgcgcggcaccggcacctgctcccgccaggtcaacaacttcgccgcggcggtccccgccgggggcgatgccggacagggtttcgcgtgcgaccagctgatcgccgtcgagatcatcacgccgggaggcaactggtcctcgttcccgccccacaagcacgacgagcaccgccccggtgaggagtccgagctggaggagatctactacttcgagatcgccgcccacgacggcacgcccggcctgggctaccagcgggtctcgccctccggccacggccggggcaccgacgtcctggccgaggtgcgcagcggcgacaccgtcctcatcccggacggctggcacggcccgtcgatggcggcgcccggccacgacatgtactacctcaacgtgatggcgggtcccggcgccgagcgcgactggctgatccgcgaccaccccgaccacgcctggatccgcgccacctggccggatcagcccgtggacccccgactcccccgctacaccgccccgtcccag

SEQ ID NO: 7128 - DNA, 876 bp, Streptomyces avermitilis
  CDS (1)..(876)
ttgaccatcagcatccccgacctcgccacggtgcgggcccggcatccggaggccatcgccgaagcggccggccgccgcacgcgccggccgctgatcggcgagagcggccgcctcctgatcgtcgcggccgatcatccggcgcgcggcgcgctcggcgtgggcggccgagggctggccatggcgcatcgcgccgatctgctcgagcgcctgtgtgtcgcgctgtcccggccgggtgtggacggggtactggccaccgccgacatcctggaggacctgctgctcctgggtgtgctggagaacaaggtcgtcatggggtcgatgaaccgcggcggcctggccggcgcgtccttcgagatggacgaccgcttcaccgggcaccgcgccgaggacatcgagcggctccgcttcgacgcgggcaagctgctgctgcgcatcgactacgccgaccaggggtcttcggcgaccctggagtccacggcccgcgcgatcgacgacatggccgcgcgccgactccccgtgttcgtcgagccgttcatctcgcgccgggtggacggcacggtccgcaacgacctcggcgccgaggccgtcacccgctccatcgccatcgcctcgggcctcgccggcacctcggcgtacacctggctcaagctgccggtcaccgaggatcccgacgacatgggcgaggtcctcgaggcctccaccctgcccgccgtgctgctcggcggcgaggtcggcgaggaccaggagggcgcgtacgagagatggcgcaaggcgctgcggctgcccaccgtccagggcatggtcgtgggccgctcactcctgtatcccgccgacggcggcgtggcgacggcggtggacaccgcggtcggcctgctc

SEQ ID NO: 7129 - DNA, 954 bp, Streptomyces avermitilis
  CDS (1)..(954)
atgccagactccgttgaaactttcgacctgatcactatggggcgcatcggcgtcgacctctaccccctacagccgggcgttccactgccgcaggtcgagtccttcgggaaattcctcggcggttccgccgccaatgtcgccgtggccgccgcacgcctcggccgctccaccgcggtgatcacccggaccggcaacgacccgttcggcacctatctgcaccaggcgctcgaggagttcggcgtcgacgaccggttcgtcacccccgtcgacgcctatccgacgccggtcaccttctgcgagatcttcccgccggacgacttcccgctgtacttctaccggcagcccaaggcaccggacctggagatccgcaccgaggagctcgacttcttcgccctccgcgccgcccgaatcttctggatcaccggcaccgggctgagcgaggagcccagccgctccgccacgctcgccgccctcaaggcccgcaccaaggggggcaccacggtcttcgacctcgactggcgcccgatgttctggcaggacccacgggcggcccgcccgtactacgccgaggcgctgcgccacgcgaccgtggccgtcggcaacctcgacgagtgcgagatcgccaccggcgtacgcgaaccccgggcctgcgccgaggcgttgatcgaggcgggcgtggaactggccgtcgtcaaacagggccccaagggtgtcctcgccgtgcaccgcgacggcaccaccgccgaggtgccgcccgtcccggtggaggtcgtcaacggcctcggcgcgggcgacgcgttcggcggctcgctctgccacgggctgctggcgggctgggagctggagcggaccatgcgctacgccaacgcggccggcgccctcgtcgcctcccgcctcgcctgctcctccgcgatgcccaccctcgatgaggtcgaggacctcgtcgcgcgcgga

SEQ ID NO: 7130 - DNA, 1017 bp, Streptomyces avermitilis
  CDS (1)..(1017)
atggaccgcacgttttacccccgctcccgcaggatcgccccgctcgtcgcggcggcagccgcctccgcgctgctcgtcgcgggctgctccagcggctccggcggcaagaaggccgaggagggcgggagcggcgcctccgccggcaaggccaacacgccccgtatgacggtcgcgttggtcacccaccaggcgcccggcgacacgttctgggacatcgtccgcaagggcgcccaggcggccgccgccaaggacaacatcaagctggtctactcggccgacccgaacgcgggcaaccaggccaacctggtccagaacgcgatcgaccagaaggtcgacggcatcgcgatcaccctggccaagccggacgccatgaagagcgtcgcggcaaaggcggagaagtccggcatacccgtggtcgggctcaactcggggttgagtgactggaagtcgctgggcctgatggagttcttcgggcaggacgagggtgtggcgggcgaggccttcggcaagaagctgaacgaggtcggcgccaagaaggccgtctgtgtggtccaggagcagggcaacgtcgggctcacccagcgctgcgccggcgtgaagaagacgttcaagggcacgacggtgaacctgtatgtcaacggcaccgacatgccgtcggtgaagtcgacgatcaccgccaagctcaagcaggacagttccatcgactacgtggtcgcgctcggtgccccgtacgccctgaccgcggtgcagtcggtgagcgacgcgggcagcaaggccaagatcgccaccttcgacctcaacaaggaactgaccagcgccatcaagaagggcgacatccagttcgcggtcgaccagcagccgtaccttcagggctacttggcggtcgactccctgtggctctacaagaacaacggcaattacagcggcggtggtgagcagccggtgctgaccggccctgccttcgtcgacaagaccaacgtcgagacggtcgccgagttcgccgcgaagggcactcgg

SEQ ID NO: 7131 - DNA, 1071 bp, Streptomyces avermitilis
  CDS (1)..(1071)
atgactcaagcaacggcaccggcgacgagtccctcgtcgccggcctcgccggccgcccccaaggacggccgtaccggcgaacgctcgttggggcggcggctgctggcccgccccgaggtcggcgcgctgatcgccgccgtcggtgtgtacgtgttcttcttcgcggtggccccctccttccgcgacgcgagcgccctgtccaccgtgctctaccaggcgtcggtgatgggcatcatggcgctgccggtggccctgctgatgatcggcggcgagttcgacctgtcggcgggtgtcgccgtgacgacctcggcgctcaccgccgccatcctgagcttccagctgacgatgaacgtgtggaccggcgtcttcgtcgcgctcctcgtgtccctcgccgtcggcgcgttcaacggctggctgctgatcaagaccggcctgcccagcttcctggtcacgctgggctcgttcctggtcctccagggcgccaacctggcggtcaccaagatcttcaccgacaacgtcgcgagcgactcgatcgccgacatggacggcttcgagcaggccaagaaggtcttcgcctccgagttcgacatcgggggagtgagcttcaagatcaccattgtctactggctggtgttcgccgccgccgccacctggctgctgctgcgcaccaagttcggcaactggatcttcgcggtcggcggcaacaaggacagcgcccgcgcggtcggcgtcccggtcggcctcaccaagatcgcgctcttcatgggcgtcggtgccggcgcctggttcgtcggcatgcacctgctgttctcgttcaacaccgtgcagtccggcgagggcgtgggcaacgagttcctgtacatcatcgccgcggtcatcggcggctgtctgctcaccggcggctacggctccgcgatcggcccggtcatcggcgccttcatcttcgggatggtgtcccagggcatcgtctacgccaactggaaccccgactggttcaaggccttcctgggagcgatgctcctcgtcgccgccctcgtcaatctgtgggtccgccgccaggcgacccggagg

SEQ ID NO: 7132 - DNA, 909 bp, Streptomyces avermitilis
  CDS (1)..(909)
atgacaaccaacggaaccccgcccgacggaacccccgtcgaggagaccgggcccgcggacgccgagccgatcgtggaactgcgcggcgcaggcaagtcgtacggcaacatccgcgccctgcacggcgttgacctgagcgtccgcccgggccgggtgacctgcgtcctgggtgacaacggcgcgggcaagtccaccctcatcaagatcatctcagggctgcaccagcacaccgagggcgagttcctcgtcgacggcgcaccggtgcacttcaacaccccccgcgaagccctcgaccgcggcatcgccaccgtctaccaggacctcgccacggtgccgctgatgccggtgtggcggaacttcttcctgggctccgagctgacccgcggcccctggcccgtgcgccgcctcgacatcgcccgcatgaagcggaccgccgacgacgaactgcgcaacatgggcatcgtcctcgacgacctggaccagcccatcggcaccctctccggcggccagcgccagtccgtggccatcgcgcgcgccgtccacttcggcgcccgcgtcctcatcctcgacgagcccaccgccgccctcggcgtcaagcagtccggagtcgtactgaagtacatcgccgccgcccgcgaccgcggtctcggcgtcatcttcatcacccacaacccccaccacgcctatatggtcggcgaccacttcagcgtgctgcgcctcggcaccatggaactcaacgccgcccgcagcgaggtcagcctcgaggagctgaccaaccacatggccggcggtgccgaactggccgcgctcaagcacgagttggcgcaggtccgcggcgtcgacgtcgaggggctgccggatgcggacgacctccaggcaccggtggcggccgcttccgaagggacttcc

SEQ ID NO: 7133 - DNA, 900 bp, Streptomyces avermitilis
  CDS (1)..(900)
atgacccctgccctggaccgcatccgggtcggatcggccccggactcctggggtgtctggttcccggacgacccccagcaggtcccctggcagcgcttcctcgacgaggtcgccgaggcgggctaccagtggatcgagctgggcccgtacggctatctgccgaccgaccccgcccgcctcaccgacgaggtggcccggcgcaacctccaggtgtcggccggcacggtcttcacctcgctgcaccggggaccgtccgtgtgggacgccacctgggagcacgtcgggcaggtcgccgcgctcacccgggcgatgggcgcacggcacctcgtggtgatcccgtccttctggcgcgacgacaagaccgccgagatcatcgagccgccggagctcacgggcgagcagtgggcccatctcgccaagggcatggagcggctcgggcacgaggtcaaggagacctacggcctcgacatcgtcgtccacccgcacgccgacacgcacatcgacaccgaggcccatgtcgagcgcttcctcgactcgaccgactccggactggtcaacctgtgcctggacaccgggcactacgcctactgcggcggcgacagcgtcaagctcatcgagacctacggcgagcgcatcggctatctgcacctcaagcaggtcgaccccgacatcctcgccgaggtgcgcgcgggcgaggtcccgttcgggcccgccgtgcagcgcggggtgatgtgtgaaccgccgtccggcgtacccgagttggcgccggtcctgacggcggcgcagcgcctcggggtggagctgttcgccatcgtcgagcaggacatgtacccctgcccgccggaccagcccctgccgatcgcccggcgcacccgcacgttcctccgctcctgcggagcc

SEQ ID NO: 7134 - DNA, 1182 bp, Streptomyces avermitilis
  CDS (1)..(1182)
atggagaacgagggcagtggagccgcacgccgtcccctcggcgtcgcggtcgtcggtttcggctggatggggcgcgtgcacacccaggcgtacgcccgggtgctgcaccatttcccgcagctggccgtgcgcccggagctggtgacggtcgccgaggaggtgccgggccgggccgaggaggccgccgcgcagttcgggttcgcgcgtaccgcccgggactggcgcgaggtggccgcggatccgcgggtgcacgcggtgagcatcaccgcgccgaacttcctgcaccgcgagatcggcgtcgcgatggcggaggcgggcaagcacatctggatcgagaagccggtgggtctcacgctggaggacgcccgcgcggtgtcggacgcggtgaccaaggccggcgtccagggcacggtcggcttcaactaccgcaacgcacctgccgtcgagaccgcccgcgagctcatcgcctccggcgagatcggcacggtcacccatgtccgcatccggctcttcagcgactacgccgcccacccccatggcgccctgacctggcgctacgagcgcgagcgcggcggcagcggcgtgctcggcgacctcgcctcgcacggagtcgacctggcccggttcctgctcggcgacatcgcgtcgctcaccgccgacaccgcggtcttcgtacccgagcgggcccgccccacgggggcgaccgccggccacaccctcgccacggggggcgagcctggtccggtggagaacgaggactacgtctcctgtctgctgcgcttcgcctccggcgcccgcggtgtcctggaggcgtgccgcgtctcggtcggcgagcagaacaactacggcttcgaggtgcacggcaccaggggcgcggtcttctgggacttccgccgtatgaacgagctgggcgtcagccgcggcacctcctaccaggaccagcccctcaccaccgtccacgtcggcccgggccatggcgagtacggcgcgttccagcccggagcggcgaccagcatgggctacgacgacctgaaggtcatcgaggcgtaccgcttcctgcgctcgatcgcggaggagacaccgtacggggccacgctgccggacgccgtgcacagtgccgcggtgctggaggccatggccgcgtccgcggagagccgcgcctgggtggacgtgccgacgccc

SEQ ID NO: 7135 - DNA, 1014 bp, Streptomyces avermitilis
  CDS (1)..(1014)
atgtccgaggcgcagtccgaaggccggccgacgatccgtacggtcgccgagcgcgccggcgtgtccaagtctctggtctccctggtgctgcgcggctccgagcaggtgcggcccgagaagcgggaggccgtgctgcgggccatggcggagctcggctaccggccgaacgccgcggctcgcagcctcagcgagcagcgcacccgcacggtcggtgtcctcctcaacgacctgcgcaacccctggttcgtcgacctgctggacggcctgaactcactgctgcacgacaacggcctgcacatgatcctggccgacgggcgcctcaaccgccgtatcggccaggacctcacccgcccgttcctggacctccaggtcgacggactgatagccgtcggcaccctgcccgacccggccgcgctcggcacggctgccgcgcggatcccggtggtcgtcgcgggcacccgcgaacccgtgctccccggcgtcgacgtggtcgcgaacgacgacgagcacggggcgcggctggccaccgagcacctcatcggactcggccaccgcgccatcgcgcacatcgcgggctacggcgccgtcggcgacctgcgccgacgcagcttcgaggccacgatgcacgcacacgggctggccgacgacgcgctcgtggagcccagcgacatgaccgaggagggcggctaccgcgccaccgtgcggctgctcagcggcccccggcgccccaccgcggtcttcgccgtcaacgacatcgcctccgtcggcgcgctctcggccgccgacgaactcggcctgcgggtaccgcgcgacctgtccgtggtcggatacgacaacaccagcatctcccggctgcggcacctgtggctcaccaccgtcgacaccgccagccacgacgtcggcagacgcgccgcccgctgcctcctggaccgcttcaccgaccccggccgccccgccggggtacacctgtcgacgccgaccctggagatccgccgcaccacggcggcgccgagt

SEQ ID NO: 7136 - DNA, 357 bp, Streptomyces avermitilis
  CDS (1)..(357)
gtggagagcccacgccacagggatcagccctgcggtcaggcgcagcacaccgcggctgacctcgaggtttctcccctgtccgaccggccgggtgtgcgggccgccggggaagtcaccctgaccacgctcacggagtgggagcgggccctggaccaactggtccggcggcgtgaggacgcgctctacgtagagctctcagcggtcaccttcatcgatgtggctggtgcgtcggccctggcgctggcagcccagcggctccccgccggccagcacatccatctggaccggccacccttcggactgcggcgcatgttcgaaatgttctggcctgacctgctgacgattgagatggtggcg

SEQ ID NO: 7137 - DNA, 930 bp, Streptomyces avermitilis
  CDS (1)..(930)
gtgatgagtacggccgcccctgccgacccgtttgtgcacccggccctgttctaccgaggcgatcggcagtacgtggcgggaacggttccgttcgtcctggacggtctgtccgccggtgagccggtggcagtggccgttccgggcccccagctcaagctgatgaagacggaactgggcgcggacgccgatcaggtgcacttcctcgacatgacccaggccggccggaacccgggccggatcatccccggagtcctgcgggccttcgccgatgcccggtccacggcacgggtacggatcatcggtgagcccatctggccgggccgcacctccgcggaatacccggcctgcgtccagcacgaggcgttgatcaacgctgccttccgcggccgggaggtgaccatcctctgtccctacgacgcggatgggctggacgagaaggtgctcgccgacgcctacgccacgcatcccctggtgatcgacgaaggccgtgagctggccagcgccgcatacagccccgacaccgtcgtcgcccgctacaacgagccactggcgcccccgcccgcggccgtggcagccgccttcaccgtcgaagagctttccgccgttcggcatttcatggtccggcaggccgaagacctgggcctgtccggcgtcaggctgcaggacctggccttgctggtcgccgagttgacgaccaacagcgcggtgcatggcggcggttcaggaacggcacggatatggaccgagggggaccaggtggtgtgcgaggtccaggacggtggacgactcgtggatccgctggccggccggcgccccgcggagcgtggtcagatcggtggacgtggactgctgctggttcaccagctgtccgacctcgtacgtatgcacacgagcgagagcggcaccactgtccgctgttatctgagccgc

SEQ ID NO: 7138 - DNA, 1446 bp, Streptomyces avermitilis
  CDS (1)..(1446)
gtgagcatcctcaacgacgtgcccaagcagttgttcatcggcggtacctgggcggacgcggccgacggcgccaccatgccggtggacgaccccgcgaccggcgagatcctctgccacgtcgccgacgccggacccaaggacgcccggctcgcggcggacgccgccgtcgaggcacaggacggctgggcccgtacggcgccccgcgaacgcagcgagatcctgcgccgcgcgtacgagatcatcgtctcccgcaccggcgaactcgccctgctgatgaccagcgagatgggcaagccgctggccgaggcccggggtgaagtggcctacgcggccgagttcttccgctggttctcggaggaggcggtacggatcgacggcggctacggcgtcctgccggacggccgcaaccgcatgctgctgatgcgccgtcccgtcgggccgtgtctgctggtcacgccgtggaacttcccgttggcgatgggcacccgcaagatcggcccggcgatcgcggcgggctgcacgatggtgctcaagccggccccgcagactccgctgtccagcctcgcgctggccgggatcctgaaggaggcgggcctgccggacggcgtactcaacgtcgtcaccacctcccgggccggggaggtcgtggaaccgttgctgaccggcggacgcatccgcaagctgtccttcaccgggtccacccgggtcgggcggctgctgctcgcgcagtgcgccgacgcggtcgtacgcacgtcgatggaactgggcggcaacgccccgttcatcgtcctcgacgacgcggacctgagcgcggctgtcgacggggcgatgaccgccaagatgcgcaacatgggcgaggcctgcaccgccgccaatcgcttcttcgtccaccgctcggtggcggacgagttcgggaggcggctcgcggagcggatgggggcgctggtcgtcggtcccggcacccgggacggcgtggacgtggggccgctgatcgacgaggccggtcgagccaaggtcgaggagctggtcgccgacgcggtggagcggggcgcccgggtactggtcggcggcgtggcgccggacggccccggccgcttctacccgccgaccgtcctggcggacgtcgaccccggcagccggctgatggagacggagatcttcgggccggtggcggcgattctcgtcttcgacgacgaggacgaggtcgtgcgccgggccaacgacaccccatggggcctggtcggctacgtcttcacgcaaggcctggaccgcgccctgcgggtcagcgagcgcctggaggtgggcatggtcggtgtgaacacggggctggtgtccaaccccgccgcgccgttcggcggcgtcaagcagtccgggctcggccgggagggcggccgggtcggcatcgaggagttcctggagtacaagtacctcgcggtgccgctccgg

SEQ ID NO: 7139 - DNA, 1257 bp, Streptomyces avermitilis
  CDS (1)..(1257)
atgagcgcactgtcaccgcacctccgccaggccacacccgtcgtcgcggtccggggcgagggcgtccatctgtacggcgaggacggccgccgctatctcgacttcaccgcgggcatcggcgtcaccagcaccgggcactgtcaccccagggtggtcgccgccgcccaggagcaggcgggcacgctcgtccacggccagtacacgacggtgctgcaccctccgctgcggcgcctggtcgaccggctcggcgaggtgcttccggccggcctggacagcctgttcttcaccaactccggcagcgaggccgtcgaggccgccctccggctggcccgtcaggccaccggccgtcccaacgttctggtctgtcacggcggcttccacggccgtaccgtggccgccgccgccatgaccacctccggtacccgcttccgctcgggcttctccccgctgatgagcggagtggtcgtcaccccgttcccgacggccttccgctacggctgggacgaggagaccgcgacccgcttcgccctccaggaactcgactacacactccggacgatctcctcccccgacgacacggccgcgatcatcgtcgagccggtgctcggcgagggcggatacgtgcccgccacccgcgccttcctcgaagggctgcgcgaacgggccgaccgtcacggctttgtgctgatcctcgacgaggtgcagaccggcgtgggccgtaccgggcggttctggggacacgaccacttcggcgtcacgccggacatcctcatcaccgccaagggactggccagcggcttccccctgtccgggatcgccgcctccgccgagttgatgggcaaggcatggccgggctcgcagggcggtacgtacggcgccaacgcggtggcctgcgccgcggcgtgcgccaccctcgacgtcgtacgcgacgagaagctggtggacaacgccgaggcgatgggcgcacggctgcgcgccgggctggcggcggtggccgcgacgacaccggccatcggggacgtacggggcctcgggctgatgctggccagcgagttcgtcaccgaggacggcggccccgaccccgagaccgccgcccgggttcagcgggccgccgtggacgaggggctgctcctgctgctgtgcggcgcgtggaaccaggtggtgcggatgattcccgcgctggtgatcgacgaggcggaggtcgacgaaggactgcgggcgtggtccgccgccgtggaagtaggcgtgccggcccga

SEQ ID NO: 7140 - DNA, 1653 bp, Streptomyces avermitilis
  CDS (1)..(1653)
gtgagcgaaccccaccccgcggccccgccgccacccgccgacgaacgggccgccggccgcccgctcaccgtggccggcgcgctcgcgctgccggtcctggccgcgggacagcccacggtcgtcaccggggaatcccaactcggccggccggtccgctgggtgcacgtcaccgagctcacggaccccgcctccttcctcaagggcggcgagctcgtcctcaccacaggaatgcccctgccggaggaaccggcccggatacgccggtacgtcgacgagctcgccgacatcggggccgccgccctggtcatcgaactcgtgcggcgctaccaccgcccgcccgaggccctcgtcgccgcctgccggacccgggacctgccgctcatcaccctctcccaggacgtcaacttcctggaagtcacccaggtcgtccatacgctcgtcctcggcgaccagaccgacgcgatgcgcagaacccagcggatccacgaggcgttcaccgccctgaccctgcgcggggcggaccccgaggacgtggtgcgcgcggcggcggagatgagcggccacaccgtcgtactggagaacctcgtgcaccaggcgctgatctgcgagcccgccggcgccaccgtcgaggacgcgctcaccggatgggaacggcgctcccgggcggccccgcccggcgaccaggccgatgtgcggggacccgagaactggttggtggcgcccgtggagttcaagggcgaacgatgggggcgggtcgtcatgctccccacccgtcgtgggcgtcccttcggcccggagcaggtgaccgtcctggaacggacagcgatgacactcacgatcgcccgcctcgtccacaccacgacgtgggagcgcagggcgcaccgcaacacgctgcgggacatcgccgagcaacgccaccgctcgccccacgaactccggtcccgcgccgccgccctgggtctgccgaccgaagactgccgcttcctcgccgtgctggtggacatcggtcccgacgaggacagcgccgagttggaagcgcgactggccgaggaactgacggcggcggggattcccgcactcaccggcacattgcccctcggacgcgtcggcagcctgctcgccctgcgtccctcccggacgccctggcggcagacggtcgaacgactggcccgcaccaccctgcgcctgcacccgcacgcgatcgtcagcgtgggctgcgaagtcacggacctccgccacgccgcccgctcctttcgtgaggcggcccgcgtggcggaggcggcgccgcccgattccccgaggctgcccggctccccggagaggtccttccacgaactgtccgacgtcggtctgcggcaactcctgtacgcactgcgcgaggacacccggatccaggactacgccgagcgcaggctcggccgcctcgccgaccacgacacccggcaccacaccgacctgctgacgactctgcggcactacctggaggccgccggcaacaagacgaccgcggcacgccgtgacgacctgtcacgccagacgctctaccagcggctgcagacaatcgagagactgctcggctgcgacctcgaatccggcgaccgacgcaccgaactgcacgtggctctcatggtgttcgacatcctccggccgcgc

SEQ ID NO: 7141 - DNA, 1080 bp, Streptomyces avermitilis
  CDS (1)..(1080)
gtgcccgtcatttccgttccctacgccttcaacgaagaggagctctatgtcgacctccggtcgatcttcgggcactcgctcttcctgaagtgtgagggcttcaacttcgccggctcgatcaagttgaaggccgcgaccgagatggtggaggccgctgagcgcgatggagtcctgacgccggaatcgatcctggtcgagtcctcgtccgggaacctcggcgtggcgctgagcatgatcgcggcgagcaagggctaccggttcctgtgtgtgacggactcccgcggcaacctgtcgaccaggatgatgatggaggccttgggcagcgaggtgcacatgatcgccgggcaggaggccaacggcggcttcctcggcgctcggatcgcgtacgtccgcgcgctgtgcgcctccgacgaccggtacgtgtggctcagccagtacaccaatccgagcaactggaaggcgcattaccgcaagacggcgccggagatcgcccgtcagttcccgcggctggacgtgctgttcgtcggggccggcaccaccgggaccctgatgggctgcgcgcgctacttccgggagtggcaccggccggtgcggatcgtcgcggtggacagcgtcggctcggtgtccttcggcggtccgccgggccgccggatgattcccggcctggggatgagcatgcgcccgccgctgctcgacgagtcctatgtggatgaggtgatacgtgtcgaggaggcggacaccatacgtacctgccatcgtctggccaggcgcggattcctgttcggcggctccaccggcacggtggtcagcggcgcgacggactggctggccgggcacgacgcgcgtgaactcaccgcggtggccgtcggcccggacctcggcgagcgctacctcgacaccatttaccagaccaactggctgaaggatctctacggcgacgaggtgctcgactccgacgatgtggccgccggttcctgggcgtcctcccccgcgcagccgacccggtggggccgttcgctggatctgcagaccggtgaccaccacggcaaccagcaccatcagttccatgaccgcaagacc

SEQ ID NO: 7142 - DNA, 1068 bp, Streptomyces avermitilis
  CDS (1)..(1068)
atgaccaccatcggttccaccacgacggagtccgcgacgtccgcgccgatgacggtgccaccgttcgcggtgatctccggcgcccaggtccggcacgcactgcacggacgtgagaaacacatcgtggagctggtcgaggccacctaccgggtgcacggcgccggtgattcggtgaacccgccgtcgtacttcctgcgtttccccgaccgcccgtcctcccggatcatcgcgctgcccgcctcggtcggcggcgaggtgcgggtggacggcctgaagtgggtctccagctttccggagaacgtgacggccggcatcccgagggcctcggccgtgctgatcctcaacgaccatgacaccggctacccgttcgcctgtctggaaagctcgatcatcagcgccaccaggacggccgcgtcggcggcgtcggcggccgaccggctcagccgcggccggccgcgaccgacgcgggtcgggttcttcggagtgggtctgatcgcccgctacatccacaccttcctcgtcggcaccggctggtcgttcgacgagatcggcgtgcacgacctgtccgccgacagcacggcaggcttccagagctacctggagcagtcgggcacccctggccggatcaccgtgcacgacagcgccgaggagttgatccggggcagcgacctggtggtcttcgccaccgtcgccgggcagccacatgtcggcgatttgtcctggttcgcacacaatccgctggtgctgcacgtgtcactgcgtgacctcgcgccggagatcctgctcgcctcgaccaacatcgtcgatgacatcgagcactgcctgaaggccgacacctcgccgcatctggccgagcggctcacgggcagccgggacttcctgcacggcacattggacgacgtgctggccgggcgggtgacggtgccggcggaccggccggtggtgttctcgcccttcggcctcggggtgctcgacctcgcggtgggcaagtacgtctacgacgacgtggtccgccgcggggagttgcacgtggtcgacgacttcttccacgaactgagccggtacgga

SEQ ID NO: 7143 - DNA, 969 bp, Streptomyces avermitilis
  CDS (1)..(969)
gtggaactgaaaccgggcagacctccgctcctgcgggccgaggccgccgccgacgcgctgcactgggcggccgagcaccgggacgcgctgcgcgctgtcgtcgccgagcacggctgcgtcctggtccgcggcctcgggctgcgcgacgcggccgggaccggcgccgtcttctcgaagctggccaccggcctgatgaccgagaaggaggtcttcgcgccccgggagacctactccgacggcgtgtactcctcaacgaagtggccgacgaaccagcccatgtgcatgcaccacgaactgagctacacgcttgagttcccgggcctgatgatgttcgcctgcctcggcgcgcccagcgacggcggggcgaccgcggtggccgactcaccgaccgtgctcgacgcgctgcccgccgagttgaccgagcggttcgagcgagagggctggctgctcacccgcagctacaacgacgagatcggggcgtccgtcgccgaggcgttcggcaccgaggaccgtggcgccgtcgagagctactgccgcgccaacgggatcatgttcgagtggcagcccgacggcggactgcgcaccagacagcgccgcagcgccgtggtgcgtcacccggtcaccggccggcgctgctggttcaaccagatcgcgttcctcaacgagtggacgatggcccccgaggtgcgcgagtacctggtggacgtctacggcgccgacgggctgccgttcaacacccgcttcggcaacggcgacccgatcggcgaggacgtcgtgcagttgctcaacggcgtctacgaggccaacaccgcacgtgagccgtggcaggacggcgacctgatgctcgtcgacaacatccgcaccgcgcacagcagggagccctacgagggaccgcgcgaggtgctcgtcgccatggccgacccggtgcgtctggccgactgctcgccgaccgtcgaggtgaccgccgta

SEQ ID NO: 7144 - DNA, 2715 bp, Streptomyces avermitilis
  CDS (1)..(2715)
gtgcagggcgccgacgctcacggccggtggcgctcgaaagttgctcaaggagcttgtatggaggagaaatccatcgaagtcctggcgtccgggccggatgaatctgcgagagacaaaagcagggactccggcccgaaggccggcatcgaaagagacctcgccgaggtgctggctgacgtcatgtccgtcgaacaggtgtcggtcgacagccacttcttcgatgacctcggcgccaactcgttggtgatggcccacttctgcgcacgggtcaggaagcgggcggacctcccctcggcgtcgatgaaggacatctaccggcacccgacgatccgaagtctggcgacgggtctcgcggacgccgcgcccacccctgtcgagtcgtcggtcccggcgccgaccgaggtggtgacaccggcgagcacgcggcagtacctcctctgcggaacgctgcagttcattattttcgtcggatattgctgcctcgccggacttgtcaccggccggggctacgagtgggtctccgccggctcaggtctgcgcaacgtctacctgcgggcggtcctcttcggcggcgccggcctcgtcggcctgtgcatattcccgatcgcggcgaaatggatcctcatcggccgctggaaatcccgcgagttccccatctggggtctgacctatctgcgcttctggaccgtcaagacactggtccacgccaacccgatgatcttcttcgtcggcaatccgctgtatgtgctgtatctgcgcgccctcggcgcgcggatcggtaagggcgtcacgatcttctcccgcaccattccggtctgcaccgacctgctgacgatcggcgccggtacggtgattcgcaaggacgcgttcttcctctgctaccgggcgcacgccgggcgtatccagaccggccacgtcaccctcggccgggacgtgttcgtcggcgagaagaccgtgctcgacatcgacacgtcgatgggcgacagggcacagctcggccacacctccgcgctgcaaagcggccaggtggtaccggaagaccagcggtggcacggatccccggcacagcgcacggagttcgactacctgagcatcgcgcccgcggcgtgcggcactctgcgccgggccgggtacggcctcatcagcgtgctccaagtgttcttcctgtacgtgccgctgaccgtcgggggcgcgtacatgctgatcaccgaggttccggaactgaggaacctgctgggcccggacatggtgggattcacgtcgccgacgctctacatcgacgcgctggtcctgtccctcgtgctgttcttcggcttcatcgtcctgggcctcgccctgttgttcaccgttccgcgcctactgagtctgatggtcaagccggacaaggtctatccgctgtacggcctccattactcggcgcacagggcgatcgcgcgcatgaccaacctgaagttcttcaaatggcttctcggtgacagctcttacatcgtccactatttgcgtggcctcggatacgacttgtcccatgtcgagcagaccgggtcgaacttcggtaccgaagtgcagcacgagacgccgtacctgacttctgtcggcagcggaacgatgatcgccgacggactctccgtcatcaatgccgacttctcgagcacgtccttccgtgtatcccaggcgtcgatcggtccacacaacttccttggaaacaacatcgcctatccctcgggggccaagacgggtgacaactgccttctcgcgacgaaggtgatggtcccgctcgacggcgaggtccgcgagggagtaggcctgctcggctcgccgtgcttcgagattccccggtcggtggaacgcgacagccggttcgaccagctccggtccggggaccaactgcgtcgccacctcgccgcgaagaatcggtacaacctccgctcgatgggcctgttcctgttggtgcgctggctgcacttcttcgtgctcaccgtgctcggcctcgcggcagttgacatgcacggtgtgttcggctgggtggtgatcaccgcgtccctggcactcgccctcgtggtcagcgccgtctacctcgtactggtggagcgtggaatcgcggtgttccgcccgctgcaaccgcagttgtgctccatctacgacccgaacttctggctgcacgagcgcctgtggaaaatgcccatcgagtacttccatgtcttcaacggcactcccttcatgaacgtggtctggcggctgctgggtgttcaggtcggcagcagggtcttcaacgacggctgcctcgtgacggagcggacgctcgccaccatcgggagcgacagcacactcaatgtcggaagcaagatccagtgccactcgcaggaggacggcaccttcaagtccgaccgcagcacgatcggcgacggctgcaccctcggcgtcggcgcgatcgtccactacggcgtgacgatgggcgacggctcggtgctcgcccccgactcctttctcatgaaaggcgaggaagtcccgaggcacgctcgatggggcggaaaccccgccacggagtggcgagacgccccctatcggcccgtcgcactgggacggaaggccgcgctgaaccctctcgaccagcatgccccgccggccgagcgacagggccggcccgccgatccgccgagaaaaccacggcgcctgcgacgccgcgctgaccggcggtccacagcaccgtggcgaccg

SEQ ID NO: 7145 - DNA, 1956 bp, Streptomyces avermitilis
  CDS (1)..(1956)
atgcagaaacctttcccccgtgcaccggccgtgcgatgtctgtaccggacggcgtgcgcgaccgcggcggccgcgctggtggtgccgctgctggtcaccgggccgtcgagcgacgcccagggtgaggcgacgacgcggttgcagcgcgcgttcgccgacgcggcggccgagtaccgggtgccgcagagcgtcctgctcggcgtgtcgtacctgcagtcccggtgggacacgcacgacggtgccccgagcgtcatcggcggctatgggccgatgcacctcaccgacacacgcacggccctcgccgaggccccgcatcacggcgtgacccgcgacacggccccgccgctcgcggtggcggcggggccgcagcagcccgccccccggcttcccggccagctgacgactctggagcgggtagccgggctgataggggtcccggcggcccggctgcgtacggacgccgacgtgaacgtacggggcggcgccgccctcctggcggcgacacagcgccggctcggcaagccgctgagtgccgatccggccgactggtggagcgcggtggcgcgcttctccggcgcggacgacagcgcgacggcggcgacgtttgcgaacgacgtcttcgcggtgatccgcgccggcgcgcaccgcaccacggacaccgggcagcgggtcacgctcgcggcgagcccgggtgtgcggcccgactccaggcaggtgcgggccatacggccacgtgcgacggccgaccccgatgtcgagtgccccgcgacgctcgcctgcgattggattcccgccccgcacacggagttcggcgacgaccagtacggcaatcacgacctggccgaccgtcccaaggaccagcgagtcgagtacatcgtcattcatgacaccgaggccacccggacctccatgatcgacacggtgcaggaccccagcgaggcgtcctggcattacaccgtccgttccagcgacggccacataacgcagcatgtcaagaccaaggacgtggcctggcactccgggagccagttcgtgaacgcccgctcgatcggcgtcgagcacgaggggttcctcacgcagccggacgcctggtactcggagcagatgtaccggtcctcggcccgcctggtggcgtacctggcgaagaagtacggcgtcccgctggaccggcagcacatcttcggccacgacaatgtgccggccccgaccgcctcgtcgatccccgacatgcacgacgaccccggccccttctgggactggcggcactacttcgacctcctcggcgcgcccctgcgcgccacggccggggcggacagcgacctcgtcaccgtgctgccggacttccgcacgaatcagccgctgtacacgggctgcaacgagtcgggcaagccctgcgcaccacatggctccagcgcggtccgcgtccacaccgagccgcacgaggacgccccgctgatccaggacccggggcggcgcccggacggcgaggactcgacggccgacgtcaacgacctgggctcgcgcatctccaccggccagacgtacgccgtcgccgaacgccgcggtgactggacggcgatctggtacctgggccagaaggcctggttcaagaacccgaagaggaatccgacggccgtcggagcctcaggtctgatggtgaccccgaaggacggcctgaggagcgtgccggtctacgggcgcgcccacccggaagaggaggcgtacccctcggaggtgcccgtgcagcccgactcaccgcttccgtacgaactcctcgagggccagcggtacgcgacgcagggccgtacgagcggctcgtacttccagccgtcggccaccgacgccgcactgaaccacgtggtgaagggagaagacctgtactacgagatccagttcggccatcggatcggattcgtccgcgcggccgatgtggatgtggtgcacgccgacaagcgg

SEQ ID NO: 7146 - DNA, 588 bp, Streptomyces avermitilis
  CDS (1)..(588)
ttggctcgatccaacgcgccgtcacgtgagcgcatcgtggccggtgccgccgacctgatcagccggcgtggcctgaacgccacgagcatccgggagctggccaaacacgccaaggcaccgctcggctcgacctaccacttcttccccgagggcaagcagcagctggccaccgaggcagtgcgctacgcgggagaagcggtcgcccgcatcctgcgcaaggaattggccgcgggcccggtcgccggcctgcgggccttcctggcgctgtggcgcggcatcgtcgtcgagagcgacttccgtgccggctgccccgtgctggccgtctcggtcgaggagccgccggccgacgagatcccaccggcgctcgtcgccgccgccgaggcgttcgaggagtgggagcacctgctcgcccaggcactgcgggcgcatggcgccgactccgaccaggctccggggctcgcggccctcatcgtggcatccgtcgagggcgccatcgccatgtgccgcgccaagcgcagcacggaccccctggaccaggtggcacagcagctcgaagtcctcatcgtcggcgcgctcgaccgtccggcc

SEQ ID NO: 7147 - DNA, 537 bp, Streptomyces avermitilis
  CDS (1)..(537)
gtgacctccggttataacgactgttatagatcctgtgcgcagagctgtgcccagagctgtgcgcacagctgtgcgcagaactgtgcacatccgaagggagacttcgccatgccgatgatccggctcaccgtcccgcccggttccctgaccgaggagggccgcaggaccgtccagcgcgacctggcggccgtcctgctgcgctgggagggagcgcccgacaccgcgttcttccgcgcccaggcgtggagctacctcgtcgagctgcccgaaggggcacagacgaccgccgaggacgacgcaccccgcttcctcgtggaggtgacggttccccggggcgcgctgtccgagcggcgcagggccgggctggtcgaggacgccaccaggaccgtcctcgacgccgccgggctcacccagtcggacgccccgcgcgtgtgggcactggtgcacgaacagcccgacggcacctggggcgcgggcggctccgtcatccgctacgccgacctggtggccttggcgaaggggcagcgggccgatgcg

SEQ ID NO: 7148 - DNA, 1008 bp, Streptomyces avermitilis
  CDS (1)..(1008)
atgcgtgaactgacctacaccggccggaacaccgtcgagtggcgcgaggcgcccgaccccaagctccagtccgaccaggaggcgatcgtcgtgccggtggccgccacgtcctgcgacgtcgactccatgatcctggccggtcacggcttcatcgacccgcccttcgccctcggtcacgaatgcgtgggccgggtcgtcgagaccggcgacgccgtcaccaccgtcgcccccggtgacctggtggtcgtcccctggtccatcaactgcggcacgtgcgacaactgccgcgccggactgaccgcgcactgcacggccgtaccgcacatggccatgtacggcgcgccgatcggcggcagttggggcggtctcttctccgacctggtccgcgtgccgtgggcggacgccatgctcgtacccctgcccgccggcctcgacccggtcgccatggcctcggcgagcgacaactggtccctgtcgtggcgcctggtggccccccacctgaagaacaagcccggcgcccgcgtcctggtcgtcgcccgcggcagcatcggcctgtatgtctgcgacatcgcccgcgcgctcggcgcctccgacatcctgtacgtcgacccggaccccgaacaccgcgagatcgcccgcggctacggcgccgccaccgccgagacgctcgagcccttcccgcatggcttcgacatcgccgtcgaggccaccggacgcgtcgaccaactcgccctggccgtcaagtcccttgccccggaaggcatctgcgagtccgccggcaaccacttccggcccggcgagctgcccctgctcgacatgtacctcaccggagtcaccctgcgcatcgcccgcgacaacgtccgcaaccacatccccgacgccctcgaactcgccgcctccggcaaggtcgcccccgagcgcgtcgtctcccacgtcctcgactgggagcaactccccgacgcgctgcccgagaagcacctcaagcccgtcttcgtccgcgccgacagc

SEQ ID NO: 7149 - DNA, 525 bp, Streptomyces avermitilis
  CDS (1)..(525)
gtgcttcagcagccacggcagtcacagcagcgatcgcgcggccgcggcggccgcgtcacccgcacggcccgcctggcgcgcgctgccgtactggccgggagtctggccctccttcccctcagcacggcgtgcagcggaggcgaggacgatgccgccaagaagagcaaggcgtcgccgacgacagtgaccgacgccccagcggcgggggcggtggcaccggcgaaggtcgaggtgatcgccaacctgaccggctgcaagcccaagatccgtatcgacgcggacgaactgcgccagggcctctgtcacacgaaggagatcgactacctcatcaccaccttccccgaggagaagtaccagcaggcttggctggactccgccgccgtctacgggggcaagtacctggtcggcctgcggtggatcgtcagcgcgaagaaaccggagatgctggagcagttccgcaccaagctcggcgggacgattcgacaactgcgtggcataggcccgaccccggccccgagcacgtcg

SEQ ID NO: 7150 - DNA, 573 bp, Streptomyces avermitilis
  CDS (1)..(573)
gtgaacgttcttgagccgcccggcgtcccagcggtaaccgaccccgagggagtcaccatgaccgccggacgtgcccgtgctcgtttcctgtccgccgccgtgctgctcgccgccctgtcgtgcgcgaccacagcctgcggctcctcgacatccgcaggttccgccgagaccaagccacagagcacctgggaggaacctgtctcgtactcctacacgctgacatcgaacacccaggtcctggcggggaccttccaggtgcaggtacgcgacggcaaggtggcggaagtggtcgggctcgacgaggacagccggcggcaggtacaggatctgcgcgccgaagtacccacgatcggcgagctgttgaagacgctgaagcaggcccgcagcgaagacgcggacacggcggacgcggactacgccgccgacggccaccccgtgcggatctccctggactgggacaagaactccatcgacgacgaagccctgtacacgatcagctcctacgaaccgacccccggccggcgcgactcaccgctcccgacggcaccggcccgcgggttccagcggccggac

SEQ ID NO: 7151 - DNA, 2382 bp, Streptomyces avermitilis
  CDS (1)..(2382)
atggatcgttttccgcatgcggccgacgtcgatttccatagtcctctggacctctccaaggccgcggccgcggtgctggacgacgaaggccgcatttccgggtggggattctcggcccagcgcctcctcggacattcacccgaggatgtgctcggcaagtcggccacccggctgctggccgctccctcgggccagcccacgggccagcggctgtccgccctgtgcaaggcgcacaagccccgcagcaccgtcttggacctctgctgtcgggacggacgtaccctgcgcgcggccgtgacgttcagccccctctcggaccggggcgtcgctgcgaccgtcgtggtcgcggccgaggtggaggcgctacgcagctgggaagcgcagttggcgatgctgcagggactggcgaccgagtcttccgtgggcctgacgatcttcgacagcgacatgcgcgtcgtctgggggaacatctccaccgacttggaactcgggggagtcgcccagtacaccggccgaccggccgcggacctctttcctgagggcgaattcatctcccgccaccaccccccggacgaagaccagatcatggagcacgtgctgacgacgggggaaccgatcatcggcatgcactaccgcgggcgcgcccccgccgacccggggcgcgagcacgtctggtcctgctcgtaccaccggatgctggacgcccgaggcgaaccgctggggctgttcgaggagtccctggacatcaccgaccgctaccgcgcacaggaacgcctgtcgctgctggtgcgggcaggaaagcgcatcggtgcctcgctggacgtgcgccgtacggccgcggagattgccgacgtggcggtaccgcagctggccgacgaggtgctcgtggacctgccgccggcggtcatcgagggacggcagccgccgacgggctcggcgccggggcacagtctgctgcggatgcacggccggaccccggaaggattccggaccagtcccgtctcctacccaccctcgtcaccgcaggcactgagcctggccaccagccgccccgtcgtcgacgcctccccgcccgaggcaccgggcggggagggatcggccgccccgcactcctgcctgttcgtcccgctgctcacccgcgatgcgatcctcggccttgtcaccttccggcgcagcagcaaccccgatcccttcggccccgaggagcagacgctcgccgtggaactggccgagcgagccgccgtcggcatcgacaacgcccgccgttacaccagccagcatgcggcggccctggtactgcagcgcagcctgctgccacagcacctgcctgagcagagcgccgtcgacgtggcgtaccgctacctgcctgccgacagccgcgtgggcgtgggcggcgactggttcgacgtgatcccgctgtccggtgcccgagtgggcctgaccgtcggcgacgtggtgggccacggtgtgcacgcggccgcgaccatgggccggctgcgcgccaccgtacggaccctggccctgctggacttggatccggccgagctgctcacccggctggacgacctggtcgcgcaggactcggactcccacgcggagggcgggccgatcgacgaggcgctcggggtgacctgcctgtacgcgatctacgacccggtcagcagccggtgcgtctgggcgagcgcgggccatcccccgccgatcgtggccgatgcgagcggctcggtggccttgtccgcgctggcgccgggaccgcccctggggctggggggcctgccctacgagaacgttgagctgaacctgtccagcggcagcgtggtggcgttcttcaccgacggggtcgtggaggaccggcgcaccgacatcgacatcggtatcgaccgtctggcccaggtgctcacctggcaacgatgcccgctggaggagctgtgcgaccgggcgctgtcggacatgccgcccggaccacaggcggacgatgccacgctgctgctcgtccgcacccggcggctcggcgccgaccatgtggcggacctggagctgccgcctgagccgaccatggtggctcacgcccgcacactcactgagcgccaattggcgatctggggcctgtccgaactgtcgttcaccgcctctctcgtggtgagcgagctggtcaccaacggcatccggtacgccaccgggcccgtcatgctgaggctgatcagggatcgctgcctgctgtgcgaggtctccgacaacgcgcacaccgcaccccatctacggcgagcacgtcgggacgacgaaggaggccgcggcctgttcctcgtcgcccaggtgtcccagcgctggggcacgcggtacacctcgtccgggaagacgatctgggccgagctggccataccg

SEQ ID NO: 7152 - DNA, 318 bp, Streptomyces avermitilis
  CDS (1)..(318)
atgagtgggtgtggccggacttcttcgccgtccgaacccgacagctcacctcgcaggcggctgacgaaggtgcgggaagccatgacggcaacgcagaacggcccgcagctctcggggtccagggacgagcctccgaagagcaacaagaagacggatgccttgatcgcggtgttgatcgcgatcatcggtggctgcttcgcgggcatcgtccgtcggacgatggagggggtctcgtactacgaggccatcagtacaggagcccttgcggcactggggctgggcggtttcatctttgtgatcttgacctacatcaggtct

SEQ ID NO: 7153 - DNA, 531 bp, Streptomyces avermitilis
  CDS (1)..(531)
gtgatcatgaaacgggaactcatcgtcgcccgggccgtgtgcttggcgccgagcacttcttctgccggagttcatgcctttgaggcagaacacaggatcgtgctgcccgagccgtatcgggccttcgtcgctgagatagcggacggttcgtactccgggccgcccgagtatggactgctgtcggtggcggagctgccggacgactggggcgatgacgagcaggaacgcgacctgagtaagccgttcccgctggtggaggcatggatgtgggaggaggactcggacccgtccgaggatgccgacgagctcctggagcaggtctacaaccacggctcgatcgtgctcggcaccgacgggtgcgcgatgaactggcatctcatcgtcaccggacctcaccgaggacacgtctggctgatcagtgacgtcggcgctgtccccttcggtgcgcagttcgggttcaccactgctgagcctggctttgcgggctgggtccggcattgggcagcgaacaagccctggcatgacgctgcg

SEQ ID NO: 7154 - DNA, 204 bp, Streptomyces avermitilis
  CDS (1)..(204)
atgaacgagtcccgcccgcacctggtgcccgtccgctcccgtgacgccgaggatttcgtccgcctccggcatcggcaccaccccccgcccgccggacaggtcttctcggtcggtgccgccgacgacaccggcatcctgcgcgccgtggccgtggtcggccgccccgtcgcccagccgacagcttcgtcccgctcactgaaccca

SEQ ID NO: 7155 - DNA, 258 bp, Streptomyces avermitilis
  CDS (1)..(258)
gtgagttggtggagcagccccatcgaccgggctgtcaacgacggtggcgcgacggacacgtacttcccgcggctcgaccccgtgaccttcgccgcacggggtgtcgtccccatggcccaggccgctttcgccttcgtcctgggcgtcgccctcggcctcgtcatccgccgcaccctgcccgcgatggcaaccccgctcgtcgtctacgccgctgtccagatgaccaggcagcaggtccggaccgcgacgccggaccgc

SEQ ID NO: 7156 - DNA, 1521 bp, Streptomyces avermitilis
  CDS (1)..(1521)
atgacccgtttcgcagcgcccggcaccgacggcgcgatcgtctcctaccaggcgcgctatgaccacttcatcggcggcgagtacgtgccgccggcccgcggacagtacttcgagaacccgagcccggtgaacgggcagccgttcacggagatcgcgcggggcacggccgaggacgtggagcgcgcgctcgacgccgcgcacgcggtcgcccccgcctggggccgcacgtccgtggcggagcgctccgacatcctccgccgcatcgccgaccggatggaggcgaacctggagaagctggcggtcgcggagagctgggagaacggcaaaccggtccgtgagacgctggccgcggacattccgctggccatcgaccacttccgctacttcgcgggcgcgatccgcgcgcaggagggttccctcggcgaggtcgacgacgacacggtcgcgtaccacttccacgagccgctcggcgtggtcgcgcagatcatcccgtggaacttcccgatcctgatggcgacgtggaagctcgccccggccctcgcggcgggcaacgcggtcgtcctcaagcccgccgaacagaccccggcgtccatccactactggctgagcctggtggccgacctgctgccgccgggcgtgctgaacatcgtcaacgggttcggggtggaggcgggcaaaccgctcgcgtccagcccgcgggtggcgaaggtggcgttcaccggcgagaccacgacggggcggctgatcatgcagtacgcctccgagaacatcaccccggtcacgctcgaactcggcggcaagtccccgaacatcttcttcgacgacgtctggtcggcgaacgacgacttccgtgacaaggcgctcgaaggcttcacgatgttcgccctcaaccagggcgaggtgtgcacctgcccgtcccgggcgctcgtccagcgcggccagtacgccgagttcatggaggcggcggtcgcccgcaccgagctgatcaagaccggtcacccgctcgacacggacacgatgatcggcgcccaggcgtccaacgaccagctggagaagatcctctcctatctggacatcggccggcaggagggcgcgaagatcctcaccggcggcgaacgcatcgagcacgacggtgagttgaagggcggttactacgtccagccgaccatcttcgagggcgacaaccgtatgcggatcttccaggaggagatcttcggtccggtcgtctcggtgacgtcgttcaatgacttcgacgacgccatcaagatcgccaacgacacgctgtacgggctcggcgcgggcgtatggacgcgggacatcaacaccgcgtaccgcgcgggccgtgccatccaggcgggccgcgtctggacgaactgctaccacgcctacccggcccacgcggcgttcggcggctacaagggctcgggcatcggccgcgagacccacaagatgatgctggaccactaccagcagacgaagaacctactggtgtcgtactcgccgaagaagctgggcttcttc

SEQ ID NO: 7157 - DNA, 1287 bp, Streptomyces avermitilis
  CDS (1)..(1287)
ttgtccgatccatgggtggcactggagccgggtgccgaccccgccgagcgtgtgcgggcgctgcgccgtgcccacgagacgttcacagcggcgggcacggcggcgggcacggtgccacggccggtgcgttccgtggtggccgactcctggcggcgttccgcgcgggccggggtgggcccggacggcaccgcgagcgtggagctcaccgacggcgacctcggctcgtaccgggcggagcacccgctcgcaccggtgatgccgttgttccgtgagctgatgggcacgttcgcggcggacggggagcatctgctggcggtgtgcgacgcgcagggcaggctgctgtgggtcgaggggcatccggcggtgcgccagcgggcggacgggatgaacttcgtgccgggtgcgcgctgggcggagagcgcggtcgggacgaacgcgccggggaccgctgtggcgttggaccggccggtgcaggtgttcgcggccgagcacttcatccggcgggtccagccatggacgtgcgcggcggcgccggtgcacgatccacgcaccgggcgggtgctcggcgcggtcgacatcaccggcggggacgggctcgcgcatccgcacagcctcggcttcgtacaggcggtggcacgggcggccgagtcccagctggcgctgctcgcgccggcgcgcggcacggcggacacgctcgaactgaccgcgctgggccgcgacgaggcacagctcctcgcgggcgggcggaagatccggctcagccgccggcacagcgagatcctggtgctgctggcccaccatcccgaggggctgaccggcgacgagctgctgtgcgcgctgtacgaggacgagtcggtgacaccggtgacgctgcgcgccgaactggccaggctgcgccgcctcctcggtcccggtctgctggcctcgcgcccctaccggctcacggccgcggtggagtccgacgtggcggtcgtggagcggcgtcttgggaccggggcggtcacggcggccgtggcggcgtacgcgggtccgttgctgcccggttcgcaggctccggcggtggcccggctgcggcgcaggatcgccgacggactgcgtacggcgctcatcgcgcgccgcgaccccgatctgctggcggactgggcgcacgcgccgtggggcgaggacgatctcgacgtatggcgtgcgctggcggcggtgcggccgacggcgccggtgagggcacgcctcgacgagctggagtacgagctgtcggcgccggcgggttgggcccgttcggcgccccgg

SEQ ID NO: 7158 - DNA, 597 bp, Streptomyces avermitilis
  CDS (1)..(597)
atggagcgagccagagcgctgcccagcagacggcagctgctgaagggcgcggccgtcgccgcggtcccctacgcgttattgcccgccgcgcaggccggcgccgagccccgggccgtcgactatccgtccgccgagtggacggcggccagcacgtccaactacacggcgtccagccgcccttcgagctatcccctcgactacgtggtcatccacgtgacgcaggagacgtacccgacgacgctggacatcttccggaacccacagaagggcgtgtccgcgcactacgtcgtacggtccgccgacgggcacgtcgcgcagtgcgtccgggagcgcgacatcgcctggcacgcgggcaactgggactacaacacgcgcagcatcggcatcgagcacgaggggtgggtggaccagcccgcgtacttcaccgacgccctgtacgaggagtccgccaggctgacggcggcgatctgcgcccagtacggcattccgaaggaccgggcgcacatcatcggccactacgaggtgccggggacggaccacaccgatccggggccgaactgggactgggtccggtacatgaggctcgtcaacttcgcc

SEQ ID NO: 7159 - DNA, 1236 bp, Streptomyces avermitilis
  CDS (1)..(1236)
atgaccgcaccgctgcacgaggcacacccggccggccggggccgtcggctgcccgacacgcaacagggcatgcgccgccgcaacctggcgcgggtgatgcacaccgtgagcgccgagggaccgctgtcccgcgccgccgtcgcctcgcacatcggcctgacccgggcggccgtctccaccctggtcgacgaactgatccgctcggggctcctcgaggagctggggcccgagcgccccggccgggtgggacgcccgggttcggccctcgcggtcagcggacgcggaccggccgggatcggtgcggagatcggcgtcgaccacctcgccgtgtgcgcggtcgatctgcgcggcgcggtgcgggcacgggccgtacggaacggcaccaaccggggccgggagcccgcggcggtgatcggggaactcacccggctggtgcgccgggtcgtcgccgaggcggaacaggaagggctgtggcccgcgggcctcgccgtggccgtaccgggtctggtcgcgcgggacgccaggaccgtggtccgtgccccgaacctcgactggcacgacacggacctcggcgcgctgctgcccgacgagctgccgctgaccgtggacaacgaggccaacttcggcggcctcgcggaactctggctgggcgacggcacgccacgcgacttcctccatgtgtcggcggagatcggcatcggcggcgcggtggtcgtggacgggcggctgctgcgcgggacccgcggtttcgcgggcgagctggggcatgtgcccgtgcacccggacggaccggagtgcccctgcggcgggcacggctgtctggagcagtacgcgggcgaggaggccgtgctgcgcgcggccggtctggagcccggcgaggaccgcgtcgggctgctggccgagcgcgcggctcagggggacgaggacgtacgcggggcgctgcgcgacgccgggaccgcgctcggtatcgcgctgaccggggcggtcaatctgctggatccggagacggtcgtgctgggcggtgcgctggcgggcctggcgccctggctgctgccgtcgctggaacgggagctggcccggcgcacggccggtcccgcctgcgcggtgtccgtctcgcggctcggttccgaggggccgctgctgggggccgcgcacgcggtggtgcgggcggtgctcgacgacccggcggcggtggcggaacgggcacaggacagtgcccgcgcggcgacgcaccgg

SEQ ID NO: 7160 - DNA, 1572 bp, Streptomyces avermitilis
  CDS (1)..(1572)
atgtgtctccgccgggagacgaggtgttttcgttccagaggtactgggtgcccagaggcgttgtggtcccagaggtgtttccgttcccaacaggccagatcccgcgagccgcggaagagggagagcccgatgtcagcagccgagggtccgctcgtcgtcggtgtggacacatccacccagtccaccaaggccctggtggtcgacgcatcgaccggacgggtggtggcgagcggccaggcgccccacaccgtctccgccggggcgggccgcgagagtgatccgcggcagtggtgggacgccctgtgcgaggccctgcaccagtgcggcgacgcggcacacgaggcggcggcgatctcggtcggcggccagcagcacggcctcgtcaccctcgacgcgcacggcgacccggtgcgcccggcactgctgtggaacgacgtgcgctcggcgccgcaagcccgccggctgatcgaggaactgggcggcccgaaggcctgggccgagcgcacgggcagcgtgccgggcccctcgttcacggtcacgaagtgggcctggctgacggagcacgagcccgaggcggtccgcgcgaccgccgcggtacgcctgccgcacgactacctcaccgaacgcctcacgggacagggcacgaccgaccgcggtgatgtctccggtacgggctggtgggcgtccgcgacggagtcgtacgacgaggaggtcctcacgcatgtgggcctcgatccggcgctgctgccccgcgtggtgcgcccgggtgaggtcgtcggcaccgtgcgcgacagccatgacctgccgttctccaagggcactctggtcgccccgggcaccggcgacaacgcggccgccgcgctgggcctcggcctgcgcccgggcacgccggtactgagcctcggcacctccggcacggtgtacgcggtctcgacccggcgccccgccgaccccaccgggaccgtggcgggcttcgccgacgcgcgcggcgactggctgccgctggcctgcacgctcaactgcaccctcgccgtcgaccgcgtcgccgcgctgctcggcctggaccgggaggcggtggagccgggcacgggcgtgaccctgctcccttacctggacggcgagcgcaccccggatctgccgcacgcctcgggtctgctgcacggactgcggcacgacacgacgggcggacagctgctccaggcggcctacgacggagcggtccacgcactgctgggcgccctcgacctggtactcgacgcggacgcggaccgctcggctccgctgctgctcatcgggggcggggcacggggcacggcgtggcagcagacggtacgccggctgtcggggcgtcccgttcaggtgcccgaggccagggagctggtcgcgctcggcgccgcggcgcaggccgccggggtgctgacgggcgaggatccggcggcggtggcccggcgctgggacacggctcacgggccggtgctcgatgccgtggaacgggacgaggcgacgctggccaggatctccggggtactctccgacgcggcgccgctgctggagcgggaaccggaccggcgc

SEQ ID NO: 7161 - DNA, 1164 bp, Streptomyces avermitilis
  CDS (1)..(1164)
atgaactaccagcccacccccgaggacaggttcaccttcggcctgtggaccgtcggctggcagggaagggacccgttcggcgacgccacccggcgcgccctggacccggtcgagacggtgcagcgcctcgccgggctcggtgcccacggagtgaccttccacgacgacgacctgatccccttcgggtcctcggacaccgagcgcgagtcgcacatcaagcgcttccggcaggccctcgacgccaccggcatggccgtgccgatggccaccaccaacctcttcacgcaccccgtcttcaaggacggggcgttcaccgccaacgaccgggacgtccgccgttacgccctgcgcaagacgatccgcaacatcgacctcgcggccgagctgggggcgaagacgtacgtcgcctggggcggccgggagggtgccgagtccggcgccgccaaggacgtacgcgtcgcactcgaccggatgaaggaggccttcgacctcctcggcgagtacgtcaccgcccagggctacgacctgcgtttcgccatcgagcccaagccgaacgagccgcgcggcgacatcctgctgccgaccgtcggccacgcgctggcgttcatcgagcgcctggaacgcccggagctgtacggcgtcaaccccgaggtgggtcacgagcagatggccgggctgaacttcccgcacggcatcgcccaggccctgtgggcgggcaagctcttccacatcgacctcaacggccagtccggcatcaagtacgaccaggacctgcgcttcggggcgggcgatctgcgcgccgccttctggctggtcgaccttctggagagcgccggctacgagggcccgaagcacttcgacttcaagccgccgcggacggaggacctcgacggcgtgtgggcctcggccgcgggctgcatgcgcaactacctcatcctcaaggagcgtacggccgccttccgcgccgaccccgaggtccaggaggcgctgcgcgccgcgcggctggacgagctggcgcagcccaccgccggggacggtctgacggcgctgctcgccgaccgtacggcgttcgaggacttcgacgtggaggcggccgccgcgcgggggatggccttcgagcagttggaccagctggcgatggaccacctgctgggggcgcgtggc

SEQ ID NO: 7162 - DNA, 606 bp, Streptomyces avermitilis
  CDS (1)..(606)
atggccaatggcaggggtgacggctcgaccgacaagaagtcacccgccgagagcagcaagggcacgggccgctcgcccacgccgtcgctgagcatcccgtccgcgattcccagcgagattcccacggaactgccctccgggttcccctcgaaactgcccagcggcttccccagtggccttcccagcgactttcccagcgacttcccgagtgagttgccgagcggcctcgagtcgctcttcgcggccccggcgggcgacgaagtgccgtactacatgctgaagaagggcgactgcttcgacaccagcgtcagccggcccggccaggccgccaagcgctcctgccgcacgccgcacgacgcggaagtcgtgaaagtgacggagttgaagggcggttacgcgaccgacgccgcgctgaagaaggcggcggcgggcctgtgcgaggcgtcgctggcgcgcacggaggcccagcacgccgccggtaccgtgcgtggcacgctcgtgcagtatccggacacggcgggatacaagctcggcatcgacaaggtcgcgtgcagcctgaccgcggacgtcggtggtggggaccgcaagttcaccgcgccgctgaag

SEQ ID NO: 7163 - DNA, 4551 bp, Streptomyces avermitilis
  CDS (1)..(4551)
gtgcccgacagctccgtgcccgtcgaagaacgcctccgctccgccctcgacaccgtcgaggagcagcagcagaccatcagcaagctcctgcgggagaagcacgagcccatcgccgtggtgggcatcggactgcgcttcccgggtggcagcaacacacctgacgagttcgccgagttcctccgcgagggaaggtcgggcatcggccccttcccgacggaccgcttcgacaccgacacctacgtggcggacggcagcggggaggacgacgaaccgggccgcatccgcaccataggtggcggcttcctcgaccggatagaccagttcgacgcgccgttcttcaacatctcgcccaaagaggcgcagtacatggacccccagcagcgcctgctgctggaaacggcctgggaagccctggagcacgccaacatcgacccgaccccgctgcgccgcgccaacggaggggtctacatcggggccagctccatcgactacgccctggaactggactccctcccgtacgaggagctcgacggccacctggcctccggaatcaccttcttcccgctctcggggcggctgtcgtacttcctcggctggcgcggaccgtgcatgagcctggacaccgcctgcgcctcctcgctcaccgcgctgcactccgcggccgaggggctgcgccgaggtgagtgcgacatcgcgctggccggcgcggtcaacgccctgcaccacccccgcatcccggtgatcttctcggccgccaacatgctcgcgcccgacgcccagtgcaagaccttcgacgagtcggcggacggctacgtacgcgccgagggatgcgccgtcgcggtgctcaagcggctctcggacgcccagcgggacggcgacaccgtcctcggcctcatccggggctccgcggtgggccaggacggggacagcgccgggctgaccgtgcccaacgggcccgcccaggaagcggtcatgcgggcggccatccagcgggcgtcgctccagccgagcgacatccagtacgtcgaggcgcacggaaccggcaccccgctcggagaccccatcgagatgggcgccatcagcgatgtcttcgccacgtcgcacgacaaggaacgcccgctgacggtcggctcggtcaagacgaacctcgggcacatggaaccggtcgccggcctcgtgggcgtcatcaagacgctgctccagatgcgcgagcagaccatcttcccgcacctgaacttcaccaccccctccggccgcatcccgtgggacagctaccccgtcaccgtccccaccgagaaccggccctggaaggccgacacccggcgggccgtggtgaacagcttcggcttcgggggcaccatcgccgccgtcgtcctcgaagagcccccggtgcccgagcagccggccaccgccccggccgccgtccaggcggaccgcacggacagcgcctcggcggtcgagcagcacgtgttcacggtgtccgccaagaaccaccgctcgctgaagcagctcatcgagcggtaccagcgacacctggacgactccccctccaccgacctgggcagtctgtgctacacgggcaacgtgggccgcgcgcaccaccccctgcggctggcgggtgtcgtcggcggccgggaggacctggacgcactgctcaagaagggtctcggccagatcgagaaacggtccatcgccgcggagcgggcccgcaagaccgccttcctcttcaccggccagggctcgcagcatgccgggatgggacgaccgctgtacgaacgcttcgtcgtcttccgcgagcatcttgacgagtgcgaccggctgttcgccccgctcctgggccgctccatccgagcgctggtgctcggcgaggacgacgatccggacgccatccaccagacccgtttcacccagcccgcgttgttctcgctggagtactccctggcgcagctgtggttgtcgtggggcgcgcgtccgagcgtgctgatcggccacagcatcggtgaggtcgtcgccgcggccgtcgcggggctgttcagcctcgaggacgcggtgacgctggtggccgctcgcgcccgtctgatgcagtccgtgtccgccccgggtgggatggccgcggtgccggaggccgccgaacaggtcgccccgttgctcgagtcgtacccggacctcaccatggccgccgtcaactcgccccgtcagtgcgtgatatccggcggaacggactcgctggccgaggtgagcgaaacgctccgaggccgcggcctggacgtcaaacagctgagggtgtcgcacgccttccactccccgctcatggcagaggtgctcgacgagttccgcgaggccttgaaggacatcacgttccggcagccccagctcaccctggtctccaacatcaccggcaaggtcgcccgggtcgccgagatctcgaagccggagtactgggtccgccacatcgtggagccggtgaacttcgaggcggggatgcgggccatcgaacggcggggcaggcacgtcttcgtggagatcgggccgtccatcgcgctgaccggtctggcacggagttgcgtcgacgccggggagcaccgctggctcaacagcctgcacccgaaggagaagcaggggctcaccatcctccaggcggtggccaagctgtactccgccggagtgcgggtggactggaacggcttccacgacggtcgtccgggccgacgcgtggacctgccgctgtacgccttcgaccgcaagcgttactggctgccgaacggcaccggtcccagcgcacaggacgaggcggccggtccccggtcggcgttcctgcacgaaccgcgttgggtcgagcagcccccgacggcccggacggtggcgggcccccggcacgttctggtggtgaaccgcgccgcccaggacgtcaccgggctcgtggaacaggccgccggacaggacgtacggctgtccttcgcggcggaccccgagcaggcactggacgtggtgcgcgcgggtgagccgacggacgtgtgctggttctggcagtcggacgacggcccggtgagtgccgagtccctccgggcggagtgcgagcacaactaccgcgatctgctcacgctgctcggcctgttggagcaggaggaaggcggcctggccaggcgtctgtggctggtcaccgaagcggcccaagtcctgccgggtgacgagccgggcagcggcgcacacctcgcggccgccactctctggggcttcggccatgtgctgctgaacgagtacccgtcgtaccgggtcaccctggtggacctgccggcgggcggtggccgcactgccgaggagatgctgctcggggagtggctggccgccgacaccggcgagttccaggtggcctaccgcgaccggaccggccgccacgtccacaggctgctgcccagcgccttcgactcccctgagcagcccgccgaacccggcaccgcacccgtacgccccgaccggaactatctgatcaccggtggtctcggcgcgctcggtctgctcaccgcccaccgcctggtggacgagggtgcccggtatctgacgctggtcagccggcgggcggagccggccgcggacgccgccgggctgtgggagcggctgcgggacagggccgaggtgacggtcctgcgcggcgacgtcggcgacagcggcgacgtccaccggatcgtcgagtcgctgcacgcggcgccgcagccgctcggcggcatcgtgcacacggccggtggcctggacgacgccccggtcgccgcacagacgtgggagagcatcgacgcgctgttctcggcgaaggtgtacggaagctggatgctgcacgaggccgctcagggcttcgacgagctggacttcttcgtcgcctactcctccgccgcggcggtggtcggcggggcgtcgcagtccaactacgcggctgccaacgcgtatctggaccagttgctgcactggcgggccgcgcagaacctgcccgccctgggcgtcaactgggggccgtggtccgaggccggtatgtcggcccgcctgaacgcacggcacatcgaggcgctggaacgcgagggcatcgtcttcattccaccgcggcaggccctggacaccatggtctccctgctcggggagccggtgacgcaggtgctggccggcgagtgcgactgggaccgcttctccgccgccaagccggtggtcaacgccttctaccaggagctggtcggcgccgacgggacctcctcgcggaccctcgacctcgatgcgctgctggcgtccccggacggagaacgcgtcgagaagatcaccgacttcatccggcaccgggtcgccgacgtgctgcacatcgacgacgccgacgacatcagtccgtacaccgagttcgtgcaactgggcctggactccctggtggcggtggaactgaagaacgccctggaagcggccttccggatcccgttgcccctcacgatggccttcgactacccgagcgccgcggtgctcggcgagttcatcggcaagcgtctggaacaggcacggcccacggcgccggctggatca

SEQ ID NO: 7164 - DNA, 1281 bp, Streptomyces avermitilis
  CDS (1)..(1281)
gtgaaggtaagtgtgtcgacggccggcagccgcggtgacttcgaaccgtatgtcgcgctcacccaggcgctgatcagcgctgggcacgaggtcaccttcgccgcccctcgcgacgcgcgccgcctggtggccgggacggacgccaagttcatcgagatggacctggaagtacgcgaggtactgcggtccgaggagggccagcagtggctggccgccggcaatgtggaggcgtatctcgggggcatcacgaagatgctgtcggacgcccggcacaccatcggcacgtcggtgctggccgcggccgacggcgccgacatcctggtgaccggcgtcaacaccgaggactacgcgctggcagtctcccaggcccgcggaacgcccatcgtcctcggccatctgacgccgtggttgctgaccgacgagttccctcagccgctgactccgcaggtcgtaccggccgaccagtccgccgagcagtacaacctggggacccaccaggtggccgaagacgtgtactggcagggcaagcgggacgacatcaacgagttccgagggtcgctcggcctgccaccggcccccagcgccgcactgacctggaccgtcgaactcggtctgccgacgctccaggcgttcagcgaggaggtggtcccccgaccgcacgactgggggccgcggaacgtcatgaccggattctggcggctccagtccgaggtgcgccgccgtgtgggggaggccgagatacccgagtggctggccggctggctcgccatcgggcctcccccggtgttcctgggattcggcagcatgccggtgctggatccgccgaagctcctcgacctgatcgtgcgcgccgcggagcgaaccgggctgcgtctgctggtcggagcgggctggtccgacctgtcggggctgaccggcgaactgccggacaccgtgcgcctgatcggtgccatcgaccacgactggctgttcccgcggtgccgggcggtggtgcaccacggaggcgcgggcaccaccgccgcgggcctgacggccggcctgcccacctggatctacaccgtcttcagcgaccagccgttctggggtgaccgggtcgcccggctcggtgccggcggctacagcaacttcctggagttcgacctggatcacctcaccggcgtgctcggtcagctggtcggcgaggacgtacggcggcgggcggccgcgatcggcgagcggctgcgagccgaggacggagtgagcgcggccgtccggctgatcggtgagatcgccggccgacac

SEQ ID NO: 7165 - DNA, 1191 bp, Streptomyces avermitilis
  CDS (1)..(1191)
atgacccagaccgctgcggttaccaccgcatggccgctgcaccgcacctgtccgatgtcccaaccacccgccctcgccgcgttccgcgacggcccgccccgccaggtactactccgcggcgaccagcccgcctggctcatcacccgctacgcggacgtacgccaggcactcgccgacccgcgcctgagcgtcaacgaccagcaccccaactggccgaaccgactgctgtttcccgtgccgccgcgggccgtgtcgttctggcggatggacccgccggaacacggggcctaccgcaagatggtcgcggcggagttcatcgcccaccgcacgcaggcccttcgcccactccttcagtcgataaccgacgagttactcgacgagatggccgcgatgcccaagccggtcgatttccattcggtgttcgccctgccacttccctgtatcgcgatcgcccgtatcttcggagtgccggacgaagacatgagcgaattcaaggaaaataccagcgccctgctcaaccagaaggaaccggaaaaggccgtccaggcgtttctcgccaccaccgcctacctcgacgggttggcgcgggccaaggaacgggagccgaaagacgacctgttgagccggttggtggtgaatttcgtccgccccgggcagctgtcccacgacgacctggtggccatggtccggctgatgctcgtcgccgggcacgagacgacggcgaaccagatcgccctcagcatcttcaccctgctcgacagacccggggtactcgccgaactccgcgccgacccgcgcctgctcactcccgtggtcgacgaactgctgcggtactggtccatagcccaggataacgttgtcagaacggccaccgaggacctgtccgtcggggacgcccgcatcgcggccggcgacgccgtcgtcatctctgtcccgggcgccaatcacgacgaggccgtcttccccgacgcggcggacttcgacatccaccgggacaacagccgccatctggcctttgggcacggaccccacttctgccccggcggaccgctggcccggaccgagctggagatcgccatcaccagcgtgttccgccgcttccccgacctgcgtctggccatcggacgcgaccaggtcccggtccacaccgacacgctcgtgtacggcctggagtgcctgccggtgacctgg

SEQ ID NO: 7166 - DNA, 1563 bp, Streptomyces avermitilis
  CDS (1)..(1563)
atgcgtccaacgcaatggacaggactgcttacttgggcaagaatccatggggccgacgcgtcggctgtgcgtgcggacaaacccaacggagggctatccatgactaccgaggagttatccgagtcggagctcgccggggcacctgccgcgactgtcgcggaaccgccgccgcgatggagcccgctcattctcgtgtcgctcggcacattcatcaccgtgctggatttcttcatcgtgaacgtcgcggtgcccgacattcagcagagtctgcacgcgagctcggtcgcggttcagttcgtcctggccggttacggccttccgctggccaccttgatgatcacttcgggccggatgggggacctgtacggccggcggcggttgttcgtgaccggcctggcgttgttcacagccgcctccgcctgtgccgggctggcgcagagccccgcccaactcgtggcggcgcgggtgttccagggcatcgcggcctccctcgtcactccgcaggtactggccctgctgggcgccatgtaccagggcagggcccgcgcggtggcgttcaacgtctacggtctggcgatcggtctggccgcggtgttcggacagctgatcggcggatctctgatcgcgctggacccgggcgggctgggctggcgcgcgatcttcctggtcaacgttccggtcgggctggtcgccgtggcgctggtgccgaggctggttcccgagtcccgtgggggcgggcggaccaggctggacgtgatcggcatgctcctggtgatgctcggacttgtggcggtcgtgctgccgttgaccgaggggcgggagctcggatggccgctgtggtcggtgctgtgcctgatcgcggcggtgccggtgctggccgtcttcgcggtgcagcagcaccgcggcacggtccggggtggggcgccgctggtgaacaccactctgttccgctcgcgggcgttctccgtcggactgttcgccatgatgttctactacgccacgatgggcgcgtgcttcctggtgctctccctgtatctccagcaggggcgcggcatgtccccgttgggttccggtctgctgtacctgccgctgggtgccggcttcttcgcggcgacggcactggccggccgcctggtcgggcgactggggcggcaggctccggcggtcggcgcgctgctcgtcgtcgtcggctacggcacgctggctgttctggtctcggggatcggcgtcggcgggcgggtcgagtggctcgcgggaccgttgctggtggccggtctggggatggggctgaccatggcgcccctgtcctcgatggtgctcgcccccatcaccgcggaccatgcggccgccgcctcgggtgtactcaccaccgctcaggagatcggcgcgaccgtgggcacggcgctgatcggcagcatcttcttccggatggtcggcgaccacacacaagcccccgcgacgtcgcatgccttcagcgtctgcctggcggtgctggtggcgttcgacctgctggtcgtggtgctggtgcagctcatgggcaaggcctcggaaccggcgtccgac

SEQ ID NO: 7167 - DNA, 1005 bp, Streptomyces avermitilis
  CDS (1)..(1005)
atgcgtatcggcatcatgggtcttggccggatcggcgcgttccacgccgagaccctctcgggtctgccggcggtcacgtccctcgtggtcaccgaccccttcacggacgcggcgaagagcgccgccgagcggttcggcgccgaggtggcggactcgccggaggccgtcctggccgcgggcgtggacggggtggtggtcgccgcggcgaccgacgcccacccgggtctcgtcctggccgcggtcgaggcgggcgtaccggtcttctgcgagaagcccgtcgcgcgcaccatgcgcgaaggcgtcgcggtgctcgaagcggtccgggatgccggggtcgagatccagatcggctacaaccgccgtttcgacgccgggttcgtggccgcgcgcgccgccgtcgcgagcggtgaactgggcgcactgcacaccgtacggtccaccacgctcgacccggccccgccgccgcccgcgtacgtcgccgcctccggaggcatcttccgcgactgctcggtgcacgacttcgacatcatccgctgggtgaccgggcgcgaggtcgtcgaggtgtacgccaccggcggcaaccgcggtgccgactacatcgccgccgcgggtgacgccgacaccacggccgcggtcctcaccctcgacgacggcacgctggccgtcgtctccaacagccgccacaacgcccggggtcacgacgtccgcatggagctgcacggcttccgggacagcatcgccgtgggcctggaggaccggctgccgctgcgctccgtcgagcccggcacctcgttcccggccggcaccccgcacgacttcttcatggaccgcttcgccgccgcctaccgcgccgaactcaccgcgttcaccgaggtcgtcgccggtcggcgcccctccccctgcacggtcgccgacgccctggaggcgggctggatcgccgaggcgtgcacgctgtcgctgcactcgcatcggccggtgacggtcgaggaggtgcggcggcagtcg

SEQ ID NO: 7168 - DNA, 819 bp, Streptomyces avermitilis
  CDS (1)..(819)
atgggacatctccacgacagcggcaagagacttctggacgacacgggcggcctcctcgacggcaagatcgttctggtcaacgggggcagccagggcatcggcgccgcggtcgcccgggccgccgcccgcgagggcgccgcggtgaccgtcaccgggcggcgcccggaacccggcgaggcgctggtgggcgagctgcgcgcggccgggtgcgaggcggcgtacgtgcgggtcgacctcgccgacgccgggcaggcgcgcgggagcgtggcccgggtgatcgaggcgcacggccggatcgactgtctggtcaacgcggcggggctcacctcgcgcggaaccctgctggagacgacgcccgagctgttcgacgcccatctggcgatcaatctcaagggcccgttcttcgccatgcaggccgccgtcgcggacatgctggagcgcgaggcgccgggcaccatcgtcaacatcggctcgaactgcgcccacggcggcccacccaacctgaccgcctattccaccgccaaggccgggctcgcggggctgacccgcaacgcggcgcacgcccaccgctgggaccgtatccgcgtcaacgcgctgaacatcggctggacggccaccgagggcgaggacgcgacccagcgggccttccacggcgcgggcgacgactggcgcgagagggcgggccgggggctgccgatgggcaggctcggcgatccggacgagatcgccgacttcgtcgtcctgctcctctccgaccgcagcggtgtcgtcaccggatcggtcatcgactgggaccagaacgtgctcggcgccctggac

SEQ ID NO: 7169 - DNA, 1173 bp, Streptomyces avermitilis
  CDS (1)..(1173)
atgtcccccaccaccgacgtacgcccgtcctggctcgccgaggaggactgcgacctcgacgccttccgtgtcctggtcgagcgcacgaccgacgcggacgactatccgtacgccgacgccgtggagcgcaacgtcctcttctacgacagcgaccggctgcggtccgccgtcgccgcccacgaactccgtcacgtccaggccgagttggtccgtgccttcagtgaggggcccggcgtcgtcgtgttccggcgcgccttccccgacccgtcggtcgtggcgcgcgccaccgccgccttcgacgcgctcatcactgcccagcgggcatccggcacggtcgccggcgaccacttcgccgcaccgggtgcgaacgaccgggtctggaacgcgctgcagaagctggccgtccacgcgccggaggcgttcgccgactactacgccaacgacgtcatcgcccttgtctcgcaggcgtggctcgggcccggctaccagatcacctcgcagatcaacgtggtcaaccccggcggcgccgcccagtccgtccaccgcgactaccacctgggcctcctgtccaacgcggtggcggccacgtacccggcgcacgtccaccgcctctcccccgcgctgaccctccagggcgcggtcgcgcactgcgccatgcctgtcgagtccgggccgacgatgtacctgccgtactcgcagacgtacgagcccggctatctggcctggcgactgcccgatttccaggcgtacttcgagtcccgtcacgtccagcttccgctggccgagggcgatgcggtgttcttcaacccggcgctgttccacgcggccgggacgaaccggtcgtcggacatcaggcgcatggccaatcttctccaggtctcgtccgccttcgggcgggccatggagaccgtcgaccgcgcgaccgtggtgaacgcggtctaccccgcgctgctcacccgcaaggccgggggcgcgagcgtggagtggctggacaccgtcgtggcggcctgcgccgagggctaccccttccccaccaacctcgaccgcgacccgcccgtcggcgggctggctccgccgtcgcaagccgacctcgtacggcgtgcgctgcgcgaggagtggacggcggacgcgctgcgcgaggcactgaacgccggcgccgagcgccgcaccagc

SEQ ID NO: 7170 - DNA, 1047 bp, Streptomyces avermitilis
  CDS (1)..(1047)
atgggccacccctatccgctgcgggagatcgcccgccaggcgggcctgagcgaggccaccgtcgaccgggtcctcaacggccggggcggggtgcgcgagagcaccgcgcgcgaggtgcaccgggcgatcgccgacctggaccggcagcggacccaggtcaggctggtcggccgcaccttcatgatcgacatagtgatgcagacgcccgaacggttctccaccgccgtgcgcgccgcgctggaggccgagctgcccgccctgcgcccggccgtcatgcggtcgcgcttccacttccgtgagacgggcccggtggccgagctggtcgcgaccctggatcggatcgcccgacgcggctcccagggcgtgatcctcaaggcgccggacgtccccgacgtcaccgcggcggtcggccggctcgtgtccgcgggcatccccgtggtgaccctggtgaccgatctgccggccagcggacggctcgcgtacgtcggcatcgacgaccgggccgcgggcgccacggccgcgtatctgatgggccagtggctcggtgaccgttccggcaatgtgctcaccagcatcagcagcggcttcttccgtaacgaggaggagcgcgagatgggcttccgcgccgccatgcgggccctgcacccgcgccgcacgctggtcgaggtcgccgaggggcagggcctggacgccacgcagtacgacctggtcgtcgccgccctcgaacgcgatccggagatccgcgcggtctactcgatgggcggcggcaatgtcgccacgctgcgggcgttcgaggcgacgggccgccgctgccaggtgttcatcgcgcacgacctcgaccacgacaacacccggctgctgagggaacaccgactgtccgccgtgctccaccacgacctgcgccaggacatgcgcgaggcctgccgcaccgtgatgcgggcccatggcgccctgccgcccgcggggcccgtgctgccgtcgccgatccaggtggtgaccccgtacaacatgccgactgtggccgaggcgactcccgccgccgcggac

SEQ ID NO: 7171 - DNA, 363 bp, Streptomyces avermitilis
  CDS (1)..(363)
gtgaacacgcaatcgccgccggcttcggaagtccaggtggtactcaccgactgctccgccacggacgccggacatctcttcgacgccctgcgcaggcgcttcgaatgtgaccgcgaggacagcgacagccctgctgagaccccgaccgcctggacggccacgttcgacacggccgccgtgtgcccgcccgcgtcgggggcgtcggtgcccctctcgggtccggtgacggccgaggtccagggcagcccgcacgccgtacgagagctggaggacgccctggcggacgtcttcaccgtgcacgaggtgggctcggtctccggcgatcaggaggtcgaggtggagctgcggctggaaccgcgcggg

SEQ ID NO: 7172 - DNA, 1008 bp, Streptomyces avermitilis
  CDS (1)..(1008)
atgcggatgagtgtggtggacgtgggttcgaacacggtgcggctggtggtggcggacgcggagggcggcgtaccgctgccggtgcacacggccaagtggaggttacggctgtccgaagtggtggggcccgacgggaggattcccgaggaagccgtgcacagactcgtcggggcggtcgccgcggccgatgagacggcgcggaagtggggcgccgccggaccgctggccttcgcgacggcggtggtgcgcggtgcgccgaaccggctggaggtgctgcgcgccgtccgggcggagaccggggtgcggctgtgcacgctgcccggggaggaggaggccgagctcaccttcctgggggcccggcggtggatgggctggcgcgcggggccgctcgcgctgttcgacatcgggggcggctcactggaagtggccttcggtcgcgggcggctgccggacttcgtggcctcgctgccgctcggcgcgggccggctgacccgggagttcttcgagggcgaggatctgccgtccgccgcgatggtcaaggcgctgcgccgcaaggtccggcatcagctgcgggatgtggccgcgcggatccggtgggaggggccgcgtaccgtcgtggcgacctcgcggacgtttcagcagctgggccggctgtgcggggcggcgcccggccgtcaggggccgttcgtggaccggcatctggagcgccgcgagctgcgcggctgtctcgaccggctgaccgcgctgccggcggccgagcgctacctgctgccgggcatctccgcgccgcgggcccggcagagcctggccggggcgatcgtggggcacacggtgatgaagacgaccggggtcagcagggtgaccctctgtccgtgggccatccgggaaggcgtactgctgcggtacatcgaggacggcgccgcctggtgggcggacatcaccgaccgcgccgccgaactcccaccgacggcagcccccgtgccactgcgggtggcggctccgcctagc

SEQ ID NO: 7173 - DNA, 663 bp, Streptomyces avermitilis
  CDS (1)..(663)
atgggaatgccagccgggccctacctgctgacaccgccgggcgtctacgcaccgcaacacgacaccgaccttttggcccgcgccttgcgccgggaggacatagacacctcgacggaggtactcgacctcggtaccggaagcggcgcgctcgccgtgcacgccgcgcgcctcggcgcccgggtgacggccgtcgacatctcccggcgcgccgtgctcaccgctcgcctgaacgcgctgctcgccggccggcgcgtcaccgtccgccggggtgacctgaccgcggccgtgccgggacgctcgtacgacctcgtggtgagcaacccgccgtacgtgccgtcaccttcggcccggctgccgagccggggagcggcccgcgcctgggacgccggacacgacggccgggcgttcgtcgaccgtatctgcgacacggcgccggccgcgctgcgggccgggggagcgctgctgatcgtgcactccgcgctctgcggcacgcggcccaccctggaccggctggccgccgccgggctcgacgcctcggtcaccgaccgcgccttcgtccccttcggccctgtgctgcgtgcccgccgggcgtggctgcgccgccagggcctgctgaccgacgagaacctggaagaactggtggtcatccgtgccgaacactcc

SEQ ID NO: 7174 - DNA, 207 bp, Streptomyces avermitilis
  CDS (1)..(207)
gtgccgaacactcctgagcgaccgcgccgcgtcaccgtcgaccgggacggacccctgctcgtcgagggcccggtcgaggtggtctgcgaggacggcacggtcgtcacctcgcgacggttcaaggtcgcgatctgcacctgccgccgcagccgtgcgtacccctggtgcgacaccagccaccgccgccgggtgaagggggacacgccg

SEQ ID NO: 7175 - DNA, 1020 bp, Streptomyces avermitilis
  CDS (1)..(1020)
gtgaggagtcctgaactccccaccccacgaggtgagttgtccaagtccgtcttctcgacgctggcctacagcactcccctccccacctggtcgcacgaggtgcaggaggccgacccgtacggggacgatctccaactcgccctctacgtcctgtacgagctccactaccggggcttcgccgaagtgtccgacgaacgggagtgggaccccgggctgctcggcctgcgccgcgccatggagctgcgcttcaccgaggccctgcgctccgacgtaccgctcgagcccgacgtcgacgtcgagaaggtgctggccgcgctcctggtggaacccgtgggacaggacgacaccagcgtcagccaccatctccagcgcgacggcgaactgtggcagttcaaggagtacgccgccctgcgctccctctaccacctcaaggaggccgacccgcacgcctgggtcatcccgcggctgcacggccgggccaaggccgccatggtggcgatcgagtacgacgagttcggcgcgggccgcgaggaccagatccacgcccggctcttcgccgacctgatggcggacctgggcctgcggacggactacggacactacgtcgacgcggcccccgccgaggtgctcgccaccgtcaacctcatgtccctgttcggcctgcaccgcgccctgcgcggcgcactggtcggccacttcgccgccgtcgaggtgacctcgtcacccggctcccgacgcctggccaccgccctgcgccgggtgggagcgggaccggccgcccagcggttctacgacgagcacgtcgaggcggacgccgtccacgaacaggtcgtacgccgtgacgtgatcggcggtctgctggagagcgagcccgaactcgaacccgacgtcgccttcggcatcctggccaccggtttcctcgaagaccggctcggcgcccgcctgctggacgcctggcggagtcgacgcagtgccctgcgcgtgccgttgaccggcgacgaggaaggtgccccccatgcc

SEQ ID NO: 7176 - DNA, 879 bp, Streptomyces avermitilis
  CDS (1)..(879)
gtgccccccatgcctgacaaccccaccgaccagcatccccgccccgacttcccgcagcaggatcaggaacacccgggctggaccggccccatggacccgccgcccgaccacggcgaggactcgtacgagggaagcggactgctccaggaccgtgccacgctcctgaccggcggagactcgggaatcggccgggcggtggcgctcgccttcgcgcgcgagggcgccgacgtcatgttcacccacctcccggaggaggagaaggaggccgccgagaccgtccgcctggtcgaggacgcgggccgcaaggccgtcgccgtggcctgcgacatccgtacggaggaggcatgccgccgactggtggagcgcgctgtcgcggagttcgggcggatcgacgtcctggtcaacaacgccgcgtaccagatgtcccagccggacggcatcggcgccatctccaccgagcagttcgaccgggtcgtacgcaccaacctgtacggcatgttctggctctgcaagctggcgctcccgcacattccggcgggcggttccgtcatcaacacgacgtccgtgcaggcgtacaagccgagtccgcatctgctcgactacgccatgaccaagggcgccatcgtgaccttcacccaggggctcgcgcagatggtggccggtgacggcatccgcgtcaacgccgtggcgcccggccccgtgtggactccgctgatcccggcgacgatgccggacaccacggagttcggcaagcaggctccgctcggccgccccgcgcagcccgccgagatggcccccgcgtatgtcttcctggcctcgccgcgggcgagcttcatcaccgcggagatcctgaacgccaccggcggcacaccgctgccc

SEQ ID NO: 7177 - DNA, 897 bp, Streptomyces avermitilis
  CDS (1)..(897)
gtgtgcttgtcacctttggtgaccacccccgtatccccccccgtatcccccacctggagggaccgttccatgaccgtgctgcgccgcgtgtccgtcaacggcgtcgaactcaatgtggccctggccggaaagggccccgccgtcctgcttctgcacggcttcccgcacacctgggaactgtggaccgacgtcatggccgggctgtccgagcggtaccaagtgatcgcaccggatctgcgcgggttcggcgcgagcacacgggccaagaccggttacgacgccggctcgctggccgacgacgccgcggccctgctggagacgctgggcgcgggcccggccgccgtggtgggcatcgacgcgggcacgccgcccgccctgctgctcgcgctgcgccgacccggcctcgtgaggcggctcgtggtcatggagtccctgctgggccgactccccggcgccgagtcctttctggcgggcggtgccccctggtggttcggcttccatgccgtacccggcctcgcggagaccgtgctcgagggcaacgaggcgcgctacctcgactggttcctcgacacgggcaccctcggcgacggggtgcggcccgccgtacgggacgcgttcgtccgcgcctataccggacgtgaggccctgcgctgcgcgttctcgtactaccgcgccctgcccgtcagcgccacgcagatcgagcgggccttcgacaccgcgcggctgaccgtccccacgatggccgtcggctcgcatcccgtcggcgcggcgctggagcgccagttgcgcccgttcgccgacgacctcaccggccatctcgtcgaggactgcggccacatcatcccgttgcaccgcccggacgccctgctcgccctgctccacccgttcctgaaggac

SEQ ID NO: 7178 - DNA, 384 bp, Streptomyces avermitilis
  CDS (1)..(384)
gtgaccaaggcgaaccgcggtgacctcttcgatccgcagtgtccgacccgtcggctgctcgaccgtatcggcacgaagtggacctcgatggcggtcaaggtgctggccgaggcggccccggacgaggtgcgcttcgcggaactgcggcgccgcatgccgggaatctcccagaagatgctctcggtcaccctccagagtcttgcccgcgacggtctggtggcccgccgtgtcgagccgacggtgccgccgcgcgtgcactaccggctcaccgagctgggcctgtcgctggagggccccctggccgctctgcggcactgggccgagcggcacatgtcggagatcgatcgcaacaaccgcctcgaggatgcccggagttcggccggc

SEQ ID NO: 7179 - DNA, 843 bp, Streptomyces avermitilis
  CDS (1)..(843)
atggctgaacgacttaaaaggctggggttgatcggcgagctgtcggctgagttcgccggcaccatgattctcatcctcttcggcgccggcgtggtggcacaggtggtcgccggtggagcgctcacgaccccgccgggcggcctcggaaaccacgacagcatcgcgtgggcctggggcatcggcgtcaccatgggcgtgtatgtcgcggcgcggctgagcggtgcgcatctcaaccccgcggtgacggtcactctcgccgcgttcaagggtttcccgtggagcaaggtcgcgccctacgcggtggcccagacgctcggcgccttcgtggcggccctcctcgtgcgctggaactacaccgaggcgctggcgaaggccgaccccggccacaccctcaagacgcagggcgtgttctccacgctccccgccaacggcaacccgaacctgccggtccacgagtggggcgcgttccgcgaccaggtcatcggtaccgcgatcctcctgctgctgatcctcgccatcacggacctgctcaacacgccccccggcgccaacctggccccgttcatcatcggcctggtggtcgtggcgatcggcatggcctggggcaccaacgcgggctacgcgatcaacccggcacgcgacttcggtccccggctggccagcttcatcacgggctacggcagcgcatggcgagatcagtacgggaacttctacttctgggtgccgatcatcggtccgctgatcggcggtctgctcggcggggtcgtgtacaagttcttcgtgggccggttcctgccgacggcggagccggagccccccggacgcgtcccgacccccgaggcc

SEQ ID NO: 7180 - DNA, 1515 bp, Streptomyces avermitilis
  CDS (1)..(1515)
atggcggacttcgtcggcgcggtggaccaggggaccaccagcacccgattcatgatcttcgaccacgccggcaacgaggtggcgaagcaccagctggagcacgcccagatccttccgcgctccgggtgggtcgagcacgacccggtggagatctgggaacgcaccaactcggtgatacagaacgccctgcggcacgggaacctgtccccggacgacctggcggcgatcggcatcaccaaccaacgggagaccaccgtcgtctgggacccgcgcaacggccgtccctactacaacgccatcgtctggcaggacacccgcaccgactccatcgccgcggccctggaacgctcgggccagggcgacgtcatccgccgcaaggcggggctgccgccggcgacctacttctccggcggcaagatccagtggatcctggagaacgtcgacggcgtccgcgaggcagccgagcaggggcacgccgtcttcggcaacacggactgctgggtcctgtggaacctgaccggcggccccgacggcggcatccacgccaccgacgtgaccaacgccagccgcaccatgctgatggacctggaaaccctcgactgggacgacgaactgctgggactcttcgacatcccgcgatcgatgctgcccaccatcaacccgtcctcccacccggaggcctacggccagacccgtacctcccggccgctgcgcgccgccatccccatcgccggggtactcggcgaccagcaggcggccaccgtcggacaggtctgctacgcgcccggcgaagccaagaacacctacggcacgggcaacttcctggtgctgaacaccggcaccgaactggtccgctcccagcacggactcctcaccaccgtggcctaccagttcggcgacagcccggccatctacgccctggagggctccatcgccgtcaccgggtccgcggtgcaatggctgcgcgaccagatgaagatcatcaagtccgcggccgagagcgagacgctggcgcgtaccgtcgaggacaacggcggcatctacttcgtccccgcgttctcgggcctgttcgccccgtactggcgctccgacgcccgcggcgcgatcgtcggcctcgcccggtaccacgacaacggtcacctggcccgcgcgacgctggaagccatctgctatcagagccgtgacgtcgtcgaggccatggagcaggactccggagtccacctcgatgtgctcaaggtcgacggcggcgtgaccgccaacgacctgtgcatgcagatccaggccgacatcctcggcgtaccggtcagccgcccggtcgtcgccgagaccaccgcgctcggcgccgcctacgcggcgggtctggccaccggcttctggcaggacaccgacgaactgcgcacccactggcaggagtccaagcgctgggagccccagtggtccgaggaccggcgggcggagggctacgcgggctggaagaaggcggtggagcgcacgctcgactggtccaaggtggaa

SEQ ID NO: 7181 - DNA, 525 bp, Streptomyces avermitilis
  CDS (1)..(525)
atgaccgaaaccacgcccggctggctgacttccgacgatcttgagatggcccgcgcacgcatgccgatcctctacgtcgaggccgtgcccgtgcgcgtagacgacagcggtgaagtgaccagcatcggactgctgctgcgcatcggaccggaaggaacggtcagccgcgccctcgtctccggccgggtgctgcatcacgagcgggtccgggacgccctgctgcgccatctggagaaggacctcgggccggtggcactgccccgggtccccgcttccctgcagcccttcacggtcgcggagtacttcccgacgcagggggtgacgccgttccacgacccccgccagcacgcggtctccctcgcctacatcgtcccggtggccggcgactgccgccctcggcaggatgccctcgacctggtctggttcagtccccgggaggcgtcgtcggagctggtccagaacgagatgccgggcggccagggagtcctcctcaagcaggccctcgcccatgtgggctgcctgtcc

SEQ ID NO: 7182 - DNA, 1548 bp, Streptomyces avermitilis
  CDS (1)..(1548)
gtggagaaggcacaggccggtggccgtatatccggcgccgagggagccggcggcgagagcggatccgggggtggcggggccctcggccatcgggatgaggcaccgggtacgggcgaagcaggcccggccgagggtgcgtacgacttcgcggagctgcgcgcgcaggagttcggctacctcgattccggtgggcacacctatctcgaccacaccggcgccgggctcccgccacgctcgctcgtcacggcgagcgcggagcggatcacgggcggctgcttcgggaatccgcactccgagagcccggcgtcccgggcctcggggctgctgctcgccgaggcacgccgcgcggtgctccggcacttcaacgccgacccggccgagtacgccgtgatcttcacgcccaacgcgaccggcgccctgcgcctgatcggcgaggcgtatccgttcgggcggcacagccggctggtgatgtcgttggacaaccacaactcggtgaacgggctgcgggagtacgcgcgggcaaagggagcctcgacggcatacgtacccgtgagcgggcccggcctgcgcatcgacgaggagcggctgaccgccgcgctgacggcacgcggacgcgggctcggcctgttccgctcgcgggacggcggacgctcccgcgggctcctggcctacccggcgcagagcaacttcacaggtgtccagcacccgttggagtggatcacacgggccaaggagcacggctacgacgtactgctcgacgccgccgccttcgtcccggccaacaccctggacctgagccgcttccatccggacttcaccgccgtgagctggtacaaggtcttcgggcatcccaccggcgtcggcagcctgatcgcccgccgggaggcgctcgccacactgcgccgcccctggttctcgggcggcacgatctacgcggccagcgcccaggcgggctggcacgtcctcgcggacgacgaggccgccttcgaggacggcacggtcaacttcctcgccctgccggacgtgacggccggactggaatggctcgaccggatcggcgtgcgccgcgtgcacgaccatgtcagctcgctgacggatcaactcttacgcggtctcggggagttgagtcacagcaacggttcgccgctcgtccgggtgtacgggcccggggagggcgaggcggcgcgcggcgggacggtcgccctgaacctgctggcggccgacggcgggatcatcgacgagcgcgtcgtcacccgcgacagcgccctgcgcggaatctcgctgcgcacgggctgcttctgcaaccccggcgccggcgaggcggcgttcgccctgtcgccgcctcggctgcggtccgcgacacgcaggcaactcagctcgatggaggactacttggagttgctgcggctgccctcggcgggtgccgtccgtatctctgtggggctgtcttcgcagcccagggacatcgagacggtcctgcggttcgtgacggagacctaccgggaccaggtgccgggggtggcgggcctggccgcgcgatcgggctgc

SEQ ID NO: 7183 - DNA, 1518 bp, Streptomyces avermitilis
  CDS (1)..(1518)
gtgcgtacggatcgaaccctcaggagtcagccagtgaatcaggacagcagtggacgctcgatcagccggcgcgaagcactccgtggggcgggtgccgtcgcggtcgcaggggccggtgccgccgtgctcggcggtgcctccaccgcggtcgccgccgacgcgttcgcacatccggggttgctgcacacccgggccgacctggaccggatggcggccaaggtgaaggcgggcaccgggcagtggaaggcgggcttcgccaagctgacggccaactcccacgcgcggagcggctggcaggcgaacccgcagcggacggtgtaccgcggatcgggcacccccgagaactacggcacgctctacaacgacatccacgccgcctaccagaacgccctgcgctggcacatcaccggcgagaccgcgcacgccgacaccgcggtggcgatcctcaacgcctggtcgggcaggctcaccgcactcgacggcagcgccgaccggttcctcgcggccgggctgtacggctaccagttcgccaacgccgccgaactcgtccgtgaccacgacggcttcgaactggcccgcttccagaagatgatgctgaatgtcttcgccccggtcagcgaggacttcctcacgaaccacaacggcgcctacctcaccaactattgggccaactgggacctgaccgccctcgcctgcgtcctggccgtgggcatcctgtgcgacgaccgcgccaaggtgcggcgcgccgtcacctacttcaagtcgggccagggcatgggctcggtcaggaacgccatcccggtcgtgcacgccgacggtctcgcggagtgggtcgaggccggacgcgaccagggccacgccctgctcggcgtcggactgatgggcaccgtctgcgagatggcctggaaccagggcatcgacctgtacggccacgacgacaaccggttcctcaagggcgcccagtacgtggccaagtggagcatgggcggggacgtgccctacacggccaacacccggaagaagggcgctccgggggtctggtcgggcacggagtccgccaccagggcggcggacgtcgatccgaccatgacgcggccgatctgggccatgatctccaaccactacaccaagcgccggggcctgtccgcgccgtacctcacccggatcgccgccaaggccgctcccgagggcggcggcggtgactacggtcccaacagcggaggatacgaccagctcggcttcggcacgctggccttcacccgggaggcgggggacacggctgagtccaccaaggccccgacgcccacgcgcacggacgccgctccgtcagccgcctcgtccgccggcccggccacgtccccgtccgcctcggcgtccgagggcagccggtcgcagggcggcagcggcgacctggccgtcaccggcaccggtggcgtcgccgcggtcgcgggcaccggcgtcctggccatcgcgggcggcctgatcgcactgcgtcgccggcaggcgggcacccggccg

SEQ ID NO: 7184 - DNA, 795 bp, Streptomyces avermitilis
  CDS (1)..(795)
atgaccgccctgccccgggtcctgacgatcgccggctccgactccggcggaggcgccggaatccaggccgacctgaagacgatgctggcgctcggcgcccacggcatgagcgtgctgaccgcggtcaccgcgcagaactccgtcggggtgcagggcgcctgggaactgcccgtggaggcggtgcgcgcccagtaccgcagtgtcgtcgacgacatcggcgtgcaggcggtcaagaccggcatgctcggctcgtccgccctggtcacggccgttgccgagctgctgtcggacgtggcggctccggtcgtcgtggacccggtgagcgtgtccaagcacggcgaccggctgctggccgacgacgcgctggatgccgtacggacccggctgctgccgctcgcgacggtggccacgccgaatctggacgaggtcgcgcagctcaccggcatcgcggtgaacgacgagtccggcatgcgccgcgccgccgcacacctgctcgcgtacggcccgcgctgggtgctcgtgaagggcggccatctgcccggcgaggccgtggacctgctgaccgacggcagcgcggagcactggctgcgcgccccccggcacgacaaccgtcacacccacggcacgggctgcaccctcgcctcggcggtggcggtggggctggcgcggggccttccggttccggacgcggtgcgggaggccaaggactacgtcacggcggcgatcgcggcggggttcgcactgggggccggcatcgggccggtggatcacgggtggcggctgcgctcccaggcg

SEQ ID NO: 7185 - DNA, 1413 bp, Streptomyces avermitilis
  CDS (1)..(1413)
atgcctttggcgcatgttcccggcgggctgcccgccgacggccggcggaccgtcttcgacgggcggatgcccgcggcgcccggcgatctccgggtcgaggggcacggcatcgaaccggtccccgagaacaatcgctacggcggagccggacgcctgttcaccgtgtggttcgcccccaatctgacgatgacgggcgtgttcaccggaaccatcggcatcgcgctcggcctggacttcgcgaccgcgctcgccgccgtcgtgctgggtacggtcgtgggcgcggtgcccaccgcctacctgagcacctggggcagccggaccggcgccggacagctgccgctggcccggctcgccttcggccgcgcggtggcggtgcccggcatgctccagtggctgtcctcggtggcctgggacgcgctgatcggactgttcggcggggacgcgctggcacagctgtgcggctggccgttctggctcggcgtcctggtcatgatggccggccagggggcgctcggcgtcctcggctacgaggccatccaccggctccagatcgtcatgacgttcgtgctcgccgccgcgttcgcgctgatcgcctggcgcatgctcgacggtgtccacgccgcgtcgaccggcggcgcgcacggcgccgaccgggccggcgcgttcgtgctgaccagcaccatcgccctgagtctggccctgtcctgggccccgtacgccagcgacttcagccgctatctgccgcgctccacgtcccgcccgcggatgttctggtgcaccctgctgggtctcgcggtctccttcgtggcggtccaggccctcggactgtggggcgcgtccgtgctgaccgaccagaccgccgcgggcgtggaccaggtgctgggcggcggggccctcggggcgttcgggctgctggccgtggcgctggcggcgctgtgcagcaacgcgatgaacgactacagcgggtccctggccctgcagaccgcgggcgtgcgcgtgccgcgcccggtggccgccgccctggccgccgcgctcggcttcccgctggtgctgtggatgcacgcggcaaacaccaccgcgcgcttccagaacgtgctgctgttcgtcggctactggattcccgggttcgtggcgatcgtcgtcgtcgactggatcgcccgggcccgcacccgcgagggtgccgagatcgacctggccgcggaggccggccggccgcagccgtggtggccgccgctggtggcgttcgtggccgccttcgccgcggccgtgccgttcatggacacgagcctgtacgtgggcccggtggcggacgcgctgcacggcgccgacctgtcgtactacgtggcgttcgtcgtggccctggccctctacgcccccgtgcggctgcgccaccgccgagaggagagcctcgta

SEQ ID NO: 7186 - DNA, 1335 bp, Streptomyces avermitilis
  CDS (1)..(1335)
atgcgcagacttctcgcctgtctggcgaccgcggccgtggccgtcggcgggctcacggtgagcgcctcccccgccgcggcggccgactcgggcacgttcagcgtgctcacctacaacgtcgccggtctgccggagtccctctccagcgcctcgacgccgcgcgacacgagcaccacggagatcggccggcgcatcgcgccgtacgacatcgtcaacgtccaggaggacttcaactaccacgcgtacctgtactccacggacacccacccctaccgcacggcgaccagcgggggcgcgggcatcggcagcggcctcaacaccgtctcgacctatgcctgggacggtgacgacttcgagcgcgccggctggaactcctgccagatcgattcgggcgactgcctcacccccaagggcttcaccttcatgcgcgagcgcctggccgagggcgtctacgtcgacttctacaacctgcacaccaacgccggcaccaacgacggcgacgaggcctcccgcgccgacaacctcgaccagctgacctccttcatcggcacgcactccaacggcaacgccgtcgtggtgatgggcgacaccaacacccgctacacccggtcggccgacaccatcgccgagttcgccgccgccaacgggctgaccgacgcctgggtgaagctgatacgcggcggcgcggcgcccgccaagggcagcgacgcgctggtctgcgaccagaccggggccaccgtgcccaacacctgcgaggtcgtcgacaagatcctttaccgcggcagcaagctcgtcacgctcgacgccacgtcgtacgacaacgagcacgccgcgttcctcaactccgacggcctgatgctctccgaccacgacccgatcaccgcggcgttctcctggtcgcgcgcctccgcgttccagctgagcgaccagttcggcgggccgcacggcgactacttcaacgacatcgacagcgtgccggccggcgcccgcgccacgacggtctcgctgcgcagcggctcccgcgtggaccggatgggtctcacgctcggcaacggcacgacgctggcccacggcggcaccggcggcaccgcctcgtcgctgaccctcggcagcggcgagtacgtcacctccgcccatctgtgccagggcgtgaaggacggccacacccggatcttctacgcgaagttcaccaccaacctcgggaacagcctggcgggcggcaccaccacgtccgactgcgtgacccgcaccgctccgtccggtcggcagatcgccggattccacggccgcgccggcgacgaggtcgacaagatcggcttcatctacacccagcgc

SEQ ID NO: 7187 - DNA, 954 bp, Streptomyces avermitilis
  CDS (1)..(954)
gtgtcccttctctccgcgccacccgacggcaccgccccgcggcccctggcggcccagcgtgtgctgccgctgcgccggcccggccgctggatcctcacggcgatcgtgctcgtgctggtcgcccagatcggccacgggctggtgaccaaccccttctaccagtgggaccgcttcgcctactggttcctgcgccccacgatcctcgacggactgctcatcactctcgaagtggcggcgtacagcgccgtgttggggctgctcggtggcatcctgctggcactggcccggctctcccgcagccccgtgctgcgcgcggtcagctgggtctacgtgtggctgctgcgctcggtgccgctgatcgtggtgctgatcttcctctacaacttcagcgccctctacaagacgctcagcctcggagtgcccttcggcccggccttcctcaccttcgacgagtcccggctcgccaccgacatggccgtcgcggtcgtcggactgagcctcaacgaggcggcctacgcggccgaggtcgtccgcggcggcattctctccgtcgaccagggacagcacgaggcggccgccgcgctcggcctgccgaagagctaccagttcacgaagatcgtcttcccgcaggccctcaggtccatcaccccgaactacgtcaaccagctgatcggcctgatcaagggcacctcactggtgttctacgtgtcgctgctcgacctgttcggctccgcacagaccatgggcagcacctatcccggcgacatcgtgccgctgctcctggtcgtcaccgtctggtacctgatcctcacgagcatcgtgtccgtcgtccagttctacgtcgagcggcactacgcccggggcgccacgcgctccctgccgccgaccccgttgcagaagctgcggaccgcgctcggtgacctgcgggcccgcatacgcagggaggccgcccta

SEQ ID NO: 7188 - DNA, 783 bp, Streptomyces avermitilis
  CDS (1)..(783)
atgaccaccgagaccctcaaagtcgactccgccgcggtcgaggtccacgacgtgcacaagtggtacggcgcccaccgggtgctgaacggcgtggagctgaccgtgcgaccgggtgaggtgaccgtgatcctcggcccctccgggtccggcaagtccaccctgctgcgggtgatcaaccacctggagaagcccgaggtcggctacgtcagcgtgaacggcgagctgatcggcgtccgccggcacggcgacaggctcaaggagctgagcgagcgcgtcatcctggcccagcgcagccgtatcggcttcgtcttccagaacttcaacctcttcccgcatctgaccgtcctcgacaacgtggccgcggcccccgtcgcgaccggccggctgaagaagcccgaggcccaggaactggcgcgcgacctgctcggccgggtgggcctcgccgaccggaccggcgcctacccacggcagttgtccggcggccagcagcagcgcgtggccatcgcccgcgccctcgccctgcggcccggcgtcatcctcttcgacgaaccgacctccgcgctcgaccccgaactcgtcggcgaagtactcgccgtcatcaaggacctcgccaccagcggcaccaccctcgtcgtcgtcacccacgagatcggtttcgcccgcgaggtcgccgaccgggtggtcttcatggacggcggccggatcgtcgaacagggcccgcccgccgaggttctggaccatccgaaacacgagcggaccagggatttcctgagcaaggtgctc

SEQ ID NO: 7189 - DNA, 1023 bp, Streptomyces avermitilis
  CDS (1)..(1023)
atgcgcaccctcagcctccgcagcagactcctccgcggcctcaccgcgggtaccgccgtcgcctctctcgccgccgggctcgccgcatgcgggggcgacagcgacgcggccaccacgaccgacagcgcggcgtccgggaccgtcaccgtgggccgactctccaacggcgccgccaaggagaccgagctcaaggtgtccgaggtgaagtccatcagcgccgagctgcccgagtccgtcgccaagagcggcaagctggtcatcggtgtgggcgggctgccctccggctccgcgccgctgaactacgtgggcgaggaccagaagaccctcaccggtgtcgaacccgacctgggccggctggtggccgccgtcctcggactgaagccggagctgaagaactcgacctgggagaacctgttcgtcggcatcgacagcggaaagtccgacgtgggcttctctaacatcaccgtcaccgaggagcgcaagaagaagtacgagttcgcctcctaccggcaggacaacctggcgttcgaggcggccaagaagaacaactggaacttcgacggcgactacaagaacctggccggccagaccgtcgccgtgggcgcgggcaccaaccaggagaggatccttctggagtggaaggcgaagctggcgaaggagggcaagaagctcaccgtcaagtacttccaggacaacaacagcacctatctggcgctgtccagcgggaagatcgacgcctacttcggccccagccccgcattcgcctaccacgtcacccgggtcgcgaagacccccgctccgacgcgtatcgcgggcaagtactccggagccggcgcgacgctccagggcctgatcgcggccaccgcgaagaaggacagcggactggccaagccggtcgccgacgcgatcaactacctgatcaagaacggtcagtacgcgaagtggctggccgcctggaacctctccaacgaagccgtcgccaagtccgagatcgacccggcgggcctgccgctcgacaactcc

SEQ ID NO: 7190 - DNA, 756 bp, Streptomyces avermitilis
  CDS (1)..(756)
atgtcgaccagtgtccttcccgtcgcgtcgcggagcccggaggcaccccatgtgctggacaacgccgcctgggccgcgctgaccgggccgcacgcccgcttcgccgaacgcgtgggccgcgccgcccgctatccgctggacgtgtcccccttcaccgcgctcgccgacccgtccgatccacgcgcctgggacgacctggccgcactcgtcggccccggcaccgtcacccccgtctcgggggcgacggtgccgcccgccggctgggagaccgtgcgcagcggccacggcgtccaactggtcgccaccgccctgcactcggaacccgcccccgaagcggtacggctggggcccggcgacgtacccgagatcctggagctggtcgccgagaccgagccgggacccttcctgccgcgcaccgtcgaactcggcacctacctgggcatccggcatcgcggacggctcatcgccatggccggtgaacggctgcgcccgcccggctggacggagatcagcgcggtctgcacccacccggaccaccggggccggggtctggccacccggctggtccgcgcggtcgcggcgggcatcagggagcgcggagacacccccttcctgcacgccgccgcgagcaacaccaccgccatccggctctacgagtcgatcggcttcaccctgcgccgcgcaacggagtccgtacgggtccgcactccggaccggcggcaggaacagaccgcgggtccgtgccgttgtgatgca

SEQ ID NO: 7191 - DNA, 1260 bp, Streptomyces avermitilis
  CDS (1)..(1260)
gtggcctcgacacccccttcttccctgccctcttcctccccttctgcctcctccaccccttcgtcgtccgcgctgcatctcgccgtcgccctcgacggcgcgggctggcacccggccgcctggcgcgagcccgtggcccggccccgcgaactgctcaccgccggatactgggccggcctcgtcaccgaggccgagcgcggactgctcgacttcgtgaccatcgaggacgggctcgggctccagtcctcacacttcaccgagcccgacgggcgtacggaccaggtgcgcggacggctggacgccgtactcatcgccgcccgggtggccccgctcacccggcacataggtctcgtgccgaccgtggtggcgacccacacagagccgttccatatatccaaggcgatcgccaccctcgactatgtgagcaccggccgagccggcctgcgcgtccaggtgtcggcacggcagaacgaggccgcgcacttcggccgccgtacgtttccgcggttcgacatcgaggacctggacacccccgccgtacgcgaggtgacgaccgacctcttcgacgaggccgccgactacgtggaggcggtgcgccggctgtgggacagctgggaggacgacgcggagatccgggacgtcgccaccggccgcttcatcgaccgcgacaagctccactacatcgacttcgagggccggcacttcagcgtcaagggcccctcgatcaccccccggccgccccagggccagccggtcgtgagcgccctggcccaccagagcaccccgttccagctggtgggacgttccgcggacatcggatacgtcaccccgcacgacctcgaccaggcgcgggccatagtcgacgagatccgtgccgcgcagaccgcggcgggccgcgccggagacaccctgcacatcttcgccgacctgctggtgttcctcgacgacgaccccggcacggccgcggcccgccgggagcgcctcgacagcctcgccggacacccgtacaccggcgacgcccgcgtcttcaccggcaccccggcccaactggccgacctgctcctggagttgcggcaggccgggctgtccggcttccggctgcgccccgccgtcgtgggccacgacctcccgcagatcactcgcggtctggtccccgaactccagcgccgggacgccttccggcgtgcgtacgaggccgacaccctgcgcgggctgctcgggctcacccgccccgccaaccgctacgccgccgccaccgtc

SEQ ID NO: 7192 - DNA, 1374 bp, Streptomyces avermitilis
  CDS (1)..(1374)
atgagcaagccgctgaagcagatccatctggccgcccacttccccggcgtcaacaacaccaccgtgtggagcgatcccgaggccggcagccacatcgagttcagctccttcgcgcacttcgcgcggaccgccgaacgcgccaagttcgacttcctgttcctcgccgagggactcaggctgcgcgaacagggcggaaagatctacgacttggacgtcgtcggccggcccgacaccttcgcgatccttaccgcgctggccgccgtcaccgaccggctcggtctgaccggcaccatcaactccaccttcaacgagccctacgaggtggcccgccagttcgccagcctcgaccacctctccgacggacgcgccgcctggaacgtcgtcacctcctgggacgccttcaccggcgagaacttccgccgcggcggctttctcccgcagggcgagcggtactcccgggccaaggagttcctcgccaccgcgaacgaactcttcgactcctggcgcggcgacgagatcgtcgccgaccagcaggccggcaccttcctgcgggacgcccgggccggtgccttcgtgcacaagggacagcacttcgagatcgaggggcagttcaacgtcccgcgcagcccgcagggccgcccggtgatcttccaggcgggcgactccgacgacgggcgcgagttcgccgccgccggcgcggacgccatcttcagccggtacagcaccctcaaggagggccaggcgttctacacggacgtcaagggccgcctggcccggtacggccgtacccacgaccagttgctgatcctgcccgccgcgaccttcgtcctcggcgacacggacgccgaggcccgggagctggcccgcgaggtacgccgccagcaggtcagcggcgccaccgcgatcaagcacctggagttcgtctggaaccgcgacctgtccgcgtacgacccggacggcccgctgcccgacatcgacccggacctcggcgaacacaccatcgcccgcggccgtgcccaggtccggatgtaccgcgacccgctggccaccgcccgcgaatggcgcgagcgcgccgcggccaacaactggtcgatccgcgacctggtcatcgagaccggcagccgccagtccttcgtcggctccccggccaccgtcgccgagaccatcgactccttcgtccaggccgacgcctccgacggcttcatcctggtcccgcacatcacccccggcggcctcgacgccttcgccgacaccgtggtcccgctgctccaggagcgcggggtgttccgcacggagtacgagggcaccaccctgcgcgaccacctcggcctggcccacccggacgccgatgcgccgggggagcgggtggcctcg

SEQ ID NO: 7193 - DNA, 2217 bp, Streptomyces avermitilis
  CDS (1)..(2217)
gtgactgactcgaccatcatctacacgcacactgacgaggccccggccctggcgacgtattcgttcttgccggtggtccaggcgtacgcgtcgcaggcgggtgtcgccgtggagacccgtgacatctcgctggccgggcgcatcatcgccctcttccccgagtacctggaggacggccggcgcatccccgacgcgctcgcggagctcggtgagctcgccaagacgcccgaggcgaacatcatcaagctgccgaacatctcggcgtcgattccgcagctgaaggccgcggtcgccgagctccaggagcagggctacgcgctgccggactacccggacgacccgaagaccgacgaggagcgcgacatccgcgcccgctacgacaaggtcaagggcagcgccgtgaacccggtgctgcgcgagggcaactccgaccgccgcgcccccgcctcggtgaagaactacgccaagacgcacccgcaccgcatgggcgcctggacctccgagtccaagacgaacgtcgccaccatgggcgtcgacgacttccgctccaccgagaagtccgcggtgatctccgaggccggctcgctccgtatcgagctgaagggcgacgacggctccaccaccgtcctgcgcgagtccgtacccgtgctgccgggcgaggtcgtggacgcctccgtcatgcacgtcaccgcgctgcgtgagttcctcaccgcgcagatcgcccgcgccaaggccgagaacgtgctgttctccgtgcacctcaaggccacgatgatgaaggtctcggacccgatcgtcttcggtcacgtggtgcgcgccttcttcccgaagacgttcgcgcagtacggcgagacgctcgccgcggccggcctgaccccgaacgacggtctgggcggcatctacaagggcctggagtccctgcccgagggtgccgcgatcaaggcctccttcgacgccgagctcgccgagggcccggagctggcgatggtcgactccgacaagggcatcacgaacctgcacgtcccgtccgacgtcatcgtcgacgcgtccatgccggccatgatccgcacctccggccacatgtggggcccggacggccaggagcaggacaccctcgccgtcctcccggacagcagctactccggcgtgtaccaggtcgtcatcgacgactgccgtgccaacggcgccttcgacccgtcgaccatgggcaccgtcccgaacgtcggcctcatggcgcagaaggccgaggagtacggcagccacgacaagaccttcgagatccccaccacgggcacggtccgcctcgtcgaccaggccggcaacgtcgtcctggagcagacggtcggcgccggcgacatcttccgcgcctgccagaccaaggacgccccgatcaaggactgggtcaagctggccgtcacccgcgcccgcgcgaccggcgacccggccgtgttctggctggacgagacccgcgcccacgacgccgtgctgatcgagaaggtcaagcagtacctgccggagcacgacaccgagggcctggacatccgcgtcctgtcccccgtcgaggcgaccaagttctccgtggagcgcatccgccgcggcgagaacacgatctccgtcacgggcaacgtgctgcgtgactacctgaccgacctgttcccgatcctggagctgggcaccagcgccaagatgctgtcgatcgtcccgctgatggcgggcggcggcctcttcgagacgggcgccggcggctccgccccgaagcacgtccagcagctggtcagggagaactacctgcgctgggacagcctgggcgagttcctcgcgctggcgtccagcttcgagcacctcgcgacgaccacgggcaacgcgcgcgcccaggtcctcgccgacaccctcgaccgtgcgacggcgaccttcctcaacgaggacaagtcgccgacccgtcgcgtcggcggcatcgacaaccgcggcagccacttcttcctcgccctgtactgggcccaggagctggccgggcagaccgacgacgcggacctcgccaaggccttcggcccggtcgccgagaccctcggcacgaacgagcagaagatcgtcgacgagctgatctccgcccagggcaagccggccgacatcggcggctactaccagcccgaccccgagaaggcggcggcggtcatgcgcccgtcggccacgttcaacgaggcgatcgcgtcgctcgcg

SEQ ID NO: 7194 - DNA, 1173 bp, Streptomyces avermitilis
  CDS (1)..(1173)
gtggcaagtgacgagacttcacatccggccgggcgaccgttccgcctctcccgcgggaggcgaccgatgaaccgcgccctcaccctggacgacctgatggtcgccggcatcgccctggccgcgggcctggtggcggccttcctgctgcgcatgctgatgcgctggctgggcaagcacgcgctgcgcacccgctggagcggggacgacgtcatcgtggacgcactgcgcacggtcgtgccatgggcggcgatcaccggtggcgcggctgccgcggccacggcgctgccgctcaccaagtcggtcggacaccacgtcagccagacgctgaccgtgctgctcatcgccgtcgtgacgctgacggcggcccgggtgatcagcggcctggtgcgggcggtcacgcagtcccggtccggagtcgcgggatcggccacgatcttcgtcaacatcacccgggtcgtggtgctggccatgggcttcctggtgatgctccagaccctgggcatctccatagcgcccctgctcaccgccctgggcgtgggcggtctggccgtcgcgctcgcccttcaggacaccctcgccaacctcttcgcgggcatccacatcctcgcctccaaaacggtccagccgggcgactacatccggctgaccagcggcgaggagggctatgtcgtcgacatcaactggcgtcagacgaccgtccgccagctctccaacaacctggtcatcatccccaacggccagctggcggggacgaacatgaccaacttcacccggccggaacagcagatgaccctgctggtgcaggtgggtgtcggctacgacagcgacctcgagcacgtcgaaacggtcaccaccgaagtcgtcgccgaggtgatgacggagatcaccggcgcggtgcccgaccacgaaccggccgtccgcttccacacgttcggcgactcgcgcatcggtctcacggtcatcctgggcgtcggcgagttcagcgaccagtaccgcatcaagcacgagttcatcaagcgcctccacaagcgctaccgcgaggaaggcatccgcattccggccccggcccggacggtcgcgttgcagcaggggtccgtgtcgatcccgcatcagcgcaccggcgacgacctgccggccgggcagggcggcccggcgtccgccctgctcgaccag

SEQ ID NO: 7195 - DNA, 765 bp, Streptomyces avermitilis
  CDS (1)..(765)
atgtcggtccggatcgaacgccagggatacgtcagcacggtcgtcctctcccgcccggccgcccggaacgccgtggacgggccgaccgccgccgagctcgccgccgccttccgggagttcgaggccgacgagacggcgcgggtggcggtgctgtggggcgagggcggcaccttctgcgcgggcgccgatctcaaggcggtcgggggcgagcgcggcaaccgggtcgctcaggacggcgacgggccgatgggaccgacccggatgacgctgtcgaagccggtgatcgcggcggtcgcggggcatgccgtggccggcggtctggagctggcgctctggtgcgatctgcgggtcgccgaggaggacgccgtcttcggggtcttctgccgtcgctggggcgtaccgctcatcgacggcggcaccgtgcggctcccccggctgatcggcaccagccgggccatggacatgatcctcaccggccgcccggtgccggcccgggaggcgtacgagatggggctcgccaaccgcctggtcccgccgggccgcgcccgcgcggaggccgaggagctggccgccgccatcggccgcttcccccaggactgcctgcgcggcgaccgggcctccgtcctcgaccaggagggcctggacgagacgacggcgatgcgcggtgaactccgtcacggcatgcgggtactggcccagggcgtggagggcgcggcccgcttcgcggcgggcgccggacgccacgggtcgttcggcgagcagggg

SEQ ID NO: 7196 - DNA, 864 bp, Streptomyces avermitilis
  CDS (1)..(864)
gtgcgccagcggtccgtgctcaccgagggcttcggccagctggcgacggcccggtggccatggctggcggtcgcggtcgccgcgacctgtctcacctgggtcgcggccgccgtcacccggcagggcgcggtcgtcgagcggctgcccgcgcggcggctgctcgccacgcagttcgcggcgggcgcggccaaccatctgctgcccaccgggctgggcgcgagcgccgtcaacctccgtttcatgacggtgtgcggcgtgccgctcgcacgctcctcggccgcgctcgcgctgtacatgctcgcggaggcgatcacccgcctggccctgctgctggtcctgctgatcgccttcccggacgccctccacctcggctccctcgtgcccgacggagcgctcggcccccttctgctcgcggtggccggagcgctgggtctcgccgtgacggtgctgctgctcgtacgacggctgcgcacggccgtgctctccttcctgcggacggcgctcggcgaggcccgctcggtgcacgcccgcccggcccgcgcgctcgccctgtggggcggcgcgctcgcgttccccgcgctccaggcggccggccttgccgccgtggggcaggcgttgggcctgccggtcccgcccctgcacatggcggtcgcgtatctggcggcgacggccgcggtcgctctggtgcccacgcccggcggaatcggctcggtggaggcggcactcgttgtcgccctggtcgcggcgggtggtccggcggccgtggcgacggccgtggtcctggcgtaccggatcatcacggtctggctgcctctgctgcccggggcgctgacgctgggtgcgctggtgcggctgaaggtgatc

SEQ ID NO: 7197 - DNA, 1905 bp, Streptomyces avermitilis
  CDS (1)..(1905)
atgagtatggagaccaccgcctggacccagttgcacagcgtcatgaacgcgcagcgggagacccgccccttcgcccgtgcgacgctgcgccgcatcgccgcgttcgcccgcccgcaccgccgccgtatcgcgcagttcgtcgtgctcagcgtggtgaccgcgctgctcgccgtcgcgacaccggtgctcgccggacgcgtcgtcgacgcgatcgtgtcgggtggcgacgagagcacggtcgtacgcctggccgtcctcatcgcggtcatcgcgctcgccgaggccggactcggactcgtcagccgcctgctgtcggcgaccctcggagaagggctcatcctcgatctgcgcacggctgtgttcgatcatgtgcagcgcatgccggtcgcgttcttcacacgtactcgtacgggcgcgctggtcagtcgtctcaacaacgacgtgatcggcgcccagcgcgcgttcagcaacaccctgtccggagtcgtcggcaatgtggtgaccctgctgctcaccctcgccgtgatgctcaccctgtcctggccgatcaccctgctcgcgctggcgctgctgccggtcttcgtgctgcccgcccggcggatgggcagccggatggcgaagctccagcgggaggccgcggacctgaacgcggccatggggacccggatgacggagcggttctcggcgccgggtgccacgctggtgaagctcttcggccggcccgacgaggagtccgccgagttcgcggcgcgggcccggcgggtgcgggacatcggggtgcgtacggcgatggcgcagtgggcgttcatcacggcgctgacgctcgtttccgccctggccctcgcccttgtctacggcctcggtggctggttcgccctgcgcggccgcctcgagccgggcgccgtcgtctcgctcgccctcctgctgacccgcctctacgcgccgctgacctccctcgcgggggcgcgcgtcgaggtcatgagcgccctggtgagcttcgagcgcgtcttcgaagtgctggatctgaagccgctcatcgaggagaaggcggacgcgcgcgcggtgccggacggcccggcgtcggtggagttcgacaacgtccgcttcggctacccggcggcggacaaggtgtccctcgcctcgctggaggaagtggccgccctggacacccgcggcggcgcggaggtcctgcacggcgtctccttccgtgccgaacccgggcagacggtggcgctggtcggctcgtccggcgccggcaagtcgaccatcgcccagctgctgccgcggctgtacgacgccgacgagggcaccgtacgcatcgggggcgtcgacgtacgcgacctgagcgcgccgtcgctgcgggccacgctcgggatggtcacccaggacgggcacctgttccacgactcggtacgggcgaacctgctgctggcgcgcccctcggccgccgaggacgaactgtgggacgtcctgcgccgggcccgcctcgacgagctcgtacgctccctgcccgacggcctcgacaccgtggtcggcgagcgcggctaccggctctccggcggcgagcgccagcgcatgaccatcgcccgtctgctgctcgcccgccagcgcgtggtgatcctcgacgaggcgaccgcccatctcgacaacacctccgaggcggccgtccaggaggcgctcgccgaggcgctcgcggggcgcacggccgtggtcatcgcgcaccgactgtccacggtgcgggccgcggacgtgatcctggtcgtcgaggccggccggatcgtggagcggggcacgcacgagcaactgctcgcggcggacgggcggtacgcggaactgcaccgcacacagttcgggaagcccgtgccgggggcggcggaggtcgccgaggcgggggaggcggtggcc

SEQ ID NO: 7198 - DNA, 2223 bp, Streptomyces avermitilis
  CDS (1)..(2223)
atgtcatcgcagactggtgcgttccggggacggcgcaagcccggggagtgcggcgtgaccgagccggaggccggagccggtccgcgccgccgtcgcgctgccccgaagcagccctggcaccgccgtgtcctcagctccttcacgacctcggcggacgcggaggcgggggccgcggagcgcccctcggcccggccggccgacggggcggccagtgcgcaccgccgcggcgcccgccgcaaggcggcggagcccacggcgatcgcgcgtgtcaccgtccgtctcacgccctacgcccgacggctcaagccggagtacccgcggccgggcctcgacggctggcggcgctggatgccctccgtgcgccagtggctggggatctgcctcgtctccctgggcctgagcggcacgttcctggccgtcgcctacgcggcgaccgacataccggacaacctgaacacgtacgccacccagcaggacaacgtctacttctgggccgacgggacacccatggcccgcaccggctgggtgcgtcggcaggcgatgccgctgaaggacatacccgaggatgtgcgctgggcggtcctggcggcggagaacgcgagcttctactccgaccccggcatctccgtcagcggcatcggccgcgcgctgtggcgcaccgtgggcgagggggacacgcagggcgggtccaccatcacccagcagtacgtgaagaacgtctatctgacccagaaccgctccgtgacccgcaagttcaccgaggcgatgatcgccgtcaagctggaccagcggatgagcaaggaccagattctggagggctacctcaacaccagctggttcggccgcggcacctacggcatccagcgcgcctcgcaggcctactacggcaaggacgtcggggaactcaacgccagcgaggccgccctcctcgcctccctgctcaagggagccggcctctacgaccccaccctgagccaggccaaccaccagcgggccgtggagcggtggaagtggatcctcgaccgcatggtggagctcggcaagctgtcgcccaccgagcgggccaagtacacgcacttccccgagccgaccaagcaggcgcagacgtacgacaccggcaaccagagcgactacctggtggagctggcggcccagtacgccaagaaggccggacacatctcggacaagcagttcgacctcggtggctaccagatctacaccaccttcgacaagaagcgggaggaggcgctcaccgccgccgtgaagaaggcccgcaagaaggcgcagaaggacgacaagggcaaggccgaaaccgcccactacgggggctcttcggtggctgccgacggccggatcctcgccgtctacggcggacccgatcaccgcaaacagggcttcaacgagtccaacgcctccaccgtcccggccggttcggcgttcctgccgttcgtctacgccgccgcgctggagcacggcgtgcacaaggaccgcggatccacgacgactcccgtcaccccggattccgtatacaacggtgacgacggcgtccccgtcaccacgcccgagggtccctactgggaccgcagcggcaagaaggtcgccgcccacaacgacggcggcacgtcctgggggcagatcacgctgcgcaaggcgctcgccgagtccgtgaacacccccttcatgcaactgggcatggacgccggcctggccacggtccgcgagaccgccgaggcgacgggcatgctgtcgtccagcatggggccgcaggtgcccaccctgtccctgggcacctcgacgcccagcgcgatccggatggccagttcctacgccaccttcgcggccggcggcacccacaccgcgccctactcggtgcgccgcgtcacccgcaacggctccaaggtcgacctcgacaccccgcgcccccgtcgcgcggtcggcgccgatgtcgcccgtcaggtcaccgacgcgctcacggactccttccgcacccaacaccccaccgcggcacccgcgtcggcgcaggtcgccgggaaggccggcacgacggacaaggacaccgccgcctggtacgtcggcacgaaccgctcggtctccaccgcggtggtcgtctaccggatggacctgaccaagagcctcgaacccctgccactgaaggggatcgccggtactcccgcaaccggcgtcccctacgacatctggtcgagtgccatgagtcccctcggc

SEQ ID NO: 7199 - DNA, 1224 bp, Streptomyces avermitilis
  CDS (1)..(1224)
atggcggtcctgctcgtcgtcgcctgcatcgccgcgaccttcctggcgttgaacggcacggacgacacgaagccgaccgcgtcgtccaccgacggcggacgctccggcgacgacaccgacaagtcgacgagcgagcccaagtgggacggcaagacgaaggtgctcggcgacggttccacgtcgtacaccgggccgcagaagggacagctcaagccggagcggctcaagcccggtgagaagccgccccagttcgtggtcttctcctgggacggcgctctgcagggcgacgaccagctcttctcgcactaccgggagttggccaaggagtacaacgcccatatgacgttcttcctgacgggcatctatgtgctgcccaaggccaagaagacgctctacgaaccgccgatgcactcgccgggctcctccgcgatcagctaccccaccgacgagcacatccgcaccacgctgacggagctcggcaaggcgtggaaggacggcaacgagatcggaacccacttcaacggccacttctgcgacgccaagggcggcaaggactggagcgtggcggactgggagagcgagatcaagcagttcttctcgttcgtcgagaagtggaagaccaacaccggctacaccgatctgccggccctcccgttcgatgccaagcgcgagatcagcggggggcgcgcaccctgcctggagggccagaagaacctgctcaaggccatgcgggcgacggccaaggactacaactggcgctacgacgccagctccgcgggcgacttccagatatggcccgccaagaagaacggcatctgggacttcccgctgcagatgctcccctacgagggcggcaagtaccagggactgtccatggacttcaacttcctctacaaccagtccgacggcgagactgagggcgatccggtccagtacccgcagtggcaggcggagaccgtgcagtcctacatggccggcttcaaccgcgtgtactacggcagccgcgcacccctgttcatcggcaaccacttcgagaactggaacggcggcatctacatggaggccgtcgaccaggtcatcaagaacgtgtgcaccaagaagggcgtccgctgcgtgtccttccgtgagctggccgactggatggacgcgcagacccccgaggtgcgggcacagctgcgcaccctggacccggcccagtcgcccgactggtcggaggtcgtcaag

SEQ ID NO: 7200 - DNA, 1131 bp, Streptomyces avermitilis
  CDS (1)..(1131)
ttgagccgcagacgcgccaccgtcctcgcggtcgccgtctcggcggcgctgctgcccgtctcggccgccggtgcggccaccggctcggcagccacttccggcacggccgaccgggcgacgaccgacgccttcggccgcatcgccgacgcggtgctcaccgaccgcaccgcggcgctgctcgaccggcagcagctgaagtccacggccgcgaagatcaaaggcggtgtgcgactgtcctcggcgctgacgaagaccgaggggacggcactgtccgcgctgcgcggccggcagtcccggctcgcggccctgggggaggcgtacaccgccgccgacacccgggtcggcgtcgacaagacccgcatcaagggctcacgcgccacggtcgaggtcaccgagaccacggtcctgacctacaagaagatccgtggcgacgagccgcgcacgaccggcttcaaggcccaccacgaactgaccttcgtcgcgcaggcggacggcacgtggaagctgtcgggcctgcgctccacggacaagggcccgcgcgccgtcaacgagcccgtcacgacggcgccggcgaaggtgcgcccgtcggccgtcatcgacgccccgcgggcggccaccacctacccggcgccggccaacccgaagcagaccaccggtaccggctacgactacacggcgatggccgcctacgccgagaagtactggaagaactacaacacggcctaccggaagttcaacggggtcggcggtgactgcaccaacttcgtgagccagagcctgctggcgggcaagtggcagccgatcagcaccgtgaccccggaggagtacgacacctggtactacgtcgccaacggccagtccgactcctgggcgggcgtgaacgagtggtcctggttcacccagaccgccaagcgcaccacaccgctggcgaacgtctaccagctggacgtcggtgacgtcctgcagatggacttcgacaaggacgggtccaaggaccacaccatgatcacgtcctaccgcggctccaacggcgtcccgtacctgacgtaccacgacgccgacacctaccgccggtcgctgtcgagcctcatcgcgtcctacccgaccgcggcgttctacgggtaccgcacc

SEQ ID NO: 7201 - DNA, 1617 bp, Streptomyces avermitilis
  CDS (1)..(1617)
gtgtcagcggtggtccgtacgctcggtggcatggaggggaacgaagggaagccggtacgcggtgcggaagccgatgccgaggcctggcagcggctgagtgcgtactcctacctcagcgcgcccgagcgcctggagtacgtcgcggtgatgcgggtgttctgcggcacgctgctcgcggacctgtccgtacccgacctcctcgcgaagctggccgagaagggcgggccgggagcagcgctggacgcggagacgctcacccgcaggctcgaagagctcgtgcgctggggcaatctgctgcgtagcacgcacacggtcagggcgacgagcatcgccgaatatcagcgctcgcggtcccgctaccagctgtcgaagctgggggagcgcgtacagcgcgacgcggacgaggtactggccggggccgacgcggcacgcgaggtgagcagcgagctgctggccctcgtcgaccgcggcctgcgggagatcgccgccatggccgcggcaccgggcggtgccgatccgcagcaggccctggagcggatcagcacgctcttcgtgcagttcgccgaattcgccgagtccgtccgggacttctacgcctacctgggccaggtgctggcgcgctacgacctcgactcggccgagtaccaggggttcaaggaactgctgctcgactacgtggaggccatcaccgaggacgtctccttccgggccccgcgcatcgcggcccacctggacgccgtccggccgcacctgcccgcgctgctcgaccgtgtcgacgcacatgcggcgggcatcggagcgctcgcccacgggctgaccgagacgcgggtgcagcgcagccgcgggcgggacctcgcggactgggagggtctgcgcgactggttcaccgacaccggagggcacggaagccaggtcgaccagctcagggacgccaccctccgcgcactggagtcgctgctcgccaacgccaagcggatgctgcgttcggcctccggtgagatgtcccgccgcaaggacctgctgcggctcgcggcctggttcgacgccgcggagccggaagaggcccacgacctggcggtcgccgccttcgggctgtacggcgcgcgtcatctcggtgtggcgccggaccccgaccggtccgtgccggcgtacgtgagttggtggaccggacccgtggtggacgtgccggtggcgctgcgcgagcgcggcagcagggctccgcgcgggcgtgccgcggcggccgaggaccattccgagcagaaacgccgcctcatggagcgggcgcggcagcaggccgaggcccgacaggccgcggccgacgaactgcgcagcgcctcgggcaggttcgagcaggtgcgcctcagcgccccggccatgcgactgctgctggagctcctcacgaccgcactcggcaacgcccagctgcacaaggacgcccacgacttcctgctcgacggcgcgcaggcgcacgacgcggacctcgacatccggctgaccgcctggcgcacgcccggcaggtccacggtcctgcggtccgtggacggcgacctgacggcggacgatctcaccgtggccgtcgagagcgcgtccgcgcccgcggtgggggaggcgagcgcc

SEQ ID NO: 7202 - DNA, 1335 bp, Streptomyces avermitilis
  CDS (1)..(1335)
atgcccctgccctccgcgcacgacgtcgcactcgcggccgaacgccacaccgccgcccggctcctgctggcccaacccctggtcaccggcgccggaccgcacagcgacgccttcccgctgatccgacggcacgcggactggctggcccagcgcttccaacaggtgttcggataccgcctgctggtggaggcctcgtacgcccgtctcttcaaggcgggcctcggccccggctcgggccaccgcctggaacgaccgtcgaccggaacgccgttcagcccgcggacgtacgcgtacctgtccctcgcgctggcggtcctcgtcaccgccccggagcagctcctgctctcccggctggtcgccgacctgcgggccgcggccgtcgacgccggcatcgagatcgccgacaccgggcggcagggcgagcgacggaccctcgcggccgcgctgcggcaactcgtcgactggggggtcctggtggagaccgagggacatgtcgcggccgtcgcggaggaacgggccggggaggctctgctgaccgtggaccgcgagatcgcgcgagccgtcgtcgccggcccgctcgcccagagccgcgacggcgcggacctcgtacgccgggccgccgacccaggcttcggcgggccccgtacgtacgtccgctggcgtctcgtcgaaacccccgtcgtccacctcgacgacctcacggacgcggagcgagaatggctgcgtacccggcagcggcgcgaggcgcaggcattctccgaactgctcggtctggaagccgagatccgcgctgagggcatcgccctggtcgacaccgaggacgaactcaccgacctgcacctgccaggaaccgggacggtggctcaagccgcgctgctccttgtggagcggctggtcgaccggctgcgtcccgaagacccgggccatccggcagtcggcggacggctggtcatcggcgtacccgtcccggacgggctgctgcccgccctgctcgacgaactgatcgaggagtacggcaggcgcagcaactggcagcgcggtcacctggaggaccgggacggattcctcgcggccgtactcgacctcctcgtccggatgcgtctgatggctcccgccgggcccgtacgcgcggaaggtcacggcctgcccgaggggtacggggagacggtggccgacgaccgctccgtcaccgatgtctctcaggcgcgcggccagggccgtacggacggggtctggatcctgctcgccgcagccgcccggtacgccaccaccgtggcggtcaaaccccgcaccgaccagcccccagcggacgacgtctccaaggagtcgccccga

SEQ ID NO: 7203 - DNA, 4197 bp, Streptomyces avermitilis
  CDS (1)..(4197)
atgaaccgcccgccgaacccgcaccgctaccgactgcaccgcgcgggcatccggaacgtctggcagtacgacgagcaggagttcgccttcggtgaggggcgcctgctgcttcgcggcaagaacggcgccggcaagtccaaggccctggagatgctgctgccctacctcctcgacggtgacgcccgtgcgttggacgccacgggaacggggcgcaccaccctggcctggctgatgctcgacggcttcgagcagaccaaccgactgggctatctgtggctggagttcgtacggacggacgacgaggagaacgaccaccatctgaccatcggcgcggccgtccgcgcgtcccggtcgaccaagacggcgaagccgatcttcttcaccacgcggctgcgggtcggtaaggacgtagacctcgcccccgccggtcggccacttcccgtcgaccagctcaagtcgctcgtcggcccggagaacgtcaccgaccgtgccgtcgagcaccgggccagggttgcccgtgaactgttcggcctcaccgactcggcgcgctaccgcaacctgctccatctgctgcaccggctgcgccgtcccaccatcggtgaccgcattgactccggcgggctggtctcggtcctcgccgagaccctgcccgccctcgacgacgaggtcgtggagcaggtggcccgcagcctggacgacctcgactccgtcagggcctacctcggacgcctcgaacgcaccgaccgagctctgcggaccttcctcgccgactaccgcggctatctgcacgggacgctgcgccgccgcacgggccgggcgaacggagcgctggagcagctgatggagtaccgcacgttcgcgggtgacgcgacgcgcaacgcggaagggctccgcgagcgcgagcgggaactcgatgcccgcaccgaggcgctcgaaggtgaggcgagtgcagccgagacggacctggccgcgctgcacgccggcgccgggtaccgcggtgtgaaggaactggcggagaagcgcgccaccgtcaccgccctgcacagcgccgctgccgccgccttcaaggccgtccgccaggcgcacagcaatcaggaggaggccgggcggcggctcaccgacgagtcggggcggttcggtgaagagctggtcgaactgagcacgctacagggcgagttggtgcgggaggccgaacggtccggggtcgaccccgtgcacctgggggagcccgtggggacccccgccgcgccggtcgcgccggccaggacggccgaactgaccgcgccggaaggtgacttccacctggtacggcacagcgaggtgctggcggtcgacatcgagacctgtgcgaccgcgctgtatgcctgggacgcccggctcgacgccgcacagccggtgatcaggaaccgctcccggttcgtcaccgaactgcgcgccctcatggggcggtcggacgaggcccagcgggaggcgcaggcggccgacgccgcccgggagcgtctggaggaacaggccgaccacgcgcgctccggcgccgagcagcgtcggcaggaaaccgtgcacgagggagaggcgtacgcggcggcggcccgagcgtggaccgagcagctgcggagcctcaccggggtgcctgtggacaccgccgtgtccgctctggccgggcatgatccggccgacggtccgctgtccgctcatgcccccgacgaggtggccgacgcggcccggtcggccgtcgacccgtggctggcggaactgggcgaggaacgcgacaccctcaccctggccgcccgtgaactgcagaccgaacgggaccgtctgcggcaccggcgcgaggaatgggaacgccgcaccgaccccgagcccccgcccccgtcccaccgcgcggctcctcgcgcacccggcacgggagcgcccctgtaccggctggtggatttcgcccatgacctggagccggacgcgcgggcagggctggaagcggcactggaggcgagcggcctgctcgacgcctgggtgcgcgccgacggcacggtcctggacccggccacgcgggacaccctcctggtcccggcagcacccgtgccgggggagacgctcgcccgggtcctgcggccggtcgacgcgccggacagcggagtgacggcggagcaggtcgagcgcgtgttgcgggcggtggccctggccaggggcgggatcggcgccggcgaggccgacacggcgggcgcggcgcacaccgcgatcggcgtcgacggctcctggcggctcggcgtggcccgcggccgccacgccaagcaggtcgccgagtacgtgggcgcggaggtgcgggcggagacccgccgccgggcgctggcggaactcgacctccggctgacccgtgtacaggatgagctggcggaacgtcagcgtagtctgcgcatgctcacccagcaccgcgaccaggtcggggacctcctgcgccgaccgccctcagcgcgtgggctgacggacgcgtgggcccgtaccgccgaggccgagcggaccgccgaatctttcgccgggcaggcggccacggcagcccgcgaggcggagcaggcacgggccggcgcggtcgtcgcccggcgtgaggccgaggcgacggcgagcgcccaggacctcccggcggacccggccgcactcgaaacggtccgcctggccctggaccgcctcgggcagggggcgcagcgactgcggcgccgggtgcgcgcggtcctgtccgcggccgacggccatcgcggcagccggacggactacgggcgtgccgagtcggcccgccgggaggccgagtcggactacgccgagccgctcggccgcctggaggccgcccgccgtaccgtccgtgctctggaagaggccatcggcgccacggaacaggagatcctcgaccgcgaggcggagacgatgcgccgcctggacgccgtgggacgccaactcccgcgcatccgaagggacctggccgacgtgcatgacctgcgcgttcgggcggaagaggaggagagggcacggcgcgaggcactcgccgaccaggaggccgaggcgttggcctgcggcaggggactgcgtaaggcccttgcgctgccgggtgtgctgagaggagcgggtctcgacaccgacggggacgaggtcgcgctgaagtccccggaccccctgcatctcgacgtgcgggagcgtatcgcggcgctgcgtctgctggtcgacgccgtgcgccgcggcctggacgccgaacgccacgacatctcggacaccaccctcctcaaccgccacaccgacctgcgcgaccagctctccggaggctacgacgcgacgatcgaggaacatgacggcatcaagctgtgccggctcgtcgacgaccacggcctccacgacatcgccgtggtcggcgagcgcatcgcggccgaggccgccgaggcacgtgaccgtctgacagagcgcgaacgcgaggtctttcagcgtttcctggcgggcgagttgggcgaccacctgtcctcgcaggtactggccgcgggcgccctggtcgccgccctcaacaccaccctcgccacggtccgtacctcacacggtctgggcgtcgccctcgactggaagctggccgacggtgtggaggcggacgtcaaggcggccgtcgacctcctgcgcagcccctccgggctgcgcacccgcgaacagtccgagcaactccgcgacgtcctccagcgccgcatcgaggacgcccgccgcgccgacccggccgccggatacgcggctcacctgcgtaccgccctggactaccgtgactggttcgccttcaccccctgggtggtgaacgacgcggcaccgggcagccgccgtagactctccggccgcacgggcctgagccagggcgaacagcgtgtcctctcctacctggtcctcttcgccgcggcggcggcgcacttcaccagcctcgccgacgccgccccgcacgcgccccgcctcatcctcctcgacgacgccttcgccaaggtcgacgagcccacgcatgcccgcctcggccgcatcctggtcgacctggacctcgacttcgtcctcaccagcgaacgactgatcggcaactggcccgacgtaccgtccctccacatctacgagtgcctgcgcgacccgcatgtgcggggcgtggccacactccattacacgtggaacgggcggcagcggaggctgatgtcggta

SEQ ID NO: 7204 - DNA, 1335 bp, Streptomyces avermitilis
  CDS (1)..(1335)
atgacaggacccgagcgagccgacgtacgtcccccggacgccgacgccctcgcgtttctcacccggccgggcctcgcccgcctctggacggccgtacgcacccggctcgaacgcaacggccttcggccggccggagccatcagactggaccagctggacgcacgggaacgtgaggccctgtccctcctgctggccagacccgtcaccggcctcaccgtcacgatgcgcctgacggacctggacacccgcttgcgcgccagcgcggtcggacggggcctggtggccatgctggaagaactgggaccacccctgacggaccgtcgggcggtccgcgacgcggcggcggccgaacgcgcacatgtgtggtcgacggctcggtccgagctggaagccacgttgctgtccgcccagccctgggcggcacagtggttggaggagatccgacgcggcggcacactcgcccgccaggactcgcacaccgcgatcacggtcatcacccaggcgatccagaccctgggggcgctcttccccggcacgaaccaaccccccacccccgccacctggggccgcggcgaactggccacccgcaccaccggttcggcccacggcctggacgacggcacactgctgtcccggctggtcctccgcggcatcgcgctggcacgcggcgtcgagtcccccgccgacgcgccggcccgccgggccctgtggcgcatggcctcggtcacccccgacgaggtctccagcacggtgctcacctacggcctgcgccccaccggcggcacctggcgcgagcgggccctgcgcgagcgcgccgaccaccacatggaaacccacctgaccctgcgcgaactccgcgctctgcgcctggaggtgccaccgcgcacccgcgtccacgtctgcgagaacccccgcgtggtcgaggccgcggccgacaccggcggcggtacggagcccctgatctgcacctcggggagcgcgacgaccgtcgtcctcaccctcctggacgcgctggcggcggccggctgcacgttcgcctaccacggcgacttcgactggcccggcatcgcgctggccaaccggatcaggcaccggtacgcagccgagccctggcgtatgcgggcggccgactacgagtacctcgccacacgagctcagttgcacggcactccgcagatccccctcaccggcacaccgacggacgccgagtgggacccggaactgaccccgaccatggccgccctgggcatcgccttgcacgaggaggcggcgctcgatctgcttctggaggacctcggtacctccgtcggaacccacccgtccggcgattcccca

SEQ ID NO: 7205 - DNA, 1206 bp, Streptomyces avermitilis
  CDS (1)..(1206)
atggcctcgatccgctcgcgcgtcttcggcgcgcatgtgcggccccttcaactggacctcgccgacctgtcgtccctgaagaccgccgtggacaggctgggcctcgatcatctcgacgtggtggtccacaacgcaggtgtcgcgctcgacgagccgccgcgtcgagagaccgaggacggccacgagctgatgttcggcaccaaccaccttggccacttcgcgctcacccagtggctggtcccccctgctgtccgcggcgtcggcgggccgcagcgtgacggtgggaagcttcgcggcgcggtcggagcgactggacctggacgatctgcagtcgacccgggatccccccagccgttcgacttccgcccgtcaccacccggactgcgcccggcccggtggtcatatacgttcgaatcggaagcgggcggggccgcggggtgcgcgctgtcacgtccgccggtccacgcccctgcaacccatcgcagggaaggtgctcccatgaaggtccaggggtctgtcgcctttgtcaccggagcgaaccgcgggctcggtgagcaattcgtacgggcgctcttcgacgctggagcagccaaggtctacgcgggatcccgcgaccccaccagggtcaccgtgcccggggcggtccccgtcgcggtcgacatcaccgacctcgaatccgtgcacgcggcggccgaccaggcccaggacgtgacactcctcatcaacaacgccggtttgtcgacccgggccgacgtgctcaccgcggacctggattcattcaggttggagttcgagacgcacgttctcggcaccctcgccatgagcagggccttcgcccccgttctggggcgcaacggcggcggcgcagtagtcaatgtcctgtccgtgctgtcctggatatcgatcaccgccagcgccggatatgccgcggccaaagctgctgaatggtccatgaccaacgctttgagagtggccctcgcggaacagggcacgcaagtcacagccctgcacgtcagttacctcgcgacggagctggccgcgaaggtgaccgcgccgaagtccgatcccgccgcggtggcccgcgcgaccctcgacggtgtcgaggccggactgcacgaggtcctcgccgacgacttcagcaggcaagtacaggcagccctggccgtcggcccggaggcgctgtatccgcaactggccggccggcac

SEQ ID NO: 7206 - DNA, 534 bp, Streptomyces avermitilis
  CDS (1)..(534)
atgctgactgtgcgacccattctcccgaagatcgagggcggccgggtacagggcctcctgcagctcatcgaggacggcatccacctcgtcgtcgcggcactcctcgtactgctcgcggggctcctgaccgtcggggtcgtccacgacgtcatcaggtcggtgcagggtccgtaccgcgaggagacggtcgttctctccgctctggacaacggccttgtgctgttcatcgtggccgagctgctccacaccgtccgcctgaccatcaggaaccagaccctcgacgcggagccgttcctcgtcgtcggcctgatcgccggcatccgcaaggtgctcatcgtgacggccgaggcggaggcttccttccggtggaacgtcgaggggatcgaactcctgatcctggcggggctgatcctcgtgatggcgacagcggcgtacgtgtggcggcgctcgacgcggccgggagactatttcccgctccaggaggcgcggcgctcttcgtcgccggcgccgtcacccgcccctgggcgcgggccc

SEQ ID NO: 7207 - DNA, 2352 bp, Streptomyces avermitilis
  CDS (1)..(2352)
ttgcccgcgctccggcccggtaggacggacggcggacgctcagcagtgtccgcagtgtccgcagtggctgcacccggtccagcggctgcggccgccagcctgttcgcggggcgtgtgggaggcttccttgcccgacggctgccgcacctcgaccaggccgacgcgacccggcagggtgttccggctaggctcacacccgtgacgtggctgcgggccttcggggaggtcgtgcgatccgggctcacgatcgaggagacgcggctggagcccctgctcgcgctgcgcacggccgctggggtggcgatcgtcgtcgggccggcgctgtggctggcctcccccgcgtatgccgcgtctgccgccctcggcgcctactccgcgggtggggccaccttccagcgcacctggcgtccgcgcaaggtgatcgcgctcggcgcgggcgcgggtctggcgctcagcaccttcgtgggctacctggcggcggggcgactcgtgacgttcctcccactgttggccgtatgggcctttgtcgcggggatggcgtgggccgtcggatcgaccgcggggatcgtcgcagcgacgaccgtcggcagcatgctggtgaccatcaccctgcccacgagcgtcgggcgagccctggagcacgccggggtcatcgcgctcggaggcgtggtgcaggccgtgctgatcttgctgttcccgatccgccgttggggggcgcatcgtgacgcgctcgccgacgccctggccgccgtggcggactacgcccgccggctgcggcacgacccgaccgccccgttcgacccggagccgttgatgacggcccgggacgcggccgccgtgacgccatcacaggcccgcacccgtccccccgtcctgcacggcccccggggcctggccgagcgcattcggccggtcgtcgccgcgctcgccgacccggacgtcggcgccccggcggagggacccgggcgggaccgcgcgcgggagttgctcgacgcggccgccgacgtcctggacgcggccgcccgttcgatccgccgcggcactcccgccgaggtgccgcccaggagcacggacgtcctgcgcgtcgacgaggaccacgaggtcctggagggccccgcgaggcaggccgccgagcggctcgtggaactgctcggcgaggtgttggagatcgccgggagcggcggcacgagcgggaggacgcccacgccgcccggccccgcggacgcccagttcctggtgcgcccgactatgttccggctggtcccggtcgtcgtccgggcggtccgccgtgagctccgccgggactcgcccgtgttccggcacgccgtccgcttggcggcggtggccacgctcggctatctgatcgccgcccggctccccctgggccacggctactgggcgcccatcgcctcggtgatggtgatgcggccggacttccaccggacgtacgcgcgtgcggtggcccgtctcgccgggaccctggcgggggtcgcgctcgccaccgggatggtgcgggccctgggcccggacgcccatgtgttcggcgcgctggcggtggtctcggcgggcctgtcgtacacgctgatccgtaccggctacgcctactcccagtgcttcactgccgcatacgtcgtcttcctgctcggcatgggcggccaggcgtgggagcagacggtaccggagcgggtggtgctcaccctgctcggcggggccctggcaatggtggcgtacgtggtgttccccgcatgggagacgcccatgctggcgggccggctcgcggactggctcgccgccaacggccgctacgcggccgcggtgctccgcagctacgccgaaccgacccgggagcatcgcgccgacatgcgcagggccctgctggcgagcaggaaggcacgcgccgcctggcaggagacctacgaccgggcaaggcaggaaccggtcggccccaggggtctgacgtcgcgcgaggcgcaggacgcgcaggaggcgctcaaggggttcggccgggcggcgatgctcatggagagccacgtcccgcgggccgacagccgtttcgtccccgaggcggagcggttcgccgaggccctcgaggcggacaccgcgcaggcggcggtcgacgtgcgcgagcacaggaatccggactgggggcgcgtggaggaggcactccacgcgtgggagggctccgccgccggggaccggagcccggtgatgcggcgcggggcggaactgcagaagcaagccctggaggacctcgcgacggccgtgagccgcacacccctggaacgggacgtcggctccgctcgcgaggagcagcgggtgcgggcgaccctggcggcggaaggtgacggaagg

SEQ ID NO: 7208 - DNA, 1173 bp, Streptomyces avermitilis
  CDS (1)..(1173)
atgaaagcagcggtatatgaaggcccgcgaacggtcgcagtgaaggacgtaccggacgcgaagatcgaacacccctgcgacatcatcgtcaagatcaccactaccaatatctgtggttcggacctgcacatgtacgagggccgcacctcgttcgagtccggccgcaccctgggacacgagaacatgggccaggtcgtggaggtcggctcggccgtccgcaaggtccaggtcggcgagtatgtggtcctgcccttcaacatcgcctgcggcttctgcaagcagtgcgagcggggtctgaccaactactgcctgaccatgcagccggaaccggctctcgccggagccgcctacggattcgccgacatgggcccctaccagggcggccaggcggaactgctgcgcgtgccctacggcgacttcaacgcgctgcgtctgggtgaggacgccgccgagtggcagaccgactacgtgatgctcgccgacatcttccccaccggctatcacgccaccgagatggcccacgtcaaaccgggtgaccagacgatcgtcttcggggccggccccgtcgggctgatggcggcctactccgccctcctcaagggcgccgggcgcgtctgggtggccgaccaccagcccgaccggctgcgcaaggcggaggagatcggggccatcccgatcaacaccgccgagcagaagccgggggaggtcgtcaaggaggccaccctcggtctgggcgccgacaacggctgtgagtgcgtcggctaccaggcacacgatcccgagggacatgaggacgccagcctcacgctcaacggactgatcgactcggtcaggttcacgggcgacatcggtgtggtgggcgtgttcctgccccaggaccccggcggcgcggaggcccagggggaactggaggcacagggcaaggtcccgctcgacttcggcttgatgtggttcaagggccagcacatgggcaccgggcaggcgccggtgaagaggtacaaccgggcgctgcgggatctgatcgccggcgggaaggcaaagccgagcttcgtcgtctcccacgaactcagcctggatgaggcccctaccgcctacgagcacttcgacgcccgtgacgagggctggaccaaggtggtcctgcatccgaacggacacgggaacggccacaagcgg

SEQ ID NO: 7209 - DNA, 1419 bp, Streptomyces avermitilis
  CDS (1)..(1419)
gtgcgtgacgtgcttgtgggcgctccagaacttgccctggtagccgtagtcgacgcggtcctcctccggctcgatgtacacggagggctgctcgtccgtgtacagcagccagtcccggtccttcttcctgagcctgcgccccggtcggtcgatgtcgatccccaggccgctcacgacactgcccagaaccgtaccgcctgcacctgctggcaggggccagcgtgtcacgcggcgtcggcgatacctcgggggcatcctgtgggcacgggcgatcgctggggcagccgacgagaaggagtcatgcgggtgtcgtctcagggcgttacggtcgtggctctcctggcggatccggacgcgcccacggagatcgcgcagcgcatggcccggatacttcctgctcggctcgccgacaagtcaggccagggacgacggttcgacgtcgaggtggtcagtgagcccttcaccgcaaggaccgaggacccgcccaccttgatgcgccggatcatggaccgcggaagagcggagagttgggacatcgtcgtggccctcaccgaccttccgctgcactcacacgggcgcaggctcgtggtggatctgagtcacgaacacggcttggccctgctgtctcttcctccgctggggggcttgcgtctgcagacgagagcccggcgggccgtggaagaagccgtgctcagcttggcgggcccgcgggccaccggggctgagggacctccgcggagtcagccgcttctggggcccttcgtcagtcgcctcgcgcctattcacccgggccaggtcggtgaggaggagaccgttgatcttcggtacgtcgtcagcggaccgcgcggttacctgagggtgctcgtcggtatggtccgcgccaaccggccgtggcgcttggtgccgggcttgtcgaaagccctggcggccgcactcgccacgggagcggtcgccaccgtgaactccaccatctggaacctggccgagtccctgagcacgccccgcctcgtgatcgccacggtcgggtccgtcgcgctcatgatcggctggctgatcgtggacgcgcagctgtggcatcgatcagcagaggtctcgcgggaggcgaggcagagggcgaggctctacaacgcctcgacggtcatgaccgtgggtatcggggtgctcgtctgctacgtgggtttgatcgtcatcaacttggtgtgggccctgttcatcctcaacgaccaagtgttcgcctccacgacacgaaccccgctcaacgccgcggaatactggaccttgtcctggttcgtcgcttcggtcgccaccgtgggcggggcgctgggatcaggcttggagagcgacgaggcgatccgggcagccgcctactccaagcgcgaacaggaacgccgccacatgctccaagacgacgacggcgac

SEQ ID NO: 7210 - DNA, 654 bp, Streptomyces avermitilis
  CDS (1)..(654)
ttgcagtccacggaaaagggatgcggacaggccctgccgggtgtccctaccgctcgcgtcgtacaaccagcgactcgtgaagggagccgtaccatgacacaggaactccgggggatgcgggtggggattctggccaccgacggcgtcgagcgcgtggaactcgaccagccgcgcggtgcgttgcagggcgcaggggcgaagaccgagatcgtctcgctccaccccggcgagatccaggcccgccagttcgacctcaacgcggccggaaccttccccgtggaccgcctggtcgccgacgcctccgtcgacgactaccacgccctgctcctgcccggcggcaccatgaaccccgaccagctgcgaatggaccgcgacgcggtgcagttcgtcaaggacttcatggccagcgggaaaccggtcgcatcgatctgccacggcccgtggaccctggtggaagccgacgccgtgcgcggccgtcgcctgacgtcctggcccagcatccgcaccgacctgcgcaacgccggcgcggaggtcgtcgaccaggaggtggtcgtcgacgggcagctggtcaccagccgcagcccggccgacctgcccgccttctgcgccgctgtcgtggaacagttcgcccgggcgcaccaccccatgcccggc

SEQ ID NO: 7211 - DNA, 603 bp, Streptomyces avermitilis
  CDS (1)..(603)
atgctgctctgccaggggaagagggggtgccctttttcggcctggggtgcggaggcgctcagcagggggctgtgcgaatctcgaccgggtaacagccgatggcggcgtgggcgggagcgaacgacgtcgtccgttcccggtgaggaggcgagaggcatgaccgtgatgggtgtgtcgaagttcgagaggttcttccgcgccgccgcaagccttgacgtggacaagaacgacctgaagcggtacggcgacttcgtcgacgccaagctctacgacctcctggtcgtcggccaggcgtcggccaaggccaacggcagggataccgtcgaaccgtgggatctaccgatcaccaagggcctccaggagagcatccacaggttccggcagctcgacgaggaggtcgagctgaagccgatcctggaacagctcgccgcgcatcctcccctcgacaggacacccacccaggagaccgaagagcgctaccccgagatcatcggcggtctcagcgtcgccctcgccgagacgttcaaaatcttgtatccggatgtgaagaacccgcagaccagtcactgggagggcgtgaccgcggtgttcgaccggctgctg

SEQ ID NO: 7212 - DNA, 843 bp, Streptomyces avermitilis
  CDS (1)..(843)
atgtctgcggaatcggccagaacggtcgcactcccctccggtgaggaggtcgcggcgctcgggcagggcacctggtacctgggcgaggacccggcccggcgtgaacaggagatcgccgcgctgcggctgggcgtggacctgggcatgaccgtcgtcgacacggcggagatgtacggcgacggcgcggccgaggagctcgtcggggaggccctttggggacgccgggaggaggtcttcctcgtcagcaaggtgctgcccggccacgccgaccggaagggcaccgtcgccgcctgcgagggcagcctgcggcggctccgtacggaacggctggacctctacctgctgcactggaagggacggtggccactcgaggagacccttgcgggattcaccgacctgatggaggcggagaagatccgttactggggcgtgagcaatctggacgtcgccgacatggccgagctgaccaccctccccggcggcgacgccgtgaccgtcgaccaggtgctgtacaacctctcccggcgcggcatcgagtgggatctgctcccctggtgccgcgaggccggggtgacggtcatggcctactccccgatcgagcaggggcgactcctgaaggtcgaggccttgggtgccgtggcccgggccctcggagccacgccgacccaggtggcgctcgcctggatgctggaacagggggtggccgcgatcccgcgttccggatcacccgaccacgttcgggagaaccgcggcgcggtggacctcaaccttcccaccgaggcgctcgacgccctcgacgaggcgttcccgccacccagcgggcccacgcccctggaggtgctc

SEQ ID NO: 7213 - DNA, 1191 bp, Streptomyces avermitilis
  CDS (1)..(1191)
gtggcggtggccttcaccgtgctgatggccttcggcaccgcgccgaccccgctgtggccgctgtacgaggcccgggaccacttcggcgcgaccacggtcacggtggcgtacgcctcgatggtcgtgggtgcggcggccgccttcctcggactgggacacctgtcggaccggctcggccggcggcgcatcatcgtcccggcgctgctggtcggcatcgtcgcgtcggtcgtactgatcgtgtggcgagacctgccggggctgatcgcgggcaggatcctgaacggtgtcggactggggctgatggcctcgaccgcgacgacgtacctgcacgacctccaccacgaggcccgtccggaacggacgggttcggtgctgcccggcatcgtggccaccgccgccaacctcggcggtctggcctcagggcccctggtcgccggagccgccgccgagtggcttcccacgcccctgatcaccacccaggcgatcttcacgctcgccatggcggtgtgcctggcgctggtgctgtccaccccggagaccgtggacctggagctgcccgcggccgaaccgcccagcaggttcgtcctgcgccccggcggctggcgggcgttcggcgcggccggcgcgctgggcgccttcgccttcgcgatcctcggcctgatctcctccctcggggcgagcgtgcttcacggcaccctgcacaccgactcgcacctcgtggtcggcctggcggccttcctcatgttcggttccgcggcggccgcccagctggtgctgggccgcctcccactgccccgggtcctgaccgtgggggcggtggtcttcccggtcggcctggtcctgtgcgccgtcgccctctaccacccggcgctctggctctacctggtcgccgtgtccctgtcgggagccggctccgggctgctgttcaagggaggcctcgaacgtgccgtttcagtggccgagcccgcctcacgcgccggggtcctcgccgtgttcttcgtcgtcgcgtacctcggaatgggcctaccctccgtcctgttcagcatcgccctgcggcatttcgccgtacagaccgcgatgatcggcttcgcggcggtcctctcctgtggcgccgttgtgtcggtcgccgtcgcgttgcgcgaccgcgcacccggtcccggcacgctctcggcgcagtccgctcgcccctcc

SEQ ID NO: 7214 - DNA, 888 bp, Streptomyces avermitilis
  CDS (1)..(888)
gtggagctacgtcagctggagcacttcatcgcggtcgccgaggagctgagtttcacgcgtgccgcccgtcggctgcacgtggtgcagtccggggtgtccgccgcgatccgctccctggagcgcgagctcggttgcgcgctgttcgagcgcacgtcgcagcaggtccggctcaccggggcgggcgcggcgctgctgccggaggctcgggccaccctgcacgccgcccaggcggcccaggacgccgtgcgcgccgcacaggacacgctgcgcggcacggtgaatgtgggcgccatggcctcggtcgaggtggtggacctgcctgcgcttctcgggcagctgcacgcgcggcatccggcgatcgacgtccggctgcggctggcgacgaccggatcggcgggactggcgcacgcactgctcagcggggacctggacgtggccttcctgtcgctgcccgagcacaaacccgccgggatcgacgcacgggagctggccaccgtgccgctcgtcctggtggtgagcgccgaccatccgctcgcccagcggggggaggtggcactcgcggacctcgcggcggagcccttcgtggacttcccgccgggctacggcaaccgcgaggtggtcgaccgggcgttcgcgggggcgggcgtcgtacgccgggtggcactggaagtgcccgacatcgacatgggggcggcactggtccggcacggtctgggcatcgccttcctgcccgcgttcgccgttgcccgcacccccggcctgcacgtcctggacgtccacggcaccatgctccgctggagcatgcatctcggcacgtcgtcgacccggcggcccagctcggccctgcgggcgctgctcgacctggtcgacctccacgtcatcgccctg

SEQ ID NO: 7215 - DNA, 1779 bp, Streptomyces avermitilis
  CDS (1)..(1779)
atggccagcagccgggcgcacaacctgtaccgccgctgctccgaccgggagagcagccttccgcggggcagcgccgggcggcaccacacagccgcgcggagagggccccgcccacccgctccaaccctggccgatcatgccctccgcgacctgacggtgctctcccgcgccctgctcgacaccccggacgaaggcgagatcctgcgcctggccatggagcacatagccgccgcggggccatacagcgccgaggccggatacctcaaggtggacggcgacctggtccccagcccgaggaaccggcagacgcatgcctcggccgtgaaccggagggtgcgggagctggccgggcaggacggtgctgtgaccgtacccggcaggccctggggccgggccctggggctacgcggacttgagggactccacggctacctcgtggtgacgtcccgctcccggcccaccgaggccgagcgctccctgctcgccacactcgtccggcacaccgctgccgcactgtcggtcgccttcgcataccgacaccaacgcgaggacgcgcttgagctgcaccgactgagggacgaacgcacagccctccagcggcagctgatctccgtcgtggccgagctgaggtaccagcgggccgttcacgcgctcatggccgacgtcactgcctcgagcggcggcgaggaagccatcacccgcgtgctgcacaagctcactggatttcccgcgctggtcgaggaccgcttcggtcggctgaggtcctggaccggccccagccgccccgacccctatcccgagcctgaccccgtgcgccgggacgaaatgctgcacgccgtcgcccgtcaggccgggccggtgcgaataaaggaccggctgatcaccctggtccgcccgcacggcgagatcctgggcgtgctggccctggtcgatgcccgggacgaggccgacgagcacgccgtgctcgcgctggaacacgccgccgcgtcgctcgccccggagctggcgcacctgcgcaatctggccgaggtggagctgaggctgcaccgcgggctggtcgacgacctcctggcagggacggacgaggggagcgcctacgcccggtccgaggcagtcggacacgacctgcaccgcagccactacatcgtcgtggtgcagtggccgaaccggactgcggacgattccttcgcgcagaccgtggggcgggcggcctctgccgtgggcatgcgctcgctgctgacccgacgttccgaccacgtggtcctggtcgccgacgccaggccgcacgcccgcgcgttgtacgaggcgctcgcccgggagaccgggacacggtccgggacgatcggggtgagcgccccttgcgactccccggacgacatcccccaccactaccaagaagcgcagcgcgccctggaagtgcgccttcactcccgcgagcactacggcacgacgttcttcgacgagctcggcctctaccgcatcctggggcctggcaacgattaccgggaactggagacgttcgtccaggagtggctggggcagctcatcgactacgactcccggcaccacacggccatggtggagaccctgtcccggtacttcgactgcggcggcaactacgacgagaccgcggactccctcgcgatccaccgcagcacgctgcgctatcggctccagcgcatccgcgacatcagcggcaacgacctcgcgaacgtcgaggaccggctgaacctccaggtggcgacccgagtgtggaagatcgtgctgggcggccccggc

SEQ ID NO: 7216 - DNA, 1899 bp, Streptomyces avermitilis
  CDS (1)..(1899)
atggccaaggcagtgggcatcgacctgggcaccaccaactcggtgatcgccgtgtgggagggcggcgagccgtccgtcgtacccaacagcgagggcaaccgcacgacaccgtccgtggtggccttcaccgacaccggggaacgcctggtgggccagctggcccggcgccaggcgatcctcaacccgaagggcaccatctactcggccaagcggttcatcggccggcacttcgacgagatctccgacgaggccagggcggtgacgtacgacgtcgtcgagggcgacggcggggcggcccgcttcaaggtgcgcgacaagctgtacgcgcctgaggagatcagcgcacaggtgctgcgcaaactcgccgacgacgcctccaagcagctcggggagcgggtcacggaggcggtcatcacggtgcccgcctacttcaacgacgctcagcgcaccgccaccaaggacgccggacggatcgcgggactggaggtgctgcggatcatcaacgagccgacggcggccgccctcgcgtacggcatggacaagaaggagcacgagaccgtcctcgtcttcgacctgggcggcggcaccttcgacgtgagcatcctcgacgtcggcgacggcgtggtggaggtgcgctccaccgccggcgacagccacctgggcggcgacgacttcgaccgccgtctggtggattacctcgcggacgacttccagcaggagaacggcatcgacctgcgcaaggacccgcaggcgctgcaacgactgttcgaggcggcggagaaggccaagaccgagctcagttcggtgacgcagacgcaggtcagcctgccgttcatcaccgccgacgcctcgggccccaagcacctcaccgacacggtcatgcggtccacgttcgagcagatcaccagcgacctggtggagcgttgcctgggaccggtccagcaggcgatggccgacgccaaggtcggcgagagcgacatcgacgaggtcatcctcgtaggcggttccacacgtatcccggcggtgcaggctctggtccgccgactgaccggcggcaaggacccgaacatgagcgtcaaccccgacgaggtcgtcgccctgggcgccgcgatccaggccggggtgctcaagggcgaggtcaaggacgtcctgctgctcgacgtcacacccttgtcgctgggcgtggagacgcgcggtggagtgatgacgaagatcatcgagcggaacaccaccatcccggtgcgtcgcagcgagaccttctccaccgccgaggacaatcagccggccgtcgatgtggtggtcctccagggcgagcgcgagcgggccgccgacaaccgggtgctgggccggttccagctcaccgacatccggccggcgccgcggggcgaaccgcaggtcgaggtcaccttcgacatcgacgccaacggcatcctcaacgtcaccgcacgggacaaggacaccggcaaggaacagggcatcaccatcagcgagagctccaacctggaccgcagcgaggtcgaacgcatggtccaggaggccgagcgcaaccagggccaggaccaggcactccgcgaggccgtcgacgcccgcaacgaactcgacgccgtcgcgtaccaggtcgagaagcgcctcgccgaactgggcgacgcggcgcccgcgcacgagaaggcacgcgccgagatgctcgtgtccgacgcccgggcggcggtcaaggaagaggcgggcgtggagcgcgtgcggcccctgacctccgaactccagcaggtgctcgccggactggcggcccatcagggcgccgccaccgcggatggcggtcccgcccagcacgccgccaccggtggtcccacgagcggcggtggcggtggcgacgatgtcatcgacgccgagttcgacaagggc

SEQ ID NO: 7217 - DNA, 609 bp, Streptomyces avermitilis
  CDS (1)..(609)
atgcccacccgcccccaggaacccgaccgggccgcgtcggatccggtcgaaccggtcccggaaggtgccggacgccctcctcgcggtgatttgccgcaacccggcccgccggcccggccggaagcgacgaacggcgaaccgggacccgacgccgccggccccgcgcctgccgaggacgagtacacgaccgcgatccaggaactggaggaccgctggcggcgcacactcgccgacctcgacaacctgcgcaagcgccacgccagggaactggagcgcgaacgggcggtcgagcggtcccgcacggcggccgccttcctgcccgtcctcgacaacctcgaactcgccctgacccatgccggcgccgatccgggcgcgatcgtggagggtatccgggccgtacgcgaccaggcggtgaacgtcctcgaactgctcggctacccgcggcacgcggagaccggcgtcgccttcgacccggcccggcacgaggtggtcggcgtcgtccaggacccagacgccccaccgggcacggtcgtcgaggtgctgcgccccggctacggggacggggagcggcagctcaggccggccgcggtgaccgtcacgaagcgggag

SEQ ID NO: 7218 - DNA, 951 bp, Streptomyces avermitilis
  CDS (1)..(951)
atggcacgggactactacgaggtgctgggcgtgtcgcggagcgcgagccaggacgagatccagcaggcatatcgcaaactcgcccgcaggcaccaccccgacgtcaacaaggaccccggggcggaagagcgtttcaaggacctcaacgaggcatacagcgtcctgtccgatcccaagacccgagcccgctacgaccgcttcggcgaggacttccgcaagatccccgaggacttcgacgaacgggtcgcggccggagcgggcggcggcttccgcggtcggaggaccgcaggcgggggcggtcctcgtgtccggtacgcccccggcttcggcgacgacttcggagcggagggcatcgacatcgaggacctgttcggctccatgttcggagccggcgccgcccggggcggcgtccccggagcggaccaggaggccgaactgccgctcaccgtcgaggaggcgtaccgaggcggccgtcgcaccgtcacgctcgccggtcccgacgggcagccgcggcggtacgaggtcgacgtgccgccgggcgtcaccgacgggcagcgcatccggctggcgggcgagggcggccggggcagtggtgacgccgccgcgggcgacctgtacctgcgagtgcgtatccagccccacccccggttccggctggacggccgcgacgtgcacgtccaggttccggtcgccccctgggaggcggccctgggcgcgaccgtgccggtgcccacgcccggcggcggcacggccaaggtcacggtgcccgcgggctcgtccagcggccggcggctgcggctgcgcggcgagggcatgccgaacccgcgcggcgcgaacggcgacctgtacgccgaactccgcatcgtggtgccacccaccctcggcgaccaggagcgcgaactgttcgaggagctcgccgccacttcctcgttcgaccccaggaggacgcga

SEQ ID NO: 7219 - DNA, 405 bp, Streptomyces avermitilis
  CDS (1)..(405)
atgaacgaccgacccgcgggagcggcaggcatcggccgggccggcgtgggcgaccgtccgggacgaacgggcgccgacctcaccgcctcgacggctgtccggtacgcgctcgtgcccgcccccaggctctccctggaggccgtggcccgtcgctcgggcctccaccccgatctgatccgccggttcgtcgccctcggcctgatcgacgccgaacgcgacgccgcggggcgcctggtgttcgaccccacggccccggcggtccttgcccgcatccagcggctgcgcaccggactctgcctcaactacgcatccatcggcctggtgctcgacctgctcgaccgcatcagcctgctcgaagccgccctgcgcggccgcggcacgaggagtgaaacacccccatggaca

SEQ ID NO: 7220 - DNA, 2637 bp, Streptomyces avermitilis
  CDS (1)..(2637)
atggacatgaaccgtctcacccagaagtcccaggaagccctccaggaggcccagaccgcggccggccgcatggggcacaccgaggtcgacggggaacacctgctgctcgcacttctcgatcaggaggacggtctgatcccgcggttgctgcaacaggccggcaccgagccgaaggaactgcgcgcggccgtgcgcgaggaactctcccaccgcccgaaggcgaccggccccggcgcggcacccggccaggtcttcgtcacccagcgcctcgcccggctgctcgacgccgccgagcgggaggccaaacgcctcaaggacgagtacgtgtccgtggagcacctcctgctcgcgctggctgaggagagctcttcgaccgccgccgggctactgctcaaacaggccggcatcaccagggactcgttcctgagcgcgctcacccaggtccgcggcaaccagcgggtcacctccgccaaccccgaagtggcctacgaggctctggagaagtacggccgcgacctggtcctcgaggctcggtccgggcggctggacccggtcatcggccgggacgcggagatccgccgcgtgacccagatcctcagccgcaagaccaagaacaaccccgtcctcatcggcgaccccggcgtcggcaagaccgccatcgtcgagggcctggcccagcgcatcgttcgcggcgacgtccccgagggcctgcgcgacaagacggtgttcgccctcgacatgggctccctggtcgccggcgccaagtaccgcggggagttcgaggaacgcctcaaggccgtgctcagcgaggtcaaggccgccgaggggcggatcctgctcttcgtcgacgaactccacaccgtcgtaggagcgggcgccgcggaaggggccatggacgcgggcaacatgctcaagccgatgctcgcccgcggcgaactccacatgatcggcgccaccaccctcgacgagtaccgcaagcacatcgagaaggacgccgccctcgaacgccgcttccagcaggtcctggtcgacgagccgagcgtggaggacaccatctccatcctgcgcggactgcgcgaacgcctcgaggtcttccacggcgtgaagatccaggacaccgcgctggtctccgcggccaccctcagccaccgctacatcaccgatcggttcctgcccgacaaggccatcgacctcgtcgacgaggcgtgcgcccggctgcgtaccgagatcgactcgatgcccgcggaactcgacgagatcacccgccgcgtcacccgcctggagatcgaggaagcggccctgtccaaggagagcgaccccgccagcaagacccgcctggaggagctgcgcagggaactggccgacctgcgcggcgaggccgacgccaaacacgcccagtgggaggccgaacggcaggcgatccgccgcgtgcaggaactgcgccaggaactggagcaggtccgccacgaggcggaggaggccgaacgcgcctacgacctcaaccgcgccgccgaactccgctacggccgcctccaggacctggagcgccgactcgccgcggaggaggagcaactggccgccaagcaaggggagaaccggctgctgcgcgaggtcgtcaccgaggaggagatcgccgagatcgtcgccgcctggaccggcatccccgtcgcccgcctccaggagggcgaacgcgagaaactgctgcgcctcgacgagatcctgcgcgagcgcgtcatcggccaggacgaagccgtcaaactcgtcaccgacgccatcatccgcgcccgctccggcatccgcgaccctcgccgccccatcggctcgttcatcttcctcggccccaccggcgtcgggaagaccgagctggccaagaccctcgcccggactctgttcgactccgaggagaacatggtccgcctcgacatgagcgaataccaggagcggcacaccgtcagccggctcatgggcgcaccgcccggatacgtcggctacgaggaaggcggccagctcaccgaggccgtacgccgcaagccgtactcggtcgtgctgttcgacgagatcgagaaggcgcacaccgatgtcttcaacaccctgctgcagatcctcgacgacggccgcatcaccgacgcccagggccgcaccgtcgacttccgcaacaccgtgatcatcatgacgtccaacatcggctccgagcaccttctcgacggcgccaccgccgaaggtgagatcaagcccgacgcccgcgccctggtgatgggcgagctgcgcgggcacttccgcccggagttcctcaaccgcgtcgacgacatcgtgctgttcaaaccgctgggtgagcggcagatcgagcggatcgtggaactgcagttcgacgagctgcggcagcggctcgccgaacgccgcatcaccgtcgaactcaccgacgccggccgggaagtgatcgcccaccagggctacgacccggtgtacggggcccggccgctgcgccgctacatctcccacgaggtcgagacactggtcggacgcgccctgctgcgcggcgacgtccaggacggcgcgacggtccgcgtcgacgccgagcacggagagctggtggtcacctacgaccagcccgaggacgtgaagggagcgtgggcggca

SEQ ID NO: 7221 - DNA, 453 bp, Streptomyces avermitilis
  CDS (1)..(453)
gtgggcggcatgagcacgatgcaggcgacgaccgtcagttgtccgaactgcgggcgcaccaaccgggtgcccgtggccgcggagggccgccccaagtgcggccactgcaagcagcccctaccgtggatggtggacgcgagcgacgacgacttcaccgaggtcgccgagcgggccgacgtccccgtcgtggtcgacctgtgggccacctggtgcggcccctgccgcatggtcagccccgcgctggagaaggtcgccaccgatctcgccggccgcatcaaactcgtcaaggtcgacatcgacaagaatccgcggctgtcgcggcgtttcgaggtccaggcggtaccgacactgctcgtcctcgatcagggcgagacggtcgcccggcaggcgggggcggcgcccgcccccgtcctgcgccagtgggtggaacagtcgatcacggcccgggaaggg

SEQ ID NO: 7222 - DNA, 1848 bp, Streptomyces avermitilis
  CDS (1)..(1848)
ttggcgctggtgctacgtccacgaggcgttcgtctgatgtccggcgaccagccgctgccgggcgaagaaccggtgccggaggaagcggacgaggccgtcttcttggagaccccggacatctacggcgcgtatccgcgccttacggaggaccagatagcacgtctggcggagcacgggcaacgccggagcatggctccgaacgacgtgctgatccgggagggggagcgctgcgagacgctcttcgtcgtgctcagcggttccgtcgccgtcgtcgaggaccacggcactcccgaggaacacgtgctgcgcgtgcacggccccggtcgcttcatcggcgaactcgggctgctgtacggacaggtggccttctacaccgctgtcgccagggagccgggcgaggtcctcgtcgtctccttggaccagttgcgccgcctggtgtcccaggactccaccctcggggacctcgtgctgcgcgcctgtctgggccgtcgcgcgttgctcgtcggacagggcgccggcttccgcatcatcggctcgcgctactcgcccgacacccggcggctgcgcgagttcgccgtccgcaaccggctgccccaccgctggatcgacctggagaccgacgaggaggccgaggacctgctgcgccgcttcggcgtcggcccggaggagacaccgctcgtcatctggcgggacaccaccctgttgcgcaaccccagcaacgcggaactggcccggctcatcggcctgccgtcactccccgccggaaaccgtcacggcgacgtcctcatcgtcggctccggacccggcggcctcgctgccgcggtgtacgccgcctccgagggcctgagcaccaccgtggtggaggcgatggccaccggcggccaggccggcacgtcgtcccgcatcgagaatctgctcggcttccccgccggcatctcaggcgccgaactcaccgaacgggccgtgctccaggccgacaagttcggcgccaggatcagcattccggtggaggcgagcggtctccatcccaaggacgaggaccactacgtggtggcgttcgccgacggcagcgagatcgccgcccgcgccgtcgtcctggccacgggtgcccgctaccgccggctccaggtgcccggcatcgaacgcctggagggaacgagcgtccactactcggcgaccgtctacgaggcccagcagtgccgcaccgacccggtggccgtcgtcggcggaggcaactcggcgggccaggcggtgctgttcctcgccgggtacgcgccgaaggtgcacctgctggtccgcggacccagccttgaggccaacatgtcccgctacctggtcgaccaggtagagcgccatccgcgggtggaggtcatgctgcacaccgaggtcaccgaggtcatcggccaggaggtgctggaggagctcgacgtggtcgacaaccgcacgggcgggcaccgccgactcgcggtacggggcctgttcgtcttcaccggcgccgacccccacaccgagtggctcgccggcatcatcgccctcgactcccgtggcttcgtcctcaccggcccggaggcccaggaagcctgcgcccaccccgaggtgtggcacggccgcgggcgctcgtgcatgaccctggagaccagcctgcccggggtcttcgcggtaggggacgtccgtagcggctcggtgaagcgggtggcctcggcggccggtgagggcgcgatggccatccacttcgtgcaccggcacctggggcactcggccgcacccggtcccacgggcacgtccgctgccgcgggcggctcggacgtctccccacgcatacgtcacaaggagtccgcatggctcgca

SEQ ID NO: 7223 - DNA, 360 bp, Streptomyces avermitilis
  CDS (1)..(360)
atgaggtcacgcccacccctctcgatcccctggtcgagctcgacgaactgcaaggacatcgccgtcgaggccaacggtcccgaactcgtggtcaccggagacatcaaggagcgggagcgcaagggcgtcctgcccggcagcacccgccacgtcggagccttcgagtaccgcttgcggctgcccggagagttggccacccacaagatcaaggccgacatgcaggacggagtgctcggcatcaccgtccccaagggcgaagccgccgggccccgccgggtccagatcagtgagtccggcgagggcgcgcgcgaagacgccgcccggagcggcgcagcggcgggcggcgggaccaccgccgcc

SEQ ID NO: 7224 - DNA, 417 bp, Streptomyces avermitilis
  CDS (1)..(417)
atgctgcgtaccatgttcaagtccaagatccaccgagccaccgtcacccaggccgacctgcactacgtcggatccgtcaccatcgacgccgatcttctggacgccgccgatctgctgcccggcgagttggttcatatcgtcgacatcaccaacggtgcccgcctggagacgtacgtcatcgagggcgagcgtggctccggagtcgtcgggatcaacggggcggcggcccatctcgtccaccccggcgacctggtgatcatcatcagctacgctcaggtttccgacgccgaggcgagggcactgcggccgagggtcgtgcacgtggaccgcgacaaccgcgtcgtggccctgggcgcggacccggccgagccggtaccgggctcggaccaggcgcgcagcccgcaggccgtcaccgcc

SEQ ID NO: 7225 - DNA, 342 bp, Streptomyces avermitilis
  CDS (1)..(342)
atgagcgacatcgagatccgcgacgaccggacggcgggccgtctcgaggcgtacgccggggacgaagtggtgggccacatcgagtacttcgtcctggagacgccgcggcgcgcgctcgtcccggtccacaccatcgtggagccggcgcacgagggccagggcatcgcgggctccctcgcccgtgagctgtacggcatcgccgcccgcgagagcgtcgtggtggctcccctgtgcccgtacgtcgtgaagtgggcggcgcgccaccccgaggaggcgccggccgcggatccggagctcctggcggcggcgaaggcgtggctcgtggcgcaccccggacggttc

SEQ ID NO: 7226 - DNA, 738 bp, Streptomyces avermitilis
  CDS (1)..(738)
gtggctcgtggcgcaccccggacggttctgatgacgtcgcggggcggcgtgggggcgccgcacgccacgctcgccctgctgcacacgtcccccgcccacgtccccgtgttcgacgcgctgcgcgacgaggggcacccggggctggaactgacccacttggtggccggggaactgctcgcccgcgcccgtgccgaaggccccgaagccgtggccggcgaggtgagggcggcgctggacagggcggtcgcggccggagcgggcgccgtgctgtgcacctgctcgaccatcggagcggtcgccgaggcggccatcgccgacgtgcccgtactccgggtggaccgcccgatggcggccgcggcggtggcggccggcccgcggatcgtcgtggtcgccacggtggagagcaccttggagccgacggtcgccctggtcgaggaggaggccgccgggcgccccgtcgacctccggaccctgctcgtggccgacgcctgggcccgcttcgaggcgggcgacaccgtcggctacgtccgtgcggtggccgaggcggccgacacggtcgccgacgccgacgcgatcgtcctcgcccaggcctccatggccccggcccagcacctgaccacgaccaccgtcccggtcctgtcgagcccccggccgggcctcgccgcgggggcggccgcggcgcgctcgggtcagggcccgtcccaggcccacctgggcccgcgtcgtcgcgcgacaggg

SEQ ID NO: 7227 - DNA, 219 bp, Streptomyces avermitilis
  CDS (1)..(219)
atgacccatccgcaccccgatcccgtaccgccgggtcccacccccggaccgggacccggacccggcccggcgccgttccccgaccccagcccgctgccgacccccactccggacccggccccgagcccggagccgtctccgatcccggagccgtccccgatcccgaagccgccgggcccggacccggtgccggagcccgaaccggggccgccgctctcc

SEQ ID NO: 7228 - DNA, 1437 bp, Streptomyces avermitilis
  CDS (1)..(1437)
atgagcacaacagcccagatcggcgtcactggtctcgcggtcatgggccgcaacctcgcccgcaacttcgcgcgcaacggctatacggtcgcggtgcacaaccggaccgcgtcgcggacgcgtgacctcgtggaggagttcggccacgagggcgacttcgtgccggccgagaccgcgaaggacttcgtggcggcgctggagcggcccaggcgcctggtgatcatggtgaaggcgggcgcgcccaccgacgcggtgatcgaggagttcgccccgctcctggagcccggcgacatgatcatcgacggtggcaacgcacacttcgcggacacccggcgccgggagcgcgagctgcgcgagcaggacatccacttcgtcggcaccggcatctccggcggcgaggagggcgcgctgcacgggccgagcatcatgccgggcggctcgcccgagtcgtacgactccctcgggcccatgctggagaagatctccgcgaaggcggccgacggggcgccgtgcgtgacgcacgtcggtccggacggtgccgggcacttcgtgaagatggtgcacaacggcatcgagtacgcggacatgcagctgatcggcgaggcgtaccagctgctgcgcgacgtcgccggctacacgcccgcgcagatcgcggacatcttccggacctggaacacgggccgcctcgactcctacctgatcgagatcacggcggaggtcctgtcccacgtggacgcggcgaccggcaagccgttcgtggacgtggtccaggaccaggcggaacagaagggcacgggccgctggacggtccagatcgcgctcgacctgggcgtgccggtgtcgggcatcgcggaggccgtgttcgcccgctccctgtccggccaccaggagctgcgggaggcctcgcgcgggctggccgggccgaaggcggctccgctcggcgagtcggaggcggcggccttcgccgaccgcgtcgagcaggcgctgtacgcctcgaagatcgtctcgtacacgcagggcttccacgagatcgcggcgggcagcgacgagtacgactggaacatcgacctggggaagatcgcgtcgatctggcggggcgggtgcatcatccgcgccgccttcctggaccgcatccgggaggcgtacgacgcgcgtgcggacctgccgagcctgctgtccgacgacacgttcgcgcaggagatcgcggcggcgcaggacgactggcgcgaggtgctgatcgcggcgacccgccagggcgtaccgaccccggggttcgccgcggccctcgcctactacgacgccctgcgcgccgagcgcctgcccgccgccctcacccaggggcagcgggacttcttcggggcgcacacctatcgccgcacggaccgggagggctcgttccacacgctgtggggcggggaccggtcggaggtcaccgcg

SEQ ID NO: 7229 - DNA, 1191 bp, Streptomyces avermitilis
  CDS (1)..(1191)
atgtctagggggtcccccatggccgtacgcggccggcaccgccggtatcagccgaacaggatcaaccgcgcctcgctcaccgtcacggcgggcggagcgggcatggcgattccgctcatgggcaccggcgtcgcccacgccgccgatgcggacacctggaacaaggtcgcggcctgcgaatccagcgacaactggagcatcaacaccggaaacggctactacggaggacttcagttcacgcagtccacgtgggaggcgtacggcggcaaggtctacgcgcagcgcgcggatctggccaccagggaccagcagatcgccgtggccgagaaggtcctcgaggggcagggcccgggcgcctggccggtgtgctcggtccgcgcgggcctcacccggggcggcggcacgccggacatcgacccgtccggcagcgcgacacacacggcggaccggagcaccaagcggaccgtccgtgatgtgaagccacagacgacaccgcagtcgcaggcgggcaccgccgagatgtacaccgtcctgcacggcgacacgctctccgggatcgccgactcccggcacgtccggggcggttgggagcagctctacgccgccaaccgggggaccatcggcgccgacccggacctgatccttccgggccagcggctgcatctgcgcgccaaggccacgacccgcaccgacgacgcctccacgtcgacccacaagtcgtcgacgtcctcctccaagtcctcgacggagaaggcgtcctcggacaggaccgagaaggcgaccacgagccactccctcgtcgccccggtgaacgccgggacggggacgcaataccatgcggcgggttcgtcctggtcgaagggctatcacaccggcgtcgacttccccgtgcccacgggcacctccgtgaaggcggtcgcggcggggcacgtcgtcagcgccggctggggcggctccttcggctaccaggtggtgctccggcacgccgacggccgttacacgcagtacgcccatctgtcggccatctccgtgaaggccgggcagagcgtgacggccgaccagcgtatcggccgctcggggtccacgggcaacagcacgggcccgcatctgcacttcgaggtgcggacggggcccggcttcggcagtgacgtcgatccggtcgcctatctgagggcgggcggcgtcaggatc

SEQ ID NO: 7230 - DNA, 1125 bp, Streptomyces avermitilis
  CDS (1)..(1125)
atgagcgccctcgcgttgtccgtgctgctgtcactcgtctccgccgtcgcgtacgcgggcggggcgatcgtgcaggagcgggtcgcggcgacgacgccggaccggccctacgcaccgctgcgccacctcctgtggtgggcggcggtgggtctcaacggcctgggcgcgctgctgcacgtggtggcgctggcctgcggcccgctcagcctggtgcagccgctgggcgcgctgaccatcgtcttcgcgctccccatggcggccctcttcgtgcgccgcaaggccggggcgaccgcctggcgcggcgcgctcatggcgacggtgggcctggccggcctgctctcactgaccggcacggccgactcgcagaccctggacaccacgcagcgggtgctggtggccgtggtcagcggtggcgcgatcgtcgcgctgatgacggcggctcgtgccgtgcaccggcacccggtggtgcgcagcgtgctgctcgcgagtgcggccggtgtggccttcggcatcgcctcggtgttcacgaagaccgtcgcggtggactgggaggacggcgtcgcgctcgcctcgctgcccaccctggccgtgatagccgtcctcgccgccgcgggcctgctcctctcgcaggcctcctaccgcggcgcgggactggcggcccccctggccacggtgacggtcgtcaaccccgtcgtggccgcggcggtgggcctgacgatgttcggcgaaaccttccgctacggcaccacgggcaccctgctcgcgctcggctgcggcgtcgtcgcggcgggcggtctgatcctgctgacgacggagcggatcggacgcgagcagcgcgcggcgaccgtgtccgccgacgccacccacgcaccggcggccgcctccggaccgtcccccgccgaggagctgctcgccgggcttccgccccagccgggcgcctcgagcgcccaggacgtccacgaaccggagccggtccggatgccgcccgaggagagcggctacgacgacgacctggcgccgtccgacgccgccgcgacgccgctcacgtacgcctccttctacggcggcccgtacgtaccactgcccgtcctgccccgccaccgcgcccgcgaccgcgtcagatcc

SEQ ID NO: 7231 - DNA, 723 bp, Streptomyces avermitilis
  CDS (1)..(723)
ttggtactactgctcttcgtggacctcgaccccgatctcaccgcactcgacgccctcggcggcttcttcgtactacgcaccgaggcgccgccgcgcggcccgctgccgacgctcgcacaggcgtacgcgggacaacacgtggatgtttacggagatccgctgattttccgggttcgaaaagtcaccgaaagtcttcgggcgcccgagccgcggatcgcggtctccgtggcccagcaggcactcgcggcccggctgtggtcgatcgctctcggctgcgccgccctgtacgaccaggttcccgacctcgatccccggctcctgcggtgggatccggacgccagcgctccggacgatctgtggctctccgaggtgcgcccccggcccgccacggcgatcggcgacctcgtacgagagggccacctcgccccgctgatcacggccctgcggcggcagcagcacgtgtccgcacgcctcttgtggggcaacgcggcctccgcgctggccggcgcgctccgccagctcaaccgctgggcacacgcgggcggccgcgacgaggtggccgaccgggcccgcgccttcgccgccgcgtccctcgcgcaccccgacctgtccggcaccctcgacccggccaccctccgccgccgcagctgctgcctctactaccggctgcccggcggcggtctgtgcggcgactgctgtttcgaccggccgccgcgccactcc

SEQ ID NO: 7232 - DNA, 1149 bp, Streptomyces avermitilis
  CDS (1)..(1149)
gtgcgagtgggactgctgacccgggagtacccgccggacgtgtacggcggcgcgggcgtccatgtcgagttcctcgcacgggagttgcgctccctcaccgacctggctgtgcactgctggggcgagggcggcgcgggcggagtcgtacgccaccggccctggaccgccctcgacggcgccaacgacgcgctgcgcaccttctccgtggacctctccatcgccgccgccctcgaaggccgcgaactcgtccactcgcacacctggtacgcccatctcgccggccacctcggcaagctgctgcacggcatcccgcatgtgatgaccgcccactcgctggagccgctgcgtccctggaaggccgagcagctcggcggcggatacgccctctccggctgggccgagcgcaccgcgatcgaggccgccgacgcggtgatcgcggtgtccggcgccatgcgcgaggacatcctcacctgctatccgacgctcgacccggcgaaggtgcgcgtggtgcacaacggcatcgacaccaccctctaccggccggaccacggcaccgacgtgctcgcccgcatcggcctcgacgccgaccgcccgttcgtcctgttcgtcggccgcatcacccgccagaagggcgtgccccaactgctgcgcgccgtgcgggacatcgacgcctcggcgcaggtcgtgctgtgcgcgggcgcccccgacacccccgagatcgaccaggagttccgtgacctcttccaggagctgagccgcgtacgcgcgggtgtccactggatcccgcagatgctgccgcgcccggatgtgatccaactcctcacgcacgccgccgtgttcgtgtgtccctcggtgtacgagccgctcggcatcgtcaacctggaggcgatggcgtgcggtaccgccgtcgtcgcgtcgcgggtcggcggcatccccgaggtggtggacgacggacgcaccggcgtactcgtccccgtggacgaagacttcgaggcgtcactcgcgcacgccctcgactccgtgctcggcgacccggaggccgcccggcgcatgggcgaggccgggcgggagcgtgcggtgcgggagttcggctgggacgcggtcgcgagacgcacggttcacctgtacgaggaagtcctcaaacagggg

SEQ ID NO: 7233 - DNA, 1218 bp, Streptomyces avermitilis
  CDS (1)..(1218)
atgcggcgcggaggaccttcggtgctgggaatcgtactcgcgggcggcgagggcaaacggctgatgccgctcaccgcggaccgggcgaaaccagccgtgaccttcggcggaacgtatcgcctggtggacttcgtcctgtccaatctcgtgaacgcggacatcctgcggatctgtgtgctgacgcagtacaagtcgcactcgctggaccggcacatcaccacgacctggcggatgtcgagtctgctcggcaactacatcaccccggtgccggcgcagcagcggctgggcccccgctggtacctgggcagcgcggacgcgatcttgcagtcgctgaacctcgtgtacgacgaacggccggagtacatcgcggtgttcggcgccgaccacgtctaccgcatggacccgcggcagatgctcggcgagcacatcgagagcggtgcgggggtgacggtggcggggatacgggtcccgcgcgccgagtcgtcgtcgttcggtgtgatcgcccccggctcggacgggcagaccgtggagaacttcctggagaagccggccgatccaccgggtctgccgggcgaccccgagtgcgtgttcgcctcgatgggcaactacgtcttcaccaccaaggtcctgatcgaggcgctccaacgggacgcggaggacggggactccgtgcacgacatgggcggttcgatcctgcccgcgctcaccgaccggggcgaggcacggttgtacgacttcagcgccaaccacgtccccggcgagaccacccgggaccagggctactggcgggacgtggggacgctggacgcgtactacgacgcccacatggacctgatcgccgagcggcccgcgttcaacctcttcaaccgcagctggccgatctacacccactccggacagctgtcgccggcgcggttcaacgccgggggcatcgccagcgagtcgatcatcagcgcgggctgcctgatccggggccaggtcacccggtcggtgctgtcaccgggggtcgtcgtcgacccgggggccgtcgtccagggctccgtgctgcacgacaacgtgcacgtcgggcggggcgcggtggtccgcggagccgtcctggacaagaacgtcgaggtgccgccgggcgcgacgatcggcgtcaacccggggcgggacgccgacctgtacacggtgtccaagggcggcgtgatcgggctgggcaagggacagcgggtgtcg

SEQ ID NO: 7234 - DNA, 2331 bp, Streptomyces avermitilis
  CDS (1)..(2331)
atgagatggaagctgcgcaccgcgggcgggctgacggccctcgccctgctcggcggcgcacttgccgggcccgccgcccgagccgccgagcagggcagcgaccggctcggcgacctggtcaacccgttcatcggcacccagaacgagggcaacacctacccgggcgccgccgtgcctttcggcatggtgcagctctcgccggacaccgggcacaacaccggttacgactacacgcagaaccacatccgcggcttctccctcgtgcatctctccggcgtgggctgccggatcggcggcgacctgccggtgctgccgacgacgggggacgtgaccgagacggactacgcgaagtacgcggccggattcagccacgacagcgagcgggcgagcccgggctactaccgggtgggcctcgacagcggcatcgtcgccgagttgacggcaaccgggcggacgggggtgcagcgctacacctttccggccaccgacaaggcgaacgtcctgctgaacgccggccaggcgctgcacaagaccgtctccaccgacgtcgaggtcctggacgaccggaccgtgcggaccaggatcagtggcagcggcttctgccgggacaccggcccgtacacggtctacacgatcacccggttcgaccggccgttcaccgcgtacggaacgtggcacgggggcacggtcaccgagggctcggcggaatcggccgccggcaccgggcgcaacggtgcctacgcccggttcgacgcgaccgaggaccgcacggtcgaggcgaccaccgcgctgtcgtacgtggacgcgcggggcgccgaggtcaacctccgctcggctgagggccgttcgttcgccgacgtccgggaggccgcccgccgctcctgggaggaccggctcgacgacgtacgggtcaggggcggcagcgacaccctccgccgcaccttctactcgtccctctaccggtccttcctcgcgcccaacatcggcagcgacgccgacggtcgctacaccggctgggaccaccggatccaccgggcgcggggcttcacgtactaccagaactggtccctgtgggacacgtaccgcacccagtgccagctgctcgccctgctcgcgccgcgcgagtcccgcgacatggcgatctccgtactcaagatcgacgaggacggcggctggctgcccaagtggggctacgggacggtcgagacgaacatcatgtccggcgacccggtcaccccgttcctcacgaacgcctaccagcagggcctgctcaaggggtacgaggagcaggcgtaccgggcgctcgcgaagaacgccgacgggttgccgcccgccgcctatccgggggtggggcgcgacgggaaccgggagtacatcgccgacgggttcgtgccctacatcaagggcggcccgcacgccaaacccggcgactccgactacgcccacggcgcctcggcgaccatggagtacgcgctgtccgacgccatgctctcccggatggcgcgcgacctgggacacgacgcggacgcggagcgctatacggcccgctcgcggaactaccgcaccctcttcgacgcttcgacgggcttcttccgggcccgcgacacctccggggcgttcgccggaccggccgaccccgccgacagcgagggcttccacgagggcacggcctggcagtaccagtggctcgtgccgcaggacctgccgggcctggtcgacctgatcggcggcaagcaggcggccaacgaccggctcgacgcgttcttcgcctacgagcagctcctccaggacccggcgcggacggcgcgcgaggtatgggtcgacggtccgtacgagtactacaactccgacaagtacaacccgcagaacgagcccgacctcatcgccccgtacacctacctctcgaccggccagccgtggaagacgaccgacgtggtgcacgccgcgctgaccctcttcaccgacacgccgaccggcatgaccggcaacgacgacctcggcacgatgtccgcctggcacgtcctgtcgtcgatcggcctcttcccggtacagccgggctacgacacctggggcctgtccacgcccgtcttcgagcgggtcgacctcaggctcgaccgcggctactacccacgcggcacgctgacggtgacggcacccggtacctcggaccgtgaccggtacatccagtcggtgcgcgtggacggtgcgtcgcacgatcggacgtatctgacgacccgtgtcttgcgcggcctggaagcgctccacttcgcggtgggagcgcgtccgtcggcgtggggtacggcgccgcatgccgcgccacctgcactgaag

SEQ ID NO: 7235 - DNA, 1341 bp, Streptomyces avermitilis
  CDS (1)..(1341)
ttgacctctgacctgctcgccccactcgacctggcgttctggaacatcgagtccgcccagcacccgatgcacctcggcgccctcggcgtgttctcgtgccactcgcccaccgccggcgcccacgccgccgacctgctcgcctcccgcgccgccgcggtacccgggctgcgcatgcggatccgtgacgtctggcagccgctggccttcccgctgaccttcccgctcccgttcggcggcgcgacccgcgagcccgcccccgacttcgacccgctcgaccacgtacgcctgcacgcgccggccgccgacttccacgccgtcgcgggccggctcatgcagcgcccactggagcgcggccggccaccgtgggaggcgcatgtactgcccggggaggacggcacgtcgttcgccgtgctcttcaagttccaccacgcgctggcggacggactgcgggcgctgatgctcgcggcggcgctcatggaccccatggacatgccgacgccccgcccgcgtccggccgagcccgcgcgggggctcctcccggacgtgcgcaaactgccggagctgctgcgcggcaccctctccgacgtgggccgggccctcgacatcggcgcctccgtcgcccgtgccaccctcggcgcacggtcgtcgtccgcgctcacctccgagcccagcggcacccgccgcaccgcgggcgtcctcatcgacctcgacgcggtgcaccgcgtccgcaagaccgtcggcggcaccgtcaacgacgtactcatcgccatcgtcgcgggcgccctgcgtacctggctggacgagcgcggcgacggcagcgcgggggtcgcgccccgcgccctgatccccgtctccaggcgccgcccgcgcaccgcgcacccacagggcaaccggctctccggttacctgatacggcttccggtcgacgaccccgatccgctcgggcggctgcgcacggtgcgtatggcgatggaccgcaacaaggacgcggggcccaaccggggagcgggcgccgtggcgctgctcgccgaccacgtgccgccgctcggccaccggctgggcgggcccgtggtcggccaggcggcccggctgctcttcgacatcctggtgaccagcgtgccgctgcccagcctcggcctgaaactcggcggcagccccctcacggaggtctatccgttcgcccccctggcccgcgggcagtccctcgcggtcgccgtctcgacgtaccgcggacgcgtccactacgggctcgtcgccgacgccaaggccgtgccggacctcggccggctggcgcgtgcggtgaccgaggagatggagacgctgctcactgtctgcggcccc

SEQ ID NO: 7236 - DNA, 1482 bp, Streptomyces avermitilis
  CDS (1)..(1482)
atgacggtgacagaggacggccccgtgggcatggacgaggtggcagacgcctcctacggtcccggcatcgacccggagcggctggccgtctgcctcggcgtgctcgacgagctggacaagctggaggtcgaccacccggacgcgatcgccgtgcgccgggccaccgcgggcgtctaccgcacggtcaagcagcgccgccgccaggagcgccgagccgccaagaccgcgcacgacaaggcggtcaccgaagccaccgcgaccggctccgcgcagcgcatcgacgacgagaccgagggcatcctgccgtcgtcggtgacggacgagggacagatcgcggggatactccagcgcccgcgctcctgctacatctgcaagagccgctacaccgaggtcgactacttctaccaccagctctgccagggctgcgccgccgagaaccgcgcccgccgcgacgcccgcgccgacctcaccggcaagcgcgcgctgctcaccggtggccgcgccaagatcggcatgtacatcgcgctgcgcctgctgcgcgacggcgcccacaccacgatcaccacgcgcttcccgaacgacgcgatccgccgcttcaaggccatgcccgacagcgacgagtggatcggccgactgaagatcgtcggcatcgacctgcgcgacccggcgcaggtcgtcgcgctcgccgactcggtcgccgccgcgggcccgctcgacatcctgatcaacaacgcggcccagaccgtacgccgctccccgcaggcctacagcgagctgctcggcgccgagtcgggaccgctgccggcgggcgagctgcccccggccgagatcatcggcacgttcggctccggcgccgtggccgccctcccggtggccggcggcggcgcgctgaccgcgcaggacgtcaccgacctcgcgctgatctccggctccgcctccctggagcggatcgcggccggcaccgcgatcgacgcgggcgggctcgtgcccgacctgcacgacaccaacagctggatccagtcggtcgaggaggtcaccccggtcgaactgctcgaggtgcagctctgcaactccacggcaccgttcatcctgatcagccggctgcgcgcggcgatggcggccgcgcaggccaagcgcacgtacatcgtgaacgtctccgcgatggagggcgtgttcaaccgcggctacaagggcgcgggccacccgcacaccaacatggccaaggccgccctgaacatgctcacgcgcaccagcgcccaggagatgttcgagaaggacggcatcctgatgaccgccgtggacaccggctggatcacggacgagcgcccgcacccggacaagatgcgcctcgccgacgcgggcttccacgccccgctggacctcatcgacggcgccgcacgggtatacgatccgattgtgcgcggtgagcagggcgaggacctgtacggcgtcttcatgaaggactacgcgcccgggaagtgg

SEQ ID NO: 7237 - DNA, 309 bp, Streptomyces avermitilis
  CDS (1)..(309)
gtgacctggcgaccgccgggaacccgggctctgtcgagagccgtgcaaggagttcccatggccagtccacacgacacagatccgcacagggtcgacatggacccgcgcagcgtcgacgacccgcgcaacgtctgtccgagcgacgccgacttctacgcgagcgaccgtccggcccaccctttgctgccggaggaccgtccccgcggcggtgggcccgcgacgccgctgaggcatcgcgggacctgggagacggtcgcgctcgtcgccgccgtcatcctggtgatcatggtggggatcgctctgttcccc

SEQ ID NO: 7238 - DNA, 804 bp, Streptomyces avermitilis
  CDS (1)..(804)
atgacgtcgccgtacgggcttgagggcagggtcgccgtcgtcaccggggcctcgcgcgggatcgggcgggccgtggccgaggcgttcgcggcagcgggggcgcacgtgtgcgtcacggcgcgggacgcggacggggtccgtcgggccgccgaggagctgggcggcgtggggctcgcgggttccgtcgccgatccggcgcatccgcgggagctgacggaactggcgctcgccgcgttcggacggctcgacgtcgtggtcaacaacgcggcgaccaacgagccgtacggccccttgatggacgccgacccggaccgctggcgcgaggcgttcacgatcaacgtcgaggccccgttgcggctggtccagtgcgcttggcgggcctggatgggcgagcacggcggagcggtggtgaacatctgcacggagggtgccgggcacgtcggacccaacgtcggcgcgtacgggaccacgaaggcggcgttgctgcacctcacgcgacagctggcgggcgagctggccccgaaggtccgcgtcaactccgtctcccccggcctcgtccgcacggagctggcccgattcgtgtgggagcacggcgaggacgaactggcggccgggcttccgctcggccgcatcggtcaccccgcggacatcgcgcgtgccgtcgtctggctggcctcggacgcggccgaatggatcaccggcgccgatctgctggtcgacggcggtacgcgggtcaggacggcgtactccgcggacgggtacgccgtccaggagcggctgcggtcatacgcaccacctcactcg

SEQ ID NO: 7239 - DNA, 546 bp, Streptomyces avermitilis
  CDS (1)..(546)
atggagctgcgcagcgtcgaggagctgatggatctgctgcacgcctgccggggtgcccgggccacctcgggtctcccccgttcccggcccggctcgggcggcgggccccccgtcggcgacccggtcgatccgcacgagcacgccctgcagaccgccgcgctgctgcgcagaagccgtccggccgacaaagaactccaggtggcgggcctggtgcacgacatcgggcagctgctggaccccggcgacgaggccgggcacgccgaccgcgcggccgacgcgatacgtgcactgctcggcgaccgggtctcccggctcgtccgtctgcgcgccgcggcctgggcggacgactcgctcgacgacgacctggcggcgctgcggcaggcggacgaatcgggccgggtgcccggcctggacgccggcgtcctggaggactggcgcacggtgctggagctggtggcggcccgcaactcgcggccgggtacggccggtccgccgcgactggatgcggccggcccgccgacgcgtccacagccgggggctgttggc

SEQ ID NO: 7240 - DNA, 480 bp, Streptomyces avermitilis
  CDS (1)..(480)
atgctgatcagagaagccgcggccgacgactggccgcggatctggcctttctggcaccggatcgtcgccgcgggagagacgtacgcctgggacccggccacctccgaggagcaggcccgcgccctgtggatggcgcccggcaagcgcgtgtacgtcgtcgaggacgagaccggagcggtcgtcggctcggcctatgtcaccccgaactacggcggcccggccgcccgcgtcgccaacgccggcttcatggtcgaccccgaccacgccgggcggggcatcggccgcgccctcgccgaccacgtactcgccacggccaaggccgacggctaccgggcgatggtgttcaacgccgtcgtcgagaccaaccccgccgtgcagctgtggacctcactcggcttcaccgtcctgggcaccgtgccggacgcgtacgagcacccccggcacggcagggtggggctgcacatcatgtaccgggcgctc

SEQ ID NO: 7241 - DNA, 1992 bp, Streptomyces avermitilis
  CDS (1)..(1992)
atgaagccctcaaggctcatgctgctcaccgctgttgccctgctcgcgccgatggcccccgcgctgtcggccgcggcggcgccgggagacggcgcgactcccgcagcgaacaccgcctccgccgcccgcgcccaactcaccctcgacgacccgggcttcgagaacggcggcacgggctggaccttcggcgcgggcaccggggtcggcaccggcaactcccacggcggcgcccgcttcctctacctcgactccggagccggcaagagcgcgaagctgaccctcgtcgcaccccggaacggcagttacgacttctccgcgtgggtcgggagcgccggcaccggcggcacgtacacggtccggcgcaacgacgagaccgtcgagacgatcaccctgccggagcgccgcgcgtacgcccggtacaccatcagccgtgtcgagctgaagaccggcgaccggctggagatcgccttcggctccggcagcagttgggtcaacgccgacgacctgatgatctcccccgccgcgcccgccgaccccaaggtcacctcgtccgaccccgaggtcgtcgagatgttcggctgggccaagaagaaggccaacagctgggtgcagctacccggcacgacgggcccggtcaacgtcgacgagtaccagaccggcggcaccggcaccgcgccgtacgcggccggctactgggccggatacgccaaccgcagcgcctactactcccgcgacatgacccaccagctcgccggtgcccacatcatcggcctcgacgccgagaacgagacgatgctccgttcgtacgcgtcgtcggccaccgccgcgcacaagtacttcccggtgtggtccctcaacttcgacgccaagacctacctgagcatcgactacaagagcccggacaacttcgtgcgcgaggtaccggccgtcttcgaactcgtcgagaaggcggcccaggcgtacctctggaccggcgaccggagatacgtcgacgacccggcgctgtgggacttctaccggcactccaccgaggagttcatcgacctgcacaactccgccaagcccaacggcaaggtcaaggtcgccgagggcacgggcaacggcatcttctccggcgccgccagctacaacgagcaggacggcgacggcctcgccgaggccggggacggcatcgcctcgcagtaccaggcgtatctggcgatggccacgctcgcgcgcggcaagggagacaccgcgctggccaaggcgtacgaccggcgtgccgccgatctgaaggcgtactacaacgacgactggagcgggggcggaagcggagccgacatggtccgcgcgtacaccacgtccggcaccccggtcaccggctggggcaaggagaacagcgtgttcgtgccgatgaagcagatcatcgatcccggcccgcgcaacgacgcctatctcgactacatcgaggcgcaggagctggggccgcaggggtcacccaacatcgagtcgacgacgtacctgcccgacatgttcttcaagaacaaccgcaacgacaccgcctggacatggatgaagaagatctacggccagcgggaactccagcacgtcaactccagccagggccccaacggtgactaccccgaggtgtcgttcactctggtcagccagaccgtcgagggcctgatgggcatcgcaccggacgcggcgaaccacaaggtgaccacgcagtcgcgactgccgtccggcatgaagtggctccagacggcggacgtacccatcggcacgagcacgatcaccgtgcggcacgacggcgcgacgaagaccacgctgacgaacaacgcgcgcaagggcgcctaccactgggaggcccgcttccagggggtccacaagaagatcacggtcaacggtgtcccgcagcgcgcgcgaaccaggacggtcgacggcgtgacgtacacgtacgcgacgccgacggtgcgcgcgggggcgacggcggtggtgcgggtggccggc

SEQ ID NO: 7242 - DNA, 1389 bp, Streptomyces avermitilis
  CDS (1)..(1389)
atggacgcctcacccctgaaccagccaccgccggacgagccgccccgaaacggtctgaaccgacggcgcctgctcgcgctcagcggttcactgctcgccgccggagccgggacctcgctgctcggcgcctgctcggtgaccggcgccaccaaggcggggagcctcggcgacccggaccgggccgcgatcaccgtctggagctggcagggccccgccgccgccatgaaggctctggtccccgccttcgaggcgcggcatcccgggatcgacgtcaccgtgcaggacatcggaaacccggcgatctgggacaagatcaccacggccctggcggccggcgggcagggcctcgcggacgtcctgcacatcggcgtcgactatctcccggcctacaccgagaagttccccgaaggcctcgccgacctcggcccgctcggcgccgaccgctaccgtgacgccttcgccgacggcatgtggcagaccgtcacccgcaagggcaaggtcaacgcccttccctgggaggccaattcggccggtttctactaccgggccgaccttttcgaggccgccggtgtcgacggcgaggcgctggcgacgtgggacgacgccatcgacgccgggaagaagatcaagaagaggaccggagtccatctgctgggcatcgacaagcccgcgtcccagccggacgccgccaacttcttccagatgctgctccagctccagggcacgttctacttcgacgccgagggccggatcaccctcagctctcccgaggccgccaccgcgatgaccctcatcaaggagatgaacgacgccggcctggtcagcgatctggcgggcggctggaccgcgctggagagctccatcaagtccggcaccgctgccgtactgccctggcccacctggttcggcagcatcatcgagggcctggtccccaaggaatccggccagtggaaggtccgcctcccaccggcggtgaagcccggcggcaccacggccgcgaccgtcaactccacccatctcgccgtcgccggctccagcatgcaccaggccgccgcctgggcgttcgtcgagtacgtcctgaccagaccggcgtcgcaggaggcgatctaccgcagcaagggcatcgcccccgccctgctccaggcgtacgaggcccccgtcttccacgagccgtcgacattcttcagcggccagcacaagggcgagatcttcctcgacgccctcaaggcgcgctcgcccgccgtcaattactccgccgactacgcccgcgcgctcaagacggtcgccgacgcgcagacccaggtgctcctcaagggggccgaccccggccgcgcgctgcacaacgccgccgaccagctcgcccgccagaccggacgggagctcgcctca

SEQ ID NO: 7243 - DNA, 939 bp, Streptomyces avermitilis
  CDS (1)..(939)
atgaccacgaccaccaccgccgagggtgtcctgaaaaccgccggcgccgcccgcccggcggccgcgtcccgccccaccgcgcggatcctgcgccggcgggccgtcccgtatctcttcatcctccccgcgctcgtcctcttcgcggtcttcaagctgtacccgatcggctcgtcgttcctgatgagcctgtacgagaacgtcaacggcacccaggagttcgtgggcgcgggcaactacacgcgggcgatggacgatccgctgctgtggaccgcgctgaagaacaccgcgatcatcctggtcgtccaggtgcccgtcatgctggcgctggccgtcggcatcgcggtcgccctcaactcgaccctcctgcgcggccgcgccttcttccggctcggcttcttcctgccgacggtgaccggactggtcgcgtacggcatcgtcttcgccgtcctgctcaacacccagtacgggctggtcaactggctgctcggcctggtgggcgtcggagaggtcccctggctgaccgacccgctgtgggccaggatctccctcggcctcgcactgacctggcactacaccggctacaacgcggtgatcttcctcgcccggctccagtcgctgccgaccgagctgtacgacgcggcggccgtcgacggggcctccgcccggcagtcgttccgccatgtcacgctgccggggctgcggcccgcgctcctgctgacgacggtgctgtccaccatcggcacccttcagctcttcgacgagccgtacgtcctgaccggcggcgggcccgacaacgccaccctcaccatcggcgtgtacctctaccagaacgctttcaagtacttcgacttcggctacgcctcggccgtcgcgtacatcctcaccgtcctgatcggcatcctgggcgtcgtgcagttccgcctgctgggagagaagtcg

SEQ ID NO: 7244 - DNA, 873 bp, Streptomyces avermitilis
  CDS (1)..(873)
gtgaccctcaccgccacccgcccgcggcccggccgcacgccccgcacaccccgatcccgcacccgcacgcgctcgatcctgctgacctcctcactgaccatcgccgtggcggccgtcctgctgccgttctactggctgatcatcgccgccacccacagctccaaggagatcttcgacagcccaccgccgctgctgcccggcgggcacctgagggagaacctctccaccctggagtcgtcggcgcggttcagcgacgtcatcgtcaactcgctgctgatcacggtcatttacacgatcgccgccggagcgatctgcacgctggccggatacggcttcgccaagttccgcttccgcggcagcggcgccctgttcgggctgctgatgctcgggctcgtcatccccacccaggtcacactgatccctctgttcaagatgatggtcgacctggagtggctgggcacctaccaggccgtcatcatgcccaatctcgccctgccgttcgggatcttcctgatgcggcagtcgatggccgcgctgcccgacgaactcatcgactccgcacggatggacggctgcggggagttcaggctcttcctcaaggtcgtgctgccgccgatgaaaccggcgctcgcggccctcgccatcttcctgttcctcttccagtggaacgacttcatctggccgctggtcgtcctgcgcgacgccggcgagttcacgatccccgtcgcgctggcgtccctccagggcctggaccagaccgactacggcgccctgctcgccggcacggccctcgccgcgatcccgatggccctcgtcttcctcgcactccagcgccacttcgtctccgggctcctcgccggggccgtgaaggaa

SEQ ID NO: 7245 - DNA, 1830 bp, Streptomyces avermitilis
  CDS (1)..(1830)
atgatccccgcgatgaccctcagcaccacccggcccgtcaccacggccgaactcccctcggcgcgctacgagccactcgtcgacggcgtccgtatcgcggtcctcacccacgcgcccggcgtcggcgcgcgctggacggtttgcgaactcggcgacgggctggccctgttggagatccggacggacggcgggccggcaccgacggaggtgcggatgagcgtgccgctcggcgacgcggccggctactggcacccgggcgccggctgggagcgcaccctcgtcgccgactgggcgggccgttcgcgcgtgagcctcgtcgacggcaccgccgccggctgtctctacgaccacgacggccgcacgcggctcaccttcgccgtcgccgacccggtccccgagaccgatgtcgtcttcggggtctcggaggagaacgacacccatgtggtgcacctgcacctggctcccgcgcccgacggcggcccgcgtcgcgtcctgctggcccgctcggcgcccacggtcgcgacggccctgcgcgggctgcggcagtggttcgccgcgcagccgcagtgcgcccccatgccggtccccgacagcgctcaggcacccgtctactccacctggtacgccttcaaccagcgcgtggacgccgcatcggtcgaggccgaggcccgcgtcgccgcctcgctcggctgcgaggtgctcatcctcgacgacggctggcagaagtacggcagcggtcgcggctacgccggatgcggcgactggcgccccgacccgacgacgttccccgacttcgccgcgcatgtgtcggccgtgcgggcgcagggcctgcgctatctcgcgtgggtcgctccgctgctgctcggccccgacgcggactgcgccgagcggctcactccctatgcccccgcgcccgccggtgtcccgggcgcccaggtcctcgacccgcgccgccccgaggtccgcgaccatgtcatcagtctgtgcacccggctggtcgccgaccacggcctcgacgggctcaagatcgactttctggacgaggccatggcgtaccgcggcgacggcgcgtacgcccaccacgaaggcaccgacatcgacgatgtcggccgggccatgaccgtcctgctcaccgacctgcgcaccgcgctcgaagagctgcggcccgacggcggactgctgctggaactgcgccagccctacgtcggccccggcatggcccccttcggcaacatgctgcgctccttcgactgcccgggcgacgccaccggcaaccgggtgcgcacgctcgacaccgccctgctcgccgtcggcggcgcggtccacggcgacatgctcctgtgggaccgcgacgcgcccgcgcacgcggtggcacggcagctgatcggctccctgcactgcgtcccgcagatctccgtgcggctgaccgagctgtccggcgagcaccgcgagacgctggcgttctggctcgccgagtggcggcggctgcggccggtgctgctgcacggggacgtggaatccggccggcccgacgagctctacaccctggtcaccgcggcccgggggagggcctgtgtcaccaccgtgcacagcgaccggatcgtgcccgtcgacaccaccgcgtacgacgacatcaccctggtcaacggcacggcgtcggaccgtgtggtgatcgaggtgaccggtgggcagcgccccttgcgcatgaccgtccgtgacgagcgtggacgtatcatcgacgactgcgaacggtcgccggcaccggggctgcacatcgtgtccgtaccgcgctcggggctggtggcactacgggtgacggagggaaccgta

SEQ ID NO: 7246 - DNA, 996 bp, Streptomyces avermitilis
  CDS (1)..(996)
atgaaggtcggcatcaccgaggtcgcggaccgggcgcaggtgagcgaggccacggtcagccgtgtcatcaaccggcgccagggcgtgtcgcgcaagacccgcgaggcggtcgagcaggcgatggccgacctggggtacgagcggcagacgcggggtcagctcatcgcggtcatcaccgagtacgtctccaacccgttcttcgccgacgtctgcgaacggatcgagtccaccctcgccccgcacggcctgaagacggtcctgtgcccgtgcttccccggcggagtgcaggagctggacttcgtgacctccctcgccgaccggggcgtcgccgccgtcgtcttcctctcgtccagcaacacgatcgagggcgcggacccggaggcgtacgaactcctgcgctcccgccggatcccgttcgtcggggtcaacggccagttcgagggcgtgagcgaggcgccggtcttctccaccgacgacctgctggccgccgaactcgccgtcgaccacctttaccggctcggtcaccgccgcatcggcatggcatcgggcccggtcggcaaccgcccggccgaccgccgcgtcagcggcttcgtctcctcgctcgccaggcgcggtgtcgaggacccggagcagtgggtggtccggcagtcctacaccgtcgagggcggccagtccgccgcgatctcgctcctcggccgcggcgccacggccatcgtcgccgccagcgactacatggccctgggcgcgatccgcggcgcgcgccggcaggggtacgacgtcccgggcgacgtgtcggtcgtgggctacgacggcgccatgatcatggacttcgtcgaccctccgctcaccacggtccgccagccggccgaccgcctcgcctcggaggtggcccgcagcatcctcgccctggtcggcaaccgcgacgtccccgtcggcgaactcctcttcgaccccgaactggtgatccgtgcgagcacggcggcgccgagggcggag

SEQ ID NO: 7247 - DNA, 1875 bp, Streptomyces avermitilis
  CDS (1)..(1875)
gtggctcacggatgctccggaggggctatgtctcggttcgtgtttcttggggtggcactcgcgttgctcggaggtgccaccagtcctgccgccgcggcgccgagggtgacgccggtggtggtcgacgtggacgactacggagccgaccccaccggccggacggactcgacgcccgctgtcgccgcggcgctgcggcacgccaagagcgtcgaccggccggtcaggatcgtcttctccaagggcacctaccagctgtaccccgagcgggccgagacgcgtgagctgtatatgtccaacaccgtcggcgccgaccagcgttaccgggacaagaagatcgggctgctcgtcgaggacatgcacgacgtcaccgtcgacggcggcggggccaagctcgtccaccacggtcttcagacggcgttcgcgtcgatccgctcgaccgatgtgaccttccagaacttctccttcgactacgcggcccccgaggtcatcgacgcgaccgtcgccaccaccggtgtcaccgacggacacgcctaccgcgttctgaagatccccgccggcagcccgtaccgggtgaacggcacgcacatcacctggctcggcgagaccagtcccgccaccgggcagccgtactggtcgggtgtcgacgggctccagtacacacagatccacgaccccgaggcgcaacggacctggcgcggagacaaccccctgttcaacgacgtcgccgcggtcaccgacctcggcggccgccggatccggatcgactacaccaccgcggcgcggccggcggacgccgggctcgtctaccagatgcgcctcatcgagcgaacggagccgggcgctttcatctgggagtccaagaacgtcacgatgcgctcgatgaacgcctactacctacagtccttcggcgtggtggggcagttcagcgagaacatctccatcgacaaggtgaacttcgcacccgatccgaggtccggccggtcgacggcctcgttcgcggacttcgtgcagatgtccggcgtcaaggggaaggtctcgatcacccggagcctcttcgacggcccgcacgacgacccgatcaacatccacggcacctacctcgaggtcgtcgggaagccggggccgtccaccctcaccctcgcctacaagcacccgcagaccgcgggattcccacagttcgccccgggtgacgaggtcgagttcgccaccaagcgcacgatgaccccgctggcggacgcgcacgcacaggtcaccgcggtcgacgggccgagcggcatggaccacacgaaaccgctgaccacgatgaccgtcaccttcgaccggccggttcccgccggggtcgagaccggcggcacggtcgtcgagaacatcacggccaccccgtcggtcgtcatctccggcaacgtgttccgcaacgtgccgacccgcggcatcctggtcaccacccgcaagcccgtcctcatcaccggcaaccggttcgacgggatgtccatggccagcatctacgtctccgccgacgcctaccagtggtacgagtccgggccggtcgccgacctcacgatccgcgggaactccttcacgcggcccagtggtccggtcatcttcgtggagccgaccaatcaggtcatcgacccggcgaccccggtgcatcacaacatctcggtcgagcacaactcgttcgacatcggtgacgtcaccgtcgtcaacgccaagagcgtcggcgggttcgctttcaccggcaacacggtccggcggctggacggagcggatcacccgccgtacacctcaccgctgttcgtcttccacggcagttcaggcatccggatcgcacgcaaccactacgacaagggcctgaacacctccgtggtcacggac

SEQ ID NO: 7248 - DNA, 1362 bp, Streptomyces avermitilis
  CDS (1)..(1362)
gtgaccagctgggtcggcctttccgccgccgagatcgccgcagccgtacgcgagaagcgggccacgccccgtgaggtggtcgccgaacacctcgcccggatcgaccggctcgacgcccgcgtcggcgccttccgccgggtgcgcgcggacgcggccctggccgaggccgacgaggtggcgtcccgcaccgacctggccgaactccccctggccggggtgcccgtggccgtgaaggacaatctcgccgtacggggcgagtccactcgccacggctccgcggccacccccgacaccccggccgaccacgaccatgtcacggtggcccggctgcgtgcggcgggtgccgtcgtcgtgggggtgacgaacgtgcccgagctctgcgtgttcggcaccacggacggcgtgcacggcacggcccgcaacccgtgggacacctcgcgcacggcgggcggctcctcggggggcagcgcggccgcggtcgccgccgggatggtgccgatcgcgctcggcaacgacgggatgggctccctgcgcatccccgccgccaactgcggtctcgtcggcctgaagccggggtacgggacggtgccggcgggcatcggaaacggcgactggttcggcatgtccgagaacggcccgctcgcgaccacggtcgaggacgcccggctgatgttcgcggtgctggccgggacggtcacggcggtcgcggagacggaggcgatacgcccgtccgggcccggcacccgcacgatagccctctcggtccgcagtccgctggccggtgtcgccgtcggccgcccgtacgcgtccgccgcccgggaggccgccgagttgctggccggggccggtcaccaggtgcggcgtgccgatcccccgtaccccctgtggctgagcacgacctcgctcgcacactggacggcgggcaccgcggtggacgccgaggacctcgatgtacggcggctgacccggcgcacgcgggtgcacgcggcggtggggcgccgctttgtgcgctcggtgcggggcggcgcacgccgggagcagttgcgggagcgcctgacgccgttcttcgaggagcacgacgtgctgctgacccccgccctcgcccggcgcggccccgccgcggcggcctggcacgagcggggctggctgcgcaatctgctggtcaacaccacctactcgccgctgaccccgccctggaatctcacgggctggcccgccctgtcggttccgttcggcacactgccgagcggcgcgcccggtgccgtgcagctggtgggacgccctggttccgagctcgatctcctcgccctggcgggccagttggaggaactgcacccctggcgacgcacggccccgctcggc

SEQ ID NO: 7249 - DNA, 1041 bp, Streptomyces avermitilis
  CDS (1)..(1041)
ttgtcagccaagcggtctcccgcgcgtcggccgacgatgaaggacatcgcacagcgcgccggggtctccgagagcgccgtctccttcgcgctcaacggccggccaggggtctccgaggtcacccgcgaccgggtgcgccgggtcgccgagcagctgggctggcggccgagcacggcggcgcgccagctgtccggcgaggggtctgccaccgtcggtctggtcgtggcgcggcccgccgacacgctcggcgtggactcgttcttccttcagctgatctccggcatccaggaggtgctggcggagcgtcatctcggcctgctgttccaggtggtcgaggacgtggccgacgagtgcgcggtgtaccggcgctggtgggccgagcaccgcgtggacggcgtgctggtcgtcgacccccgtacggacgatccgcgccccggccttctcgacgaactggggctgcccgcggtggtcatcggcggcgtcccggacgccctgcatccggggctgtccacggtgtgggcggacgacgcgggggcgatggcgtcagtcgtggaccagcttcataccctcggccatcgccggatcgtgcacatcgcgggtctgccgggcctcgcccacaccgagcgccggatccgtacgctgcgggccgaggccgggcggcgcggactggccgaggtgcggtcggtgcccacggactactcggacgcggagggcgcggccgtcacccgccgcgtcctggagagcggcactcccccgaccgcgctggtctacgacaacgacgtgatggccctcgccggggtggccgccgccacggaactgggcttctcggtgccggccgacgtctcggtggtgtcctgggaggactccgcgctgtgccgcatggtcaagccgtggttgtccgcgctctcccgcgacacggtggagttcgggcgtacggcggcgacggaactgaccgcgctgctcgacggcggcccggcgcgcacggtccaggtgccggtgccacggctgatcgaacgggacagcacggggccctgcggggct

SEQ ID NO: 7250 - DNA, 1290 bp, Streptomyces avermitilis
  CDS (1)..(1290)
gtgcgcatctcccgcagaaccttcgccgccgctgccgccgtagccgtcgtcctgccgctgagcgcctgcggctcaggggacgacggcggcggctcgacggacgcctcgggcaaggtcgagggcaccatcaccttccagacctggaacctacgggccaacttcaagtcgtacttcgagggcgtggtctccgacttcgagaagaagtacccggacacccaggtgaagtgggtcgaccagccggccgagggctacgccgacaagatcagcgcggacgcggccggcggcaccctgcccgacgtcgtcaacgtctcgccggacctggtcgcgccgctcgccaaggccgggctcgcgctcgacctcgacaaggcggccgcgaagtaccggaaggagtacctgcccggcgcctgggccagccaccggataccgggcatgaccggcacctacgccttcccctggtacctcaacaccggcccgctgttctacaacaagagcctcttcaaggacgccgggctcgacgcctcgaagcccccgaagacctacgacgaactgttcgccgacgccctccggctggcgaagaagagcaagggcgaggtcgccacgctcgccaacgtgcccaccatcgaggacttcggccgctacggcgtcgagctgatgaacaaggaaggcaccgccttcgccttcaacgacaccaagggcgtcgaactcctcaccaagtacaaggagttgtacgacgccaaggcgctcgacccgcaagtactgaccgccaccccggagtcctccggcaagaagttcctcaccggggccgtcgccatgaacccgggcagcgccctggacctcggaaacttcaagaagcaggcgcccaacctgtacaagaacatcggcatcacggaccagatcaccagcaccggcaaggtgaacatgtacgtgatgggggtgatggtcaactcccgttcccagcggaagccggccgccgtcgccttcgcgcactacgtgaccgacgcgcagcggcagatgtcgttcgccaagaaggtcgcgatcttcccgagcaccgccggctccctcgacgacccgtacttcaccaaggaggacggcacggacgagacgcgggtgcggatcgcggccgccgcatccctgaagaacgcggtcaattacacgcccgtactgttcagcgagcagatgaagaccgcgctgcgcaacgaggtcgccaaggcgctccagggcaaggagagccccaaagcggcccttgacaacgctgtcaaggcgtgcgaccggcttcttcagcagcagggc

SEQ ID NO: 7251 - DNA, 891 bp, Streptomyces avermitilis
  CDS (1)..(891)
atggcgagttccaccgtgtcgagggtgcggcgccatctccccaccagcccctggctgttcgccgcccccgggctgctggtcgtaggcgtcttcgtcctctatcccttcgtctccacgctggtcaacgccttcaccgaccgtcggacgctgatccccggccggttcgtggggctcgccaacttccgcgagctgctgcacgacgacatgttctggatcgggctgcgcaacagcgcactgtacgtcctcggggtggtccccgcgctcgtactcctgccgctgctgctcgccctgctcgtccagaagaacatccccggcatcggcttcttccggtcggccttctacacacccgtggtcgcgtccatcgtggtggtcggtctgatctgggtgtggctgctggacgaacgcggcctggtgaactcgctgttggagacgatcggcgtcggcagggtcggctttctcagcgaccagtggctgctcctgctgagcgccatggccgtcacggtctggaagggcctcggctactacatgatcatttacctggccgcgctcgccaacgtaccgcgtgagctgcacgaggccgcggcggtggacggggccggggcggtacgccgcttcctcaccgtgaccgtgcccgccgtccgctccacgatggtgctggtcggcgcgctctcctcggtcgccgccttcaaggtcttctccgaggtgtacctgatggcggggcccgacggcggcccggcgggcgaggacaccacgctcgtgatgctggtccagcgcaccggcaccggcctgaccggccgcgtcggctacgcctccgccatgtccgtcgtcgtcttcgtggtcaccgtcgggctgatgctgctcgtgctgcgtgccgaccggaaggaggaggcg

SEQ ID NO: 7252 - DNA, 903 bp, Streptomyces avermitilis
  CDS (1)..(903)
gtgagcgtcctggagaaggtacgacccgtccggacaccggccgccgcccgggaaccccgggccaccgacgagcacggacgccggatccgcgtctgggaactggccctgcgctacctgctgttgctggccgtcctcgccctcaccgtcggccccttcctgtggcagctgtccacctcgctcaagggcccgaccgaggacatcttcagctccccgccgaagttcctgccgggcgatccgaccctgcacaactatcagcgggtcgccgacaccatccccgtctgggactacgcgttcaactcgctgaaggtggccgcggccaacgtcgtcaccaactgcgtgggctcggcactcgccggctacgcgctggcccggttgcgctaccggggccggcgcgtggccaccctggtcttcatcctggcgatgctcgtgcccgtggagggcatcatcatcgcccagttcacgaccatgcgggagctcggcctgaacaacacgctgatcggcgtggtgctgcccggctgcatcggcgcgatgaacgtcctgctgatgcgcaacgccttcctcaaccttccccacgagatcgaggaggccgcctacgtcgacggcgcgaacgcctggcagcggttcctgcggatcgcgctgccgtcggtgaagggcaccctggccgtcgtcgcgatcttcgccttcatgggcgcctgggacgacttcctgtggcccctgatcgtgctcagcgacccctcgaagttcaccctgaccatcggcctcaactatctgcacggcaccttcgccaacgacgaacgcgtggtcgccgcgggcacggtcatcgccgtggcacccctgatcgctctcttcgcctgcctccagcggtacttcttccgcggcgtgggcgagggcgccgtcaagggc

SEQ ID NO: 7253 - DNA, 1230 bp, Streptomyces avermitilis
  CDS (1)..(1230)
atgccctctgccgtgcgcttcggcgtcaactacaccccgagcgtcgggtggttccaccactggctcgacttcgacctcgactccgtgcgcgccgacctcgactcgatcgccgcactgggcctcgaccacatccgggtcttcccgctgtggccgtacttccagcccaaccgcacgctgatccgcccgcgcgccgtcgagcagctcgtcgcgctcgccgacgcggccgccgagcgcgggctcgacgtcaacgtcgatggactgcaaggccacttgtcgagcttcgacttcctgccggcctggacacagacctggcaccggcggaacatcttcaccgatccgacggtcgtcgagggagaggcggagtacctgcgcaccctcgccgccgcgctcgccgaccggccgaacttcatcggcatgacgatcggcaacgaggtcaaccagttcgcggccgggccgcatcccgacccggaccgcatcacccccgagcaggcgggcgcgtggctgcggcgcctgctcgccgcgtgcgcgcagggcgcccccgggaagctgcatctgcacgcctcgtacgacgccgcctggtaccaggacgaccagcccttcacacccggacactccgcccgtctgggggacatgaccgccgtgcactcctgggtgttcaacggcacggcccagcgtcacggccgcacgggcaccgccaccgagcaccacgccgcctacctcgtcgagctgtccaaggcctgggcggacgacccgcgccgcccggtctgggtccaggaggtcggcgcgcccgccccgctgatccacgccgagcacgccgccgcgttcaccgaggcgaccgtcgcgggcgtcctcgactgcacggacgtgtggggcgtgacctggtggtgctcgcacgacgtggcccgcgacctggccgatttccccgaactcgagtacagcctcggcctgttgaccaatgaccggcagcccaagcccgccgggaggaccctcgcccggatcgtcaaggagcagcggccgtacgcacccgccgtacgcaccaccgcgctggtcgtcgacaccacccccggccgctccgtctgcgcccccggcggcgccgtcttcgaggccttcgcccggctcaccgccgacggggcccgccccaccaccgttctcgcgagccgcgccgacgacaaggaacacctcgcggcccgtggcatcaccgctgtcgtcacccccgatcaggtcaccgag

SEQ ID NO: 7254 - DNA, 426 bp, Streptomyces avermitilis
  CDS (1)..(426)
gtgaacctcagcagacgcaccgtcctgctcgccgcgaccggagcggccgccggactcgtccccggcctgtccggtacggcgggcgcggccacccgcaacctccagccgtacgcctcctactggtaccccgactcgctgccctccggcaccccgggcaccggcatcacctggcgcagcctgaaggcctggcgcgccgagaacgacacggacctggcgttcaacgccgccgccgtgccgctcgccgcccgcttcaccccgacccccgccaacaccacggcccgctcgggccaggcccgcatccagtccctggtctccttcggacccacgtcgagcaaccccgcccagggcgcgccgaccgccgactactacgccctgacccactggtcgtacgtcgacgaactcgtcttctggggcggctcgtccggt

SEQ ID NO: 7255 - DNA, 1542 bp, Streptomyces avermitilis
  CDS (1)..(1542)
gtggacgcggcccaccgccacggggtgcccgtcctcggcaacatcttcctgccgcccgtcgcgtacggcggacagttgcagtggacgcgcgacctggtccagaaggacgcgaccgggcactacccgctcgcagcccaactcgtcgcggtcgccgacgcgtacggcttcgacggctggttcgtcaacgcggagacgagcggcgggaacaccgccctcgccaccgacatgcgtgggttcctacaggagctgaaggcgctcggcacggcgaagggacagcgcgtcacctggtacgactcgatgaccgcgaccgggtcggtgagctggcagggcgccctgaacagccagaaccaggcgttcttccaggccgccgactcgatgttcgtcgacttccgctggtcgaagagcacgctggcctcctcaggcacgctggccgggcaactcgggcgcagccgatacgagttgtgggcgggcgtcgacgtcgaatccaacggaacgagcacctcggtcaactgggacgccatcgtcccgtccgcctccgcgcacgtcgtctcgctcggtttctacaggcccgagtggacccgcaaccacctgcccgcgaaccgcacacccggcgacttccacgcggccgacgacctgttctggacgggcgcgtccctcgaccccgcgaagccgaacacgaccgcgagctggcgcgcccccgcgctgcgcgtcgccgaccgctcgaccgtcgactcgctgcccttcgcgaccgtcttcaacaccggccatggactgaagtggtacgagggcggcgaggtcacctcggacacggcctggaaccacctcggactccaggaccgcctgccctcccgccgctggatcgtccggacgagcggcgcgcggccgtccgtcaccttcgacttcgccgacgcctggcgcggcggcagcagcgtgctggtcgccggcaccctcggcgcgccggccaccctggacctgtacgagacccggttgccggtcggttcctccgagacggtcgtcgagctgacccatcgcaccgacgcgggcagcgcccagatcgagctggcggtcgccaccgccgagccgagcgcccccgggcaggcgccgtcgtacacctacttcccggtgagttcaggcgacggctgggggacctcgaccgtacggctgacgggtctgtcgggcaccgtacgcacgctggccgtacggctcaccgggagcggctccccggtgagatggcggctcggcgcgctcgccgtcaagaacgccccggcggagcctgccgcccccaccggtctgcgcgtcaccgacgccgacggcggcagcctgcgcttctcctggcagcccgcggccggggaggtacgccactacgagctgcaccgcgtcctcgccgacggcacacgccgcttcctcggcggcacctgccagtgcgcgtactacgtcgccgggctcgcggccgagcagggcgagagcgccgcacggttcgaactgcgcgcggtaggggagctctacaccgaatcgaccgccaccacgaccacccacccctgg

SEQ ID NO: 7256 - DNA, 3012 bp, Streptomyces avermitilis
  CDS (1)..(3012)
atgcatgacgaccgcaccctggtcgaagcccgcctccggcgcgttctcgacgagcgcatccgccccgccgtgtaccccgagtccgtaccgctggaggtggcggtgtggcacgcgccggacgagccggtgccggtcgccgaagggctcgccgccccggtcggcccgatcgcggcgggcgcacgctggggtgctccctggggcaccagctggttccgcgtcaccgggaccgtccccgaggcctgggccggcaagaccgtcgaggccctgctggacctcggcttcgacgagaacatgcccggcttccagtgcgaggggctcgtctaccgtcccgacggcaccccggtgaagggcctcaacccgcgcaaccagtgggtgcggatcggcgcacccgtcgagggcggggaagaggtccggctgcacatcgaggcggcgtccaaccccgtgatcctcgactaccacccgttcaggccgacccagttgggcgacaaggagacggcgggcagtgagccgcagtacaggctggagcgcatggatctcgccgtcttcgacgagacggtgtggcagctcgtcatcgacctcgaggtcctcggcgagctgatggccgaactgccggtggagtcggcgcgccgctgggacctcctgcgcgcggtggagcgggcgctcgacgcggtcgatctccagaacgtcaacggcacggcggcagcggcgcgcgcccggctcgaaggggtgctcgcggaacccgccgtgccctccgcgcaccacatcagcgccgtcggccatgcgcacatcgactcggcctggctgtggccgctgcgcgagacggtgcgcaaggtggcgcggacgacctccaacatgaccgcgctgatcgaggacgagcccgacttcgtcttcgccatgtcgcaggcgcagcagtgggcctgggtgaaggagcaccggcccgaggtgtgggcgcgggtgaagaaggccgtggccgagggacggttcgtgccggccggcggtatgtgggtcgagtcggacacgaacatgccgggatccgaggcgatggcccgtcagttcgtgcacggcaagcggttcttcctcgacgagttcggcatcgagaacgacgaggcctggctgcccgacacgttcggcttcgcggccggactgccccagatcatcaaggcggcgggctccaagtggctgctgacgcagaagatctcgtggtcgcagaccaacaagttcccccaccacaccttccggtgggagggcatcgacggaacgcggatcttcacccacttcccgcccgtcgacacctacaactgctccatgaagggcagcgagatcgcccacgcggcacgcaacttcaaggacaagggagtggcccggcactcgctcgcgcccaccggctggggcgacggaggcggcggcacgacccgcgagatgatcgccaaggcggccaggctccgcgatctcgaaggctcggcgacggtcgcctgggagacacccgcgaagttcttcgagcaggccgaggccgaatatcccgacccgcccgtctgggtcggcgagctgtacctcgaactgcaccgcgccacactcaccagccaggcgaagaccaagcagggcaaccgccgcagcgaacacctcctgcgcgaggcggaactctgggcggccaccgcggcggtccgcaccggattcccttacccgtacgaggagttggaccgtatctggaagacggtgctgctccaccagttccacgacatcctgcccggctcgtccatcgcgtgggtgcaccgggaggccaggaagacgtacgagaaggtcgccgaggagctgaacggcgtcatcgacgccgcgcagcgcgcgctggccggcgaggggacgacgccgctcgtcttcaactcggcgccgcacacccgtgacggggtgcccgccggcggtgcgcggaccccggccgtcgggggcgagtgcgcgctcgtgccccgcgcggacggcggttatgtcatggagaacgggcggctgcgggtcgagatcgacgcacacggactcgtggtctccgccttcgacctcgccgcggaccgcgagaccgtcgcaccgggccggccggcgaacctgctccagctgcaccccgacttccccaacatgtgggacgcctgggacgtcgacgagttctaccgcaacacggtgaccgacctggtcgacgccgacgagatcgcccccggtgaggacggcgtctcggtgcggatcgtccggaccttcggcgcgtcccgtgtcacccaggtgctgtcgctcgcgccgggggagtggcggctggacatcgataccgaggtcgactggcacgagaccgagaagttcctgaagctcgccttcccgctcgacgtgcacgcggaacgctacgcgtccgagacccagttcgggcacttcttccggccgacgcacaccaacacgtcctgggaggccgccaagttcgaggcgtgcaaccaccggttcgtgcacatggaggagcccggctggggtgtcgcggtcgtcaacgactcgacgtacggccacgacgtgacccgtaccgtgcgcgacgacggcggtacgaccaccacggtgcgtgtctcgctgctgcgggccccgcgcttcccggaccccgagaccgaccagggcgtgcaccggttccgacacgctctggtgcccggcgccgggatcggggacgccgtgcgtgagggctggcggatcaacgtgccggagcggaaggtcaccggcgggcgggaggtgacgccgctgctggccgtcacccaggacgcggtcgtggtgaccgcggtcaagctggccgacgacggcagcggtgacgtggtcgtccgcttccacgagtcccgcggcggccggacccgggccacgctcaaggccggcttcgaggtcgcggcggtctcggtgacggacctgctggaacgcccgctggcggacgcacgggagccggccgtggacggcgaccgcatcacgctgtcgctgcgtcccttcgaactggtgacgctccgcctccggcgcgcc

SEQ ID NO: 7257 - DNA, 699 bp, Streptomyces avermitilis
  CDS (1)..(699)
gtggacgagtcggccccgcagaagggcaccgtgacgcagcgcgccatcgagcggatcaaggcgatgatcggcgaaggccgtctggagccggggcagcggctgcccaccgaacgtgatctggccgtgcagctgggtatctcgcgcagctcgatgcgggaggcgatccgggcgctcacggtcctcggcgtactggaggcgcggcacggttcgggcatctatgtgacgcagctggacgccggtgacctgctggagaccttcggggtcgtggcggatctctcgcggggtccgcagctggtcgagctgctcgaagtgcgccggatcctggagtcgacggcgacggcgctggcggccgcgcggatcacgcccgatcagctggccgaggtggagaagcacctggcggcgatgaacgcgacggacgatccggaggagatcctcgcccacgatctggccttccaccgcgagatcgcggccgccgcgggcaacgacacgatggcggcgattctggagggcctctcctcccgcacgttccgcgcccgggtctggcgcggctaccaggaggagggcgccttcgcccgcacccgccgcgagcacaccgcgatccaccgcgccctggtcgcccacgacccggaggcggctcgggcggcggcggccgcgcatgtgggcgaggtggaggagtggctgcggacccagatcgggccg

SEQ ID NO: 7258 - DNA, 1044 bp, Streptomyces avermitilis
  CDS (1)..(1044)
atggccggtagaaccctctggaaggcggcggccgcggccgcctgcgccaccctcgcgctctcggcgtgcggcagcaccaaggacaccgccgcctccggcggcgcaggcggcggcaccggcaaggtcggagtgatcctgcccctgctgacctcgccgttctggcagtcgtacaacgactacgtaccgaagatggcgaagtccgagggcgtggacacgctcaagaccgtcaactccaacagtgacccctcgcagcagatcaccgacatcaacaaccagctcaaccagggggtgaagggcctcgtcgtggcccccctggacagcgccgcgatcgaggccgggctcgaccaggccgaccgcaagggtgtccccgtcgtcgccgtggacgtcgccccggagaagggcaaggtcgcgatggtcgtacgcgccgacaacgtcgcgtacggcgagaaggcctgccagtacctcggcgaacaggtcacctccggcaaggtcgtgcagatcatgggcgacctcgcctcggtcaacggccgggaccgctccgaggcgttccgcacgtgcgtcaggaagaactacccgaagctgaaggtcctggagatccccgccaagtgggagtccgacaccgcggcctccaagctcgacaccctcctcaacgccaaccccgacatcaagggcatctacatgcaggcgggcggcgtctacctcgcgccgacgctgcagaccctcaagtccaagggactgctgaagaagacgggcgagaagggccacatcacgatcgtctcgaacgacggcatcccgcaggagttcgacgccatccgcaagggccagatcgacgccaccgtctcccagcccgccgacgcctacgccaagtacggcatgtactacatcaaggccgcgatgcaggggaagaccttcaagccgggtccgacggaccacgactcgacgatcgtgaagctgcccagcgggatcctggaggatcagctgcccgcgccgctggtgaccaaggacaacgtcgacgacgccaagctctggggcaacacggtcaaa

SEQ ID NO: 7259 - DNA, 1563 bp, Streptomyces avermitilis
  CDS (1)..(1563)
atgagcacaccaccactggtcgaggcgcgggggatcgtcaagcgctacggccccaccgtcgcccttcaggacgggcagctcaccgtcctgcccggcgagtcccatgccctcgtcggccgcaacggcgcgggcaagtcgaccctcgtcgccgtcctcaccggccttcaggtccccgacgccggctcggtccgcttcgatggcgagcccgcgccgccgctcgccgaccgggacgcctggcgccgcaaggtggcctgcgtctaccaaaagcccaccgtcgtacccgacttgacggtcgccgagaacctcttcgtcaaccggcagcccaccggccgcggcggcttcatcagctggcgccggctgcgggccgaggcgagcgaggtccttcagacctgggatgtgcgcgtcgacccggacgcccgcacggccgacctcaacgtcgaggaccgccaaatggtggagatcgcccgcgcgttgagcttcggcgcccgcttcatcgtcctcgacgaaccgaccgcgcagctcgacaaccgggagatcgagcggctcttcacccggatgcgcgcactccaggagtcgggcgtcaccttcctgttcatctcgcaccacctccaggaggtgtacgaggtctgccagacggtgaccgtgctgcgcgacgcccgctggatcaccaccgcacccgtcggcgaactcccgcgcgcggcgctcgtggaggcgatggcgggggaggtcctcgcggcgcgggaacgggcggccgtgcgggacgcggtggcccctgacgcgccggtggccctcgaagcgcgggggctcacctcaccggcgtacgagaacgtcgatctcaccgtccgccacggcgaggtcgtcggcctcgccggctccagcggcagcggcaaggtccagctcgccgagtccttcgccggactgcacaccccgacgggcggcagtgcccggctggacggcgaacagctggtcttcggcgacgtgcaggccgccctcagggcgggcgtcggctgcgtaccgcgcgaccggcacgagcaggggctcgtgtccgggatgagcatcggcgacaacgccaccatgagcgtcctgggccggctcgggcggtacgggttcgtcggcaccgaacgcaagcgcggtctcgccgcccagctgatcgatcgcctcgacatccacaccgagggccccgaccagcccgtctccgacctgtccggcggcaacgcgcagaaggtcgtgatggcccgcgccctcgcctccgatccgcggctgctcgtcctcatcaaccccaccgcgggcgtggacgtgaagtccaaggagtccctgctggcccgtatggacagcgcccgcgaggacggcaccgccgtgctggtcgtctccgacgaactcgacgacctgcgccgctgcgaccgcgttctcgtcctcttccacggccgtgtcgtcgccgagcacgcggcgggctggcacgaccacgagctgatcgcctccatcgaaggagtggaccatggccacggcatctccccgggggacgacccccggacccccggccgatcagagcgcggccccggtgag

SEQ ID NO: 7260 - DNA, 957 bp, Streptomyces avermitilis
  CDS (1)..(957)
gtgctgctccgccgcgcccgcgaactcgccctggtgccagccctgttgctgctcctggtgctcggtgcggtcgtcaacgactcgttcctcaccgagcgcaatctgatctcgatcctcggcgcctcggccgccctcgccatggtcgtgctcgccgagtcgctcgtcctgatcaccggcaagttcgacctctccctggagtcggtcgtcggtatcgcgcccgccgtgggcgcgctgctcgtgctgccggccgcccagtccggctggggcaccgagttccccgccgcgctcgccctcctcgcgatcctcgtcgtgggcgcggtcatcggcgccttcaacggcatcctcgtcgtgaagctcaagctgaacgccttcatcgtcaccctcgcgatgctgatcatcctgcgcggactgctggtcggcgcgaccaagggcaagacgctgttcgggatgcccgacgcgttcttcaccctggccaccaccacgttcctgcgggtccccatgtccgtgtggctggccgcgatcgccttcggtgtgaccggcctggtcctgcgctaccaccgcgtcggccgcgccctgtacgcgatcggcggcaacgcggacgcggcccgcgcggccggtatccgcgtcgagcgcgtcatgctcggcgtcttcgtcgtcgccggtgtcctcgcctccgtcggcgggatcatgcagaccggctatgtcggcgcgatcagcgccaaccagggcaacaacatgatcttcacggtgttcgcggcggcggtcatcggcggcatcagcctcgacggcggcaagggcaccatgttcggcgccctgaccggcgtactcctgctcggcgtcgtacagaacctgctgaccctcgcccaggtgccgtccttctggatccaggccatctacggcggaatcatcctggtcgccctgatgatcgcgcgggtgacgacgggccgcgcccaggac

SEQ ID NO: 7261 - DNA, 1338 bp, Streptomyces avermitilis
  CDS (1)..(1338)
gtgtccccaactgccgcccgtatcaccgcggtcgacacccatgacatccgctttccgacctcccgcgagctcgacggctccgacgcgatgaacccggaccccgactactcggccgcgtacgtcgtgctgcgcaccgacgcggccgacggcatcgagggacacggattctccttcaccatcgggcggggcaacgatgtccaggtcgccgcgatcgacgcgctgcgcgcgcatgtggtgggccggtccgtgggcgaactgtgcgccgacccgggcacgctgttccgcgacctgatcggcgacagccagctgcgctggctcgggcccgagaagggcgtgatgcacatggcgatcggcgcggtcgtcaacgcggtgtgggacctggcggccaagcgcgccgccaagccgctgtggcagttcctcgccgacgccgagcccgcgtggctcgtggaccagatcgacttccgctacatcaccgacgcgctcacccccgaggaggcgctggagctgctgcggcgcggcaggcggggagccgccgagcgggccgcccgcctgagggagaagggcttccccgcctacaccacctcaccgggctggctcggctacgacgacgagaagctcacccgcctcgccacgcaggccgtcgccgacggcttcacccagatcaaactgaaggtcggcgcggacctcgcggacgacacccgccgctgccgggtcgcccgctcggcggtcggccccggcatccgcatcgcgatcgacgccaaccagcgctggaacgtcgccgaggccatcacctggaccaaagccctggccgagttcgacccctactggatcgaggagccgaccagccccgacgacatcctcggccacgcggcggtccgccgggccgtcgccccggtcaaggtcgccaccggcgagcacgtccagaaccgcatcgtcttcaagcagctcctccaggccggcgccatcgacatcctccagatcgacgcggcgcgcgtcggcggcgtcaacgagaacctcgcgatcctcctgctggcggccaagttcggcgtgcccgtctgcccgcacgcgggcggcgtcggcctgtgcgaactcgtgcagcacctctcgatgttcgacttcgtcgcactctccggcaccaccgacgaccgcgtcatcgaatacgtcgaccatctgcacgaccacttcctcgacccggtggtgatcagagagggtcactacacggcacccgccgcgccgggcttctcggccaccatgcggcccgagtccatcgcccggtacacctatcccggcggcaccttctgggccgccgacctcgcgcagcagaagggggaagccgca

SEQ ID NO: 7262 - DNA, 753 bp, Streptomyces avermitilis
  CDS (1)..(753)
atgaccgacttcgagggcctcaaggcgctggtgaccggcggagcgtccggcatcggccgcgccaccgccgaactcctcgccgcccgtggcgcccaggttgccgtgctcgacctcgacccgagcggtgtcgacaagccgctgttcggccatcgcgccgacgtcaccgacgacagctccgtacgcgaggccgtggccgccgccgtcagcgacctcggcggactcgacgtactgatcaacaacgcgggcatcggagcccagggcacggtcgaggacaacgacgacgcgcagtggcaccgggtcctggacgtcaacgtcctcggcatcgtgcgcacgacgcgtgccgccctgcccctgctgcgcgcctccgcacacgccgcgatcgtcaacacctgctccatcgccgccacggcaggtctgccgcagcgcgccctgtactccgcctccaagggcgccgttctcgccctcaccctcgccatggccgccgaccacgtccgcgagggcatccgcgtcaactgcgtcaaccccggcacggtggacaccccctgggtcggccggctcctcgacgcggcgcccgaccccgccgccgaacgcgcggcactggaggcccgccagcccaccggccgcctcgtgagcgcagccgaggtcgcgggcgccatcgcctacctggccggcccgctgtccgacgccaccaccggcaccgcgctcgccgtggacggcggtatgcaggggctgcggctgcgcccggtgggacag

SEQ ID NO: 7263 - DNA, 984 bp, Streptomyces avermitilis
  CDS (1)..(984)
gtgaccaccctcggccgcagcggcgtcgaggtcagcgaactgtccttcggcgccgccggcatcggcaacctcttcaccgcggtcaccgacgagcaggcgtcacaggccgtgcacgccgcctggacgagcggcatccgctacttcgacaccgcgccgcactacggcctcggcctctccgagcgccgcctcggcgccgccctgcgcgagcacccccggaccgcgtacacggtctccaccaaggtcggccgccggctggaacccacggacgcgggcggcgacgacctggccgacggattcgccgtgcccgccacccatcaccgcgtctgggacttcagcgccgacggggtacgacgcgctctgacggccagcctcgaacggctcggcctggaccgcgtggacgtcgtctacctccacgaccccgacgaccatgccgaacaggccttccgcgagggctgtccggcgctggagaaactgcgttccgaaggcgtggtcggcgcgatcggcgcgggcatgaaccagaccgcgatgctgacccgcttcgtccgcgagacggatgtcgacgtggtgctgtgcgcgggccggtacacgctcctcgaccagcgcgcactggccgacctgctgcccgccgcggccgaccgcggcacctccgtcgtcatcggcggcgccttcaactccggcctgctggccgacccgaaaccgggcgccacctacaactatgccgctgcgccgcccgagttgctggaccgcgccctgcggctcaaggcggtggccgagcggcacggcaccaccttgcgcggcgccgcgctcgccttctgcgccgcccacccggccgtggccagcgtcctggtcggtgcccgctcgccgtacgaagtccgtgactgcgccgagcagttcgccgcgcccgtgcccgccgacttctggcaggagctgcgcgccgagcggctgctgcccgaggacgccccggttcccggcgaggagggccca

SEQ ID NO: 7264 - DNA, 312 bp, Streptomyces avermitilis
  CDS (1)..(312)
atgaggatcgcgctgcacaccaaggtccgcgccgaccgcgtcgccgcgtacgaggccgcccaccgcgaggtccccgaggagctgaccgccgccatccgcgccgccgacgtcacctcctggacgatctggcgctccggcaccgacctcttccacgtcctggagtgcgaggactacggccgtgtgctcgccgagctggagaagctgccggtcaacatcgcctggcaggcgcgcatggcggagctgctcgacgtcgtgcacgactactccggtgcgggcgcagaagcgggcctgcccgtcgtatgggagctgccg

SEQ ID NO: 7265 - DNA, 849 bp, Streptomyces avermitilis
  CDS (1)..(849)
atgggagctgccgtgacggtcgacgcccaccaccacgtctgggacctgtccgtccgcgaccaggactggatcaccggcccggaactccagcccctgcggcggaacttcactgtcgcggacctcgaaccggaggcacgggcggccggggtcgaccggaccgtgctcgtgcagacggtcaccgtcgccgaggagacgccggagttcctcgccctcgcggcggagagtgagctgatcgggggagtgatcggctggaccgacctgacccggccggacgtggccgacgagctggcgcgcctcgcggagctccccggcggcgcgtatctgcggggcatccgccaccaggtccagggcgagcccgaccccgactggctgctgcgccccgacgtccgccgagggctcgccgccgtggccggggcggggctcgtccacgacctggtggtcctgccgcaccagctgccggcctgcgtcaagtcggccagagacctgcccgaactcattttcgtcctcgaccacttgggcaagccgcccatcgcgtcgggcgcacgcgaaccgtgggcgacgcacgtccgggcgctcgccgcgctccccaacaccgtctgcaaactctcgggcatggtcaccgaggccggccccggcacctggacggccgacgcgctgcgcccgtacgcggacacggtcctcgacgccttcggccccggccgtctgatgttcggctccgactggccggtgtgcacgctcgccgcgtcgtacggccaagtcatcgacgtcgccaacgagttgacggccgcactcggggccgacgagcgcgaggacctgttctccggcaccgcgacccgggtctacggcctc

SEQ ID NO: 7266 - DNA, 1425 bp, Streptomyces avermitilis
  CDS (1)..(1425)
gtggagtggttcacggcaaccgactactggtggagccggctggtcttccagcgggcgctggccgtcgtgtatctcgtcgcgttcctcggcgcggccctccagttccgcgcgctgatcggggagcgggggatgctgccggttccgcgcttcgtggcacaggtgccgttccgtcgggcgccgagcgtcttccaactccactactcggaccgcttcttcgcggcctgggcgggcgccggctgcgcggtgtcggcggcgctcgtcgcgggtcttgactcgcacctgccgctctggggcgccatggtgctctggctggtcccgtgggtgctgtatctgtcgatcgtcaacgtcggccagacctggtacggcttcggctgggagtcgctgcttctggaggtgggcttcctcgccgtgttcctcggcaacgacgaggccggtccgcccgtcgtggtcctcttcctgctgcggtgggtgctgttccgcgtcgagttcggggccggcctgatcaagatgcgcggggacgcgtgctggcggaagctgacgtgcctgtactaccaccatgagacccagccgatgccgggcccgctgagctgcttcttccaccacctgcccaagcccctccaccgggccgaggtggccgccaaccacgtcacccaactggtcgtccccgttctgctgttcaccccgcagccgatcgccacggccgccgccgcgctgatgatcctcacccagctgtggctggtcctgtccggcaacttcgcctggctgaactggctgacgatcgtgctggccctgtccgcggtggcgttccccggcaccccgccggacgtgcccggcgcaccgctctggtacgagatcgtggtgctggccgtcgccgccgggctggtgggcctcagctaccggccggcccgcaacatgctctcccggcggcaggtcatgaaccgctccttcgacccgctccacctggtcaacacctacggcgcgttcggcagcgtcagccgcacccggcacgaggtggtgatcgagggcaccgccgacgacgaaccgcgcgaggacgcggactggcgggagtacgagttcaagggcaagccgggtgatccacggcggtggccgcgccagttcgccccgtaccacctgcggctcgactggatgatgtggttcgcggcgctctcccccgcgtacgccggttcatggttcggcggtctggtggagcggctcctggagaacgaccgcgacacgcttcggctgctgcgccgctcgccgttcccgccggacgccccgccccggttcgtccgggcccggctgtaccgctaccagtacacgacctggcgcgagctgcgggagacgggcgcgtactggcagcggacgtatgtgcgcgagtatctgccggcgacgcggctggcgacgagggtcgagctgcgggacccg

SEQ ID NO: 7267 - DNA, 2070 bp, Streptomyces avermitilis
  CDS (1)..(2070)
atggttgatcggggagcgagcgccctgtcactcccggacgactggaccgcccacccggatccgatcctggcgctcaaccgcatgggcagcttcgactgggacctggacaccggtctgatgcacatggacgcccaggcccacgagatcttcgacgtgcgccccgacgaatacgaaggccgccccgagaccctgagcgaccgggtgcccgccccggaggcccgccggctcgacgcgctggtctcccgggccctcaaggacggcagcgagaactacggagcctacttccgcctccgccgtcgcgacggctcgctgcgctggacccacacccagggctacatccgccgcgacgagggcggccgcccgcgccggatcgtcggcatcgtccgtgacgccacggaggaactgcgcgagagcgaggcacgccaggaagcgaggggccgggacgaagtcaggcgccggcagacgaacgtcgtccaggccatcacggcggccctggcccacgcacggaccgtccaggacgtgatcgacgtcctcaaggacacccacggcctcacctatctcggtgcgacgagcctggtcatgggcctggtggaggccggccgcatacggctggtcgccgaggggcccgcggggagcttcgtgcccggcaccctggtcacacgcatcgacgagaagtatccgatgagcgaggtcgtgcgcaccctcaggccgatcttcatcgagtcgcccgaggagttcgccgaccgctatccgatcctctggccgaacatcatcgacctgaacatcacctcgtccgcctacctgccgctcatcgtgcaggcccggcccatcggcgccatgggcctgctctacaacgaccggcgaggcttcaccccggaggagcgcaacgtcctcgtcgcgctcggcagcagcatcgcgcagagccttcagcgcgccatgttctacgagcaggagaaggatctcgcgcagggccttcagcaggccatgctgccccgctccatacccagcgtgcccggcgccgacgtggccgtccgctaccgctcggcgaagatcggccgggacatcggcggcgactggtacgacctgatccccctgccgggcggccgcgtcggcgccgtgatcggcgacgtgcagggccacgacacgcacgcggcggccgtcatgggccagctgcggatcgtgctgcgcgcctacgccgccgagggacacacgcctgccaccgtgatggcccgcgcctccgtcttcctgcacgaactcgacaccgatcgcttcgcgacctgcctgtacgcggaggccgacctgtccaccggggtgatgcagctcgtccgggccggccatatcgaccccctggtgcggcacatggacggcacctgccgacggctgcccgtgcagggcgggctgccgctcggtctctcggcggagttcggccgcctcgaatacccggtcgacaccatagagctcgatccaggcgagaccctgctgctgtgcaccgacggcctcgtcgagcagcccggtgccgacctcgacgagggcatgcagaccctgctggagctgctccgctcgggtccggacgacgtgcgcgacctcgccgacctgctgatcgacgtggccgaggaacgcggcggcgacgacgacgtggccctgctcctcatgcgccgccagggccttggccggcagtccggcgggcgtctccagcagcacgtcgcgcccggtgacccggaggcgctcaccgaggcccgccacatgatccgcgccgcggtccgggcctggggcgcccgcgagcgcgccgacgagatcgaactggtcgccgacgagctgatcaccaacgccctcatgcacaccgagggctccgcgatcgtcaccctcagggtcctcaccggccccgaccacagactgcgtgtcgaggtcgaggactcctccagcgccctgccccgccgccgcgaggccggtgagtgcgaggtgtcggggcgcggtctgctgctcgtggaccggctcgccgatgtctggggcgtggaggcccggggcagcggcaagtgcgtgtggtgcgagttcatcgtcccggagcggagc

SEQ ID NO: 7268 - DNA, 858 bp, Streptomyces avermitilis
  CDS (1)..(858)
atgccggaactgcccgaggtcgaagcgctcaaggacttcctggccgaccatgtcgtcggccacgaggtcgtgcgggtgctgcccgtcgcgatcagtgtcctgaagacgtacgaccccccggtcaccgcccttgagggccgggagatcacggcggtgcgccggcacggcaagttcctcgacctggaggcggacggcctgcacttcgtgacgcacctggcccgcggcggctggctccattggcgggacaagctgcccgacgccccgccccgccccggcaagggcccgctggcgctgcgtgtcgcgctggagacgggagagggcttcgacctgacggaggccggcacacagaagagactggccgtccatgtcgtacgggacccgggtgacgtcccgggcgtggcccggctcggcccggacccgctcgccgacgacttcgacgaggcgcgcttcgcgcggcttctggagggcgagcggcgccggatcaagggcgcgctgcgcgaccagagcctgatcgcgggcgtggggaacgcgtacagcgacgagatcctgcacgccgcgaagatgtcaccgttcaagctcacctcggccctgaccgccgaggagatacgacagctgtacgcggcactgcgtacgacgctcaccgaggcggtcgagcgctcccgggggctggccgccgggcggctgaaggcggagaagaagaccgggctgcgggtgcacggcagaacgggggagccctgtccggtgtgcggggacacgatccgcgaggtctccttcagcgactcctcgctccagtactgcccgacctgccagaccggcggcagacccctggcggaccggcggatgtcacggctgctcaag

SEQ ID NO: 7269 - DNA, 648 bp, Streptomyces avermitilis
  CDS (1)..(648)
atgaggtccctggaacgccatcgcgacgtcggcgcctacgcgctcggcgtgctcgacgaggcggaagccttccgcttcgaggaccacctcatggagtgccccagctgcacggcacaggtgaccgaattccggcccgccgcgcggcagttgatgctgtaccggcgggcgacgccgcgagccgtgcatcccttcgcggcacccggaccccgcctgatggagcggctgctcggcgaggtggcgacacggcaccgcagcgggcgcaggcgctggctgtacgcggtcgccgccgccgtggtgttcgcggtgggcgggcccgtggtggcgatggtcgccgggcacggctccgcatcgacggaactgaccgcgaccggcgcgaagaccggggtgtgggcgcaggtcaccacccaggaacgggtctggggcagcgagatcgacgtgacggtcaaggacgcctccggtccccactcctgtcggctcatcgcggtggggaaggacggttccgagcagaccgtgacgacgtggatggcgccctcgcacgacggcggtcccaccaccatgcagggcggcgccgcgctgcggcccgacgagatcgagcactacgacatccgcaccggcaacgggcagctcctgctgacgctcaggtcccac

SEQ ID NO: 7270 - DNA, 513 bp, Streptomyces avermitilis
  CDS (1)..(513)
atgctgcacagaggtcaagagagcacggacggcgccggcggcggtgaactcaccgtccccatggcatggttgtacgcggagtacatcgcggacgaactgctgcggaccggcgacctgatgccgccgacgtccttcgagttccgcgccgggcgcgacgccctggcgcttaccatcttcctctccgacaccagcggtgagctctccggtatccgggtcgtctcgcagctggagacctggctttcgctgacggcgtacgaccagccgtggcaggactgggtgtgtgcacggatggccgcgctggccgccgaggccgtcgagtcgggcggcccgtcgccggacctggatctggcgtccgcggcctggcgctggctggaggagaccgagctgctcgcccctgacctggacgcggtgcccggcggcggctcggtcttgggcgaggacgacggacccaaggtctggacgcccgcctggcagctggggctgccgctcggacacctcgccatccatcttttt

SEQ ID NO: 7271 - DNA, 546 bp, Streptomyces avermitilis
  CDS (1)..(546)
atgacggccgtaaccaccaccatcgggcgcgggacgaccgccgagcacgagctggcgcagctgcagcgcgagcacggccgaccgctcttcgcgctgctgctcaggctctgcgacggggaccgccagcgcgccgaggacctcgtgcaggagacgttcgtacgtgcctggcaacaccccgaggcgctgcgcgcgcacgatttcacctccgtgcgcccctggctgctcaccgtcgcacggcggctcgccatcgacgcgcgacgggcccgccaggcgcggcccgccgaggtcggggacgccgtactggagaacgcccgggtgtgcgccgatcacgccgaacggtccgccgcgacgctcgatgtgcgcgacgctgtgaagacactcactcccgagcatcgtgaagtactggtgcaggtgtatttccggggggcgagtgtggcggaggccgccgaggccctggggattccgcccggtaccgtgaagtcccgcgcgtactacgcgctgcgcgccctgcgccgggttcttccgggatacgcggccgacctgcgg

SEQ ID NO: 7272 - DNA, 1146 bp, Streptomyces avermitilis
  CDS (1)..(1146)
atgacaccacacgcccgccgggccgccgcggccctgaccgccgccctgctgaccgccggcgcggcctgccaggcccacgacccgtcgtcacggcaagcgggcgggcccgcggccgcgcccgcgacccgtggcttcaccctcgtcgcgtccggcgacgtcctgccgcacgccccggtcatcgagcaggcgaaggccgacgcgggcggcatcggctacgacttccgccccatgctcgcggctgccgaacccgtcgtgtcccgggccgacgtggcgatctgccatctggagacggtgttcggcgaggacggcgactactccggctattccgccttcgtgtcgccgccgcaggtcgccctgggcctcgctgccatcggatacgacggctgctccacggcctcgaaccatgccctcgactacgacacagccggcatccacagcaccctgaacgccctcgaccgggccggcgtgcagcacacgggctcggcacgcctggcgccggaggcggccgccccggccatgttccacgccgacggcgcccaggtcgcccacctggcgtacacccacgacatcaacggccgtccgctccccgcaggagaaccctgggccgtcaacctgatcgaccgggaccggatcgtcgcggacgcccgggccgcccgggcggcgggcgccgacgtggtcgtcgtatccctgggctggggcaccgagtggcaggacgagcccgacgcgcagcagcttcggctgagcagggaactgaccgcgtcgcagacgaagggccgccccgacatcgacctgatcctcggcacccgcgcccacgtcccccagccgtacgagaaggtcaacggcacctgggtggtctacggcctgggcgaccagatcgccggggagatggccaaccgggaaggcttccgcgacccgcgcggacaggagagcaccatcggccgcttcaccttcgccccgcccgcccgcgcgggagagcgctggcaggtgacgaaggccgagttcattccgcagcgattcgacctcggccgggtcgtggacctcaacgccgcgatcgcgcagggcgccgggacggcacccgtacgcgaccggatccgcgacgtcgtgctgcgccggggggccgccaaggacggcctcgtcatggggagt

SEQ ID NO: 7273 - DNA, 1416 bp, Streptomyces avermitilis
  CDS (1)..(1416)
atggccgggatccgaatgggtgagggtgttctccgccgcaaacccatcgaacagatcgaggagacggaggccggcacacagctcgagcggacactcgggctgtggcagctgaccgcgatcggggtcggcggcatcatcggcgccggcatcttcaccctcgccgggacggtcgcgaacggtacggccggcccggctgttctcgtctcgttcctcatcgcgggcttcgcgagcgccgcggccgcgctgtcgtacgcggagttcgcgggcctcatcccgaaggcgggctcggcgtacacctacggctacgcggtgctcggcgagctcgcgggctggttcatcggctgggacctgctcctggagtacacggcgatcgtggcggtggtcgcgatcggcatctccgggtacttcggcttcctggtcggcgagctgggcgccgatctgccggcgtggatgctgggcgcgccgggcacgggcggcgggcaccgggtcgacctgttcgcggcgatcctgtgcctgctcatcgcgtatctgctgaacctcggcatcaagagcgcggcccggttcgagacggtcgtggtcgctctgaaggtcctggtcgtgctgctggtgatcggtgtcggtgtcttccacatcgacacgggcaactaccaccccttcttcccgtacggggtcggcggggcgttcacgggcgcggcgaccgtgttcttcgcggtcttcggctatgacgcgatgtcgacggcggccgaggagtcgaaggacgcgcagcgccacatgccgaaggcgatcatctactcgctggccatctcgatggtgctgtacgtggccgcctgtctggtcctgaccggcatgcagaactacaaggacatcgacaaggagagcggcttctcgacggcgttcaagtcggtgggtctcggcggtctcgcggacgtgatcgcggtcggcgcgatcatcggcatcctcaccgtgatgttcacgttcatgctgggcgtcacgcgtgtctggttcagcatgagccgcgacggactgctgcccaagtggttcgccaagacgcatccgacgcggcacgtgccgacccgggtgacctggatcgtggggttcgcgtcggccgccatcgccgggttcctgccgatcggccaggcggccgaactcaccaacatcgggatcctgctggcgttcgtcgtggtgtgtgtcgcggtgatcgtgctgcgttaccggcagccggatctgccgcgcaccttccgcacaccgtggatgccgtacgtcccggcgctgggggtgatcttctcgatctggctgatcacgtttctgcagtggcggacgtgggtgcggttcggcgtgtggctcgtgatcggcctggtcatctacttcggctactcgtacaagcgctcggaactggccaagggcgtcaactcccca

SEQ ID NO: 7274 - DNA, 459 bp, Streptomyces avermitilis
  CDS (1)..(459)
gtgacggaacagcactcccaccagttcgagcgtggcacggacggtcccaaggtgatcctcgtcggggtggacggctccgactcctcgctccacgcggcggcgtatgccgccggcctggccagacggcagcacgcgctgctcgccgtcgtgtacgtgcagccggtgatggcggcgggagcggcgctcggggttccggtcgccgacaccaccgacgagatcgcggcggacctggtccagtacatccgtgacgcgaccgagcgggtcaaggacatattcgaggtgcgctgggagttccacaccttccgcggcgacccctacaacggcctggtgacggcggcggacgaactgaaggcggacgcggtcgtggtgggcgcctccgagcaggcggggcaccggatcgtcgggtccgtggcggtccgcctggtcaaggcggggcgctggccggtcacggtcgtgccg

SEQ ID NO: 7275 - DNA, 3279 bp, Streptomyces avermitilis
  CDS (1)..(3279)
atgagtgccaccgtggaggccgccggacccgggcacgccaccggcccgacacggccgtcctggggcggcttcctcagcaaggtgcccgagggcttcgcgaccttcttcggcgccctcggcctcctgtgcgtcctgctggccttcatcgcgccgctgcgccgtctgctgggcccgttcgtgcgcgacctcgacaggttcgtggtcccggtcagcgccaacctcgcctacggcgtcttcctcttcctgctcgccgccgcgaccgccgcccgcaagaaggtcacctggtggctcgtggtcgtctacctcggcctggtgaccctcgacgacctgctcggcctcgccctcggccactacgccgagtcggtcgtctcgctgatcgtgtgctcactcgcgctggcgctgctgatcgcggcccgcaaggagttctacgcggcctcccggcgcggcgccgcgtggcgggccctcgccgtgctgttcgccgggctcggtgtggcgatcctggtcgggtggggcctggtcgaactcttccccggcacgctgccgcgcgaccagcggctgctgtgggcggccgaccgggtctgcggcggactggtgtccggacgccggttcgacggacgcacaccacgccccgtgtccttcctcctcggcctgttcggcgcactcgccctgctcaacgccgccgccaccctcttccgctcccagcgcatggagtcggccctgcacggcgacgaggagccgcgcatccgcgccctgctcggggcgtacggcgccgacgactccctcggctacttcgccacccgccgggacaaggccgtcgtcttctcgcccagcggcaaggccgccgtcacctaccgggtcgaggccggtgtctgcctggccagcggggacccggtcggcgaccgcgaggcctggccgcacgccatcgacgcctggctcgacgtggcccgccgccacgcctgggcgcccgccgtcatgggcgcctcggaagagggcgccaaggcgttcgcccgctccggactcggcgcgctccaactgggcgacgaggcgatcctgaacaccgccgacttcgatctcgacggccgcgacatgcgggtgaccaggcaggccgtcaaccgcgtgcggcgcaccggcgccacctgccgggtacgccggcactccaccctcagcgacgaggagatggaggaggtcgtcggccgggccgacgcctggcgggacaccgagaccgaacggggcttctcgatggccctggaccggctcggcgaccccgcggacggcgactgcctcctcgtcgaggccctgggagaggacggaaaactcctcgccctgctctccttcgtgccctggggcggggacggcgtctccctcgacctgatgcgccgtgaccgtgccgcgcccaacggagtgatggagttcatggtcgccgagctgtgtgccgtggccggacggacgggcatacgccggatctcgctgaacttcgcggtgttccgctcggtgttcgaggagggcgcccgtatcggtgccgggccggtcctgcgtctgtggcgccgactgctgctcttcttctcgagatggtggcagctggaggccctgtaccgctccaacgccaagtaccacccgcagtggtacccgcgcttcatctgctacggcgacaccgcctccctcgcccggatcggactggcgtcgggcatcgccgagggcttcgtctccgtgccctcgctgcgcaagctgtggggcaagggccactccaaggggatcaccgagccgacgacgaccgagggtctgccgtcgctgtcggcgctcggcctcgacaagggcgacgagaccgggccgggcgcgccgggactgcccgaacaggtccgggtgcgcctgagcaagctcgaccggctgcgcgcggacggcaccgacccctaccccgtgggcatcccaccgcgcacccacaccctcgcccgggcccgtggctctccggcgggcgagcaggtcaccgtcgcgggccgcgtcatgctcgtacgcgacttcggcggcatcgtcttcgccgtgctgcgcgactggtcgggtgatctgcagctcgccctcacccgatccgggtccgggcccgcgctcgaccggttcggcaaggacgccgacatcggcgaccacatcaccgccaccggccggaccggcaccagcgaccgcggcgagccgacggtcttcgtcacggactggcagctcaccggcaaatgcctgcgcccgctgcccgacaagcaccgaggcctcgccgaccccgaggccaaggtgcgccgccgctatctcgacctggtggcgagccccgacgcccgcgcggtcgtacgggcccgctccaccgccgtccaggcgctgcgccaggggctcctcgaccgcggctatctggaggtcgagacgccgatgctccagcagatccacggcggcgcgaacgcccggcccttcaccacccacatcaacgcctacgacctcgacctgtatctgcgcatcgcccccgagctctacctgaagcggctgtgcgtcggcggtctggagaaggtcttcgaaatggggcgcaccttccgcaacgaaggcgtctcctacaagcacaaccccgagttcacgatgctggaggcctatcaggcgttcgccgactacgacgtgatgctcgacctcacccgcgaactgatccagggcgcggccaccgcggccttcgggggaccggtcgcccgcaagaacggcaccgagcacgacatctccggaccgtggccggtgaagacggtgtacggcgcgatctccgaggcactgggggaggagctggacgccgggacgagccttgaggccctgcaccggcactgcgaccgggcgggcgtgccgtacaccgcggacgacggccgtggtgacgtggtcctggagatgtacgagcggctggtcgaggagaggaccggactgcccaccttctacaaggacttcccgaccgacgtctccccgctcacccggcagcaccgcgccgatccgcgcctggccgaacgctgggacctggtcgccttcggtaccgaactgggcaccgcctactcggagttgaccgacccgatggagcagcgcagacggctgacggcgcagtccctgctggccgccgggggagaccccgaggcgatggagctggacgaggacttcctcgacgcgctggagtacgcgatgccacccaccggcggcctcggcatcggcgtggaccggctcgtcatgttcctcacgggcctcacgatccgggagaccctgccgttcccactggtacgccgccgc

SEQ ID NO: 7276 - DNA, 846 bp, Streptomyces avermitilis
  CDS (1)..(846)
atgaaaaaggatcagctgctcacgcggcgccgggcgttgctcgccggtgccgctgtcctgggcgcggccggggcggcaggcacggcccggctgctcaccgccgacgagccggccgggagcccggtgcggaacaccgcccccgtcgcgggcccaccggtgcgccgcgcgctcaagccctccgcctaccgtctgcggcccctcaccggttatggcccgccacgcagcgcgcccgcgcggaccgtcgtccggcacgagccgttcctgcgcatctccgggcgcggccgcagcatggtgctgaccttcgacgacggccccgatccgcgctacaccccggacatcctgcgcaccctgcgcgagtacgacgtacgcgcgatgttcttcgtgtgcggggagatggccgtcgacaacaaggacctgctgagtgagatggccgacgacgggcacgtcgtcggcaaccacacctggacgcacccccggctcaccgagctgtcgcggtccgggatccgctccgagatggaacgcaccagcgaggtcatcgagcaggcgtacggcgagccgccgcagtggttccgcgcgccgtacggtgtctggaaccgggcggccttccagctcggggccgacctgggcatggagccgctggcctggacggtcgactcgctcgactggacgaccccgggcacccgcaccatcgtgaaccgggtggaggacggtgccgcccccggcgtcgtcgtgctctcccacgacgccggcggcgatcgctcgcagagtgtgcgggcgctgcgcgactatctgcccgcgctgctggattccggctatcacctcacggtgccccgacggcagttcgca

SEQ ID NO: 7277 - DNA, 708 bp, Streptomyces avermitilis
  CDS (1)..(708)
atgcgcgacggacatggcgacggccacgtcgagaggggattgcgaatgtccgtgtccgagctggccgaagaggaggagcggcggaggaagcgggccccgtggggcgtgatagcgcttgttctgctgaccggcctcgctctcattcggaatggttcgggggagttcgacgtgggccccccgcagccggcgacggcggcggccgcggacagccgcagcaccccgaagccccccaccgccaagctgccccggcccctgccgtactccgcggcccgacgcgttcgcattccggcgatccaggtcgacgcccccgtcactccggtgggtctcgacatgtccggctgggtggacgcaccgtcgcccgacgacccgaatctcgccggctggttcaccggcgcggtctcgcccggtgagaacgggactgcggtggtcgtgggccatgtggacaacatgaagggcccggccgtcttctacggcctgggggcgctgaagaagggcaaccgggtcgaggtcgagcgcaaggacgacaaggtcgccgtgttcgagatctacggagtcgaggtcttcgcgaagagcagctttcccagcgaccgcgtctacgcgagcaagggcgccccggagctgcgcgtcatcacctgcggaggaggcttcaccaagcagaacggctatgacgggaacgtggtggtgttcgcccgcctggtcgaggtccgc

SEQ ID NO: 7278 - DNA, 1218 bp, Streptomyces avermitilis
  CDS (1)..(1218)
atgcgtacttctcgtgccctggcggccggtgccgccgtggccctggccgtcgggctcgccgcccccacggccgcggccttgagcgacccgagcaatatcgtcgccctgtccagagtcatcgcgcggggcgggcagctgacgatcaccgtggaagggtccaggtgccaggtcaacggcagcacggtctcctcgccggtcttcccgacgacccggctgagccccgcggggcacaactcggcgagcgcccgcgtcaccatcgaccgcaacgcgcgcccgggctcgtacgggattacggcccgctgcggcaatggcaccggagtcgtgaacggcgctaacggcgggcccggtaacggggtcgggaacgggaacgggaacgggctcggcaacggattcggcaacgggttcggcaacgggttcggcaacggatttgggaacgggctcggcaacgggttcgggaacggattcggcaacgggttcgggaacggattcggcaacgggttcggcaacggtaacggagtcgggaactgcaacggcttcgggaactgcaacggagtcgggaacggcaacggcttcggtaacgcgaacggcaatgggctcgggaacggcaacggtcacggcaacggcttcgggaacggcaacggcttcgggaacgggaacgggaacggaatcgggaacgggaacggcttcgggaacggtaacggcctcgggaacggcaacggtcacggcaacggcctcgggaacgggaacggattcggcaacggcaacggcaacggactcggtaacggattcgggaacggcaacgggctcgggaacggtaacggcaacggattcggcaacggcaatggacttggtaacggattcggtaatggcaacgggctcggtaatggcaacggcctagggaacgggaacgggctcggcaacggcaacggcaacggtcacggcaacggtctcgggaacggcaacggtcttgggaacggcaacggtctcgggaacggtcacggcaccggacttgggaacggcaacggcaacggcaacaacgcccagtccctgacccggcccaacgcgttcaccgtcatcggcggcgtccgcggcggtctcggcggtagcagctccatcggcgccacgcccaccgacatggcgatcggcggcggactcgtcgcggcggccgtgatcgccggcgggttcttctggatgcgccgccggaccgagaacaagagc

SEQ ID NO: 7279 - DNA, 762 bp, Streptomyces avermitilis
  CDS (1)..(762)
ttgtcggaatggcttgttctcgccctcgcgatggcggccgcctgtgtcgtggtggtcatcgtgaccctcgtacggcatcgcacggccgccgaggacgacgatccgtccgagaccccggacgtgatcgagtacatgacgatgatgatcggcgtggtgtacgccatcgtcctgggcctggccatcgcgggtgtctgggaggcgcgcagcgtcgcccaggaccacgtgcagacggaggcccaggcgctgcacgagatctccgaacgggtgcgggtctacccgcccgacgtccgcgaccgcatccgcgacgacgtcaacgcgtatgtcggccaggtcgtcaccaccgagtggaagaccatggcggacaagggccgggtgaccgcccggggcgcggagctcttccagcgcatccgccaggacgtgaccgactaccaaccgaagacggacttcgaggctcaggcctatcagccgctcgtcgaccaggtgtccgcggccgacaccgcccgggcctcacgcgccgactcgacgggcgcgaccatgccgggcgtggtgtggttcgggctgatcacgggtgcggtggtcaccatcgggatggtgttcgccctgcagatccggcgtacgaaacgggagctggtccttgccgggctgttctccgccctgatcgccttcctgctcttcctgatctgggacttcgacgcgccctacagccggggcgtcgcggcctccgcggagcccttcctggcgctcttcccgcaccttcacggg

SEQ ID NO: 7280 - DNA, 618 bp, Streptomyces avermitilis
  CDS (1)..(618)
atgatctccgtcgtgtatggacccgaacggactcgatccgccgtcgccataagggtgttggccctggtggcgttggtctggatcctcatgggcgtgccgcccgagacggcggtcgccgacgcctgcgcgtacgtctcgaccggcccggacggcatcgaggtggtggcggccgccggcgacggtctccgctgccccgtcccgtcgactcccccgccctgcccgacaccgacccccaccctcacaccgccaccaccgccacctccaccgccacctccaccggctcccaccccgacgcccactcccagcccgacgcccaccgagcggccgagaccgacgccgagacccgacccgccgccaccccggccggcgccgccaccgcccgtcgccgtggcgccgcggccgactcccactccgacgcccacccccacccccacgccgacacccacgcggactcgcgctccgaggccgagcccgccgcccgaggcgtccccggtgagctatccgcggtaccacgcctcggcgcaccagcggccaccgcgcggcggcccgccgctggtcaccctcgccctgctcatcaccgcgcccgcggtgctcgccgtcgccgcgctgcgtccgcgc

SEQ ID NO: 7281 - DNA, 951 bp, Streptomyces avermitilis
  CDS (1)..(951)
atgaagacctcctggcggagcgcctcactcgtagcggcagctgcggccgtgctggcgctcacgacggcgtgcggtcaggaatctggcacccagtcgacaggcagtcagaacgtgggcgcagccgcgcctgccgccggttacacctccagccccggtgccgctgctggatccggaaatggttacggcgcggattccaaggaggagcagaactcgtcttccacggaatccgcaggtcagttgacggttgccgagaacgtgaagatcggcaaggtgatcaccgacgccgccggtttcactctctaccgtttcgacaaggacacggcggaaccgccgaagtcctcctgtgacggcgactgcgccaaggcctggccgccggttcccgccgagggcgcctcggccgccaccggcatcgacaaggctctgctcggcgaggtcacccggtccgacggcaccaagcagctgacggtggccggctggccgatgtaccggttcgcgaaggacaccaaggccggtgacaccaagggccagggcgtgggcggcacgtggtacgccgcggcgcccgacggcaagaaggcctcggccaccgatctgcccggactctccgtccgcaacgatcccaagctcggcgacatcgtcgtcgacaagaacggcaagacggtctaccgcttcctgaaggaccaggcctggcccacccccaagtcggcctgcgtcggcgcctgcctggagaagtggcccgtcgtcgcgccggtcgcggcggacgacaccaagggcgtccagaagaagggcctgatgaacttcgcccgtccggacggcgccaagcagcagaccatcaactgctggcccatctacaccttctccggtgacaaggccgccggggacaccaacggacagggcgtgggcggcacttggtacgccgtcgcgcccgacggaaagccggtcggcgcgccgaag

SEQ ID NO: 7282 - DNA, 810 bp, Streptomyces avermitilis
  CDS (1)..(810)
atgcagcgtcccgcctgggccccacggagcatcgacatctcggtgccgagcgtgtcccgcatctacgactactacctgggcggttcgcacaacttcgaggtcgaccgggaggcggcccgcaaggcgatggagttcatgccgggactcccgaagatcatgcaggccaaccgggcgttcatgcgccgcgccgtgcgctacgcggtcgacgagggcatcacccagttcctcgacatcggctccggcatccccaccttcggaaacgtgcacgaggtggcgcaggcggccgaccccggcgcccgggtcgtgtacgtcgaccacgacccggtggccgtggcgcacagccaggccgtactcgcgggcaccgagggcgcggacgtcgtcgcgggcgatctcctcaagccccgggagatcctcgcgagccccgaggtggaggggctgatcgacctgaaccgtccggtcgcgctcctcctcgttgccatactgcacttcgtggaggacgcggacgacccgtaccgggcagtggccgagctgcgcgacgcactcgcgccgggcagcctgctcgtcgtcacgcatgcctcgtacgagggagttccgctccctcaggagcgggccgaaggcgcggtcgacgtgtacaggaacatccgcaacccactgatcatgcgctcgcgcgaacaggtcgcgcggttcttcgaggggtacgacatggtggaacccggactggtgccgatgccgaactggcggcccgacacggcacccgaggacgaggatccgtatgccttctccggattcgccggcgtggggcacgcggcg

SEQ ID NO: 7283 - DNA, 2151 bp, Streptomyces avermitilis
  CDS (1)..(2151)
gtgaccccggagccggacggaccggaggacagactgcgcaggttcgcgacgatctggagccgggcggtcttcccggtgacctcgacgccgctgacccgtccggagctggagaaccgactcctgccgctcgcccggcggttgagcgaggcgctgcgggccagggcgttcgacgcggccgaggccaaggcggtcggcgccgcgctgatcgacgcgcactgcaccgaccccgacgcgctcagcgccacgctcgactgcgtcgacgcctacctggtgctctactgcggcaccccggacgcgtcccccggggaccaggaggccctgcgcacccgtgcctcgcggttgcagcacgccatggcggccggcttcgcgcaggcgctgcgggagcggacgctggccgagcaggaggccatctccgtcgccgcgttgcaggcccaaggggtggtggggcaggcgctccacgcgagcgaggcccgcttccgcgcggtcttcgagggcgcggccataggcattggcatcgccgacctcgaagggaacatcctccagatcaacggcgcgctgctgcgtatgttcggcggttccgagcaggcggtgcgcggccgcaacgtcaccgactggacgcaccccgacgacgctccacaggtctggcggctgtacgaggagctggtccgcggcgagcgcgagcactaccacgtcgaaaaggccttctaccggcccgacggcaccgtcctgtggaccaacctgacggtgtccctgctgcgtgacgcggacggccggcccgagtaccagctcgcgctgatggaggacaccaccgagcgccggctgctgaacctccggctgcgctacgaggccacccacgacgcgctcaccggactgcccaaccgcaccctcttcttcgagcggctggagaaggcgctgtcggcgggcggggggcagcggttcgggctgtgctacctcgacctcgacggcttcaagaccatcaacgacagcctcgggcacgcggccggggaccggctgctcgtcgaggtcgccgaccggttgcagtcgtgcgcgaccgcgcccggcgagatggtcgcccggctcggcggcgacgagttcgtcgcgctgaccaccggacccgacaccgagcgcgaggtcgacgaactcgccgggcgcatcatgaacgcgctcgtcacccccatcagcatcgacggccgggagctggccgtgcggggcagcatcggcatcgtcgagggcccggccggggaacgcggtccggcggaggtgctgcgcagcgccgacatcaccatgtaccgggccaagtcggcgggtggcaaccgcttcgagctggccgaccccgaggccgacgcccgcgccatcacccggcacggtctcaccacggcactgcccgcggccctggaccggaacgagttcttcatcgagtaccagccgctggtgcacctcggcgacggcagcgtccgcggtgccgaggcgctggtgcgctggctgcatccgcagcacggtgtgctcggccccgaccgcttcatcccgctcgccgagcacaccgggctgatcgtgccgctgggccgctgggtcctggagcagtcggtgcggcaggcccgggagtggcaggagcggcactgcgcagaggcggcggccccgctgcgcatcaacgtcaatctgtcaccgtgccagctcacccaccccgggctggtgtccgacacggtcgacatcctggagcggtcgggtctggaacctggcgcgctgtgcctggaggtcacggagtcggcgctcatcggggccgacgacgatctgctcaaacccctgcgccgactggccgagatgggcgtggacatcgccctggacgacttcggcacgggctactcgaacctcgccaacctgcgccggctgccggtgagcattctgaagctggaccgttccttcacccagggcatgcagcagtacccggcggaccccgtcgacctcaagatcgtggagggcatcgtcaccctcgcgcacagtctcgacctcgcggtcacggtcgagggcgtcgaaaccggcgcgcaggccgagcagctgcggatactgggctgcgacacggcccagggctggtactacgcccggccgggaccgccggagcggttgcacgagctggccctggtggacgccaccggc

SEQ ID NO: 7284 - DNA, 777 bp, Streptomyces avermitilis
  CDS (1)..(777)
atgagcaaggaactcgagggccggaccgccgtggtgaccggcgccagcaagggcatcggactggccgtcgtgcaggcgctggccggggcgggggcgcaggtcgtcgccgggtcccgtaccacgtccgagggcctggacgggctggtcgaggagggctccgtcacctgggtgcccgtcgacctcgccgagcccgagggggccggacgactggtcggggcggcgggcgggcgcatcgacatcctggtcaacaacgtcggctcggcaccggcccgcaccggcgggttcctgtcggtgaccgacgaggactggcaccgcacggtcgacctgaacctgctcaccgccgtacgggtcacccgggccgccctgcccctgatgctggaggccggccagggctccgtggtgacgatcagctcggtcaacgccaccctgcccgacccgctggtgatcgactacagcgcgagcaaggccgccctggtggccttctccaaggcgctgtcgaaggaggtcggcccgaagggcatccgggtcaacacggtgagccccggtccggtggagacggaactgtggctcggcggcgacggggtggccgccacggtgtcggccgccgccgggatcacccccgacgacgtggtggcacgggcggcgggcgcgacggtcaccggccgcttctcgcagtcggccgaggtcgccgacctggtcctgttcctcgccggggaccgcgcccggaacatcaccggcagcgacctggtcatcgacggcggctacatcccgacgtgg

SEQ ID NO: 7285 - DNA, 891 bp, Streptomyces avermitilis
  CDS (1)..(891)
gtggggtgggtgcagttccaacagctccagtacttcgtggcggtggccgagacccggcacttcacccgggccgccgacctcgtgcatgtcgcacagccctcgctctcccagcagatcaaggccctcgagaaggagctgggggcggatctgttcctgcgggcgcgcgggaacatcacgctcaccgacgcgggcgaggcgctgctgccgctggcccgccgcatcctggccgacgcggacaccgcccggcacgaggtgcaggaactggcccagctgcgcagcgggcgcgtccgcctcggcgcgaccccgagcctgtgcacgggcctgctcccggacgtgctgcgcgccttccacgaccgctatcccggcatccggctgctgatcgaggagggcggctcgcacgatctcgtacgggaactcgcccgcggcgcgctcgatctcgcgctggtcgtgcttcccctgcctacgccgtcgcccgcgctgacgacggtggagctgctgcgcgaggatctggtggtggtgtcgtcaccggacgccccggcaccgggccggggccggcgtacggtgcggatccccgatctggagggcgagcgcctggtgatgttccgccacggctacgacctgcgcgaactgaccgtcgccgcgtgccgtgccgagggcttcgagccggacttcgcggtggagggcggcgagatggacgccgttctgggcttcgtacgggcggggctgggggtggcggtcgtgccgcgcatggtggcgacgcggtcgggtcggggtttgcgggtgaccccgctggcccgccccggtctgcaccgtacgatcgccctggcccaccgcagcgacgtggccccgccgcgggcggcccgcgagctccagcggatgctgctggaacgg

SEQ ID NO: 7286 - DNA, 705 bp, Streptomyces avermitilis
  CDS (1)..(705)
atggctctggcaacacggacggaccgacggtcgtccatggcacgcaccgtctgggacagctccgtcggcaagaaaacggtcatggcggtgagcgggctcgtcatgctgctctacctggtcgtccacatgatcggcaatctgaagatcttcttcggatccggtgagttcaaccactacgcccactggctgcgcaccctcggcgagcctttcctccactacgagtgggcgctgtggatcatccgcgtggccctcgtcgccgccgtcgtcgcccacgccaccgccgcctaccagctgagccggcgcgacatcagggcgcgccccagcaagtacgtgcaccggaaggcgcgggccagctacgccacgcgcaccatgcgctggggcggcgtcatcctcggcctcttcatcgtctggcacatcctcgacctgacgacgggctccgtgcacccgggcggattccagtccggccacccgtaccagaacgtggtcgacaccttctccacctggtacggcaacatcatctacatcgtcgcgatgctcgcgctcggcctgcacatccggcacggcttctggagcgccgcccagacgctcggcgccggcagccgcacccgcgaccgcgccctcaagaccgtcgccaatgttctcgcgctgctgctcacggcgggcttcgtcgccgtacccgtgggcgtcatgaccggagtggtgagc

SEQ ID NO: 7287 - DNA, 1947 bp, Streptomyces avermitilis
  CDS (1)..(1947)
atgcattcctacgcggactacgcgaccggtgagccggtcgtcgacagcaaggccccgcagggcccgatcaacgagcggtgggacacccgccgtttcgaggccaaactggtcaaccccgccaaccgccgcaagcacacggtgatcgtcgtcggcaccggcctcgcgggcggctccgccggcgccacgctcgccgaacagggctaccacgtcgtccagttctgctaccaggactccccgcgccgcgcccactcgatcgccgcgcagggcggcatcaacgcggcgaagaactaccgcaacgacggcgactccgtccaccggctgttctacgacaccgtcaagggcggcgacttcagggcgcgggagtcgaacgtccaccggctcgcgcagatctcggtcgagatcatcgaccagtgcgtggcgcagggcgtgccgttcgcccgggagtacggcggtctgctcgacacccgctccttcggcggcgtacaggtctcgcgcaccttctacgcccgtggtcagacgggtcagcaactgctgctcggcgcgtaccaggcgctgtcgcggcagatcgccgcgggcaacatcgagatgcatccgcgcaccgagatgctcgacctgatcgtcgtcgacggacgggcgcgcgggatcgtggccagggatctcatcaccggccgcatcgacacgtacttcgcggacgcggtggtgctggccagcggtggctacggcaatgtcttctacctctcgacgaacgccatgaactccaacgccaccgccgtctggcgggcgcaccggcgcggcgcctacttcgccaacccctgcttcacccagatccaccccacctgtatcccgcgcaccggcgaccaccagtccaagctcacgctgatgagcgagtcgctgcgcaacgacggccgcatctgggtgccgaaggcgaagggcgaccagcggcccgcgaacgagatccccgaggacgagcgcgactactacctggagcgcatctacccctccttcggcaacctcgtaccgcgcgacatcgcctcccgcgccgcgaagaacgtctgcgacgagggcaggggagtgggccccggcgggcagggcgtctacctggacttcgccgacgccatcaggcgcatgggccgggcgaaggtcgaggagaagtacggcaacctcttcgacatgtacgcgcggatcaccgccgaggacccgtacacggtccccatgcggatctaccccgccgtgcactacacgatgggcggcctctgggtcgactacgacctgcagaccacgatcccgggcctgttcgcgatcggcgaggccaacttctcggaccacggggcgaaccggctgggtgcctcggccctgatgcagggcctcgccgacggctacttcgtgctcccctccacgatcaacgactacctcgcgcgcaacccgcaccccgaggaggtgacggccgaacaccccgtcgtccaggagatgctggccgacaccgaggaccggctgcggttgctgctcgccgtcgacggcgaccgcacccccgactccttccaccgcgaactcggcgaactcatgtgggagttctgcggcatggcccgcaccgagagcggactgcgcaaggcgctcgaacgcatcccgcagatccgcgaggagttctggcggcgcatcaaggtccccggcgtcggcgaggagttcaaccagtccctggagaaggccaaccgcatcgtcgactacctcgaactcgccgagctgatgtgcctcgacgcactgcaccggtccgagtcctgcggtggtcacttccgcgaggagtcccagaccccggacggcgaggcggcccgcagggacgaggcgttctcgtacgcggccgcctgggagttcaccgacaccggcgacgcgcccgtcctgcacaaggaagacctcgtcttcgagtacgtccaccccactcagcggagctacgca

SEQ ID NO: 7288 - DNA, 747 bp, Streptomyces avermitilis
  CDS (1)..(747)
atgaagctcaccctgcgcgtctggcgccagcagaacgccgacgccgacggagcgatgtccacctacgaggtggacgacatctcggccgacatgtccttcctggagatgctcgacaccctcaacgaggagctcatcctcaagggcgaggaccccgtcgccttcgaccacgactgccgcgagggcatctgcggcgcgtgctcgctcgtcatcaacggcgacgcccacggacccgagcgcaccaccacctgccagctccacatgcggtccttcgaggacggcgacaccatcgacatcgaaccgtggcgcgcctcggccttcccggtcgtcaaggacctcgtcgtcgaccggtcggccttcgaccggatcatccaggccggcggctacatcaccgccccgaccggcgccgcgcccgaggcccacgccacggccgtgcccaagccggacgccgacttcgccttcgagcacgccgagtgcatcggctgcggcgcctgtgtggccgcctgcccgaacggcgcggcgatgctgttcacctcggccaagatcaaccacctcaacgtgctgccgcagggcgcgcccgagcgcgagacccgcgtcctcgacatggtgacccagatggacgaggagggcttcggtggctgcaccctcgccggagagtgcgccaccgcctgcccgaagggcatcccgctggtctccatcaccggcatgaacaaggagtggctgcgggcgactcgtaaggcggccaagcgg

SEQ ID NO: 7289 - DNA, 768 bp, Streptomyces avermitilis
  CDS (1)..(768)
atgaccggcgtttccaccctcgacagcccgccgcagccgacggcccccgcccgctacaccgtcaccctcgcccgcgacgaagccgacgtccgggccgcgcagcggctgcgccacgacgtcttcgccacggagatgggcgccctgctgtccaccccgcagccggggctcgacatcgacgccttcgacgcgtactgcgaccacctgctcgtccgcgacacggcgaccggtcaggtcgtcggcacctaccggctgctgccgcccgagcgggcggcggtcgccggccggctctactccgagagcgagttcgacctcggcccgctcgccgtagtccgctccggactcgtcgaggtgggccgctcctgcgtccaccccgaccaccgggacggcgcggtgatcgggctcatctgggccggcatagcccgctacatggtcgacggcggccacgagtggctcgccggctgctgctccgttccgctcgccgacggcggtgcgctcgccgcggccacctgggaccgggtcgaggccaagcacctggcgcccgaggagtaccgggtacggccgcggctgccctggaacccggagggcgtggcccggccggcgcgcaccgaactgccgcccctgctgcgcggctatctccgcctgggcgcctgggtgtgcggccgccccgcgcacgacccggacttcggcgtcgcggacctctacgtcctgctgccgatgcgccgagtcgacccgcgctatctgcggcacttcctctcgctcgtaccggcg

SEQ ID NO: 7290 - DNA, 897 bp, Streptomyces avermitilis
  CDS (1)..(897)
gtgcccgtccccgcgtccgcgtctgccgctcggcggccccttcccgcggggtccgccggggggcgttccgccgcgcgggtcagcgcatggctgcccaccgcgccgtgcactgcgcgtggatgcgtggagagcacggcggcctggaccgccgtgccgcgcgcggtactgcggctcaccgcgctcctgctcctggtcctggccggtgtcctgctgaccccggccgtcgggcggatgcgcgcggcggagcgcgacccgctgatccgacgatggtgccgggccgtggcgcgtgccgccggtgtgcgggtgcgcatcaccggggccgccgcccccaccggcggcctgctggtcgtggccaaccacatctcgtggctggacatcccgctgctcgccgccgtccgtccggcacggatgctcgccaaggccgaggtccgcgcgtggccggtggcgggcgcggtggcggcacgagggggcaccctcttcatcgagcgcgaccggttgcgggccctgcccgacacggtggggcggatcgccgccgccctgcgcggcggggcggccgtcgtcgccttcccggagggcagtacctggtgcggccgggcccagggccggttccggcgggccgtcttccaggccgcactcgacgccggcgtgcccgtccagcccgtgcgtatccactaccggtccgccgggggagcggcgagcaccacgcccgcgttcgtgggcgacgacccgctgctcgcgtcactgtggcgggtggcgtcggcgcgagggctggtggccgaggtcgaggtgctgccgatgccggcggccggtgaccgcgccgaccgccgggcccttgccgacgcggcgcaggaagccctgcgcagggcgagcacagggccgcagtcgacgtcgcatccc

SEQ ID NO: 7291 - DNA, 2925 bp, Streptomyces avermitilis
  CDS (1)..(2925)
ttggtgaacgagcacgacccggtgcgggcggacgacaacggcctgctgaacgcgccgccaggaacgaccgagttcctgcatctcgtgcgggcactggtgcccaggccgcggcgtggcgagcggtggctgcccgcgttggagatcgacggcccgcacgcgcgagccgtgtacgacgtgctcaacagccgtctggtcaccgccgctcggccgaccccgtactgcgcggtgccgtcgcccgagacggaaacccgggtcggtcacggtccggagcccacgaacggcacggccaggacgggcgggacggacgggacgggcgggacggacgggacggacgggacggacgacccagcctccgacacggaagtgtccggccgacgggcggaccgcgggggaaccgcgctggccgaggaggccgatcccgccggtcacgccctcgatcaccaggacgtcgaggcgctgcgggtcctgctggacgaggtctgccacggcctcgcacggcagcgaagcggccaaccgcggctgcgtttccggcacttctccctggtgcagtgggccatgaacacccggctgcccgcgggtgcccggacggacgagtatcccgccgtgctcgccgccgacctgcgcgcgacccgacgcggagcggaccgccccgcggccgacctcacgggcctcggcggcgcgctcgatcccgtccttcaattcctgtggaacgtactgacggtggccgtgcccccggccttcttccgggtggtggccggaggccgtgttcccggactggggcgcacctaccggtggttcatgcggcagccctacctgagacctcaactgtccgggaacttcctcggcctcgccgaacggctgaccgccggttaccgggccgacgagccctccgaacaggtggcgaagctgctggtgcacgcctttctggaggacctgcgtcgctcgttgcggcgccgtccctggcggcccggcggctggcggcacacggcgtaccccgtggtgcagatccgcagcggggaatcacccaccacgagccggacactgctccggctcgtggaacaggtgcgggacgagaccgggcggctcgtgcccgtcctcctggtacacgtcgcaggccggcaggacggcggcccggtaccgtccgctcccgcccacgcgctgcgcatgacggatctgcacgcgatcgaccggaaccagtgggctcccgtctcgtaccgaagccgtctggcgcgccggacctccgcgccgacggcccgggtccgcgggcggcgccggctgtgggccgatggcgaggtggacgcggagcgggtgcccgcctccgccgtggtggcggccccggctccgccgtggttcagccgccccgtcgtgatcgtcgccgcctgcctgttgctcttcgtgcccgccgcggtctggtccgggcggtatctggggattcccggctgcctgcaccggccgttcgccgccgacgtcgtcgtgcgcgacgtcggcggagagtgcatcggcttcagcgacggcgccgccctcaccttcaacaaccagcccggccaggagaatctgcactacatccaggagcgcatcttcgcccagaaccgggatgccaggagagcctgggaagagagcggccggcgccgcccgtacgtcaccgtcgtgtacctgggcacgctgaccggtcgtgccacccaggccggtgaggaggcgtacgccgctgaacgcgaaggcctggaaggcatggccgccgcccagtacatcggggtgcgggccacggtgaacacctcctccgtcccgttgctgcgcatcgtcatcgccaacgccggcttccagatgaaacacgccgacctcgccgtcgacatgatcgcccggctggcacgccaaccgtccgacgccccggtgatcggtgtcgtcggacccgtcgagagccggaccgccagcgccgtcgccctgcgccacctcaatcgggtgggtctccccgcgatcgcaccggcgctctccgccgaccacatcgacagcaactcgaacctgtacttccagatctccccgcccaaccgggaccaggtccatctgctctccgcctacgcacgccgaaagggctggaagggcctgcacatttacgtcaccttcggcgagaagtccagccgcaaggacgacctctacgtcgccacgcttctggacgacttgaagaaggagttcaagggcaccagcgatctcacttccaccaagtggcatcccggacggtcgatgcaacgcgagtgcgattaccgcggcatgctcttcttcgccggccggtggtcggaatacggcgacttcctggcgggtctgcggcaagcctgccagaacaacgactggccccggcacctcgtggccgacgactccgtcaaccgctacatggccaacaagacgctccgcaagacggcgccggacaacctgaccatgctgtacgtgtccaagtcgggcctggcgacgtgctcctcgctgcgccgccccgacccggacgtcggtcagttcctggccgcggtgcagtcaccggacctgctcagcccgcccaggtgtgtcggtgggcccggccctcagcagtggatcggcgaacaggtcggtctcgcgtacgacgccaccatgctcttcagccaggccgtcgagcagctggccggacgcatccgtgtgtggccccagccatgggacgggcggatgatcgacccggcggccgtccacaccgagatcctccgggggaacgcgaagggtggctggcctggcgtcaccggccacctctcctacgacatgggctcgggcgagccgaagaacaagccgctttcgctcctgcgcgtcgacgacatcaccgatatggacaagctgcccaccgaggtcttcgtgtgcaacccgcggggagcccagggcgcggccgtgtgcaacagcagcacagcggaccggccg

SEQ ID NO: 7292 - DNA, 642 bp, Streptomyces avermitilis
  CDS (1)..(642)
gtggttctcgacctcgtcgtcattggcgtggccatcacgttggggccgctgcacaacaccgccttcatcctgcttttgtccgcgcccaagggagtccgcaaggggctcgcgttcattctggcgtggctggcctgtctggtcctgctgatcgccgtcgtcgtcctgctcacaggcggcagaccgccgccccacaaaagcgcgccttccaccgccgttctggtcctcaagctgatcctgggcctggggatggtgttctacggggaacgcaagcggcgccgggggagccggccccgccagtcccccaagtggatggcgcgactggaccacgtctccgtgtgggcggccgccgggttcggcgtccttctccagccctggggcgcggtcgccgcaggcgcggcgacggtggtggaggcgaacatgtcgtccgccgccacgtacttcgcgttgacggggtactgcctgctcgccacttcgagcctgctggcgatggagctgcacgccacgttccggccgctcaccgcccaggtcagactgaggaagctgcgcgcatggatcgacggccaccaggaccaggcgatcgtgtccatctccctggcactcggcctgtggctgatggccaagagcatctaccagctcgtgggg

SEQ ID NO: 7293 - DNA, 1356 bp, Streptomyces avermitilis
  CDS (1)..(1356)
gtgagatctcctcatcactctttcccgaggagatctctgatgcattcagcaaagccgcgtccgcccaggacgacgggacgacgaggcatgctcgccgccgtcacggcgctgctcaccgcgctcgtcgtctcggcggccgccgtggcgcgggaggacgcgcggcagcaaccgcgcgccaccggggggccggtgtggacgggggcgtggggcaccgccgtgcagcggcccgtcgaggggagcgaggacaaggggcccaactggtcgcggcagggattcgccgaccagtccgtacgccaagtggtccgcgtcgccacgggcggatccacggtgcggatccggctgtcccacacgtacggcaccacgcccctgcggatcaccgccgcgaccgtcggccggtccgccggagacgcccaggtctggccgggcacggcacgcgagctgaggttcggcgggagtcagggcaccaccatcgcccccgggcgggacgccgtgagcgacgccgaggccctgagcacctctccgctggagaagctgacagtcaccctgtacttcgccggccgcaccggcccggccaccttccaccggttcaccaccgccacgtcgtaccgtgccgccggacgccacctgtccgactccggcggcgacgccttccaggacgccacgaacgcctggtacttcctgagcggggtggaggtgtccggccccgccaccccgcggcgcggcaccgtggtcgtcttcggtgactcgctcgtggacgggacaggggccacgcccggcgccgacaaccgcttcacggacaagctcgccgaacgcctggtcgccgaccgtcgcccgctggacgtcgtcaacgccggcatcggcggaaaccggatcctcaacgactcgccctgctacggggacaaggccgaagaccgattccggcgcgacgtactcgaccgccccggcctgcgcacggtgatcatccacctgggcgccaacgacatcggtgcgcccgagatgggggacccctgcatgggctccgcgccccgtgtgaccgcacgtcagctcatcgagggtcacaagaagctgatccgcgccgcccacgcccgcggcgtcaaggccgtcggcgcgaccatcctgcccatgaagggcgccctcttccccgtctacagcgaacggggcgagaaggtccgggccgccgtcaaccactggatccgcaccagcggcgcgtacgactccgtcctcgacgtcgaccgtgccctcgcgagcccggccgatccggccctgccgcgccccggctacgttgtcgaggacggcctgcaccccaacgaggccgggtcccacgccatcgcctccgccgtggacctgaacgccctc

SEQ ID NO: 7294 - DNA, 228 bp, Streptomyces avermitilis
  CDS (1)..(228)
atgcagctccccgccgaagccgttgccgccaccgcgctgatcgaggtcgtgaggatctccgccctcccggccaagcggggcgccccgtaccccggcaggacggtcgcccaatgccacgaggtccttatgcacggaacggccgtgccacctgcgctgggcacgcagttcttcgacgcggacaccccgccggctcaggccctcctggccctcttccgcgcggcggccccg

SEQ ID NO: 7295 - DNA, 642 bp, Streptomyces avermitilis
  CDS (1)..(642)
atgaacgcggacggatggttggcggacacccggagctcctacgacacggtcgcggtcagctatgccgaccaactgcgcggggccctggcagggacgccgtaccttcgggcggcgctggagttgttcgccggcatgattcacacagccggcggcgggccagtggcggatgtgggctgcggaccggggcacgtcaccgcccacctgcatgggttgggcgtcgacgcattcggtatcgacctttcacccgcgatgatcgacgtggctcggcgtgaccatcctgacctgcggttcgaggtgggctcgatgacggatctcaacctggccgacgcgtcggtcaccgccctgctcgccttctggtcgttgattcacgtccctgacgatgcgatccctgcggtcttcggccatttccggcgggtggtgcgtcctggcggaccgctgctgctcggctttcacatcggcgacgagtcgcgactgaagacggagggctacggcggtcacccgatgaaggtccatgtccaccaccgccagcctgtccaagtgacagcctggctgcgcgatgccgggttcactgtcgaggctcaatggctgctcggcctcgacgggcacattccaggagcagtccttttcgcgcaccgccagtcc

SEQ ID NO: 7296 - DNA, 801 bp, Streptomyces avermitilis
  CDS (1)..(801)
ttgatcaactgctcgatcaatcggatgatcaaaaaatgcacgtcagttcttcctcatcccccggcctcggccgcgagttcggtggatcgtgctgtccctccagggctgaggagctcttgcagacgtcagtcggcgtatcccggagaaccgatgaaactacccgtcaccatccatcaagcacgcctcggatccgcggagttcaaagtgatccggccggcccgcccactggaccgcgccgtgctcatcgatcacgaccggcacctggacgcctacctcgatcaggacgcggcgcggcgaatcggcgggctgtgggagcttgccgcctcctcaccgcacgcgctgatccacctgccgatacgaggcaacccggccccttcccgcgacctccccgcagccggcacacgccagcttgacctcgtgctgctgcatcactcgcggcaattcgcgccttcgcgctggaaggaagtacgcgggcgactgggccgagggcgcccgcagaccgtgacgctgcccggggcgggccgcggtgacggagccgtggtcgaccccggggcacggcaccaccgggagaaccgggacctgttccatcagcatctccacgcggagactctgttcatgacgggcagcgcgaaggtgttcagggagaccgcccggcacttcctcgatgtcgcccgcaacggtcctggctacgtccccgtccatccgagctacccgtacttctgcacagaactccactccaacgacggcattctcggcgacgcccgcgagatccacatcgagtactgcgaccagtgggactca

SEQ ID NO: 7297 - DNA, 1005 bp, Streptomyces avermitilis
  CDS (1)..(1005)
gtgagctcagtgatcgcggcaacccgcttctccgtactcgaccgctcccgtacccgcgaagggcacgacggtgcggcggcgctgcgtgacacggtggggctcgcgcgggacctggagcgcctcggttaccaccggatctgggtctcggagcaccatggcgtgcccggagtcgccggttccgcgccgaccgtgctggccgcggccgtcgccgcggccacccgttccatccgggtgggcaccggcggggtgatgctgccgaaccaccaaccgctggtcgtggccgagcagttcggcgtactcgatgccctcttcccgggccgcgtcgacatggggctcggccggtccgtcggcttcaccgacggggtgcgcagggcgctgggccgggacaaggacgatgccgacgacttcgcggcgcagctcgacgagctcctcggctggttcctcggcacgtccccgaccggcgtgcacgcgcggcccgccgagggccggaccgtgccgcccttcgtgctggccatgggcgagggcgccacgatcgcggcccgcgccgggctgccgatggtgatcggcgacctcaggaaccgcgagaagatgcggcgcggcatcgaccactaccgcgagacgttccgcccctccccctgggcgcgggagccgtacgtcgtgatctccggcacgatcgcggtggccgacaccccgcagaacgcccgccgcctcctcgtccccgaagcctggtcgatggcgtactcacgcacgcacggcaccttcccgcccctgccgcccgccgagcgcgtcgagtccctgcggatgaccgccagggagcgcggcttctacgagtcgggcctcaccggtcacatcgccgggaccgaggaccaggtcgcccacgaactggagacggtgatcaaggagaccggcgcgcaggaggtgctggtcaccaccagcacgtacgaccgggacgcgctgctggactcctaccgggggctggcccggctcgcgggactgaccgccctc

SEQ ID NO: 7298 - DNA, 750 bp, Streptomyces avermitilis
  CDS (1)..(750)
gtgcgcgtccaggacgacccccgcgcggcgcctgcccaaacgggttgttccggagccgaattgacggacagtcaagcgtccctcgaagcgttcatcgaggccgaggcggcccggatccacgaccgccacgggcacaccccgcgccgggacgtcgccgcgtcccgcgccctccacgactacgcgtggtcggtcggtctgctgatgagcggggtctggtacctggaacagcgggtgccgcgcatacgccccgaggacgtacgcctggacctggcgtccgggacgtacacgatcaccgcgggctcggacctggcctgcctgcccgacgacccggcggccgccctccccggcgccctccccctggccgacgaagaggccctgcgcgccgcgctgcggtccgcggtcgccgaccacatgcgtccgctgctgaccgcgctcgccccgtacgtccggcgcggaccgcgcaccctgtggggcatggtcggcgacgacctggtctccgggatctggtacctcggccgcacactcggccgggaggccgccgcgatccgggccgccaccgcgctcctgccctcccccaaggcccccttccccggcggcgccgacttccgtcacctcaccggcggcgacggccgccaccacccgacccgcacccgcatcggctgctgcctctactacacgatccgcccggccgaggcctgcgccacctgcccccgcacctgcgacgcggaacggctgcgcaggctggaggcc

SEQ ID NO: 7299 - DNA, 1170 bp, Streptomyces avermitilis
  CDS (1)..(1170)
atgcggctctacctgctggccctgaaccccaccgactccgtcaccgaaggcttcctgcccgccgcggcccgcctcggcctcgacgtcacggtcctcaccgaccagccggacccgcaccggcgcgcgtatccggaggtcgaggtccgggagtgcgacgtgcgtgactaccgcgccgtcatcacccggatctccgcccaccacccgcccgacgcgatcttcaccaacagcgaccacctccagacccaggccgccctggccgccgactacttcgggctcccggcgaagaactggcgggccgcgctgcggaccaaggacaaggccgagatgcggcgccacctcgccgccaccggcgtggacaccgtctggtcggccgaactcaccgaaccggtcgccctcgacgcgccgtacccctgcgtggtcaaaccccgggaaggcgtcgccagcgaggacgtggtgctggtcgacgggcccgaggaactcgtcgcacgctgcgcggacatcctgacgcgccgtccgggcgccgctctggtcgtcgaggagtacctgcccggcgagctgtacaccctggagaccctcggcgacggccgcgtccggcacgtcctgggcggcttccacaccgaactgtcgccgctgccgtacttcatcgaggagcggatggccttcgtgcccgcccacccggaagcggtgcgcgcgcaggtcctcgcccaactggacgcgctcgaggtcgggttcggcgcctgtcacaccgagttcgtggtgcacggcggccgggcgcggatcatcgaggtcaactaccgtgccatcggcgaccagtgcgacctgctgctcgcccagctcctggagatcccgctcttcgagcacatcctccgcacccacctgggcgaacccctccccgccgaactgggcgcccgccgcgacggcgcagcccgcctcgagtacccctgcgccgaccgcgccggcaccctgaccgcggcccccgccgccacagaactcgccgtcgacgacgtccggttgacctaccgtccgctacggagcatcggcgaacgccacgagctgtacggcaccaaccgcgactacctcggcgtcctgcgcgccaccggcaccgaccagcaggccgtcgacaaggcgacggccggcttcctggccgcccagcgctgggagatcgggccg

SEQ ID NO: 7300 - DNA, 1761 bp, Streptomyces avermitilis
  CDS (1)..(1761)
gtgaccgccccgacggccaccgacccggccgaggccgagctgctgacccgggtcctcagcgccctgctgcgcgaggacgtcgtcggcctgcgcacccgcagcacgctcgtgcaccgggccgacggcccctggctgcggctggcccaccccggcgacgccctgctgctgcccgtgaccgaggacgggttccagagccgccatgccgcccggctgccgttgctcgtcagcgagacggacggcgagctgaggaccgtctcgaccgtcctcggggcgctgcgcacccgggccgagccccccgaccgcgacggcttcgacgccttcgccgaggaatgccgccagacgctggccaccctgcggctgcactccggaacccggcaggagatcgcccagctgctcaccgcacgccacggcgccgaccccgccgactggaccggcctcgccggcggcctggcccacgacacgctcgccgcccgcctcgaccaccccgtctacccgaccgcgcgcggccgctcagggctggacgcgcggcaactacgcgcctacgcacccgagttccacccacgcttcgccctgcgctggctcgccgtaccccgccgggcgctcaccctctcgacgggcgtgctcccggaccgctggcccacgccggccgcgctcggcctgcccgaggccgagcacacgcatgtcgccctgcccgtacacccgctgaccgtcggcgccccgctggacgccgccctgcgggccacggatctggccgactccgcgatcctcgcgagccgcggccacctcgacgtcgtaccgaccctgtccatgcgtaccgtcgcggtgaccgccgatccgtccctgcacctcaaactgcccctgcccaccgcgacactggggctgcgcaaccggcgcaccatcaagcccggcaccctcgtcgacggagccgccggccaacgcctgctggaggcggtgaccgcccgcgagccgcgctttcgggacaccgtcctgcacgccgacgagaccggctacgcgcacgccgggcacgagctgctcgccgtactgtgccgccgccagccggccggactcgacggctcggtcgtcgtacccatggccgccctgctcgccgaggcgccgggcggccggctggtcgtcgaccacctcgccgaccgcttctacggcggtgacccgctcgctctgctggacgccttgctgaccctgctgttcgactggcagaccacgctgttcggctacgggatcgcgctggagtcgcaccagcagaacatctccctggtgctggaccggcaggcggacggccggacccggccgcggctgctcctcaaggacaacgacggaccacgcatcaacgccgtacggctgcgcgagcggctgggggacgcggcgcccgggcccgcggacttcgacgacgcgcgcgtcttcggcgacggtgacggaccggtcgccgacctcttcaccaccatcacgctccatctgtgcgcgggcgcctacgcgttcggcctcgcccggcacggtcgcgcccggcttccggcagtcctcgggctcgtacgcgaccgcctcgccgaggccgtcgagcggctcgggaccggcgtgggcgagcccggtgcggttctgcgcgcccgggtgctggacgcgccgcggctgccggtcaaggcgatggtcaccgccggaacgctgctcagcaaggaacgttcgggtgcggccgacatcaacaagcactacaccagcggccccaactacctgctacgagccggtgatccggca

SEQ ID NO: 7301 - DNA, 1803 bp, Streptomyces avermitilis
  CDS (1)..(1803)
atgcgtccccaccctgccctctctccgcccccgctggagccgctgatgcccgcactgaccgactcgctcgatgccgctccccgccgcaccgccccggtccgaccgcccaccgccgaacaggcagtgacccacaccctgctcaactgcctgctgcgcgaggtctccggacccgagcggcagaccgccgtcgccgacggccacctgctgctgcgcctgccccgccgcggtgtgctgctgcgcatcgccctgcgccgtacgtcccttgtgggcgcgcaccggttcagcgggccggtgtgcgaggacgacgaccacggcggctggccggaggtcgactggcagcggctggccacctacgtgcacgacgagctgtcccttcgcacgggggtacgcaacgaggagttcctggagcaggtcgactccagccatcgggccgtcgcggccgggctcgccgcacggccggcggacgacaccccggccgccatgctcgccacggacgctctctccgcctacgtggcctcggaacagtcgctggtgttcggacaccgcttccaccccaccccgaaggcgcgcaccggcagcgccggctcctggtcctcgtacgcgccggaggccggcgcctcgttcccgctgcggcacctcgcggtccgggcgcacctgatcgccgaggagatggccgaacccgcggccgccgcgtcgctggaccggcagcgcgcggacgtgccgcacggccaccggctgctccccgtccacccctggcagtacgagatgctgcgtgaacaccccacgctgcgcgcggccctcgaccggggtgacatcgtcgacctcggcgagggcggaaggcccttcgccgccacggcgtccgtccgcacgctctacgacggcgagacgttcctcaagttcagcctgaacgtccgcatcaccaactgccttcgtaagaacgccagttacgagctggccggagcggtcgccctcacccgcgccctgagcccggtcctggccgacctggccgaccgcttccccggcagcgccgtactgcgcgagcccgcctaccgcagcctcgccctccccgggcccgacggcacgccggaccgcgagctgctcgaaggcttcggcgtcatcgtccgcgaaggcctgcccggacggctcctgccccgcatcaccccgctgctcgccgccgccgtcgccgacgagtacccgaccgggcccgcgcacatctcccgcctcctcgccgccgcgggcccggggaccgtcctcgactggtgggcggcctacctcgacctcctagtaccgcccgtactggccgcctacttcgaccacgggctggtcctcgaaccgcatctgcagaacgtgctgatctgcgtcgacggcgacggcatgcccacccaggtcctcttccgcgatctggagggcaccaagctcgtccccgaacgccacgccggcacactcgccgcgctgccgcccgacgtggccggagcgatgacgtacgacgcccagcgcggctgggaccgcgtcgtctactgcctgctggtcaaccacgtcgccgaactgctcgccgccctcgccgacctgcgtccgcagacggaggccgcgctgtgggcgcaggtccgcgccaccctccaggcctacgccgaccggtacggctgcccaccggaactggccgctctgctcgccggagtcccgctcccggccaaggccaatctgctcacccgctggcagcgcaaggccgaccgcgacgccggatacgtccggctcgcctcaccgctcgccgaggacatcctgcgccacacggcccggagcgcccga

SEQ ID NO: 7302 - DNA, 1224 bp, Streptomyces avermitilis
  CDS (1)..(1224)
atgaccgtacccacgcccgcggtgcgcgaccgcatccggaccctcgcccccggcgaactgcccgcgtacgtctacgacttggcggagctacgggcacatgccgcaggtgtgcgggcggcgcttcccgagcgcgtcgagctgtactacgcggccaaggccaacccggagccggagatcctggccgcgctcgccccgtacgtcgacggctacgaggtggcctcgggcggcgaactcgcccatgtcgcccaggcggtgccgggccgcccgctggccttcggcggccccggcaagactccggacgaggtggcggccgcgctggctgggggcgtgcagcgcttccacgtggagagcgagtacgaactgcacatgctcgccgagcaggcccgccgcgtcaccccgggcacgcgggtggcggtcctgccgcgtttcaacctccccgtgcgggacggttcgctggccggcagcgccctggcgatgggcggccggcccacccccttcggcctcgaccccgcgcaggccggtacggtgctccggctgctcaccgacggcacctacccgcacctcgagctgcgcggcgtccacgcccacctggccagcggactcgaggcgcccgaacagctggcggtggcggagacggtcgtcggctgggcgacggacatggcgggggagcacggcgtcgggctcggcgaggtcaacgtcggcggcggcatgacggtggactacgcggcccccgagcgccgcttcgactgggtcacgtacgggaagggtctggcccggctcgcacacgcgcatccggaactgacgttgcgcatcgaaccgggccgggcgctgaccgcgtactgcggctggtacgccaccgaggtgctggacgtgaagcgcagccacggcgaggagttcgccgtggtgcgcggcggcacccaccacctgcggacaccggcgaccaagggccacgaccagccctgttccgtgctgccggtggacggctggccccatccgtggccccggccggcggccgaggccgaacgggtcacgctcaccggccagttgtgcaccccgaaggacgtcctggcccggcaggtaccggcaggcggactgcgggccggtgaccgcgtggcgttcgcactcgcgggcgcctacgcgtggaacatctcccaccacgacttcctcatgcacccccggcccgggttccacttcctgctcccggacaggggtgacggcgagccc

SEQ ID NO: 7303 - DNA, 2448 bp, Streptomyces avermitilis
  CDS (1)..(2448)
atgcgccgggactcaccccgggtcgaccggaacggtggcgtccgtacggccgccgagttgttacggctccggtatgggatcattctggggcacatggagcgtgtcgctgctgcggcgatcgtcgacgaccacggcgtcgtgacggcgtggagcgaaggtgcccggcagctgacgggatacggctccgaggacgtcgtgggccgggcggcggccgacctgctcgtcgaagcggcgctgcgggagacggccgccgcgctgaccggtgtgaccgtgctgaccggtgtcgccgtgctgcgacaccgcgacggtcaccccgtggagatcgccctgactgcgtgccccgtcctcggcccggacggcggaccgcacggatacgtcatcaccgcggagcggcccggcgggccggagccgaccccggagggccgggcgttccagcaggcttccgtccccatgtgcgccttcggcacggacctccgcttcctgcggctcaacgacagcgcctgccgggggatggggggcgccgaggagtccctggtgggccggttctacggggacaccgtcccggcggacaagaccagccgcggcttcctgctgaacctgcgcaaggtggtcgagaccgggacacccctgcgctacgagacgtacaccagtgcccccgcagggggaccggcacgcgcctggagcatcgagatgtggccggtacgcggcgacaccggcgccgtggacgaggtcgccatggcggcgttcgacagcagcgagcagcacgaggcccggcagcggctcgccctgctcaacgaggccgcggccgccatcgggaccactctggacgtggtgcgcaccgccgaggagctggtgaacatcgccgtaccgcgcttcgccgacttcgtcagcgtggatctgctcgactgggtgctgggcgcggaggaaccggccggcgaccacggacccggcgtcgtactgcgccgggtcgcgcacggatccgtcacggagggcaccccggaggcggccgtcaggctgggccagacggacacctaccccccgttctccccgcccgcccgggcgctgacgtcggggcgggcggtgcgcagccgtgcgggcgacccggatttcgaccggtgggtcggcgagcgcaacgcgcggaacgtcggaacccgtgcctcccgcgaaggcgcgcactcgctggtgacggtgcccctgctggcccgcggcaccacactgggcgccgcggtgttcatccgcgtcaagaaccaggacgcctacgccgtcgacgacgcgtcgctcgccgaggaactggccagccgcgccgccgtctgcatggacaacgcccgccgcttcgcccgcgagcagtcgatggcgctggccctccagcacagcctgctgccccggggcctggccgcacacgcggccacggaggtggcctaccgctatctcccgacggattcggcggcgggcgtcggcggcgactggttcgacgtgatcccgctgtccggcagccgggtcgccctggtcgtcggcgacgtggtgggacacggcattcactcctcggcgaccatgggacgcctgcgcacggcggtaaggaccctcgccgacgtggacctgccgccggacgaactcctgacccacctcgacgacctggtgatccacctggcgacggaggggagcggcgaggaggtggcggagctcggcgcgacctgcctgtacgcggtctacgaccccgtctcccgccggctggtcctggcgtccgccggccatccgccgccggccgtcctgctgcccgacggcaccgcgcaggtcgtcagggtgtccgccggaccgccgctcggggtcgggggtctgccgttcgaggcgacggcacgggaactgcccgagggctcgctgatcgccctgtacacggacgggctgatcgagggccgcggccgcgatctcgaccgcggcaccgccgagctgtgccgcgcgctggtccttcccggcgcctctctggaggccctctgcgactccgtgctgaagtcggtgctgccggacagtcccagtgacgacgtggccctgctgctggcccgcacccgcgcgctcggcgcggaccaggtggccacctgggacatttcgccggaggccgcctgcgtgtccgcggcccggcagtccgtcctcgagcagctgaccacgtgggggctcgacgagatggcgttcgtcaccgaactggtcgtcagtgagctggtgaccaacgcgatccgctacggcgaaccgcccgtccagctgcggctgatccgcgaccgttcgctcatctgcgaggtctccgacgggagtgccacgtcaccgcacctgcgtcgggcgcacgcctacgacgagggtggccgcggcctgctgctcgtggcccagctcacccggcgctggggcagtcggcagaaccctccgggcaagacgatctgggccgagcagccgttgccgccgggg

SEQ ID NO: 7304 - DNA, 495 bp, Streptomyces avermitilis
  CDS (1)..(495)
atggatagtgaaggtatccaatatgccctccacgccgtcccgcgccgcttccggaagaaggccgtcgccatgcccacgctcccctggaccaccgtcgaagaacccgcaccgggcgccgaggcgttcgtcatggcgtcccgcctggaggtccgcaggttcgccgacgtgccgcgcttcttcctgcgctcgctcgccacgtggaagcaggtgaagagcgcgcccggcgcgttcggcgcctcgctcgtcgccgaaccgctcaaacgcaccttctggaccctgtccgcctgggaggacaaggaggcgctgtacacctacgtgaagaccgaaccacaccggacgatcatgaacggtctgcggtccacgatgagcggctcggtcttcacgttctggcggacaccggccggcgagctgcccgtcgactgggcggacgcccgacgccggctggccgaacaggaacgcgccgacctctcgaactccggtggcccgaaggccact

SEQ ID NO: 7305 - DNA, 654 bp, Streptomyces avermitilis
  CDS (1)..(654)
gtgaaggtatccaatgaccagagcggagccgtcccgatgcgcatgtccgagctgagccgccgcagtggcgtctccgtcacgacgatcaagtactaccttcgcgaaggtctgcttccggccggccgccggctgtcggccacccaggccgggtacgacgaggaccatctgcgcagactgcgtctgatccgcgcgctgaccggcgtacgggggctgcccgtgagtgccgcccgggacgttctcggcgccctggccgagcatgcgggcgacacccattccctgctgggtctcaccctcggctcgatccggctggccgaggagtccgccgacgactccccggagccggccgaagtcgactcgctgatccaggagttgggctgggacgtccacaagtcggcgccggccaggtccgcgctggcagagaccctgacctcgctgcgcacgctcggcgccccgctggaccggcgcgctctgctgtcgtacgcgcatctcgcggaacggaccgcggtcctggacctcgaccaactggacggcatcgaggacccgttggaggtggccgaacgcgcgctgctcctcacggtcctgctggaacccgcgctgctggcgctacggcgcctggcccaggagaacgagtcggcgcagcggcacgccgagagc

SEQ ID NO: 7306 - DNA, 495 bp, Streptomyces avermitilis
  CDS (1)..(495)
gtggtcggtgtgacgcagaagagcaggccactggccgtattcgacctggacaacaccctcgccgacaccgcgcaccggcaacggttcctggagcggaagccgcgggactgggaggcgttcttcgccgccgccccgaaggatccgccgctggcggcgggcgtggcgctggcgcgggagagcgccgaggagtgcgaggtcatctatctgaccgggcgtcccgaacgatgccgccgcgacaccctcgactggctcgcggcccaggggctgcccgaggggcgtgtgttcatgcgcggcaacggcgaccgccggcccgcccgcgtcaccaagctggagatcctgcgcagactcgcccgggaccgtgaggtccgcgtgctcgtggacgacgacgaattggtgtgcgtcgacgccgagcgcgcgggcttcaccgtcgtacgggcccgctgggcatcctcgtccgaggcgctcaaggaggcgcaggagggtgaggggcggacc

SEQ ID NO: 7307 - DNA, 255 bp, Streptomyces avermitilis
  CDS (1)..(255)
gtgacgcgtgacacacctgtcacggccgagaggagcacccgcatgtccgaccacacctaccgggtcaccgagatcgtcggcacctcgaccgagggcatcgaccaggcgatccgcaacggcatcgcccgcgccgcccagaccttgcgcaacctggactggttcgaggtcacccagaccaggggccagatagtgaacgggcagatcgagtactaccaggtcggcctgaaggtgggcttccgcctggacgacggcgac

SEQ ID NO: 7308 - DNA, 1248 bp, Streptomyces avermitilis
  CDS (1)..(1248)
gtgagacgtcgactcctcgctctcctctgcgtttttgcctcgttgctcaccgcctgcggcgccctgcccggagaggggaccgggcggcggaccgtcaccgtatggctgatgaaggacagcgcgtccaaggagttcctggcccggttcaccaaggagttcgaacgggcccacggcgatctgcggctcgacatccgcatccagcagtggaccgggatcggcgaaaaggtgcagacggcgctccgacggcagggcggcgacgggcccgacgtcatcgaggtcggcaacacccaggtcgcccagtacgtcgacggcggcgggctgctcgacctcaccctcgagtcgttacgcgactggggcatgaacgactggctgcccggtctcgccgaacccggcaggttcggctcccgccagtacggcatcccgtggtacgcggccaaccgcgtcgtcatctaccgcaaggacctgttcgccgcggccggcctggccggtcccccgaagacgcgcgaccagtggctcgccgacacccagaagctcaactcccacgatgtccagggtatttacctggccggacaggactggtacaccctcgccggattcatctgggacgagggcggcgacctcgccgagcagccctcctccggcacctgggagggcagcctggacacgtccgccgccctgcgcggcatggacttctaccgcaggctccaggccctcggtacggggcccgcggacgccgacgaggaacacccgccgcaggccggggtgttcgcgcgggggcgggtggcgcagatcgtcgccgtacccgggctcgcccaggccgtcgtgcgcaagaatcccgacctcagggacaaactcggctacttccccgtccccggccgaaccgcggcacggcccggtgccgtcttcaccggcggctccgacctcgtggtccccaagaacaccgacgaccgccgtggcgccacggcggtcgtcgcggcgctcgccggcggcaagtggcagacggatctcgcccggacgatgaactacgtgcccaacaagacgaccctcgccgacgcggtcgagggcgaggagggcgtcgcggccatggcggcgggcgccgcgcagggccgggcgaccccctcgtccccggactgggccgccgtcgaggccgacaacccggtcaaggactacatgacgaaagtgctgaccggcgccgatcccgcgacggaggcccgccgcgcctcacgccggatcacccggacactgtcg

SEQ ID NO: 7309 - DNA, 2106 bp, Streptomyces avermitilis
  CDS (1)..(2106)
gtggtccctgtgccgcacagcgatcccggccggcgagtggacgagacaaccgcctcgatgctggaggcgctgttcacgcagtcaccgatcgggctccacctgctggacaccgacctgcgggtggtgcgcatcaacaccgccacccccggcatgcgtggcgtgcccctggacgacctgaaagggcgcccggtccgcgacgtctacaacctcgtccaaggcgtcgacctggaggcgctcctgcgcgaggtgctggacaccggggtccctgtggtgcagcgcatcgtccgggcgcgaagcaacggggacccgccgccggagcggcacttcgagatcaccgcgctgcgcctggagaatccgcgccggtccgtgctcggggtggcggtcaccgcgatcgacgtcaccgagcgggagcgggcccgcacccgcaccgaggtgctcgacgccgtgcgccggcacgtgggacgcaccctggatccggtcgtgaccggcgcggaactcgtcccgaccgtggtccccgcgttcgccgatatcgcgatcgtggaggtggtggaggccgtgatccgcggcgacgacccgccgcaggccccgccgcccgcgagcacgcccctgatgcgcaccgcgttccgcagcacccgtacgcggccgccgcaggcccatccggtgggcgatgtccgccgcctgccggctccgaccccgttcacccaggccctggccgacttgagcccgcgcgtggtcgcgctccatccgaccgccccgtggctgtccgtcgatcccccgcgcgccgaggcgatccactcatcgggagcccattcgctcctcgtggttcccctggcgctgcgcgacgcggccctcggcgtcgtcagcctgtaccgcaccggacagtcgccccccttcgacgaaggtgaccgggacctcgcggtcgagctggccacccacacggcgctgtgcatcgacaacgcgcggcgctacacacgggagcacacggtcgccgccacggtccagcgtcaactgctgccccgcagcccggagacccacgcgtcactggacaccgcctacctctccgtcaccggcgccgatcccggggtctggtacgacaccatcgccctgtccagcgcccgcaccgccctcgtcgtcggcaaggtgtcggggcatggtctgaacgcggccgcgaccatggggcaactgcgcaccgccgtacgctccctgtcggcgttcgacctctcccccgacgagctgctcgcccgcctgcactacacggcgggccagctcgccgccgaacgcgcccggctcccgctcggcgatccgctgcgccgcgaatccctcaccgccgactgcgtgtacgcggtacacgaccctctgaccggcacgtgcgcgatggcggcagccggccccctggtccccctcgtcgtgtgccccgaccgcacggtcaccgtccccggcataccggccgggccgcggctgggcgcgacggagggcgcgcccttcgcgaccgtcggcgtcgaggttccgcacggaagcgtcctggtgttcgccagtgatccgctcctcacctcgtatctcgccgaatcctcagaaccgttgtccacggcgccggactaccacgaccgtccgctccaggacctctgcgacgccctcgtctacgcacgcccggcaggtctgggcgccggcgatgccgcggtgatcgtcgcgcgcacccgggcctttccccccgaccggttcgccgcgtggccgctcgacgccgacccggcgtccgtggccgtcgcccgccgccgtacccgcgggcagctcgccgcgtgggacgtggacgacgagaccgccttcaacacccagctcatcgtcagcgaactcgtcaccaacgcggtcagatacggaagcgcgccgttcgagctccgcctgatccatgaccgcaccctgacctgcgaggtacgggacgcaggctcggccgcaccgcatctgcgccacgccggtacggccgacgagggcggtcgtggtctgttcatcaccgcgcagctggcacaggcgtggggcacccgttacacgccgccgggcaagacgatctggaccgagcaggcgctgtcccccggcaccggcccggccgaatcgctc

SEQ ID NO: 7310 - DNA, 2700 bp, Streptomyces avermitilis
  CDS (1)..(2700)
gtggtggtgagcgccatggcagggctggaagagaacggctcggaaccgaccgcgccacgcgccgatccccagggagacccgtttctgcgcacccggttcgccctgccgacgcgccccgggacgttcctgcggcgggagcggttggtcaggcacctcgaccacgccctccggacaccgctgaccatggtcaacggagccgcgggtgccggcaagaccctgctggtcgccgactgggccgcggggcaggaccggtccgtcgcctggctcaccaccgacgcggcggaccaggggtgcggaacgttctgggcgtacctgctccaggccctgcgcgcctgtgatgtgccgctgcccgccgaggtcggcttccccgcggacgcgaaccgcgtggaccacacgctgctggcgcgactcgccgccgacctgagtgtccgggaccggcccgtggtggtggtgctcgacgaatacgaccgggtgaccgacccggagatcgcggaccagctggagttcgtcctgcaccacgcgggtcggggcatgcgcctgatcttcgtcacccgcaccgagccgttgctgccgctgcaccgttaccgggcggccggcgacatgacggagatcagggacgcggagctggccttcacccccgaggaagcggccgcgctgctcgaactgcacggtctgcgcctttcggtgcacgcggcgcgcggcctcgtcgaacgcacccgagggtgggccgccggactacggctgtgcgccctggccgcgcaggagcgcccggatccggagacgtatctgaaggagttcgaggccgaccgcagcaccgtcgccgacttcctgctggcggaggtgctcaaacggcagcccccccagacgcaggacctcctgctgcgcgtcagcgtcctcgagcgcttctgtcccgagctggcgaacgcgctgacggaccgcagcgacgcggaggccattctggccgggctgcaccgcgagaacgcgttcgtcgagcacctcgggcacgcgtggtaccgcctccacccgctgttcggggagattctccgcgcccatctgcgggtgcgccttcccggcctggagcccgaactccaccggcgggccgcgcagtggctgcggcgctccggatccctcgcggagacgctcggccacggtgccgccgccggtgactgggagttcactgccggtgccctcgtcgacgacctcgccatcggtcagctcttcaccggccttcgctccgacgacctggccgagctgttctcccggatggggcccgaagccacgagccccgcgacggagctcgtacgcgcggcccgtgacctgtcccggggtgacctcgaccgcggcctgacccatctgcggcacgccgagcagagcctggccggggaacggatgccgacgggggatgactcggccggcctggcggcggcccggctgagctgtgctctgctggaagccctggcggcccgcctgaccggttcgccgggcagggcggaggcggccgcggaggcggccgggaaactccaggaggaggtgtcctcgcatctcctggacgagcatcccgaactcaccgccctcctgctgacgcaccttggttcggcgcggctgtgggccgggtgcttcaaggacgcgcgtgccgccctgaccacggtggcagcctgctccgggggagcttcgacggcgctcccgcgcgaggagtccctgggccacctggccctgatcgactacctgaacggctggctcggcagggcggagcgcaaggccctggcggcgctgggcgagacggagcgattcagcctgccgcaggcgtccggctccggcatcggactgctggtcctggccgccgtggccgtcgaccgcaacgaactgggtgaggcccaggccctcctcgacgcggcggccgacacgcaccgcgcgatgcgggacccggtgagggaagcggggcgggccatcgccaccgcacgtctgctgctggcccgcggcaacccgcacgccgcgatcgaggcggccggaccggccgtcgccgcggacgtggtctccccctgggcggaggggcacacggcgctggtggcctccgccgcacacctggccgaaggccggccggaggcggccgcggagttgctgcaagcggtgcccgacgaccagccggcgtgtgcggtgggggccgcgcgggcccagctcgccgcgggcaatcccggcgcggcgatcgacctgctcgaccggttgcaccccaagggccgtatcggcccgggggtgaccgtccgggcctcgctggtgcgggcgcaggccgcggacgcggcgggggactccgccacctcgcgcaggctggttgcccaggccctccaggaggcacggcgtgagcggctgcggcgccccttcctcgaagccggaccgtggatccgtccgttgctgggcacggcgccactgcgcgggctggccgcgggctggctcgcccccggcccgccgccacacggcgggccccggcccgtggaccaaccgccggcgccggtcgtggaggagctgagtggccgcgagcgcgaggtgctgcaacggctggccgagatgatgtcgacggaagagatcgccgccgatctgtatgtgtcggtgaacacggtcaagacccacctcaaaagcgtctaccggaagttggcggtgaaccggcgccacgacgcggtgcgccgggcgcgcgagctgcggctgctg

SEQ ID NO: 7311 - DNA, 1824 bp, Streptomyces avermitilis
  CDS (1)..(1824)
gtgggggccgggccgcatgacggaccgccgaggcccccgcggctgggcaggcgccttcgcggctcgtccggctcgcccgtggcgggtgaggcgcagggggagttctgcggatgcgatgggggtggcggcagggcacgcgccggccgctgcccggccggccgcgccggcgcgccgggccgactcggcgaggtggacatcgtgacgcactggcgggcgctgatcgtcctgggcacggcccagttcctgatggtcctcgacacctcggtcatgaacgtgtccatcagtcaactggtcgaggacttcgacaccgaggtcaccgccatccaggccgtcatcacgctgtacgcgctggtcatggcggcgttcatgatcatcggaggcaggctcggagacatcttcgggcgccgccgcctcttcctcctgggtctcgtcgtctacggcgcggggtcggccctgaccgccgcggcccccaccctgtgggtcctcgtgctgggctggtcggtcatcgaaggactcggtgccgcgatggtgctgccggccatggcggccctcgtggccgagtcctaccgcgggcgggaccgggccgtcgccttcggcgtcatcggcggactcgccggcgccgggatcgcggtcggcccgctgctgggcggctgggtgacgacgtacctcacctggcggctggtgttcgccggtgaggtcgtggtcgtcctggccgtgctgtgcttccaccgggtgatcacggaatccccccggaccggtccgcgcccccggctggacggggtcggcgccgcactctcggcggccggcctcgcgctgggcgtgctcggtgtgctccagagcggcacctggggatgggtggagccccgcaacccgcccttcaccgtcctgggcttcgcgccgacgctgttcgtgatcggcgccggagtggccgtgctggccggcttcctgcgctgggagaggcgccgggacgccctcggtgccgagcccctcgtacacctgcccctgctgggcaagcccgcactgcgctccggcctgctgtccctgctgtgccagaacctcatcctgctgggactgttcttcaccatcccgctgtacttgcaggtggttcaggggttcgacgccttccagaccggactgcggctgcttccggtgtccgtcaccatgctcgtgacctccatgtgcgccgcccgcctggggcgggtggccgggccgcgccgggtggtccgactggccctggtgaccctggccgcctccatcatgtggctgctggccaccatcgacccggtcatcgacgacgcgcagttcgccggggccatggccctgctcggcgtgggcatgggcctgctcgcctcgcagctgggcaacgtcgtgcagtccagcgtcggcgaggaggaacgcagcgaggtcggcgggctgcagttcacggcccagaacctgggctccgcgctgggcaccgcgctcatcggatcgctgctcatcggcgccctggccaacgccttcaccacgcaggtggaggacaacccgagcctgtcgcgggaagcccggcagcagaccggtgtcgccctcgaagcggggatcagcttcgtgcccaccgagcaggtgcgctcggcggccgagcgtgccgggctgccgccctccgaggccgacgccctcgcggagtcgtacgcctcggcgcagctcggcggtctgagggcggcgattctcgccaccgggggaatcaccctcgccggcttcctggtcacaccgcatctgccgagtcgtccggccggccgtccgaagcgacccgactcgggcgctccggccgacgcgatcgaccggacccgc

SEQ ID NO: 7312 - DNA, 429 bp, Streptomyces avermitilis
  CDS (1)..(429)
atgctcgccgcctcggtggtcgtcggcgccgggaccctgggctcgttcccgtacgtggagctggtgctgctgctgttgctcacgggtgtggcgttctggatcgcgcatgtgcacgcccagttgttcggggcgcggatggcacagcagggcctggaccgccggatcgtgctgcatgtgtgccgcgacgagtggccgatcgtcaaggccgctgtcccgccggccgccgccgtggccgtcagccccctgctgggcctcggcgtacagggtgctctctggctggcgctctcggtcgccgtggcgggccaggtcggctggtcggcggccgcggctcgacgggccggcgcctcgtggggcctggtggctgtcagtgcctcggtgaatctggtgctcggtctgctgatcatcgcgttgaagatctccctgacgcat

SEQ ID NO: 7313 - DNA, 195 bp, Streptomyces avermitilis
  CDS (1)..(195)
atgcgctacgagatccgcgtcgaaggacacatgtcggagacgctgaccagagccttcccggagctggaccacgtggtgatgtccggtcagacagtcctgttcggctccgtcgtcgacgaggcgcacctgtacgggctgctggcccgctgtcagtcgctgggactacgggttctggagatgcgccagctgccggag

SEQ ID NO: 7314 - DNA, 663 bp, Streptomyces avermitilis
  CDS (1)..(663)
atgaccgtgccgcgtggtccgacaccgcataccggaccggaacagatgtccgaccgggcggcccccgggccgtcggacggcgatcccgcggaagtgctggcggcactcgggcgctcatggacgtggatcctgggttccgcggtcgccacgctcgtgccgggcgtcctggtcctggtctggccggacgagaccctgcacatcctggcggtcctcatcggcctgtacctgctcgtgatcggggggttccggttcgttgcggccttctcccgggacgagcacggcgaccggctgcccggggtgctcctcgcggtggcgttcgtgctggccggggtgctgtgtctgaggaacccgttgcagaccattgccgggctctcgctgatcgtcgggatcgtctggctggtgtccggcatcctgaccctctacacggccatcgccgccaaggacctgccccaccgcggtttcgtcctcggcgtcgcggtgatcgccatcgtcgcggggatcgtggtgctggccctgccgaccgagtcggcccgggcgctgacccggctgctgggtctgtggatggtcctgctcggcctggccgaggtggccctcgccctggcctggcgagcggcactccgcaggtcccgaggcgcggggccgcacggacccggcgggacggtc

SEQ ID NO: 7315 - DNA, 495 bp, Streptomyces avermitilis
  CDS (1)..(495)
atgagtgggcagatgtatctcgcgtacgactatccgctgctgagcgtcttctggtccatgctggtgttcttcctgtggatcatgtggttcatcctgctcttccggatcatcgtcgacatcttccgtgacgacgacatgggcggctgggccaaggccggctggctggtgctggtcatcgtcctgcccttcctcggcgtcttcatctacgtgatcgcccgcggcaagggcatgggccgccgtgaggtggcgcaggcgcgcgcgcagcaggagtccttcgaaagctacgtccgggagaccgccaagggcggcggccggtccagcagcgtcgatgaactcgccaagctgtccgagatccgcgcccgcggtgacatcacggacgaggagttccgcaaggcgaaggaactggtcctgagcgactacggcccgtcggcaggcgcaggcgcaggcgcgggtactggcaccggcgccaacgccggcccctccacttccggtcgc

SEQ ID NO: 7316 - DNA, 444 bp, Streptomyces avermitilis
  CDS (1)..(444)
atgaccgcgacacacacagcgcacgggcagacggtcgaccggccctgggccgaaggcctgacgattttcgcggcagtcatgctcatgatcgccggcatactcgatgtgtgccggggcatcatggcgctcgccgaggacgacgtcttcttcaggacacggaactacgtgttcgcgttcaacctcactggttggggctggatccatctcattctgggcgtcgtcgccgtgatcgtcagtttcggactcttccagatggcgctgtgggcgcgcgtcgccggggtggccatcgccgcactgatcatcatcgccaacttcctctccctgccgtactacccggtctggtcggtcgtgatgatcgctttctcggcgttcatcatctgggccctgtgcgtggtccggcaggacgagtccgccgacccgttcgcgagcccgccgcacggcatg

SEQ ID NO: 7317 - DNA, 999 bp, Streptomyces avermitilis
  CDS (1)..(999)
gtgagcccgttccttctcacccgcaccctgcccgaggacaccacggacgcggccctgcgcgccgacgtcctgcacggcctcgccgtcccccggggcgccggccccgctcgacctggggagaccgccaagcccaagacgcttccgccgaagtggttctacgacgcgcacggcagtgagctcttcgagaagatcaccgaactgccggagtactacccgacgcgcgcggagcgggagatcctgatcgcccgggccgcggagatcgcggccgcgaccggcgcgcgcaccctggtcgagctgggttccggctcctccgagaagacccggcacctgctggacgagctgaccgggctgcacacctacgtcccggtcgacgtcagcgagagcgcgctgacccaggcgggacaggcgctgatcgccgagcgcccgaatctgaacgtgcacgcgctgatcgcggacttcaccggcggtctcgcgctgcccggcacgccgggtccgcggctcgtcgcgttcctcggcggcacgatcggcaatctgctgcccgccgaacggacggcgttcctcgcctccgtacggaccctgctgtcgcccggggacgcgttcctgctcggcaccgacctggtgaaggacgagtcggtcctggtcgccgcgtacgacgacgcggcgggggtgacggcggagttcaacaagaacgtgctgacggtcgtcaaccgtgagctgggcgccgacttcgaccccgacgccttcgaccacgtggccgtctgggacgccgagaaggagtggatcgagatgcggctgcggtcgcggacggcgcagaccgtgaagattccggcgctggatctggcggtggacttcgcggacggcgaggagctgcggacggaggtctccgcgaagttccgcaaggacggcgtacgggccgaactggcggcggccggcctggacctgacgcactggtggacggacgaggaggggcgtttcgcactgtcgctgagcgtggtgcgg

SEQ ID NO: 7318 - DNA, 825 bp, Streptomyces avermitilis
  CDS (1)..(825)
atgtgccgtcacctggcctacctggggccggcggagccgctcggcaggctgctcgtggaacccgcgcacagcctcttccggcagtcgtgggcgccccggcggcagcggtacgggaccgtcaacgccgatggtttcggggtgggctggtacgccgaggaggacccggtgccggcgcggtaccgccgggccgtgcccatctggggcgaccagtccttcgccgacctggcccgtgtcgtacggaccaccgcgctgctcgccgccgtacgggacgcgaccgtggcgggggcggacggggaggccgcggcggcgccgttcgccgccggcccctggctgttcagccacaacggggccgtcgccggctggcccgactcgctggcccccctggcctgctcgctcccgcccaccgagctgctgtcgctggaggcgcgctgcgactcggcgctcgtctgggccctggtcctgaaccggctgcgcggcggcgacgaggaggggcaggcgctggccgacaccgtgctggaggtcgccgcggcggcccccggctcccggctcaacctgctgctcacgagcggcgagacgatcgcggcgaccgcctggggcgacacgctctggtacctcgccgagcccggccgccgcaccgttgtggcctccgaaccgtacgacgacgatccgcactggcaggaggtgccggaccgcacgctgctcgccgcgagccgcaccgacgtcctgctcaccccgctcaaggacccgcgggaacaggggggcccgccggaacacggtgaaccgcacacccacatggcatccgcaccaccgaaggagccccgtacg

SEQ ID NO: 7319 - DNA, 1320 bp, Streptomyces avermitilis
  CDS (1)..(1320)
atgaccgaccccgggtccccgaccgaccccgacacgctccgggcccgcgcgctcgacgcgctcaccaccgcccgcgagcgcaccgcgctcctcaccacgtgcgtggacgagcccgacctcaccgcgcagcactcgccgctgatgtccccgctggtgtgggacctggcgcacatcggcaaccaggaggagctgtggctgctgcgcgcggtcgccgggcgtgacgcgatgcggcccgagatcgacgggctgtacgacgcgttcgagcacccgcgcgccgaacggccctcgctgccgctgctgccgcccgacgaggcccggcgctatgcgtcggaggtgcgcggccgggcgctcgacgtcctggagagcacggcgttccgtggcaccccgctgacggaggcgggcttcgccttcggcatgatcgcgcagcacgaacagcagcacgacgagacgatgctgatcacccatcagctgcgcaagggccccgcggcactgacggcaccggaccccgcgcccgcgccgccgttcaccggtccggccgaagtcctcgttcccggcggcccgttcacgatgggcacctcggccgaaccatgggcgctggacaacgaacggcccgcacacgagcgcctggtgccgtccttctacctggacaccacaccggtgacgaacgccgcgtaccaggcgttcatcgaggacggcggctacggtgacgagcgctggtggaccgccgaaggctgggaccacatccgctcccactccatcgaggcgccgctgtactggcgccgcgagcaggggcagtggctgcggcggcgtttcggcgtcaccgagcccgtgccgccgaacgagccggtgctgcacgtgtgctggtacgaggcggacgcgtacgcgcgctgggcggggcgccggctgcccaccgaggccgagtgggaaaaggcggcccgtcacgacccggtcaccggccgctccacccgctacccgtggggcgacgccgacccgacgcccgagcacgccaacctcgggcagcggcatctgcgtccggctccggcgggaagctatccggcgggcgcctctccgctcggcgtacggcagttgatcggcgacgtgtgggagtggacgtcgagcgacctggagccgtatccggggttcacggcgttcccgtacaaggagtactcggaggtgttcttcgggcctgagcacaaggtgctgcgcggcggttcgttcgccgtggacccggtggcctgccggggtacgttccgcaactgggactatccgatccggcggcagatattctccgggttccgcaccgctcgctcgggagcttcc

SEQ ID NO: 7320 - DNA, 1272 bp, Streptomyces avermitilis
  CDS (1)..(1272)
atgtccgattcggtgagtgactgtacggagccccgctccgccgtcaccgaggccgatgtggaggctctggtccgcggtatctgcttcaagaccggaccgccccgcacgctcggtgtcgaactggaatggatagtccacgagctgcggcggccgcagctcccggtagcacccgaacgactcgatgcggcctacgccgcattgcggaccgtgcccctgcgttcggcgctcaccgtcgaacccggcggccagctggagctcagctccgctcccgccgcctcgctgatggagtgcatcggatccgtctccgccgacctcgacgcggtacgcgcgctgctgcgcgaggcgggtctcggcctccgtggatacggccacgacccctggagccccccgacccgctatctccatgagccgcgctacgacgccatggagtcctacctggaccgcgccggacccgagggccgcgccatgatgtgctcctccgcgtccgtccaggtgtgcctggacgccgggcacgaggagccggggccgctcgggcacgggcggcgctggtggctggcgcaccagctgggcgcggtcctcgtggccgcgttcgcgcactcccccatggcccatgggcgggccacgggctggcgctcgacccggcagtacctgtgggccgccatggacccggggcgttcgagtgccccgcccctcgacggcgacccacgaaggacctgggcccggcacgtgctggacgcgccggtgatgtgcatacgggccgacagcggcccctggcaggtaccggaggcaatgagtttccgggagtggacccggtccggcaccccgccggaccgcggcgacctcgactatcacgtctcgaccctgttcccgccggtgcgcccgcgcggccatctcgaactgcgcatgatcgacgcccagccgggtgacgacggctggatcgtgccgctggcggtgacggcggccctcttcgacgaccccgaggccgccgagatcgcctaccggacggtcaaacccctcgcggagcacggccgttcactgcccgctccgtgcaatccgctgtggatcgaggccgcacgccagggtctggccgaccccgagttgcacgaggccgccgtcatctgcttcgcggccgcggccgaggcgctgccccggctcggcgccaccgccgaggtgcagaacgccgtggcggagttcaccgaccgctatgtggcccggggtcgctgccccgccgacgatctgctgctccagctccacgggaaggacctccgcaca

SEQ ID NO: 7321 - DNA, 981 bp, Streptomyces avermitilis
  CDS (1)..(981)
ttgtgtcggggacagggaaactctgttgcggcgtatgtccagcatcgctcaccattcgttcatgagcacgacgggggagatcgcggcaggggaaatcgcaggcgggggcctcacagcgtccacgggggtggtgctgtgagcgcgcgcctgcgcgcgatcgcgcgggagacggaggagatcgtcgcggcgggccggtaccacgcgtccgacgggcgtgcggtgtcgatcgccgcggcggtcgaggccgcacgggccgcgacccgggtgtatgggccggaccctgtggagatatcgcaggtcggcccggtcgccacgctcttcgaggtgaccggtgagagcagcctggaggcggcccggcgactgacggagcgggcgggcgatccggtcgccgtactgaacttcgcctcggcccgcaatccgggcggcggctatctgaacggcgcacaggcccaggaggaggccctgtgccgggcctccgcgctgtacacgtgcgtgctgggggcccgcgcgttctacgagcaccaccgggcgcaccgggatccgttctacacggaccgggtcatccattcgcccgccgtgccggtcttccgagacgaccgcgggcgcctgctcgacaagccgtatccggtcggcttcctcaccgccgcggcgccgaatgccggggtcgtgctgcgcagcgcgccggagcgggcccccgagctgccgcgggccctcgcggcacgcgccgagcgggtgctggagacggcggtgacgcacggctaccggcggctggtgctgggcgcctggggctgcggagtgttccggaacgaccccgcgcaggtggcgggggcgttccacgggctgctgggtcccgggggccggttcgccgggcacttcgagcacgtcgtgttcggcgtcctcgaccggacgccggggacggcgaccagaggcgccttcgagcgtgcgttcgatggcgaggtgcggggcgctcagcgccagccg

SEQ ID NO: 7322 - DNA, 453 bp, Streptomyces avermitilis
  CDS (1)..(453)
gtgacccgcgtgactgcctttaccgatgaagacattcccggccgccacggcccttccgcgaccaccgaggccgaaccccgcacggtgggccgggtgcggaccgagtactcccccgcgcacgacggtgaccccgaccccggcgagatcgtctggacctgggtgcccttcgaggagaacgacgggcgcggcaaggaccgcccggtgctcgtcgtcgcccgggaggcggccggcacgctgctggcggtgcagctctccagcaagcggcacgacggcgaccgggagtgggtgccgatcggcagcgggccctgggacaggtcgggacgcgactcctgggtggccgtggaccgcgtgctgcggctgcacgagagcggcatgcggcgggaggcctgcgccctggaccggatgcggttcaacctggtggtgcaccggctgcgggagcgctacggctggcgc

SEQ ID NO: 7323 - DNA, 1479 bp, Streptomyces avermitilis
  CDS (1)..(1479)
atgattgtcggcgtcgtggcgggggcagcagtcctcgcactgatcttcatcgttgtggtcttcaagctcatgtggcgcgtcgcggagcccaacgaagcactgatcatctccggttcgaagcatcggaccgaaggccttgaagaaggcatgggtttccgcatcgtgacggggcgcggcacgctggtgctgccgggcgtgcaagcggtccgcaagatgtcgctcgatctcaacgagaccgagctgtccgtggactgcgtcaccacgcagggcattccgctgaaggtgcggggcgtggtcatcttcaaggtgggcgacgacttcgtgtcgatcgccaacgcgggccgccgcttcctcgaccagcagaagctgatggcggagcgggtgcacaacgtgttcgccggtcatctgcggtccatcgtgggcgggttgacggtcgaggacatgatccgcgaccgcgagaagctcaccgggcagacgcgtgccgcgtgcggtacggagatggagaagctgggtctgatcgtcgactcgctccagatccacgagatcgaggacccgaccgggtacatcaagaacctggccatgccgcacgcggccgccgtgcagcgggacgcgcggatcgcgcaggcggaggcgaaccgtctcgccaccgaggccgagcagttggccgcgtcccggatgtcggaggcgacccgggacagcgagatcctgcaagccgggtaccaggccgagcgtgacaaggcggccgccaaggccaagcaggccggtccgctcgccgacgccgccgcgcgccaggacgtcgtcgtccaggagacgcgggtcgccgaactcgaggcgcaccgccgtgagcaacagctccaggcggacgtccgcaagccggccgacgcgaaggcgtacgagacccgggcccgcgccgaggccgaccgcgacgcgcgcatctccgcggcgcaggccaaggccaaggagacggagctggcggccgcggccgaggcgacccgggtgaagacggcggcgagcgccgaggccgaggcgacgaaggcgcgcggtgccgcctccgcgacggcgacccgggccaccggtgaggccgaggcggccgcggcgcaggcgaaggggctcgcggtggccgaggcgacccgggcgaagggtctcgcggaggcggaggccatcaaggcgcgggcggccgcactcgccgagaaccaggaggcggtggtcgcgcagcaactcgccgagaactggccggagatagtccaggcgggcgcgagcgccttcaacaacgtcgagcacatggtgctgctcaacggcgccgacggcatgggcgacatgttcgccaaggcgctcaccatgggcggcacggggctgggtctggcccgccagctgctggcgtcgatgaaccagaacgggacggcgggcggcggcgccgccgggctcaacgggttcgtgcccgcgcgtacggagaaggtgccggtggagaaggacgagggg

SEQ ID NO: 7324 - DNA, 1512 bp, Streptomyces avermitilis
  CDS (1)..(1512)
gtgtcccgcatggctgccgaacgcgccgacacccctcccgagcgtgccgagggcctcgcccggtgcgcccgggccctggccgacggcgaggtgacctcgcgcgagctcgtcgagcggacgctggcccggatcgaggcgacgcagccctcgctgaacgcgttccggctggtgcgcgccgaggcctcgctcgccgaggcacaggcggcggaccgggagctggcggcgggggcgcggcggccgctgctcggggtgccggtggcggtgaaggacgacatggacgtggcgggcgaaccgaccgcgttcggctgtcggggcgagttcccgccgcgggccgaggacagtgaggcggtacggcggctgcgggcggccggggcggtgatcgtcggcaagaccaacacctgcgagctgggccagtggccgttcaccgaggggcccgctttcggcgccacccgcaatccctggcatccggaccacacgccgggcggttcctcgggcggctcggcggccgcggtcgccgcgggcctggtcccggccgccctgggctcggacggtgcgggttccgtccgcatcccggcctcctggacgcatctggtcggcatcaaaccgcagcgcggccggatctccacctggccgcgccccgagtccttccagggcatcacggtcaacggaacgctcgcccgtacggtcgccgacgcggcgctgctcctggacgcggcgagcggcaaccacgcgggcgacctgcaccgcccgcccgccaccggcgtcctggaggccgtcgggcgcgagccgggccggctgcggatcgccctctcgctcaagcccccgttcacggcgctgcccgcccggctcgatccccgggtacgggcgcgggtcctcgagctggcggagcggctggcggcgctcgggcacgtggtcgaggaggcggagccgcgctacggccggatcggactgacgttcgtcccgcgggccacggccggcctggcggagtgggtgcgcgacgcgccgtttccggacctcctcgaccggcgcacccgcgacgccgcccgcctcggccgactgctcggcggagcacccctgcgcctggcacgggcggcggaggccaggctgcaccggcgggtcggggcgctcttcgacgtgtacgacgtactcctcgcgccgacgaccgccgctcccccgccgcacatcggctcgatggtgaacctgaacggtttcgggaccgaccgcgccatgatcgccgcctgcccctacgcctggccgtggaacgtgctgggctggccgggcgtcaacgtccccgccggtttcgtggacggcggcccctccccggccgagggcggccgagacggcggactcctgcccgtgggcgcccagttgctgggcccggcgcacagcgaacccctgctcgtctcgctcgccgcccagctggaggcggaccggcgatggcacgaacagtggcctccggcctcgacggacgccgactcggcggcgacccggaggagttcgggccgtacgctg

SEQ ID NO: 7325 - DNA, 1032 bp, Streptomyces avermitilis
  CDS (1)..(1032)
atggtgcacataccgaacgagcccgtcccttcgccgtccgcaccacgctccgtgccgacgagcgccgatgtggcacgcctggcgggagtctcgcgcgcgaccgtctcgtacgtgctcaacaacaccagcgccgtccggatcagcgagcccacgcgccgccgcgtccacgaggccgccaaggaactcgggtacgtcccgcacgccgcggcccgcagcctgcgcgccgggcacagccgtatggtcctgatcccgacgccgaacgtgccggtcggaccgctctacaaccagttcttcaacgaactgcagtgggcgctcagccgacttgagtacaccgtggtgcagtacggcgacctgtcgccgcacggcgacgaggcggcccgcgcctgggccgagctgcggccggtcgccgtcctcgtgcccggcggcgggctcgggccccagggcctggccgtgctcaagcgctccggcgcccgcgccgtcgtcaccctcggcgccgaacgcgtcgagggcgcccacgcggtgctgctggaccacgagggggtcggccacagcgccggccggcacctgctcgcccgcggccgccgcgcggtaggggtcgtggtacccgaggagcccggcttggagatgttctccaagccccggctcgaaggcgtccggcgggccctccagggcaccggggccaccgtcaccgaactgccgctcgcctacgaggaggaggccgcggcccgcctcgccgcgcgctggcgcccgctgggcctggacgccgtcttcgcgtacaacgacgagtacgcgatgctgctcatgcgcgccctccaggacgagggcatcgccattccgcgggagacggccgtgatcggcgccgacgacctgatgctcggccggctgctgcggccacgcctgagcacggtccacatcgagctgccgtcggggcgcgacctcgcggagctggtcgatcgcgcggtacgcgatccgggcgtcgcacccgaggtgcacgaggtgctcggcacgagggtcgtacagcgggaatccagc

SEQ ID NO: 7326 - DNA, 387 bp, Streptomyces avermitilis
  CDS (1)..(387)
atgagcagcaccgtggagctcaccaaggagaacttcgaccagacggtcacggacaacgagttcgtcctgatcgacttctgggcgtcctggtgcgggccgtgccgtcagttcgccccggtctacgagaaggcggcggaggccaatccggacctggtgttcgccaaggtcgacaccgaggctcagcccgagctggccgcggccttcgacatccagtcgatcccgacgctgatgatcgtccgcgaccaggtcgccgtgttcgcccagccgggcgccctgcccgaggcagccctggaggacgtgatcggacaggcccggaagctggacatggacgaggtccgcaaggcggtcgcggcacagcaggcgcaggctcaggcacagcagggcgag

SEQ ID NO: 7327 - DNA, 1431 bp, Streptomyces avermitilis
  CDS (1)..(1431)
atgacggaaacggaatccatcgcgtacgacgtcgtggtgctcggggccggtccggtgggggagaacgtcgccgaccgcacccgcgcggccggcctgtccaccgcggtcgtcgagagcgagctggtcggcggcgagtgctcctactgggcctgcatgcccagcaaggccctgctgcgcccggtcatcgcccgcgccgacgcccgccgcgtgcccggcgtgagccacctcgcgcagggccacctcgacacggcagcggtcctcgcccaccgggactacgaggtctcgcactggaaggacgacggccaggtcggctggctcgacggcatcggggccgacctgtaccgggggcacgggcgcctgtccggaccccgcgaggtgacggtgacgggccccgacggtgatcgccgggtactgaccgcccggcacgcggtcgcggtgtgcaccggcagccgcgccctgctgcccgacctgccgggcctcgaccaggtcgaaccgtggacgagccgcgaggccaccagcgctcaggccgcccccggccggctgatcgtggtcggcggcggtgtggtcgccgtcgagatggccaccgcctggcgggcactcggctccgaggtcacggtcctcgtccgcgggaagggtctgttgccccgtatggagccgttcgccggggaactggtggcggaggcgctcaaggaggcgggcgccgacgtccgcaccggcacatcggtgtcggcggtgacccgcgagggcccgaccgtggtggtgctgacggacacgggcgaccgcatcgaggcggacgagatcctcttcgccacgggccgcgccccgcgcaccgacgatctgggcctcgacacggtgggtctggagcccggctcgtggctgtccgtcgacgacagcctccgggtgacgggcagcgactggctgtacgcggtcggcgatgtgaaccaccgggcgctcctcacccaccagggcaagtaccaggcccggatcgcgggcgcggccatcgccgcccgggcctcgggcgtgcccctgctggaatcggatccctggggcgcccacgccgccaccgccgaccacgcggccgtcccccaggtcgtcttcaccgacccggaggcggcggccgtgggtctctccctcgccgaggcggagcgggccgggcaccacgtccgcgccgtcgacgtcgagttctcctcggtcgcgggcgccggtctgtacgccgacggctaccgcggccgggcccgcatggtcgtcgacgtcaaccgcgagaccctcctcggcgtgaccttcgtcggccctggcgtgggcgaactgatccactcggcgacgatcgccgtcgccggcgaggtgccgatcggccggctgtggcatgcggtgccctcgtatccgacgatcagcgaggtatggctgcggctcctggaggcctaccgggacgcc

SEQ ID NO: 7328 - DNA, 672 bp, Streptomyces avermitilis
  CDS (1)..(672)
atggcatccgaaagtgaccgcacggtccccgacacccgctccgcctcccgcccgctcgccgaccgtgtcgaggaactcctcgccaccggcggcccgttgccgatcgtcgcggccggcgacccggtgctgcgccgcggcgccgagccctacgacgggcagctcggacccgggctcctcgcccgcttcgtcgaggccctgcgcctgaccatgcacgcggcgccgggcgtcggcctcgcggcgccccaggtgggggtggggctgcggatcgcggtcatcgaggacccggcgccggtgccggaggaggtgggggcggtgcgggggcgggtgccgcagcccttccgggtgctggtcaacccgtcgtacgaggccgtcggcagcgaccgggccgcgttcttcgagggctgcctcagcgtgccgggctggcaggctgtggtggcccggcccgcccgggtgcggctgaccgcgctggacgagcacggtcgcgccgtggacgaggagttcaccggctggcccgcccgcatcgtccagcacgagacggaccacctcgacggcatgctctatctcgaccgggcggagctgcggtcgctgtcgtcgaacgaggcgatggcactgcggtggagccagccgacgccggaacgggcggcggcggcactggggttcgcgctgcccgac

SEQ ID NO: 7329 - DNA, 1410 bp, Streptomyces avermitilis
  CDS (1)..(1410)
atgaccaccgctccctccgccccagacgctccctcgaccacgacggacgagcccccgcagtccggtacgcccgggcccgccagatgggccccgctgcgccccctggtcctgcgcctgcacttctacgccggcctgctcgtggccccgttcctgctggtcgccgcgctgaccggattcctctacgcggcttcctaccaggccgagaagatcgtgtacgcgcatgagctgaccgtccccgtcggcgacaccgagctgccgatctcccagcaggtcgccgccgcccgcaaggcccaccccgagggcacactcacggccgtgcgcccctccccggaggcggacgcgacgaccagggtgctgctgtccggcgtcaagggcgtcgacgagggccacaccctcgccgtcttcgtcgacccgtacaccggcaaggtgcggggctcgctggaacagtacggatcgaccggcgcgctgcccctgcgcacctggatcgacgagttccaccgcgatctccagctgggtgagaacgggcgcctgtacagcgaactcgccgcgagctggctgtgggtgatcgcgggcggcggcctcgtgctgtggttcgggcgtcggcgcgcgcagcgcaaggtgcgcgggacgagcgggcgccgccgcaccctgggcctgcacggcacggtcggcgtctgggccgcggccggcttcttcttcctctcggccaccggcctgacctggtccacctacgccggcgccaacatcgacgaactgcgcacctcgctcggccaggccaccccgtcggtgtcggcggcggcggccggcgagcacgcgggccacgacgccgcggcgggaaccggcggtaccgagcacggcgtgggcctcgacaagatcctcgccgccgcccgtgccaaggggctcggcgatcccgtcgagatcgtcccgcccgccgacgcgtcgtccacgtacgtggtgaagcaggtccagcgcagctggcccgagaagcaggactcggtggccgtggacccggcgaccggcgaggtcaccgacacgctccggttcgccgactatccgctgctcgccaagctgacccgctggggcatcgacgcccacaccggcgtcctgttcgggctcgtcaaccagatcgcgttgatggccctcgccctgtccctggtcctgctgatcgtctggggctaccgcatgtggtggcagcgcggccgggcctccgccttcggccggccgatcccgcgcggcgcctggcagcaggtccctccgcagatcctcgtaccgtgcatggcggtgatagccgtcctcggctacttcgtgccgctgctcggcatcccgctggcggtgttcatcgccgtggacgtcgtcctcggcgagatcgcccaccggcgtgggcagcgcacttacggaaggcaggtagcg

SEQ ID NO: 7330 - DNA, 411 bp, Streptomyces avermitilis
  CDS (1)..(411)
atggcacagcgcgaggccaacagcccgcaccgcggttcccggcgccgcgggcagggcgagctggaggtccaggtgctcggcgcgctgcgcgaggcggacggcccggtgaccgcgtcctgggtgcaggagcacctcggcggcgacctcgcgtacaccaccgtggtgaccatcctgacccggctgctggccaaggacgtcgtctcccgcgagcggcaggggcgttccttcgcctggacgccgaccgccgacgtcgcgcgcctcgccgcgctcaagatgcgccgcctcctcgacggtgaacgcgaccgcgaagccgtcctggccagctttgtcaccgcgctgccgccggacgacgaacaggtcctgcgcacactcctggacgcggcggacacggcggacggcggtacggaaggc

SEQ ID NO: 7331 - DNA, 345 bp, Streptomyces avermitilis
  CDS (1)..(345)
gtggaaacgacgtactacgaccaggggacggccgcggagcgctgggagcgcgcgcagatgttcttcgacgccaaggactacgccgtcgccgcgcggattctggacgggctggtcgacgaggtgccggagcagaccgggccgcggctgctgctggcgcgttcctactaccactcggcccagttgggccgtgcggaggccgagctgcgcatcctcgtcgagcgcgaccccgtggagcactacgcccggttgatgctgggccgcacgctccagcgccaggggcgggacgacgaggcggactcgcagctgcggatcgcctcggcgctcgcgggcgacttcgaggcacgg

SEQ ID NO: 7332 - DNA, 462 bp, Streptomyces avermitilis
  CDS (1)..(462)
gtgaccaccaccaaccccaccaccaacctcaccaccaaccccaccgtcaacggtcaggtcataggccttgcccactacgccggtcgcggcctgctggagaccgtactggcccgcaccggcaccacgttcgaggagtcggtggccctgcacgcggccgcggccgccggcggaactgtcgcgcgcgaccggctcgtcgaccgcctgaccggtgcgctgaagaccggggaaacacccgcccggcaggccgtcgacgagctgatcgccgcgaagctgctggacgaaccggcacccggtcaggtgtcgctcacggacagcggccgggagctgttcgaaagcatccaggccggcggcaaggagatcgcgacccggctgtacgcgggcatcccggcccaggatctggagacggccgggcgtgtgctgacgctggtgacggagcgggcgaacgcggagcttgcggccctg

SEQ ID NO: 7333 - DNA, 525 bp, Streptomyces avermitilis
  CDS (1)..(525)
atgagcaacacggtgagcgacacggcccccgagggcgcgacccccggtttcctggtctggcgactgtcgatgaaatggcgcgtcgcggtcgaccgggcggtcgcgccgctggggctgacgcacgcgcagtattcgctggtcgccacgctggtcggcatgcaccgcaccgggctcaggcccaaccagcggcagctcgccgaccacaccggactcgaagcgctctacgtctcgaagctggcccgcgcgctggagtccggcggcctcgtcgaccggacccgcgacccggcggacccgcgcgcgatccagctgtcgctcaccccgcggggacacgaggtcgcccagcaggcgatcaaggtggtccaccggctgctggagcagctcctccagcccttgggcggcctcgacagcccgcgcacgacgcgattcacgcacgaactgagaactctgctcgacgcaccactcgacgcatcgatcgaacccggcacatccaccgaactcggcacacctgccgcagaggagcagtcg

SEQ ID NO: 7334 - DNA, 963 bp, Streptomyces avermitilis
  CDS (1)..(963)
atgagcaatcttgatcgcgaggcagtgcccacgctgtgcggcggccgtgggttcgtggtggccgagccggtgcgcgaactcctcagcccccgcaaggtcaagctcggtgagtccaccgaagtccgccgtctgctgcccaacctaggccgccgtatggtcggcgcctggtgcttcgtcgatcactacggtcccgatgacatcgccgacgagccaggcatgcaggtcccgccgcacccgcacatggggctccagacggtcagctggctgcacgagggcgaggtcctccaccgcgactcgacgggcagcctccagacgatccgcccgcgcgagctgggcctgatgacgtccggccgcgcgatcagtcactccgaggaaagccccaagtcgcacgcgcggttcctgcacggagcacagttgtgggtggccctgccggacagtcaccggcacaccgatccgcgcttcgagcaccacgcggaactgccggtcgtcacggcgccggggctccaggccacgctgatcctgggcgaggtcgacggcgcgacctcgcccggcacgacgttcaccccgatcgtgggcgccgacctgtccctcgcgagcggcgccgacgtacgactgccactggagccggacttcgagtacgccgtcctgtccatgtcgggcgaggcccacgtcgacggcgtaccggtcctgccgggctcgatgctctacctcggctgcggccgcagcgaactgccgctgcgcgcggagtcggacgcgggcctgatgctcctgggcggcgagccgttcgaggaggagctggtgatgtggtggaacttcatcgggcggtccaacgaggacatcgcacaggcccgttcggactggatggcaggctcccgattcggtgaggtggtggggtacgacggcgctccactgcgcgctcctgaactcccgccggtgccgctgaaaccgcgcggaagggtgcgc

SEQ ID NO: 7335 - DNA, 1761 bp, Streptomyces avermitilis
  CDS (1)..(1761)
atgaccgacgatcccacgcccactactccccccggctccttgtccgccctcatcggctacgcgcggcctcactggcgggtgctgctgctctccctcgtcctcactctgctggccagcgtgtcggggctggtgcagccgaagttcgcgcaggcgatcctggaccgcctcgacgacggcgccggcgtggtcgccccggtggcgctgctcgccgtgttcctggtcgcgggcgccctgctgaccggcctcaacgcctggctccagcaacgcacttcggagcgggtggtccggcaggtacggcgcggtcttgtgcaccgtctgatccggctgcgggtcgccgaactggaccggcgcgcccccggcgacctcatcgcccgcgtcacctccgacagcaccctgctcaagagcgcggccaccgagggcctgatcatgacggtcaacggcgtactgaccttcgccggggcgctgttcatgatggcggcgctcgacgcccggctgctcggggtcaccctgctggtgctcaccctggtcggcgtcgtgatcaccgtgatcctgccccggatcaaggccgcagtggcccgttcccagagctccgtcggcgcggtcggcgccgtgctcgaccgcaccctcggcgcggcccgtacggtcaaggccaacggcgccgagggccgtgagacgctggccgccgaggacgcggtcgacgaggcgtacgcggccggcctggtcggcgcccgatacagcgcgctggtcaccatggtcggcggcgccgccatccagaccgcgttcctggtggtgctcggcgtgggcggcaccttcgtggcgaaccgcacgatgtcggtctccgagctgatcgccttcctcctgtacgtgttcttcctggcgagtccggtctcccagctggtcggcggggccgcccaactccagcaggggctgggcgcggtgggcaggatccaggaggccgccgggctgccggtcgaggacgacatcgacgcaccgcccgccgccgcccccgcccacgccgcgccgcccgccgtcgagctgaccggggtcgagttcgcctacccgggccgcgcccccgccctgcgaggtgtcggcttcacggtccccggcggtacgcagacggcgctcgtcggcctttcgggcgccgggaagaccaccctcttctccctcctccagcgcttctacgagccgaccgcgggcacgatcaggatcggcggccaggacatctccgcactgccgcgtgccgaggtccggcggcggatcgcgtacgtcgagcaggactccccggtgatggccggctccctccgcgagaacctgctgtacgcggcaccctcggccacccctgaggagttggccgaggccctggccgtcacgcgcctcgacgcgctcgtcgcccgcctgccccagggcctggacactcccgtcggcccgcgcggcgtgaccctgtccggcggcgaacgacagcgcctcgccatcgcccgcgccctgctccgccgccctcaggtgctcctcctcgacgaggcgacggcccagctcgacgcccgcaacgaacaggccctgagcgaactcgtcgcccgtgccgcgggccggtgcacggtcctcttgatcgcccaccgcctgtccacggtcaccgacgcggaccagatcgtggtcctggagcacggcggcgtccgcgccgtcggtacccaccactcgttggtcgacgacgacgacctctaccgcgaactggccgcgacccagctcctggcggccgagcccccggcg

SEQ ID NO: 7336 - DNA, 1191 bp, Streptomyces avermitilis
  CDS (1)..(1191)
atgggccgattcctgttcgtggtgcccccgctggtcgggcacgtcaacccggccgtgggcaccgcggcggccctcgcggcccgcgggcacgacatcgcctgggcgggccatccggaactggtccgcggtctcgcgggggcggacgccgtcgtcttcccctgcgcgctgcccgaggacggtctttcccggcccgccggcctgaagggaccggccgccttccagttcctctgggagagcttcctcgtcccgttggcggacgccatggcgcccggggtgcgggcggcgatcgaggcgtacgatcccgatgtcgtcgtctgcgaccagcaggcggtggcgggcgcgctggtcgccgagtcgctcgggcggccctgggtgacctcggccaccacgtccgccgaactggtcgacccgctggccgggatgcccaaagtcgcggcctggctcgacggtctgctcggggagctgcgccgccggatcacgggcggcgccggcgccgcggatccgcggttctctccgcacggggtgctcgcgtacaccacgcgcgcgctgctcggcccggtggaactgccggaccgggtctggctggtggggccgtccgtcgccgcccgcccggcgggccccgacgacttcccctgggagtggctggaggcctccgcgctgcccaccgtcctcgtcagcctcggcacggccaacaacgacgccggcgcccgtttcctgaacgcggccgccgaggcgctgggcgggatcgcggaccgggtgcgggccgtgctcgtcgatcccggcggggtggtcgagcacccggtgcccgacaccgtcctcgtacgccggtacgttcctcaactcgccctgctggaacggctcgacgcggtggtctgtcacgccgggcacaacaccgtctgcgaggccctgtggcacggggtcccgctcgtcgtcgcgccgatccgtgacgaccagccgatcgtggccgcccaggtcgtggacgcgggcgccggggtacggctgcggttcggccgcgccgacgcggcgaggatcggcgcggccgtcgaggccgtcctcgatccggctcagggccaccggaaggcggccgaggccgtcggggagtccttccgggccgcggggggcagcgagtccgccgccgaccgcctcgaaacactgacggccgagtcggccgtgcccggagtacgaggctca

SEQ ID NO: 7337 - DNA, 801 bp, Streptomyces avermitilis
  CDS (1)..(801)
gtggcgaccctgcgggtgaacggcatcgacgtacacgtccagcgcatgggtgggccgggtgacgtcccgcgccccgtcgtggtgctcatccacggcatgctcatcgacagcctcgccagctactacttcagcctcgcgccgcagctcgccgaggacggcatggacgtcgtcatgtacgacctgcgcgggcacggcaagacctcccggccgccgaccggctaccgcatggaggacttcgtccgcgacctcgacgcactgctcgacgcactggcggtgaaccgcccggtgcacctcgtcggcaactccttcggcggggcgatcgcgtacgccatggccgccgcccaccccgagcgggtcgccagcgtcatcgccatcgaggccgagccgccgggccgggcctgggcgcagagcatgtacgagggcctggtcggcgaggagggcggcctggtggtccgagaggtcaaggagtggctgcgggagaacccgggcgagcgcaacgcccggccgttccgggcggccggccgggtgctggacgagaccgccctcgcccaggagatcccgctcagctctctcctcgacgacgacctgtccgcgatccgctgcccggtgttcgccgtgttcggcggcgcgtccaagctcgccgcgcagaccgggatgctggaagcgtccctggcgcgctgccgtacggtcgtgctgcccggtctcggccactcggtgctggtggaggccaccaaggagacgtacgccctcgtacgcgactggctgctcggccaggaggcgctcgcgctgcgggaggcccgc

SEQ ID NO: 7338 - DNA, 273 bp, Streptomyces avermitilis
  CDS (1)..(273)
gtgctcgcggacctctcggccatcctgcgcaccgtgctggaggagtacgggctcgacgactccgagatcaccctggacacgtccttccacgacgacctggagctggagagcatcgacctcgtcactctctccgcccagctgcgcgagttctacggcgagcgcgtcaacttcgccgcgttcatggccgaccgcggtctcgaggagatcatcgcgctgaccgtcggtgacctcgtcggctatgtggtggggtcgctcgccgtcgcggaggtgggc

SEQ ID NO: 7339 - DNA, 4569 bp, Streptomyces avermitilis
  CDS (1)..(4569)
atgaccacccccggacgcgccgaacccatcgccatcgtcggcatgtcggtgctcttccccggcgcccccgacctcgccacgtactggcacaacctggtctccggcgtcgacgccatcaccgacgtcccgcccggccgctgggacgccgacgagcactacgcgcccggcgccgagccccgcgccgaccgggtctactgccggcgcggcggcttcgtggacgagctggccgaggtggacgtcaccgagttcgggatcatgccggccgcggtgccggccaccgagcccgaccagctcatcgcgctgcgggtggccgcgcaggccctcgccgacgcgggcggcgcggaccggctgcccgccgaccggcaccgggtcggtgtggtgctcggccgcggcggctacctcacccccggcctggtcaggctcgaccagcgagtgcggaccgcgagccagctcgtacgcaccctgggcgagctgctgcccgacctcggcgcggaccgactggaggccgtacggcaggcgttcaccgaccgcctcggccccgaggcgccggagtcgtcgatcgggctcgtacccaacctcgccgcctcccggctggccggccgcctcgacctgcgcggccccgcgtacaccgtggacgccgcctgcgcctcctcgctcatcgccgtcgaccacgccgtgcgcgaactcgcggacggacggtgtgacgtgatgctggcgggcggtgtgcaccactgtcacgacatcaccttctggagcgtgttcagccaactcggcgcgctctcgccgagcgagcgcatccggccgttccacaaaggcgcggacggggtgctgatcggcgaggggaccggcgtcgtcgtcctcaagcggctcgccgacgccgagcgcgccggcgaccggatctacgccgcgatcaccggcaccggcgtcgcctccgacggacgtacgaccagtctcatggcgccggactccggcggccaggtccgcgcggtccgtcaagcctggcaggccgccgggctcgacccggcggcacccggctcgatcgggctcctggaggcgcacggcaccgccaccccggccggcgacggcgccgaactcgccacgctcgccgaggtgttcgggccgccaccgaaggacgcgaccgccgacgaaccgggcgccgtcatcggctcggtgaagtcgatgatcggccacaccatgcccgccgcgggcatcgccgggctgatcaaggccgccctcgccgtccaccacggggtgctgccgccgaccctgcactgcgacgagccgcatccggcgctggcccgcacccggttcgcccccatcagcgccgcccggccctggcccgccgacgaccggcagcccgtgcgccgggccgccgtcaacgccttcggtttcggcggcatcaacgcgcatgtggtgctggaacaggtggcggtcacgagggcggcccaggtctacgagccggagcgggtgctgcgactgaccgcgccgacacccgaggcgatggccgcgctgctggaccgcgacgactccgcgatcctcgccgccggtctcgacgaacgcgcgccggcgcccgccgccgatccggtgcggctcgccgtcgtcgggcccaccgcgaaacggctggcgctggcccgcaaggcggtcgcgaagggcgacgggtggcggggccggggcgacgtgtggttcgtgccgagcccgctgctggggcccggcggcggcaagctcgccttcgtcttccccggcctggaggccgagttcgtgcccaactccgaggacgtcgcccggcacttcgggctgccctggtcgcgggccgtcgccgacgccaccgtgggcgacgtgggccggcagggcaccggcgtcttcgaactcggccggctcctcgacgcggcgctgcgccggctcggcgtcgcacccgacgcgctggccggacacagcctgggcgagtggaccgcgatggccgccgccgaaatccacgcaccggacgaggtcgacgccttcctcgccggcttcgaccccgacgcgctgagcgttcccgggctcgccttcgccgcgatcggcgcccccgccgagcaggtgctgacggagctggccgggcgcacggacgtggtcctctcccacgacaacgcgcccaaccagtcgatgatctgcggcccggagcccgccgtcgccgcactcgtcgacgtgttccggtcccgggcactgatctcgcagatcctgccgttccgctccggcttccacaccccgatgctggagccctacctcggcccgatcagaaaggcggccgagacctacaccctccacccggccgcgctgccactgtggtccgcgacgaccgtagccccgtacccggaggaaccggcggcgatccgcgacctgttcgtccgccatctgctggagccggtccgcttccggccgctggtggacacgatgtacgcggcgggcttccgcgccttcgtccagctcggcgccggacacctcggctcgctcatcggcgacaccctgcacggccgtgcgcacctcgtggtcgccgcgcactccccgaaccgctcgggcctgccccaactccaccgtgtcgcgagcgcgttgtgggcggacggggcggcttcggacctctccccgctgctgggcagggcggccgccgcacccgcgcgcaccggccgccggccggtccggctggacctcggcggagcgaacgtctccctggacgcggagacccgccaccgggtgagcgccgcgctggccccgcgccgcgccccggccaccccaccaccccgggacgtcggcgaccacggcgaccacggcaccctcggcgaacagggcctgctgggagctgagttgtccgcgctgctgcgggacgcgacggcgctcgcctcggacgtggtgtcggcgggccgccgcaggcccggggccgcggcggcgacccaccacacccgggccacgcccggctcacgtacgaccgcggtgcccggccctcgtacgacggagccccccgcgccccgccccctcgacaccacccttcacgtgtccgtcgacaccatgccgtacctcctcgaccactgcttcttcaagcagcccgaccgggccgaccccgccgacagctggcccgtggtccccggcaccaccgtgatcgcccatctgatggacttcgcggaacgggccgcccccggccgccgggcggtggccgtccacgacgtacggctgcaccagtgggtgacggccactccggcggtcgacatcccggtacggatcgtccccgagagcccggaccgggtcaccgcgtcgctcggctcgtacgcgcaggccgtggtcgaactcgccgccgaccaggggcggtcagcgcctgccacgccctgggccttcccggccccggcggagccctggaccttcccggccgcggcggaggagaagcccgagctgacggccgcggagctgtactcgcgccgctggatgttccacggaccgcgcttccagggcgtgcgcgaactgacggcggtcggcgaacggcatgtgcgcggggtgctcgtctgcccgcccgcgccgggcgccctgctggacaacgtgggacagctcctcggctactggatcatgtccaggctgccggtgcgcaccacggtgttcccggtcggcatgaaggagatccgcttccacggcccgcaccccgcccccggggagcggttggagtgcctgatccggatcacctcggtcaccgacgccacgctcgaagccgatatgcagctggtgtaccggggccgggtgtgggcggagttcaccggctggcaggaccgccgcttcgacagcaacccgcggatccgcgcggtggaccgggagcccgagcggcacaccctgtcccggatgcagccgggcggctgggcgctggtccacgaggagtggcccgatctggccacccgcgagctgatcatgcggaacatcctggcgggcgaggagcgcgagcggtacgcggcgcacgcaccgcgcggccgacggcagtggctgctcggcaggatcgccgtcaaggacgccgtacggcatctgatgtgggacggcggcgcgggccccgtcttccccgccgaagtgcgggtcggcaacgacccgacgggccgccccttcgtgaccggcggctacggccggaccctgcccgccctgcatgtctcgatcgcccaccgcggcgagagcgccgtggcgatggccaggaccgaggggccctgcggcatcgacatcgaggaagtgaccgaccgtcccgagggcaccctcgccgtcgccctcgccccgccggaacgcgagctgctccgagccctcgcccaggctccgcgaggagcccccgaacgactctggttcacccgcttctgggccgccaaggaggccgtcgcgaaggcgcgcggcaccggactgggcggcgcgcccaagcagttcgagatcacggcggcggacggcgccgtggtgagcgtccgtgtcgcgggcgaggagtaccgcgtgcggcactcctcgctgaccatcccccggccgtccggacagcccggcaaggagtacgtcgtggcctggacggccgtcaacgattcaggagagcgaaga

SEQ ID NO: 7340 - DNA, 7095 bp, Streptomyces avermitilis
  CDS (1)..(7095)
gtgcctgtgtcgaatttcgatacttccgggctgtttgctgtcgaggacatcgtcatcgccgtgagcccgctcgccgtcccctcggcacgggtcaccgcggccgccgtacgggccggcggtctcggcgtgctcgacctcacctcgggtgggcgccgggcggcggcggaactcgcgctcgccgaggaatggtcggccgccggcttcggcgtacggctctccgacaacgatgcctttcccgcgcgggacctccccgcccgcgtgcacaccgtcctgctgaccagcgacgcctcgtgcaccccgggcgacttccccggccaccgcgtgctcgtcgaggtgaccggccatgagcaggccttacgggccctatcggccggggcgcacggactgatcgcccggggccacgaggcaggcggccccgtgggcgaactgggcacgttcgtgctggtgcaacagctgctcgccgaccgggagttggacctgccggtctgggcctgcggcggcgcgggcccgcacaccgcggcggccgtcgtcgcgggcggcggtgccggtgtcgtcctggacacccagctcgccctgctcaccgaggccgaggccggactgcccgccggcacctccgtactcctcaccgggctcgacggctccgagaccaccgtggagaacggccgccgtgtcgtacggcgccggggtgccccggacggtgccccggcgcccgagatcggtcaggacggtttcctcgcggcacgcttccatgagcgctggggcaccgtccacgcggcggtccggggcgtacgtgacgccgtcctcgacgccctcaagagcgcgggtcccgccctcggccccgacagcgcgggcagccgtgcgctcgggaccgaactgccggtcgtccaggggccgatgacccgggtgagcgaccaggccgcgttcgccgccgaggtgagcggccacggagcgctgcccttcatcgcgctcgcgctctccggcgccgagcagacccgcaccgtcctggagcggaccagggacgccctcgggcacgcgccctggggagtcggggtcctcggattcgccgacgaggagatcaaggccgcccagctggaggtcgtacgggagatccgcccctcccacgcgatcatcgcgggcggccgtcccgcgcaggcggccgcactggaggcggtgggcatctccaccttcctgcacgtgccgtcgccggggctcctgaagcagttcctggaggcgggcgcgcgcaagttcgtcttcgagggcgccgagtgcggtggccatgtcggcccgcggggcagcttcccgctgtgggaggcgcagctctgcgtgctcgacgacttcctggcgggcgccaagaacggtacggccgcggagttgcagctgctgttcgcgggcggggtgcacgacgagcggtccgccgccatggtgaccgccctcgccgcgccgctgagcgcccggggtgccgccgtgggcgtactgatgggcacggcgtatctgttcaccgaggaggccgtgagcgcgggcgcggtactgcccctgttccagcggcaggtgatcgcagccgagcgcaccgatctcctggagaccgctcccgggcacgccacccgctgtgtccgcagcccgttcaccgacgagttcgccgccgtcaaggaggagctggccgcccgcgacgtacccggccgggaggcctgggagcggctggagcagctcaacgtcggccggttgcggctggccagcaagggcctggagcgggccgggggcgaacttcacgaggtcggtgaggagagacagctcgccgagggcatgttcatggccggagaggtcgccgtcctgcgctcggccatcaccaccgtcgccgacctgcacgcctcggtgaccaccggggcggccggcttcctggcggcccggctggacgccctcggcatcgaggaaccggccatcgccgcctcccccgagccgctggacatcgccgtcgtcggcatggcctgcatgttccccggtgcccccgacctcgccgccttctgggcgaacgtgctcgccggtgcggacgccgtcacggaggtgcccgcgacccgctgggacgccgacctctaccacgacctgaacggcgccggggagaagaccccgtcccgctggggcggcttcctccccgagatcccgttcgagccgctgcggtacgggattccacccgcctcactgcccgccatcgagccggtgcagctgctggccctggaggccgcgcgccgggccctggaggactccggttacgggagccggtccttcgaccgggcccgcgcgtcggtggtgttcggcgcggaggcgggcagtgacctgtcgaacgccatgacgctgcggtccgtactgcccgcctatctcggcactctgccgcccgcgctggcggagcagctgccgcggctcaccgaggactccttccccggcatcctcgccaacgtcatcgcgggccggatcgccaaccgcctcgacctcggcggcgccaactacaccgtcgacgccgcctgcgcctcctccctcaccgccgtcgacgtggcgtgcaaggaactgagcggcggtaccagcgacttggtgctgtgcggcggcgccgatctgcacaacggcatcaacgactacctgctcttcgcctccgcccacgccctctcgccctccggccgctccgcgcccttcgacagcgccgccgacggcatcgcgctcggcgagggcgtcggctgcgtcgtcctcaagcggctcgccgacgccgagcgcgacggcgaccggatctacgcggtcatcaagggcgtcggcagcgccagtgacggccgggcgctgggcctgaccgcgccccggcccgaggggcagtacaacgcgctgacccgggcctaccgcaacgcgggcgtctcgcccgccgaggtcgggctcgtggaggcgcacggcaccggcaccgtcgtcggcgaccgcaccgaactcggctcgctcacccgggtgttcgaggaggccggcgccgagcccggcaggtgtgcgctcggctcggtcaagtcgcagatcgggcacaccaagtgcgcggccgggctggccggactgatcaaggcctcgctcgccctccacaccggagtgaagccgccgaccctgcacctcgccgaaccgaacccggcctgggacgcgcagagcagcccgttcgccttccacaccgaggcccgcccctggcccgccgcgccggccgaacgggtcgccggagtcagcgccttcggcttcggcggcaccaacttccatgtcgtgctgcgggcctacgaggacggtccaccgccggtcaccgccgcccagcagtggcccgccgagctgttcaccttccggggcgcggaccgggcggcggccgtgcgcgccgccaccgagctgctcgccctcgtcgaggcggaccccggaccccacgagccgtggcggctgcgggacttcgcgctcggcgcgtcccgccgcgcggagtccgccggcacgcgtggcgcccggacctggatcgccctcgtggccgagtcggccgaggagctggcggcgctgctgcgccgggccgtcgcgggtgaacacgccccgaaggagggcctgttcaccgccgacgacacggagacgggcgaggtggcgctgctcttcccgggccagggcagccagcggccggggatgttcgcggagctgttcgtggccttccccgaactccagcgccatctgcggctcgacgagacgacggcccgcgtcctcttcccgccgacggctttcgacgaggcgagccgcaaggagcagcaggagcggatcaccgacaccaccgtcgcacagcccgcgctcgggctcaccggactcgccgcgttccagctcctcaccagggccgggatacgcccggcgatggccgcggggcacagctacggagagctggccgcactggccgcggcgggcgccctcacccccgacgcgctggtgcggaccagccgcggccgggccgccgccgtcctgggcgccgccggcgacggtgatcccggcaccatggcagccgtcgccgcgggcgaaccggaggtcgcggcggccctggcggcggcgggactcgacggctcagtggtgacggcgaaccgtaactcgccccgtcagacggtgatttcgggccccacggacgacgtgctcaccgccgtcgagcggctgcgcgcccagggcctgggcgccaagcgcatcccggtcgcctgcgcgttccacagcccgctggtcgcggcggcgggcgaggccttcgcgaaggtgctcgccgacgtcccggtcggcgcgaccgacttcccggtctggtcgaaccgtacggccgcccgctacccggagagccccgaggcgatccgggccgaactcgccgcccagatcggcgcaccggtccggttcgccgaccagatcgaggcgatgtacgaggccggggcccgggtcttcgtcgaggccggccccggctcggtgctgacccggctggtgggcacggtcctcggcgaccggccgcaccgcacggtcgccctggagaagggccggcacaccggtctcgtcggattcctcgccgcgctcgcccaactggccgtcgccggtgtggacgtcaggacctcgtggctcttccagggccggggcgcggtcgacgccgcccgggcacctcgccgggtgcgcgccgcgtggaccgtcgacggccatctgatccgcacggcggacggcgcgatccccgccgccgcactccatcccgccgagcgcgtcccggaggccctcgtgacccacagcacctcggccggaccggtggcagccaccggctccgaggccctgatcagtgagttcctgcggacgagccgggagatgatcgcggctcagcgggatgtgatgctggggtatctcggtgcggatccggcggtacggcccccggccccggccgccgccccggccacgtacgccgacgccccggtcacgtacgccgacgcccccgtcaccgtgaccgcgccgcccgccgcaccggctgccgtggctgccgtggccgagcccgccgggggctcggtgctctcggtcgtactcgacgtgatcggcgaacgcaccggctaccccgtcgacatgatcgaacccgacctcgacctcgaagccgacctcagcgtcgactccatcaaacgagccgaaatcgccggcgaactcgccgcccgactcggcctcaccaccaccgccgacaccgacgtggaagaactcgccaaggcacgcaccgccgccgccatcaccgcgctggtcgagcgggtcaccggaccgggcgccgttcccaccccggccccggctgcccaggcccccgctcccgccgcgggccccgcaccgaccgccgagtccgtcctcgcactcgtgctcgacgtgatcggcgaacgcaccggctaccccgtcgacatgatcgaacccgacctcgacctcgaagccgacctcagcgtcgactccatcaaacgagccgaaatcgccggcgaactcgccgcccgactcggcctcaccaccaccgccgacaccgacgtggaagaactggcgaaggcacgcaccgccgcgagcatcgccgagctggtggcgggtgcccgaggggaggcagccgaggccagggccccggaagtcaccccggcagccaccccgcagtccgccccggccggcgcagagcccttggtcgtggcgcccaagcgcctggtgatgcgggagttcgacctcgcccccgccgagcccgcgcccaccggcgaccggctgacgggccggaacttcctgctcctcggcaccggacccgtcgccgacgcgctgaccgcccgcctcaccgcgcacggcgcccacgcgctcaccgccgacgagcccccggccgacgagaagttcgacggcctcatccacctcgtcgcgccggacgccccacccgtcctgccggacaccttccccgtctaccgacaggtgctggcgggcaacccacgctgggtgctggcctcaggcacctccgccggactgcgcggcttcttccgctccgtggcgcgcgagtaccccgacacggtggcccgggtcgtcgagcacgcccccggcaccgcgcccgaggacatcgccgccggtctcgtcgccgaactcaccgccgacgaccgggagccggtggtgctacgttccccgggcacccgtcgcggactgcgcatggccgaggagggcctgggcctgctcggcggaacgggcgcgggcccggccggtgacggcgcggccgaggccgccgcgctcggcctcgacaccgactcggtcgtgctgctggtgggcggcgcccgcgggatcaccgcccggttcgccgcgaccctggccgccgcctgccgctgccggatcgaactgttcggccgcaccgccctgcccgagggcgccgaggaccccgccctcgcccccgcggtcaccacgggcgaactgcgcgccgcgctcatcgcgggcggcctgcgggtgcccgccgagatcgaacgggcgatcggccggatccaggccgagcgcgaggtgcgtggcacgctgcgccggctcgccgcactcggctccgaggtccgctaccgcaccgtggacgcgctggacggcgacgccgtgcgccgggcggtgaaggagatccacgccgagcacggcagactcgacgccgtcgtctacgcggcgggcgtgatcgaggacaagctgatcgcggagaaaagcccgcggtcgtacgaccgggtgttccgtacgaaggccgacggcgcccgtgaactgctggacgcgatcagcgagttgccggacgggccgcggttcgccgtgctgttcggcagcatcgccgcgaccctcggcaaccgcggccagtccgactacgccgccgccaacgacgccctggagaccctcggcacccgctgggcggacgccggggcgggccgccgcgggctgaccgtccactggggcccgtgggcaccgaccggcgacggcaaccacggcatggtcacccccgagctgatgcggcactacgccgcccgcggcatccggctcatcgaccccgacgagggcaccatgagcctgctgcgcgagctggcctggggccccgagggcgacaccgccgtcgtgtacaccgcctcgggctgg

SEQ ID NO: 7341 - DNA, 1476 bp, Streptomyces avermitilis
  CDS (1)..(1476)
gtgcgcggccgcctggagggcggcctggcggtcttccgcggtgtcccgttcgccgaaccgcccgtgggggacgcgcggttcgccgcgccgcgcccggtacgcgcctgggacgggacacgggacgcgttcgccttcggtccgccgccgccccaggagacggggatccagggccgcgccgccctgctggacgcgcccacgggcgacgactggctgacggtcaacgtctggacacccgacccggaccctggtgcccgccgcccggtgatggtgtggatctacggcggtgcctacaagctcggccactccggcagccccggctacgacgctcgccgcatcgcccgcgacggcgacgtcgtcgtggtcaccctcaactaccgtgtcggcatcgagggcttcgcccgggtcgacggcgctcccgccaaccgcggtctgctcgaccaggtcgcggccctggaatgggtacgggagaacatcacggcgttcggcggcgaccccggccgggtcaccgtcttcggggagtcggccggcgccggatcaatcgcctcgctgctggccatgccgagcgcgtccggcctcttccggcgggccatcgcccagagcgtgccgggcacgtacttctccgacgaactggccaaggacatcgcggccgcgatcgccgccgaagcgggcctgcgccccacggccgccgatctgtccaccgtcgacccacgtcaactacccgccgcaggcgaggcgttggcggccacgatgcgccagtacgaggaccggtgggggccggtcgtccacaccctgacccccttctcccccgtcgtcgacggcgaggtcctgcccaccaccccctggcaggcgctggcggccggcaccgcccgggacgtcgaactgatcgtcggtcacaacagcgaggaattccggctgttcgtcctcctctccggacagctcggaaagatcaccgacggggaggcgcgggcagcactgcgcaggttcggacccggaccggacgccgaacaggcctaccgcaccggcttccccgacgcctcgccgggcgagctgtacgaacgcgtcatgtccgactggctgttccacatgccctcactgcacctggccgaggcgcagctcaccggcggcggacgcgcccacgtctacgagctgacctggccggccccgggcaacggcggcgtactgggcgcctgccacggcctggacatcccgctgctgttcggcacgttcgacgccgacctcggcagcctgctgttcgccggtacggaaccctcaccggaggccgaggcgctgtcatcccgtttccgggcgtcctggacggcgttcgcacggacgggcgaccccggctggcccacgtacgacaccgagcggcggctggtccaagtcctcgacgcggccccagaggtcatcccctaccccgaggaaacctcccggcgcctctgggagcgccacaccttccccgcgctgccgctgatccag

SEQ ID NO: 7342 - DNA, 612 bp, Streptomyces avermitilis
  CDS (1)..(612)
atggattccgagccgggtaccggtcctgcccgccactacgaccccggccgccagttggcccagttcaccggccgcatgctggtggtctgtccacgatgcggcggccgtgcgctcgtggttccccggcctggtcttcccgcgcccaggtacttcagcgagctgttgttccagccacgccgtctggcttgcggtgggtgcggaaccgtcgccgaccgggaacccgagatgcgtggtgcggggctggtcggcgcggtgccgggcgggagtgaggatccgtttttccggcggccgctgtggctgcagacccgttgcgtcggccggatcctgtgggcctacaacgaggagcatgtcgacgagttgtcggcctacgtgggcgcccgggtgcgcgagcgtggcggggtgcggccgacgcgggccatgttcgcgcggctgccggcgtggatgaagagggcggaccagcgctctgaggtcctggccggtctggagacgctgcgcgctctggccgagcggtcggcacctgccgaccgctccgacgccgcgcatgagcgcggtgaccgtccccgaccgtacggaagcctgtacttccggggcggcccgtatgaggcgaggtcc

SEQ ID NO: 7343 - DNA, 1839 bp, Streptomyces avermitilis
  CDS (1)..(1839)
gtggccagcgcgttcaacagcctcacccagcgcgcccatgccgaactgcgggaccgtggccacaccgtggcggtggaactcgccctgcccggcggctcgttgccggaggccgtgcggcggcacgccccgcagctcatcctggcgccgatgctgaagaccgcgatccccagggaggtgtggtcggcgcacacgtgcctcgtcgtccatccggggcccgtgggtgaccgcggaccgtcctctctcgactgggcgatccacgagggcgccgaccagtggggtgtgacggtccttcaggccgacgaggaaatggacgccggtgacgtgtgggcgtccgttccgtgcctgcttcctccggtgtccaagagcgacctgtaccggggcgaggtcgccgacgccgcgctcgcggccgtcctgctcgccgtggaacgctttgccaccggaaccttcgttccgcgcaaacaagccgaccaagccggccaaggcggcggccaaggtggtggcgaagccgaccaagtcggccaaagcgtggcacgcccggaaggcgcccacccgcgcacccgtccgtacctcgaccagagcgtccgacggatcgactgggccgaggactccacacggaccgtcgtacgcaagctgcgggccgcggactcccagcccggtgtgctggacgtgctgctcggcgacgcgtggtatctccacggcggccacccggagagcgtgttgcgtggccaccccggcgagctgctggccaccagggccggggcgatctgccgggcgacgaaggacggcgccgtatggatccccgagctgaggccccggcgtgcgcccgggcagccgccgacgttcaaactgcccgccgtacaggccctcggcgaccggcttcctccactgcgagagcacaccgtgcccctgttcccggacgcgcggcaccctacgtggacggacatccgctaccgggaggaggggaacgcgggtttcctctcgttctccttccccggcggcgcgatgagcaccgcgcagtgccgacgcctgctggacgcctaccgggacgcgtgcacgcgacccacatcggtgctggtgctgggcggcgaacgggacttcttctccaacgggatccacctcaatgtcatcgaggccgcggacgaccccggtgccgagtcctgggcgaacatcaacgccatcgacgacctcgtcgaggcggtcctgacgacgacggaccggctggtggtctcggccgtcgcgggcaacgccgcggccggcggggtgatgctcgccctggcggccgacgaggtgtggtgccgcgcgggagccgtgctgaacccgcactaccgtctgatgggcctgtacggctcggagtactggacgtacaccctgccgcgcagggtggggcccgcggcggccgaacgactcatgcgcgaggcgctgccggtgagcgcggcaagcgcccggcgtacgggactcgtcgaccgggtgatggagtgcggcccgcaggagttcgccgcggaggtcggccgcctggcggctcgcctggcggcgctgccgggaaccgcgtcacggatcaccgcgaagaagagggagctggaccggcaggagagcgtcatcccgccggccgctttccgcgagcaggagctggcccggatgcgccggaccttcctggacccggacgccccgtatcacgcgctgcgtcgcgcgttcgtccgcaaggagcggcctcggcgcaccccgccgcatctcagccccgccgcggttgcgccatcgggccagatcccctccgaggctcacgtcactggaacggccccccacggcgtctcaccgcgaccggatggctggtacgaagaaagc

SEQ ID NO: 7344 - DNA, 1086 bp, Streptomyces avermitilis
  CDS (1)..(1086)
atgactgcggcaacgccggacacggtcggcgctgcggacgccggaggtgcgcccgccgacgagacacccacgatccacattctctggatcaacgcagggctgagctgtgacggcgactcggtcgcgctgacggcggccatgcagccgagcatcgaggaaatcgtgctcggcgttctgccaggtctgccgaagatcgccgtccattggccgctcatcgacttcgagtgtggtccggtcggtggctcggacacgttcatcgagtggttcttcaagggggagcggggcgagatcgacccgttcgtgctggtggtcgaggggtccatccccaatgagtcgatcaagccggagggctactggtgcggtttcggggacaacccggagaccggccagccgatcaccaccagcgagtggatcgaccggctcgcgcccaaggcgctcgccgtcgtcgccatcggcacctgcgccacctacggtggcatccacgccatggccggcaacccgaccggggcgatgggcgtgcccgactacctcggctgggactggaagtcgcaggccggcatccccatcgtgtgcgtccccggctgtccgatccagcccgacaacttctccgagacgctcacctatctgctctatcaggcggccggcgccgccccgatgattccgctggacgacaagctgcgtccgacctggctcttcggggccaccgtgcacgagggctgtgaccgtgcgggctattacgaacagggccagttcgccctgacgtacgactctccgaagtgcctggtcaagctcggctgctggggccccgtcgtcaagtgcaacgtgcccaagcgcggctggatgaacggaatcggcggctgcccgaacgtcggcggtatctgcatcgcctgcaccatgcccggcttccccgacaagttcatgcccttcatggacgaaccccccggcgcgaaggtgtcgagcagcgccagcggcgcctatggcgcggtggtccgcaagctgaggaccctcacggcccggaccgtggacaaggagcccaagtggcgccacaccggagaccggatcaccaccgggtaccggccaccgtgg

SEQ ID NO: 7345 - DNA, 1782 bp, Streptomyces avermitilis
  CDS (1)..(1782)
atggcatcgacgacgaaggcggccggcgacggcagtggcctggtggagatggcctgggacccgatcacacggatcgtgggcagcctgggcatccacaccaagatcgacttcaagcagaagcgggtcgcggagtgctacagcacctcgtcggtcttccgcggctacagcgtcttcatgcgcggcaaggacccccgcgacgcgcacttcatcaccagccgtatctgcgggatctgcggggacaaccacgccacctgctcggtgtacgcgcagaacatggcctacggcgtgaagcccccgcacctcggtgaatggatcatcaacctcggcgagtccgcggagtacatgttcgaccacaacatcttccaggagaacctggtgggggtcgactactgcgaaaagatggtcaaggagaccaaccccggtgtcctcgaactcgccgagcgcaccgaagcgccgcacgccggggaccacggctaccgcacgatcgccgacatcatgcggtcgctgaaccccatcgagggcgacttctaccgcgaagccctacaggtgagccgctacacccgggagatgttctgcctcatggagggacgccacgtgcatccctccacgctctacccgggcggcgtcggcacgatcgcctccgtgcagctcttcacggactacctcagccgcctgatgcgctacgtggagttcatgaagcgcgtcgtgcccctgcacgacgacctgttcgacttcttctacgaggcactgcccgggtacgaggaagtggggcgccggcgcgttctgctcggctgctggggagcgctcaacgaccccgagtactgcgacttcacctacgccaacatgacggactggggccgacgcatgttcgtcacccccgggatcatcgtcgacggcaaactcgtcaccaacgacctcaccgagatcaacctcggcatccgcatcctgctgggcagttcctactacgaggactggcaggggcaggaacagttcgtcacccatgaccccctcgggaacccggtggacccgcggcacccgtggaaccagcacaccatcccggccccgcagaagcggaacttcgacgacaagtacagctgggtcatgtcgccccggtggttcgacggcaaggaccacctggccctggacaccggtggcggccccatcgcccgcctgtggtccaccgccctgtccggcctcgtcgacaccggctacgtgaaggccaccggccacagcgtggtcatcaacctgccgcgcaccatgaccaagcccgagaccaccttcgaatggaagattccgcgctggagcaacgcgctggaacgcaatcgcgcgcgcacctacttccaggcctacaccgccgccgtcgcactccacttcgcggagaagggactggaggaggtccgggccggacgcacccagacctgggagaagttcgaggtgccggacgagagcatcggcgtcggattcaccgaggcggtacgcggcgtcctctcccaccacatggtgatccgcgacggcaagatcgccaactaccacccgtacccgcccaccccctggaacgccagcaccagggactccttcggcacgcccggcccgtacgaggacgccgtgcagaacacgccgatcttcgaggagaacacgccggagaacttcaagggcatcgacatcatgcgcgccgtgcgcagcttcgacccctgtctgccctgcggtgtccacatgtacgtcggcggaggaaagacggtgcagaagatgcatgtgcccaccgggctgagcggactgggcgga

SEQ ID NO: 7346 - DNA, 588 bp, Streptomyces avermitilis
  CDS (1)..(588)
atgagcgcggtatcggcgacgaaccgcgtgaccgccgagcagaccgggcgccgtatcgaggacgtactggaccggctggccgccaccggcgacccggcggccggcgcggcggccgaagaactcgtccggaccctcatggagttctacggctcaggcctggcccgcatcctccacctgctgtcctccgcccccggcggtccacggcccccgggcgaccccctggcggccctgctcggcgacgaactggtcgcgagcctgctcgtcctgcacgacctccaccccgaggaccgggacgtccggatcgccagggccctcgacagcgtccgcgaccaggctctggaagtggtggccttcgacgagacgagcgggaccctgcggctgcggacccgggcgggcgcgggctgcggctgcgccggcaccggcacggccgccgtccaggccgccgaggacgcgctcgcctgcttcgcaccggaggtcacggccgtcgagatgcagcccgccgccgcccccggggagcccgccctgctccagatcggcaccggcccgaattccggcgccgtggcccgtccggcagcggcgaagaccgca

SEQ ID NO: 7347 - DNA, 666 bp, Streptomyces avermitilis
  CDS (1)..(666)
atgagcgggacccggacacccgcccgggcccccggcccgggcccgcgcgcccccggcctgcgcaggttcctgacggagcgtccaccccgccaggagcggtgcgagctgtgcgcggtggcggtggccgaggccgaccaccgccacctggtcgacatcgagaaacgggccctcgtctgcgcctgcgtctcctgcgcactgctgatggaacagccgggagccgccgcgggccgcttccgtgccgtcccgaaccggtacctcaccgacccggaccaccgcctcgacgacggtgcgtgggaggcgctccagatcccggtcggtgtcgccttcttcttccgcaacgcggcgctggaccggctggtcgccctctacccgagcccggccggagccaccgagagcgaactcgaaccgtccgcctggacgacggtgctcggtgacagccgcctcgccgtgctgctcgaacccgatgtggaggcactgctgctgcgccgcaccgacggccggtgcgagtgctacctcgtaccgatcgacatctgctacgaactggtcggccgtatgcgcctgctgtggcagggcttcgacggcggcgccgaggcccgggccgccctggagacgttcttcgagcacgtcgtgcgacgcgccaagcccgtacgcgaggtgggcaggccg

SEQ ID NO: 7348 - DNA, 690 bp, Streptomyces avermitilis
  CDS (1)..(690)
gtgacggagttctccttcgagtgcaccggcgtacgcgccgaccggtacgccgccggaccgaccctcctgttccggctgcgcgtcaccgcggccgacaacgcccgcgtgcacgcactcgcgctgcgctgccagatccgtatcgaacccgcccggcgcggctatgagtccgccgaggccgacggtctcgccgacctcttcggcgagcgctcacgctggggcaacaccctccagccggtgcagttcgcgcaggtctccctgatggtccccggcttcaccggagagaccgaagtcgacctcgtcgtgccctgcacctacgacatggacatcgccgcgacgcgctatctggccgcgctcaagggcggcgaggttccgctgctgatgctcttctccggcacggcgttcaccggagccgccgggttccgggtcgagccggttccgtgggaccgggaggcggccttccggatgccggtctcggcctggcgggagatggtcgagcagcacttccccggctgcggctggatccggctgccccgcgacaccatggacgccctgctcgcctaccgctcacagcgggcgctgccctcctgggaggcgaccgtgcgggctcttctcgaggagaagggcaccacggacccgccccggaaggacccctacctcgcgctcacccgaacgaccggagggacggatctg

SEQ ID NO: 7349 - DNA, 1434 bp, Streptomyces avermitilis
  CDS (1)..(1434)
gtgaccgtgaccgcgttcgccgcgcagaccgaggcgcggttcgccctcgcccggcaggtggccgacgccgttctcttcgagggctatgtgctctacccgtaccgggcctcggcggccaagaaccggctgcgctggcagttcggggtgctggtaccgcccgagtggggtgccgactgcgaagagcacgacttccagcacaccgaatgcctgatggaaccgaaggcgggcgcgacgctgtcggtcgagctgcgcttcctgcgcgcccggcggcggaccgtgcagcggatccgcccggacggcggcttcgacacggttcccgaactccggctcgacgaccgggtcctggttccctgggacgagggagccgaggagcgcgtcgaagtggtcgcggcggtggacgagctcctgggcgacggtgtcacggttcccttcacccgccccgccctggaggaggacgagccggttctcgacgcgacgggccggcccgtcggccgcctggtccggcgctgcgaggagatcagcggcgccgtgcggctgtccgcccgcgaactcgacgggccctaccggacgctgcggctgaccgccgtggtcgagaacacctccacctggacacctccacagggccgcagcgccgaccgggacgcggcgctgccgcactccctggtggccacgcacctcctcatggccctcagcgccggatcgttcctgtcgatgaccgatccgcccgagtgggcgaagggcgcgatcgccacctgccgcaacctgcacacctggcccgtactcgccggcgaacccggccgcgcggacctggtgctgtcctcgccgatcatcctggaggaccacccggcgatcgctccggaaagcccgggagcgctctacgacgccaccgagatcgacgagatcctcgcgctgcggaccgccgccctcaccgacgaggagaagcgcgaggcccggggcaccgacgagcgggcggccgccgtgatcgacctcgcggactcgatgccggccgaggttctcgaacgcctgcacggggcggtgcggagcctgcgtgaggtgaccgccccgccgagcgccgccgggccggccgccggagggttcccggacgagtacggggtgcggcgcccggacaccccgtggtgggacccggcgagcgaggccggcttcgaccctcagcacgaccgggtcgtcgtggacggccgctcgttgggcgccggaagccgcgtactgctgcgaccgggcctgcgccgcaccgacgcacaggacctgttcctccagggccgcagcgcgcaggtcgaggcggttctgcacgacgtcgacggcggggtgcacctggcggtgacggtcgagggcgatccgggcgccgacatccgccgtgagcaggggcggttcctgtacttccagcccgacgaggtcacaccgctggaggacgacgca

SEQ ID NO: 7350 - DNA, 549 bp, Streptomyces avermitilis
  CDS (1)..(549)
atgagcggtccccgggaggtgcccccaaggaccctcgtcgccggcatcgggaacatcttcctcggggacgacggcttcggtgtggagaccgcgcgcaggctcgccgagcggcaactgcccgcacacatcgaggtcgtggacatcggtgtgcgcggggtgcacctcgcctatcagctcctggacggctacgacaccctcatcctcgtggacgccacggcacgcggcgaagcccccggcacgctgtacctgatcgagcacgacagccccggtggaggcgagcccgagggagcccccgtgctcgacggccaccggatgacccccgacaccgtcctggcactgctggacacgctctgtgccggtaccggcggacagccgccgcggcgcaccctgatcgtcggctgcgaaccggcctcggtggaggagggcatcggtctcagcccgccggtgtccgacgccgtaccggaggccgtccggctgatcgacgagttgctacgggccgacgagccgggagagtccgcgccgcgggccacggccgacggagccgcgaag

SEQ ID NO: 7351 - DNA, 393 bp, Streptomyces avermitilis
  CDS (1)..(393)
atgcacgagatgtccgtcgcgctggccgtgatcgaccaggtcgagcaggccgcgcagcaggccggcgatgtcacggcggtgcgctcggtacgactccaggtgggtgaactggccggtgtcgtacccgattccctctccttctgcttcgaactggcctgcgccggaaccgtgctggagggcgccgacctggtcaccgaagaggtgccggggcgggcccgctgcgcaccctgcgcgcgcgaatggtccgtcggcatgccgccccggctgagctgccccgagtgcggcggggcgagagtcgacctgctctccggccgtgaactacagatcgtcagcgtgcactgggaggacggccggacgcacgcgcaaacccgcgaaccgatctccgaggagcgc

SEQ ID NO: 7352 - DNA, 825 bp, Streptomyces avermitilis
  CDS (1)..(825)
atgtgccgtgtggtcgacctgcaccaggccgtgctcgccaagaacgacgcgagcgcgcacactctgcgcgccgaactggcggctcgcggcaccgcggtggtcaacctgttgtccagccccggcagcggaaagaccgcgctgctggaacgcgaactgctgctggcacgggagcggtcggtgcccgtcgccgcgctgaccgccgacctcgccaccgagaacgacgcgagacggctggcgcgttcgggcgtaccggtcaagcaggtgctcaccgacgggctgtgccatctggaggccgggatgctcagccggcacctcgacggatggctgcccgacaacacccggctgctgttcgtggagaacgtcggcaacctggtctgcccggcctcctacgacctgggcgagactctgagagtcgtcctcgcctccgtcaccgagggcgaggacaagccgctgaagtaccccaccgcgttcggtctcgcccacctggtcgtcgtcaccaagaccgacatcgccgaggccgtcgacttcgacgaggccgcgttccgcgcgcacgtcgagcaggtcaacccaggagtcgaggtgctcctgacctcggcacgccggggccgggcgatcggcgcgctgctcgacagggcgctggcggccgcggacggcgcgccgctccacaggcctgtcatggcccgacggacggatgtcctcggacccgccggccccgcgcacgaccacggccacggcgacggccatgagcatgcccacaccggccccgcgcacgatcacggccatgcccacccggacggtaccggcgccatggcccagacccgctcg

SEQ ID NO: 7353 - DNA, 2364 bp, Streptomyces avermitilis
  CDS (1)..(2364)
atgccgcggcgccgtcgggtcaccgttcggggcgtggtgcagggtgtgggcttccggccgtacctgtacggcctcgccaccgagctcgccctggccggacatgtgaccaacacgccggagggcgtcgtcgtcgaagtcgagggaacaccctcggccgtcgaccggttctgcgaccggatcgccgcacaggcgcccccgctggcccgcgtggagtccgtccaccaccaggacctgcccgccacgggcggcggcgcgttcaccatcctcgcctcccgtgccgacgggccggtacgcaccctggtctccccggacatggccacctgcgccgactgcctcgacgaactggccgactccgccgaccggcgctaccgccatcccttcgtcaactgcacccactgcggcccgcgcttcacgatcgtcaccggtgttccctacgaccgcgcccacaccaccatggccggcttcgcgatgtgccccgactgcgcccgggagtacgccgatccggccgaccgccgcttccacgcccagccggtcgcctgccccgcctgcggtccgagcctgcgtctgctcgttggccggcagccgctcgacggacggccgcagagcgtcgccggggcggacccggtcaccgaggcccgcacgcttctggcgcgcggcgcgatcctcgcggtgaagggactgggcggctaccacctggcctgcgacgcctcggaccccgcagccgtcgccctgctgcgccgccgtaaggcccgcggggacaaaccgttcgccgtcatggccaggagcgcggacgacatcgagcacctcgtccggctcggtcccgaggagcgaagcctgctggagggcggcaccaggcccgtcgtgctgctgcgtcggcgtacggacccctcgtacccggcaggagcaccgcggccggccgaggccgtcgcgcccggcagccccgacctcggcgtgatgctcccgtacacgcccctgcaccatctgctgctcggtctgcccggcgacgccgaagggccccggctgctcgtcatgaccagcggcaatgtggccggtgagccgatcgtcaccgacgacgcggaggcactggagcggctggcgccgctggccgatgcctggctcacccacgaccggccgatccaggtgccgtgcgacgactccgtggtccgcgtcagtgacggaaagccgctgatgatccgccgagcccgcggctacgccccgctgccggtgcccctcccgctgtccgtccggccggccctcgccgtcggcggggacctcaagaacgcgttttgtctcggggaggaccggcgggcctggctgtccgcgcacatcggcgacatggacgacctcggcacccagcgagccttcgggcgcgccacggcgcaactggagtccgtcaccggcgtgcggcccagcatgctggtggccgaccggcaccccggctaccgctccgcccgatgggccgaccggaacgcggccgggcggcccgtcgtacgcgtccagcaccatcacgcccacgtggccgccgcgatggccgaacacgggctggagggcacccggccggtgatcggagtggccttcgacggcacgggccacggcgacgacggcgccgtgtggggcggggagatcctgctcgcggactacgacggtttcacccggttcgggcacctcaggtacgtcccgctgcccggtggtgacgccgccgtgcgccggccgtaccgcatggcgctggcccatctgcgcgccgccgggatcggctggtcggacgacctcgcctgtgtggccgcctgcccgcccgacgaacgccgcgtgctggaacgccaactggagcgagacctgaactgtgtccccacctccagcatgggccggctcttcgacgccgtgtcctcgctcgcgggcgtgtgtcaccgggccgggtacgaggcccaggccgccgtcgagctggaggccgccgcgctgaacgcgcccgtcgaggacgtcaccgcctacgcgttcgccctccgggcgtcggagccggacgggggcggcgcggtacgggccgacccggcacccgtcctcgcggcgatcgtcggtgacctgcgagcgggcaccgaaccggctctggtcgcggcccgcttccaccgggccgtcaccggtctcgtgcaccggatctgtgtgcgggcccgcgagcgtcacgggctggacacggtggccctgaccggaggcgtgttcgccaacaccctgctctcctcggcctgcgccacggccctgcgcgaggacggcttcacggtgctgcggcaccacctggtcccgccgggcgacggcggtctggcgctcggccagctcatggtggccgcccgtgacacggcccggaccgcgaccaccggc

SEQ ID NO: 7354 - DNA, 318 bp, Streptomyces avermitilis
  CDS (1)..(318)
atgtgcctggcggtacccggcagagtgctggacatcgaggaacgtgacggcacccgaatggccaccgtcgacttcggcggtgtggtcaaggaggtgtgcctggagtacctgcccgacctccaggtcggcgagtacgccatcgtccacgtcgggttcgcactgcaacgcctggacgaggaatcggcgaagcagacgctcgaactcttcgcccagctcggcatgttgcaggaggagttcggcgacccctgggaacaggcggcggaagcgggcggggccaccccgcccgtgggcgacgccgtcatcgaggaggtgcggaag

SEQ ID NO: 7355 - DNA, 1122 bp, Streptomyces avermitilis
  CDS (1)..(1122)
gtgaagtacatcgacgaattccaggacccggaactggcgcgccggctcctcgacgacatccactccacggtgaccaggccgtgggccctgatggaggtctgcggaggtcagacgcacaccatcatccggcacggcatcgaccaactcctcccggaacaggtcgagttgatccacggcccgggctgtcccgtgtgcgtgaccccgctggaggtcatcgacaaggctctggagatcgcctcccggccggaggtgatcttctgctccttcggtgacatgctccgtgtgcccggcaccggtcgcgacctgttccaggtacgcagcgaaggcggcgatgtacgcgtcgtctactcgccgctcgacgccctgcggatcgcgcggcagaacccggaccgcgaggtggtgttcttcggcatcggcttcgagacgacggcaccccccaacgccatgacggtccatcaggcccgtcggctcggcatcccgaacttcagcctgctggtgtcccacgtccgggtgccgcccgccatcgaggcgatcatgtcggcgccgaactgccgcgtccaggccttcctcgcggccgggcacgtgtgcagcgtgatgggcgtgggggagtacccggaactggccgaacgcttccgcgtcccgatcgtcgtgaccgggttcgagccactggacatcctcgaaggcgtacgccgcaccgttctccagctggaacggggtgagcacaccgtcgacaacgcgtacgcccgtgccgtccgcccggagggcaacccggccgcgcaggccatgctcgaggatgtcttcgaggtcaccgaccgggcctggcgaggcatcggtgtgatccccgacagcggctggcggctgtcacccaagtaccgcgaccacgacgccgagtaccgcttctcggtcgacgggatccagacgcgcgaaccggccgaatgccgcagcggcgaggttctgcagggaatgctgaagccgcacgagtgcgaggccttcggcaccgtctgcacaccccgtacccccctgggagccaccatggtctccagcgagggcgcctgcgccgcgtactacctctaccggcgactggacatcaccaccgccgcccgggaggcgagccccgttgtc

SEQ ID NO: 7356 - DNA, 1074 bp, Streptomyces avermitilis
  CDS (1)..(1074)
ttgtctgagaccaccgatctccgcgggccggcgaccctcgaggcctggacctgtcccgccccgctgcgtgaccggccgcgcgtcgtcatgggccacggcggaggcggggcactctccgccgagctggtccagcacgtcttcgcccccgccttcgggggagaggtgctcgcccagatgggtgacgccgccgctctctcgctgggcggtgtccggctggcgttctccaccgactccttcgtggtgcggccgctgttcttccccggcggcagcatcggcgatctcgccgtcaacggcaccgtcaacgacctcgccatgagcggcgcccgcgccgcctacctctcctgcggattcatcctggaggagggcgtcgaagtggaggtggtcgcccgggtggccgaggcgctgggggcggcggcgcgcaccgccggcgtcgaggtggcgaccggcgacaccaaggtggtggaggcaggacacggcgacgggatcttcatcaacacggcgggcatcggcctcatcccggcgggcgtcgatctgcgtccgcagcgggtcgtccccggcgacgtcgtcatcgtcagcggtgccatcggcgtacacggtgtggcgatcatgagcgtccgcgaaggcctggaattcggtgtggagatcgaaagcgactgcgcggcgctcggcggcctggtcgacgccatgctcgccgtcaccccggatctgcatgtgctgcgcgatcccacgcgaggggggctggcggccgcgctgaacgagatcgcggcggcctccggcgcgggggtggtcgtccgggagcgcgacgtcccggttccgccggccgtggccaacgcctgcgccattctgggcctggaccccctgtacgtcgccaatgagggcaagctggtggccttcgtgccgcgcgagcacgccgacgcggtcctgggcgcgatgcgggcccacccgctgggtgccgacgccaggatcatcggcgaggcggtggaggcccacccagggatggtggtggcccggacgggactgggcggcaccagggtcgtcgacctgccgatcggcgagcagttgccgcggatctgc

SEQ ID NO: 7357 - DNA, 384 bp, Streptomyces avermitilis
  CDS (1)..(384)
atgccgaagaaatcacattcgtccgagccgtcgcacggggagggcccgagtcgtcaccggggtaccgggcagcacggctggtcacctgatgtggatgagacccgtcagcaggacaacccgagcgctcaccgctccttccacccagccgaacacgccggcgacaggggccggggccggacgaagtccgcggaggagacgaagtccgttcccggtgagaccgcgaagagcggcagcgcgcgcggcgaggagtacgccgaggagtccgaagagggcaggcaggacaccggccgcaggggtcgctcccagcggcccagcggcagcaaggacgcttcctcctacaccggtgtggaccccaaggacccgccgtccaggcatcggccgggt

SEQ ID NO: 7358 - DNA, 318 bp, Streptomyces avermitilis
  CDS (1)..(318)
atgttcgccgccttcgtcggcggtctggtcatcgtcggcgcgttggtgtgggcggtgcgcttcggcaccaaggtgcgccgccgcgagccgggaccgccccgacgcgaggagcagcccacgctgccggagtccgggccggttcacgagacgcgacagaggcgggagcccgacgaggtccccagggcggcgaacgagagcgaacggctcaccccgcacgacctccacgcgtccggaagcaaaccgagcgagaaccagcagcggccacgctgggacgagggcgccggcggttcgttcggcagcggcggccccgggaggtcg

SEQ ID NO: 7359 - DNA, 525 bp, Streptomyces avermitilis
  CDS (1)..(525)
atgggcagccagaacggcgacgacctcatgggcgacgaggtgtaccagcccgagggccccgaggaccgggaggacgagggcatcctcgacccggaggacaccctcggcgaccgcggatcggacccgtacgacgagggatggtcgccgcccgagcgtccgctcggcgtcgagcacgagggcacgaccgcgcgcgagcagcgggagggcgagagcctggaccacaggctggccgaggagcggcccgatcctgcgctggaggagttcggggatcccgcggacgccgacgatccgggtgacctgcgcgacggcgagggagagcccctcgacgacgaggtcggcgacgagccggcgggccgtctcgtcgccctcgacgagggtgtacgcgaggaggcggagaaggacctgctcgccgaggacgacgcggagaaggatctgctcgccgaggacgtcggcatcgacggcggcgcggcttccgcggaggaggcggccgtccaccgcgtccccgacgaggacgactatccgctg

SEQ ID NO: 7360 - DNA, 636 bp, Streptomyces avermitilis
  CDS (1)..(636)
gtggcccctgtccggaggtgttccatggattcccacaccgagcccggcgtcgcggcgcccgaccctcaccgctccgaggtcactctgcgggtcaacggcaagctgtacacgctcaccgtggaccaccgttccgtcctcctggacgtcctgcgggaagacctcgacctcaccggcgcgaagaagggctgcgaccacggccagtgcggtgcctgcacggtcctcgtggacggccgccgggtcaacagctgtctgctgccggcggtcgcccaggacggccgcgacatcaccaccatcgaggggctcgccggcactggtgaggtcgtcggcgaggagggactcgccggcggcgacggtctcgtcgagggcggcggcgccggactccatccgctccagcgggcctttctggagcgggacgccttccagtgcggatactgcacgcccggacagatctgcagcgccctgggcgccctggcggaggcggaggcgggccacccctcccgcgtcaccgaccccgccaggccctccgggcagcccgtaccgctcggcagggacgagatccgcgagcggctcagcggcaacctctgccgctgcggcgcgtatacgcacatcgtcgaggccgtcgaggacgtgatccga

SEQ ID NO: 7361 - DNA, 990 bp, Streptomyces avermitilis
  CDS (1)..(990)
atgaagcccttcgcctacgtacgtgccggcagcgtccaggaggcggccgacgcccatgcctcccggcccggcgcgcgctatctcgccggcggtaccaatctcgtcgacctgatgaagctcggcgtggagcagccggccgctctcatcgacgtcagccggctgccgctcgacaccgtggaggaactggccgacgggtcgctgcggatcggcgccaccgtccgcaacagcgacctcgccgcccaccccttggtccgtgaccgccatccggtgctctcgcaggccctcctcgccggggcctccgggcagttgcgcaacgtggccaccaccggcggcaacctgctccagcgcacccgttgtccttacttccaggacgtgaccaagccgtgcaacaagcgggcgccgggcaccggttgcggcgcccgcgacggggtccaccgcgatcacgcggtgctcggccactcggagcactgcatcgccacgaacccctccgacatggcggtcgcgctcgccgccctcgacgcgcgcgtggagctgtacggcgccgacggcgaacgctccgtcccggcagccgagttccaccggctgcccggcgaccgccccgagcgggacacggagttgcgccccggcgaactcatcaccggtgtcgtcctccccgccgcgtcggccggacttccctcgctctaccgcaaggcccgcgaccgcgcctcgtacgccttcgctctcgcctcggtggcggcggtgctgcaggtgcgggacggcgtggtcgagcacgtggggatcaccttcggcgggctggcccaccggccctggcgggcccggcgcgccgaggaggcgctgctgggtgccgccccgacccgggccgcgttcgagcacgctgtggatctcgaactcgacgccgcccggccgctgcgcgacaacgcctacaaggtggacctggcccgcaatctcgccgtcgacgtcctggcccggctcacaccgcccggcggggcc

SEQ ID NO: 7362 - DNA, 2118 bp, Streptomyces avermitilis
  CDS (1)..(2118)
atggccgacgcacccaccgccctgggcgcacccgtcgagcgccgggagggccgggacaaggtcaccggcaccgcccgctacgccgccgagtatccgctgccgggccgggcgcacggatggccggtgcccgcggcgatcgggcgcggtgcggtccgcgcgatcgacgcccgagccgcgctggacctgcccggggtgctcgcggtgctcacgcacgagaacgcgcctcggctcgccgaaccggaggaccccacgctcgccgtgctccagaacccgcgcgtaccgcaccgcggttggttcgtcgccctggtcgtcgccgagaccctggaggaggcccgggcgggcgccgccgccgtccgggtcgactacgcggccgaggaccacgacgtgacgctgaccgagacccaccccgaggcctacacgccggacacggcgaacggagggtatccggcacaccgcgaacacggcgaccccgagtgggcgttcacctcggcgccggtccgcgtcgacgtcggctaccggctgccgccgctgcacaaccaccccatggagccgcacgcggccaccgcctcctggcagggcggcagactcgtcgtgcacgactccagtcagggcgccaccacggtacgtaccgtcctcgcgggcctgttcgagctgcccgaggaccgtgtcaccgtcgtcgccgagcacgtcggcggcggcttcggctgcaaggggacgccccgcccgcatgtcgtgctggccgcgatggccgcgcgcgagaccggccggcccgtcacggtcgccctgccccggcgatttctgcccgccgtggtcgggcaccgcgcccccacactgcaccgcgtccgcctgggcgccgcggccgacgggaccctggccgccgtcctgcacgaggtcaccacccacacgtcccggatcaaggagttcgtcgaacaggccgcgacacccgcgcgcgtgatgtacgcggcggcgaacatcctcaccagccatcgcgtggtgccgctcgacgtgcccagcccgtcatggatgcgggcccccggcgaggcgccgggcatgttcgcgctggagtcggcgatggacgaactcgccgtcgaactcggcatggaccccgtggaactgcgcatcgccaacgagccggacgcggagcccgacagcggccggcccttcagcagccgccatctcgtcgagtgcctgcgggagggcgcccgccgcttcgactgggccgcacgccccgcggccccgcgcgccagaacggcgggcccgctgctgatgggcaccggagtggcggccgccacctatcccgtcctggtctcgccggccaccgccacggcgcaggccctgcccggcggggacttcgtggtacggatcaacgccacggacatcggcacgggagcccgcaccgtcatggcgcagatcgccgcccatgccctcggtgtcccggtggatcgggtccgctccgaggtgggaagcagcgacctgccgtcggcgccgctggccggcggctcctcggggacggcgtcctggggctgggccgtgcacgaggcgtgcacacgactgcgcgcacgactggcggagggcacgggtcccgtgccggaccagggaatcgtcacgaacgccgacaccgcgggccacgccgacgccgaaagcgcctacgcccgccacgcgttcggtgcccacttcgccgaggtcgccgtcgacacggtcacgggggaggtccgcgtgagccgactgctcggcgtgtacgcggcgggccgcatcctcaacgcccgtaccgcccgctcccagttcatcggcggcatgaccatgggactgggcatggcgttgaccgagggcagcacgatggaccccgcgttcggcgacttcacggagtccgacctcgcggcctatcacgtgcccgcgcacgccgacgtccgcgacatcgaggcgtactgggtcgacgaggacgacccccatctcaaccccatgggcagcaagggcatcggggagatcggcatcgtgggcacggcggccgccatcggcaacgccgtgcaccacgccacgggcgtccggttccgcgaactgcccctgacgcctgaccgggtgctcggcggcctggcgacgccgggctcggtgagtggaggt

SEQ ID NO: 7363 - DNA, 174 bp, Streptomyces avermitilis
  CDS (1)..(174)
gtgaccgcgcagaccaaccggaagtccgtcgtctctcgccccaggacggggtgggcgaaggcccgccacctgcggggagacggcgtacgtacctgtgtctcggcccgcgatgacggcgaacgctcctgctccccggagcagggggccgaggagaacatcgtcaggggcgaggac

SEQ ID NO: 7364 - DNA, 228 bp, Streptomyces avermitilis
  CDS (1)..(228)
atggatcttcgcatctcgacgaaatcgcagacggcggtactcgccggcggaccggcggacggcctgcgcatgcgggtcgccgaccggccctcggtgctccaagtgacctacccctgcccgctcgacgcccccgcggagggcgtacgcgtggaggcgctgtacatctaccggcgtgcactcggcagccaggacgagccgctcacctacggctacgacccggccagcccc

SEQ ID NO: 7365 - DNA, 573 bp, Streptomyces avermitilis
  CDS (1)..(573)
gtgggcgtaactctggccaagggcggcaacgtttcgctgagcaaagaggctccgggcctgaccgcggtgacggtgggcctcgggtgggacgtgcggacgaccaccggtgccgcatacgacctggacgcgagtgcgctgctgtgttccggctcgggccgggtcgtctccgacctgcacttcgtcttctacaacaacctgacgagcccggacggttcggtccagcacaccggcgacaacctgaccggtgagggcgagggcgacgacgagtccatcaacgtcgaactggcccaggtgccggccgaggtcaccaagatcgtcttcccggtctccatccacgaggcgcagtcgcgcggccagagcttcggccaggtcagcaacgccttcatccgcgtggtgaaccgcgccaacaatgtcgaactcgcccgctacgacctgtccgaggacgcctcgaccgagacggcgatggtcttcggcgagctctaccggcacggcggcgagtggaagttccgcgcggtcggccagggatacgcatcgggcctcgcgggcatcgcgtccgactacggcgtgaacgtc

SEQ ID NO: 7366 - DNA, 675 bp, Streptomyces avermitilis
  CDS (1)..(675)
gtgtccggctttcccggggtgttgcgcatggcgaagcgaaaggtacggcgacaagcccgccgcctcctgggcgaggacccggtggctctcgtctggtgcgaggttcaccgccgcatcccccggccgccggaggaggtccaccgggcggcggggaaggggcggctcaagcccggacaccactggctgctgtacgtcggagccgtactgttcttcttcgtcgtcgtcccgatgatgctgatcgacaggctgggcgggaggctcgaccgggcgcaggcgcctccccggaggcaggggccgacgcccggcgggggccgtgaccgcgaccccggccgggaggccgcgaacggtgtcttcgacggcgactggagcctgaccgcgggccagttgctgctgcgctggtacggacgctcgcccaaccccaagcggctcgtcctgctgacccgcgaccgagtctgcctggccgcgtccccgcgccgtcggctgtcgcccaccagggccggcgacttccggatcgtcgccgagttcccggcgcgcgaggtgagcgtcgagggtgaggccggacagccgcgcggtttcgccactttccggctgtgcttcagcgacggctcctggctcgaggtcggcaggctgggcgagcccgaggacgcggaccacttcctgcgcacgatcgacgac

SEQ ID NO: 7367 - DNA, 1239 bp, Streptomyces avermitilis
  CDS (1)..(1239)
gtgcactccgcggtcctgctgatcgagttcggcgccatcatcctctctctcgggctgctcggccgggcggccgcccggctgcggttctcccccatccccctgtatctgctggccggactggccttcggcgagggcgggctgctgcccctcggcgcgagcgaggagttcgtcgccaccggcgccgagatcggcgtcatcctgctgctgttgatgctcggcctggagtacacggccggcgatctggtctccaacctcaaggcccactacccggccggcctggtcgacttcacctgcaacgccctgccgggcgcggccgccgcgctgctgctcggctggggcccggtggccgccgtggtgctcgcgggcgtcacctggatctcgtcgtccggtgtcatcgccaaggtgctgggcgatctgggccgggtcggcaaccgggagaccccggtcatcctcagcattctcgtcctggaagacctggcgatggcggtgtacctgcccatcgtcaccgcactggtggccggggccgggctggcggccggcagcgtgaccctggccgtcgcgctggccgccgcgggcctcgtcctgttcgtggccctccgcttcgggcggctcatctcccgcttcgtctccagcgacgacccggagaagctgctcctggtcgtcctggggctgacgattctggtcgccgggatcgcccagcagctccaggtgtccgccgcggtaggggcgttcctggtcggcatcgccctgtccggcgaggtcgcggagggcgcgcacacgctgctcagcccgctgcgggacctgttcgccgccgtgttcttcgtcttcttcggactgcacaccgacccggccagcatcccgcctgtcctgctgccggccctcgcgctggccgccgtcaccgccgtgacgaagatcgcgaccgggtactgggccgcgcggcgggccgggatctccgtgaagggccgctggcgggcgggcggcgcgctggtggcgcgcggggagttctcgatcgtcatcgcgggactcgccgtcaccgccgggatcgagccctcgctcggcccgctggccaccgcttacgtgctgctcctggtcgtactcggcccgctcaccgcccgctacaccgagcccctgatcgcccggctgaacgcccgctccggccgtgtccgcccggaacaccgggacgctccggtgccgacggaaccggagggcgacacgcgagcacagacgacggtcggcgac

SEQ ID NO: 7368 - DNA, 423 bp, Streptomyces avermitilis
  CDS (1)..(423)
atgacgcgagaacaccgccatctgtcggtggtggcgcaccgcgacggcgcccgcacggtgagcgtgtaccgggccgacgaccccgactcctgtgcgcagtcgctgcggctgacgagttccgaggcgggctcgctgatcgatgcgctcaagccctcccaccacagtgcgagcctgctgtacaccacggacctcgggctggtcgccgagcgcgtcgaggtcgccgcggcctcccgttggaacggacgggtactgggcgagacccggatgcggaccgagaccggcgcgtccgtggtggccgtactgcgccgagcggaggcgatcccgtctccggccccggacttccggctcacgggcggtgacaccctcatcgtcatcggcacccgcgagggcgtcgacgccgccgcggcgatactcggacgggag

SEQ ID NO: 7369 - DNA, 1164 bp, Streptomyces avermitilis
  CDS (1)..(1164)
atgggtgtcatgacggatggacgcgggcggcggcgagcggagaggctggtcggggcggcggcatggccgcggtccgggaaagagggaacgccccgggagcaccgggggacgccgaccggaggggacggaaagaggagcgtgtcgctgttccggcggatcttcctgctcaacgccgtcggcctgaccgtggccaccgcgttgctgctgggtccggtcaccgtgtcgacccccgtgctgcccggcgaggcgctggtcgtcctcgcgggccttgccgtgatgctcgtcgtcaacgccgtcgtgctgtggatcgggctcgccccgctgcaacggctggggcgggccatggccaccgccgatctgctgcacccgggggcccgtgcggtcgtcaccggtccggcggagatggccgatctgatctccacgtacaacaccatgctcgaccggctggagaccgagcgcgccaccagcgcggcccgggccctctccgcccaggagcgcgaacgccaccgcgtctcccaggaactccacgacgaggtcggccagaccctcaccgccgtcctccttcagctcaggcgcgtcgccgaccgggcgcccgaggggctgcgcgcggaggtgaggcaggcacaggaggccacccgcggcagcctggacgagatccgccgcatcgcccgccggctacgccccggtgtcctggaggaactgggcctgctcagcgccctccgcgccctcacgaccgagttcaccgcccacggactgagcgtgcgccaccacttcgacggcgaactgccacagctgagcgaggagacggaactcgtggtctaccgggtggcgcaggaagggctcaccaacaccgcacggcacgccggtgccgatcgcgccgaactccggctccaccgggtcgccgacggagtcgaactactcgtacgcgacaacggcacaggagccggccgggcgccggagggcgccgggatccgcggtatgcgcgagcgggccctgctgatcggcgccggcctcgcggtggagcccgggcccgaccggggcaccgacatcaggctgcgcatcacgagcaccacgagcacgacgagcacgacgagcgtgatgaacgcgacgagcaccggcgaccggtccgggccccgcaccggaacccctccccacggagcgcgc

SEQ ID NO: 7370 - DNA, 669 bp, Streptomyces avermitilis
  CDS (1)..(669)
atgtctcttcccccgcccgcccagcgcccgacccgcgtcctgctcgccgacgaccacgcgctcgtacggcggggcgtacggctcatcctggacggcgaacccggcctgagcgtggtggccgaggccggcgacggcgcggaggcggtcgccctggcccggacgacggacgtggacctcgccgtcctggacgtcgccatgccccgcatgaccggactccaggcggcccgcgaactctcccgccgcctgcccgagctgcgcatcctcatcctgacgatgtacgacaacgagcagtacttcttcgaggcgctcaaagccggtgcctgcggctacgtcctgaagtccgtggccgaccgcgacctggtcgaggcgtgccgggcggcgatgcgcgacgagccgttcctctacccaggggcggagaccgcgctcgtacgcacctacctcgaccgcgtccaccggggcgaaggactgcccgagcggaccatcaccgagcgcgaggaggagatcctcaagctggtggccgagggacacacgtcgaaggagatcggcgaactcctcttcatcagcgcgaagaccgtcgaacgccaccgcgcgaacctgctccagaagctgggcttgcgtgaccgcctggaactcacccggtacgcgatccgggccggcctcgtcgaaccg

SEQ ID NO: 7371 - DNA, 489 bp, Streptomyces avermitilis
  CDS (1)..(489)
atgaagaccgcagcgccctgttactaccacctcgacgtggaggtcagtccggaacggatcggacacgtccgccggattctggccgcccatctccggtactggaatctggagacactcgtcgagccggtctgccactgtgccgaagtgctactgcacacgatcgacgagcacgcggcggacaagaacaccaccctcgagatgtggtggaacggtcagcacctcatcaccgcggtgcaggacagcgaccaggacgtccgcccgcactacgcgccgcgcggctgcctgacgcagatcgccgcgatgagcgacggctggggctgttgtgccacgaataccggcggcaagatcatttggttctcgcgccgggctctggccgccgaccatgccccactggttccgacggctccgtggcccacgctgcgcgaggcacgcccggttccccgcgcactgcccgaacccctcccgcgggtgcccgagccggctgtctcc

SEQ ID NO: 7372 - DNA, 324 bp, Streptomyces avermitilis
  CDS (1)..(324)
gtgactggagcgatgctgctgcctgccagaaccgaggtcgccagatatctccagcggtaccgggcgtgggagcgcctgatgctcgctgctcccgacaacctcgtggtacggggaaatttcgagaacacgggttacaccctctgcgtgttgatgggggaacggtgcgcccgcgaggccgcggacgccgccgaacactttctgcgcaccggctcggcggcggcaccgcacgagcggaggacacgcaccggctctcccgcgcgcacggcaagcggttctcccgcgcgtacggcaaccggttctcccgcgcgtacggcaagcaacgcc

SEQ ID NO: 7373 - DNA, 1995 bp, Streptomyces avermitilis
  CDS (1)..(1995)
atgaaccggaatcccgtcatcggccgcataccgatcctggacgtccaccccctcgtcgagggcggcagacgtcccgcgaaggccgtggaaggggagacgttccaggtcaccgccacggtcttccgcgaaggtcatgacgcggtcgccgccaatgtcgtcctcacggatccgcagggccgcagcggcccctggacgcccatgcgtgaactggaccccggggccgaccgctggggcgccgacgtcacgccatggacggtcggcaactggacgtacctggtcgaggcctggagcgatccggtcaccacctggcgccatcacgccgggatcaagatcccggccgggatcgacaccgaactcgtcctcgcggagggcgccgacctgttcgagcgcgcggcgtacggcgtgccggaggggaaggggcggaagatcctgctggccgccgccgacgccctgcgcgacaccgagcgccccgccacgtcccggctcgccgcggcgctcactgtcgaggcggacacggtcctcgcgcggcatccgctgcgtgaactgctcacgtcgtcggagccgttgccgctgctggtggagcgggagcgggcgctgttcggttcctggtacgagttcttcccgcgttcggagagcggccgcgtggacccggtgcacggcaccttcgccacggcggcggagcggctgcccgcgatcgccgggatgggcttcgacgtcgtctacctcccgccgatccaccccatcggaacggcgttccgcaagggccccaacaacaccctgtcggcgagccgccgggatgtcgggtcgccatgggcgatcggctcaccggagggcggtcacgacgccgtgcacccagagctgggcacgatcgaggacttcgacgccttcgtacgtcgtgcggcggccctgggcctggagatcgccctcgacttcgcgcttcagtgctctcccgaccatccgtgggtggagaagcatccggagtggttccatcaccgtccggacgggacgatcgcgtacgcggagaacccgccgaagaagtaccaggacatctatccgatcgcgttcgaccgggacatgccggggctgatcgcggagacggtgcgggttctgcggttctggatgggtcatggggtgcggatcttccgggtggacaatccgcatacgaagccggtggtgttctgggagcgggtgatcggggaggtcggccggacggatccggatgtgatcttcctggcggaggcgttcacgcggccggcgatgatgcgggcgctggcggcggtcggtttccagcagtcgtacacgtacttcacctggcgcaacagcaagcgggagctgacggagtacctgaccgagctgtcgggggaggcggcggccgttatgcggccgaacttcttcgtcaacaccccggacatcctgcatgagttcctccagcgtggcgggcggccggccttcgaggtgcgggcggtgctggcggcgacgctgtcgccgtcgtggggggtgtactccggctacgagctgtgcgagaacaccccggtgcgcgccgggagcgaggagtacctcgactcggagaagtaccagctccgcccgcgggactgggcggcggccgagcgcgagggacgcagcatcgcacccctgatcacctcgctcaaccggatcaggcgggagcacagtgccctgcgccggctcaggaatgtccacttccaccatgccgacaacgacgctgtgatcgcgtacagcaagcgctcgggccgggacacggtcgtggtggtggcgaacctggatccgcaccacacccaggaggcgacggtctcgttggacatgccgcaactcggtctggactgggccgcgttcgtgccggtgcgcgacgagctcaccggggagagctaccactggggcagggccaactatgtgcgtctggagccggggcaccggcccgcgcacgttctcaccgtcctgcgaccgtcctcaccgcagatcggagggtcacccacacga

SEQ ID NO: 7374 - DNA, 1749 bp, Streptomyces avermitilis
  CDS (1)..(1749)
atgatcgtcaacgagcccgtcccggacaccttcgaggacacgcccgccaaggaccgcgatccggagtggttcaaacgcgccgtcttctacgaggtcctggtccgctccttccaggacagcaacggcgacggtgtcggcgacctgaagggcctgaccgccaagctggactatctgcagtggctgggcgtggactgcctgtggctgccgccgttcttcaagtcccccctgcgcgacggcggctacgacgtctccgactacaccgcggtgctgcccgagttcggtgacctggccgacttcgtcgagttcgtggacgcggcccaccagcgcggcatgcgcgtgatcatcgacttcgtgatgaaccacaccagtgacctgcatccgtggttccaggagtcccgcagcaaccccgacggcccctacggcgactactacgtgtgggccgacgacgacaagcagtaccaggacgcccggatcatcttcgtcgacaccgaggcctccaactggacgtacgacccggtccgcaagcagtactactggcaccgcttcttctcccaccagcccgacctcaactacgagagtgccgccgtccaggaggagatcctggcggcgctgcggttctggctcgatctgggcatcgacggcttcaggctggacgccgtcccctacctgtacaacgaagaggggacgaactgcgagaacctgccggcgacgcacgagttcctgaagcgggtgcgcaaggagatcgacacgcactatccggacacggtgctgctcgcggaggcgaaccagtggccggaggacgtggtcgactacttcggcgacttcccctcgggcggcgacgagtgccacatggcgttccatttcccggtcatgccgcggatcttcatggcggtgcggcgtgagtcgcggtatccggtgtcggagatcctggcgaagacgccggcgatcccgtcgagctgccagtggggcatcttcctgcgcaaccacgacgagctgaccctggagatggtcaccgacgaggaacgcgactacatgtgggcggagtacgccaaggatccgcggatgcgggccaacatcggcatccgccggcgtctggcgccgctgctggacaacgaccgcaaccagatcgagctgttcaccgcgctgctgctgtcgctgcccggctcgccgatcctctactacggcgacgagatcgggatgggggacaacatctggctcggtgaccgggacgcggtgcgcacgccgatgcagtggacgccggaccgcaacgcgggtttctcgtcctgcgacccggggcgtctgtatctgcccacgatcatggatccggtctacgggtaccaggtcacgaacgtggaggcgtcgatgtcgtcgccgtcctcgctgctgcactggacccggcggatgatcgagatccgtaagcagaacccggcgttcggcctcggctcgtacaccgaactccagtcctcgaacccggccgtcctcgcgttcctgcgggaggccccctcgaccggggggaacggggacgacctggtgctgtgcgtgcacaacttctcccggttcgcgcagcccacggagctggatctgcgggcgttcagcggccgtcatccggtcgagctgatcggcggtgtccgcttcccggccatcggggaactcccgtatctgctgaccctggcaggccacggcttctactggttccggctccgcaaggacgtcacccaggtcaccaaggtgagcttgttcgtgagctct

SEQ ID NO: 7375 - DNA, 1392 bp, Streptomyces avermitilis
  CDS (1)..(1392)
atgccgaagaccgcaccgctccgcccgagccgcctcagccccgggccgctgctgacctcgctggccggtctgctgcgggagtggctgccgacgcaacgctggttcgcgggcaagggccggccggtcatggatctcgccctgctgtcggtgaccgaactgcacccgggctgtctgcacctcctgctccaggccggacacgccgagcaggccgccggcagcggttccgacgagcattccgtccacgactgctaccaactcttcctaggtgtgggggagacggtcccggcccagccggcccgtgccgtcatcggccgggccgacgagggcccgctggccggcctgatggtctacgacgcccttcaggaccggaggtcgacggcgctgctcctggagcggctgcgcaccccgggcgtcgtaggacccctgcgtttcgagcgggacctcggggtgacgctgcccgccggtctcgagccgcgccttctcgacgccgagcagtccaactcctcgctggtgtacggggaccggtacatcctgaaggtgttccgccgcgtccagcccggcatcaaccccgacctcgaggtgccctgggccctggcccgacagggctgtgaccgcgtacccgcgccggtggcgtggatccgtacctcccttccatggggggcgaccctcggcgtgctccagccgttcctgcccgatgccgccgacggctggacacgggcgctccaggctctggactcgggccgggacttcatcgacgaggcgcacgagctggggcgggccaccgccgaggtgcatctggcgctggccgcggccttcccgctcgagttccagcagcggcaccacaacggacggctcgcggccgggatgacacggcgcctggaggccgtggcccggtccgtaccggaactcctgccgcacgcccccgccctgcgctcggccttcgacgcgctcgccgccgtcgacacaccccgtcccgcccagcggatccacggcgacctgcatctcggccaggtgctgcgcaccggccgacgctggcacctcatcgacttcgagggcgagccggcccgcccgctccccgaacgccgtcgtgcccagtcgcccgtgcgtgacgtcgcgggcatgctgcggtccttcgactacgccgcgcacgcgcgtcacccgtggcggccggactgggcccggcgttgccgggacgcctactgcgggggctatgcggacgaggcgggctgggatccgcgcgaggagcccgaactgctccgcgcatacgagacggaccgggcggtgtacgaggtcctgtacgaggcccggcaccgacccgagtggctgccggtacccatggcggcgatcgcacggcttgccgaccggcagccgctgggcgcaaggaggccgcag

SEQ ID NO: 7376 - DNA, 423 bp, Streptomyces avermitilis
  CDS (1)..(423)
gtgaacgcacatgctgttccccccatctccaccccggccccgccgtccggcgctcggccggccccggtggcaccgggtgaccgcgaccggctcctgtccgggacgcatcacgacccgcactccgtgctcggcgcgcatcccgtgcccggcggggtcgccttccgggtgctgcgcccgtacgcgctgtccgtcaccgtcgtcaccgacgacctgcgcaccgagctgcacgacgacggcgccggcttcttcaccggcctgctgccgctgcgcgccgtaccggactaccggctgcacgtggcctacgagggcacggtccacgagaccgagacgcctaccgcttcctgcccgcgctcggcgagctggacctgcacctcatcaacgagggccggcacgaggagctgtggacggcgctcggcgcccggg

SEQ ID NO: 7377 - DNA, 1776 bp, Streptomyces avermitilis
  CDS (1)..(1776)
gtgatgacccacgcgggggtcctgggtacccgcttcaccgtctgggcgccgaacgcgcgcggcgtcagggtctgcgggaacttctgccgctgggacggggccgcgtttcccatgcgctcgctcggctcctccggtgtgtgggagctgttcgtgcccggcatcggcgaaggcgaactgtacaaattcgagatcacccgccccgacggcacacacaccgtgcgcgcggacccgatggcccgccgtgccgaagtgcccccggcgaccgcctcgatcgtgacggagtcgtcgtacgcgtgggcggacggggcgtggatggccgcgcgcggcgagcgtcccgtgcacgagtcgccgttctccgtgtacgaggtccacctgccgtcctggcgacccggactgacgtaccgccagctcgccgaacagctccccgcctacgtcgccgacctgggcttcacccatgtcgagctgctgcccgtcgcggagcaccccttcggcggctcctggggttaccaggtcaccggcttctacgcccccaccgcccgcctgggcacccccgacgacttcaaatacctcgtcgacgccctgcaccgggccggcgtcggcgtcctgatggactgggtgcccgcccatttcccccgcgacgactgggccctggccgaattcgacggacgccccctctacgaacccgaagacccgcagcgcgccgcgcatcccgactggggaaccctcgaattcgactacgggcgcaaagaggtacgcaatttcctcgtcgccaacgccgtgtactggtgcgaggaattccatatcgacgggctgcgcgtggacgccgtcgcctcgatgctctacctggactactcccgcgaggaagggcagtggagcccgaacgagttcggcggccgggacaacccggacgcggtcgccttcctccaggagatgaacgccaccctctaccggcgggtgcccggggtgatcacgatcgccgaggagtccaccgcctgggacggcgtcacccgcgccacacatgacaacggcctcggcttcggcctgaagtggaacatgggctggatgcacgactccctcggctatgtgcagcacgagcccgtgcaccgcaagtaccaccaccacgagatgaccttctccatggtgtacgcctacagcgagaactacgtcctgcccatctcccacgacgaagtcgtgcacggcaagcaggcgctggtgtcgaagatgccgggcgactggtggcagaggcgtgccaaccaccgtgcctacctgggcttcatgtgggcccatccgggcaagcaactcctcttcatggggcaggagttcgcccagggcgcggagtggtcgccggagcacgggccggagtggtggctgctggacgacgagtaccactcggcgggcgaccaccggggcatgcgggacctcgtacgcgatctgaacacgctctaccgcgccgagccggccctgtgggagcgcgacaccgacccctccggcttcgcctgggtcgtcggtgacgcagccgaggacaacgtcttcgccttcctgcgccacgccgccgacggcaccccgctcctcgccgtcagcaacttctccccggtcgtccgccacgactaccgtctcggcgtccccgacgacatccccgcctggcaggaagccctcaacaccgacgccgcccgctacggcggcagcgacctcatctgtcccgaccccgtcaagcccgagtccggcgagatccggctgaccctgccgccgctcgccaccgtctggctccggccggcc

SEQ ID NO: 7378 - DNA, 792 bp, Streptomyces avermitilis
  CDS (1)..(792)
atgcgcaccacgactggaacgaagcagcacccgcatgacgacgcccccgacacggccgcggacttcgagcggctgttcggattgccggacgggcgcgagcggcaggcgctgcgcgacgagatcgtccgcgcctggcttcccatggcggagcgcatcgcgtggcgctaccgggggcggggcgagtccaccgaggacctctgccaggtcgcggcagtcggtctggtcaaggcagtcgaccgctacgacccggcacgggggaacgcgttcgagagctatgccgtccccaccatcacgggcgagatcaagcggcacttccgggaccacatgtgggtcctgcatgtaccgcggcgtgtccaggacctgcgcaaccgggtgcgggtggcggcgaaggagctgtcccagaccgtgccggggcacgagcccaccgtcacggagatcgccgagcacgcacagctgagcgaggacgacgtacagatcggcctggaggccatggacaccttcaccgccctgtcgctggacgctgagctgcccggaagcgacgacggctacgcgctgtcggacgccttgggcggccccgactccggctacgacctcgtcgtcgaccgtgaggccgtcaagccttccctgcgagcgctgcccgaacgcgaacgcaccatcctctacctgcgctacttccgcggcatgacccagagcagcatcgcggagcagctcggcatctcgcagatgcacgtctcgcgcctgatcagcggctgctgcgccaggatgcgcgaggagacgctggccgatgtcgcc

SEQ ID NO: 7379 - DNA, 387 bp, Streptomyces avermitilis
  CDS (1)..(387)
gtgacgcccgcggaggggacgatgatttcgaagccccgttcaggtcctgacgagccgcatgccaccgctgccgaaccggatcgcatcgtcgagctggaggaggagatcggccagctcaaggaggccgtcacctcccatgcggtggtggaccaggccatcggtgtgctggtcgccctgggccgggtgacacccgaccagggctgggccgtgctccgggaggtctcgcagcacacgaacatcaagctgcggtgcgtcgcggagatgatcctcatctggggacacagcggggacgacctgccgcccgatgtccgcgccaccctggaggacaccctcgaccgctgcgggcccacacagttgccgggggcaccgccggttccgccggctgat

SEQ ID NO: 7380 - DNA, 609 bp, Streptomyces avermitilis
  CDS (1)..(609)
ttgacaagtgagtctatctacacaactttggaggtcgaagcccacatgggcgtgggtgatgcgatggcggggaggtccttggtcgtggagtggacgggtgcgaggtatgcggacgggccgacggtcgaagtgccggtctggatcgatgctccgccgcagcgggtgtgggaactggtctcggacatcgcgctgatgccgcggaccagccccgagcttcagtcggtggaatggctcgacggccgccgcgggcccgccctgggcgcccgcttcgtgggccgcagcagccacgaggcactgggggagtgggcgaccacctcccacgtcgtacggtacgagccgccacgggtgttcgcctgggcggtggaggaccccgaactcccctcctcggtctggcggttcgagctggaggagcgggacggcggcacgctgctgcgggagtggatgcaactcggccccggccgctccgggctctcgtacgccatcgaccggatgccggacaaggagcagaagatcgtcttcgtacggatgcgggagttcgagaccaacatgggtgccaccctcgatgtgatcaagaagctcgccgagggcggccgggacgaggtggaggcg

SEQ ID NO: 7381 - DNA, 1047 bp, Streptomyces avermitilis
  CDS (1)..(1047)
gtgatgcgtacgtcgaccacgatcgaggcgtccggcggcacctggcgggagacggtggactacgtcaccgaggcggagaagctgggtctcgacatctgctgggtggccgaggcatggggctccgaggcgccctcgcccctgggatacctcgccgcacgcacccaacgcatgctgctcggctccggcatcatccagctcggcacgcgcacccccatggccatcgcccgggcggcgatcacgctgtccaacatctccgagggacgtttcctcctcgggctcggcccgtccggcccgcaggtgatcgaggggctgcacggcgtgccgttcgcgcgtccgctcgcccggatgcgggagaccgtcgagatcctgcggtgcgcggcgaccggggagaaggtctcgtacgccggacgggagttcacccttccgctgccgggcggggaggcccggcccatgcggctgtccatgcgcgccgagcacgacattcccgtgtacctcgccacgctctcgccgaagatgctggagctgaccggccggatcgcggacggctggctgggcaccagcttcgtgcccgagggtgccaaggaggcgtacttcgaccatctggacaaggggctcgcggcagcggggcgcacgcgtgcggacctcgacatctgccagggcgcggaagtcgcgttcgccgcggacgaggaagcactgcgggtgatgatcgcgggccggaagaaggaactcgccttcagcctgggcggcatgggctcggccggcacgaacttctacaaccaggcctacagccgccagggctgggccgccatcgcggccgaggtcggcgagcgctggcaggccggcgaccgtgccgcggcggccgccctgatcaccgacgagatggtcctcgccaccaccctgatcggcaccgaggacatggtgcgcgagcggctgcgcgtctggcggaacgccggcgtcgacaccgttcgcctctacccggcgggcgacaccctcgacgcgcggctcaccacactcgggcgcgccctggacctcgtacgagcgacggac

SEQ ID NO: 7382 - DNA, 1308 bp, Streptomyces avermitilis
  CDS (1)..(1308)
gtgttcgctctggccgtgcgctccgtccggcagcgccccgggcgcttcctcgccacgctgctgtccgcgttcctcggggcggcgatcatcatgacgttcaactcgatgtacgacaccgccgggcagcggggcgtcgacccggtgagcgcggagtcgctgaccacctcggcgagcgtcgtcggcggctacggcaccctgctggtgttcttcgccgtggcctcgacgctgacggtcaacgtccgccaacgcggcgccgagatcgacctgttgcgctgctcgagggcgactccggcgcagatcaaacggatggtggtgggtgagtcggtggtcgtggccctggtgggtgcggtgctggcgatcggtccggcgatgctcggcgggcgggcgctgctgagcgtcttccaggacagcggacaggtcgccggctccgtcgaccactccttcggccccgtcgccctgatgtccggtatcgacatcacggtcctcgcggccgcgggcgccgcgttcctggcggtgcggcgggcgacacggcggcgcgaaccccgggccggggcacggaagttcttcgcctacgcggccctggcggccggcggggcggcggtctgctccaccttcgccttctcggcgaaggacgccgccctgatggcgccgcccgcttacggggcgatcctgatctcggtggggctcgcgctgttctcgccccggctgctgaagggcttgctcgaccggctttcgccggccggcgcgagcggctggctcgccgtacgcaccctgcgggagcgcaccgccgaggcgtccgccgtgctgatgccgctggtcctcttcaccgccgtggcgacggcgacgctctgcatgcaggcggccgagaacgacgcgatcaaggcctcgggcgtcccgaagtcgatcgacgcgaagaacctggagaccctgaacctcgtggtcgtcggcatcatcgtggtcttcgcctgcgtcatgctgatcaactccctgtacgcggcgacgacctaccgcggccgggagttcgggcagcagcggctggcgggggcgaccccgggacaggtgctggggacggtcggagtcgagagcgtcatcctgacggtcaccggcgtcctcctcggatccgtcgccgggctggccgggatcgttcccttcaccgtcgtgcgcacggattcgccgtggccgcaccaaggcctggggatctggctcacgatcgcctcggtggccgcggcggtgacgctgggcacgagcctggccaccgcccggcgaacgctgcggacaccggcggtggagtcggtgacgctggccgcg

SEQ ID NO: 7383 - DNA, 783 bp, Streptomyces avermitilis
  CDS (1)..(783)
gtgatgacgatgtttcgccgcaaggacacggggtccgccccgagcgcggaggcgctgcgcctggtcaaggtcaccaggacctacggcagtgacgacagtgccgtgaccgccctcgacggggtgtccctcagcctggcccgcggcacgttcaccgcggtgatggggccgtcgggttccgggaagtcgacgctgttgcagtgcgcggccggactcgaccgtcccgacagcggcatcgtgagggtggacggcacggagctgacgggcggcagcgaggccgcgctgacgaggttccggcgcggccgggtcggcttcgtcttccagcagtacaacctgctgccgacgctgaccgtggcgcagaacacgatcctgccgctgaagctcgccggccggcgcgtcgaccggcagcgggcgcgggagacgctgacggccgtggggctcggcgaccgcctcggccaccggcccgaccagctctccggtggccagcgtcagcgggtcgcgatcgcccgtgcgctcgtcaccgaaccccgcgtgatcttcgcggacgagccgacgggcgcgctggacacccgcagcgcgcgcgaggtgctgcggctgctccagcaggcggtgcgggtgcacggccggacggtcgtgatggtgacgcacgacccggtggcggcctcgtacgccgactcggtcgtcttcctcgcggacgggcgcctcgcgggcgaactgcacggcccgacggtcgacgcggtcgccgagcgtctggcgcacctgggcgacgacgtgacggcgggggtg

SEQ ID NO: 7384 - DNA, 750 bp, Streptomyces avermitilis
  CDS (1)..(750)
gtgtacccagcgacaccccgtacgggtcaccagaacgagccgacccccgcgcccgcccggtgcaatggacgggtgaccgcgcccccggacgactgcctcgcgcgcaacgagtggatctgcggggagtacctgagcagccgccgccagatcctcctcgacgcggtggtgcagcacctccagctgaccgcggtctcggtgctcgtcggcctcgtcatcgccctgccgctggccgtgctggcgcgccgctggggctgggccgccgggccggtcctcgccgtgaccacgatcctctacacgatcccgtccctcgcgatgttctcgctgctcctgcccgtgtacgggctctcggccgccctggtcgtcgcggggctcgtcctctactcgctcaccctgctcgtacggaacatcctcgccggtctgcgcgccgttcccgaggagacccggcaggccgcgcgcggcatggggtacgggcccgtccggctccttctgaccgtagagctgcccctcgccctgcccgccgccatggccgggctccggatcgcgacggtctcggccgtctccctggtgaccgtcggcgcgatcgtcggcttcggcgggctcggcaacctcatctacgcgggcatgaacacgtacttcaaggcccaggtgctgaccgcgtccgtgctgtgcgtggtcatcgccgtggcggccgatctgctgctgctcggtgtgcagtggctgatcacgccctggacgagagcgcagcgcgga

SEQ ID NO: 7385 - DNA, 669 bp, Streptomyces avermitilis
  CDS (1)..(669)
atgaacaccctgaccggcgcgtgggactggctcaccgacccggcgaactgggcgggcgccgacggcatctggcaccggctcgtccagcacctcgtcctgaccgtcgtctgcctggtcatcagctgtctgatcgccctgccggtcgccctcgtcctcggccacctcggcaagggcggtgcgctcgccgtcaacatctccaacgtcggccgtgcggtgcccaccttcgccgtgctggtgctgctgctcctcacaccgctcggcaagtggggggaggggccgacggtggtcgccctggtcctgttcgccgtgccgccgctgctcaccaacgcgtacgtcgggatgcgggaggtcgaccgcagtgtggtgcgggccgcccgcggcatgggcatgaccgggcgacagatgctgttccgcgtggaactccccctttccctgccccttgtcatgaacggggtgcggatcgccgccgtacagctcgtcgcgaccgccaccatcgccgcgctggcgggcggcggcgggctcggccggatcatcaccgcgggattcaatctggcgagcacgccgcaggtggtggccggagccgtactcgtcgccgtgttcgcgctgatcgtcgagggcgtcttcgaggccgccgagcggctggcaccgtactgggcgcgaggcccgcgg

SEQ ID NO: 7386 - DNA, 933 bp, Streptomyces avermitilis
  CDS (1)..(933)
gtgacgtggcgcccggcgctggcgggcctgctcctgctcacggggtgcaccaccggcccgtccctggagaaccgcgacgaggtcaccgcgccgcccggcgacagcagacacctcaccatcggctcggccggattcaccgagagcgacctgctggcccagatgtacgcgctgctgctggagcgggccggatacaagacctcgatgctgaccgtcgccaaccgtgaactctacgaacccgcactggaatcggggcagatcgatgtcgtcccggagtacgcggccaccttcgcggactggctcaacgccaagacccacggtaccgacgccccggccgtgggctcacccgatcagaacgccacgatgagcgccctgcgcaagctcgccgcgccccgcgggctgaccgttctcgacgcgggcagggcggtcgaccagaacgccttcgcggtgacgaaggcgtacgcccggcagcatcacctcaagacactgagcgacctcggcgggtccgggctgaaggtgcggctcgcggcgggcgacgagtgtgtgcaacgcccgtactgcgaaccggggttgaagaagacgtacggcatcgacatcaccgccgtcgacccgaagggcgtcggcaccacgcaggcgaagcgggcggtccagagcgggcaggaccagatggtgctgaccaccacgacggacgcgaccctggacgagttcgggctcgtcctgctcgccgacgaccggcatctccagaacgccgacagcatcgtgcccgtggtcaaccgtgcgcaggcaggcagcgagcgggtcaccggggcgctcgaccggctcaacgacgtgctcacgaccggtgacctggccgccatgaaccagcaggtggacagctggcggcggctgccgaaggacgtggcccggtcctacctgacggagaagggcctgctgaag

SEQ ID NO: 7387 - DNA, 1152 bp, Streptomyces avermitilis
  CDS (1)..(1152)
atgatccggttcgaacaggtcaccaagcgctatccggacggcaccacagccgtggacggcctgtccttcgaggtcgccgagggtgaactcgtcacgctcgtgggtccgtcgggctgcggcaagacgaccaccatgatgatggtgaaccggctgatcgaaccgacctcggggcggatcttcgtgaacggcgaggacatcgcggcggtcgaccccgtgcggctgaggcggcggatcggctacgtgatccagcaggtgggtctgttcccgcaccggacgatcctcgacaacacggcgaccgtgccctcgctgatcggctggaagaagccgaaggcgcgggcgcgcgcggccgagctgctcggcctggtgggcctcgacccgaagacgtacggcgcccgctatccggaccagttgtcgggcggtcagcgtcagcgtgtcggggtggcgcgggcgctggccgccgacccgccggtgctgctgatggacgagccgttcggcgcggtcgatccggtggtgcgggagcagttgcaggacgagttcctgcgaatgcaggaggcggtgcgcaagacggtgctgctggtgacgcacgacatcgaggaggcggtgcggctcggcgaccggatcgcggtgtacgggcaggggcgcatcgagcagttcgacacgccgggggcggtcctcggaacgcccgccacgccgtacgtcgccgagttcgtgggcgccgaccgcgggttgaagcggctgtcggtgaccgagatcgaggcggacgatctcgaacagccgccgatcgcccgcctcgacgaggccgccgagcggacggctgcccggctgaacgcggagggcgcccgctgggcggtcgtcctggacgccgggggcgacctgcacggctgggtcggcgtcgacgagctcggcgccggcggcgccgtgcgcgatctcgcccaccggatgaactcctgggtgccggtgggcgcccccctgaaggaggccttcggtgtgatgctccagcacgacgcgggctgggtcgccgtcctggacggggcacgtttcctgggcgtgctgaccccggccaagctccatgaggcgctgcgccgttcggtggacgcggacgcgctgggtgtgccgcgcgggcaggtgtcgttcgactcggtcgcggatgcc

SEQ ID NO: 7388 - DNA, 693 bp, Streptomyces avermitilis
  CDS (1)..(693)
gtggcagcgtacgcacggtggaaaggacgcgaagtgagcagcagggacgtgatcctcggccgggtgcggcgcgcgctcgccgacgtatcggacgacacgccgtacgagcaggcggtcgaccggagctatctgcgcgagcacggtgcccggagcgtcgcggagacggtcgacctgctggccgagaacctggcggactaccgggcgatcgtgcaccgctgcacggccgacggactgccggcggtgatcgccgggctgctcgcggaccgcggctcgacgtcggtgctcgtgccgcccggtctggacggggaatggctggcggcgaccggggtcccgcgcgtccccgaccgggccgacagcaccgcgcacgagctggaccgggtcgacagcgtggtcacggcgtgcacggtggcgatcgccgagacgggcaccctcgtgctggacggcggcccggagcagggccgccgccgcgtcactctggtgccggaccaccacatctgtgtcgtacgcgtgccggaccaggtggtctcctcggtgccccaggcccttttgcgcctcgacccgacgcgcccgctgacctggatctccggtccgtcggcgaccagtgacatcgagctcgaccgggtcgagggagtgcacggtccgcgcatcctggaggtggtgctggtgagcggccggcccggggcggtcacggcg

SEQ ID NO: 7389 - DNA, 1473 bp, Streptomyces avermitilis
  CDS (1)..(1473)
atgagcgggacgttcgtcgggatgccggccttccctgaggcggcccatgacgcggtgaacaaccggaccctgcgcggcaatctgcgccacgcgacccatacgatccgcgccaagcgtgccaaagcggtcgcggaagtctcggactgggccgcgctgcgcgaggccggcaagcagatcaaggatcacacgctccgtcatctcgaccggtatctggtgcagttggaggagtcggtcacggcggccgggggcacggtgcactgggcggccgacgccgacgaggccaaccggatcgtcacccggctggtcaaggaaaccggcgagaccgaggtcgtcaaggtcaagtccatggccacccaggagatcgccctcaacgaagcgctcgaagccgaggggatccgcgcctacgagaccgacctcgccgaactcatcgtgcagttgggcaaggaccgcccctcgcacatcctcgtccccgccatccaccgcaaccgcggcgagatccgcgacatcttccgctccgagatgggcgcgtggggacgtccggcgcccgaaggcctcaccgacacgcccgccgagctcgccgacgccgcccgcctccacctgcgcgagaagttcctgcgcgccaaggtcggcgtctccggtgccaacttcatggtcgccgagaccggcacactggtggtcgtggagtcggagggcaacggccggatgtgcctcaccctccccgagacgctgatctcggtcgtcggcatcgagaagatcgtgccgacctggcaggacctggaggtgttcctccagacgctcccccgctcctcgacggccgagcgcatgaacccgtacacctcgacctggacgggcaccacggacggggacggcccgcgaaccttccacctggtcctcctcgacaacggccgcaccgacacgctcgccgacgaggtcggccgccaggcgctgcgctgcatccgctgctcggcatgtctcaacgtctgcccggtgtacgagcgggcgggcggccatgcctacggatcggtctacccgggtccgatcggcgccatcctcagccctcagctccggggcaccgcgagcgagatcgacgcgtcactgccgtacgcgtcctcgctgtgcggcgcctgctacgaggtgtgcccggtcgccatcgacatccccgaggtgctggtgcatctgcgcgagcggatcgtggagggcggccccgtgacgcgggagggcgccaaggtcgtactgaagccggcgaaggggcacgccgccgagcgggccgcgatgcgcggggcgcgctgggccttcagccacccgggcgccctgcgcgccgggcaacggctcgcgtcccggacgcgccgcttccatccccgtaccttgcccggcccgggcaaggcgtggagcgcgagccgggacctgccggaggtgcccgcggagccgttccgcgactggtggcagcgtacgcacggtggaaaggacgcgaag

SEQ ID NO: 7390 - DNA, 753 bp, Streptomyces avermitilis
  CDS (1)..(753)
atgcgtgtcgccctgttcctgacctgtgtcaacgacacgctgtatccggacacgggccgcgccgtgctgaagttgctgaccaggctgggtgtcgacgtcgacttcccgatggaccagacctgctgcggacaggcccactacaacaccggctaccggcatcaggcggagccgctggcacggcatttctccgatgtattcggggagtacgaggcaatcgtcacgccgtccgggtcctgcggcgcgatggtgcgggagctgtatccgcggatgggtgagcgggcacgcgccgagggccgcggggacacactggcgaagaccttggcgccggtcgtgccgaagacgtacgagctgaccgagttcctggtggacgtgctgggtgtcacggacgtcggcgcgtactacccgcacacggtgacgtaccacccgacctgccacggtctgcgcagcctggggcttggcgaccggccgcgccgactgctccaggcggtcaaggggctggagctgcgggagctgcccggcgccgacgagtgctgcggcttcggcggcaccttcgccgtcaagaaccccgacgtgtccgcggcgatgggcaccgacaaggtacgcagcgccgagtcgacgggcgccgaggtgctgtgcgccgccgacaactcgtgtctgatgcacatcggcggcacgatggcccggctgagcaccgcaatgcggccggtgcacatcgcggagatcctggcgagcacggaagaggagccgagcgca

SEQ ID NO: 7391 - DNA, 1443 bp, Streptomyces avermitilis
  CDS (1)..(1443)
gtgaccgctgtgcacacgtacgccgcggtcgacctcggcgcgtccagcggacgcgtcatggtcggccgcgtgggccccggctcactggatctcaccgaggcgcaccgcttcccgaaccggcccgtccgcgtgcccgaagggctgcgctgggacatcctcgcgctgtacgcgggcgtcctcgacgggctgcgggccgcgggccgggtcgactcggtcggcatcgacagctgggccgtcgaccacggcctgctggacgccgacggcgcgctgctcggcaacccggtgcactaccgggacgcgcgcaccgaggggatcgcggagcaggtgtgggccaatgtgcccgccgccgagctgtatgcggcgaccggactccagtacgcgcccttcaacacgctctaccagctgacggcagcccgctcctcggcccaactggcgcacgccgagcgtctgttgctcgtcccggatctcctgacgtactggctgacgggcgaggcgggcacggagctcaccaatgcctcgacgacccagttgatcgacccgcggacgcgcgactggtcgtacgacatcgcccggcggctcggcatcgacctcgggctgttcgcgccgctgcgccggcccggtgacccggcgggcgtgctgcggcccgaggtgctggcggagaccgggctgaccgggccggtcccggtgacgacggtcggttcgcacgacacggcgtcggcggtggcggcggtgcccgccgtgcgcgaacgcttcgcgtacatctgcaccggcacctggtccctggcgggcctggagctggacgcacccgtcctcaccgaggcgagccggctggccaacttcaccaacgagctgggcctcgacgacacggtccggtatctgcggaacatcatggggctgtggctgctccaggagtgcgtacgggagtggggggacccggacctgccgcagttgttgtccgccgctgccgagcagccgcccctgcggtcggtcgtggacgcgggggacgccgccttcctggcccccggccggatgccgcagcgcatcgccgacgcctgccgcgcctcggaccagcccgtgcccgactcccccgcgggcatcacccgctgcatcctcgactcgctcgcgctcgcccaccgcagggccgtcgccgaggcgcagtccctggccgaccacccggtcgacgtcgtccacatcgtcggcggcggcacccgcaacgcactgctgtgccagctcaccgccgacgcctgcgggctcccggtcgtggccggtccggcggaggcggccgcgctgggcaacgtcctcgtccaggcccgggcgggcggcctggtcggcgaccgtgcggccatgcgcgaactcgtcgcccgcacccagcccctggcgcggtacgagccgcgcggcgaccccgcgcggtggcaggcggccgaggcgcggctcaccggcagg

SEQ ID NO: 7392 - DNA, 2037 bp, Streptomyces avermitilis
  CDS (1)..(2037)
atggcaccccaccccgaagccgccgctctcctcgcccggtcccaccggctcggcgccgatcctcgcaacaccaactacgccggcggcaacgcctccgcgaagggcaccgccaccgaccccgtgaccggtggcgacgtcgagttgatgtgggtcaaggggtcgggtggcgacctcggcacgctgaccgaggccggtctcgcggtgctgcggctcgaccggctgcacgcgctgaagggcgtctacccgggtgtcgagcgcgaggacgagatggtggccgcgttcgactactgcctgcacggcaagggcggtgcggcgccgtccatcgacacggcgatgcacggactggtggacgcggcccacgtcgatcatctgcaccccgactccggtatcgcgctggcctgcgccgccgacggcgagaagctgaccgccgagtgcttcggcgacagcgtggcgtgggtgccctggcgccggcccggtttccagctcggcctggacatcgcggccgtcaaggaggccaacccgcagacgatcgggtgcgtcctgggcggccacggcatcacggcgtggggcgccacggccgaggagtgcgagcgcaactcgctgcacatcatccgcaccgccgaggccttcctggccgagcgggggaaggccgagcccttcgggccggtgatcgaggggtacgcggcgctcggcgcccccgagcgccgggagcgggcggcggcgctggcgccgtacgtccgtgccgtcgccgcccaggaccggccccaggtcggtcacttcaccgactccgaggtcgtcctggacttcctcgcgagcgccggacacccgcgcctggcggccctcggcacgtcctgcccggaccacttcctccgtacgaaggtcaggccgctggtcctcgatctgccgcccaccgccgacctggacaccgcggtcgcgcgcctgacggaactgcacgccgagtaccgggcggagtacgccgcctactaccagcggcacgccctgcccgactcccccgcgatgcgcggcgccgacccggcgatcgtgctcgtccccggcgtcggcatgttcagcttcggcaaggacaagcagaccgcgcgcgtggccggcgagttctacgtcaacgcgatcaacgtgatgcgcggcgccgaggccgtctcgacgtacgcgccgatcgaggagtcggagaagttccgcatcgagtactgggccctcgaggaggccaagctccagcggctgccgaagcccaagccgctggcgacccgggtggcgctggtgacgggggcggggagcgggatcggcaaggcgatcgccgagcggctggtggccgagggcgcgtgcgtggtggtcgcggacctcaacgcggagaacgcggccgacgtcgcctccgcgctgggcggtcccgacaaggccgtggccgtcaccgtcgacgtgacctccgaggagcagatcgccgaggcgttcaaggcggcggtgctggccttcggcggagtcgatctcgtcgtcaacaacgcgggcatctccatctccaagcccctcctggagaccaccgcgaaggactgggacctccagcacgacatcatggcccgcggctccttcctcgtctcgcgcgaggcggcccgggtgatgacacagcagaagctgggcggcgacatcgtctacatcgcctccaagaacgccgtcttcgccggccccgacaacatcgcctactccgcgaccaaggccgaccaggcccaccaagtacggctgctggccgccgagttgggcgagcacggaatccgcgtcaacggcgtcaacccggacggggtcgtccgcggctccggcatcttcgcgggcggctggggtgcccagcgggcggcgacctacgggatcgaggaggagaagctcggcgagttctacgcccagcggaccatcctcaagcgggaggtactgccggagcacgtggcgaacgccgtcttcgccctgaccggcggggacctcacccacaccaccggcctgcacgtcccggtcgacgccggcgtcgccgccgcgttcctgcgg

SEQ ID NO: 7393 - DNA, 1158 bp, Streptomyces avermitilis
  CDS (1)..(1158)
gtgaccgagctcgccgcggtgaaggccgccctcaagacccaggccgtagagacgccgtcatgggcgtacgggaactcggggacccgcttcaaggtgttcgcgcagccgggagtcccccgcacgccccaggagaagctcgacgacgccgcgcaggtgcacgcgtacacgggtgccgcgccgaccgtggcactgcacatcccctgggaccgggtcgaggactacgcgaagctcgccgagtacgccgaggagcgcgggctgaagctggggacgatcaactccaacaccttccaggacgacgcgtacaagctcggcagcatctgccaccccgaggcggccgtgcgccgcaaagcccttgatcacttgctcgagtgcgtcgacatcatggacgcgaccggttcgaaggacctgaagctgtggttcgcggacggcaccaactatcccggccaggacgatgtccgtgagcgccaggaccgcctcaccgaagggctggccacggtgtacgagcggctcggtgacgaccagcggatgctgctcgagtacaagttcttcgagcccgccttctacacgacggacgtgccggactggggcacggcgtacgcgcactgcctcaagctcggtgacagggcgcaggtcgtggtcgacaccgggcatcacgcacccggcaccaacatcgagttcatcgtggccacactgctgcgcgaggggaagctcggcggcttcgacttcaactcccgcttctacgccgacgacgacctgatggtgggcgccgccgaccccttccagctgttccggatcatgtacgaggtgatccgcggcggcggcctcacgtccgacgtggccttcatgctcgaccagtgccacaacatcgaggcgaagatcccggcgatcatccgctcggtgatgaacgtccaggaggcgacggcgaaggcgctgctcgtggatcgtgaggcgctgcggtcggcgcagcggtccggggacgtgctggaggcgaacgcggtcctcatggacgcgtacaacaccgatgtacggccgctgctcgccgagctgcgcgaggagacggggctcgacccggacccggtcgccgcgtaccggcggtccgggtgggcgtcgaagatcgccgaggagcgggtgggtggtcagcaggcgggctggggagcg

SEQ ID NO: 7394 - DNA, 1515 bp, Streptomyces avermitilis
  CDS (1)..(1515)
atgacccacccgtccgacacgggtccggcccccgtgctggcgctcgaggacatctccaagtccttcggcgccgtgcgcgccctgcgggacgtctccctcgagctgttccccggcgaggtgcacgcgctcgccggtgagaacggcgcggggaagtcgaccctcatcaagacgctcgccggggtgcaccgaccggacgccggccaggtgctgctcgacggccggccgaccgtcttccacggtcccgccgacgcccgggacgcgggcatcgccgtgatctaccaggaaccgacgctcttccccgacctgtcgatcgccgagaacatctacatgggccgccggccccgccgctccttcggccgtatcgatcacaaggccacccgggccgcgaccgccgcgctgatgcggcgcctcggcgtcgaactcgaccccgaacgccccgcgcgcggactgtccatcgccgatcagcagatcgtcgagatcgccaaggcgctctccttcgacgcccgggtcctgatcatggacgagccgaccgcggccctgaccggcagcgaggtggcgcgtctgttcggtgtcgtccgcacgctgcgcgagcagggcgcggcggtgctgttcatctcgcaccgcctggaggagatcttccagatctgccaacgggtcaccaccctgcgcgacggtgccctgatctccagcgaaccgctggacggcatgacggaggacgacctcgtacggcggatggtcggccgcgacctcgacgagctgtaccccaagcaggaggtgcgggcgggcgaggtggcgatgagcgtgcgccgcctcaccagggagggcgtcttcaccgacgtctccttcgacgtccggcgcggcgagatcgtcggcctggccgggctcgtcggcgcgggacgcacggaggtggcacgggccgtcttcggcatcgaccgctgggacgcgggcgaggtcgaggtcgagggacgcaggctgacgaacggagccccgtccacggccatggccgccgggctcgccctcgtccccgaggaccggcgcgcccaggggctggtgatgaacatgtccatcgagcggaacatcgggctcaccggactgcggactaccgtccgggccgggctcgtggaccggggcgccgagcgcagccgctccctcgactgggccgccaagctccaggtcaagtacgcgcgcatcgccgacgccgtctccacgctgtccggcggcaaccagcagaaggtggtcctcgccaagtggctcgccaccggtcccagggtgctgatcgtcgacgagccgacccgcggtatcgacgtcggtacgaaggccgaggtgcaccggctgctctccgcactggccgcggacggagtggccgtcctgatgatctcctccgatctgcccgagatcctcggcatggccgatcgcgtgctcgtgatgcacgagggccgcgtcaccgccgagatcccgcgctccgaagccaccgaggaatccgtgatggccgcggccaccgggagggccgccgca

SEQ ID NO: 7395 - DNA, 1038 bp, Streptomyces avermitilis
  CDS (1)..(1038)
atgacggtgaccgcgcccaatcccgcccccgccgccgaggtgcccgagtccagtggcacgcggctggtcgaccgtgtcttcaagatgcgcgaactcgccatcctggccgtcttcctggtgatgatcgccctcactcaggcgggcaacagcgagttcctgtccgaacagggcatcaaggacctgttgctgaacgcgaccatcctggtgctggtcgccaccggccagtcgctggtcgtgatcacccggaacgtcgacctgtcggtcggctccacgctcggcatcagcgccttcgcggccggtacgtatctccagggcggcggaaaccccgtcgtcgccatcgtgctggccgtcctgctcggcgtcggcttcggcctgctcaacggactcctcgtcagcctcggccaggtgcccgcactcgtcgtcaccctcggcaccctctacatcatccggggcatcgactccatctgggtcggctcacgccagatcacggcggccgacctccccggcggcttcgtggacttcggctccggcggcatctcggccgtgccctggctcgcgctcatcgccctggccgtgctgatcgcgaccgcctactacctcaagcacttcggcagcggacgcgagctgtacgcgctcggctccaaccccgaggccgcccgcctcgccggcatgcccgtccgcaagcggatcctggccgcgtacaccttctgcggaggcctcgccgggctcgcgggcgcgctgtacctggcccggttcgggaacgtcgactccggtacgggcaacggctacgaactcaccgtcgtcagcgcggtcgtcgtcggcggcatcgtcttcaccggcgggtccggcagcgtctacggggccgctctcggcgcgctgctgctcacctccgtcaacagcgtgctgccggccctcggcgtcagctccgtgtgggtgctcgccatcaacggcatcctgctcatcctcgccatcgcggtcgaccggatcgtcgccctgcgcgtggcggccgccctgaagaagaggaacgcccgtcatggc

SEQ ID NO: 7396 - DNA, 996 bp, Streptomyces avermitilis
  CDS (1)..(996)
atggctgactccaactggacgcgggccatccgctgggacacggtcgtcggcgcgctcctcgtggtcgtactgctgctgtccttcggcttcgtcgacggcttcggcaacggcctcaacctgtcgttcctcatcggcaacaccctgccgatcgcgctgatcgccctgccgatgaccctgctcgtcgtggcgggtgagatcgacctgtcggtcgcgtcgacggccgggctctccggttccgtgctgggcgcgctgtggaaccagggcatggcgatcgagacgatcatcccgctctgcctcctcctcggagtcgtctgcgggctggtcaacggcctgctggtgacccggctcgggctgccctccctcgccgtcaccatcggcacgctcgccgcctaccggggcatcgcgcagatcgtgctcggctcggacgcggtgaccgacttccccacccagtacctggacttcgcggccggacgcatcggcgacaccttcctcccgtacgccttcctgcccttcctcgtgctgctggccatcgcggtggtcgcactgcacgccaccccgttcgggcggtcgctgttcgcgatcggcgcgagcgaggaggccgcccggttcgcgggcctgcgggtcaagcgccagaagctgatcctgttcaccctgaccggcctgatggcctcgctcaccggcgtcctctgggccctgcactacgccagcgcccgctacgacaacgccaccgggctcgaactctccgtcgtggcggccgtgttgctcggcggcatcgacttcgacggcggcaagggcacgctcggcggcgcgatcgcgggagtcttcctgctcggcgcgctccagaacgtgatgagcctcgtcaatgtctccgcgcagtcgcagatcgtcgtcaccggcgtcctgctcgtcgtctccgtgctcggcccgcgggtcgcacggcagatctccgtcgcgagggcggggcgcagagccccctcaactccgaccccgactccg

SEQ ID NO: 7397 - DNA, 1080 bp, Streptomyces avermitilis
  CDS (1)..(1080)
atgcgcaagtcatccctccgccgcacctgtgcggccctcgccgccgtcacctccctcgccctcgccgccaccgcctgcggcggcaccaccaaggacgacgtgaaggacgacagcggctccgccgccacggccggcaaggccgacccgaacgccgccaccaagaagggcctgacggtcggcttcctgcccaaggcggtcaacaacccctacttcacctccgccgacaagggcggcgagaaggccctcgaggagctgggctccagctacaaggaggtcggcccgagcagcgccacggacacctccgggcaggtcagttacgtcaacacgctcacccagcagcaggtggacgcgatggccgtctccgcgcaggacccgggcgccctgtgcaccgcgctcaagcaggccatgaagaacggcatcgaggtcgtcacctacgactccgacaccaagaccggctgccgcaacgccttcgtctcccaggcgagcgccgaggacctgggccgcaccgaggtgcagctgctcgccgagcagatcggctacaagggcgagatcgcgatcctgtccgccgcgcagaccgcgacgaaccagaacacctggatcggcttcatgaaggacgagctgaaggaccccaagtacaagaacgtgaagctggtgaaggtcgcgtacggcaacgacgacgcccagcagtccttccagcagacccagggcctgctccaggagcaccccaagctggccgggatcatctccccgaccaccgtcggcatcaaggccgccgcccagtacctgtccggctccaagtacaagggcaaggtcaagctgaccggtctcggcaccccgaacgacatgcgcaagtacgtcaagaacggcaccgtcgagggcttcgagctgtgggacccggccaagctcggcgagctcgccgcgcgcacggccgtcgcgctgtcgtcgggccagatcagcggcaaggagggcgagaccttcaaggccggggacatgggctcgtacaccatcggcaaggacggcgtgatcagcctgggcaagcctaccgtgttcgacgcgaagaacgtcgaccagttcaacttc

SEQ ID NO: 7398 - DNA, 309 bp, Streptomyces avermitilis
  CDS (1)..(309)
gtgtgctttctgctgaaggtccgggcggaccgcctcgacgagtaccgcgagcggcacgccgccgtgtggcccgagatgctggacgcgctctcggccaccggctggcgcaactactcgctcttcctgcgcgaagacggcctgctggtcggctacgtggagaccgaggacttcgcggccgcccgggccggtatggaagccaccggtgtcaatgcgcgctggcaggcggagatggcgccgttcttcgagtcgctggacggcgccgggcccgacgaagcgatgaaacccctgaccgaagtcttccacctcgcc

SEQ ID NO: 7399 - DNA, 1410 bp, Streptomyces avermitilis
  CDS (1)..(1410)
atggacatgagacgacgcaccctgttggcaacggcgctgctgggtgccgtggccgccccgggcaccgcccgggcggccgatcccggcccctcggtcaccctgaccggcagcaccctgctcgacgcccgggccgtgtacttcgtgtcgtacgacgggctggtcaacaacaacgcgttccagaagaacggcctgctgacgtacaagggccaccagtacgcggcctggtacaccgccgaccgcagcgcggtcgtcgcccgccggacgctcggcgcgtcgaactggtcgacgctcaccctcgcgcaccggctcaagagcgacgactcccacaacgtcatctccatgggcgtgtcgaagacggacgggcgtctgcacctgaacatggactcgcacagcgacggcttcttctacgtgaagtcggcggccggactgctcgacaatgcccccgcgtggacgtccgccgccttcggctccgtagggaccacactcgacggactcgccctcacctcgcagttcacctacccacagttcatcgccacgcccgagggcaggctccagctcagctaccgcgcggggatctccgggaacggccgcaacgcgctggccgagtacgacggttcgtcctggaccgcgctcggcgagtggtccggctcgaccggcacgtacaccagcgagcacggctccagcacggcccggaacatgtatctgcacggcatcgactacgacacgaacggcaggctgcactccttcttcacctggcgcgagcagtccgcctccgtgatgtgcgacagcggtggcatcaccaaccacgacacgggctatgtgtactcgaccgaccgcggccggacctggcgcaacgacgcggggacgctcgtcggcaccaccggcggctccgaccgggtcgccgtcaccgacaccggactcgtgatcgacccgctcaaccccgaccactccctcatgaaccaggagagccaggccaccgactccaccggcctgccgcacgcgatcatcagctacgtccccgggcgcttcggccagtgcacgacgaactacgtcaccgaccggaccgcgaacggccgtgccttccacctccgcaagaacgcctccggcggctggaccaagaccgagatcccgatcgccctcaactccagccagcgcaccaagctggccctcgaccggtacgacaacgcctacgcgatcatgccgttcggccggatcgccgccgcctccaagtcctccgggtacacggactggaagctcctgtacgacggcggcggcctgaacgccttcggcgaggtggtgatcgacgagacgcgggccggccaggacggcgtgctgtcggtcatgtaccaggagaagtccagcggtacgacgccctcggcgctccatgtcctcgacttcgggctgcccgcg

SEQ ID NO: 7400 - DNA, 1023 bp, Streptomyces avermitilis
  CDS (1)..(1023)
atggcccagtcggtgggtatcaaggacgtggcccgcgccgcgggggtttccgtggggacggtctcgaacgtcatcaaccgcccggattcggtcgcctccgagacccgggcccgggtgctgtccgcgatcgaccggctcggctacgtccgcagcgagtccgcgcgccagctgcgcgccgggcgcagccggatcatgggcctgctcgtcctcgacatgggcaaccccttcttcgtggacgtcgcgcgcggcgccgagcgggccgcgcgcaaggccgggctcggcgtgatggtctgcaacagcgcgcagagcgccggcgaggagtccgactacctgtcgctcttcgccgagcagcgggtgcgcggggtgctgctgacgcccgccgacgcgacgggccgcaacatccaggcgttccggcgccacggcatcccgttcgtcctggtcgaccgggtcgccgagggcaccaccgagtgttcggtctccgtggacgacgtggcgggcggagcgctcgccgtacggcacctcgtcgacgccgggcaccgctccatcgcgtatgtgagcgggccgccgggcctgaaccaggtcagcgaccgccggacgggcgcgctcaacgcgctggccgaggccgggctggggccggactgtctgcgcgagctgcccaccgaacgcctggacgtggcagccggccgcgacgccggcgcccgcatcctcggcctcgccgaccgcccgaccgccgtgttctgcgccaacgacctgctcgcgctcggcgtgctccaggccatgtacgcggccggggtcggcgtccccgacgacctcgcgatcgtcggctacgacgacatcgagttcgcggccgccgcggccgtcccgctcacctccgtgcgccagcccgccgtgaccatgggcgcgctcgcggcggaactcctcctggaggagacggaagccgagacggcgccgaccccgcacgagcacaggcgggtcgtcctccagccggagctggtggtgcggcgctccagcctgtcggcgcgc

SEQ ID NO: 7401 - DNA, 1350 bp, Streptomyces avermitilis
  CDS (1)..(1350)
gtgttcaactgggacgcagcctggaatccgtacgtctcgggagccctgttgaccgtcacctatcgccagcccggtgtcgtcctcaccgaccaccacttcaccgtgcccctcgaccacgacgacccggcgggggagtccatcgagctgttcgcccgcgaggtcgtcgcgagcgacaaggcgcaccaggacggactgccctggctggtctacctccagggcggccccggcttcggcgccaaccgcttcgtcggcacgcaggcctggctcgggcgcgccgtcaaggagttccgggtcctgctcctcgaccagcgcggcacggggcactccacaccggcgaaccgtcagacgctccccctgcgcggcggcccccgggaacaggccgactacctcacgcacttccgcgccgactccatcgtccgcgactgcgaggccatccgcccccggctcaccggcggcgccccctggaccgtactcggccagagcttcggcggcttctgcacggtgcactacctgtcgacggcgcccgaaggactgcgcgccgccctcatcaccggcggactcccctccctcgacgcccacgcggacgacgtctaccgggccgcgtacccgcgcatcgaacgcaaggtcgccgcgcactacgcccgctacccgcaggacgtcgagcgggcccggcagatcgccgagtacgtgctccggcacgagccggtcctgaacggcggctaccggctcaccgtcgaggccttccagtcgctcggcatcctcctcggcggcggcgagggcagccaccgcctgcactacctcctggagaacgccttcgtccgcaccccgcagggtccggccctctccgatgccttccaggaggacgtccagagcctcctctcctacgcgggccacccgctgtacgcactcgtccacgaggcgtgctacgcccaggacgaccgccccaccgcctggtccgccgagcgcgtgcgcgccgagttcccccggttcgacgccggcaagacgctcaccgaggacgggccgctgctgttcaccggtgagtccgtgcacccctggatgttcgacgccgaccccgccctgcgtccgctgcgcgagaccgccgaggaactggcctcccgcacggactggcagccgctgtacgaccccgcccgcctcgcggccaacgaggtgccggtcgccgcggccgtctaccacgacgacatgtacgtcgacaccgagcactccctgcgcacggcccgcgcgatccggggcctgcgcacctgggtgaccgacgagttcgagcacgacggggtgcgcgcgggcggtccgcgcgtcctggaccggctgctcgccctgacgcgcgacgaggtc

SEQ ID NO: 7402 - DNA, 966 bp, Streptomyces avermitilis
  CDS (1)..(966)
ttgatcatcacggccctgaaccgccgaccggaacgcggcagggctccgcggacgagtgggggagcgatgggcgacgggggaacgatgagcgagagcgatctgctggcgggccggttcgaggaacaccgcaggcacttgagggccgtggcctaccggatgctgggctcgctcagcgaggccgacgacgcggtgcaggagacctggctcaagctcagccacgccgatgtgagcgaggtcaggaacctcgccggctggctcaccaccgtcgtcagccgggtctgtctcaacatgctgcgctcgcgtgcctcgcgccgcgaggagcccatggacaccttcgtgcccgaccccgtggtcagctccctggagcgcatcgatcccgaacaggaggtgctcctcgcggactccgtcgggctggccctgctcgtggtcctggagacgctggagcccgccgagcggctcgcgttcgtgctgcacgacatgttcgcggtgcccttcgacgacatcgcgccgatcgtggaccgcagttcggccgcgacccgtcagctcgccagccgcgcccgccgccgggtccagggctccgccccggcgcccgatcccgacctcggccggcagaagcaggtgctcgacgccttcctcgcggcctcgcgcggcggtgacttcgaggcgttgctgtccgtcctcgacccggacgtggtcctgcgcgccgacgcgggggccctcgccgggggtgtcgcggtgtccaagctcgtccggggcgcggcggcggtggccgagcaggcgctcatgttccggcagctggcgcagttctcgcggctggtgctggtcaacggcgcggtgggcgtcgtcaccgtgctcgacgggcagccgatgggcgtcatgggcgtcaccgtcgcggacggcaggatcgtcgacatctgcatcctgtccgaccccgaccgactggcccgcctcgacctcccggccggc

SEQ ID NO: 7403 - DNA, 828 bp, Streptomyces avermitilis
  CDS (1)..(828)
atgcgagacaccccggttgacctctccgaactgcgagccgactgtgcgcagtgcttcggcctgtgctgcgtcgcgctgcccttcgccgcctcggcggacttcgcgatcgacaaggacgccgggaagccctgccgcaacctccagggcgacttccgctgcggcatccacctggaactgcggccccggggcttctcgggctgcacggtctacgactgcttcggcgccgggcagaaggtctcgcagatcaccttcggcggccaggactggcggtcgggcacccgggagcacgcccggcagatggtcgacgtgttccccgtcgtacggcagctccaggaactgctctggtacctggccgaggcgctgaccctgcccgcggcccgccccgtccacgccgacgttcgccgcgcgctggaggcgaccgagcggctcacccgccagaccccggaagaactggagcagttggacgtcggcgcgcatcggcaggaggtcaatgtgctgctcctgcgcaccagtgaactggtccgggcgggcggtggccgccgcaagaaggaccgtcgaggcgccgacctcgtcggcgcccgtctcaagggagccgatctccgggcggccagtctgcgcggcgcctgcctcatcgccgccgacctcaccggcgcggacctgcgcggcgcggatctgatcggtgccgacctgcgcgacaccgatctcacggacgccgacctcaccggcgcgttcttcctgacccagccgcagctcaacgcggccaagggcagtgccggcaccaagatcccggcgtcactcacccgccccggtcactggacagcggggacc

SEQ ID NO: 7404 - DNA, 1512 bp, Streptomyces avermitilis
  CDS (1)..(1512)
atggcgcagtcgacgcggaccgtgattcccaaggggttccgcagcgcggagctgggctggccggagctgcaccgcatcccgcatccgccccaccggcttccagtcgtcggcgatgtgctgggcgtcaacgtccgtactcccgtgcaggattcgctgcgcatcggccgccggctcggcccggtcttccggcgcaaggccttcggcaaggagatcgtcttcgtggggggtgcggacctcgcggccgaactggcggacgagtcgcggttcgccaagcacgtgggcctgggcgtcgccaatctgcggccggtcgccggcgacggcctgttcacggcgtacaaccacgagccgaactggcagctcggccacgacgtcctggcgccgggcttcagccgtgaggccatggcggggtaccacccgatgatgctggccgtgaccgagcggctgatcgaccactgggaccgggagcagacggcaggccgtgccgtggacgtgccgggcgacatgaccaagctgacgctggagacgatcgcgcgcaccgggttcgggcacgacttcggctcgttcgaacgcgcccggccgcatcccttcgtcaccgcgatggtgggcaccctgacgtacgcccagcggcggaacgtcgttccggagccgctggctccgctgctgctgcgcaccgccacccgccgcaacgccgccgatctggcgtacctcaaccgcacggtcgacgccctggtgcgcgcccgccggaccacgagcggcgaaggcgacctgctcgaccggatgctggacaccgcgcgtcccgggaccggggagcggctcgccccggagaacatacggcggcaggtcatcacgttcctggtcgccggccacgagaccacctcgggcgcgctctccttcgccctgcactacctctcccggcacccggacgtcgccgcgcgcgcccgcgccgaggtggaccgcgtgtggggcggcacggcccggcccggctacgaccaagtcgccaagctgcgctacgtgcggcgggttctggacgagtcgctgcgcctgtggccgaccgcgcccgccttcgcccgggaggcccgccgggacacggtcctcggcggcgtccatccgatgcgggaaggcgcgtgggcgctggtcctgacggcgatgctgcaccgggatccgggggtgtggggcgcggacgcggagcggttcgaccccgaccggttcgacgcgcaggcggtgcgttcccgggccgcgcacaccttcaaaccgttcgggacgggggcacgggcctgcatcgggcgccagttcgcgctgcacgaggcgacgctggtgctgggactgctgctgcgccggtacgagctgcgggccgagcccgggtaccggctgcgggtggcggagcggctgacgctgatgcccgaggggctgcggctgcggctggaccggcgggtgcccgccgtcgaggacgtcccggtcgcgaacccggaggtgtcctcaggtccccgctgtccagtgaccggggcgggtgag

SEQ ID NO: 7405 - DNA, 606 bp, Streptomyces avermitilis
  CDS (1)..(606)
atggccgctaaccagggcgagcgcacccgtcgcaggctcagcaccgaggagcgcagggaacagctgctgtccgtcggggcgcggctcttctcggagagtccgtacgacgaggtgtggatcgaacaggtcgccgagatcgccggtgtctcgcgcggactgctctatcactacttcccgaccaaacgggacttcttcgcggcggtcgtcgagcgtgagagcgggcggatgctgcggatgaccgcggccgtccccgggatccccgtgcgcgaacagctgggtgcgggcctggacgtgttcctggagtacgtcgaggcgcacgcccacggctttcgcgcgttccaccgtgccgacgccgccggggaccaggccgtacggacggtctatcggcaggcgctggccgcgcaggagcggcagatcctggcggcgctcgccgcggatccggagatcggccggtcgcccgaggaggagcccgagctgcggatcgccgtacgcgggtggctggccttcaccacggccgtctgtctggagtggctccgcggggccgagctgacccgggagcaggtgcgcgatctgtgtgcacgggcgctgctcggtgtcatcgcgctc

SEQ ID NO: 7406 - DNA, 726 bp, Streptomyces avermitilis
  CDS (1)..(726)
atgggtgaccgtcacacgtggacggccgcgcctgccgcggcggaacgcgcccgctccgtgctcgctgccgcatggtcctgcgcggtgaccgcggagggcggccgggaagagttcgtcggcacgcacaccgtggccgcggacggcgtggtgctgctgcccgtgcccgaggacagtgcgctgcgggtcgccgcgatctgcgcgccacgcggagagccgtccgccgtgctggagttcgccgatgtggcccccgtccccgtacggaaccggatccgtgcccggctctggatggccggctggttcgccctggaggaggggcacttggcgttccggccgacgcgcgtggtcctgcgcggccggcccgccggggcggtcgtcgtcgacctcgacgagttcgccgcggccgagcccgacccgctggccgcggccgaggccgggctgctgacccacctcgccgacgcccacccggacgccgtcgaacggctcacccgcctcgtcgaacacgacagcctgcacggcgccgtacgcgtacagccgctcgccgtcgaccggcacgggctcaccctgcgcgtcgagcgggcgcgtggcgacgtcgacgtacgactgccgttccaccggcctgccgacgacgtgggacagctcaccgaacgtatgcacgtcctgctcgcccaggccgcccaggccgcgcgcccccgtgcgctacagcggcagcgcgcagacggcgacggg

SEQ ID NO: 7407 - DNA, 1224 bp, Streptomyces avermitilis
  CDS (1)..(1224)
atgagcagtggtgcggaaccgacgcggggcccgcggagcggcggctggagcaggcgccgcttcctcggagccgtcacggccgccaccgcggtgacgacgatcccggcgccggtcgcccccggtgacagccccaggacgaccccacccggaagccccgccccggcgcccacgcccgagaccactgagtcacagccttccggtccccgcccgctgtacctcggcacctacacctccgtcgacggcggcggcgcgggcatcggtctggcgacctacgacccgaagacgggcaagatcaccggaaccggcaccgtcacccaggtcggcgacccgtcgtatctggcggtccaccccgacggccgtacgctctacgccgtcaacgagcggcaggacggcggcgtgagtgccgtacgactggcggacaagaaggttctcggcgcgcgcggcaccggcggagcggccccctgccatctgtccgtgcacccgggcggacgctggctgctgagcgccaactactcctccggcagcgtggccgtgcaccccatcggctcctcgggagcgctcggcgagcgcatggacctggtcacgcactccggtccgccgccagggccgggccaagaggggccgcacgcccaccagttcctcaccagccccgacggcggccacgtgctcgccgtcgacctgggcaccgacaccgtctacagctaccgcctcgacctgtcgaagggcacgctcaccgaggcctcccaggcgcacacccggccgggggcgggcccgcgccacctcaccttccacccccggggccgcttcgcctacctggccaacgaggtcgacaacacggtcgccgtctgcgcctacgacccggccaccggccgtctgaccccgggcgacccgcagtccaccggcacgggcgcaggcaccagctacccggcgcagatcctggtgacctcggacgggtcgtacgcgtatctcgccaaccggggccacaacagcctgacgcggtacgcggtcgaggcggacggcgcgcgactgaggctgctggacaccgttccggtgggcggcgacttcccgcgtcacatcgcgttctcgccggacggcgggctgctgttcgcggcgaaccagcggtcgagcacggtcagcgtcttccacgtcgaccgcgagagcggcgaactccgcctcgcgggcgagccgttcgcgtcacccgtcgccgtctgcgcgctgccgctg

SEQ ID NO: 7408 - DNA, 1056 bp, Streptomyces avermitilis
  CDS (1)..(1056)
atgaccgagggcaccgtgcggatcgacggaaacacactgcgactgccgggcggagtacaggtccggttcatccggaccctgcggctgcccgagacgggcacgcacgagctgcctccggggctcggcgagtttccggtgcgccgcgtcgaggactaccccgacacggtgcccgccgcatggcggtcgcgcggcggtgtgatgctgccggtgtatctgcgggaagccatgtggctgagtttcgcgggcacctcggagccggccgcgctccaggtcggcgtgggcaaggtgtgtgccgtgtcgggcaagccgtggagttcccggctgacccgcgacccgcagaactacgtggtgctgccgcgccagccgtggctggacggcatcaactccgggaagggcacggtccgtcagttcgtggcggtgcccctcggcctcggcgccaccgtcgagggccaggtcaccggcgaggaggtgtggggcggcgtacagctccagtccttcccgctgaacgacggggaactggccgcgtggcgcgacgcggagcgccgaaaggctcaggcacgccgggagatgcccccggcgcccggggggtacggcaccgcgatgcccatggcggcacccgccgcaccgggcgccgcgcccgcaccggccggtgcgccctcgcgccggtcgcgcggcgccgcggcgatgggtctcggtgtcggcggctcgatgcgccaggaggtctaccgggacgaccggccgctcggggcctgggccgagaagccggccggtcgggtgttcgtgcatctcgtgacgcctcccgagtggcgccgcatcaccggcgaggcgcccccgccctcccccgtggaccgcgcggcctacacccgcgcgggactcccctggttcgactactacgaccaggacgccgcggacctcgcccccacggacacgctcggcaaggtgcggccggtgggcgactggctcggcgacgaccacgagccctggcaggagccctcaccgcaccaggtgaagccgctgggcgacgcaccgggcaagccggtcggggacggcgactgg

SEQ ID NO: 7409 - DNA, 1251 bp, Streptomyces avermitilis
  CDS (1)..(1251)
atgcgagatgtacgtgatgcgtgggcggcggccaccgcgcaggtcgggaagtggcgccagcccgtggtcgtccagtcggtgcgttcgacggcggccgcgactgtcgcgtacgtcatcgcccttcacctgagcccggaacccgcaccgctcaccgcgccgctgacggccctcctcgtcgttcaggtcacgctctacgccaccctcaccaccagttggcgcagggtgaactccgtggtgacgggtgtcgtcatcgccatcggcttcagcgtgctggtgggactgacctggtggagtctgggcctgatcatcctcgcctcgctggccgtcggacatctcgtccgggtgagcgagttcgtgcccgaggtggcgatcagcgcgatgctcgtcctgggcgtgacccgggtcggggacaccgcctgggcgcgggtggtggagacgctgatcggcgcggtcgtggggctcggcacgaatgtgctcttcgctcccccggtctgggtgagcgaagccgcggagtccatcgaggacctggcgcgccggatccgtcagttgatgctgcgcatcggggaggaggcggcgggccgcgcgcccatcgaggaggcgacggcccggctgtacgaggcgcgccgcctcgaccacgacatcgtgcaggtcgacgcggcgctgcgacaggccgaggacagcctgaagctcaatccgcgggtccgcgaagggctgctgtaccggatcgtgctgcgcaccggcctggacacgctggagatctgcacggtcgtgctgcgggtcctcgcccgcaccctcgccgatttcgccaaggcgcgcgatctgcagcgttggctggagccggagaccggcgcggtgctggaacagctcctctccgagatcgggaacgccatcgtcagcttcgcggtgctggtcaccaccgatgtcagtcgcagcgccgagaacgcggagtcccggctcgccgcggagctgacgaccgcggcggcgacccgggacaagctggcccagctgctgctcgaggagatccaacgggatgcgagccagtggcagttgcgcggcgccattctcacggaggtcaaccgcatcctggacgagctcgacatcgaacaccgctcccggcggctgttcgaggaactggaccgcagcacccgcgagcagcgcgagcgcagatcacgcctcacccgcctgcggcagcgtatgggggtcgtgcgcctgccgcgccggaaccaccgggcctcttcgggtcgttctacc

SEQ ID NO: 7410 - DNA, 405 bp, Streptomyces avermitilis
  CDS (1)..(405)
gtgcggatcccggcccaaaaaggcgagcaacgcctcggcccggctgggaccttcgggcacctcgcgcacgggagcgaacaccccgtacgcgtcgcgaagatgatccgcgagacgctccgcggcggcccagatgccgtcggccatctcctcgtccaacggcatgtccaggcccgtcgccacggcgatgtcccaggcgtgcacgccggcgtccatggcggctggagcagcgggcccagcggggtcggcacctgctcggcgtcggcgggcagtgcggtgtacacgtccgccacccggcgcagcaccgcgtccagctcggcccgcgcgtcgccggacagcgcgtccgcgggcgcgaaggagtccgactccggccgcccgtcccccgtgacggcggcgccgtacgcctgc

SEQ ID NO: 7411 - DNA, 1443 bp, Streptomyces avermitilis
  CDS (1)..(1443)
atgctcgcggtcgctgaggcaggcctcagtctttgccgccgggttttccccacccccggcggcaggcctgccggatggtccgggcccgggccgggacgagagccttggatcatgaaacggcatcggactggattggccctggccctgctcctcactctggggaccgtggcggccggcgtggcgccggccgcctccgcgacgacgagcggaccggtcgtccacgccctcgaaagcggcgcccaccccctgcggaccgtcgaaccgcagggcgacacgagcgatctacggcctctcgacggcatgatcggcggcgcccgggtcgtcggcctcggcgaggccactcacagctcccacgacttcttcgccctgaagcaccgcgtcttccgccatctggtcgaggagaaggggttccgcaccttcgccctggagggcagctggagcaccggacagcggctcgacgactacgtgctgcacggcaagggcgacccgcggcgcatcatgcgcgaggagttccaacgcgactacctgtggtggaacaacaccgactatctggcgctcgtcgagtggatgcgcgcgtacaacctgcggcatccgcacgacccggtccgcttcatgggcgacgacatcggctgggtcggacccgagctgtacgacgccgtcacggactatgtggcccgcacccggccggagctgaccgcccgcttcgacgagctctaccgcggactgcggcccacggtggcgacgggcacgtacatggagcagtacctgaacaagccgtacgccgagcgcagggagatggcggaccgcaccggccaggccctggagctgctgaaacggcagtcaccgggcgcggaccgggcggcgtacgaacgggccgtgcagaacgcgacggcactcgaccaggtcgcccggcagtacgccttcgacttcacggacccgcggcagatcgccgcgagcatgcgctaccgcgactccgcgatggcggccaacgtgctctggtggcagcggcacaccggcaccaaggtgctgctggcggcgcacgacgcccatgtcgggtaccggacgtacgatccggccaactacccgaagatgcagggcgcctttctgcacgaccgcctcggctccgggtacgtgagcgtgggcctcaccttcgaccggggctcgttcaacgccaccggacaggacggcgccatccaccgctggacgctgggaccggccggccccggcaccaatgagcggaccctcgaccgggtccggtaccgcgactacgtactcgatctgcgccgggtcgccgcaccggcgcgggagtggctggacagggcccggcccacccgcagcatcggcaccgactacccggacggcccgcacgacatcgcgctcgcgtccacccacgacatactcatccacctgcaccgggtggaggcggcgcggctgcgggaccaa

SEQ ID NO: 7412 - DNA, 486 bp, Streptomyces avermitilis
  CDS (1)..(486)
atgagagcactcaccgagcaggacatccgcgactccttcgtcaactgctcgaagggcgaggccaagcgcctggcgataccccgcgatctggacgaacgcccctgggacgacctggacttcctcggctggcgggatccgggggcgcccgatcgcagctatctggtcaccgagcgcgcggacggcctggtcggcgtgacactgcgtttcccgtcctcgcgacgcggcttcctgcaccgcagcatgtgctcgctgtgtgtgacgacccacccgggcaacggggtgtccctgatgacggctcgcaagacgggcgcggccgggcgcgagggaaactcggtcggcgtctacatgtgcgccgacctcgcctgttccctgtacgtgcgcggcaggaaggtcccggagtccgggacgcgcttcgaggagagcctcaccgtggaggagcagatcgcccggatggtgggcaatctgtccgccttcctggacaagctg

SEQ ID NO: 7413 - DNA, 261 bp, Streptomyces avermitilis
  CDS (1)..(261)
gtgcacccgcccccgaccggggcgccggtggggggggcgacggggcggcaggcccggcagaccggcggacgccaggcggccggctcgttcagggcggcccgagccgcccgggagacgggactgacgacggacggcgtcacctgtcacctgcggcggctgtccgagcggtggagcgcggcgaaccgtacggaactggtcgcccgcgcctacgcgctgggcgtgctcagctccggggtgtggccaccggaggcggtcacggac

SEQ ID NO: 7414 - DNA, 1287 bp, Streptomyces avermitilis
  CDS (1)..(1287)
atggcggcgcggaacgggcggacggtgcgtgatctgcggcggggcaatcgcaccgccgtgctgcaacggttgtatttcgagggcccgatgagccgcttcgaactggggccggccaccgggctgagttccggttccatcagtaacgtggtcgccgagctggtcgccgacggactggtcgaggaggccggcagcgtcgactccgacggtggccgcccgcgcatcctgctgcgcgtcgcgcccggcagcggccacatgatcggcgtcgatgtcggcgagacccgggtacgtgtcgagctgttcgacctcactctcaccgaactcgcccgcaccgaaaggccgttggagcgtgggtgctacgacgtcgaggtcgtcgtcgggcacatccgcgacggcgtcgacgaggtgctgacggccgcggacatcgcgcccgaacggctcctcggggtcggtgtcggcgtccccggcatcgtggaacgcacgccggggcagggcgcggtcgtccacggccagacgatcggctggaacgccgtccccctcgaatccctgctccgctccaccggccgcctgccggacaccgtcccgtacttcacggacaacggggccaagaccctcggccaggccgagatgtggttcggcgccggacgcggtgcccgcagcgccgtcgtggtgctcttcggctccggtgtcggcgcctgtctcgtcacggaggaggtggacagcggccgggcgctggagtggggccacctgaccgtacgggtcaggggccgccgctgccggtgcggcgccctgggctgcctggaggcgtacgcgggtgcggaagcgctgctcgaccgctggcgggaggagggcggacgcccgccggagcacaccgacgaggagaccgcgctgaccgcgatgctggccgcggcctacccgcccgggggcgccgaccccgacccggccgccctcgccgtcctggaggagaccgcggaatacctgggcgcgggtctgtccgacctgatcaacctcttccagcccgagcgcattctcatcggcggctgggcgggtctccagctcggctcccggttcctgcccgcggtgcgccggcacgcgacgtcgtacgcactgcgtcacccggccgagcgcgtctccatcgacctcggcaggctcggccccgacgcggtcacggccggcgcggccatcctgccgctcgccgacttcttcgcccggggcgggcggcgcgcggagccggcgagcgaggggccgtcgcccgcgtggcgtacggcgctggaggagcggccgccgcgc

SEQ ID NO: 7415 - DNA, 333 bp, Streptomyces avermitilis
  CDS (1)..(333)
gtgcccgaggtactcgcgcggcgcccagggggccccgcgagctctgcgcggggtccgccgccctcccgcagaatggagcatgccgtgaccgagcaccgccaagaggctcccggcgagaacggtgacccgatcccgcgggacctgccggaccagcaggcccgcgagagcgaggatccgtgggacgccgcccccgcaggaagcggcaaggacgacctcgacgacgagcccgacctcgacgtccccgacacggacgaggcgggcacgggccggcagggcgctccgcacgcggccgccgtgaacccggagcaccccgtgccggacgagcccgccgac

SEQ ID NO: 7416 - DNA, 966 bp, Streptomyces avermitilis
  CDS (1)..(966)
atgaacactgcacagcacaagatcggctcgggtttcggtgccacgagcaccgcggtcgacgtacttcacggcatcgacctctccggacagctcgcgatcgtgacgggcgggtactccgggctcggcctggaaaccacacgcgcgctcaccggggcgggcgcccgggtcgtcgtccccgcacgacgccccgacgtcgcccgggaggcggtggcgggcatcgacggggtggaggtggacgagctcgatctcggggacctcgagagtgtgcggggcttcgccgaacggttcctcgcctcgggccgcacgatcgacatcgtgatcaacaacgccgggatcatggcctgcccggagacccgggtcgggcccggctgggaggcccagttcgccaccaatcacctgggccatttcgcgctcgtcaaccgtctgtggccggctgtcgagccgggcggggcgcgtgtcgtctccgtgtcgtccgggggccaccacctctcggggatccgctgggacgacgtgcactggacgcacgactacgacaagtgggaggcgtacgggcaggccaagaccgcgaacgtgctgttcgccgtgcacctcgacaggctcggccgggagtccggcgtacgggccttctccctgcaccccggtggcatcctcaccccgttgcagcgtcatctcgcgaaggaggagatggtcgagcgggggtggatcgacgagaacggcgacctcgtgcaccccgacgccttcaagacgcccgagcaaggcgcggccacccaggtgtgggcggcgacctctccgcagctggcgggcatgggcggggtgtactgcgaggactgcgacatcgccgagccggcgtccgcggacggcgagcggggcggcgtgaaggactgggcgaccgacccggagcaggcggcccgcctgtgggacctctcggcggaactcaccggagtgaacgcgttcgcgtcccgcgcc

SEQ ID NO: 7417 - DNA, 663 bp, Streptomyces avermitilis
  CDS (1)..(663)
atggaacgcgccgccgtgttcgacgtcgacggcactctcgtcgacacgaaccatctgcatgtcacgacgtggtgggaggccttccggcaggcgggtcaccaggtgccgatgcacgacatccaccggtcggtgggcctgggctcccaggacctcatcgcccatctcctgggggaggaccgggaccaggacgaggtcgacgcgctgagcgccgcccacaagaccctgtacggaacgtacttcgaccggctgcacccgctgaaggacgccgggcggctgctgaagcggctggacgacgacggctggacggtcgtgctcgccacctcggcgggcggctccgaactgtccgcgctgcgccgggcgatcgacgcggacgacgccatcaaggccacggcgagcgccgacgacgtgtccgccggcaagcccgcgcccgagcccgtcgagcacgcgctgggcctggtcggcatcccgcccgagcacgcggtgttcgtcggcgacacggtctgggacatgcgcgcgggcagccgggccggggtgacctgcgtgggcgtcctgtgcgggggcatcccgcgggcggatctggtggaggcgggggcggacgcgatctaccgggatccggagcatctgctcgcgctactgccggacagcgcgctggcgccgaaggcg

SEQ ID NO: 7418 - DNA, 1041 bp, Streptomyces avermitilis
  CDS (1)..(1041)
gtggtcatggaccccctggaggccttggaccggatcgcgttcctgctggagcggggtcaggctcccacctaccgtgtccgcgcgttccgcaccgccgccgccgtactggccgcacggcccgcggacgaggtggccgagctggtccgcaccgggtcgctggagtccttgaagggcatcggcccgaagacggcgcaggtggtgcgggaggcgctggccgggcaggtgcccggctatctggagaagctggagcgggaggccggtgcgccgctcgcgcagggcggcgaggagctgcgggcgctgctgcgcggcgactgccatctgcactccgactggtcggacggcggaagcccgatcgaggacatggggcggaccgcggcgcggctcgggcacgagtgggcggtgctcaccgaccactcgccgcggctgacggtggcccggggcctgtctccggagcgactgcgcgagcagctggcggtggtcgccacgctcaacgaacgctgggctccgttccggctgctcaccggcatcgagtgcgacatcctcgacgacgggtcgctcgaccaggagcccgagctgctggcccggctcgacgtggtcgtggtgtccgtgcactccaagctgcgcatggacgcacggtcgatgacccgccgtatggtcgccgccgtacgcgacccgctgtcggacgtcctcgggcactgcacgggacggctgctgaccgggcgcggacggcccgagtcggagttcgacgcggacgaggtgttcgccgcctgtgcggagtccggcaccgctgtggagatcaacagccggcccgagcggctcgacccgccgcggcgcctgctgcgccgtgcggtcgcggcgggtgtcctgttctccgtggacaccgacgcacacgcgcccggccagctcgactggcagatccacggctgcgcccgggccgaggagtgcggggtgcccgccgagcgggtgatcaccacctggaccatggaggaactgctcgcctgggcccgcgaccgggagacaccggcgggcgtggaccccgtc

SEQ ID NO: 7419 - DNA, 234 bp, Streptomyces avermitilis
  CDS (1)..(234)
atgaccgaaatcgcatgcccctacgtcacccacccgcggatcatggtgctcggggtacagccgggcaagccgccgttccggatcgtggagatcgacggtgaagtggtcgccgaggcgagagcgatcaccgacgtcctgacggtcgcggcggaggccggcatcacggtccacgacctcgacgacccggacgtggtccgctgggtcggcggcgacaaacaccactggacgctgcgc

SEQ ID NO: 7420 - DNA, 1260 bp, Streptomyces avermitilis
  CDS (1)..(1260)
gtggactccccacgcctgctccgccgatgtctgttcgccgcactctccgcggcgctcatcgcctccgccgcgatcggtcccgccgatgcagccgacgccgcccccaaggcggcctcgtccgagaaggtggccgctgccgcggccaccttctcggacacgttcgacggggccgccggttcggccgtcgactcctcgaaatggcaggtcgagaccggcgacaacgtcaacaatcacgaaaggcagtactacacctccggcaacaacaacgcggccctggacggccagggccatctggtcatcacggcccgcaaggacaatcccggcaactaccagtgctggtacggccgttgtgagtacacctcggcccgcctgaacacctcggggaagttctcggccgcgtacggtcgggtcgaggcgcggatgaagataccgcgcgggcagggcatgtggcccgcgttctggatgctcggcactgacatcggacaggtcggctggccgaactcgggcgagatcgatgtcatggagaacgtcggcttcgagccctccaccatccacggcaccatccacggtcccggttactccggcacgggcggcatcggtgccgcgtactcgctgcccgggggccaggccttcgcggacgccttccacacattcgccgtggactgggcgcccgactccatcacctggtcggtggacggcaccgtctaccagcggcgcacgcccgccgacctgggcggcaagacctgggcgttcaacaagccgttcttcctgatcctcaacctcgcggtcggcggctactggcccggcgatccgaacagctccacggccttcccgcagcagctcgtggtggacgacgtgaaggtgacgaccggcgacagctcaagcggcgcgcccatcaccggactggccggcaagtgcgtggacgtggccggttcgagctcggccaacggcgcccccgtccagctctacgactgcaacggcaccaccgcccagaagtggacggtggcctccgacggcacgctccgcgcgctgggcaagtgcctcgacgtcacggagaacggcacggcggacggctccaccgtccagctgtgggactgcggtggcagcgccaaccagaaatgggtggtcaccgcggccggcgacatcgtcaacccgcaggccaacaagtgcctcgacgtgaccggcaacaactcggccaacggcacccggctgcagatctggtcctgctcgggcgcggcgaaccagaagtggaaggtcggc

SEQ ID NO: 7421 - DNA, 588 bp, Streptomyces avermitilis
  CDS (1)..(588)
ttgaacctggagggttggatggcccgtaccgagctacgcaccggcacctcgaaattcggcctcggccgccgtcgcacctcgacggcaccaccgccggagcaccggccactgccgcttcccgtgcgactgctggcgatggtgctcgccttcgcgaccatggtggcgttcgccgcggtgctggcccggctgaccctggagccgtcgcccgcttcggaggcgctgacccacaacaacctgcatccgggccgctccctgcacgcctatctgagccggcccgagttgcgcgacgccgtcaagcagatcggcggcaatctgctgctcggggtgccgttcggggtactgctgccgatggtggctccgcgcacccggggcctggtgcgggtcggggtactgaccgcgctggtcatgctgctggtcgagctggtccagggggcgctcatcaccgggcgcgccttcgacatcgacgacgtcatcctcaacacgacgggcgcgctgctgggttatctgctgctggggcggcgactcgggcgggccgtgcatccgcgccggaggcggcggcaggacacgagcggcggcaagggcaagagc

SEQ ID NO: 7422 - DNA, 582 bp, Streptomyces avermitilis
  CDS (1)..(582)
gtgggccgtcctcgccctcctctggctggtgttcatcagcgcggtcgacacactggagctgatcgtgggggcctcggcctcgtgcgccggagcggtcgcggcgcgcggagcgcggcgggcgatgagcgcgcggtgaacggctggaccgtcgcggccacggtcacgatcgccggcggagtcggggccaccgtgtggggcgtcgccaccgggccgttgagccgccgggtcgtcgcccagaacctgtcctgcgcactcgcctgccccggactgctgctgctcgcccagggatacgagaggcccgcgtacgtcgatctcgccctggtcctcgccctcctcggcccggtcggcaccctcgtcttcgcccggctgctcgccgacgacctcgcgcaggacccgccgcgtgcccgggccgtcacggtcgccgtcgcgtgcttcggcggcgtggtcgtactggtcctgtgcgcggccgccggacccggccgggccatgatgaaactcctggtgaccggggcgctgctgatcggcggaaacctcctcgcctcccgcgccctgtccggaggattctccgggggccgccgtgga

SEQ ID NO: 7423 - DNA, 273 bp, Streptomyces avermitilis
  CDS (1)..(273)
gtggatgaccccctgatcttcgtcgccctgctgctggtcgccgcctccgcgaccgcggccgtcgccgtccgcgaccccgtgcgccaggccctcgtcctgtccgtcctcggtatcaccctcgccgtcctgttcaccgtgatgcaggcgcccgacgtggcgctctcccagctcgccgtgggcgccgcgctcaccccgctcctgttgctcctgtccgtgcgcaaggtcggacgccgggcccggcaggggaaccggaaggggaaggggaaggcacgg

SEQ ID NO: 7424 - DNA, 738 bp, Streptomyces avermitilis
  CDS (1)..(738)
gtgacgcggcgcgtacggctgatcgtcctggccgtcggcggggcgggcctcgcggccctgctcgtcgccgcctgtctgcggctgcccggcttcggcgggacacggcacccctacggagaccgggtcgtccgcgcctccctggcccggcacaccgccaacaccatcgcgtccgtcaacttcgaccagcgtgccttcgacaccctcggcgagatgggcatcctcttcgcctccgtcctcggcaccgtcgtcctgctgcgccagacccgcgacgagcgaagcgcgcgaccggaacccgaggacgtcgcactccccgtacgccggtacgccctcgtcgtcctgcccgtcgccctgctcaccggcctctacgtcatcgcccacggccagctcagtcccggcggcggcttccaaggcggcgtcatcgcggccaccgccctgcacctgctctacctcggcgccgactaccgcgccctggagcgcatccggcccgtcggcctgtacgagatcggcgacgcgctcggcgcctgcgcctacctcgtcctcggcctcacgggagtcgtcgcgggcacgtccttcctcgccaacacactgctcccgtacggcaccttcaacaccctgtcgtccggcggcaccgtccccctgctgaacgcggccatcggcgtggaggtcgcctgcgcggtcgtcgtcctgctcgcccgcttcctcgaccaggccgtcgagatcgaggagggaagcgggaag

SEQ ID NO: 7425 - DNA, 348 bp, Streptomyces avermitilis
  CDS (1)..(348)
gtgatgtccgtactgccgtatctcgtcgccgtgtggatcttcctgaccggctgctacgggctcgcgaccagccgcaatctgatccacgccgtgggctgcctcgccgtctgccagtccgccacctacgtcctgctgctgaccgtcggctaccgcgacggcgccaccgcccccgtctactccgacatcaagcccggctcgcggcccgtcgtggaccccgtcgtgcaggccctcgccctcaccgacgttgtcgtcggcgccaccgtcaccgccctgctgctcgccctcgtcctccaggtctccaaacgccacggcacggtcgacccggacgaactgcgggagctgcgcggc

SEQ ID NO: 7426 - DNA, 1755 bp, Streptomyces avermitilis
  CDS (1)..(1755)
atgaaccacctgctgccgctgctcgtcgccctgccgctgctcggggccgccctcctcgtcatggccggccgccggctgccgcgcgtggccgccgagtcggtcggctgcgcggtctcggccggtacggcggccctggccgtcgtcctgctgctgaactcctcgccgccgctggtggaatgggtcgggggatggctgcccagggacggcgagagcgtcgggatcgtcctggtgggcaacggcgcgggcctcggcatggcggcgctcgcctccctgctgaccgtgtcggcactcgcgtattcctggcgctacttcgaggaaccgccccaccacgcgggttccttcccggcgctgatgctgctcttccagggcggcatgtgcggcttcgcgatcgcgggggacctgttcgacgcgttcgtgttcttcgagctgatgagcgtcgtcgcctacgcgctgaccgggcaccgggtcgaggaggcgaaggcggtgcagggcgcgctgaccttcggcgtcgtcaactcgctgggcgcgtacgccatgctgatgggcatcgcgttgctgtacgcgcgcaccggcgaactcggactgacacagatcggccgcaagctcgacgcgcacggcgggcccgacgccctcaccctcgccgccttcgttctcgtcctcaccgcgctgctggtcaaggcggccgccgtgcccttccacttctggctgcccgacgcgcacgcggtcgcgccgacaccggtgtgcatgctgctgtccggcgtgatggtcgaactcggcgcgtacggagtctggcgcgtctacgggaccgtcttcgccggccccggcggcatccccgcggccgacctggaacgcgccctgctggtgctcggcgtactgaccagcgtggtcggcgcggtcctgtgctggtaccagcggcatgtgaaacggctgctcgcgtactcgacggtcgcccacatggggctgttcctgatcggcatcggcacgctgacgccggaggcggacgacggcgtcgcgctgtacgtcctcggacacgccggggtgaaggcggccctgttcgcctgcaccggaatcctgctcgaccggtacggcagcgtcgacgaacacgccctgcacgggcgtgcccgggagctgcgcggggtggccgtgctgttcctgatcggcgccctgggcctcgccggactgccgcccttcggcaccgcactgggcaaggcgatcacggaggaggcggtgggcggaccgctcaccgtcctgttcgtcgccgtctcggcggtcaccgcgggcgcggtgctgcgggtcgtggcgcgcgtgttctacgggctcgggccgaagccgcggaaggagtcctcgtacgagaccaccggcaccggcgaggaacccgagacccggcaccggctgcgccggatcccggacaccatgaccaccgtccccgcggtgctgctggccgcggcgctcgccgtgggcgcggtgcccggcttcgccggtgtggtggcacgcgccgtgaacgaggccggatccggtggggcggtcacctcaccccactggaccctggccggcgtcgtcctgggactgacctcgacggccgtggcagtcggcctggccgccctcgccgtgacccgcccgaagctgctcggtgagcagcgctggaccgaaccgctgcggcaccttcagtccgggtacatcggggactacgtggcgtggctgctggcgggggcgacgctgctgggtgcgctggccctgcccggcgtgctcggcggc

SEQ ID NO: 7427 - DNA, 681 bp, Streptomyces avermitilis
  CDS (1)..(681)
atgacgacgtccatcaagcagacgcccggctcgacgtccagtgagcgcaaacggatgcccggctggttgaaggcggtcaccgccctcgtcctggtactcgtggtgctgttcgccgggctgcggctcagcgtgcttccggggctgcgcgacctgttcggggaagacacccacgaccggtccgggcccacactcctcaagtccatccaggacatgagccgttacgacgcggcctcgggcaacttccaggtggtcgtggacctggagaaggacgccaagctcctgccggacgcgatccgcggcacccgcacgctgtatgtgggcgcgggcaccgtggacgcgtatgtgaacctcggcgggctcggcaaggacgacgtgaaggtcaacggcgaccgcacgtccgcgacgatcaggctgccgcacgcggtgctgggcaagcccgcgctcgacgccgaccgctcctatgccgtctccaagcagcgcggtctgctggaccggctcggcgacctcttctccgacaaccccaacagcgaacgcgccgtgcagaagctcgcggtcaagcacatcggggaggccgccaaggacagcgaactcgccgaacgcgccgaggagaacaccaccagcatgctggacgggctgctgcgttcgctcggcttcaaggaggtgcacgtgacctacggtgcc

SEQ ID NO: 7428 - DNA, 399 bp, Streptomyces avermitilis
  CDS (1)..(399)
gtgccgcgtcacgacctcgccacacgcccgacctcaggggaccggaatgcgccgattcctcggaaccccggcgcgatcgaccgcctcggcagcatcgacgccggcgacacccgtacggacgacggggagatcgagcggcggcgcggcatcaccatccgttcggccgtcgccgccttcaccgccggagccgtacagatcaaccccatcgacaccccgaagcaccccgacttcatcgccgaggccgagcgcgccctggaggtgctggacggggcggtactgccgctctccgccgtggagggcttccctcgacgcgccggccccggtgacagcgcaactggccgcgtacgacgcggagttccgggagacgacgggcgggcgcacggcctggctgatcaccgg

SEQ ID NO: 7429 - DNA, 951 bp, Streptomyces avermitilis
  CDS (1)..(951)
gtgcgtgacatcgccgtgttcagcggtagtgcccatcccgagctggtggcggaggtctgtgcgcatctcggtgtgcccctcagtccgtcccgggtgagccggttcgccaacgactgtctcgaggtgcagcttcaggccaactgccgcgagcgggacgtgttcctggtgcagccgctggtcgcccccgtgcaggagcatctcgtcgagctgctgctgatgtgcgacgcggcgcgcggggcctcagcggggcggatcaccgtcgtcatgccgcactactcgtacgcccgttcggacaagaaggacgcgccgcgcatctcgatcggcggacggctggtcgccgatctgctggtggccgccggggcgagccgtgtcctggcgatgacgctgcactccccgcaggtccacggcttcttctcggtgcccgtcgaccaccttcacgccctgcgggaactggccgcccacttccgcggccacgacctctcccggacgacggtcgtctcgcccgacctcggcaacgccaaggaggcggccgccttcgcgcggatgatcggggcgcaggtggccgcgggggcgaaacagcggttcgcggacgaccgggtcagtatcagcgccgtcatcggcgacgtcgtggaccgggatgtcatcgtgctggacgacgagatcgccaagggcagtacggtgctcgaactccttgaccggttgcgggagttggggccgaggtcgatccgagtggcctgtacgcacggcctgttcgcggccggcgcgctcaagcggctcagcgagcagcccgacgtgctggagatcgtgtgcacgaacaccgtgccggtcgccgccttggagcgcaccgggaagctgcgggtcctctccatcgcgcccgccctggccgaggccgtgcggcgcattcacaacggcgagtcggtgagcgccctgttcgacgcgccccagggcgaa

SEQ ID NO: 7430 - DNA, 405 bp, Streptomyces avermitilis
  CDS (1)..(405)
gtggagccggttggaggcgatgccgtcatgccgcaggaccccgcaccgcgcacccggcatctgcacgtccaccgggtacgcggccatacggtcctcgagttccgcggcgagatcgacatcgccgcggccctggagatcatccccgtgctcgactccgtgacgggacgcccggcagcgcgcgtggtgatcgacctcggccccgtcgagttcttcgactgctcggggctgcgcctgctgtaccgggccaggagccgggtcctcggacggggcggacagctgcggctcgtctgcacgcacgcgctgacgctgcgcatcctgcgcctgaccggcctgcggacgctgctaccccccgccgcgtcgctggacgaggccctgcggcaggccgaggccacgtccggatcctgg

SEQ ID NO: 7431 - DNA, 945 bp, Streptomyces avermitilis
  CDS (1)..(945)
atgagcactgtgaacaccatgcgagccatcagtcaggacgtcctcggcggtcccgaggtcctcaaggaagtagagacggaacgccccgcgccgcggcccaacgaggtgctggtccgggtgcgtgccgccggggtcaacccgaccgactggaagcaccgcgccaccggcggcttcctcggcgagccgcccttcgtcctcggctgggacgtctccggcgtcgtcgaggcgaccgggatcggcgtcgcccgcttcaagccgggtgacgaggtcttcggcatgctgtcctacccgttcggccacggctcgcacgccgagtacgtcaccgccccggcccgcgccttcgcgcacaagccgtccggggtcgaccacatccaggcgggcgcgctgccgctggtttccctgaccgcgtggcaggccctggtcgagacggcggacgtgcggccgggccagcgggtgctgatccacgcggcggccggcggggtcggccacgtggccgtgcagatcgccaaggcccgcggcgcgtatgtgatcggtacggcgagcgccggtaagcacgacttcctgcgcgggctcggcgtggacgagacgatcgactaccgggagaccgacttcgccgaggccgtgcgggacgtcgacatcgtcctggacacgatcggcggcgaccactccctgcgctcactgcgcgtactgcgcccgggcgggatcgtggtgtcgatcctgccggtcgggtcggacgacttctacgaggaggccgagcggctcggcgtacgggcgctcaggatgctcgtggacgcctcgcacaccggcatgaaggcgatcgcggagctcgtcgaggcgggcaagctacgcgcgaccatcgccgagaccttccccctggccgacgccgccaaggcgcacgcgctcggcgacaccggccgcaccacggggaagctcgtgctgaccatg

SEQ ID NO: 7432 - DNA, 945 bp, Streptomyces avermitilis
  CDS (1)..(945)
atgcggcatgtggaacgcgtggtcgtcctggcgctcgacggcgtctaccccttcgagctgggcatccccagccggatcttcggcgcggccgacggccggtacgaggtggtgacctgcacggtcgacgggaagccggtgcgcagcaacgcggacttctcggtcatggtcgagcgcggccccgaggtgctgcgtacggcggacaccgtggtgatcccgcccgtcacaccggcctcggtcaccgcggaactcccggccgaggtcaccgccgcgctcgcgcagatccggcccggaacccgcatcgtctccatctgcacgggggcgttcgtgctggcggcggccggtcttctcgaagggcggcgggccacgacccactggcagttggcggaccacttccggcgcatgttcccgcacgtggcactggacccggacgtactgttcgtcgacgacgacccgatcctcacctcggcaggcgccgcctccggggtcgacgcctgtctgcacatcgtgcgcaaggaccacggcagcgcgctggccaactcggtcgcgcggcgctgcgtggtgccgccgtggcgggacggaggtcaggcgcagtacatcgagcacccggttcccgggcccaccaccaccggcacggccgccacccgccagtgggcgctcgaacggctgggcgagccgctcgcgctggccgatctcgccgggcacgcccggatgagcctgcgcaccttcgcccggcgcttcggcgacgaggtgggcatgagccccggccgctggctcatccagcagcgcgtcgcccgcgcccgccagctgctggagtccagtgacctgccggtggaccagatcgccggcgaggtcggcttcgcgaccggggcctcactgcggcagcacctgcacgcggcgatcggagtctcaccacaggcgtaccgccgtacgttccagacggcccgc

SEQ ID NO: 7433 - DNA, 702 bp, Streptomyces avermitilis
  CDS (1)..(702)
atgactcaattcgttttggtggcaggcgcgtggctcggatcgtgggcgtgggacgaggtggtgcctcacctgcgtgcggccgggcacggcgcccatccgctgacgctgtccggcctcgccgacaagcagggtgtgccggccgggcagcagacgcatgtgcgggacatcgtcgacgaggtcgagcgcctcgatctgcgtgaggtggtgctcgtcggacacagctatgcgggcatcccggtggggcaggccgccgagcggatcggcgaccggctgacgcgcgtcgtgttcgtcgactcgaacgtgccggccgtcgacgagtcgttcgtctccacctggtgggaggggccggcgaagttcgaggccgtactcgccgcgaacggcgacgtctggccgcccctgactgcgcccgacttcgaaggccagggcctcaccgaggagcagatcgcacggttcgtcggccgcgccaccccgcacccgggcgccaccctgtccgagccggcggtgctgacacgtccgctcggcgaacttccggcgacgtacatcaagtgcctgctcgacggtcccgagccgaccgacgacgtggccgagctgctcaagagcgagcactggcggctggtcgagctggacaccggccactggccgatgctctcccggccgacggagctggcccggatcctgctcgacgcggacggctccgccggc

SEQ ID NO: 7434 - DNA, 903 bp, Streptomyces avermitilis
  CDS (1)..(903)
gtgcgtcggaggagggacgggtacggcgttcggcggacaggagcgggaatgcgcaaggggatcgcggcggtggcggtgctggtcgccatgacggcgtcggcagggtgcgacgacgggagcggggccgatctcgtggtcaccggaacgccgccggcgacgccgtacagcgggccgctgaaggtcccgtccaagaacctcgacgaggacagcgcccgggcggtgcggctcgtggcgggggcggccgggcgagccctggagtgcgacggcgagatctacacgggggcgtcggacggctcgtggagccgggacgacggcggggcgacgcccgaggaggggctccaggcgtacttcgacctggagcaggccgaggatccgcactacggctatcgcgtcgagcgcgaggaacgggaccgggtcctgtactccttcgacgtccacggccgtaccaaggtcgccgtcgtcgtcgccaaggaccagaaggggcggcccggttggggtccggagtcgagcgcgtcctgcgacccggccgaacttccggcgagcttcacggactccaagccctacgagatctggaccgaccgggacggccgtcgcgtggcaacgacggtggtgagcagcaatgacggcccggagcactgcggctggcagtccgccgtcttcctgtacaccggccggggtgagggcgtgaggcactacgtgcgtgatccgcacggggtgctgggccgtcagctgctcacctccgcgtacgacggtcatgtccgtatgcccgccgacgcccacgacacgggataccgcctgaacgaccgggaactgtggttcaccggcgacaggtcgaaggcctacgtacgcacgtccgacggggtggagctctggccggccacgaaggagagtgtgggctgcaag

SEQ ID NO: 7435 - DNA, 561 bp, Streptomyces avermitilis
  CDS (1)..(561)
gtgagccccgtgccatgggaggacccgcgggccgcccgcacccgcgcgaagctgagggaggccctcctccacgagtgcgccgcgcacccgctggaggaggtcagcgtggccgcgctggtacgccgggccggggtcggccgcgccacgttctacgtgcactacgccgacctggaggcgctggcggtcgacgcctgtgccgatgtcgtacgcgacgcggtggacgcgctgcacgcctggcgcggccgccccgacccggtccgcgcacccgaggcactgcgcgcgttcctcgccggcctcgccccgcacaccgccctgtaccgcgccctgctcagcccgggcggtggcggcccgctcggccgcgtactgcaccgtgatctgcgcgcccgcagcctcagcgaacgcaccctcgcgggcgcggccgacgccccgctcgtggcctccgccgtggcggcgaccttcgcgggggtgctggccgactggctgcacggcctcctcgacgcgacggcggacgacatcgccgatcaggcctggcagttgctggtcgcgttgcaccgcagccgc

SEQ ID NO: 7436 - DNA, 360 bp, Streptomyces avermitilis
  CDS (1)..(360)
atggagatcctcgcgaacgtgctggtcgggctggtcgccgccctgcacgcgtacatcctggtcatggagatgttcctgtgggagaagaagcccgggcgggggctgcacggattcgacccggagatggcgcgggccacggcgccgctggccgcgaaccaggggctctacaacggcttcctcgcggcgggcctggtgtggggtctgatcgccggcgacccgaccggattccgtgtgcaggtcttcttcctggtgtgcgtcgtgatcgccggcgtgtacggcgggctcaccgcgaaccgccgcatcctgttcgcccaggccctgccaggagctctcgccctggccgccgtactcatcgcgcac

SEQ ID NO: 7437 - DNA, 1533 bp, Streptomyces avermitilis
  CDS (1)..(1533)
gtggccgtgttctgccttggtgaagggggagttgacgtgtcgggcagcatcgcgccggtcggctggagcgagagtgaacgggggatgtgggccgccttccgccgtggcgagtggtacgcggacgggggcgaggtccgggcctcggccgtgcgcaggctgctgctcgccccgccccaggccgagcccggccatccggcccgcctgcgactgcgggacgtgctcgtcaccggacgcctcgacctggaggaggccgtcgtcgcggcagcgctgcgactgcggaactgccgcttcgagcacgcgccccgtctggacggcgcgtccctgggcgccctggagctgcgcgactgcactctgccgggcctgtcggcggtgggcgtgaccatcggctggaagtgcgagatcagaggctgccgggtgcagggcgccctggacatgcacggggcctcgatcggcggcaccctgcatctggaggacagccggctgaccggcggtgccgacctgcgggacagctcggtgggcggcagcgtcatcctccggcgcgccgcactcctcaacccacggggcacggcgctgcacgccaaccggctgcacataggcggcgacctggactgccgcggcggactcgtcgcggagggcaccgtcgacgtgtgcgacgcccgggtgggcggcggcgtccgcttcgaaggggcctcgctcaccgccgagcacgggcccgccctgcgcgcccacggcatcgacgtgggggccgagttcaagtgctgcgagggcttcgtcgcgcacggcagactgtcgatgagcagcatcaccgtacgcagccagctctgcttcaagaacggttccatcgacgtaccggccggacagccggcgctggtcagccgccgctccaccgcatccgacctcgacctgagcttcagcggccccgtgcacggcaccgtggacctcagccacacccggttgaccctcctgaccggcgcgccgggcgagtggcccctggcgctgcgcatggaaggcgtcgtctacgacagtctcctgccccaactcccggccgcggaacggcttccgctgctcgcccgtgaccccgagggcttcaccccgcagccctacgagcaactggcggccgtgtaccggctgcacggccgggacgccgaagcgcgcaccgtactgctcgccaagcaacggcggctgcggaccaccctgccctggccggggcgcgtatggggagggctgcaggacctcaccgtcggatacggctaccggccgatgcgcgccgtgtggtggctgttcgcgatcatgctcagcggcaccctgctgttcacggcctggccgccacaggccgtcgaaccgggcaagccgccccacttccaggccgccatctacacgttcgacctgctgctgccgctcgtcgacttcggacaggaacaggcgttcagcccgcgcggcggcctccagtgggcggcggtactcctcatctgcctgggctggctgctcgcgaccacggcggcgacgggcgccaaccggatgctgcgccgggcg

SEQ ID NO: 7438 - DNA, 462 bp, Streptomyces avermitilis
  CDS (1)..(462)
atgacgaccccacccgcccgcaccgcgaagcagcgcatacaggacaccctgaaccggctcgaactggacgtcgacgcctgggtgtccacggccggagccgacggaggagcgccgtatctggttcccctgtcctacctctgggacggtgagacattcctggtcgccaccccggcggcgagccccaccggacgcaacctcagcgagaccggccgggtgcgcctgggtatcggacccacccgcgacctggtgctcgtcgaaggcaccgcgctgccgctggagcccgccggcctcccggacggcgtgggcgacaccttcgccgagaagaccggcttcgatccgcgccggctcaccacctcctacctctacttccggatcagcccgcggcgtgtgcaggcctggcgcgaggccaacgagctgtccgggcgcgaactgatgcgggacggggagtggctcgtgaccgac

SEQ ID NO: 7439 - DNA, 390 bp, Streptomyces avermitilis
  CDS (1)..(390)
atggcactcgtagtggcaggcgtcgtggtcctggactgcgccgagcccgagaagctcgccgcgttctacagggaactgctcgacgccgaggagacggacgcgaccgcgaaccgggtggagatccggggagccgacgggatgcggatggcattccgccgcgatgtgatggcgacgccgccgagctggccgcgccccgagaactccctccaggcccatctggacttccacgtcgaggacctcgacgcggcggaacgcaaggtcgtcggcctcggcggccgcccgctggacacgaaggacgcgcagggcccgttcgaggaacgcggttacgccgacccggccggccactccttcaccctgcgctgcgcacggccgacagcgccgaagcagggg

SEQ ID NO: 7440 - DNA, 306 bp, Streptomyces avermitilis
  CDS (1)..(306)
atggccaggaacaagcagaagaagatgaagctcccgctcgtatacaagcctctggggttcgcactcagctgggcgagcggagcgctggccgggctcgccttccagcaggcgtggaaggcgattcgccacgaggacaacgcccccgacgcgctggaccaggaccgcggctggggcgagatcctgttcgccgcggccgtccagggcgccatcttcgcggtagtccgcagcgcggtggaccgcacgggcgcgaaggccgtcgaacggtccacgggggtgtggccggacgggaacaagggcggccgggac

SEQ ID NO: 7441 - DNA, 1014 bp, Streptomyces avermitilis
  CDS (1)..(1014)
atgagcgagggcaacggcaacagcgcgtacggacggaaggcgttcaagcggtccaggagccacttcacggaccggatcacggccgacggccgggacggccggccggtggaggccggccgctaccggctcatcgccagccgcgcctgcccctgggcgagccgggcactggtgtcgcggcggctgctcggtctggaggacgcgctgtcgttgggtgtcgtcgatccggtccaggacgaccgcagttggcggttcaccctcgacccggacggccgcgaccccgtgctcggcatccggtacctcagtgaggcgtacgacgcacggcagccggagtatccgggcggcgtcagtgtgccggcgattgtggacgtgccgagcgggaagctggtcacgaacgactaccagcagctcaccctggatctggccaccgagtggaaggccctgcaccggcagggggcaccggacctgtatccggccgggctgcgcgacgagatcgacgaggtgatggcggacatctacgaggacgtcaacaacggcgtctaccgggccggcttcgccaccggccagaaggagtacgaggcggcgtgcgccggagtcttccaccgcctggagctgctcggacagcggctggcggaccggcgccatctcgtcggggactcgatcaccgaggcggacatccggctgttcaccacgctcgtccgcttcgacgccgtgtatcacggccacttcaagtgcaaccgctggaagctcaccgagcacccggtgctgtgggcgtacgcacgcgacctctaccagacgcccggcttcggcgacaccgtcgacttcgaccacatcaaacggcactactaccaggtccacaccggcatcaatccgaccggcatcgtgccgctcgggccggacctcgcgggctggctcacgccccatcaccgggagcggctgggcggccggccgttcggcgacgggacaccgcccgggccggtgcgcgaggacgaggagatcccggctcagggacgaccc

SEQ ID NO: 7442 - DNA, 1068 bp, Streptomyces avermitilis
  CDS (1)..(1068)
gtgagcaggacatcctcttcggactcttcgaaccacgcttcttcgacccccgcggactcttccgcggattcctccgaggacccttctgcggactcgtccgcggacgcctcggaccgcaagacccggatcaccgtgctggtggcgctgggcgccaacctggtgatcgccgtggccaaggccgtcggcggcctcctcgcgggctcgccggcgctgctctcggaggcggcgcactccgtggcggacagcctgaacgaggtctttctgctggccgccctgcgccgcagccgccggccggccgaccagcggcacccgttcggctacggcaaggaacggttcttctggtcgttgctcgcggccgtcggcatcttcgtgatgggcggctgcttctccttcttccagggcatcgaggcgctgcggagcggagccgaggaatcgcacagcggttatgtggcgggcctcatcgtgctcggtgtggcgctcctcgcggagggcgcgtccctgctgcgggcgctgcatcaggtgcgcgggcagcggggttccgcggcggaagggctgcgggaccccgcgctgcggacggtcgtcgccgaggacggcaccgcggtcctcggcgtcacgctggcgatgatcggcatggcgctgcacatggtcaccgggcaggtggtctgggaggcggcggcctcgatggggatcggcgcgctgctcgtctacgtcgcctaccggctcggccgcgacgcccgtgaccagctcatcgggcaggccgccgaccccgagctgagcgggcggatccgggccctgctggaggcacagcccgagatcgacagcgtggagtcgctcctcaccatgcaactgggcctccactccaccctggtcgccgcccgcgtcgacctggtcccgggcctggacagcgaggaggtcgaggacgtcgcggtgcgcatcaaacgctcggtcgcccatctgatcccggaggccgaccagatcttccttgacgtgacggacgcgcgagcgctggcggcggaccgggcgggggaaacagaaagccccgccgcgacgggggagcgcggcggggcc

SEQ ID NO: 7443 - DNA, 441 bp, Streptomyces avermitilis
  CDS (1)..(441)
atgcctcttgagggcgagtacgaacccagcccgacgcagtgggtacgtgaccaggtggagttgtacgagagctccggcggcaccaagggaacgacgctcatggacacggggctgcccgtgatcatcctcacgaccctgggtgccaagagcggcaagatccgcaagacgccgttgatgcgcgtcgagcacgacgggaagtacgcggcggtggcctcgctgggtggcgcgcccaagcacccggtctggtactacaacgtcttggggactcccgcggtggaactccaggacggggccgtgcgcaaggagttcacggcccgtgaggtcaccggcgaggagaaggcgcagtggtgggagcgggcggtcgccgcctatcccccgtatgccgagtaccaggagaagaccgaccgcgagatccccgtcttcgtgctggagccggccggc

SEQ ID NO: 7444 - DNA, 630 bp, Streptomyces avermitilis
  CDS (1)..(630)
gtgaccgccgcgctcgtcgcggggcttctcgcgggctacggcatcgccgtgcccgtcggagcggtcgcgacctatctcgtctccctcaccgcccgtacgtccctgcggaccggggtgtgcgccgcgctcggcgtcgccaccgcggacgggctctacgccctggtggccgcgctcggcggctcggcgctcgccgccgcgctccagccggtgctggtaccactgcgctgggcgtcggggctggtgctgatcgcgctggcggtccgcggcgcgacggccgcggttcgccactaccgctcgccgcggcacgccgccgcggcccggcggaccccgccgagcccggcccgggcgtacctcgggctgctggggatcacgctgctgaaccccaccaccgtgatctacttcgccgcactcgtgctcggcagccgggccgctcaggcggtactgccgctggagcagggcgtcttcgtcctcgccgccttcgtcgcctcggccagctggcaggtgttgctggccgggggtggtgcgctgctcgggcgggcactgaccgggcggcgcggtcggctggtgacggcgctcctgtccagcgcggtgatcctggggctggcggtgcgcatgctgatgtcgccggcg

SEQ ID NO: 7445 - DNA, 507 bp, Streptomyces avermitilis
  CDS (1)..(507)
ttgtggacgcgccccggctggccgtcgtcaacgccggcaccggcggcaaccgggctgctgtcggactggaccgactccgcgggcgtgcgccgcttcgcacacgacgcgctcggccatcccgggatccgcgcggtgatcgtgctgacgggcatcaacgacatcctcggcggcgagaacgacgccggacgcccgctcaccgcacgcgacctcgtcgacggctaccgttccctgatccgcgaggcgcacgagtcgggcgtacgcgtcatcggcgggaccctgctgccctcccgcacgctcacggacgcccagaacgccctccgcgaggaggccaacgagtggatccgcaccggccggcacttcgacggtgtggccgacttcgagcgggtgatggcggacccggacgatccccgcgccctcgcccccggctacgacagcggcgacggactgcaccccaatgacgcgggcatggcggccctggccggcgccgtcgatccgacgacgctgacc

SEQ ID NO: 7446 - DNA, 684 bp, Streptomyces avermitilis
  CDS (1)..(684)
gtgttcgcgccgtccgtgatcgagtccccgaaggcgaccagggtgccgtccacctcgtccgtggtgacggtcagcccggccaggaagtaccaggaggtctccgtggcggtgaacccgtcgaggccgtcctcggcggtgagatcgccggagcgcggcgcggagacgtatgtcgtctcgaaggcgtcccggtggtgggtcgagggcccggtcgagcccggcagatacacgctgaccagcagattttgcccgcgctcgacatcgaccggcagcacgtccgtgagcagttcccggccgcggccgatcaccgccttcgtggcaccgtcgaaggagaccggccgcggcggccgaccctcgggggccacactgacggcgcccacggtcagctcggccgggccgtggaggttcgacagccgcaggcgcgcacgggttcccccggcgctcggacgaaccaccatacgcacggtctggtcgcggaaggaccggccgaagggcaccatgctcggagcccatacggcgacggtctgttgtatgccggtcatggtcacccttcttcccggccgtcgcgttcgtaccgcgggggcttcaggcttcacggcggtggacgacgggtgcctgcccgcatcggtgcgacggggttcggccagttccggcatcccgtggacctggccgaagttcgagtggcac

SEQ ID NO: 7447 - DNA, 1248 bp, Streptomyces avermitilis
  CDS (1)..(1248)
atggagatcggcaagagcaagtcttcgcctgcgaggtctttcatgacagagcccggtacgtccgtgtcagcgcccgtcgccttcccccaggaccgcacgtgtccctacgacccgcccacagcctacgacccgctgcgcgaggggcgtccgctgtcgcgggtctccctctacgacggacgcagcgtgtgggtggtcaccgggcacgccgccgcccgtgcactcctctccgaccagcggctttcctccgaccgcacgctgcccaggttccccgcgaccaccgagcggttcgaggccgtacgcacccgccgggtggcgctgctcggtgtggacgaccccgagcaccgcacccagcgccgcatgctggtcccgagctttaccctcaagcgggccgccgccctgcgcccgcgcatccaggagaccgtcgacgggctgctcgacgccatggaggcacagggcccgccggccgagctggtgagcgcgttcgcgctgccgctgccctcgatggtgatctgcgccctgctcggcgtcccgtacgccgaccacgacttcttcgagtcccagtcccgcaggctgctgcggggccccgggatcgccgaggtccaggacgcccgtgcccaactggacgactacctgtacgcgttgatcgaccggaagcggaaggaacccggggacgggctcctggacgatctcatccaggagcagctgaaccggggcacggtggatcgcgccgagctggtctccctggcgacgctcctgctgatcgccggacacgagacgacggcgaacatgatctcgctcggtacgttcaccctgctccggcatcccgaacagctggccgagctgcgggccgagccgggcctcatgcccgccgccgtggaggagctgctgcgtttcctgtccatcgccgacgggctgctgcgggtggccaccgaggacatcgaagtggccggtacgaccatcagggccgatgagggcgtcgtcttcgcgacctccgtcatcaaccgcgacgcggccggcttcgccgagcccgacgccctggactggcatcgctcggcccgccaccatgtcgccttcggtttcggcatccaccagtgcctcgggcagaacctggccagggccgagatggagatcgccctgggcacgctcttcgagcggctgcccggcctgcggctggcggcgccggccgacgagatccccttcaaaccgggcgacacgatccaggggatgctggaactccccgtgacctgg

SEQ ID NO: 7448 - DNA, 282 bp, Streptomyces avermitilis
  CDS (1)..(282)
atgcacaacgacagcaacaacagcaacggcaacaactcccacagcaacggcaacgtcaacagcaacggcagcaacagcgacgacaacgtgatcgtgatcgaccgggacctctgcatcggtgccgggcagtgcgccctgaccgcgcccggtgtcttcacccaggacgacgacggattcagcgaactgctgcccggccgggaggacggggcaggcgacccgatggtgcgcgaggccgcacggtcctgcccggtgggggccatcacggtcccgcggtcggcaagc

SEQ ID NO: 7449 - DNA, 552 bp, Streptomyces avermitilis
  CDS (1)..(552)
atggagatcgcagtcgcccgcgagcaggcgctggacgccgccgagaagctgttctacggccggggcatccagtccgtcggcatggatgacatccgcggcgcgtccggcgtctcgctcaagcggctctaccagcttttccccgccaaggaacagctggtcgaggcgtatctggagcgacgcgacatccactggcgggagcggctcgcggcgcacgtcgaccaccaccgggacgccggggagcggatcctcgcggtgttcgactggctgcgacagtggttcgccgagagcgacttccgcgggtgcgcctggatcaactcgtacggcgaactgggcgccgtctcaccccgcgtggccgcccaggtccgcgcccacaagcaggccttccggggctatctggccggcctggtctccgacgccggcctgcccgcgtccctggccgaccagctgtacctgctggccgagggcgccatggtcaccgccggcatcaacggcacgacggaccccgccgatcaggcgaagcaggccgcgcgggtcctcctggaggcctgccgc

SEQ ID NO: 7450 - DNA, 459 bp, Streptomyces avermitilis
  CDS (1)..(459)
atgaccgacgaccgcccgcccctgccgcccttcacccgtgcgaccgcggcccagaaggtccaggccgcggaggacgcctggaacacccgagacccgcacaaggtctcgctcgcctactcgccggactcggtctggcgcaatcgcgacaccttcgtcaccggccgcgccgccatcgtggaactgctgacggccaagtgggcgcgcgagcgggagtacgccctgcgcaaggacctctgggccttcgacggcaatcgcatcgccgtccgcttccagtacgagtgccaggacgccgacggccagtggtggcgctcgtacggcaacgagctgtgggagttcgacgagcacggactgatgacgcgccgggaggccggcatccacgacgtgcggatcgaggagcgggagcggcggatcctcgggccccggccggaagcggagcgagggcggtccttccccgttcag

SEQ ID NO: 7451 - DNA, 528 bp, Streptomyces avermitilis
  CDS (1)..(528)
gtgactgaacaggccgagaagcccttcctctacctcgttgtctgcgccgccggaatcgccgcggacgtcggtgagttgatcaccgcggcacaggagcgccactggcaggtcggcgtcatcgcgacgccgctcgccacgggcttcttcgacaccgccgcggtcgaagcgcggaccggccgcccgcttcgctcggcctggcgctccccgggtgacccgcgccccttcccggcacccgacgccgtggtcgtcgcgcccgccaccttcaacacggtcaacaagtgggcggcgggcatatccgacaccctcgcgctgggcaccctgtgcgaggcgtacggactcggtgtcccgatcgccgtcctgccctgcgtgagtgcggcgctgacggcccaccccgcataccgggcgagcctggagcggctgcggggcatgggggtgcggttcggcgacccgtactccggggacgtgggggaggacggccggcgcccggagttccggtgggagcgggccctggatctgctcgacggccga

SEQ ID NO: 7452 - DNA, 804 bp, Streptomyces avermitilis
  CDS (1)..(804)
atggccctcacggcgctcgtgggctgcggtgccgacggaggccccaccgacgcctccccgaaaccgaagccggacgccacggccaccgcgcccacctccgtccggctccccccgctccacgccggtttcgactaccagatcggcggcgcctaccgcccgccgtccggcgtccgcgtcgtcagccgcgaccgtgcggcctcgcccgcgcccggcctctacaacgtctgctacgtcaacgccttccaggcccagccgagcgagcgggggaagtggcccgccgatctcctgctgcgggacgcgcggggcaaggtggtcatcgaccgcgactgggacgagccgctgctcgacatcggcacggcggccaagcgcgagcgggtggcggcgcgcgtcaaccgctggatcgacggctgcgccgccaagggcttcgacgcggtcgaaccggacaactacgacagctacacccgctcccggcacctgctcaccgcccaggacgccaccgctttcgtccgcctgctctcggcccacgcgcacgcccggcacctggccatcgcgcagaagaacacggtggagctggccggggtgagaaagaaggcggggctcgacttcgcggtggcggaggagtgcggcgcgtacgacgagtgcggggcgtacgcgaaggcgttcgacgaccgggtgctcgtcatcgagtacaccgacagcggtctgcgcaaggcccgttcgggctacggcggccggttgagcatcgtgcgccgggacgtgctggtgtcgacgcccggcagcacggactacatccgccggacccgc

SEQ ID NO: 7453 - DNA, 885 bp, Streptomyces avermitilis
  CDS (1)..(885)
atgacaggagaccgcatcgcgctggccgtccacgaccacgggggcgacggctcacccctgctccttctgcacggcgcccggcgcaccctcgccgactgggccgccgtcgccccgctcctcgtaccgcggcaccgggtgctgtccgtcgatctgcgcggccacggtctgtccccgtccgggccgtggagcctccccgaggtgctgggcgacatcgaagcggtcatggaggagtacgggatccccggcgcgctgccggtcggccactccctcggcggcatgatcgcggtgctgtacgccctggagcacccggaggtgacacccggcgcggtgaacctcgacggatacgggtgggggcgaccggaccagtacgtcgggctcgacgcggagtttgtggcggaacaccgccggcggctgccgaaactggccgccgcgacctggggacagcccctgctcgccggcggactcaaggacctgctcgcccgggagcgggcgacgtcggaccggctgggcatcccgtacgagctgctggaggcgggcgtactgcgctccgtccgcgaacggcccggaggcggcctcgaggtgcgccccgagcgcaggcacgcgctggaaatgctggacttcatcgagtcgttggacctcttcgccctgttccggcggatgacccgccccctgctgctcggctgcgctctgcggcccgcggcgtccgtcccgggactgaagtggttcgacgacctgatggccgcctacgcccgagggctcgcccgcgacctcgccgaactggccgcccagcgaccagatgtgacgctcgctcagatcgacagcacacatgacatgctgctggagaacccgagggcggtcgccgacgccatcctcgacttcgcctcc

SEQ ID NO: 7454 - DNA, 2865 bp, Streptomyces avermitilis
  CDS (1)..(2865)
ttgatttttccgctgcgcgtctacggcgttcctgttcgccgcccgcttcgaaagagccgtccgggacgggtgttcgggatgtcggacccccacaaggatgctgcctccgtgttgccggtcgggcagtgcgtccaatggtctggactatttcctgcggaactttggaggaaagtggacgtgaatgatggggtccggtcgaattcccccgaccccgccgcgtcgcacgaggtgacggacgagcaactcgcggccgagctgaagaagttcgccgggaagcggaccgtgcactatccggtgagcgaactcctcgcccggcactgggaggaggccttctcctacgcgcgactgtgcacggacggggcgcaccccgccggaatgctcaccacggccgcgttcaccaggctgttcgaggaagccgcacgccagggcggcccgacggccgcctggcgtccccaactgctcgtcgcgatccgccggatcgcggcggaatgggactccgaccaccgccggccactgctccatcccgaactgcgctccgaccccggggcgacgggccgggccgcggcccggctcctgccgccggagaaccgacggctcgtgtcccgcgcgttccagcgactcgccgaacccgcccgctgcctgctgtggcacacccaggtggagggcgaggccatcgacataccggccgccctgctgggcctcgacgccgacggcgcggccgtgagactggaacgggcccgcgaacaactccgtgagggctgcctcgacgtccaccgggaattcgccgccggggacgagtgccgacgctacgcgcgtctactcgacgtctcgctgcggcgcggcgacgatgccctcgaccccgatctgagcgaccacatggccggttgcgcgcactgccggtgcgccgcggaacagctcaaccgcttctacgaccggctcccggtactgctggccgaaggagtgctcggctggggtgcgcgggaatacctcgactcacggggcgaacgcgcgcccgggaccgtggagaaggcggcgggccgcccgaccgccgcggcgccgccggccgtcgtggccgacgcccgcatggacttcacggccgacacgggaccggatcccacggccggcatgcccaaggacttcgcggcccacgcggcaccgcgttttccggcgggccgcacatcggcgggattcggaccggacgcaccgcgggacttccaggccggcacgggacagggccccacggccggcacgggacagagccccaccgtcggcacgggaccgggtcccacggtcggcacgggaccgggcatccaggctggcgcgggaccgggcatccaggccggcgcgagaccgggtctcacggccgacacaccggacttcgagtccgacaggccggatttcgcagccgccacgggtccggacggcacggagggcacggccgagacagccgacacggcacaggacttcacggccggcatgccggaggacttcgcggcccacgcaacacgcgagttcccggcggccggcacgtcgccgggcttcgggacggacgtaccgccggacgtcgtggccgacgcggcgcaggacttcgcggtcgcggccgacgcgcggctggacttcgccgccggtcccgacgaggggctcccgcacgcgccccgggagaacaggagcccgcaccgctcggcggacccgcacgcacccggccacggcggcaccgcgcggtacccggccgacgcgaacgcaggtgcgggcccggcgaccgataccggcagcgcgcgtcacgcgtccgacgcgggcgcgggcgcgcgcccgtcgaccgacaccggtgggagtgcgcgtcacgcggcggggccgggtgacggctcccgttcggcgcgcgccgtgccgcccgcgggtccccgttcggcgcacaaggcacgtcggcgcgccctgcgccgccgtcggcacgtcgccctcgccgtgctgacggtgagcgcgtgtgtattcgttccgctggccctgtggtccggttcctggtcgggcgggggcggcacggccgccggccgctcgtccggcgaacccggcaccggcacggagtcgggcagctccggctcgctgccctgggtcggcgccgccgccgccgcgccgagcggcaccgtccagggacggatccgcaacgcggacagcgggctgtgcatcggcatcggcaagaacaaggccgtcgccggggcggaggccgtgctcgtcgactgcacgtcgtccgcgacccagcgctgggagtacgagacggacggcctgctgcgcagcctggccgcgcccgaactgtgtctggactcccacctcggctactcggtccaactcgcggcgtgcgcgggggagtcccagccagggacgaagaacgtgcggtacgacttcactctccagggctcgctcgtgccgcgctggaaccaggacctggccctgacctccgcctccggcggccgcggggccgcgctcgtgctgaagccgcgcacggacagcgagtcccagcgctggctggccgacacctccaacgatctggagatgcagtcggtcaactggggcatcggcagtgagtccaccgctccgacgaccaggtccgcgaagtcgtcagcgacgcccaccccggccggcacgcccacgaccggcacgccgaagtcgtcccgtacgccgtcgaccggttccgtcacctccgggggcgcctccggaggctggtgctattacccgtactgctcgtcgaacggacagggtggctggccgacctccggaggctccggcgactccggcggaggttacggcggcggcggaggctacggcgattccggcggttccggcacggggaacggcggaggcggcggtggccgggga

SEQ ID NO: 7455 - DNA, 1341 bp, Streptomyces avermitilis
  CDS (1)..(1341)
atgggacgaccccgtcggtggtggttcgtggcgtacctggttcgatggggtgggaaagccgactgtgtccgggaggaccgagacctgaacaccccgttcgccgagaccctgtccatcggcctgctcgtcgccgtgctcgtctgtgccgtcgtgcgtcccttcaactggccggaggcggtcgtcgcggtgcccgccgccgggatcgcgatggccaccggagcgatctcctgggaccacgtgcgcgaggaggccgagcacctggggccggtgatcgggttcctcgccgcggtcctcgtgctcgcccgctgctgcgacgacgaaggtctcttccgggcctgcggagcctggatggcgcggtgggcggcgggccgccccgggcgactgctcaccgccgtcttcgcgctcgcctcggcgatcacggccgtactcagcctggacgccaccatcgtcctgctcacacccgtggtgttcgccacggcagcccgcatgggcgcccggccgaagccgcacgtgtacgcctgcacccacctgtcgaacacggcctcgctgctgctgccggtctccaatctcaccaacctgctggcgttcagcgccgcgggcctgagcttcacccacttcggggcactgatggcactgccgtggctggtggccatcggcgccgagtacgtggtcttccggcgtttcttccgccgcgacctcggcacggccgcctcgtcggcggccgtcgacgaggcaccgcccgcgatgccactgttcgcgctggtcaccgtggtctgcaccctggcgggcttcgtcgtggcctccgcgctcggcatcgacccggcctggtccgccctggccggtgcgctcgtgctcgccggccgggcgctggtccggcggcgcgccaccccgctcaccgtggtgcgggccgcggcacccggcttcctcgccttcgtcctcgcgctgggcatcgtcgtacgggcggtcgtggacaacgggctctccgacgccctcggccgcctgctgcccgacgggaccgggctgcccgccctgctggccatcgccgcgctcgccgccgtgctggcgaacctgatcaacaacctgccggccgtgctcgtgctgctgccgctgaccgcccccgcggggtccgggccggtgctcgccatgctgctcggcgtcaacatcggccccaacctcacgtacgcgggatccctggccaccctgctgtggcggcggatcctgcaccagcacgatcacggcgtcgacctgagggaattcacccggctcggcctgatcgccgtaccggcggcactcgtcccggccgtgacggcactgtggctgtcactccagctcttcggcgcc

SEQ ID NO: 7456 - DNA, 2436 bp, Streptomyces avermitilis
  CDS (1)..(2436)
gtgacgcgcctgttcactgagagtgtgcgcaagggagtggcgacgatgagcccggacctgccttccggcggcgaggccgccacggctcgggctgtcatcgacgagagcggcgtcctggtcgactggaacgagggcgcccgccggctcctcggctacacgccggaggaggtcgagggccgtccggtcgcggacctgttggtcctcggcggtgccggacatccgccgcggccgtccggcgaccgctggagcggcaccctcgagctgcgccaccgcgacggccgcaccctgtccgtgtggctgctcgcccaccacagacagcgggcccccgccaacggcgccggggactggctgctggtcaccccgctgggcggcctcggcccgcgcccgcaggacgacccgttgatgaggagcgcgctgaccatgtcgccgtgcgcgaccgcggtctacgacaccgacctgcggctgcacggcatcaacgacgcgatggccgacatgatcggacttccggaggaccgcatccgcggtctgcggctctcggagatcggcggcaagcccgagaacgaggagatggagcggcacctgcgcgaggtgctcgccagcggggagagacgcgatgtgcagacgtacatgcgctccggcggggaggagcgcgcacacgcctggctcgcccggctcgccccgctgaccgacgacgccggccgggtgcacggcgcctgtgtgaccgcccacgacttctccgaccagtacctggcccgggagcggctgcagctggtgaacgaggcgagcgtccgtatcggcagcaccctcgacgtcacccgcaccgcccaggagctggcggacgtctgcgtaccggcgctcgccgacttcgtcagcgtcgatctgctggacccgtcgcaggacggggccgagccctaccccaggtcgctcaccgcaccggtctcgctgcgccgcgccgcccaccagtcggtgaatcccggctcccccgaggcggtggtcaggcccggacaggtggacgtctaccccgcctcctcgccgcaggcggactcactggtggccggccggacgatcgtcgccccggacgaccgggccacgctcgccgagtggctcggctgggaccggcggcgtgaacagcgcatccacgagtacggcatccactcctcgatgtcggtaccgatccaggcccgcggggcgaccctcggggtggccgtcctgacccggttccggcggcccgatccgttcacggcggacgacgtcctgctggccgaggaggtgacggcccgggccgccgtctgtatcgacaacgcgcgccggttctcccgcgagcgcgagaccgcgctggcgctgcagcgcagtctgctgccgcggaccctgccgctgacagccgcgctggaggcggcgtcccgctacctgccggccgcccgcgccggggtgggcggcgactggttcgacgtgatcccgctgtcggggatgcgggtcgccatggtcgtcggcgacgtcgtcggccacggcatccaggcgtccgcgacgatggggcggctgcgcaccgccgtgcggacgctcgccgacatcgatctggctcccgacgagctcctcacccacctggacgacctcgtcgtacggctgtccgcggaggccgggcaggacgggaccaccggcgaggtgggcgccacctgtctgtacgcggtgtacgacccgatctcccgccggtgcacgatcgcccgggccgggcatccgccgccggtgatgatgacgccgggagcgcggccgcggcagatcaagctgccggccggcccgccgctgggcctgggcgggctgcccttcgagtccgccgtggtcgaccttcccgagggcaccgtgctcggcctgtacaccgacggtctgatcgagagccgggagcgggacgtcggcgcgagccaccagctgctgtgcgacgccctgtccggctcccgcggctcctccctgaacgaggcctgcgaccggatcctgcacgccctgctcccggcctgcggagtggccgacgacgtggcgctgttgctcgcccgcacctacgggctgcccgcgtcccaggtcacgacgtgggacatccccgcggacccggcgctggtcgcggcgatccgcaagcaggtggtggggcagctggacacgtggcacctgagcgaggccgcgttcaccgtggagctcgtggtcagcgagctcgtcaccaacgcgatccggtacggcgaccaccccatccggctccgcctcatccacgacgccaccacgctcatctgcgaggtgtccgacgccagccacaccgccccccatctgcgccgcgccaggaccttcgacgagggcggccgcggactgctcctggtcgcccagctgacccagcgctggggcagccggcacacgcccgacggcaagacgatctgggcggagctcccgctgacgtacgag

SEQ ID NO: 7457 - DNA, 3090 bp, Streptomyces avermitilis
  CDS (1)..(3090)
atgacggtcactcgcagatcggttttgatcgccggtacggccgctccggcggccggcgcactcacgggcatcgggggcgcgccggccgtggcctcggccggcgccccgggccgccacaccgtcgccctccgcgacggctggcgcttcgcgctggtcaaccccggcgggatcaccgacccgaccggcgcgtacgccgacgccgccgaccccggccacgacgactcgggttggcgcgaggtcgccgtcccgcacgactggagcatcgagcagacgcccaccacgcagtacggcaccacgagcggcaccggcttcctgccgggcggcctcggctggtaccgcaccgccttcaccctgccgtccgccctcgccggcaagcggatctccgtcgagttcgacggcgtctacatggactcgtacgtctactgcaacggcacggaggtcggccgccacccctacggatacaccgggttcgcgttcgacctcaccgacctgctgcacaccgacggcaccaccgagaacgtcatcgccgtcaaggtgcagaaccgactccccagcagccgctggtactcgggcagcggcatctaccgggaggcccggctcgtggtcaccgagccggtgcatgtgcggcgctggggaacgtacgtcacgacgccggacatcaccgaggagcgggcggtcgtacgggtgcggacgaccgtcgtcgacgcgtcgggtgccgggagcgaggtccaggtcgtctcccggatcgtcggccccgacggccgtaccgccgcccgtacgacgtccacggtgaccgtcgctgaccagggcacccagacccatgaactcaccgtgaagaagccccagttgtgggacttcgcgcacccgcaccgctacaccctggagaccgaactccgggtcggcggcaagcggaccgacacccaccgcaccaccttcggcatccgccgtgtcaccgtcgacccggacgagggcttccatctcaacggcacccacgccaagatcaggggcgtcgatctgcaccacgaccagggcgcgctcggggccgcgatcagcatcgacgccgtacgccgccagatgaccatcatgaagtccatgggcgtcaacgccttccgcacctcccacaacccgccctcgccccagatgatcgaggtctgcgaggaactgggcatcgtgatggtggtggaggccttcgactgctggcggaccggcaagacgaggtacgactacggccggttcttcgacgagtggtgcgagaaggacgccaccgagatggtgctcgcggcccgtaactcgcccgccgtggtcctgtggtccatcggcaacgagatccccgactcgacgtccaccgccgggctcgccatggccgaccgcatcatcggtgcgatcaaggcggccgacgacacccgcccgctcgtcatcggctcggacaagtaccgcaacgtcccggccaagggctcggcggccgacctcatgctcgccaagctcgacggactcggcctcaactacaacaccgccaagtccgtggacgccctgcacgccgcctacccccacctcttcctcttcgagtcggagtcgtcgtcggagacctcgacccgtggcacgtaccaggagcccgagcacctcaacacgggcgagaaccacacgcccggcaagcgcgcgacctcctcgtacgacaacaacctcgcctcctggacgatgagcggcgagtacgggcacaagaaggaccgggaccggaagtggttcgccgggcagttcctgtggtcgggcatcgactacatcggggagcccacgccgtacgacgtcttcccggtgaaggcgtccttcttcggcgcggtcgacacggccggcttccccaaggacatgtaccacctgttcaggagccagtggacgagcgagccgatggtccatctgctgcccatgagctggaaccaccaggcgggcgacacggtcgaggtctgggcgtacgccaacgtcgacaccgtcgaactgttcctcaacggaaagtccctgggcaccaggacgttcgacaccaagaagaccaccgacggccgtacgtacttggagacgacggaggccaccggcgacgacaagacggtcaccgacggcccccaccccgggagttacaccagcccgaacggcagcgcgggcaagctccacctcgtctggaaagtgccctacgaacccggggagctgaaggcggtggcccgccgcaacggcagggcggtcgccaccgacgtcctgcggaccgccggtgcgccccacgccgttcgcctcacccccgaccgctcggcactggccgccgacggccgggcgctgtgcttcgtgaccgcggagatcgtcgacgcccgcggtgtggtggtgcccgacgccgagcacctgctctccttcgccgtgagcggcggctccctcgccggcgtcgacaacggccgggaggagagcgccgagcgctaccaggcaagcacgcgaaccgccttccacggcaaggcacttgccatcgtgcgctccggtacgaaggcggggaccctgaaggtgaccgcacgctcggaaggcctgcgtacggccaccgcgaccgtgcgcaccacccccgcgcgctccacggcgaccacccccgccgccgagttccggcccgaccacccggcggcccccgactcgccctcggccgacgcgagttactccggccgccccgacaccctccccgcggccatgctcgacggcgacccgaccaccggctggtccaacgccttcgccaagtcggccacggctctgctgcccgccttcagtggcgcccggcccgaggactgggtgtcggtcacctgggcccgcgcccgcgccttcgaccgcgtcgaggtgtccttcaccgtcgacgcgacgcacacccggcccgcctccgtcgaggtccaggtcggggacggtgaccgctacacgcccgtgtcaggcgccaccgtggactgggccaccgggtccgacgcgccgaccgtggtcaccttcgacgcggcacgcggcgcacggctgcgtctcgtcctgaccagcgcacaccccggcgccgccgacggagcggtacggatcagccggctggaggtcccgcccagc

SEQ ID NO: 7458 - DNA, 1875 bp, Streptomyces avermitilis
  CDS (1)..(1875)
gtgccatcttgcgccgtggaaggaaacccctccgtgcacaccccccaccctcctcgcccgctttatcccccgcgcccggccatgcctcccggagaatcggacgagagtctcggcggccagctgagaggccggccggagggcgcggccccccatcccgtcgcgctgctgatggcgcggcactgggagtcgacgtacgactacgccgtcatctgcctcgcgtcttcggcgaacgtcgcgtccatcgtcaccgccggcgcctttcagcaggtcgtcgggcgcctgatgcggtccggctccgccgccgccgtgcggcccgcgctgctcgtggcggtgcgggacacggtccgggagtggtccgccgaagagcggatatccggcgttctgccggagctgaggaaacccgccggggggcgtggtatgcgggccgcgaagtccctgacacccgagaatcgggttctcgccgagcgctctttcctgacgctcccgggcctctcccgatgcctgttgtggcacaccgaggtcgaagccgagagcatatccgtaccggccggtttgtcgggcatcggcaccgacaccgcgacggccgctctggaacaggcccgcgaacaattccgtgaaggctgtgtgcgcgcccaccgggagctggcgccgaccaaggaatgccgcctctacaaccggctcctcgatgtgccgattcgccgtggtggcgccttgcttcccgatgtccagcggcatcttctggggtgccgcttctgccgtaacgccgccgagcagctcagccatttcgagggcgcgctcggcggtctgctcgccgaagcggtactcggctggggtgcccggcgctatctcgagtccagaccgggacgcaccccgtacggagggcgcgctcggggcgtgtccggctcgggcgggcgcccgggcagcggcgggcgccaccggctgctggcccagatccccgccccgggccgccgcaccccggtgggggagcgcggcgcgcgggcagtgctcaccggcgtcggtatcgcctccgccgccgtccttgccaccttcctcgtcacgggcctgtggtcgaacgacgacgggaacgtcgacccgaccgcctccacgagcgcgagcggcggccgtacgaccgtcttgcccacccccggctcgcagatcccgcccacggtgtcgtcgccccccgactcggccggcctgcccaccacgccccggcagacccggctgcgcaacctcgccgccgacctgtgcctcgacgtccggggcgaggcgaaggccggcgcgggaaccaagctcgcggtgtgctcctccgcatggacccagcagtggacgtacgagaaggacggactgctgcgcagcgtggccgaccccgaactgtgcctggactccggtgcggtcgacggggtcgcggagctcggccgctgcgtcgccgagagctccgcccacggcggcgacgtgcgttacgacctgaccgtgcagggcgaggtgctgtcccgccgcaagggcagcctcgccgtcacacccggcaacaccgatccggacgccgacatcgtcgtcaaggtacgggacggttccgacaagcagcggtggctgaccgactccccgtcggaccagcccgagtcgctgtcgatcgccggtacgacacccccgtcggccacgcccgccaccgatgcgcctgccgccacccccgcgcccacgcccgtgcccgcgtcaccgggcacccggctcacggacgccccggtcgcctcgtccgcgcccccgtcggagaactacggggaacgccggtccctgacggtcacggacacctccacccccgagccggtgctgccgctgaccgttcacctgcccgacctgctgggcgagatcggcgtcggcctg

SEQ ID NO: 7459 - DNA, 975 bp, Streptomyces avermitilis
  CDS (1)..(975)
atgaccgtcaccaagaacgtcctcgccgtcgtcccgccccatgtcggcggccgcggcgcgggggccgcgctcgcctcggtcttccccggccaggcccgcgtcaccgtcgtcgaggcgaccgacgaggaccccgccgcactgcgcgaggcccacgtcatcatcacgggcctcggcccggtgaccgccgaacacatcgccgcggcaccggagttgcagctcatccagtgcgcgagccacggcttcgactacgtcgatctggacgccgcgcgcgccaggggcctgcccgtgtgcaacatcggctccagcggcgcggagcagcagaacgtggccgagcagacgttcgcgctgatgctggccctggccaagcagctggtcccggcgcacaccgcgctcgtcgacgccgactgggcgctgccgaggctccagcggtccatcacggagctgtccggcaagaccctcggcatcgtcgggctcgggcacatcggggaggaagtcgcccggcgtgccgtcgcgttcgacatgcgcatcgtgtacgcgggccgggagcgcgtcggcgcggagagggaggcccggctcggcggggcgcgtcacgtcgggctcgacgagctgctgcgcaccgccgactacgtcaccctgcacgcgccgctcaccgaggcgacccgccatctcctcgacgccgaccggctcgcgctgctcaagcccaccgcgttcgtgatcaacaccgcccggggcgccctgatcgaccaggacgccctcgcggacgcactggagaagggcgcgctcgccggagcgggcatcgacgtcttcgaccccgaaccgcccacgtccgccctgcggttgctcagggcgccgaacgtggtcctgtcgccgcatgtcgccggcgtcacccgcgagacgctcgtccggatcgcactggccgccgtccagaacgccgccgacttcgtggccggcgagacgccgcgcgacctcgtgtcc

SEQ ID NO: 7460 - DNA, 1167 bp, Streptomyces avermitilis
  CDS (1)..(1167)
atggccaagcactgggccgacttccagtacgagatctatctgaacggaatgacgggtgccgtaccgcggctgcccaccgatctgactcggctggaggaactcaccgagcagcggctcggccccggtccggtcggctatgtggcgggcggcgcgggcaatggcagcaccgcccgcgccaaccggtccgcgctcgaccggcgccggatcgtgccccggatgctgcgtgatgtgcacgaacgcgacctgtccgtcgaggtgttggggcggacgctgcccgcgccgctggcgctcgccccggtcggcgtgctgtcgatcatgcacccggacgcggagtccgccgccgcgcgggccgccgccgcgcagggtgtcccgtacatcctgtcctcggcctccagcacccccatggagcgggtcgcggaggcgatgggcgacgcggagcgctggttccagctgtactgggcgaaggaccgcgaggtcacccggagcttcctgaaccgggcgaaggcggccgggtacaccgcgctgttcgtcaccctcgacacgccgctgctggcctggcggccgcgggatctcgaccaggcgtatctgccgttcctgcacggcgtgggcaccgccaactacttcaccgacccggcgttccgggcgggcctggccaagccggtgcacgaggatccgaacgctgccgtgatgcacttcgtgagcatgttcgcggaccccggcaagacctggcccgacctcgagttcctgcgggagaactgggacggcccgatcgtcctcaagggcatcctgcacccggacgacgcccggcgggccgcgagcgccgggatggacggtgtggtcgtctccaaccacggcggccgccaggtcgccggttccgtggcggcggccgacgcgctgccgcgtgtggtggaggcggcgggcgaccggctgaccgtcctcttcgacagtgggatccgcacgggcgacgacatcttcaaggcgctcgcgctcggcgcgcgggcggtgctcgtcggacgaccgtacgcgtacgggctcggactcgacgggcaggcgggcgtcgagcacgtcgtgcgctgtctgctcgccgagttcgacctcaccctggcgctgtccgggcacgccgggccggggacgctcagccccgacgacctgatcgaggaaaccgta

SEQ ID NO: 7461 - DNA, 459 bp, Streptomyces avermitilis
  CDS (1)..(459)
gtgccggacatggacgaggacgaggcgcgccgccggttcatggcggcgcgggtggcacgcctggcgacggtggacaccgagggacgcccccacctggtgccggtcgtgttcgctcggcacggcgccgaggtcgtcaccgccgtcgactggaagcccaagaggtcgccgcgcctcaagcggctgcgcaacatcgccgcccacccggccgtctgcctgctcgtggacgcgtacgacgaggactgggaccggctgtggtgggtgcgggcggacggccgcgcccgcatcctgccgcccgacgcgccggagccccgcgtccgggaggagtacgccgcggtgctcgccgtgctgcgggagaagtacgcgccgtaccggcagcggccgccgggcggtccggtgatcgcgatcaccgtgcaccggtggcacggctggcgcgccgcgccgggggccgacccgaccggc

SEQ ID NO: 7462 - DNA, 825 bp, Streptomyces avermitilis
  CDS (1)..(825)
atgaagttcggagtgtcgacgttcctcaccgacgagggcatcggtccggcggcgctggggccggccctggaggagcgcgggttcgacgcgctgctcctggccgagcactcgcacatcccggtgaagcgggagacgccgtacccgggcggcggcgagctgccgcgcgtgtactaccgcacgctcgatccgttcgtggcgctcggcgcggtcgcctcggtgaccagcgagctgcttctgggcacggggatcgcgctggtggtccagcgcgatccgatccacacggcgaaggaagtggccagcctcgatctggtctccggcggccgtgccgtgttcggtgtcggcgccggctggaaccgggaggagatgcgcaaccaccggacggatccgaccgaacgtggccggctgatggacgaacggatccgcgcgatcatcgaactgtggaccaaggacgaggccgagttccacggcgacttcgtcgacttcgcccccgtctactcctggcccaagcccgtccagcggccgcacccgccgatctgggtcggcggcggcagcgagcgcaccttcgcccgtgtcgccgagtacggggcggcgtggatgcccagcggagtaccgcccaaggagctgggcgcgcagatcgagcgcatgcgcaagacggccggagaccggccggccgtggtggtgtacgcggcccagcacgaccgggagtcgctcgacacctacgcggaactcggcgtcgagcgcgtcctgctctatctgccgacccagccggaggacgagacgctgcgcacgctggacgagctggccgaggccgtgtccgcctaccgg

SEQ ID NO: 7463 - DNA, 474 bp, Streptomyces avermitilis
  CDS (1)..(474)
gtggcggtcgaccgggaggagatcaccgttgtcggccgcattcccgagccccggctcaccgacggcgcctcggccgccgagaaggaggccgcggtccagtcccgggtccaggagttccgcgagcgcacccgtgacgagcgggtcgcggtggcacgtgaggcggagcaccggttccgcaggaaggtctcctggggggtggagtgcgggggcgagcgcgccctgttcacgcaggtcgccgcccccgtcatgacccggctgcggcagcccgagcgccaggtcctcgacaccctcatcgccgcgggagtcgcccgcagccgcagcgacgccctcgcctggtgcgtacgactggtccagcgccacacggacgactggctcgcggagctgcgcgactcgctggaacatgtgcagcgggtacgggcgcagggcccggacgccgacccccaggacagcgccgacagccccgccgccgaggag

SEQ ID NO: 7464 - DNA, 432 bp, Streptomyces avermitilis
  CDS (1)..(432)
atgccgaacaccgcacgctgggcagtgaccctgaccctgaccgccaccgccgtctgcggccccctcgccggggcttccctcgccaccccgaacgccgccgcctccgggctctacgccccctcggccctggtgctcaccacgggccacggccagagcgcggccaccgccacccctgagcgcgccgtcacgctgaactgcgccccgaccgcctcgggcacccatccggccgccgtctccgcctgtgccgaactgcgggcgacgggcggcgacttcgatgccttgagtgccagaagcgatgccatgtgtacccggcagtacgaccctgtggtcgtcacggtcgagggcgtgtggcagggcaagcgcgtcgcgtacgagcgcaccttcgccaacgagtgcgtgaagaactcctacgggacgaccgtcttcacgttc

SEQ ID NO: 7465 - DNA, 228 bp, Streptomyces avermitilis
  CDS (1)..(228)
atggcggtcggcacccgacgatccggaagcggaggcacgtacgtgaagttcgttctcgaagtcgacctggagaacgcggcctggggcgaggagaccgccacggagctggggcggatcctgcgctactggggcggcaatctccaccactacgagatgaagcccggcgacggctccgccgtatacgactccggctatcgcgaagtggggcgctggtccctcacgtccgac

SEQ ID NO: 7466 - DNA, 582 bp, Streptomyces avermitilis
  CDS (1)..(582)
gtgatggcagttgcgggagccgaagcccccgcacttaatgcatatgatgtgcaggtgcatgaatgcagcatcagggcggcgacccccggcgacctcgacggtgcgcgagccgtgatgctcgacaccgtctaccgcgacttcggcaccggctacgttccgcgctggcacggcgacatcatcgatctcgcgggcgcctacctggcctcgccccgccacactctgctggtcgcgctcgatggctccgacggcgaggtcgccgctacggccgccctcgactcccgcggcccggcccatccgcccaacccccgcccgctggcccggcgttacccgtcgggggagacagcgcagctgcggcgcgtgtacgtccgcccggggcaccgcagacgcggcctggcccgccgcctggtcggcgagctcctcgccttcgcggccgcggacggcggctaccgctccgtctatctgcacacggatccggggatcccgggcgccgaggccttctggcgctcgctcggaaaggccgtgtgggacgagcgcgaggagccaggcggttccggtgtcgtccacttcgaagtccccttcgcc

SEQ ID NO: 7467 - DNA, 1575 bp, Streptomyces avermitilis
  CDS (1)..(1575)
atgcgctttctcggcgagctggaccagcggctgttcacccgggtggccgccgcgcggctttccggcgccgatccggcgctcatccggctcagccgcgccgccgaccacgggcggctgtggttcgccgcggccgccgtgctcgcgacggccgacgggcgcaccgccagacgcgccgccgtgcgcggtgtcggctccctcgcgctggcctcgctcaccgtcaacaccgtcgccaagtgggccaccaggcgcccccggccgctgctcgacctcgtaccgcagatccgccacctcacccggcagccgcacaccacctccttcccgtcgggacactccgcctcggcggcggcgttcgcgaccggcgtcgccctcgagtccaccggctacggcgcactggtcgcgccgctggccgcggcggtcgccttctctcgggtctatgtcggcgtgcactaccccggggacgtcctggccggtatggcgatcggcgccggcgccgccgcgctcacctgccgctggtggccgccgcgccaaggggtcccggaacgggtgcgtcccaccacccacgcacccgcgctgccgggcggcgaggacctggtcgtcctcgtcgacgggcgggccggaaccggactgcccggcgcggtcctgccggccgtcgagcgcctgcgcgtcctgctgccccgggccgaactcgtcgagttcggcccggacgacgacttcgccgcgctgctcgccggggcggccggccgggccgcgcggcgcggcggcgcgctgggcgtgtgcgggggcgacggcagcgtcgacgcggcggcgcgcgccgcggcccgccacgggctcgcgctcgccgtgttccccggcggcaccctcaaccacttcgccctggacgtgggcgtcccggacttcgacgacaccgccgtcgcggtcgcccggggcgaggccgtcgcggtggacttgggagtggcggcaccgaaggaggggcacgacgtgctcttcctcaacgccttcagcatcgggccgtatcccgaactcctccggctccgcgagcgactggaggggcgatggggcaagtggtccgccgaggccgtcgccctcgcccgggtcctgcgcaccgcgacccccgtggaactgcgtatcgacggccgcccccgacgcctgtggctgctcttcgccggcaacggccaccacgtccccgacggcttcgcccccgccttccggccgcgcctggacgacggactgctcgacctgcgcctgatcgacggcgaccgccgctacgcccgtacgcgcgtgatcgccgccgcgctcgccggcacgctcggccgttcccgggtctacagcgccgcccctgtgtcccgggtccggctggagggcctcggcggcacgcggaacctcgcctacgacggtgaagtcacctgcgcgccggatcagttgacgctggagaagcgtggtcgcggactcgccgtgtaccggccggccgtgccgtgcgccgaaccggcccggcgggcccgcctcgccaccgcgatggcccaccaccgaaagcggaagaggggccgccgtctccctgcggacggcggcccctcggtc

SEQ ID NO: 7468 - DNA, 1500 bp, Streptomyces avermitilis
  CDS (1)..(1500)
atgtcccagaagactctgaccgaaagcacccggacgggtgccgcgcaggcgccgcccgcggcctcgtcccggcggtggtggatcctcgcggtcgtcgccatagcccagttgatggtcgtcctcgacgccaccatcgtgaacatcgctctgccgtcggcgcaggcggacctcgggttctccgacggcaaccggcagtgggtcgtcaccgcgtacgcgctggcgttcgcctcgctgctcctgctcggcggccgcatcgccgacctcttcggccgcaagcccgccttcctggccggcgtcaccggattcgcgctggcctccgcgctcggcggcgccgcgacgagcttcgagatgctggtcaccgcacgtgccctgcaaggggtcttcggcgcgctcctcgcgcccgccgcgctctcgctcctgaacacgacgttcaccgacgcgcgggagcgggccaaggcgttcagcgtgtacggcgccatcgccggcgccggtggcgcggtgggcctgttgctcggcggcatcctgaccgacgcgttcgactggcgctggacgctgtacgtcaacgtggccatcgccgtggtcgccttcgccggcggctggttgtcgctgagcaaccaccgcgacgccacgaactccaagctggacgtgccgggtacggtgctggtcgccggaggtctcttcgccctggtctacggcttctccaacgccgagacgcacgactggggttcgccgcggacctggggcttcctgatcgccggcggtgtgctgctgacggccttcgcctggtggcagacgcgtgccgcacacccgctgctgccgctgcgcatcctgctcgaccgcagccgcggtgcctcgtacctcgccgtgctcatcaccggcgcgggcatgttcggtgtattcctcttcctcacctactaccttcagctgaacctgggcttcagccccaccaggaccggtgtggcgttcctgccgatggtcggggcgctgatggtgacggcgcagctcggcaccacggtgctgctgccgcggatcgggccgaaggccgtcatcccgctgggcttcgcgatcgccacggtcggcatggcctggctgaccggcatcggaaccggttcgcactacgcgaccgcggtgctgccgcagctgatcgtgatcggcgtgggcctcggcatggtgatgccgccggccatgcagctcgccaccggcggggtggggcccgaggacgcgggtgtcgcctccgcgacggtcaacgccatgcagcaggtgggcggttcgatcggtacggcgctgctgaacacgctggccgcgagcgccgcgaccggctatctgtccggcaaggacgcgaccagcaagctggtccgggcacaggcgacgatcgagagctacaccaccgcgttctggtggtcggcggtcttcttcgtcgcgggcgcggtgatcgcgttcctgctctatcgccccgggaagcctgagcaggccgcggacgccgcaccggtcgtccacatg

SEQ ID NO: 7469 - DNA, 564 bp, Streptomyces avermitilis
  CDS (1)..(564)
gtgagccgcgacgcccccccgcccaaggaccgaggcaccatgtcaaccgaactcaccggtacccacctcaccctccccgacggccgccccgccgtccgtttcagccgtgtctacgaccatcccgccgaccgcgtctggcagttcgtgaccgaccccgacgagctggcccggtggttcccctcccgcgccgagatcgagctgcgccccggcggcacgatcacgttcagcggcgacccgaacatggagaactccacgggccgggtcatcgccgtcgacgtgcccgggcacctgtccttcgagtggggcggcgacgaactccacttcgacctcgaacccctggacggcaagcgcacccgctgcacgctcaccaacgtcctggcggacgcgaaggccgccgcccgcaacgccgccggatgggaggtctgcctcgccgccctggacgcgagggcgcggggcgagcggctcgaaggcccgcacgcgggtgccacggcgccctggaaggagatctaccgcggctacgtcgaggcggggttcccctccggtgctccggtcccgggcctggac

SEQ ID NO: 7470 - DNA, 2814 bp, Streptomyces avermitilis
  CDS (1)..(2814)
atgacggcggttcacgagggcgacctcgtcctcggtgccctgggttcgatgggcaccccgtacgactgctcggggctcggccgcctcgatctggaagggccgcaggtgctgtggctggtggcggccggcgccatggacctgttcgcggtggacgccgtccagcagggccagtggcaccacctcggccgtctcgaagcgggctcgctgctgctcggcccggtcgcgggaccgcagcacaccctggtcgccaggccgctgcgggagtgcgtgatgcgccggatctcgctgcgcgagctgtacgagtccgggggcacccagacctggtcgtacgacgagtacggcaacgcccagtacgttccgccgaccacgagtccgctggagtacgccctcgccctgggcgtcggccgcggcctctccatcctcttccaggcgccgatggccaccgagcgggccgccgcgccgaccgacgacgacgtcttctggatgcaggtcccgccgggtagcgtgcagtacggctcgctgtacggcgaggaggcggcggccgacctgctgatggatcccggcgtctggcagggcatggtcgaccagcagtaccggctgctcgccaccctcgaccggtggatcgagcagttggagcgcagccacgagcaccgtacggcggcgggtatcaaggcgggcgaggccgtgcgcgtccaggccgaccgcacgctgctggcgtccatcgggaagtcgtcggcgaagcgcaccaccgcggccgacgccgatgccacgtacgcggcctgcaagctggtcgccggcgcggccgggatcgcgctcgccgagcccgcgcagagcggcaccgagagcgaccggctcgacccggtggagcgcgtcgcgatcgcctcgcgtgtccgcacccgggccgtacggctcgacggccgctggtggcgcgacaacacgggcccgctggtgggccaccgggccctgtccggcgcgccggtcgcgctgctgtggcggcgcggcggatacgtcgccgtgcagccctcgtccggccgcgagacgccgatcgagaaggccaacgcggaggagttcgagccgcgtgccgtcatgttctaccgcccgctgcccgagcggggtctgggtccgctgcggctgatgcggttcagcatgcggggcaccggcggcgatctgcgcaatctcctggccagtggtctggtgacggtggcggtcggcgccctcgtgccgatcgccaccggcaaggtgctcggcgagtacgtgccgaaggcccagcacggtctgatcgtccaggtctgtctggccatcatgatcacgagcgtcgtgtcggcggcgttcatgctgctccagaacctcaccctcctgcggatggaggggcggatcgaggcgacgctccagccggccgtctgggaccggctgctcaggctcccgacgaagttcttcacctcccgctccaccggcgagctggccagcgcggcgatgggtatcagctcgatacgccggctgctggcgggcgtcggccccacggtcgcccagtcggtcaccgtcggcgcgatgaacctgggactgttgttctggtacagcgcgccgatggcgctggcggcgatcgggatgctggtcgtcatcgccggtgtgttcctggggctcggcctgtggcaggtgcgctggcagcgccgtctcgtcgtgctcagcaacaagctgaacaaccaggcgttccagactctgcgcggtctgcccaagctgcgggtcgcggcggccgagaactacgcgtacgccgcctgggcgggcgagttcgcgcgcagccgtgagctccagcagaaggtcggccgcatcaagaacctcaccacggtgctgggcgcggtgtatctgccgctctgctcgctgctgatgttcatgctgctcgcgggcccggcgcggggggcgatgtcggcggccgcgttcctcaccttcaacacctcggtgaccatgctgctgacgtcggtcacccagctgaccggcgccttcgtctcggcggtggccgcgctgccgatgttcgaggagatcaagccggtgctcgacgcgactccggaggtgcgcacggcgagcacccgccccggcgtcctgtccggcggcatcgaggcgcggcgcctctccttccggtacgcggacgacggtccgctcgtcctcgacgacgtgtccttcgagatcaagccgggcgagttcgtggcgatcgtcggcccgagcggctgcggcaagtccacgctgctgcggctgctgatcggcttcgacaagccggtctcgggaagtgtcctgtacgacggccaggacctgggcgccctcgaccagtcggccgtacgccggcagtgcggtgtcgtactgcagcacgcccagcccttcaccgggtcgatcctggactgcatctgcggcaccgagccgtacacgcccgaggaggcgatggcggcggccgagatggcggggctcgccgaggacatcaagcggatgccgatggggctgcacaccatcgtccagggcagcggggcgatctccggcggccagcggcagcggctgatgatcgcccaggcgctgatccgccgaccgcgcatcctcttcttcgacgaggccaccagcgccctcgacaacgagacgcagcgcacggtcatcgagagcacgaaggccctcaacgccacccgtgtcgtgatcgcccaccggctgtccacggtgatggacgcggaccgcgtgatcgtgatggaggacggccgggtcgcccagcaggggccgcccgcgcagctgctcgcggacacgggcgggcggctgcacgagctggtgcggcggcagctggcg

SEQ ID NO: 7471 - DNA, 2247 bp, Streptomyces avermitilis
  CDS (1)..(2247)
ttggctgctcccgtgaccgctccccaggacaccctgccgccgtcggcgcgcggcagacggcgggccgccccgccgaagcgcacggtccccaagagccggcagaagaccgtacgcacccccaccgtcctccagatggaggccgtcgagtgcggcgccgcctccctcgccatggtgctcggccactacggccggcacatccccctcgaggaactgcgcatcgcctgcggtgtctcccgggacggctcgcgggccagcaacctcctcaaggcggcccgtagttacggcctgacggccaagggcatgcagatggacacggccgcgctcgccgaggtgaaggcgcccgcgatcctgttctgggagttcaaccactacgtcgtgtacgacggcatggggcgccgcttcggccggcggggcgtgcacatcaacgaccccggcaagggccgccggttcgtgcccatggaggacttcgacaccagcttcaccggcgtcgtcctggtcatggagccgggccccgacttcgagaagggcggccgcaggccgggtgtcctgggcgccatgccggcccggctgcgcggcacctcgggcaccatgcccgccgccgtcctcgcgagcctgctgctggtggcggtgggcgcggcgatgcccgcgctgagccgtacctacatcgacatgttcctgatcggcggccagacctcgctgctcggcgtgctgttcgcgtcgatgggcacctgtgtggcgctgacgatcgcgctgacctggctgcaacaggcgaacctgctgcacggccgcgtcatctcctccacgctctccagtgcccgcttcctgcggcacctgctgcggcttccggtcaccttcttctcccagcgcagcccggccgacctggtccagcggctccagtcgaacgacgcggtcgccgagaccctggcccgtgacctcgcggcggccggcgtcgacgcgatcgtcgtcgtgctctacgcggtcctcctctacacctacgacccgcagctgacggccgtcggcatcggcgtcgcactgctcaacgtcgtggccatgcgggtcgtcatacggctgcgggcgacgcgtaccgcgaagctgcgcgccgacagcgcccggctgaccaacacggcctacaccggtctccagctgatcgagacgatgaaggcgaccggcggcgaggacggctacttccgcaagtgggccgggcagcacgccaccacgctggaggagcagcagcgcctcggggtgccgagcgcctggctgggcgtggtcgcgccgacgctcgcgacgctcaacagcgcgctgattctctggatcggcggcctgcgcgcggtggagggcggcatctcggtcggtctccttgtcgcgttccaggccctcgtcacccgcttcaccgcgccgatcacccgcctcaacggtgtcgcgggccgcatccaggacttcgcggccgacgtggcacgtctcaaggacgtcgagaacttccaggccgacccgctctacgcccgccccggcggtggcgagtcgacccggcggctgcagggccatgtcgaactggagaacatcacgttcggctacagcccgctcgaccagccgctgctgagcgggttcagcctgacggtcggccccggacagcaggtggcgctggtgggcggttccggaagcggcaagtccacggtctcccggctgatatcgggtctctacgccccctgggagggcgtgatccgcatcgacgggcagcggctggcggacatcccgcgcggggcgctcgcggcttcggtctccttcgtggaccaggacgtgttcctcttcgaggggacggtccgcgacaacgtggcgctgtgggacccgtcgatcccggacgacgcggtggtcgcggcgcttcaggacgcggacctgtacgacgtcgtcacgcgccgcccgggcggcatccacagccgggtcgagcaggacgggcgcaacttctccggcggtcagcgccagcgcctggagatcgcgcgggcgctggtgcgcaaccccagcatcctggtcctcgacgaggtgacgagcgcgctggacgcggagaccgagcagacggtcatcgacaatctgcgcaagcgcggctgtgcctgtgtggtgatcgcgcaccggctcagcaccgtgcgcgacagcgacgagatcgtggtgctccagcacggcacgatcgtggaacgggggcggcacgacgccctggtgacggccggcggcgcgtatgcccagctggtcagggagcgg

SEQ ID NO: 7472 - DNA, 804 bp, Streptomyces avermitilis
  CDS (1)..(804)
gtgcagttccgccaacaggccctcgccaagctgcagtcgcccgaagagctcgacctcccggtgcgcttcgcacgcccccagggctggctcgtcctgtccgtgacggtcgtcgtcatggcggccgcctccgtgtgggccgtgacgggctccgtcgcctccacggtcggcgcacccgccgtcctcacgcacggcgagggcagttacgtcctgcaaagccccgtcgcggggcaggtgaccgcggtcctcgccaaggagggcgagcggctgccggcgaactcgcccgtcctcaaggtccgtacggacgacggcgacactctggtgcgcaccgtcgccgcgggccggatcaccgcgctcgccgccacgatcggcgcgatcatccagaccggcgcgaacgtcgccgccgtggagaaggtcgcccacgcctcggacccgctgtacgcgacggtgtacgtcccggccgagaacgcctcctcgattccggcgaacgcggcggtggacctgaccgtccagtcggtgccgacccagcagtacggggtgctgcacggccatgtgaagtccgtcgaccggaccgtccagacccggcagcagatcgccgcgttcctcggcgacagccagctgggcgagcagttcaccaagaagggccggccggtggccgtcctggtccggctcgaccggtcgtccggcacgaagagcggctaccagtggtcctcagcggacgggccgccgtacaccctcgcttccatgaccctggccacgggttcgatccggctggccgatcagcgtcccgtcgattggctgctcccg

SEQ ID NO: 7473 - DNA, 213 bp, Streptomyces avermitilis
  CDS (1)..(213)
atgaactccaccccccaggttgtgaccgccgagatctccgacgccgacctcgacgccgtctcgggcggtctgtccctgaacgccgttggcaccgtcaccggcctggtcgacggcgttgccccggtctccgccgtcgtcggcacggccgtcggcacggtcgagggtgtgaccggcctgaacaccgccccggtcaccaacctggtcgccggtctc

SEQ ID NO: 7474 - DNA, 438 bp, Streptomyces avermitilis
  CDS (1)..(438)
gtgtgggccggcgggcaccatcacgccatgacggtgacccctgcccaagccggaaagatcctcgccgacaacttcgcgccctgggtgctcgatctcggcctgtcggtcgaggaggtggacgaccgccgggtggtgctccggctgccgtggtccgcgcgactcgcccgggagggcggcgcgttgtcgggccaggcgttgctggccgccgccgacacggcgacggtgatcgcggtgtcggcggcgcgcggcggcttcgtccccatgacgacggttcagcagtccaccagcttccagcgcgcggtcacggaggccgatgtgctggtcgaggcggtactcacgcgcctgggccgccggatggccttcgccgacatcacgatgaccgccgagggccgcgacgagatcgcggcccgggcgagcacggtgtacgcgcttctggac

SEQ ID NO: 7475 - DNA, 1356 bp, Streptomyces avermitilis
  CDS (1)..(1356)
ttgagtcacaaacgcatacccaagcgcaaggccgcgatcgcagcgggaagcgtggcggcgctcggagcggcggcacttctactccccaatgccaacgcttcccagacggactcgggggactccaccccgaggacgttcaagtcggccgatgtctcggacctcgcctcacagctcgcctcgcagcttggtgacgccttcgccggttcgtactacaacgccgacaagcagcagctcgtcatcaatgtcgtcggcgacgacagcaacgtgatcaaccagatcagaaaggccggcgcggtccccaaccaggtgcagaacagcacctccacgctccaggccgcggccaagacgctcaagaccgatgccaccatccccggcacggcctgggcggtcgacccgaagacgaacgagatccgggtcaccgccgactccaccgtcaagggcgccaagtgggacacgctgacggcgacggtcaagagcctcggctcgggcgtggcgaccgtgaagaagtccgcgggcacgttcaagacgttcgtatcgggcggcgacgccatcttcggcggcggtgcgcgctgttcgctgggcttcaacgtcaccgcgggcgacggcagcccggcgttcctgaccgcggggcactgcggtgtcgcggccgccgcatggtcggactcgcagaacggccagccgatcgccaccgtcgaccaggccaccttccccggcgagggtgacttctcgctcgtcaagtacgacgacccgaacacgcaggcgccgagcgaggtcaacgtcggcaacgggcagaccgtccagatctcccaggccgcggaagccacggtgggccagcaggtcttgcggatgggcagcaccacgggcctcaacgacggcaacgtcaccggcctcgacgccacggtcaactaccccgagggcacggtcaccggtctcatccagaccgatgtctgcgccgagccgggcgacagcggcggctccctgttcacgcaggacggcagcgcgatcggcctgacctccggcggcagcggggactgcaccgtcggcggcgagaccttcttccagccggtcaccacggcgctggaggcggtcggcgcgacgctcggtgcgggtggcgccgcgggcgccggcgacgagtccgccgcgcccggcgatgaggcgaccgaccccgcgggcgaggcgaccgacccggcaggcgaggcgaccgacccggcaggcgaggccaccgacccggccggtgaggcgaccgatccggccgaccagtcgggcaacgacggcgccgagcagtcgggcaacgacggcgccgaccagtcgggcaacgacggcgccgacgacggctccggcctggtgtcgagcaac

SEQ ID NO: 7476 - DNA, 2136 bp, Streptomyces avermitilis
  CDS (1)..(2136)
gtgtccgacgggcaggcgtcccggcgggagccgtccgccctggcgccggtcggcggtccactgctgtcgctggcgctggccgcgctgatggaagacgtgcacgcccactccggggcggtgtatctgctggcccccgacgagccggtcctggagatggcggtcatggcggggctgccccgggccttcgccgcaccctgggagcgggtgggcctgagcgcgccgctcccggtcgccgaggcggtgcgggagcggcggctggtctgggtgaacggcgaggagcagatggcgggccgctatccgcgcgtcgcggtggtcctcccctactcgttcgcgctggcggcgctgcccttggcgtgcgccgacaccgtgtacggcgcgctcttcgtgacctggccggactcgcacccgcccgagctgtcgagccgcgagcgcgaccagctaggcgtggcctgcgaccggctcgcgacccggctggcacacgccgtcgagaagggccacccggtgggtcccgaacctgatctgccgaccccgggcgccacggcggcgatggcgggcacgctgggcgccggggaggcggtccggatggcggcccggctgccgtacgggctgtgtgcgctcgatctgcacgggcgggtcggctacgccaacgcggcggcctgcgagctgctcggcatgccggtcggcgacctgctcggcgcccagctgtgggcttcgctgccctggctcaacgaccccgcgtacgaggactgctaccgcgcggcgctgatcagccagcatgtgacgtcgttcgtggcgctgcgcccgccgggcgactggctctccttccgcctctacccgagcaccaacgggctgagcgtgcgcatctcccgcgcccgggcggtctccgcgatggcccgggcggagccgcggcacggcgaggccacgacgcggctggtgacgatctcccatgtgctgagcctggccggcgccctcaccgaggcggtgggggtgcaggacgtggtgcagctgatcgcgtcggagttcgcacccaccgtgggcagccaggccctgatcctgctcggatcgcggggcgggcggctgcgtgtgctcgggcaccgcggctatccggacgccgcgatcgcggagcgcttcgacggcgaaccgctcaccgcgcagatccccggcgcccacgtcctgaccagcggagtgcccgccttcttcgagtcccgcaggcagttggagcacctgtatccggcacggcgcacgacgcctgacgggatggccgcgtgggcctttctgccgctcatcgcctcgggacgtccggtcggcacctgcgttctcgcgtacgccgagccgcatgcgttcccggcggacgaacgggcgatcctgaccagcctcagcgggctcatcgcgctcgcgctggaacgggcgctgctgtacgacgccaagcaccagctcgcccacggactgcaagcggcgctgctgccgcactccctgccgtcgctgcccggcatcgaagcggcggcccgctatcttcccgccacccagggcatggagatcggcggcgacttctacgacctggtggcgaccgtcggccgggccgccgcggtgatcggggacgtgcaggggcacaacgtcacggccgcggggctgatgggccagatccgtacggcggtccgcgcgtacacgacggtcgggcaggcgccggggcaggtcatgcgcagcaccaaccggctgatgatcgacctgggcaccgacctcttcgcgagctgtgtctatctgcgtctcgaccccgcgcggcagcgggtggtcatggcccgggcggggcatccgccgccgctgctcaggaagcccgacggacaggtgcgggtgctggacctggccggtggcccgctgctcgggatcgacgcggacgccacctatacgacgaccgagttcgcgctcgcgccgggttccgtgctcgcgctctacacggacgggctgatcgagtccccgggaatcgacatcgaggacgccctggccgaactcggcgagcggctcgccgagagcggcgacgagccgctggacgagctggccgaccggctcgtgcggcacaccgcgacggccgaggaacggctcgacgacatcgcgttgctgttgctgagggcgcgggcttcc

SEQ ID NO: 7477 - DNA, 669 bp, Streptomyces avermitilis
  CDS (1)..(669)
atgggcacgcgctcaggacgggtggagcggctgacggctgacggggagttgagggcggacgtgatccgggtacttctggtgcacgacgcgtgtctggtgcgatcggtactggcggagtggctccgccgggaaccggatctcggggtgtacgacacgacgtggcgcggcgcacccgggcgggtgcgctcggtgcggccggacgtctgcgcggtggacctggactgcgcggactcccacggcgtgccgccgctggccgacgtgtgcggccggggcgcgggcagcctgacggccccccggcttctggtgctcgcccatgcgaacagaccgggcctgctgaagcgggcggcggaggcgggggcgctcgggtacgtggacaaggagggctcgcctgagcggctggtgtccgggatccgcagggtcgccgagggggaacgtttcgtcgacgactcgctgggcttcggcttcctcaaggccgcggagatgccgctgaccagacgcgagctgagcgtcctgtcactcgccgccgggggcgcctccgtcgcggagatcgccggaagtctccatctgtcccacggcaccgtgcgcaactacatgtccgccatcacgcgcaagaccggggcacgcaaccggatcgacgccatccggatctcgcagggggagggctgggtc

SEQ ID NO: 7478 - DNA, 1893 bp, Streptomyces avermitilis
  CDS (1)..(1893)
gtgaaggaactgacgctcctgttgcgcgaacggtggcgagtggtcgtccggctggccgcgtggtcggtgctggagacgggacagacgtttctgctggggtacgccctggcgcgggccctcgacgagggtttcctgtccgggcgggcgggggtggggctgggctggctgggcatcgcgggggcggcggttctcgtcggggccttcgggaccgggcgggtgtacgggggtgtcgccgcgctcgtcgagccgttgcgcgaccgactggtgcgacgtgtggtcgaccgaggggtgcgggaggccgacggcggggcgctctccgggctgacacagcaagtggagatcgcccgcgacacgttcgccggtctggtgatggtgtcgcgctcgttcgtgttcaccacggtcggcgccctcgtcgggctgttctcgctcgcgccgctgctcctgctcgtggtcgctcccccgctcgccgcgggggtggccctctttgtggcgaccctgcggccactggcccgccggcaggaggagttcctcgtcgccgacgaacgcctcgccgcccacctgggggccgtctgccccggcctcagggacatcacggccggcggcgcggaggagcacgtagccgccgacgccggacagcgcatcgacgccgaggtgcgcgccgcccgctcactggcccaccggggcgtgctgcgcgtggcggccctcgccgtcggcggacagctcccgatcgtgctgctgctcgccaccgccccctggctcctcgcgcgcggcgtcagcgcgggcgcgctcgtcggcgctctcgcctacgtcacccagtccctgctccccgccctgcagaacctggtgcacggcctgggcacgagcggctcccggctggcggtggtgctgcgccgcctgggcccgggcatcgcggcaccaccgccggccaccggtggaatccgcgtgccgccggccgccgtgccctccgacacacccgcactcgttctctcctccctcaccttcgcctacggccccgccagtgaccccgtcatcaaggacctcgacctcaccgttccgcgcggcacccggctcgccgtcgtcggccccagcggcatcggcaagtccaccctcacgggactgatcgccggactcctcgaaccgcggcgcggcacggtccgtttgtgcgggcatccggtgcccggacacacagcgagcgcacttcgggtcctcatcccgcaggaggcgtacgtcttcggggggacgttcgaggaaaacctcacccaactgcggcctgatcccgtacccggggcggagctgctggccgccgccgaggcggtcggcctggccccgctgctggagcggctgggcgggccctttgcccggctcgacccggcggcgctgtccgcgggcgaacgacagctgatcgcgctgacccgggcgtatctctcgtacgcctcggtcgtgctgctcgacgaggcgacctgtcacctggaccccgcggcggaggagcgcgcggagcgcgcgttcgccgagcgtgccggcaccacgctcgtggtggtcgcccaccgcatcagctccgccctgcgcgcggaccgcgtgctcgtcatggacggccggcgcaccgagtacggcgaccacgacgagttgctgcggcgctcagccctgtaccgcgacctggtgggcacatggtcgcccaccgtccccgcctcctccggcgccgcctcggtgccggtcccggcccccgcccggcggcccgcctcagacccagccctccccctgcgagatccggatggcgtcgatccggttgcgtgccccggtcttgcgcgtgatggcggacatgtagttgcgcacggtgccgtgggacagatggagacttccggcgatctccgcgacggaggcgcccccggcggcgag

SEQ ID NO: 7479 - DNA, 1785 bp, Streptomyces avermitilis
  CDS (1)..(1785)
atgcgaggccacagccgtatgaagactccctccggtcacggagcggcaccggacggcaccggtgccgcggacgaggcggccgcccgcacgctgctgcgctcggccgcccggcacagccgttcccgctgcgtggccctgtgtctgacgaccgcggccgcttcgggcgcgagcctgctgctgccggccgccctgggccgggccctggacctgctgctgacccgccccggtgacgcggcgggaacgcactgggtgctgtggtgcaccggcctggtcctcctgatcgccctgctcgacgcctgccacaccgtgctcgcgggcacgaccgacgcccgggcgaccgcctggctgaggcagcgactggtcgggcatgtgctcgccgtgggtccccgggccggtgagcgcttcggccccggtgagctggtggcgcggctcgtcggcaacgcggcacaggccggaaccgctcccgccaccgccgcgacgctgctggccgccctcgccgggccggtgggcgcggtggtggccctcggcctgatcgatcccctgctggcagccgtgttcctcggcggagcaccggtcctgaccctgctgctgcgtgccttcgcgcgcgactcgtcccagtgcgtggcgcgttaccaggatgtccaggggcggatcgccggcgcgctcgcggaggcgatcggcggcgcgcgcaccatcgcggccggcgggacggcggacaaggaggtggcccgcatcctgcggccgctgccggaactctcccgcgaggggcggcggatgtggcgggtgcaagggcgcgccgcggcacaggcggtcgccgtggcaccgctgctccagctgggtgtggtggccgtggggggcgtgctcctcgtccatcaccggctgtccgtcggcgagttgctcgccgcctcgcggtacgccgtgctcgcgaccggcgtcggtgtgctggtcgggcagctctcggggctcatccgggcgcgggccgcggcccggcgcctcggcgaggtgctgaccgagcccgcaccggtgtacggcacgcgtcaactcccgcccggcgagggaaggttggagctacgctcggtcaccgtccggcgaggcgggcgtaccgtgctcgacggcgtcgacctggtcgtgcccgccggccgcacggtcgccgtggtgggccgctccggctcgggcaagtccctgctcgcggccctcgcgggacggctcgccgaccccgacgacgggcacgtactgctggacggcgtgcccctgcgcgacctggacaggaccgcactgcgccgagccgtcggccacgccttcgagcgccccgccctgctgggcgacaccatcgaggacaccatcgccttcggcatcccctctcccccgcccgaccgggtccggcaggccgccgccacggcgcgcgccgacagcttcgtacgccggctgcccgacggctacgccaccccctgtgccgaggccccgctgtcgggcggcgaatgccaacgcctcggcctcgcccgggcgttcgcccacgacagccgcctgctcgtcctggacgacgccctgtccagcctcgacacggtcaccgagcgccacatcaccgaggcactcctgcgccacaccccgggaagcagccggctgatcatcgcccaccgggtgtccacggccgcacgcgcggatgcggtggtctggctggcggcggggcgagtgcgcgcggtgggcacgcatgcggagctgtggcggtcggcggcgtaccgggaggtgttcgggtcgagcggcaccgagcggaacggcggcgcgggg

SEQ ID NO: 7480 - DNA, 114 bp, Streptomyces avermitilis
  CDS (1)..(114)
atggcacttctcgacctgcagacgatggagtccgacgagcacaccggcggcggcggcgcgagcaccgtgagcctgctctcctgcgtctccgcggcgagcgttctgctctgtctc

SEQ ID NO: 7481 - DNA, 2646 bp, Streptomyces avermitilis
  CDS (1)..(2646)
atggacaagcggtacgaggtgtacgcgctggcggacagacacttctacgagacgcccgaccggctgtccgtgggagcgtccggtgccgctccgctgtacgggccggcgtgccgcgaggtgcccgacgggtggcggagcgcgcggatcggcgactggctgacgttcacgccggtcgacgacgccgggaccgcgctgccggggccggcccagggatggaagatccacgcctcggccacccgggcgaacgcggagcggatcgccacggacgtgtgggagtactgcgtcccgcgccggatccccttcaagttcgtaccggggccccatctgctgcacttacgcaacgccaagtacgcgggccgcgacaccagcggcaagttcgtcaccatctatcccgccgacgaggagcagctgcacctcgtgctgcgcgagctgggcgagcggctcgacgggtgcgaggggccgtacatcctcacggacctgcgctggaacgacggtcccctgtacgtgcggtacggcgccttcgcccgctccttcgtggtggacgagcgcggctcactcgtcccggcggtccgcgacggcgaggggacgctggtgccggaccggcggcagccctccttccaggttccggagtgggtcacgctgcccgcgttcctcgaaccgcagctcgcggcgcgcaacaccacgacggtcggcgacctgccgtaccgcatcgagaaggccctgcacttctccaacggcggcggggtgtacgcgggcaccgacacccgggacggccgcaaggtggtcctcaaggagggccggccgcacgcggggctcgcctcggacggggccgacgcgatcgcccgcctggagcgcgagaagtacgcgctggagcaggtgtcggggctcggtgtggtgcccgaggtgcgggactggttcacactcggcgaccaccgcttcctcgtcatggactttctggaggggcggcccctcaactccttcttcgccgagcggcacccgctgctcacgccggatcccgagccggacgccgtcgccgcctacacggcctgggcgctgcgcatccaccgggcggtcgagcaggccgtgcacgcggtgcacgcgcgcggcatcgtcttcaacgacctgcacgtgttcaacatcatggtcgcgccggacgaggagtcggtgtccctgctcgacttcgaggcggcggccccgatcgaggagaacggccgccaggtcgtcgcccatccgggcttcttcgcgccgccggaccgcacgggcccggacgtcgaccggtacgcgctcgcgtgtctgcgcctcgccctgttcctgccggtcaccacgctcttcgtggtcgaccgcgccaaggccgcgcatctggcggaggtcgtcgccggacagttccccgatgttccgcgggagttcctggacgaggcggtggcggagatcaccgggcgcaggcaggcaccggaccccgagggggacaaggtctccccttcggccacctcgcgcccgtctccggtcaggccgaccacctcgtacaccgcaccggtcgaccccggtgactggccctacagccgggactcgatggtcaaggccatcctcgcctcggccaccccggagcgcgacgaccggctcttccccggcgacgtcgcccagttctccgacggcggcgggctcgggctcgcacacggagccgcgggcgtgctgtacgtcctcgaacagaccggagccgaccggtacgaggagggcgagcgctggctgctcgaccacacggacccggcgccggtcgggacgcccctcggcctgtacgacgggctcgcgggcgtcgcctacgtcctcgacctgctcgggcaccggcagcgcgccctggacctggtcgacgggatcctccgggagcgctggcagaacctctcctccgacctgcacggaggcctcgccggactcggcctggtcctcggccggctcgcgcacaccaccggcgagacacaactgcgcgagcgggccgccgaggccgcgcgcctgctcgtccgacgactcgccgagccgcggcccgcccctccccgacggcgcgccgggctgctgcggggcgcgagcgggatcgccctcttcctgctcagggagtacgaggagaccggcgcccccgagctgcgcgacgcggccgccgaggcactgcggcaggacctggagtgctgcgtcgtccagaaaggcggcggcctggaggtcgacgagggctggcgcacgctgccgtacctcggggacgggagcgtgggcctcgggatggtcgtcgacgactttctcgcgctgggcggggacgacggccatggcacgttcgagggggcgcgttcgggcatcctcaccgccgccacctcccgcttctacgcgcagcccgggctcttccagggccgcgcgggcatgatcctccacctcagccgcacgagcgcgcccggcgccacccccgagcggctcgccgaacaggtcgccgggctcggctggttcgcgatgtcctaccagggccaactggccttccccggacaccagatgatgcgtctgtccatggacctgggcaccggaacggcagggtgcctgctcgcgctcggcgcggccctcgacggacagacgcgggcccggctgccgttcctcccgccgcttcgcggcgcccac

SEQ ID NO: 7482 - DNA, 2541 bp, Streptomyces avermitilis
  CDS (1)..(2541)
atgccggaatggtcacaggggctgcgcccacgtcccggaagcgctgtaattgcggacgtggccagtgagcgcgttgcgggacgcggagcgagaacgtcgcgtgccgaacttgccctcaaatcgctcggcccggacctggaaccccgagaacgactgcaccgcatcctcgaacaggtactcgtttttgcgggagcgatggttgccgcggcctacacgcacagcgaggacggggaccagctgtgcctcgccgagtcggccggggtgccgaggagcctgtacgggctgcgcgactcctacccgctgaccggcggcacccccgcggcggacgtccaccgctccgggcagccgctctggctcacccccgaggacctcggccgctgcgccgatgcccgccggctgccgaacggggacttctccctggccgtgctgcccctgggcgacggcggttgcctggccgccgtcagcgagcgcgccggaggcttcgacgccgacgaccgcgagtgcctccggttgctggccgggtccgtcgcctgcccggccccggcggccccggccctgaccgggtccaccgactccggcgagccggccgacagctccttcagcctggccatggactccgggcggatcacggtcgacgacgaggtgctggagctgttcgggatcggcccggacgagttcgacggcaaggtcgagaccctgctcgcgctgaccgtgcccgaggacctgccgtccctgatgtcggtcgtggaacccggccacatgtccatcggcgaccgcgagctggagttccggatcctccagccctcaggcgggccgaggtggctgcggctgcgtggccgcctgctgcccgccgagcagggccgtccggcgctgctcgtggggtcggtcgcggacgcctcccggatgcgggcgggtgtcagcgacgtgacccgcgtccagcggctcgccgcggccctcgccaccgcgggcaccgtccgcgaggtcggccgggccgtggtgaccgccctgcgcaagccgctccaggccgaccggatcgcgctcgccgaactggagggcgaccggctcgtcgtcaccgtcctcgacccgcccgaaccggattcctggcccgaactgtggcgcagcgagtggcgctcggagtggcccgacgcgcccgtacgcgccatgccgaccctggcgtccgccctcagcgaggggcgcgccgcgatctggcccgccgggaccccgttggagccggcggtcgcggacgtcggccccggcggtctcgccgtgctgcccctggccgcgggcggccggatggccggcatctgtctgatcggctgggacgccccgcacgacttcggccccgacgaacgtgccctgctcaccgccgccgcgaatctcgcgggccaggccctgatgcgcgcccacgccttcgacgccgaacacgagctggtcggcatgctccagcgcagtctcctcccgcgccggctgccccgcctgcccggcgcggtcgccgtggcccgctatctgcccaccacggcgggcctggagctcggcggcgactggtacgacgtcatcccgctgcccgacaaccacgtcgccctcgtcatcggcgacgtccagggtcacaacgcccaggccgccaccctcatgggccagatgcgtacggccctgcgcgcgtacgccgtcgaagggcaccccccggacgtcgtcgtctcgcgcgccaaccggctcctcatggacctggagaccgacctcttcgccacctgctgctacgtcgacgtcgacatggaggagggctccgcctggtgcgtacgcgccggccacctgccgcccgtgctgcggcacccggacggcagtaccgaggtcgtcgagtccgagggcgggccgcccctcggcgtcgtcgcccaggccgacttcccgatgagtccgctgcggctccagcccggcacactgctcgccctgaccaccgacggcctggtcgagtccgccgagctcgacatcgaggtcggcctcgcccggatggccgccgaactcgccgcctccgaccccgcccacctcggcctcgtcgccgacgccctgctcgcgggcgccaaccgcagcgacgacgtggcactgctcctcatgcgctacgagggcatggcgctgcgcccgctgcgcgagagctggacggtgtggcgcgtcccggaggcggtgcggcacgcccgccgcttcacccggcgcaccctgcgttcctggggtgtggcggaggaagcggacgccgcgctcctggccgtctccgaactcgtcaccaacgccctcgtgcacaccgacggccgggtacgtctcgacctcaccctcatcaaccaccggctgcgcatcgccgtcgccgactcctcaccccgtacgccgatcaagcccaccagcatcggctgggaggccaccggcggccgcggcatcctcctcgtcgaggccatgtcggcggcctgggggagcgtcccggtcagcggcggcaaacaggtgtgggcggagatcgtcctggagtccgctccccgcgtgcgcgacgcgaccggcgcggcaccc

SEQ ID NO: 7483 - DNA, 501 bp, Streptomyces avermitilis
  CDS (1)..(501)
gtgcgcctcctgctgatgtccgacacccacctcccacggcgcgccaaggaactccccgcgcgtctcctcgccgaactcccccgcgccgacgcggtgatccacgccggcgactgggtggacgccgccacgctcgacctgctggagagccgctccacccggctgatcggcgtgtacggcaacaacgacggccccgacctgcgcgctcgcctcccggaagtggcccgcgccgaactcgacggtctacgcctcggcgtggtccacgagaccggcgccgcccagggccgcgaacgccgctgcgccgaccgcttcccggacctcgacgtcctggtcttcggccacagccacatcccctgggacacgacgacggacacgggcctgcgcctgctgaacccggggtcgccgacggatcggcgtcggcagccgtactgcacgtacatgacggcggccgtgacgggcggcagactgacggacgtacagctgcaccggttgccgccacggagt

SEQ ID NO: 7484 - DNA, 1104 bp, Streptomyces avermitilis
  CDS (1)..(1104)
atgcgggacatcctcccggcgctgagccggtggtacgcggcgaaatcccccttcggtctcgccacggtggtggcggtcggccgcagcgcgccgcgcgatcccggagcggcgatggccgtggggccggacgacgaggtggtgggcagcgtgtccggcggctgcgtcgagggcgcggtcttcgagctcgcccaggaggtcgtggactcgggtgcggcgcggctcgagacgttcgggtacagcgacgaggacgcgttcgccgtgggactcacctgcggaggcgagatcaccctgctggtgcgccgggtgacgccggacgaggacccgtcgttcggtgcgctggccgagtccgtggccgccggccggccggcgacggtggccacggtgaccgacggacccgcaccgcgcggggcctcgctcaccgtgtggccggagggggtggcggggtcactggggtcgacggggctggatgtggcggtcaccgcggacgcgcgcggcgaactcgcgctgggtgccacggggctgcggcactacgggccgaacggcgagcggcgcgaggactccgtcaccgtctttctgcactccttcgcgccgcccccgcggatgctggtcttcggtgccatcgactacgcggcggcggtggcccgcatcggcgacttcctcggctaccgggtcacggtgtgcgacgcccgcccggtcttcgccacgccgaagcgctttccggcgggcgtggaggtcgtcgtcgactggccgcagcgctttctgcgggggacgaccaccgacgcgcgcacggtgatctgcgtcctgacgcacgatctcaagttcgacgtgccgctgctggaggaagcgctgcgcaggcccgccgcgtacatcggggcgatgggcagccgtcgtacccacgacgaccggatgaagcggctgaccgacgcggggctctcgcggcacgaactgtcccggttgcgctcaccggtcgggctggacctcggggcgcgtacgcccgaggaggtggccgtgtccgtcgccgccgagatcgtcgcgctgcggtggggcggcagcgggacgccgctgaccgcgaccggcggggcgatccatccgcccaagccgcgg

SEQ ID NO: 7485 - DNA, 1989 bp, Streptomyces avermitilis
  CDS (1)..(1989)
gtgcacacgctgaacctcggaattctcgcgcacgtagacgccggtaagaccagcctgaccgagcggctgctgcacacggtcggggtgatcgacgagatcggcagcgtcgacgagggaaacacccagaccgattccctcgcgctggagcgtcagcgcggaatcaccatcaaatcggccgtcgtctccttcgcgatcaacgacaccacggtcaatctgatcgacaccccgggccaccccgacttcatcgccgaggtggagcgggtactgagcgtgctcgacggagcggtgctcgtcgtatcggccgtggagggcgtgcaggcccagacccgcgtgctgctgaggacgctgcaacggctgcggatccccaccctgctcttcgtgaacaagatcgaccgtggcggggcgggggaggagcgcgtcctgcgcgccatcgcggcacgcctgaccccggcgatcgtccccatgggccgggcggccggaccgggctcgcgcgacgcccgcttcatcccgtacgaggcccatgacccgggcttcggcgcgcggctgctcgacgtcctcaccgagcacgacgaggaactgctggccgcgtacgtgaaggacacggtgtcgtacggccggctgcgcaccgccctcgtcgagcagacccggcaggccctggtgcacccggtgttcttcgggtcggcgacgacgggtgcgggcgtgcccgaactgatcgccgggatcaaggagttgctgcccgccgccgagggagatcccgacgggccggtctcgggcacggtcttcaaggtcgagcggggaccggcaggggagaagatcgcgtacgcgcggctcttctccgggaccgtacgcacccgcgaccggctgctgttccgcgacggcgaggagggcaaggtcacggccatcagcgtcttcgaccagggttcggccgtccgggaggcgtccgtggccgccgggcggatcggcaagctctgggggctcgcggagatccgcatcggcgacaccttcggagaggtgccgaaagcggcggaaccgtcccgccatttctcaccgcccaccctggagacggtcgtcgtccccggcggacggagcgacggaggagccctgcacctcgcgctcacccaactcgccgaacaggacccgctgatcaatatgcggcaggacgaaatccgccgggagatctccctctccctgtacggagaagtgcagaaggaagtcatccaggcgaccctcgccgacgcgttcggactcgacgtcaccttccgcgagacgaccccgatctgcgtcgaacggccggtcggcaccggtgcggcggtcgagttcaacggaaagggcccccatccgtttctcgccaccgtggggctgcgcgtcgaggcggcaccggtcggctcgggggtggaattccggctcgaggtcgaactcggggcgatgccgtacgcgttcttcaaagccgtcgaggacaccgtgcgggaaaccctcggtcagggaatccacggctggcgggtcaccgactgcacggtcacgatgacgcactcgggatactcgccgcgccagagccatgcccaccagggattcgacaagagcatgtccagtacgggcgccgacttccgcgggctgaccccactggtcctgatggacgccctgaggcaggcgggcaccagggtgcacgagcccctgcaccgcttcggcctggaggcccccgcggacacgctgggagcggtgctgcccgtcctggccgggctgcgcgccgtggtgcgtacgacgcggatgcgggaggccgtctgtgtgctggagggtctggttccggcggcgcacgtgcatgaactcgggcaggtgctgccggggctgacgcggggcgagggtgagctggagaccgcgttcgaccactacgcgccggtggcgggaggaacggtcccgaaccgcccgcgtaccgaccacaacccgctggaccgcaaggagtacctgctgaacgtcacgcggagggtgggcacg

SEQ ID NO: 7486 - DNA, 1941 bp, Streptomyces avermitilis
  CDS (1)..(1941)
gtgcgcaaaaacgcgaaacttactcatgagtcagaggtgttgacgttccaccgaagtgcccggactgtagtggacatgtcgaagttacgcgcgcgtctgctcggcgttctcgtgtcgctcaccggcctcctcggggcaacgggcgcccagcccgcggccgccgactcccttcccgactccctctggttcgacgcctcggcgtcggccgccttcaccgtccagaacgggcgcttcagcgacggcctcggccgcgaggtcgtcctgcgcggctacaacgtctccggcgagacgaagctggaggagaacagcggactgccgttcgcctcggtcgccgacgccaggaagtcggcgaccgccctgcgcaccctcggcggtggcaactcggtccgcttcctgctctcctgggcccacgcggagccggtgcgcggccaggtcgacacggcgtatctcgccgcggcgaccgcccagatgcgcgccttcctggacgccggcatccgcgtcttcccggacttccaccaggacctctactcccggtacctcttcaactcgggcagctggtacaccggcgacggcgcccccgagtgggcggtggacgcgggcgactacccggccgaatcgtgcggcatctgcctcttctgggggcagaacatcacgcagaacggggcggtgacgcaggcgtcgcacgacttctggcacaacgcgtacggggtgcaggacgccttcctcgccaccgcccaggcgacgatggcgtacatccagcagaacctgagcgccgacgaattcaacggcgtggtcggcttcgatccgtacaacgagccgcacgcgggcacgtacgactcgggtgagacgagccgcacctgggagcagaacgtcctgtggcccttctacaagaagttccgggcccggatggacgcggcgggctggcagaccaagccggccttcatcgagccgaacctgttctggaacgccaacatcgacttccagaagcaggagggcggcctgctggacgcgggcacgctcggaccgcgctatgtcctcaacacccacttctacgaccagaaggcgatctccggcgtcctcatgtggggcaaggcggcggacgggcagtacgcgacggacttcgggaaggtccgcgaccgggccgccggggccggcaccgcggcggtggtcagcgagttcggccacccgctgtcggggtcggtctcggacaaggcgccgacggtggtcaaggcgatgtaccaggcactcgactcccgcctccccggctccacctggtggtccgacccgacggggtccgggcccgtcctgtccggcgcgcagtggcagtgggacatctacaacggccgccaccacgagctggagaacggcaaccccgacaaggtcctcacgagcggcgacgcctggaacgacgaggacctctccgcggtgagtctgaacgactcgggcaccgcggtcctcaggcaggacgcccgcctgctggaccgcctctacccgagcgccaccgccggcgcgacggtggcgttcacgtacgaggaccgttcccgggacggctcgacgaccctgacctggaacccggtccccagttcgctcccgaacgtctcccgactggtgggctcgggccagtacggcctgctcgtgtggcgttcgaacggctccacggcccccacggagctccacctcccggcgtccttcccggccgcttccacgacggtggtctccgacctcggtacgacgtccgggctgcccgcgtacacgaggacgaccccggtcggacacgcggccgagccgggcggcaccggcagtcaccgcctgctcctgacggcggcggactcgggcacggtgcactacgcgctggtcacgaacggagcgacagccccgtccgcgggcctgctgagcgcggcacgggcggagctgtcgtcctgggctgcgacgaaggtcggc

SEQ ID NO: 7487 - DNA, 1248 bp, Streptomyces avermitilis
  CDS (1)..(1248)
atgtctgtcctcagatccaggcacctcctggcgatcgccgccgccctcgcgctgaccgtcggcgccggcgcgaccaccgcctccgcacaggactccgccgccgcgctgcgcgaggtgatgttcgtgggcaacaactgggacggcaccgccgacgtcatcaagtccaccggggacctcgcgaagatcggccggatcaacgtcgtccccgacaaggagcagcggctggcgcagatcaacgccgatccgatcaaatggatctacttcatggcgattcgcaacggcgtaggggaaggccacgaccagctcgtggacgacatgtactccacgccggacggcaggtcgatggtcgtctcccggccgagcttcgccgatgtcgtctccatcgacctcgccaccgggaaggtcaactggcgtttccccgtctcgggttaccgctccgaccacatggcggtgtcacccgacggcacgcgggtcgcggtgtcggcctcgacggccaacaccgtgcatgtgctggacatcgacaccggcaagcagctgggctcgttcgccacgggcgacaagccgcacgagaacatcttcaccaaggacggcaagtacatctggaacatggccatcggcgatgtcaacacctcgctcgacgccccgtggcaggactggacgaagggcgaccggcgcatcaccgtcgtcgacgcgaccaccttccagcaggtgaaggtggtcgacatgcggcagcggctggacgcgatcggcctcacggactactcggacgcggtccgtccggccgtcttcagccccgacgagtccaagctctacttccaggtgtcgttcttcaacgggttcctggagtacgacgtggcctccgaccggatcacccgggtgaagaccctgccgaagaatccggcgaccagcgaggaccgcacgacctgggtcaacgactcgcgccaccacggcatttcgatgaacccgtccggtaccaagctgtgcgtcgccggcacgatggacgactacacgagtgtcgtcgaccgctccaccctccaggagggcccgctcgtccccgcctccaagccgtactgggcgacggtgagcggcgacggaaaggactgcgtcgtctcggagagcggcgccgaccaagtcacggcgatcgatttcgcgacgggacagaagacggtgtcggtgccggtgggcgaccatccgcagcgggtccggctggcccatgtcccggcggactggacgggcccgtcggcgagt

SEQ ID NO: 7488 - DNA, 657 bp, Streptomyces avermitilis
  CDS (1)..(657)
gtgacgggcaggctcaggcagccgaccggccgctacgggggcaagtccgcggaggagcggcaggccgaacggcgtgggcggttcctggacgcggccctccagctcttcggcgacacgccgggcttccgcgccaccacggtcgccgcgctcagcgaggcggcgggcctgtccacccgccagttctacgaggagttccgcaccctcgaggacgtgctggccgccctgcacctccaggtcaacgactgggccgagaccgccgccctcgccgctctcgccgacgcccggcacctgccgctcgccgagcgtgccgacgcgatcttccgcgcgtacgcggcgaacgtcaccgcggacccgcgccggatccgcatcaccttcgtcgaaatcatcggcgtcagcccgcggctggaggagcagcggctgcaacgccggtcccgctgggtggacctcatctgtgccgaggccgccgccgcggccgcgtgcggtgaggcggcaccccgcgactaccggctggcggccgccgccttcatcggcagcgtcaacggcctcctgcacgactggcgcgccggctgggtggacgcgaccctcgacgaggtcgtcgacgaactcgtccgccagctgctggggatcctgcgcccggccgggtggcagccggacgcc

SEQ ID NO: 7489 - DNA, 276 bp, Streptomyces avermitilis
  CDS (1)..(276)
gtgcacaagtggctgctcgcgcatccccggttccgcctgcatttcacccccacgtactcgtcgtggatcagtcaggtcgagcggtggttcgccgaattagagcggcgctgcctggagcgcggagtgttctgctcgctggacagcctcaaggccgcgcttgaggaatggatcaaggtctggaacgaggaggcccggccgttcaagtggaccaagaccgccgaccagatcctcgaccggatctgccgttactgctcacgcatctccgaaccagctcac

SEQ ID NO: 7490 - DNA, 1098 bp, Streptomyces avermitilis
  CDS (1)..(1098)
gtgaccgtcaccagcatgccccagccgacgctgcccgcgcagcgggtccccgccccggccaaggaggccgaggacgtgatcctgggggtggacacccacaaggatgtccatgttgctgcggtcatcacgaccctgggtgcctcgctcgctcagcaggagttcccggcaaccgccatcggctatcgccaactgctcacctgggcaaggtcgttcggtgtcctgcgccgggccggtgtcgaatgcaccggctccttcggagccgcactgaccaagatgctgcgtgggcaaagcatcgacgtcatcgaggtcaaccagcccgaccgtgccacccggcgcaagcgcggcaagaccgatgccatcgacgcggacgcggccgctcgtgcggtgctgtccggacgggccaccaccgtgccgaagagcgcggacgggcccgtagaggacatgcgggtcctgcggctggccaaggaatcggcggtcaaggcccgcacccaggcgctgaaccagctcaaggctgtcctcatgtccatcgacccggatctgcgcgaactcctcacccgcctgagcaaccctgcgctggtcgccacctgcgcggccctcgacgcggattaccggggcgaggccgtcttcacgatgcgcctgctcgcccgccgtgtccagcacctgtccgacgaggtcaaagagctcacccgccgcaccaccagggccgttcgtgcctgccggccccagatgctggacctcgtcggcgttggacccgacagcgccgcggtcctcctcattgccgcaggtgacaaccccgacaggctcgtcgatgaagcctccttcgccgcgttgtgcggtgtcagcccggtcgagcagtcctccggcaagacacaacggcggcgcctgaaccgcggtggccaccgccaggccaacgccgccctctaccgcatcgtgcagacccgcatacgctgggacgaacgcacccaggcctacctgcggcgacgcaccgccgagggcatgtccaagcgcgagatcatccgatgcctcaagcggtacgtcgcccgcgagctctaccgacacatccagccccgagccaccaaccaggtcccctctgcggct

SEQ ID NO: 7491 - DNA, 912 bp, Streptomyces avermitilis
  CDS (1)..(912)
gtggggatgggcgacagcaggcttgcgccgctggtgttatccgatgccgagcggcggatgttgcagggatgggcccggcgccggacgactgctcagggcctggcgttacgggcacggattgtgctggcctgcgcggacggcggcagtaacaccgcggtggccgcgcggatgggcgtcaaccggggcacggtgaccaagtggcgggcgagattcctgcgcgaccggttggacgggctggccgacgagccgcgcccgggggtgccgcgcaccatcaccgatgcccaggtggaggaggtggtggtgcgcacgctggaggagacccccgagggcgcgacgcactggtcgaagcgggagctggccagggccgtggggatctccccggcgagcgtgctgcggatctggcacgccttcggcttgcagccatggcggaccgagaccttcaagatctctccggacccgcttctgaccgacaagatccgtgatgtcgtcggcctctacctcgccccgccggccaacgctgcggtgttcgcggtggacgagaagccgcagatccaggctctggaacggacggcaccggtgctgccgatgctgcccggagtgcccgagcggcgcagcttcgactacgtccggcatggcacggtcgatctgttcgccgccctgaacaccgcgacgggcagggtgatcacgaagctgtccgcgcagcaccgggccgtggacttccgggacttcctcgacgagatcgaccgccagaccgagcccggcctgggggtccacgtgatctgcgacaactgtgaggatcatggtgtgccgcagggggggccggagcctgacccgtgcgacaactggccacagctgccttggagtggaactgtcggccccggcctcctgcggtgcgtactgccgccggcccgg

SEQ ID NO: 7492 - DNA, 708 bp, Streptomyces avermitilis
  CDS (1)..(708)
gtgcgcgctgtgcgaacagcccaccccgatgcgctcccaccacggcgagcccgtccatcctgcgccgagggctggatcaccgcgaaccccacccaggcgcgcctcggcaggttcgcctccgacgcgcagcccaagcacggcaaggactacgacgaccacgcctgccagcgccctgatcaccccacccacacccttcgggagagccctgccatgaggcgatccaccgagaccgactcccgcatccccttcccctgctcccccacccccacagcctgccgcgccaccccacagctcttcgcccacgacatcggcgactccgacacagcacgcgccgaacaggcaaaggccgcctgccaggcctgccccatcgcgaccgcatgcctcaagtgggccctcgcgaacccccagctgacgaccgaggggatctgggctgccaccccccctcggcagcgcaccgcgctacgccaccagctggccgaccgcctcggcagcgactgggccgccgtggtcgccgaccacgaccggcgcctgcgcgagcgacgcgaagccgcccgacataccccgctcaccgtgcgtcaggaccgcatcgtccgcatggaccgcgaccttaacggccccatgccacgcccccgcaggtcactcacccccatccagcagcaccgcgacgtcgccccgcctcctggccggcgtcgcctagtgagctggttt

SEQ ID NO: 7493 - DNA, 768 bp, Streptomyces avermitilis
  CDS (1)..(768)
atgatcacagcaagaggcgcaccccacggcctgcacagctcggggtgcgcctctctcgattccgccccgaggggcgagaacaggagaaccatgatgcctgccaccaccgcattacgtcagcggtcccgcacattgatcgtcgcagccaccgtgccgctcgcgctggccgcgctgctcgccgacgacgtgcgcgtgcgccgccaactggacgctgcccgaaaggacccgctgacgggactgcccggccgcgacgtcctcatggaccgcaccgcacgcctcgcccgcacccaccgcgagcacttgcacgtcctggtcgccgacgccgacggcctgaagtccatcaacgacaccctcgggcacgccgccggcgacaccctcatcgcggccatcggacaccgcatcggggcatgggcagccgtccgcggcggactcgccgcacggctcggaggcgacgaattcgcagcggccctgttcctgccacccgctgcgacagtccgggaaatcgcggtgctgcgcgagctgctggctcagcccgtcgaccatgacgggcagaccctgcgcccggccgtgtccatcggcgccgcccgcgccgtcgacctgcccgacacggccagtgcctcccgcctcctgcgcggcgcggatatggccatgtaccgcgtcaagacccgtgagaagccgtccggctacgtggcgacccgccaggacgcctacacacccacggtccacggacgccgcccgggccgccccggcacccacctgaccgtcgga

SEQ ID NO: 7494 - DNA, 459 bp, Streptomyces avermitilis
  CDS (1)..(459)
atgaccaccgtggtcccggcttcgctcaccgacaagaatctggacgccgcctgcgccgcagtcgcaggcgagatcggacgcaccgacagcaaggcctccttactcctcgccttcaacggcgccgtgctcgccggactcgcgtccgtcgccgacaaggacctgccgcagccgaccaagacgttcggcgcactcgcagtcctcaccctcggcatcgcagccgcactcctgctcctggtcgtccgtccccgcctccgcggcgacgaccgcgcttccttcccctactgggcgcgactcgacgaagacgagatccgcgcctgcatggaaggagaccggcgcgcctccagcgtccgcgtgctgtctagcctcgcggtccgcaagtaccgccacctccgccgcgcggtcgacctcagcctcaccgccatggcattgctcgccgtggccgccgctggcgccgcgctg

SEQ ID NO: 7495 - DNA, 519 bp, Streptomyces avermitilis
  CDS (1)..(519)
gtgcgatcccgagacagggatgatcacctcatgatgcgaggtgccttcgacgacgtccccgtgaccgcactcttccctctcctggaggctgcggatgtggactccttgaatcaggcggctggcacggtcgatacggctcgtgcaggtagagacacggcggattgggagtgggccctggaacacgcaggcttcccaggcacacagctggggactccggtcgtccttgggctggatgtcatcgagcacgccgagggaggcgaccagctggaatttttgctccaggtggtgtggaccgacctaggtcggctcgcggtcgacacggcggtgaacgtggcctgctggtgcgagaccgatcacgccacccatgacatcgacgccctgaggctcgtggttggcgaggagacctcgttgcccgaagcattccgtgccggcgctgaacgtctgaccggctggctggccgatcctcacgacgccgaccactggcgtgccaaagcgggattgcctccccggtgggtcccc

SEQ ID NO: 7496 - DNA, 543 bp, Streptomyces avermitilis
  CDS (1)..(543)
atgtccacccgcctgccttccctcggccgccctgatccgaccaccgcggcgccttcagccgccccaccgctgtccctcgaggaacgcctcactctcgtcaacgcagcgatgacggcacgcctcgacgaagcggccatcgcgtatgaggtcaacaccgcccacatcgagaccaagcccatcgacctgaccgacgttgtcaccggccccctcaacacaggacccgccccgctgcccgacctgtacccgacaccggtcgcggccctcctgcagcgcgcccaccagcgactcgtcagcggcggttggtgcaaggacgccctggtcgacgccgacggcgcccgctgcatgctcggagccatccgcatcgaagccggcggcgaccgccacctggaagccgacgccgccaccgtgctcttggacgcgatccgccgccagttcggcgacgacgtcgactcggtgcccggcttcaacgacgcctggggcaccggccgtgtcccgatgcgcatgctcgaacaggccgcgagcctcgccgacgcccgcggactg

SEQ ID NO: 7497 - DNA, 186 bp, Streptomyces avermitilis
  CDS (1)..(186)
gtggccttttccgtgtccgccgccgtgctgctggccgtcatcgtggccgtcctgatgaagggcggctacgtgaggttcggatccatgctcgcctgcaccctgctcggcttcaccctcgccgcgaccggcctggcgcccctcatcaacagcgcgctcacctcactcgccggactcatctccagcctg

SEQ ID NO: 7498 - DNA, 2433 bp, Streptomyces avermitilis
  CDS (1)..(2433)
gtgatgcgcaggatgcccacacgggcgaaaacagaactcgccgcctacggggcatccaccgccgccctcgcggtgctgcccagcatggagctgctgcccgcccacgcgtccgtcgccgcgatcagcggtgtcagcacctggtggctgtaccagcgcgtcaaggccggcgacttccgcaaggcgatccgctcggggcagcggctccttggaccgctcaccggcagcgcggtctacaccgcggccgccgtcgcccctggcaacagctggtgggagatccccctcgccctcggatggggtgccctgatgtccgcctggctgcccgccagccgctccacctggactccgcccggcgacctgaccaccgtctacccgtccgggttcgccgggctggtgatgcggctgtgggaccagcacgaagtggcgccccagacgcggctggagaatgtgcagcagatcgtgtcggccagccacccggacttcagctgcgacatcgtcgctccgcagggcaagcccgtcggccggattgaggccgacgccatcgccgcctgcttcggtgtgccgacgctggccgtgtcgctgcgcgagacggagcacgggcccggccgcatccggctcaccgtcgcccccacccaggaaggcggccgcagcatcgacgacctctggtcggcgctcatctcccggcccggcggcgctatccccggcagcaccatcgtccgtgtggaacgccagcccgcccgcggccagctccccgcccgcggcatgatcctcgcccaggtcgagcccggcgaggtcgcccgcgtcaactacgaccagctgtgctccgcgttcggcgtcaaagccgaagagatgcggctggtcaccgaaagccgcggcaacgaagtcctcgtcaccctctacgaggccgcgccgctgcgggtggcccgccgtgccacccgcgcactgctcaccctggacgcctacggccgctacaccatcggcaccgcccacgacggcaccgacgccaaagtccacatgcgctccgcgtccggcaccttccacggcttcctggtcggtgtcaccggctccggcaagaccgtctcgctggcgctgatgtgcgcggcgtgggcgctggccgggatggcgagctgggtgacctccgcccggcccgacgcgcagatgtccgcggtcggccggcacgtcgaccggcagggctccggcgcgatcttcacctggtggctgctgaaggccgcggtcgccctgatggacatccgcggccagatgaacgaggaagccggccacgactactccccgcactccccctacccggccctgacgctggtcctggatgagttcaacagcctcgtcggggacgacctgttcggcgacgacatcgcgcagatgacggacgtcctcgcccgcgagggacgcaagttcggcatcggcgtgatcttcgccgggcagtccctcaacctcgacaaactcggcggcagcagctcgctgcgcgaccaggtccagggcggcatcggtgtcgtcctgcgcatcaccggcgggatcgccgcccggcaggccaccggcggcctcgccgcagacacagacctcccgccgattcccgaccggctcggcgcgcacatgtcgctgatggaccgcatgctcggcaccgccaccgatgtcccaggggagaccacgcagggcatggggcacaccgtcaccggctccgacgcgaccatgatgcgcaccctgtacgtgcacctgcccgacgacggctcccccgacggactcgacgagatcttcccggagagcggcgccatcaacacgctcactgaccgcgagatcgaggccctcagcgcgctcggtctgtggcacgagtggacgatgcccccgcccaccggcaaggaagacgacgacgctgacggcgggggcgcggcgttcatcggctcgttcaccccgcccccgccggcggcccgcaagccgaagaagaccaccgtcaaagacaagatcctcgcggtcgtcgaccgggagatgacggccaaggaggtccgcgaccaggtcgacgcggccgccggcaccatccgcaacgtcctgtccgacctggtcgccgacggccgcctcaagcaggttgaccacggcctgtacgccccggccgcaaccgacgtcaccgccgcccccgaccgggacagcccggacagcgagcagctgcccgaaggagtcgacggtgagctgctgatgttggccgccgatctggtggtcaccacccggttcggatcgcagtcgatgctgcagcgcaagctgcgcgtcgggttcgctctcgccggcgtcctgctggacgcgctggaagagcgcggactggtcggcccggccgacggcagcaaggcccgcgaggtcctggtgccggtcggagccgacgaggacgtgctccgcgaactgcgcgccgacctcggaccggtcctccaggac

SEQ ID NO: 7499 - DNA, 402 bp, Streptomyces avermitilis
  CDS (1)..(402)
atgggagagattgcccctgccgtcgcagcggacggcgccgccaacggctacctgtccatcgtcaccaagttcacggcgctgcagaaggcggcagccggcctgttcgagcacgccgagcagctcgcgcagcggatgcgcgtcaacgccgattcggcggtggtcgtcgcggagttgtgcgcgtccgcggaggccgatgcccggcacgtcgcggccgtcgccgaggtcggcgaagcgttcgggcaggtcgtcggcggctgcaagcggctgctgagctcggccgagcagactcaccaggccgcaatcgaggtcaaggccgcccaccaggcggagtacgggcccatccacgccgccgccaccgcatcgagggcccgacaggccaagcccggcttctaccggcccatc

SEQ ID NO: 7500 - DNA, 2148 bp, Streptomyces avermitilis
  CDS (1)..(2148)
gtgcgaggcgccccttccccctcaccggcagtcaccgtgagaggagggcctgtgtccgacgacgagcccccggacaacctgcgtcatctgccccggatcggctccccgccgcccccgcccgtgccgcccgcacccaccctgggcggcaccgacgaggacagcgtcaccgaccccgggcctgttcgaatttccgcgttcgacgcccccgaagtaccccacgcgccgcccccgacggcgggggcggcgctgcgcagtgagggcctgaacgagggcgagcagccccccgatgcgggggcgccgcgcgccggcgcgctgtcgctggccgcgatcctcgcgatcgccctggccgcgttcgaggggctgcagacctggatccaggaatccgggccccgccgcgcggaagccgccgcgcaccagcgggagatggagctgctggccgcgaaggccggcgccgatgccacccggcacggcgcggaagccgacgcggcacgcgccaaggcccatcgtggcgggggcgtgcagtccagccgtgactacggccgcagcgcgctcggacggggctccggcggccccgcacggggcggcggcgtcggtccgggcggctcccggggtggcggcagagggctgttcaacggctctccgcagggttcctccggccggtttggccaaggccgttccggagcgggcttgttcggcgtcggctcccgaaacggtgctcaccgtggccgttcggacggcacggcgggacgcggcagcgggggcggccgggcaggtgccgggctgttcggcggcgggggtcgcggcccgggggccggcggcggccgcggcaatgccaacggcaagggcagcggcaagggtcagggaagccctggcccgggcggcacgagcggcggcaccgggggcagcaagggtggtggcggggcggggcgccgctcgccgcggcaggccgtcgccgactggtggggcaagggcaaacaccctcgcccagcaggcgccggcggcgggtcgcagcagaagggagctgcccacgaccgggcggctgccatccagaatgcgctgaagaagacccggtctggcaaaggcggcggcgctacggcgccgacgttctgggaggcggccggtgaccggctgcaggaccggtggaagaaccgccaggcccgcaaccccgcatccacggacgcggcgggaaagaccgggaacggcggggcggccggtaccaagggcggtaacgacggctggtcgccgaacgggcgggtcaccttccgctcggctgtgttcgaggcggtcaatgagcggtgggccaaacgccgcgaccggtggaaggcccaggcaggcccccgcaccggccgacgccgctcccccaacgccaacggcccgaccagcccgcccagcccgcccggttcaggcaacggcggcggcccctcgggtacctccggtcccggtgcaggaaagggaccgggcccccgctacgccggtccccgtagctcgccgttcgacacgagctccgggccggaaatcacgatcacggtggagcaggtcgacccgcccggaacgcacgcccgccgctgggagccggacgccatcgccccacctcgccgacaactgcccgcgcagggcccgcccgccctttcgcgtgctccgcaacgtccggccggcacccggccgggaaccacccgcagaaaggaccccatccctatgcccccatccgcatccagctcggcgcccgtcatccaggtgacgcccccgcccgcgaacgccatggtcggccggcacgccacggagatcagcctggacggtgctgtgaaagcgctgaccctgctgaccaccgccgggatggagacctacgacgactgccagaacctggccaggcaggcccggcgcctgttcgccgagctggaggtgatggccaacgacctggccaacaaccacaacatcacgggagcacgcaccgtgcgcgccatgggcgtgctgatggagagcgtcgggatgctcgccgtcaacgccaaccgcatggccaaggccgcgttgaacgccgcggaactcgccgaagcggaagagaccgcgatggagcgggactaccggcccacccagaccgcggccctcgacgcaggcctggccgcgcccagcgcccgcatccacaacgagaac

SEQ ID NO: 7501 - DNA, 219 bp, Streptomyces avermitilis
  CDS (1)..(219)
atggcagggccgccgctgtccccgaggaaggcggcccactggaacagccgattcgaacaggcccgcgctcaaggcgagcgcgggcctgaggagttcttccgcgtctggctcgatctggtgaaggtctccgccatccagaaggcccgccgcaccggcgaccacggcgtgttcaacgcgctgtcggcggagctggaacggatctaccgggatcactgccag

SEQ ID NO: 7502 - DNA, 504 bp, Streptomyces avermitilis
  CDS (1)..(504)
atgagtaaggacattgcatcccgcgtgacgacgggcgtgcaggcgctggcggtgcccgggcagcgggagggctggcaggcccagcaccgcggcagcctgctctccgacgcgcaggcctacgacgctctcgccgacgccgtccaggccgacctgaagggccgccgcctggacggtgacctgccctggggcctgtcggcagcgtcccgtgcccgtaagcgggtcaagccgctgcgggacaccgcgcgcgccatgcgcagggccgcgaaggccatcaacagcgtggtcgccgcgtacgaggagacccagcccgacgtggtgctgcgccggcgcgaggacaaggcgctgaagaaggcgcagcgtaagcagaacgtgcaggtcaccgcctacaacagcgccaaccagaccctgcagcgtctcgcccccggcacggaggagggcgaaccggcgggccaggcccggctgctgggtgacttcttcggcccgggccagcagcggcggggcgcc

SEQ ID NO: 7503 - DNA, 1671 bp, Streptomyces avermitilis
  CDS (1)..(1671)
gtgacgatcactgaagtgccgcagcgcgcggcacccgacacccccgtttcgcgcccgccgaccgccgtttcggacgcgccgccgaccgtttcgggagcggcgtccaacgtttcgcggacacagaagcggaacgcgatcaagcccgcgcatgaccggctgatgaccgtcctgtcggtcgccgctgcgatcggggggccgctgatcggcgccatcggcttcgcgatgtcgtacagcaccctggcgaagaaggcattgacctggggattcagtgcggatttggcgccctggttcccggtcggcgtggacgcgtcgatcatcgtgttcctcgcgctggacctgtacctcattcgcaaggacaccccgtggccgctgctgcggatggccgcccacggcatgacgttcgcgacgatctggttcaacgccagttcgcagggccacattgcaggcgacccggtcagggccgcctcgcacggcgtcatgccgctgctcttcgtgatcggcgtggaagccgcgcgcaggctgttcatcaagaaaacgcagctcgaagcgggtacggcggctgaccggatcccgctgcaccgctggatccttgccccggtcgccaccccgcgcttctaccgccggatgaggctgcacgggatccggtcgtacccggagatgatccgccgtcagcaggacctcaccgcctacgagcagtggctcaagcggaagcatggcgacttgagcaaggcgagtgaggatgagctgctgccgatgacgatggccgctcacggctacaccgtcgctcaggcgctcgcgctgcctgagcagcaggaacgcgaggcggaggctcgggcggaggaggcggagcgccggcgcctggacgcgcagacgcgccgggagctcgcgcagaagcaggccgaagccaggcggctggaggccgacggcgagctggagaccgtccgcgcccgcgtagagggcaccacagcccaggcccgcgcccacgcccgagcccaggccagtgccgcggagcgcgccgcagagctggaagagcaggcactggagacggccgtcatcgccgaagcccgcgcccgcgaggcagccgcagagcgccaggcatcccaggagcgcgaggcgaaggccgctgcggacgcccgagcggccgaactggagcgccaggcagccgagaagcggaagctcgcggcggaggccgaccgggtcgccgtggcggaggctcaggcagtcgagacggtggagatcgcagaagcccgccagcgtgctgccgaagctgaccgggctgctgccgaaacagagcgggctgctgccgaaacgcgccgccgcgccaccgaagccgagcgactcgcggcgcaggaaacagagcggcgcgcggtcgccgacgccaacacccaggcggcccggcgacgggaagccgaaaccgaactggccgccgccgaaacgcgactggctgccgccgaaatcgagcggcgcgcggtcgaaatcgaggacgccgcgaagctcacgccccgccagcgcgcggtccgcaaggtcgcccggatgatcctcgccgtcgacggcatggccgaccggctgccgctcgccgagatccagcgcgaactcgtggtcacctcgcccggcaccgcctccgagtaccgccaggaggccgccgagcttgtggcaggcggctaccggccc

SEQ ID NO: 7504 - DNA, 798 bp, Streptomyces avermitilis
  CDS (1)..(798)
atggtgcacacgatcccgctcgcccacgcgctcgatgactcgcacctctcccccgccgccccggccccggtcgccccggcccccgttgacgcggcggctctcctggcggccggcaccgctcgttaccaccacccgcactacctgcgtgtggagcagaacggccccgaccaggtgcgttttctcttccgggagttcaccggccgggagagcgaaccgtcctcgccgctggagatgtaccgcgatcctgcgctcacctccgagcagcgcacgatgatcggccaccagtacaccgcggcccgcgtcctgtggtccaagcgccggatgcgcgagcaggccgccccgctgctggagaccgcagccttacggtggtcggcctggacgatcgcccacgacacgatgatgtcccggttcgcggagttcgcgacgctccccgacgaccggtggcgctcgcaggtgctgcggctgctggacgcgcaccgcgtcgcccggcagatggctgcggactgggacgacatcgcggagcaactctcggtcgtcgtcgacgaccagcacagcgccgtcgacgactggtccgacgaggtggacctggcggtcgtcgccgctgaactcggggtcgacatccagggctggctggtcgaccacgtcagcgcctaccgggccaccccgtactaccagcacgacaccccgctcgtggcccggctcgtcaagacgatcgacgagcagcgggcccggctcgcggccgtcgcgcacctgaccgctgaccacgacaccggccgccagctcgcccccaaccgcttc

SEQ ID NO: 7505 - DNA, 174 bp, Streptomyces avermitilis
  CDS (1)..(174)
atgcctgacgacctctaccggcgctaccaggacgcgcacaccacgcaccggcagcacgcccgtacctgcaccgcctgtacggacacgagccgctgccccacgggacagcgcctgtacgagtcgttcacccggctccaggacgcctacctcaacggtcagcgccagcaacggcgc

SEQ ID NO: 7506 - DNA, 732 bp, Streptomyces avermitilis
  CDS (1)..(732)
gtgccccgcggtcccgctgaccacgctccaccccaagcgctgaaccgccccggacgaacgaccacggccccggccatctcacagaggggaggccggggccgtggctactcgtacgacaaccctcaccgaccagagcagctgagatacagcctgcgctgcgcgtcgcacaccgctccgccctcgcggcaggagcggcgtacggcggagtgcgcaggacgcactccccgccctaccggcggggccaaaatgcgacgaacccccagggaggcacccctgggggttctttgtcgcaggtccctcgcgaaaggactgacctgcatgcccagcatgacagctctgatcactcctgccgagagcacctcccggcccccgttgccgcggcggccgatcccgcacgagcggacaccggaccggcccaccccgtccggtggccggccgcacccgcggaccgcacagaccaccggcgacccggtgatcgtcgaagcactgcggcgcgtggtcgacgaccagatcggccctcgccgcgcgggagcgatctaccagaacacggacggggcgttcgaggttctcgccgtcatccgtgaccccgagcgggcccgcggtctcctccaccgccgctgcgcgcagtgggcgctgatcgtccgtgacgtgctgcggccggacggcgagccgttcgcgatcggcagtgtgtggactgcctcggaccacctggtccgtgaggcggtcacccgg

SEQ ID NO: 7507 - DNA, 558 bp, Streptomyces avermitilis
  CDS (1)..(558)
atgaccatcacgtccgcgatgcccaccgccaaggaacgaccccgccggacccgtacgaagcgggccagtagccgccctgccctcaagctctcccagctcctgccctcgcacatcgacctgcgcgagccgctgaaggcggttctcgtctgcgaggactgcaagacctgggtgcccgtcaccggcatgcagagcaaggttcagaagctggtcccgcaccacatcggtaaggcggaggaagccgatgcgatccgctgccgcagcagcaaccgccgcatcgagtgggacatgacgatccctgaatggcgccaggccttggccgacgccgttacggaagcctccagccgccagagcactacggtgctgcccaaagcattcagtccgcagaccgatcggaccctgcgggctcgtgcggagcgcacactggccgggcgcgtggccgactgggacgcggtgttgccccgcgtggcagccaccgataagaaccgctgggcgacgcccgccggcgacgcccctacggagtgccccgcggtcccgctgaccacgctccaccccaagcgc

SEQ ID NO: 7508 - DNA, 327 bp, Streptomyces avermitilis
  CDS (1)..(327)
gtgtccaccggatttgcactgacagtgcggttctccttgcgagacaccgaggctgcccagcagttcgacgccctggtggccaggaccgcggaagggatccgtacggaacccggcaccctcgtctacgtggcgcacacgcccgtagacgagccactcgtgcgcgtcttctacgagctctacgccgatcgtgatgccttccaggcccatgaggagcaggcccacacgcgacacttccttgagacgcgcgagcagttcctgaccagcaccgacgtggtgttcctgaacgagctggaggagctcagcaagcgccctggaacggaggggcca

SEQ ID NO: 7509 - DNA, 1251 bp, Streptomyces avermitilis
  CDS (1)..(1251)
atgaagccaacgggcaaggacgtcgatccacaagatcgagtctttggccagcgcgtccagaagctccgcaaggaacaacggcgcacccaggccgagttcgcggctgctctcggaaagacgagcagctggatgtctcaagtcgagcggggtatccagcccgtccagcgcatggacctgctgcaacagatcgccgatgaactgggtgtgtctgtacagcagttgcgcccgagcgtcgccgacggaagcggaccatcacagcaccccgccccgctgtcgctgtccaacgacttggacgagacgcggagactgatctccggtcacccggcacttcgcgccttgctggccagccccggcaccgagggcgcaagatccgtcgaggcgctgcgcaaagacgttgacgacctctgggagctgacacacgcggcacgaatggcgcaggtcagcgtcctggctgtagagctgctccctgagcttgaacggaccgcccgcatggcgccggacgagactcgatcggagctgttcctgctgctctcccggacgtaccaggccctttcggcggcgttcgttcggcaggatgaagcagacgctgcatgggttgccgccgatcgtgcgatcttcgccgccgaacggtccggcgacccgctgcacgtctgcgctggcgttttccggatgacgcaggcgtttgtacggttgcgcagcctcggccaggccgaacacgcggctcggaccgctatcgacgccttggaagagcaggggggcaggtcgccgcaggctctgtccgtcctcggttcgctccatctggccctcgcgctcgttcacgcgcgagccagcgctcgggccgaagccaaggaggagatcgccaaggcccgcgctatcgcggcgcagcttggcgagaaccggaacgacttcaacctggagttcgggccggtcaacgtagagatccaggccgtcagcactgctgttgacctcggcgacgcaggtgaggccctcgatatcggcctcgccatcgacgctgagggtctgtcgcccgaacggcagggacggttgctgatggacctggggcgagctcacgcgcagaggcggcacggaggcgaagccctcgactgcctgctgcgcgctgaggccgtcgcgccggaaactatccagacgcaccaggctgctcgggcagccatccgcgagctggtgctggtcgccggcgcgaacgcatcgcgtgatctgctggagctcgccgaacgggctgatgcacttgac

SEQ ID NO: 7510 - DNA, 1065 bp, Streptomyces avermitilis
  CDS (1)..(1065)
atgggatttcgggcttcggccatagggtccgggatcatggcgactacggaggcaagcggcgtggggaagcacctggggtggaggcccgagcggctgcgggagcagcgggaggctcacgggctgacgcttgagcaggccggcgagcagctacgagctctcgcggagcaggccaagctcaagggcatcccggcggcgaatccacagacgctgtggcagcacgagcagggtgaggtctacccgggaccgcactaccgccgggcgtactgcctgctgtaccgggcgaccgaccccgagctgggattccgcaacgccctgccgggcgaggacacccagttcaagctgacgccgatggacgaccagcgcaacggctcgcacgtcttggccgtggagcgcgcgctgttgcagatagggggcaccgctgaggcggatcctctgaggctgcagcagcggatcctggatgcctggaagcgtcgccacaccggcggtgacccgcaccgcccctcggtggtgctggtcggcgggttcgccggcagtgggaaaaccgagttcgcgaggttccttacccagctcaccgggtggccactgctggacaaggatccgctgacccggcctctcgtggagcagctgctggtcgcgctcggaggcgatgcgaacgaccggcataccgatctgtaccgcgagcgcgtgcggccggtggagtacgactgcctgatgcaggccgcctacgccaacatcaactgcgggatcagcacggtgctgactgcgccgttcataggggagatgacttccgaggcgtggatgaaccggctgatcaacaagtgcaacgccctgggcgtggacgtgtcgccggtctgggtgcagtgcgacgcggagtccatgcgggagtacatcggcttccgatcggccgcgcgcgatgcgtggaagctccagcgctgggatgagtacatggcgaccgtcaacctggagctgcgcccggtcgtgccacacctggtcgtcgacaacaggctgggcacagcgatttcgctggccgaccaggctcggcacgccctcagggcggtgcacgga

SEQ ID NO: 7511 - DNA, 570 bp, Streptomyces avermitilis
  CDS (1)..(570)
atgagcagtaagaagctgggcgtcatcctgtacgggccgccggcctcaggtaaggacaccgtcgcgcaggccctaagcgaactcgatgcaaggtacggccagttcgcgcgtctcaaggtcggctcgggccggaccaccaggtaccgaatgggcacggcggagcagctgcacgacctagaggccgcaggcgccgccatctacacgaacagccggtacggcaacacgtacgtcatcgaccgaccggggatggactccgcgttcgaggccggggtgccagtggtgcacctgggccagatcgacggcatccgcgccctggtcgacggctacacggccgactgggcggtggtgctgctgtggtgctcgcaggaggtgaccgcgcagcggtccgctggtcgcggcgacagtgacaccacggcccggctcgcagcgtggcaggcgacccgcgaagaccttgacgcgcacccggacatgcgatgggacctcacagtggacaccgaggccacggcagcggaggagtcggcacggctcatcgaccagctgctgcacgcgcgggcgggagtgacgacggca

SEQ ID NO: 7512 - DNA, 840 bp, Streptomyces avermitilis
  CDS (1)..(840)
gtggaccagcccaccgtcggcatcctccaccccggcagcatgggcgcagccgtcgccgcgtgcgccgcgaccaacgcggcgacggtgctgtggtgcccagcaggccggagcccggcgagcatcgtccgcgcagagcggcacgggctgcagccggtcgccacactgccggagctcctggaccaggccgacaccgtgatcagcctctgcccgcccgcggccgccgaagacctcgccgcggaagtcgcctcgcacggcttcggcggctggtacgtcgacgccaacgccatcaaccccgaacgcatgctgcgcattaaggccctgctcaccccatccgccaaagccgtcatcgacggcggcgtggtcggctcaccgccggtcggcggcaagtcgcccacgctgtacctgtcggggccggccgccgcgattgagcgcgtcgaagcactcttcaccggcacggccgtacgtacgaagacgctgggcagcgagatcgggcaggcatccgcgctaaaactcgcgtacgcgtcgttccagaagacgtcgagggtgctcgtggccctcgcgaccgggttggcccgccagcacggagtcgaccaggaactcatcaccatcgcctcgcagcgcagcgactcatacctcgctgagactgagtacatcgccaagacggcggcacgcgcctggcggtgggggccagagctggaagaagcggccgacatgctcgaggccgcgggcctccctccggagatgctgcgcgcggccgcggccacgctggcccggtgggacgacgcaaaggacgacggcgagctcacgctcacggacgccctcaaccgcctcgcccagccg

SEQ ID NO: 7513 - DNA, 645 bp, Streptomyces avermitilis
  CDS (1)..(645)
atgcgcctggctctcttcgacctcgacggcaccttggtcgaccgccactccgcgttcggcgatgccgtagccgccctgagccgaagccacggcctcggacccgatgttgagcactggctgctcactgaactcgccgaccgcgcgagtgccgaggacttcgcccgtgtgcgcgagatcttcaacatcgatgaatccgccggagagctctggcgcgcctacgtcgaccggatggccgctgcggtcacgtgccggcccgccgtcctcggtagcctggcccgactcaaagcggcgtcctggagcatcggcgtcgccacgaacggcgcatccgacatccagcgcgcaaagatccgcgcgacgggtcttgctgacctgatcgacgggatcgcagcctcgggcgacatcgacgtccgcaagcccgatccgcggcttttcgagctcgcggccgcccgctgcgggactcagatatcgcggggcgactggatgattggagacaacccggagaacgacatcgtcggcggacacaaggccggactgatgaccgtctgggtacgaggccgcccctggcccgagagtctctccgtacctcaccacagcgtggacgacgtcaccgacgcaatcgactacctgctcacccacccaccggag

SEQ ID NO: 7514 - DNA, 2835 bp, Streptomyces avermitilis
  CDS (1)..(2835)
gtgatgccagtcgcctcgatcagcgccccacctgctctccgttggcctgccagggcttgccggaggagctgcccgccccggttccagccggctgcgagcggttcgaacttggttctcccagaacccgaagcaccccaaggggacttcgttgtgcccaccttcagagaaggaggtcgtcgctattctgcacgacgtcttgggctttcgccagcccacttatgcctgtttcatgcacatttgcggacctgtgatgtcccgtctcacgcaatctcacagcccgattcattcggtatgccccactgttcggggcgctctccaggcactccgtgtcatgttgtggccactggatcctggagtggtccgcgacggcagcatgctgcctcgggttccgtgccgggtgatccggtgagcggggtggcggcggccgccgtggtgatgcctcgggtgccggggccgcggcatcgtgtgctgcggtcggtgccggagcaaccgggtttggtgccggtgcgtggtccgggtcgtccgctggctcttggccgtgatgcccggggccggctgggtggtgcggtgcgcgcgctgctggaggcgccggggctggagggtgcgaaggacccggtacggctagcggtgatcgtgctggcggcgcggacgccgtcggcgacgggcgtggtggagatccgtacgggtgagctgggccggtggctcgggctgtcaacttcccacgtcgcctccgaggtgctcccggcgctgcgccagtccggcgtggtctccatcgacacggcggagggcgagtacggtcaggacgacgggctgacctgccgtgtgctgccgatgtgggatgcccagaacaaggttgggcacccgctgtcattgaagaagccggagcttgccaccttgctgcggctgatggaggccctgatggcgccgggctgggtgcacagggatggacgggtgaccccggccggactgctgggtgcacgtgcgaggcatggtgcggcgacggaccggttggctctgctactgctagtgctggaggcggcggagaccggtcgggtgcggctgtgcggtggccgggtcgagaagcgctatgggcggccggtggcgactctggcacggttgctgcggtgctcgctgtcgcggtcggagcgggtgctggcgcgactggagggttttgggctggtggagcgcccgcggcggcagaccgtgtccgggttgcggcaggtgtcgcggctggtagtgcctgccgtggcggccgcgcacgctgaaggacgcgctgcatccgggagcggcggccgccagggaagcactgatgctactagtgccgatgttgcagaccccgcaggtacggcatggcgtggtaaggactccctgctgccggaaaagcagcaagtcaagggctcactcgagtgctgcggcgccgatgggggagacctcgcgcctacggcatcccttcacactgatcactcttctgtgtttactcccggtggttctgctgagctctctggtgggttttccggcgaaggccgtggtgaggaccctggtcggccggatcacgtctgcgcgcacgaggaccgggccccggaagctgtcgtcgctgatcagctgcagctgatcgacggcaaaggcggcccgctgcacggggaaaagcagtccaagtccccggatggtgcagggtggtcggcggctcgcactgctggcccttctcggctgacggttgtggacgatggccgcgggctgcagcaggggcggggggtagctgacctcccggatcttggtctgcgggccgggctggccccgatcgcggatctgtgggcccggcttagccgcgggcagcaggccgtcacccgccgggctgccctgcagtcgctggaggcgttgtccgggatcgtcgacgaacaggtagcgccgcagctgctggccggccgtctcgccgaccggctggcggaagtcggcggcgaggccctggtgcgcgagcccatgggctggctgctcggccggggcctggtccagcgccctgcctgcccggacctgaggtgcgacgacggcatccgcctggacaccggcgctgactgcccgacctgcgagaatatcgtccatatccggcgcacgctgcggacccgagtctcggcccgggtggaggccgagatgccgcacagcgactccgccacgcgccgggccgagcttgagcgccgcctgcgcgaggagaccgccatagaggagcagcgggcgcagatccgtcgggcccgggcctcgcgtgaggccgagcagcgtcagcaggcgatcgagcggcgccgcgctctcgaggaggaggcggatctggctcgcaggcaggcctcgtgcgcggactgcggtctgcccgagtgcgcaggcctgtgcccggcgtgctcctaccggcggcgtaccgaggaactggtgcgggaggccgtcgacctggccgtcgccgtgcgggccgatctgtcggacgcggccgcggtcgccgagctcacccagcggtgcgaaacggacacccgcgccctgttggcgtcggcgtgcgagcgggcctgcggtccggacgccgatccggctctggtcgcgttctacgcgccgcaggtggcgcaacagatccgggacgaacggcgcgcggcggcgctgcgccggctgctgggggcggaggatgtggtggtcgaggccgacgccgcgtatgaggcgtgcctgcggcaccgcggccgcggtgcggaagaggctgcagacgcggcgggccgccgtaccgtcgagttcctccttcgctggcgcttgggcgaactgcacgctgtccgcctgcggccggccgcaggcggggtgtcggttgacgcggcg

SEQ ID NO: 7515 - DNA, 993 bp, Streptomyces avermitilis
  CDS (1)..(993)
gtgaacactgcagccacaccaggagcacagcccaaccccacccgcgcccggcgcaaactcgcctcccctaccgtcgccatgctgccgcgcatcgccgattcgctgtccttcctctacctggacatcgtccgtatccaccaggacgacaccggagtctgcgcggaagtaaccagcgagcgccggggcactgagaaggtctatgtgcccaccgccgcgctcggctgcgtcctgctcggcccgggtacatccatcaccgcccgcgccctggccaccttcgcccgccacggcacgaccgtcctgatcaccggtgccggcggagtccgctgctacgcagccgcccttcccgactccctcaccacgacgtggctcgaacgccaaacccgtgcctgggcagacgacacccgacgactcgccgtcgccaccgccatgtacgagaaacgcttcggcgaggccaccgtcccgcccggcactacactcgcccaactgcgcgggttcgaaggccaacacgtcaaagcgcattaccgcgtgctcgcgcagcagtacaagatcggccgcttccgtcgcgcctacgacccggcctcctgggacacccaagacccagtcaatctcgccctctccgccgccaacacatgcctctacggcatcgtgcacgccgccatccttgccctcggctgctccgccgcccttggcttcgtccacaacggcaaccaacaggcttttgtctacgacatcgccgacctgtacaaggccgacctgacaatccccctcgcgttttccctccacgcctccacgaaccccgaagccgaagcccggcgctcctttcgcgacggactacgtctgttcaaactcctcccgcgcatcgtcggcgacatccaggagctcctcggcctcggctccgcctacgacatccccgatccggaagaacagctcgtcgatctatgggaccccatttccggaccagtccccggtggcatgaaccacgggacggataca

SEQ ID NO: 7516 - DNA, 666 bp, Streptomyces avermitilis
  CDS (1)..(666)
ttgagcgtctggctgacccgcatcgtccccgacccgcgctcccgagacgcccgacgtgacctcggcggcaacgactcagccatgggactgcaccgccgcctcatgtcgctctacccctgcgacgccggacccgacccgcgcgcccgcttcggcgtgctcttccgcatcgaggacaccccagccggggcgcacatcctgctgcagagcgcccacgaacccgacctcacccgcctccccgacggctacggccaagccatcacccgccccctggaccccctcctggacgccctcaaacccggcctgaccatccgctaccgctgcaccgcaagccccgtccgcaaacccggcgccaacacccgcgccctctacaacctccccgccgtcgtccccctcaacggcgccgccgccgacgaatggtggacccgccaagccgacgccgccggactcaaacccctcgccctccacccccaccccctcgacgccgcccaaggcgtacgagccggcaacggcgacaaacagcgcatccgccacaaccgcatccgcttcgacggctccgccaccatcaccgaccccgacctgctccgccagaagatcaccgaaggcatcggccgcggaaaggcctacggctgcggtctcctcagcatcgcccccacacgcgaggcccag

SEQ ID NO: 7517 - DNA, 834 bp, Streptomyces avermitilis
  CDS (1)..(834)
gtgagcgacaccaccaaggccggactgctgctgcggctgagcgggccactgcagtcctggggcgagcgcagccacttcaacgaacgcgacaccgcccgcttccccacccgttccggcgtcatcggcctgctcgccgccgcgctcgggcgccgccgcggggagaacatcgacgacctggcccggctgtcactcaccgtccgcgccgaccgtcccggcgtgctcctgcgcgacctgcacaccgtcggcggcggcctgcccccaaaagccaccgtcaccaccgccgagggcaagaaacgcagcggcgacaccaccaccctcctcacccaccgcacctacctcgccgacgccgtcttcaccatcgccctcaccgccatccccgacaacaccggcctgctcacccgcaccgccacagccctcagctctccgcagtggccgccctacctgggccgacgctcctgcccacccgaaggccccctcctgctcggccgcttcgacgacgccctccaccacctcgtccacctgccgatcgccgcaccaccgccccaacacggcccacacggcatcgagttcctctccgaccaccccctggaccacctgcccacgccagaggacacctgcccaccggacgcggagaccggcagccacccctccggcgaggtcaacgaccagcccctgaacttccacccacgccagcgcgcctaccgagcccgcccgctgtaccgacgcaccctccacctgcccgccgaccagttcaccgggctgggcacagaccacctcaccagcctcgccacctacctgcacgagcatctcaaccacccagaagggagccaccgt

SEQ ID NO: 7518 - DNA, 1176 bp, Streptomyces avermitilis
  CDS (1)..(1176)
gtgctcactccggcccgcttcatcgacatccacgtcctgcagtccgtccccttcgccaacctcaaccgggacgacaccaactccgtgaagaccgtccagtacggcaacaccctgcgcacccgtgtcagcagccagtcctggaaacgtgccatccgatccgtcttcgaagaccgcatcggacaggccgcgctgcgaacccgccgcatcggcgaacgcgtcacccgcgaactggaacagcgcggctggcccgccgagctagcccagcgcgccggcggccacaccgcggcggccagcggcatcaagttcgaactcgccaaatcctccggcgacgccaagcagaccgtccccaacaaggtgctcaccaacgccatggtgtacgtgccggaggccgcagtcgccgagctggccgacctcgccgaacagcaccgtgaagaacttcagcaggccaaggacatcaagaagcccgcggacaagagcatcctccctgtcagcacggtggaggccgtgctgcgctcccgcaacggcgtcatcaacctcttcgggcggatgctcgccgaaatcaacgacgcgggcgtggacggcgccgtccaggtcgcacacgccctgaccactcacgagaccgacgtcgaactcgactacttctccgccgtggacgacgtcaccgccgtctggaacgacgccaccggcagcggccacatgggccacgccgagttcagcgccggcaccttctaccgctacgccaccctcgacctgcgcaacctggtcgccaacatcggcgacgacccgcaggccgcacgggagctgaccaccgtattcctggcctccttcatcacctcgctcccccaggccaagaagaactccaccgccccgcacaccatccccgacctggtccacctttccgtccgcaccgaccggcccctctcctacgcagccgccttcgaaaagcccgtccaggccagcccccagggcggcttcgccgacgtctcccgcacccagctcgccgcctacgcccaggccgccaacacgctcctgggcacaaccggcatcctcacctccggctgggccagcctggagaccaaggacctcaccggactcggcgagcgccgcgactccttcgacgacctgatcaccaccgccctggacaccgccctcacccacaccgccgaggcgaacgcg

SEQ ID NO: 7519 - DNA, 684 bp, Streptomyces avermitilis
  CDS (1)..(684)
atgaccacccagagcgtcaccgagaatccaactaccgcccggcgccagcgcctcgtcgcctacacctgctggatcgagcagatctgccgggacgatcccggcgcccgcaccgcactgcgcagcggactgcgccgcaccctcgacgacgtgccccgcatgcaccgcttcgtcgccccctggctcccccatgacaggcaggcacctgagtccgagcagcgggcctactacgccgtcgcggcgatgatcgccgcgcagccccgcaccacccacaccagccccgaggccgcactggaagcggacggggcctcgcagagtccgcagccggcacccgctcccccctacggcaccagcctcggcctggccttcgcactcgccgtgaccgcaagccccggccgggagcgggagatgcgggagtccaccgccgagtcccggctgaatctgctgacccggcagagcgccaacggcctgcaccgccacctgcccgccgccgtcggctacctgcgcgagctgggcgttcccatcgactgggcccagctgctggccgacctgatcgcctggcccctccactccgggcggatctcccggcgctggctgcaggactactaccgccagcgcagccagaccctccacgagcaggccgaccgcgccgaccaggacgagaccgaacaccccagcaccagcgcc

SEQ ID NO: 7520 - DNA, 1569 bp, Streptomyces avermitilis
  CDS (1)..(1569)
atgcccgccagtacgtacaacttgttcgacgaaccgtggatccccgtccgctggacccatgccgcgcccctcccccatcccgaacgggtggggctacgggacctgctgctgcgcagcggcgacatcgccaccctcacgattgccgatccccccgcgcactccgcactgctgcgcatcctgtacgcgctcaccgcccgggtgacgggtctggacgagtcggggcccggcgactggggggagcggcgcctgaacatcctggatgccggacagctccccccagaggggatcaccgcctacgccggccgctaccggcagcggttcttcctctacgaccgtgacgggggccgcccgtggatgcaggacgcccggctgaccggccagtgcgacggcggcaacaccgccggggtgaacaaactgatcgtgacgcgcccggcaggcaacgcccacgcgtggtttcggcacggcagcgacgcccgccccgacctgccgagcgccgcggaggcggtgctgagcctgctggtgtggcactactacgggccgtcgggccgctgctcggcccgcgaggtcaacggggtcaagaccgccagcgccaccgccggccccctgcgcaccgcgctgtcctaccaccccgagggtgacaccctcttcgagacgctcctggcaggcctggtcccgccggaagtgacggtacgacgctccttcgatctgtgcccctgggagcgggaggaactgcccgacccggaggccgccccgcccctgccctgcggcccctgctcacggctgaccgcttgctcccagcacgccctgctcctcgtccccgacgaaaacagtccgggcctggtgcgggatgcctacatcacctgggcgtaccgcaccggacgcatcccccgcgacgacaactatctgatctggcagatcagccagcagggcaaccgctacccgcgcccggccgactcccggcgcgcgctgtggcgcgacctggacgctctgctcctgcacgaaccgcccggcaccgcacagccccagcgcccgaaggtgttcgactacgcgagcgaggtctccgaggacctgcgcgtgcgggcactcggtttcgagcaggaaggccaggccaaggacacccagttcgtcgacgccgacacacccccggtcatgggtttcacagagcagaaggcccccgcgaccgcgcccgcggtggggcgaatgcggcagctcggcgagatgtacgggcgccgcctggaacgcgcggtcaagcgggcctgggccgagtacatgaacgacccgaaggcgaacggcgacacctgggcggccgaggccgccgcccgctactggcctggcgccgaggccgagttctgggaccgcttccgccacctggacaacaccggccacaccctcggcgccggattcgacccggccgccgcccgcaccgcattcctgcgtctggccaccgacgcatacgacaccgtcaccgcctccgtcacccgcacccagcgcggcgcaaaggcggtggcccacgcacggatcgacctgtacggcggcgtacgcaaaaaggccacgagcacaccggccgca

SEQ ID NO: 7521 - DNA, 2943 bp, Streptomyces avermitilis
  CDS (1)..(2943)
ttgggatctgttctggtatccgtgcaggtgaggatgcgttgtcagtgggggctgttatgcatggctgtcatgatgaagcgtgagtccgtctcgccgggacatgtcccggtcgacacccggttttggggcaaggagcatggtcttccgcgcccgtacccagtgctctgccatctgctggacaccgcgggagtgttcggtgccctgtgggatgtgctgctgagtgatcaaatgcgtgagaaggtcgcacgggcgctggggctgacggtggccgaggctcggcgggtgctggcgttctgggcggggttgcacgatctggggaagatcactcctccgtttcaggcccaggttccggaggcgttcgcggccgtacggaacgatccggcctatgtgttcgctccgggggcggaacgggagcgtgcgtttcgtcatgagatggccacccactgggcgctggtgcagttgctcggcgaagcggggtatcccggtggcggccgggtgatgcggtctgcggtgagtcatcaggtggcgcaattgctcggtggccatcacggatgtttcggcgtggtcctcaaagccaaagaagtggcgcacgccagtgcctatcagcccgggctgggcggggacggctgggcggtgcaacgccgggcgcatttcggggagttgcggcgcgtcaccggggggtgggcggtgccggagcgggggctaccggccgagctggcggtgatcgtcgccgggctggtggtcgtcgcggactggctggccagccaggaggaggcgatcatcccgctgctgccgccgaaggggtggcgtgcgacgccggaagaggtcgatatgcactgggagcgtacgcagaaggcggctccggggctggtggcgggagcccagctggggcgggcgcggttcgacgctgaagggttcgaggagatgttctcgttcgcacccaacgctctccaggccgaccttgtcgcccgtctgccgcggatggtcgaggagaaggggccgggactgctgctggtcacggcgccgacgggtgacggaaagaccgaggcggccctgtacgcggcgtcggtgttgggtcatgcggctggggctcgggggctgttttttgcgcttccgaccatggccaccgccgacgccatgtatccgcgggtgagcgccttcacggagcgtgccctgagcggtgagcgggccttgacgttgctgcattccatggcctggctcagccccgcttacgcaggggccgggcagtccgccggcccgccgccggcagcgggcgacgtgagcgcggacccggccaccgtgaccgaggccggggtgtggctgcgcggacatcggcgtgggctgctggccccgttgggggcggggaccattgatcaggcgctgagcgccgtgctgccgctcacgcacaacgcgctgcggctgttcgggctgtccgacaaggtgctcgtggtcgacgaggcgcatgcctacgggccgtggatgcatcagctgctgtcccggctcctggagtggctcggcgcgttcggtgccccggtggtcctgctgtccgcaaccctgtccggccgcacagcctcgtctttggtggatgcctaccgccgcggggccggattcctcgaaccgtccgccgtcgaaccgtgctacccgggctggatgttcaccggcgccgcgaccggcgaagtctgcgtgccacgggagacggacagtgagcgccgtcgcaccctggacgtgcggatgctgcctgtcgtctgggacacggcgcccgctgccggcagtcccgtatgcgccggaggtcgccgccaggccctgcgcgaggcacttgagcccgtcgtcgcgcagagcgggaccgcgctggtttgctgcaccacggtggccgaagcccagcagaccttccgtgacctgcgcgccgcgttcccggaactcagcaccggtgaaggcgggttgcggctgctgcactcgcgctacccggccaacacccggcagcacatcacgtccgcgtgcgaaagggcctacggcaaaccccgctcgccgcaggatgtcgctctgccccggccggcatccgtcctggtcgctacccaggtcgtggagcagtcgctcgacctcgacttcgacctgattgtcacggatcttgcgccgctggcccagctgctgcagcgggccggccggggacgccgccacgcgcgcggcgcttctgggcgcccgccctgggcgctgccggaggacgcgccgcgcctggtcgtcctggaaccggtcggcgagagcggggccacccaggtgccgcgcacctggggaagcgtgtacgacgccgggctgctgcagcgcacagcgcacctgctgcgcgagcgggccgcgtccgggatcgcggtcccgggggacgtgcaggagcttatcgatgccgtgtacgcggaggacttcgtggaccgactcgagggggccgtacagcgggaactggcgcggatggactccgcgcggcaggcggacgaggcggccgaggcgcacctggccgacatggttgccatctgcgcgcccgccgacgtggccggtgacctgcagcggctcagccgccgggaggcaggggtcaccgaggaactgctgaccactcggctgggggctgacagcgggcgcgttctgtgcctgtacgagcagcaggacaacaccctcacccttgatgagggcggcaccctccccttgcccacaggaaaccaaaacggtctgcttcatgccgagttgcggcaggtgatggcacacatggcgccggtgccgggcgcctggctgcgcggcgccgagggacacccggcgccgccgggctggggcaagcatccggtgctgcgtgatctggtcctgctgcggatgcagcccgcgggccaggatggcgcagcagcggtctggagctgccgccacggcacccggacgatccggatctccggtgtcggactcgaaaccagc

SEQ ID NO: 7522 - DNA, 846 bp, Streptomyces avermitilis
  CDS (1)..(846)
gtgcgggccggttcacctccgctcgcgcggagagcacgaaggcggcggcggggacggccggggcgaagaaggttcacctccgctcgcgcggagagcacggcgtcgcgttggcgatggggcaggcgtcacacggttcacctccgctcgcgcggagagcacccgaagatgtcgccgaggaggctgccgaactgcggttcacctccgctcgcgcggagagcacgcgtcgacaccgacgcccgggtccgcgcggaccggttcacctccgctcgcgcggagagcacgatccacccccacatcgtgtacaccgcgcttgcggttcacctccgctcgcgcggagagcacgtcctgatgaagcggcagcacccgacgctgcgcggttcacctccgctcgcgcggagagcactcgtagagggcgtcggcgccggacttgccgagcggttcacctccgctcgcgcggagagcacgacgacgagcaccgggatgccgacgaacacccaggttcacctccgctcgcgcggagagcacgaggggaccagcttcctggagcgcgtggtggacggttcacctccgctcgcgcggagagcacgtgaggacgacctggacgttggacccgcgcgccggttcacctccgctcgcgcggagagcacccgcactcgtcgcacgtcagtggtgcgggcggcggttcacctccgctcgcgcggagagcacgtctggggcgggctgaaggcggccgtgtcgttcggttcacctccgctcgcgcggagagcacacggtcttcttggccatctcgtcgtagttctccggttcacctccgctcgcgcggagagcacggctcggcatcctcgc

SEQ ID NO: 7523 - DNA, 1632 bp, Streptomyces avermitilis; identical to SEQ ID NO: 264
  CDS (1)..(1632)

SEQ ID NO: 7524 - DNA, 807 bp, Streptomyces avermitilis
  CDS (1)..(807)
gtgatgagcacgaagaacggcacgaaccaggccaggaccagccgcgacgtcggctccgaactgatctatctgaccaaggcgttgaaggccccggccctgcgggacgctgctgccaggctcgccgagcgggctcgcgacgagggctggagccacgaggagtatctggccgcatgcctgcagagggaggtcgccgcccgcgactcccacggcgccgagggacgcatccgggcggcccgttttccctctcgcaagtcgctggaggacttcgacttcgaccaccagcggtccgtgaaacgcgaggtcattgcccatcttgggacgctggacttcgtcgccggaaaggagaatgtgatcttcctggggccacccggcaccggcaagacccacctcgccactggcctgggcatccgggcctgccaggccggccaccgggtcgccttcggcaccgccgcccagtgggtcgcccgtctcgccgaggcccatcaagcagggcgtctgagcgacgagttgacccggctgggacggattccgctgatcgtggtcgacgaagtgggttacatccctttcgagcccgaggccgcgaacctgttcttccagttcatctcgggccgctacgaacgtgcctcggtgatcgtgaccagcaacaagcccttcgggcgctggggcgaggtcttcggcgacgacaccgtcgccgccgcgatgatcgaccgactcgtccatcatgccgaggtcatctcgctgaagggcgacagctatcgcatgcgcggccgcgacctcggacgggttcccgccgccaacaccggggaa

SEQ ID NO: 7525 - DNA, 1239 bp, Streptomyces avermitilis
  CDS (1)..(1239)
gtggaggactgggcggagatccgtcggcttcaccgggccgagcagatgccggttcgggcgatcgcgaggaagctggggatcgcgaggaacactgtccgcagggcgatcgcggacgacgcgccgccgaagtatcagcgggcgccgaaaggctcgatcgtggacgcggtcgagccgcagattcgtgaactgctcgagcaatggcctgagatgccggcgacggtgatcgcggaacggatcggctgggaccggggtctgacggtgctcaaggaccgggtcagggacctgcggccggcctatcggcctgcggatccggcctcgcggacggtctatgagccgggcgagatcggccagtgcgacctgtggttcccgccggcagacatcccgctcggcttcggtcaggtcgggcggccgccggtgctggtcatggtcgcgggctactcgcggtggatcaccgcccgaatgctgccttccaggtctgcggccgacctgatcgccgggcactggcggctgctgacagagctgggcgccgtcccccgggtgctggtctgggacaacgagggagccgtcggctcctggcggtccggcggaccccaactcacagacgaatttgctgcgttcgccggactgctcggcatcaagttcctgctctgcaagccacgggatcctgagtccaagggcctggtcgagcgggccaacggctatctcgagacgtcgttccttcccggccgggtgttcacctcgccggccgacttcaacatccagctcgcagactggctgaccagggcgaaccggcgcatccaccgcaccttgcaggcccgcccggcggaccggctggaagcggaccggtcccggatgctggccctgccgccgatcgccccgccgggctggtggaaggcatctctgcgactgccccgggaccactacgtccgcctggacacctgcgactactcagttcacccgctggccgtcggccgccgcatcgaggtcgccgccggcctggaccaggtcctggtgacctgcgacggcgtcgaggtcgcccgccatgcccgcagctgggcccgccaccagaccatcaccgacccggaccacgcggccgctgccgcggtcgcccgcaaggcggccgccggcacgaaaccggcgccagtggacgtgacagaggtcgaggaacggtcgctggacacctacgaccggatcttcggcgtcatcgacggcgggctgagcacgggtgaaggggcagcg

SEQ ID NO: 7526 - DNA, 1632 bp, Streptomyces avermitilis; identical to SEQ ID NO: 264
  CDS (1)..(1632)

SEQ ID NO: 7527 - DNA, 306 bp, Streptomyces avermitilis
  CDS (1)..(306)
atggtcgtcttcgagacgccctacgcctgggccaaggcggcgtggctcgttgtgctggtcgcgtacaggttcggtgcggcggccaccgcgagcacggccatggtggcgaggaccgaaccgaatgtcatcaccctctgcttcctggccggtcggttcatctccgctcgcgcggagagcacgaccggatcccgtcccgcacctcgttgtccgccggttcacctccgctcgcgcggagagcactggtccagcatcacgcgaagcgtgtccccgtccggttcacctccgctcgcgcggagagcacgacgg

SEQ ID NO: 7528 - DNA, 180 bp, Streptomyces avermitilis
  CDS (1)..(180)
ttgggtccggcatctccatctcgacgccctgaggtcggacggcacctgcgggaactgcgcgaggacgtgcgccgggcgggcggggcgcgtgcggcggccgacgcggtggagcgtctgctgacgcgccggcaggccggggaggctcagccgctgggcggagtccaggatcctcccacggcc

SEQ ID NO: 7529 - DNA, 156 bp, Streptomyces avermitilis
  CDS (1)..(156)
atggagatgccggacccaaccctgctctacagctccggcctcaccggcctgcccctggccgacctgttcctgaccaccgtcaacccaggccggctctcgcgtccgtcccgggtgtactccgtggactaccagcgcccacgaaagacgacttggcca

SEQ ID NO: 7530 - DNA, 594 bp, Streptomyces avermitilis
  CDS (1)..(594)
gtgatccaccgtacggggagagtattcggcatgacgattacaccgaagcaacgggcagccctgacagacgccgtcaggggcggcaccgaaagtcttttccggcgggctgccacggccgctttcttatgggccctcgtgttcacggcttttcatttctactggttcgcgggaggtcgcttcggtctcggcgacggcccgaaaatgattccggagacgggaaccactaaggatctcatctgggctttcgtgatcacctcgatgttcgtggtcggaattttccttccggtggctctgacgcgtccgtgggggcgccggattccgcgctggatcaccgtttgctgtctgtggatcggttcggcgttgctcgtggtgcggggaggcgcgggactgctcgacaccgcgctgcgtgagacgggtctggcggatcggggactgacgggcctgacgtaccagcagatcaccggggacgcgcatccctcgctgaacacgaaggtgtcgggcatctgcatcgacgcctacttcatcctgggcggcctgctgtacggacgtacggtgctgctgcaccggcgcctggtccgcggcgccgacgaggga

SEQ ID NO: 7531 - DNA, 480 bp, Streptomyces avermitilis
  CDS (1)..(480)
atggggcggggtacgtggagttggattgttccggacgggctgtgggagatcgccaagccgttgatcccaccgtcgaaggtgcggccgcagggcggcggcacgcaggacacgcctgatgagacgctgtttgcggcgatcatctacgtgctggtgagtgggtgcgcctggcgggctctgccaccgtgcttcggcatatcgaagtcgacggcccaccgccggttcctgatctggtccagggccggggtctggggccggctgcacgaagcggtcctgcaccgactcgacgacgccggtctcatcgatgtctcccgcgtcgtcctcgactccgcgcacgtgagggctaaaaagggggcgaacacacaggtccgagccccgtggaccgaggtaagccgggttccaagatgcacgtcctgtcggacgcgaacggactgcccctggtcgtcggcgtctccgccgccaacgtccacgacagcgagggcc

SEQ ID NO: 7532 - DNA, 441 bp, Streptomyces avermitilis
  CDS (1)..(441)
gtggaccgaggtaagccgggttccaagatgcacgtcctgtcggacgcgaacggactgcccctggtcgtcggcgtctccgccgccaacgtccacgacagcgagggcctgaagccgatggtggccggtcaccaaacgagacacgacccccaccgcggccgctgcttcaagccccagcgcctccatgcggacaaggcgtacgacattcctcacctgcggaaatggttacgcggcaagcgcatcggcgtgcgcatcgcccgcaaaggcatcgagtccagcgaacggttgggccgccgccgttgggtcatcgagcggaccatctcctggctgtccggctaccgccgaatcagcccccgctacgaacgcaatccccggaactacctggcctttctcggcctcgccgctgcactgtgctgctacaagcgactggtccgcctcaccaca

SEQ ID NO: 7533 - DNA, 783 bp, Streptomyces avermitilis
  CDS (1)..(783)
gtgtgcttccggtacggtcgcggcatgactggcgtgttcgacgtggcccaggctctagacggcggaatcaccgacatggagcgggcgtgggcattcgtccgcggcttcgccgctgcttgggacgagccgttgaccgaggacgacggcacgcctgcatcggaactggcgcgggccgaggcgacgctcggctgctccctgccggccgtgctgcgcgagttctacacgctcctgggtacgcggtccggcctgctcgccaaccaggatccgctgctgccgcccgccgagatgttcgtgcatgacgagtgcggcggtgtccttgtcttccgcagcgaaaaccagggctgcgccttctggggcgtgcgcctgcgcgaccttgatcaggacgatccgccggtgctcgtccaggcgcggcacggctgggtgccgttcttggaccgggtgtctctggcctgcgtcgagcttgtactgagcgaggcactgttcggcggtggcggtcagctgtacaacgcgtgcgagctgccggcggacctgcttggggcggtgcccgcacgcttccagcgggtcgcgctgcccgactatccgatgtggacgggtccggaggactttccagtgcgttggttctccgccccgggacagttgctacgccaggacggcttgggcgcccacagctggctgcacgttcggggccggacccgggccgacctggaggcgatctgcgagaccgttcccggacggtgggccctgggatacaccgagtcactggacgccgagccgctgcccttc

SEQ ID NO: 7534 - DNA, 399 bp, Streptomyces avermitilis
  CDS (1)..(399)
gtgagtactcggccgtggatcgtggacgacgacttgtgggcactgatcgagccgctgctgccaccctggcccgagaagtcaccagggccacggccggtggctgaccgacactgcttgcagggcatcctgtacgtcctctacaacgacatagcctggcaactcctgccgctggagctggggttcggttccgggcagacctgctggcgacgcctggaacgttggcagcaggcaggggtcttcgaccagctacaccggatcctgctggccgaactgaacgcggccggccgcctcgactggtcgagggcctgcgtggacggctctcacatccgcgcgaaaaagggggctccgagactggtccgtcgccggtcgaccggcggaagacgggcagcaaacaccact

SEQ ID NO: 7535 - DNA, 243 bp, Streptomyces avermitilis
  CDS (1)..(243)
atggcgagcatcagttactgtgatgagccgaagcgcgatagttgtcacataggcgggatgttgtcaccgcccgcgggggctgtgcacatcgtgcccggcttcaagcacagctcgccggtggcctcgtcgacactgaaatacgtgtcgcacacacaagcgcgcgccaaagggctcaccccatcaggacgatgcgagcccggcccaaaaccagtggctatcagtgagcgttttcagcggggccac

SEQ ID NO: 7536 - DNA, 762 bp, Streptomyces avermitilis
  CDS (1)..(762)
atgcttgtctacccatcggggatcgatctgtccacctcgaccctgcgctacctgtccgacctgctgagagcccggcggcgtgagcgcggcacgcgctggcgccgcctgaccacggaccgacaggctctgctcgcgctggcccatctgcgctgcgggcacacgtacgcccagctcgcggccggcttcgggatcgggctggccaccgtctaccggtacatcgtcgaggcggttgaggtcctggccgcccttgcccccaccctccagcaggccatgactttcgccgccaacaaggcattcgtgatcctggacggcaccctgctgcacatcgaccgcattgccgccgaccgcccctactactctggcaagcacaagcgccacggtatgaacgtccaggtcatcgccgacgcgttcggacgcctgctctgggcctcacctgccctgccaggtgccgtccacgacatcaaggccgcacgcatccacggcatcatcgaagcgctcacccaagctggcatccggacgtgggccgacaagggatatcagggagctcaggggacgatccgggtgccttaccggggccgctggagcacgctcccagccgggaagcgggcggtgaactcctcccacgccaagatccgagccgtcggagagcaggccaacgccaccctgaagagctggcggctcctgcgcaaactccgttgcagcaccacccgcatcaccgacatcgtcaaggccgtcctggccttgcacctcgccacggcagcc

SEQ ID NO: 7537 - DNA, 243 bp, Streptomyces avermitilis
  CDS (1)..(243)
atgacagacgtcagagtcacctacgacaagaccgtcaacgcagcgtacgtatacctcaccgaaccgcaggctcgcgtgaagtccgcgcgcatgtatccctgcgatccagtggacgtcgacggcatgatcaacctcgacttcgacgagcagggccgcctcatcggcatcgaggtattggcggctagttcgaaactgcccgagtacctgctccagtccgcggagcgacttgacaccgaaggtgca

SEQ ID NO: 7538 - DNA, 336 bp, Streptomyces avermitilis
  CDS (1)..(336)
gtggcggtacgacctgccgccgggaggactcagctgatgagcgcgcagcccgaccacgcacccgtcacgccctacgccccccccggggctccggccgaactcctcgcccagctgcgcgccgaccggcgcgccgcacagtgggtgccggtcttcgagcgggagtgggcggcggcgctggaagagtcccgccggacgttctccctcgccgggctgtacgaggtcgtccaggtctggcaggcccgcgtcgtctccgccccagcggtcgacgagttcctcgcctccggccgtgacgagaccggggtcgtggacctggaggagatccggagcaggcgccgg

SEQ ID NO: 7539 - DNA, 2979 bp, Streptomyces avermitilis
  CDS (1)..(2979)
gtgggggcacgtaggctgctgtcgttttcggacgcgttggcgctgctgggtagcgacccgcccgccgttgccgcgctggaccgggcgctcggtggagtgctaaacatcgcgacgggcggagtcgctgacgggctcgtgcggatcgccgacgcccggggcagcgtgctgacgctcggccgtggcgccgtgcggggtatcgggcggcgcctgggcctggcggacggccgtgccgagcgcaccgagctgctgcacgccgcccacaccgtgatcgtcgtcctcgcctggttccaggccctggaggcacagcatctgcccgttcacctcgaggacttggagctgacccgccacgaacagctcgccctcgcgggcgcgccgcacgtggcggagcgcggcgccgcgttcgcccgctcgctcgccgcctccgacgcgccgagccccgcgccccaccggcccttcgaggtggtcacggacgagctgcagcgctggtacgagggcctgtcgacgaggtttctagacttcgtcgagggactccgcgtctggaacacgcagacggagacatcccggggcgaggcccggcggattatccgtaccgagctgccccgcgaggcagtccggcagtacgagtccctgtatgcccagctggcccaagaggcaccggagttcgggttctggacgacccagatcgagcaccgggcgacccgggccgaggtgcgccgctccctcggggggatcagcgagctgcttgccggcctggcccgcacagtccgtccccccgtggacgtcgcggcggctctggcccgctcgtccgaggccatgctgacccgcaccgtcctggacgcctcgtccggcccggaaggcatccgtgtaccgacgctgcgggagatgtacctcgacccggacttccgggtccgtgaggtgtccggatcgaacgggccggctaccgagtcctggtgggaggaggcccaagtccgccgggacctcactggctacctcgccggaacgctgacgttcgctgggccggccgatgcgcccctcctcgtgctcgggcagccaggcgcgggaaagtctgtcctgacgcgagtccttgccgcccgactgccctctgccggcttcctgcccgtgcgcgtgccgctgcgggacgtacatgccgaggacgacctccagacccaaatcgagcaggcggtgcgcactgcgaccggagagcgggcgtcgtggccggagctggtccgctcggccggcactgccgttcccgtcctgctcctcgacgggttcgacgaattgctgcagaccaccggggtccaccacagtgacttccttacccgcgtcgcccgcttccagcaacgcgaggcggaacagggccggcccatccgtgccctcgtcaccagccgcatcgccgtcgccgaccgggcccgctacccagagggcctcgtcgccctgcgcctggagccgttccgacccgagcagatccgcagctggctcgcagtgtggaacgaggccaatgccgacagcttcgcagcccgcgggctgcgcccgctgagctgggaggccgtcgagcgacacttagcgctcgctgagcaaccactgctgctgacgatgctggcactatacgacgccgccgacaacgctctgcgccgcgacagcgacggcccttttgaccaggccgagctgtacgaggaactgctcaccgccttcgcccgccgcgaaatcgacaaggacggccccgcccctgccgcaccggacgacgagacgcgggcccgcggcgaacgagaactgcaacggctgtccctggtcgccttcgctctgcacaaccgccgccgccagtgggtgtcggccgccgaactcgacgaggacctgacggcgctcctgggcagggcatccgcggaggcctccgggtttcgaacgccgctcggtgccgccgaagtggctctcggccgcttcttcttcgtgcagcgtgcccagtctgtgcgcgacgggcgcgcactggccacgtacgagtttctgcacgccactttcggtgagtacttggtcgtacggctcgccctgcacgtgctcaccagccttctgacgcaccgcccttccctgtccgcagctaagagcagcgtcgacgacgacctcgcctacaccctgctctcgtacgcgccactgtcctcccgccagatgctgcgattcgccggatcgatggtgcgccggatccccgctgccgagcgcgaccagctagcacgtctcctcatcggcgtactcgagcagcacggccaacgcacgcacgagccccatcctgcctaccggcccacccgctttcccgcttccccgggactgcggacttcggcccgtcacggcatctacggcgccaacctggtcctggtgatcctgctcttgaagggccgtgtcagcgcgggcgagctgttcccgtcctggaacgaccatgccagtgcctggcaccgccatgttctgctgtggcgggcctcgttcgacgaggagcagtggaccgacttcgccgtgtccctctcggcccgccgcacctggtccgatcagggcagggaactggaaatcatcctgcagtccggcgcagtggaatcgccggacccgctggacatgaactggctgtaccgctacccccggggcaacgacggcccgggctggtcgcgtacgtattgggaggaagtgcagcacaagttggacgtgtccggcggcacgaacgacggtgtcgtacggcatgtcatggacccggtcttcacatggctcggaccgtccgtcaccacgttcctcacatcagcaggaggtccggccacttctctggctcacgatgtgctgaagctgttgctcggcggagcagacctgccgcccggcgaagaggacaccgtgcgcgcccgggtgctgcgcggcctcgacaacgttccgcgcgaggtgcgggagcggatacgacgactggtcgctgagcacccggcgccgtcctcagggaccggctcgaccagcggcttc

SEQ ID NO: 7540 - DNA, 363 bp, Streptomyces avermitilis
  CDS (1)..(363)
gtgcccgatcgttgtggtgtcagggggagggagagcgatccgcacacgcaggtcaagcacctcgtgtaccggcactacctgcagtgctggatgggcaagatcctccagaagttccccgaggccaccatcgtggacgccttcgccggcccgggcatctacaccgacggcccgcccggctcccccatcgtggtcgccaagaccttcctcgagcacaccgcataccggaacttcggccggctcaacctggtctgtctcgaagagcgccccgaccgggtggaggagctccagcggcaattcgccaaactgccccgctcgccgcagctgaacatcagcgtcccaccgggccgacgtgccaaagtgtgt

SEQ ID NO: 7541 - DNA, 657 bp, Streptomyces avermitilis
  CDS (1)..(657)
ttgcttgcgggttccaaaggggagacgcgcagtgatggtgatggtgccgatggcctctgcggtggggggcgctatgtacgcgcaggggcgtgcgggcggtgcccgtgcaaccggcggctcccccggggacacttcggcgggcagggacacggggaggacgctggggaaagggccgccgtctcgacgttggcctacctgccacacccctggaggaagtgctccatgttccgctccgtcacccgcggcgcccggctcctcgtggcggcggccgcagccgccgccacgctcggcatcgcggcaagcccggcaacagcgaccgacgactggctgtcgccgggcgatctgcagaacgaggcgacgctcaagtgtctggatggcagctcgcggggcatccgcctgctgaagtgcaacgacagcaagtaccagaggtggcaggcctcgcccgaggactactccttccggaacgtggccaccctcacgtgcctggacggcagctcccgggggctgcgcctggtgaagtgcaacggcagccggtaccaggcgtgggtgtggcgcggagatgagctgcacaacgcggtgctgggtacctgcctggatggcagctcccggggggttcggctggtgaagtgcaacgacagcaagtaccagcactggtac

SEQ ID NO: 7542 - DNA, 528 bp, Streptomyces avermitilis
  CDS (1)..(528)
atggcctcaaccgcaggattgaaccaaagggaggccgccgcccgccgatccttgtggcaccgggaaaaacaacaactgcgccgtgcaggccggctgacggacagcatccaagccctcgtcaccggagctgtcacccaggaggtcatcaagcgtgggtggaagcgcacctggcccgacatcccgcaccaggcatacgggcggtggcccggttccccggagggagcatggcccgaggcgctgacggtcgacctgcccgccgacctcgtgcaggcagtccgcgccgcatgctggcacacttgcaggaaggagatcggcctgctgtacggatggcgcgaacggcaccccgacgccaggccccgctgccccacgcgacccggatgcgacgccgccgccctcgccgaataccaggaactcgcagcgaaggtcatcacacccggcgaggtctggcgcgccgccgttgcacgcggcatccacgatgcgagccccagggattcgcctgcccgtgaacgccgccgcaggcatcgtcat

SEQ ID NO: 7543 - DNA, 141 bp, Streptomyces avermitilis
  CDS (1)..(141)
gtgcaggccgtcctggaccgccgcggcggctgcgtgcgggtcggccgcgacctgtacaagcccgcgcaccggcactacccgagcctcctggccgccaacgtccgtacggccggaaccctggtccgccccgacaccgcgcgt

SEQ ID NO: 7544 - DNA, 408 bp, Streptomyces avermitilis
  CDS (1)..(408)
atgcctacgctcagcatcaatttcgacccggccgtcatcgcgcacttgatgaaagcgagcggcgacgacaccgtgcaggtgactctcaccctcggcaccgggggcaagccgtcatcgccgaggcaggtggtcccccacggtccgctggccgatctcatgcaagcggacctgctgaaggcgggcacggtcctgacctttcaccagcgccgagccaaccggtctgggcgcgcggtggtgacgcctgacggccagttggttgtcgatggccatgccactccgtacccctcgccgtccaaggcggcagaagctgtgaccggcaacgtgatcaacggatggacgctgtggcacgtggaggacggacgcacgctcgatgtcctgcgccgtgaactcgagtcacgcaacccgcag

SEQ ID NO: 7545 - DNA, 2256 bp, Streptomyces avermitilis
  CDS (1)..(2256)
ttggtcaggaggtgttccatgtccgagttgtttgacgcggtcgacgcgctggtcgcgtcccgcgccacgctgccgccaccggcggagcgcaagcggctgcgtgccgcgcacggtctgacgattgacgaggtggcaggcgcgctgaaggtgcggcgggccacggtgtccggctgggagtcgggcaagaccgagcctcgcccgccggagcgcgacgcctacgctcggctgctggaccagctcgcggagctctacccggcgccctcagcactggaggagccggacgccccggcggtgccgaccaccttcaccgccgcgcccgccccggctgaggcccggactctgtctacaggcccggcgcccgaggctgcggacatgactgcaaccgagaacactcagaccagccccgcccccgtcgccgctgctctggaggccgcgccgcgtccggcgggcaccagcaggagcacgtcgacgtcgcgccgcccggccgtgcggaaggctgccccggcaggcaccccggctggcggcaccgacccgcggttcgagaacggtccgttggcggtcatcgacgtcgaggatgggcaggtcctcgcgtactgcactggcggtctggtcctggacgtgcccgccaagtcgatcccggccctggtggactggacgctgcgcgaggcgaagctcggccagccgaagctgtccgggccgggcaaggacgccgacccgctgatcgtcctcaccgaggccgcgctggagcgctacggcctgccggtcgccctcacggatgaggagcggctcgctgggcggattccggagggccacaaggtcatcaagcagctggtccgcgcggagtggaagctgacgaagcgcgggtttgggccgtgggcgcggatctaccgtcccgcacagggttcggagcgggcctgcgtgcagctgtgcattccgtcctggaacgcgctggacacccggcactggggcgaggccgggcagctcccgccggcggaactcgcccgtgtgctgggcgtgtacgcgtcccgggtgatgacgccgcgcggatcgacggcggtgaccggcctggagctgatgaccgcgctgcacccgccgacccgcgcctccgagcccgatgagagcgggaagcggcactccgagcacaaccccggctcgctggggaaggacccggtggactgcgccccgtgcgaggcccccgacgggcacccgctgctcaaggacctgccgcggttccacgtgcgcggcccggcggagaagctgttcgaggaggcgtacgactgggcgcggccgatgacggatgccgagtgcaccctgcggcacctggtcggcatcgacgtgaacatggccttcgccgccggcgccaacggcctggccgtcggcctcggcgcgcccacgcacgtcacggcgccggtgttcgacgcgaagctgcccggatcgtggctggtggacctctcgcacgtcgacctgtcgagggtgaaggtcggcaaggacaagtgggtagacctggacgcgagtctgctgcccagcccgttcacgccgaagggcgaccggcccgagggcccggcctggtacgcgacgcccaccgtcgcctacgcggcggaactcggctacgacgtcacgccggtcgaggcctatgtgcggtacgagaacggccgctacctggacggctggtacaaccggctgcgtgacgcctacctcgccacgatggccgacctcggcgtccacgccgacctctccccggccgacttcctcgcggcgatggacggctacaaggagcgtgatccggagctggcgatcgtcgtctcggccatcaaggcgacggtgaagggcgggctgggcaagctgcgcgagcggccccggggtgagggctggcggccgggcgagccgtggcgggcactgtcgcgtccgacgtggcggccggacatccgcgcggcggtcatctcccgcacccggatcaacctgcaccgcaagatcgtcaagcacgcggcgttcaccggccagtacccggtcgcgatcctgtccgactgcgtcgtctacgcggctggcggtgagggcccgttggacttcctgccctaccgggacggcaagccgctgcccggcggttttaagctcggcatcaaccccggcctggtcaagcacgagggcacccagtccgtcctatggggtgaagaggtccgcgagcggttcgacgcgccggagctcaacctcgcccggtacatcaaggacggcaccgtcaccgacgccgacaacggcgaa

SEQ ID NO: 7546 - DNA, 555 bp, Streptomyces avermitilis
  CDS (1)..(555)
atgagcatgttcggggacggcctggaagccgcagtgcacaaggcgttcacccggccggcgcccaagagcgcgggcacgcagatgcggtacctggtcaagcagtacaagggcaccaaggcggtcgcccagctgctgcggatctcccagcgcaccgtagagcggtacgtgaaggaccagatcaaaaagccccgcccggacctcgccgcccgcctggagcgcgaggtgaagaagcggtggcagccacagatccgcgccaaggcacggcagcaggcggcgaccaccggcggcatcgtcatcgacacccgcgcccgccttggctacaccgcccccatcggctccacggaccaggaccgcatccggcacctgaccatcgccctgccgccccgctacgccgcccaactcttcgaagcccaggaacagggtgccagcgaccagcagctccaggagatcgccgccgaagcgctcaaggaggtgtacttccaggacggcggccgccgcgctggaagcctggaagaggtccggttcacggacatcgagcacctcgagttcgacctg

SEQ ID NO: 7547 - DNA, 555 bp, Streptomyces avermitilis; identical to SEQ ID NO: 734
  CDS (1)..(555)

SEQ ID NO: 7548 - DNA, 537 bp, Streptomyces avermitilis
  CDS (1)..(537)
atgcggtacgcggatggtgggggcctgaccgctgagcggcgggctgcgcgtgaagggatccggctggaggccggggtgaggttcgcacgaggtgacaggacttcggacatcgccaaagacctgcgggtgagcgagcgttcggtggagcaatggcgccgcaactggcgtgaaggcggtatcgagggtctgaagtcgaagggacctgcgaaactgccgaagctgtcggacgaacggttcgccctgctggaaaaggagctggccaaagggccggccgcgcatggctgggaagaccagcggtggacattggaacgcgtcagaacgctgatcggccgccagttccaggtcagttgctcgatcgcgggagtgtggcggctgctgcaccgccacggctggtcctggcagagcccggcccgtcgcgcgctggaacgcgacgagcatgcggtcgagctctggaagaaggacgtgtggccgcaggtggaagtgccgcggcggcgctcggggcctacatcgtcttcgaggacgaggccgggttcgcga

SEQ ID NO: 7549 - DNA, 2505 bp, Streptomyces avermitilis
  CDS (1)..(2505)
atggctgtgaaggaactccgtcctcatcagcgagaagccgtggacgcggtactccgggcgctcgaattgcctgcaagatccactgtgccggagcggggtctgcggactcaggtggtcatggcgaccggggccgggaagaccctcgtggccacccggagtgcagaggagctccgtgcgggccgtgtgctcgtcctcgtcccttcgctggatctgctcgcccagaccgagaccgcctggcgcgagggaggccgtaggggcccgatgatcggagtctcgtccctgcgcggggaggaagcgggcttccccaacaccacggacgtgcaggagctggtcgactgggtgcggccgttcgacaaggtcacggtgttcgccacgtacgcctcgctcgggctgggcacgctggaacgcgcgcacgccgccggccttccgggctgggacctgatcgtcgtggacgaggcgcacagggtttcgggccggatcggcaagccatgggcggtcgtccacgacaacactcgcatccccgccctgcgtcgcctctacatgaccgccacgccccggctgtggcagctggacgaggacttcgagccgggcgcgccgggcgagctggtcgcgagcatggaggacgatccggacgggccgttcggcagcaggtgcttcaccctgacgctgtcggaggccatcgaccggcggatctgtgccccctaccaggtggtgtgcgtggacatcaccgacacccagctccaggccgcgcagctcctgggcgccgaagcgcggtccgagcaggtacgtggtgcgcggctcgccgcgctgcagacggcgctggtcaaggcgtcggccgaggaaggcttcaggcgtacgctcgtcttccaccacgtcgtgaaggaggccgaggcgttcgcggccggtctcccggacatcgccgcgcagttgcacgccgccgatcccgagctgtacccgcgtgccgtctgggtcaactggctgtgcggcgagcacaagccactccaccgccggcgcgtcctcacggaattcgccgacggcatcgccaccgacggcacagtcgtggagaagagctacctggggtccgtgaaggtcctgggcgaaggcgtcgacaccaagaactgcgactccgtctacttcgccgacgtacgcggctccatgcccgacctcgtccaggccgtcggccgggcactgcggatgcagccgggcgaggggaagacggcctccctcgtggtgccggtactgctcgggcctggggagacagcggacaacatgctcacttcccgggcgttcggcggactggcgaaactgcttgaggccctcagggcacacgacgcccgcgtcgtggagcagctggccgaacagcaggcccccagccgctccaaaggcgtgcagacgcgggaaatcagcaaggagcagggaggcagcggggacggctccagcgtctcggtctccgcgaaggcgctgctgaagttctccacgccgcgcgacccggccgccctcgcggcgttcatcaacctgcgcgtcctcaaccccgaacaccaacactggcgccgcggcatcgaagccgccgtcatctacgcccgcgaacacggcgacctgaaggtcccgttcacgttccacgtgcccggccacaccggccaggagacgcaggccaagggctggccggcctcgctcgccgcgtttccactggggcagtggatcgccgacgccagaaggttctacgcccgcggggacatggacgccgaccgcgtcgagcagctggaaaaactcggcatggtgtggtcgcacttcgacgtcgcgtgggaggagggactggccgccgcgcgcgggtgggccgccgaacacgggcaccttctagccccgctggacgccacctaccagggcgcgaaggtgggcatctggttgaagaacgcgcggaccgccgcccggaaggctgccgagatcgaacggcggcgtgccgagggcctgccggtggagtcgtcggccggggcactgtcggacgagcggcgcgagcagctggaggagatcgacgcgtcgtggtgcccgagctggccggtgacgtggcagaggtgcttccacctggtccggatgcacctggacgcgggcgaggcgctgcccaccacggcgggcgaggtcctgggccagggcgaggatctggggcggtgggtgcggtcggtgcggctcggctgggacaagctcacgaccgtgcagcagtggatgtgcgagcacgtcctcggcatcacacccgccaccgaggacgaaaagccgaaaccgcgccgcacacaggccgacaagtgggcgatgaactacgaggccgccaaacagttctacgaacgcgaaggccaccttcaggtcccgaggaagcacatagagcggaccgtcggcgaagaccaggaggagcgagagcacaagctgggggcctggatcgggaatcagcgcagcagggccgcgacgctgacgcccgagcggatggagaagctgtccgccatcggaatgcgctggacg

SEQ ID NO: 7550 - DNA, 192 bp, Streptomyces avermitilis
  CDS (1)..(192)
atgacacacaagactgaaaacgagaagggcaaccggttctgcaaggcgtgcggcacgcccgccgaagacggaaagctgtgcaaccactgcagcaccgtcctggacctccccgacgatgcagggctgaccgaagaccaaggtgcagcagtacgacgcaacttcgaaggacgcaccgagcagcaaaagcaaaag

SEQ ID NO: 7551 - DNA, 408 bp, Streptomyces avermitilis
  CDS (1)..(408)
gtgcagcagtacgacgcaacttcgaaggacgcaccgagcagcaaaagcaaaagtgagcgaaacggcagggacaaacccaacccactgaacagcatgcacgggggtacacgggccagcatggcaaccaagaccgatcgcatcatgtccctgcgcgccgtgcggcaactgcgccatgtccgcgccttctatgcggcaggagtcctgttgtgggccgccgcagcaatctggacgggatggacccatcccgcaagccggcagatgtgggtctccgtacttctcctggcggtcttcacaagcctgctgttcacgacttccctgtggctgtggcgcctccaagccggcacagcaggcaggccggcgcatcacgctgcaccgcgacaggtggtcgcccgacgccgcgcgaacgcc

SEQ ID NO: 7552 - protein, 143 aa, Streptomyces avermitilis
MTAEWYVLVEEDTRETKRADGVELRLHRWKLAATQHIAGDQEQAAAAAEDAALNYMPGVLARHARPGDEPARHAFLTQDGAWLVLLRQRHRECHIRVTTARLMHTQEEKEAPPKSFKEKLRSALDGPQPPEPAGRPWKPGSET

SEQ ID NO: 7553 - protein, 77 aa, Streptomyces avermitilis
VPPQGARGTIVSATGSGKTSMAAASTLNCFPEGRILVTVPTLDLLAQTAQAWRAVGHHSPMIAVCSLENDPVLNERT

SEQ ID NO: 7554 - protein, 181 aa, Streptomyces avermitilis
MDWNFPDDDIFFCGGCGDDDTPDPRVPRQDKALCVRCDRVERQVRRYRITVPRRNAIMRFQRDVCALCQEGPPTDHCPDAVSFWHIDHDHRCCPPGGSCGRCVRGLLCLPCNATRLPAYERLPNVLRDSPRFNTYLNSPPARHPEARPTARDHAGPRDASSYLIDAFFTAADHPEGNALSS

SEQ ID NO: 7555 - protein, 168 aa, Streptomyces avermitilis
VALTPGGTRVTQWQDRQAIGDMHERRVAAALRARGWTVQPCGQGTYPPAVREALRRTRSALRHFPDLIAARGADLITIDAKDRMPSTDTDRYAVSADTVTAGLFFTAAHAPTPLYYVFGDLKVLTPAEVVHYTAHALRHRSGAFHLVRTEQAHCFDDVFGSAGAAAAA

SEQ ID NO: 7556 - protein, 312 aa, Streptomyces avermitilis
MMLLMAAYVDPRFRPTLWPGTPVPTPELMPLRGARADGEWIVWTPQVRSRSHTVPVPEDFYLREFMEVDPEDLDAVAALMGAYGHLGGSINTGSWDVDVYERLKELTEREHPRAPFALHGELATLFMREAQAAITTWLALRREGGLDALIEPEVSEEELAQWQASNADLEEAWPRDLDHLRELSLEIRISNLVSELNAALKPFSIGIGGLGDRYPTILAVAFLQLYNHLAEDATIRECANETCRRHFVRQRGRAAYGQNRTSGIKYCTRECARAQAQREHRRRRKQQTTTLQQPPAPGPQSHDTSEPTAEGR

SEQ ID NO: 7557 - protein, 875 aa, Streptomyces avermitilis
MISLREHQVEANARIRAWAGFPTRSPVPAQGLRGTVVSATGSGKTITAAWAARECFRGGRILVMVPTLDLLVQTAQAWRRVGHNGPMVAACSLEKDEVLEQLGVRTTTNPIQLALWAGHGPVVVFATYASLVDREDPEDVTGRAKVRGPLEAALAGGQRLYGQTMDGFDLAVVDEAHSTTGDLGRPWAAIHDNSRIPADFRLYLTATPRILASPRPQKGADGRELEIATMASDPDGPYGEWLFELGLSEAVERGILAGFEIDVLEIRDPSPALGESEEAQRGRRLALLQTALLEHAAARNLRTVMTFHQRVEEAAAFAQTMPQTAARLYEAEVSAEALVDAGALPESSIGAEFYELEAGRHVPPDRVWAAWLCGDHLVAERREVLRQFADGLDAGNKRVHRAFLASVRVLGEGVDIVGERGVEAICFADTRGSQVEIVQNIGRALRPNPDGTNKTARIIVPVFLQPGENPTDMVASASFAPLVTVLQGLRSHSERLVEQLASRALTSGQRHVHVKRDEDGRIIGTTTEGEGGQHESEGAVESALLHFSTPRDATTIAAFLRTRVYRPESLVWLEGYQALLRWRKKNHITGLYAVPYDTETEAGVTKAFPLGRWVHQQRRTYRAGELDPHRTTLLDEAGMVWEPGDEAWENKLAALRSFHRAHGHLAPRRDAVWGDADSELVPVGEHMANLRRKDGLGKNPQRAATRATQLAAIDPDWNCPWPLDWQRHYRVLADLATDEPHSRLPDIQPGVQFEGDDLGKWLQRQRRSWAELSEEQQQRLTALGVTPAEPPTPTPSAKGGGKAAAFQRGLAALAQWIQREGAHKVVPRGHVEAVVIDGQEHQHKLGVWISNTKTRRDKLTHDQRTALAALGVEWA

SEQ ID NO: 7558 - protein, 690 aa, Streptomyces avermitilis
VGLAAGSASAVGVLLSDHPSEAGACCRQVCFQGAHASRWLSSVACWRLSSSRWLFRVSSSTRSVRCPVSRASSCCPSWRFREHRRTPPDAAVAPWAAQQPPYLAPHQFSLLPLPELLRWEVLYGLQQVDPWLRIFEPAQVRRMVRDLAETGTLIDGIRDQQMCPRSTVAVLRMLGRVRTAVRAGHAEYTGTAPAQDDVLDLRALGQRSRTPAGIRQPKTVDLRTIRQPWLRGLLRTWTVQQRPGADEFARTLRGVELASRALAQRPGTDDPAGLRYDDVTAVVDAIRTALKRDGEPAGWNYRMSIASHFFALIDYGHRSGAADDLSAAFVRDPALHRIPEQEANEDEIGKAIPEPVIRQLDAHLHLLGLGRARGQRTLAPDDLQLMYRTLYILLRDTGQRPLEVLSLPRDCLETRNDQISLIWNNHKARRHRRRLPITTSTAQAIRTWQERREQLQASLPPTGADYLFPALTHLATRPYLHTSYLGETLRDWVDSIPHLHGEGTDTQGNPLPFDRSLIYAYAFRHSYAQRHADAGTPLDVLRELMDHKSVSTTQRYYTVSLKRKRDAVTKLAAHVVDHHGHPSPSSETAYELRSVAVPYGGCTEPSNVKAAGSSCPIRFQCAGCGFYRPDPSYLPAIEQHINELRADRETAQAMDAAEFVITAFTAQITAYEQVTDRMQRRLAALPVAER

SEQ ID NO: 7559 - protein, 249 aa, Streptomyces avermitilis
MSSISSALSRLPAPRAENAGDLDGGGWAAWLRGHLDPAWRTSEWRQDCWLFTGSVHEPRSSVALCRTEACDTVVSPANIFCPFCKEEQKRSPLPDAEFARAFVPVRNRVAFGGVPEPCSFTKDGQRCVRPRHCKELCATHYTQWKTHSTRKTAGRWEDTAVPYADTPACPAPACPLPGLYGRGLCRHHAQRWMAFLIRSLSSLRVRISCLASSSSVRSVAVVLRVRAGEGVVGCWRCCAASMCSRMPSA

SEQ ID NO: 7560 - protein, 57 aa, Streptomyces avermitilis
MLRHSAATRWLRDGVDRDVVQRLLGHASPLSMERYRHVNDAEARAAVERVGSLKERR

SEQ ID NO: 7561 - protein, 798 aa, Streptomyces avermitilis
MLRSLNCWPSRATDPSRVAELVRPYAGTTPQWGQRLLRLIEWALTPGLIDLAVDLIESGHADEARGPIAVNSDFWSLLYGLAETAPAPAARLVGAYLWRHLARARADDSGDPFESGHLSTHSQFADTVLSRIAEAEPEAYVSQVLPFVIDVATAGSTGGTDAYAPSGRWAHRLVGGHGVDAALLTALDTALRSLAANSPAAAADALQQLTPSPVQELRFLACRVYAVMNQADEAIAWLLNDERNLRLGWLSSARWASRELIEATTPHCSDETLERLTAMLLDYYPAWEHRRQKGQHSAWGWSQYELLSAICPSRRSDAGCRRLAEWERKFPGQVPSPPTPIQTGFVGSPISDHAARHMTNEQWHRALNMYAKPQAERFWPPQGGVHELAQTLGSRAEQEPERFTDFAFTLGPDAPATYLCAIVGAVTPHLDADRWEQLALHTHQILGPAAAPTICRALQSAPQNFTAASLPALDSYTTDPHPEQDIRDADAEGTRTDLLTAGMNATRGQAALTVAALLFHGSEHLHALTPLVTRLANDSVLAVRVCAAQAVLALMKHDPQIALDTTEQLLNHQDANAYNASTTQRLLINILVREPSRFAAHLARALQGPGDTAELAGQSWAVATIQGCLTPDLPNSTDELNALARRGAASVFADNIDHYPHLVPLFNDDDADVRKNASQGMRQVFDLFPAQADELVRAFLDGKAFPDHLEHLAFALYDHAGPLPTVAIDACERIVQHAGRELGDLRTHRAADGHHLVSAVLRLYRQSRQAERIRCLDVIDRLSQAGAYGLTAALENER

SEQ ID NO: 7562 - protein, 715 aa, Streptomyces avermitilis
VGLAGGAADKAGNRYEDWWTALRVAELLRGRATGIRLEPPGPAGAGIEFELEADDGTWCEQVKDVPSKGPWTLSAAGKILEAVTGHLAGGKKVRLVLSTGAPELHDLSKRARGADTLAEFEGMITKAQIPQFVQVLENWSDNGMPVDREVGWRYLQAVHVEHIPPEALRRLVVSEYELLFVGDPEVIVRQLSGYLDEHLHQRLTGSQIRSHLLTVPGVRPRLLAGDTGTLTALAGTVERFVRRVRRDKPAFGMAARPHVEQLYERLVAEDGPQMVVCEGSAGLGKSAVVTDVLVRLTEQGWPAAAVRMDGADASVQTAKDLGVRMTLPDSPAVLLAGVADEAPALLVIDQLDAVSTYNGRMSDAYEAVEDVLAQLVVAPNVKVLLVARTIDIDNDRRLSDLVADRVRTVRFPLSVLDVEQVRAVLSASGTDPDGLGPVTLELLRTPLHLSVFSRLSSSARAASYRTLQELYARYTDERREEIERQVAALDWRGITGTLCASMSERETLQAPMALLDGFARQHIKVLESHGVLVRDGEQIGFFHETYFDFLFARSFISAGEDIHEFLANSGQYLFRRAQTRQILEHLAGTDPERFRATVGRLLGSDRIRPHLHDVIIAVLGQFDAALPDWKAVEPVAWGQTPVAGKVRGLLALPQWFDAADHDQRWERWLGTPRTADAAFPELLAVARHRPEPCCGAGTTVCGHHATVGTAASAAD

SEQ ID NO: 7563 - protein, 628 aa, Streptomyces avermitilis
MPSATPSTPSSTPPAWPHCAHDATPEDPVGCRGLRVGSHTACLAHLDDTDRAAYLTVLSPGADIDHRGTPFTPNLLNQLLAALRDPTTGKPRTGEARFDGATFSGEARFNGATFSREVRFDGATFSRKAQFRETTFTQDARFDGAAFSGETEFENATFSHGARFGKTTFSCRTSFDVATFSDQASFAGATFSGEARFIGARFSRTWFSEATFSAGARFVDAKFSEDARFDGTTFSRDTSFQGATFSGDARFHGARFEMSSFLGPLVCSKQVVMDGAVFGQPVTVEIAAHQVSCVRTRWASTATLRLRYAELDLRDAVFEYPVTVAARPNALRSRVSVSLSEAELSGREPGVRLMSVDGVDAAHLALQDIDLSACRFAGVVHLDQLKVDGWCTFAGVPAGWGRPFSWPSSQRNTLVEEHHWRVRTARRPGRAVARGWTSPQDAPVLKPAMVAALYRQLRKSLEDGKNEPDAADFYYGESEMRRHDVTRPWGERALLTAYWALSGYGLRAIRTLAWLVAAMAATIAVMVLWGLPADDPKPTTTGRQVAVGQEVLLTTDVPAPVNPSGPLTERVTTERLEKGLRVVINSVIFRSSGQDLTATGTYTEMTSRLAEPVLLGLAVLAVRSRVKR

SEQ ID NO: 7564 - protein, 364 aa, Streptomyces avermitilis
VRSDNNKRAYRTARPEIKGLRAHDEEAIELLAIPQEPQKDVAQPSQHIGPPPEEGEDESRLLLRFAAPRDPVMVADWVSFNVIDTEKQDWARGWAALKKFTEREQHARVPYGYKEGAYPLGQWVAEQRRAYGAGQMTGQRARRLEQLGMVWSPADERFQENLEAARAYLEEHWTLCAPRSATMLDRPVGQWLSNLRRPGALEGHPEWKTALEAVDEDWNPSWPAEWQRHYAALRDLVADEEGQADVLPGFTVHGMDIGKWLARQRKPEVWQALTDGQRERLEQLGIVPLALEPEEPAKPSATPVGAFERGVAALAQYKAREGSVTVPRAHVERLEDGTEVRLGVFLTLELVPLPAPVGPPAPCT

SEQ ID NO: 7565 - protein, 277 aa, Streptomyces avermitilis
MTSQNTTAAPCAPNFLPIRKVQSRTNHVPYLRGNHAGPSPVTHAQTQQKPVGSTMSQQQYPQPQQPGRNGLATTALVLGIIAVVVSFIPVLNVVVWPLAILGIVFGAIGLSKAGKVRKGKGAGITGLVTSAVAIIMFFAMNALFFSAVDKASEELDKSYDSTTVGDGKSKTGGAKESKVMKDFKVTKCDVVTGDFGIKEMAIHVDYANNGDRRYSYFVEGEVLADGKKVDDFMSTAENLAPGQKFTDKNAGALVNADEIKDAKKLECKTINASRTDF

SEQ ID NO: 7566 - protein, 172 aa, Streptomyces avermitilis
MLPADPLLGTDQQEVVARLWKRQQTETGWAYLVGLPSYRDREDGDVEAAAYRVWVRAPDHVRPVDGVDYDQVVTEKLERSPQSAVREVLGERRPSGWVLAKLRDGRGPARSVLHAPDCEEAPAGAPLLDMDRALDSAEHPGTRLCTLCGAAQELTPLLRGFDHITDSAPDDS

SEQ ID NO: 7567 - protein, 175 aa, Streptomyces avermitilis
MSEARPRPYGGGDLHGCGGAREARAREVARDAAGEDARVGAGDFAARQTGARFEQQYLCLAASYDFPQDLTDAQDELRQVRADLQTVYRRVPWSAEPLDAWETHENAWRPSSRPASPGWGPQDAAEIARLRAREVELATANVTHAYWSEFAPAHVLAARNALKRHQEQQMADASS

SEQ ID NO: 7568 - protein, 54 aa, Streptomyces avermitilis
VNSAPRTRCPQALRDRRAAVLFVAFFAVVFLADCCFAVFFFGSSWTPASTPREA

SEQ ID NO: 7569 - protein, 294 aa, Streptomyces avermitilis
MGRGDLSDEEWARLEPHLPANRGRGGRWKCHRRVINGILFRQRTGLPWRDLPPCFGSWKTVHDRHRRWSADGTWERILRAVQADADAEGRIDWSMVSVNSTTCRAHQHAAGASTRAPKIPGRRRSPARHRPDEALGRSRGGLTSKIHLAGEGGRRPLGFLITPGQWGDAPQMIPVLEEIRVPRQAGGRPRTRPDHVGGDKAYSSRRNRRHLRRRQIKHTIPEPRDQRANRRRRGSGGGRPTGFDKAIYRRRNEVERTINRLKNFRAIATRFDKRAYVFHGTVTVAAIRLWLRPE

SEQ ID NO: 7570 - protein, 137 aa, Streptomyces avermitilis
LNEGGRMSRDTAVAEVGMRGITFPAWHGEHYVTLAEVLVRLGSFGLDLTWRIEFDEIVDPRCVEMERRSADAGMDTLTLLSLTTPFLQLIDAEARGFAGDELVLVLTEFDSSSWDVRAVDKRVLSELRQHYPGAEDL

SEQ ID NO: 7571 - protein, 174 aa, Streptomyces avermitilis
MNEIMLSLAGAELPSVLPDDVPAAYRAIAEEGWTVDGNGAYLLSALQAGYHGSTAGEFEDIVHFEATVNGRGMMDYDLPASGPERQNRLLRRSIAYACLALQAAPAESEHPLLGYVSLSEGGLSDDTLTANVTFCTRRSGIPPYVSDIQDYSEESLLELSRDDAVNALKGADGR

SEQ ID NO: 7572 - protein, 1250 aa, Streptomyces avermitilis
MTLSGLVSTAAHPERVVQAAVDGFKKDPSEFVGRLIPELIGTKGAGLARGGMRLALKEGMEGVAEQGLRKTARNAVEDAAEDASRQRGAKICEKDPVDVATGRMVLPQIDVSLPGQLPLVVKRQFESSYRLGGWFGPTWSSTLDQRLEVDTAGVVLVGEDGLVLAYPHPAPGVPTLPSHGPRWSLDRTDGGYTLTDQKSGHIRHFVDRSDTLAVLEQLDDRNGNWITFEYDADGAPRYLTHSGGYRLRISTEAGRVTALHLASAAVDGGDQDLIRYGYTDGHLTEVVNSSGRPLQYVCDELGRITSWTDTNDSHFSYAYDDEDRCTHQSGAAGHLRSTFAYGAVDPGTGAHTTTVTDSYGQTTHYLINRRCQVIAETDALGAVTRYQRDRYNRLLSQTDPLGHTTSFRYDDAGNLVAATRPDGREARAEYNALGLPVKLVNPDGTITRQTFDERGNLTSVTDPSGQTTRFGYDEGGRLTSMTDPLGHTTGIVCDRAGLPLTVTDPLGAVTRYERDAFGRTTAITDPTGATTRLEWTVEGHLSRRTAPDGTSESWTYDGEGNCTSHTDPVGGVSLFEYTHFDLPTARTGPDGVRYEFEHDTELRLSQVTNPHGLTWNYAYDAAGRLVAETDFDNRTLTYEYDFAGRLASRTNALGQMIAFERNELGQIVRKDAAGQATTYAYDFTDQLAQATGPDGTALTILRDRHGRMISEAVNGRALTYDYDELGRRTRRTTPSSATTIWSYDVAGRRTSMTGSGRSIDFVYDEAGRELGRRFGHITLEHSFDALGRLTSQSVLGPAGRRTQHRQYTYRADGHLIGIEDQLSGKRRFDLDLAGRVTAVHAVNWTETYAYDAVGNQTSASWPAGHPGQEAIGNRTYTGTSLTRAGQVRYEHDGLGRIILRQKTRLSRKPDTWRYTWDAEDRLTSVTTPDGTRWRYTYDPLGRRTAKLRLAEDGETLVERVDFTWDGTVLCEQTTTSPDLPHQVTLTWDHQGLRPVTQTERIVAADAPQQEIDSRFFAIVTDLVGTPSELLDERGEIVWRTRATLWGSTTWAKNSTAYTPLRFPGQYYDPETGLHYNYFRHYDPETARYVTPDPLGLGPAPNPAAYVPNPHMWADPLGLKCEPPEGYTSQPAFKNDPYHPDAVERGINEMRELYGIKERPPSGMIGANGTQVTSKTMWNHGPYRIDVENPNPGQRAGQLHFQDQSNPTAKYQYNFDEGKFDGLPRSVEREVGKIPGFEAGIRKGLRVLGED

SEQ ID NO: 7573 - protein, 190 aa, Streptomyces avermitilis
VSSGLRKVDSSGWQGEGGEAFREKFGVHPTKWAQAAEACNTAAGALELYADTLKWAQGQAKEAVELYKKGVKASQDAVDAYNKKVDAYNAKIKANEDPGPKPEPFHDPGKADIKAAAQKLAEARKQRNTAASEAQGKIKAALAHAPAEPPPLDRIGNDLKDGFQAANTELTHVVGGALKGTAGLVTSPPA

SEQ ID NO: 7574 - protein, 95 aa, Streptomyces avermitilis
MGLGDVTNSLLGGAENLYDAGKKKLGEGVDWATDKVGEGLDKVGAHDWADSVEDWGDEIASDLGPPRVSSSSARPRSPTNSSTAIRTRSARVPST

SEQ ID NO: 7575 - protein, 309 aa, Streptomyces avermitilis
VASVSSWPSRTSRRWPVTRWHAVRRRVSGRTRRSSARDCWMWRCPRQGCPGGWRWTARTAKRAWSSRRCAASCRTRQHSTSTPTGTRGRGMSGDGKDLKTEGLALIAKGLTEALGELKELGMVGEAGAGRGFGDIALSGLELGHEGLTGEFTSFCERWEWGVRSLINEGNGFALKTGLSAGTYYETDKYIEGTFKVVTNAAIGNPYASEENVEKMGWGDIATSGVYGGNVDYSKESFDQAMANSGQAWKDAGRDVMTSHTIGPVPGVNPEELHGAFGVSDDEYNQYLDDTFGPSPEARAKAAEQQGGEG

SEQ ID NO: 7576 - protein, 120 aa, Streptomyces avermitilis
MREFPLDKHERTEADDRLDQILATTHAELVDAIATQQDHARTMTLIPGSGTAEEPTKTIDRALWSYKEIAAYINVRPDKVRWYRKHGLLPAPDHVEGGKPYWYSDTVRAWMASRPSRREP

SEQ ID NO: 7577 - protein, 190 aa, Streptomyces avermitilis
VMSETPAQAGRREPLPETRPVPSTELVRRDDFSVFYRTEKKRLIAFLIYAGARVWEADDLAHEVLSQLLPDRWKTLEYPRAYMRKSAIRAYLRQNERTREIPTDELPDLPGGIDPVTCVELSEQTNAIIDAIQQLPPTQRTVMAFVMSDSDTAEIAEALNMAPGAVNTNICRARARLKTTLGLMKGDNNA

SEQ ID NO: 7578 - protein, 96 aa, Streptomyces avermitilis
VMRGSGCAAETEMGGTMDPVTFTAGCGVATSAVRLGYVWLSAWSHRRRVELEIHRAELERATLMETISSLPPGSEVTEVLRDGRRVTIKLPPSKAA

SEQ ID NO: 7579 - protein, 578 aa, Streptomyces avermitilis
VAEQRRAYGAGQMSGLRARRLEKLGMVWSVADERFQENLEAAKAYYEDHWTLCAPRSATALDRPVGQWLSNLRRAGALDGHPEWKAALEAVDPYWNPDWPVDWQRHYAALRELVRDEGQADVLPGVTVHGMGVGRFVAKNRQHAVWQGLMDGQRELLEAIGIEKGNLTALPELAREYAEDNTGARIVIVDRTGRLLTDSAGTTATGTTLAGEPDIAAALRNQTTVATRTGTDGGDVLAATMPGSSGTTIRGGLRVTYPMTMVTDREHRIWAALALAGACVLAAVALVAFTLARWITRPLRTLERATTQLAAGRLDNPPDAGSGPPELRRLAAAFTHTATRLQHLLQAQHSFASEASHQLKTPLTSLRLRLENFEPYLDPRAHPSLEETIAEVERLSRMVHGLLALARLENTATTPEPVDADAVLAERAAMWEPLAAEQYVTITVFGPAVGRVWAIPGALEQIIDNLVANALRVSPPGTSITLARAPGADLHVIDQGPGMSEADRERAFDRFWRASDSHHDGTGLGLPIVRHLVHASGGEITLHAATGGGLDARVRLRPASRERRFQATAITGAAGRGR

SEQ ID NO: 7580 - protein, 113 aa, Streptomyces avermitilis
MTRRNPPLTEPQYFILAALMDGPLHGYGIIKAAEQATDGRLRIAVGTLYGALERMERAGLVAAGHEEIVDGRARRYYRLTEDGTEALGREALRMQQAAAVVIGRARDAGAAPA

SEQ ID NO: 7581 - protein, 318 aa, Streptomyces avermitilis
MNRLLLAAYPKSYRSRQGKELLACLAEAYPGRSWPPPREVAALVRAGVQARARATVDDTTRPWWLDGIHLAALALAALALVPYLQDVWHWALHIDPGQHAIAFHFSGWYPWAGGPTRIRLLPYGLLPLGGLIALLRGRAWIALPAAASMIWAGATTHGRTLFGDEGKAGLSYYGLGAPITARDLALSGTLCAACAVLALCRPSRLRRRSYRWLAPVVLAMFVAGGLHIISVSPTFQRGLFVLEVAALLGAWVATAATGDHRWLIPVAAVAIVRTQAIVAQPDAFMQSFPDLVVLLLLIAPLPALAITAQRRQGQALPE

SEQ ID NO: 7582 - protein, 333 aa, Streptomyces avermitilis
VGRPSPAAHVVPQDVRDLTPLNGRNRAMTQHDPPTLPAHRPRASRQAPEAPDAPSLSRTTRPWMPALLYTLGFLTVYLLAICTPWGQRAENALFGLGKQGGEEAWFYPLSGAAYGSTPLPPLELSAKPTLMVGLAVIVVLTLVRRCWWPGCAALGVVILTTGGKEVLKSTLPRPDLVGAPENLLDQGFPSGHTAIPAALTLAAVLVVSPRIRPYVATAGVLWLACIAAYSATNGGHRPSEVLGATLLACACYGLATWLLPPSAAPGATRSPRALPVITLTLALAVALVSGARNDTLTRSLVSAATGFICAALVWYAAVGRPAHTARRTRPALG

SEQ ID NO: 7583 - protein, 200 aa, Streptomyces avermitilis
LLRGRRPRPARRSISRSGIAPARWYISRSAARSSAAFSTSRKGALMAELVRQQHLDADVGYHGFGFQESDDGDILAPFPDDFADEVFLNAFPGRLDIYSAGHTHTASVTVAVWDGPPAAHDRVQWDEQAEADYDSASGEVAVWSMSLGRADEVITLADSGGLWRVRVSCTGRAVAARLSEEEGTGHGVEKYLVQFWPRTA

SEQ ID NO: 7584 - protein, 100 aa, Streptomyces avermitilis
VTKERNEPSANPLRVGLKAALGGLRTVLPSGSQCDEYPFATTYEGAAEYDYDPDARKFNFSVRPIAKADNGAGGSLLLSFYAKNRLIDGLEDGFGVKIVS

SEQ ID NO: 7585 - protein, 678 aa, Streptomyces avermitilis
MGFVHLFPQRGRRLISLTARTTGRRRLALGTILAIVIGSGATGTAYSADGSDNPPPVHGPGARAAAAAEPDTPNGPEVGPPFTKTNNVWQTDTTTPTLRNTVTAPSGHKTTATFEVHTTDSSGKPTATVVKLTDENQWGVLVSGEVTAGKPASVTVPAGKLKNGVTYAVRSSGYDATSNVYESDWSPYSTFKINVPPAEKPYVTFPAPQATSGIDSLAQTPIEFTRTDPGPVTGLRGDDNGRKCSAPDAEGRKVCIEISRDAPTPEDAAVAKGAMRQALRGADLVSWCAAKPDGKDYMNRGEACLKKVGYATLIFVDADDLPRFGTATFALSQQIKLYNKKSDTGTDRAEFDQQLTVVPTQIDDATEGVHLTWQPGDNCKDCTSSQVQWSSNDGLNTTPHWAVGEVGAQYAMTAKRQTIWNGTGKEQFDLGWSLLGSVDAGNAHAQTSLGTSGDVRVRELAPRCDDIAGGNIKTGCVFPYFKPTWTVDTNLYPAAGAYYWLLQEKLPSHPGSRKWDSLVTYLGPGNNADPDGGDWTNDDSRGIVCPTGTSGFKPNPATPDGSCDEYAPASTYQSGGMPKGPNQVASGKECAQLYTKPMTGGTWGLLAENRDGYTGPKWNEKCGRASVPTDQNTGAFRDLGIKFVPQMRLLDKDGFFISDPGFEHCKNADTVCAWKKVG

SEQ ID NO: 7586 - protein, 283 aa, Streptomyces avermitilis
VSGFVRTGACACSPSPSASPTCSTTSSSGRHAPMSPPPFCAGGEVREVAGARHETRRVAGMTDDQQQEQAVAGAWARIEEWLERHAPRSYRMLPPPAPEADIREVEQELDLTVPPGLKAFYRLRNGTGHPGDFGWTPEPDTGLPLQGQETAWLLPRKHGIPPVQHLPYWDEGPHTIGRPDDPMVRYLAFAATDRSGLYGLFTDCTPGTGYGRIGTFEEAGIPKLGVWSSFADYLIEVADALYENRGVEYADGHQDTKVPGLVDQALVWDGPAHPRDPEWTRFA

SEQ ID NO: 7587 - protein, 90 aa, Streptomyces avermitilis
MNKTIAWLLTCAGAGVILWLLTSAPDISSAYPRSECHSVLGNDSSPAHGSMEDGVEATCATYQSRRLGWAVLVSVPTVVLASAGMRSRSA

SEQ ID NO: 7588 - protein, 440 aa, Streptomyces avermitilis
VCRGPLGSYESLTRPSFAFIVISPSATLLTHAPGSQEPHVSRHNRRRSTLHKRATVFGGGTVAVAAVVATVNIASADQVSPTPRTASKADHAVFVQGNELAGNTIHVFRRGDDGKLTAAGKYATGGKGGDQVDAPTDSLASQGSLVYDRRSGRLLALNAGSGTLTSYAVHGQKLTDRQTVPTGGDFPVGIAVSGDLAYVMNAGGAGSVQGFRITTMGLKPLSGSLRTLGLKNEKVPLFSSSPGQAAFTPDGRNLVVTTKSANTVEVFPIGRDGRPAHKPVVNKSAGMVPFAIAFDKTGRMLVAEAAESTVSTYKVRRNGELQVLQKPLPNGQDTLCWLERAGDFFYGGNTGNSTVSGYRMDARGRLALTNEAGIAAAPSAKSQGVIDIAVAADKFVYVQNATSGTVDGFRVGRTGALTKVTTVTDLPAFAESGMEGIAAV

SEQ ID NO: 7589 - protein, 313 aa, Streptomyces avermitilis
MTDAAPNRSPEQNNVPGLPLRNLAGFTHRWVDAEGIRLHAVEGGRSSGPTVVLLAGFPQTWWAWHKAMPRLAERFHVIAVDLPGQGHSDRPQGGYDTHTAASRVQAALTALNVPKYWLVAHDIGACVAFSLALRYPDRLHGVALLDAGIPGITLPDAIPTDPERAWKTWHLAFHLVPELPETLITGRERDYVGWFLRVKTLSPNTFDSADIDHYAAAIAAGGGLRASLAYFRDAAESARKNQDTLARRGHLTIPVLGISSSHGSIPDMAAAISPWAENVTGVVIPQAGHFIPDEQPDATVDALTAFIDHTRAG

SEQ ID NO: 7590 - protein, 96 aa, Streptomyces avermitilis
VPGPKRKASASTSERASGSRLWRGSSDDPRVRWATQSLPGEAARELFAVRDVGAGEQQLVILARALGHAYFRDGGRRGHRLHIAFTDIEFAGFSTG

SEQ ID NO: 7591 - protein, 246 aa, Streptomyces avermitilis
VYPNARGAAFGTPRRPPPHDGPGAKTPGPLLSDPAAGPSCPRLGGGRGGHKCAFGTRAGTGQEQPHTDQKRKTHMNRKSSAHRRPGRRAAVAAGLVLAVGLGVSTQVSAQAAVHAPAKASTAQSVSGTPGQAVTRVADFYGAYIDAKGDYTDPDATLATALRNHYLTPDFAKRLAAWEKTNAADGVLRAQNIPAQWTATDNGTVGNGHEVIVTLTFGSGETTQKTKLFVLVERYNHIVDIDTTSTR

SEQ ID NO: 7592 - protein, 126 aa, Streptomyces avermitilis
LMKSVIRKAAGLAGASVAVAAMSVTGASAAQAESPTHGCPYPYVCFYVDEDAYNAGTPITKYRDVTSSYQTVRSRPHYHVVNTRNDDVAYLRLQDGNSICLVPNSETVFANAYSVTGIKISSSSTC

SEQ ID NO: 7593 - protein, 463 aa, Streptomyces avermitilis
VPGIRDRGRDDGGTVSMRDDVEEFAALLRQLKDRTDRSYGSLARRLNMNTSTLHRYCAGEAVPQDFAPVERLAAFCEATPKERLELHRLWLLAVEARQRVRTAGPAEAAVSAEAAVPAPDTDGALAEDGEPAEESCSAEQPGDGPGPDEPAPSPAPRPWFRRRRVLASTSVTCALLAALGTTSALSDDRSSEADGSRSAGPRAAAPGASHRSAKPSAGGSPSPSRSFAAPGPRQKAPAPSGTGSGPTPAAKPATGLPLAWSADSLVWDKGCDHDYVIDKPPAQVPPPPVQQDAGAWAATQGAVHGRHTMVQISVQGQSSTAVVLKALHVRIVSRGNPAAGSAYAMGQGCGGDLTPRRFTVNLDAGRPIARPKDGADIGHTIPAVQFPYRVSAEDPEVLLVDATTQAYNARWYLELDWSSQGRTGTIRIDDHGRPFHTTSIKGMPRYWYGTNNAGGRAWVPYDS

SEQ ID NO: 7594 - protein, 130 aa, Streptomyces avermitilis
MPRVGVSASDSGRISLAGVVCRRAGQRSRLPVPAWLAGRGGQPEGYCHLQMIDAVRYLVDNGIEWPAMPADFPARDRVCAVFRRRRDHQLIAGFHDRLRGRVRESEAGTRNRRPRSWTRRSSPSVPSPQC

SEQ ID NO: 7595 - protein, 371 aa, Streptomyces avermitilis
VRTLRAAADYAVEKIRAVAPGVSAFPVGTKFEKWVYSQNGDWVGGFWPGTLWMAWLYSKDEQLRTLALESARKLAPRQHDTSTHDLGFLFSPSWVTAWRLTGDDVWRTGAVQAADSLIQRYNPRGRFLRAWGALNDPNNAGRVIIDTMMNLDLLAFASRQTGDAKYLDIAVEHAKTAQRVFPRPDGSTPHVFDFDPATGAPVGPGTVQGYSPTSCWARGQAWGVYGFTTIYRRSGERPFLATACKLADYAIGALGADYVPVWDYRAPQQPNDIKDASAGAIMACGLLDLSAATGRQQYRTVALRLLSALSQTCLTDKSARAQAVVARCTRNRPAEDGIEISLPYADYYLLEGILRVLQPQDVDRAIDLSAP

SEQ ID NO: 7596 - protein, 124 aa, Streptomyces avermitilis
VSLTGGNRNDVTQLLPLLDKIPAIAGRVGRPRRRPDALLADRGYDHDKYRRLLRARGIRPVIAKRGEPHGTGLGIFRYVVERTIAWLHGFRRLRIRWERRADIHEAFLGLAVCLITHRHVQRLC

SEQ ID NO: 7597 - protein, 129 aa, Streptomyces avermitilis
LLPKPAPKLVEGRPRVPDRQALCGILFVLHTGIQWEYLPQELGFGSGMTCWRRLAAWNEAGVWNRLHVLLLEKLRSKDKLDWSRAVIDSSHVRAARRGPKADPARSTAHVRAASTTSSPTARASRSRCR

SEQ ID NO: 7598 - protein, 396 aa, Streptomyces avermitilis
MATRVKRAFKYRFCPTDAQAAELSRTFGCVRKVYNLALAARTEAWARQERVTYNQTSAMLTVWKKTEELAFLSEVSSVPLQQALRHLQGAFANFFAKRAKYPRFKSKRKSRASAEYTSSAFTFRGGRLKLAKMAGPLDIVWSRPLPEGSVPTTVTVSRDAAGRWFVSMLCDDPTVKPLAATDAAVGIDVGLDHLLTLSTGEKIANPRHERRDRARLARAQRTCARKEKGSANREKARRKSARIHARITDRRRDGLHKLTTRLVRENQTLVIEDLTVRNMVKNHRLARAISDAAWSEFRSMLEYKAQWYGRDVVVVDRFFPSSKLCSHCGTLQGKMPLHVRTWTCDCQTVHDRDVNAAKNLLAAGLAVTVCGAGVRPQRRTPGGQSATKQKTPRREP

SEQ ID NO: 7599 - protein, 218 aa, Streptomyces avermitilis
LPSNNSSLRPMALRPDEFYAHARTAADGERRLPLARMTGWDISPFEADGLRVAPLRPPVLPEPARHGEDPLDCNACRSRDEGIWLDDRWRLTRITGVGVPLVLMLHPRDHFDLADLPDELAAELGVLTTHIARHVQALPHISRAHVYRIGDGGAHLHIWFFARPEGQAQLYGSWMVIWDDLLPEYPADAAEADAAIVADALVASYGGRRPAVSELPHA

SEQ ID NO: 7600 - protein, 97 aa, Streptomyces avermitilis
VEWWWRRTGCWRSTTPGRRIPFTSWWFPRDHAPSLIDFGAGGEELLAEVIRVVRTVAAQVEQQHGACSVMTNLGLYRESKHQHWHVVHRGEPRTEVP

SEQ ID NO: 7601 - protein, 742 aa, Streptomyces avermitilis
VPAMGPEADSGSTTARARPRPAPALRRTATKLRHGTGASACAGRRAVRVTAASVAAFYTGLYGLHEPVTATYALFAAVAMAGLSRIPGTGRQRAAVVIRVLPAGWILVTAGTLLAVHTWAAVAGMLVIGFLLAFAAAAGPRLAGAAPGLQLLYILPCFPPYAPQTLGERLGGATLGILLLVLAESLLLPDPPTTSYRTRSANAAITAARCASELTHPPWTLSDETRSAARSAGEALRPFHVPESQRPAGPGPRERALAHTGMAARVLLARLQEVPRPGRGGPHPHTLALLLEVASSARRTAAALRTGRPAGPGRLPDALAAYRRLRTVPADSATPETTSTVMHRQAMLMEAAYAAVTLATAADLALGRRPGPTETQDGSFWYAGHSTIRLWAHRLVGHLSPRSVYFQNAVRISLALAAARTVAGVDSLPHGFWAMLAALTLIRTTAAQTGAIVRQALIGTLLGALAAAALLVFVKGNNTAYAVALPVIMLATFWIGPTRGVGWAQGMFTLVVSTVFAQLAPATWHLAEFRFLDVLTGSVIGLVIGLLAWPRGAQEELRRDIAALLGAIASTVTSTTSFLTQGHAQAQRGRPSLQHALTLAESSFAQYQSEPRRAGTPVADWQATLMAGHHALRGSRRLLEPGDPAASRWPAPAYRAELARDGAELAGQYELVATLLAGTRPPPAPSGRPGPRRAEDTRPHAAPPPPVYYDAEAWLQGLTLDLDRITEATAEAVAGLPPKDKD

SEQ ID NO: 7602 - protein, 169 aa, Streptomyces avermitilis
VRTASPGDLDSITDLHTLARTAYYQAGGVPDVELASPGGHSSRRESWRRAVHSSDRTVMCADREGELVGILSMGPPHEADIDAATARQLYQIHVRPGIWGQGTGSALHAEFVRVLRDASLVTGVLEAWERNSRAQAFYARHGWKPDGHHRPGPGNGNYVRMRLSLDPAV

SEQ ID NO: 7603 - protein, 125 aa, Streptomyces avermitilis
MHPIGGAGNAGVNDCPLYSVPVRIHSVTDSDARPEKTGEVVNKIKKAAAVAVMVGGMALGGGAAHAAGGHGLDDPADIIIGNLQAVNCDQDFAGGAAFAPVQGISTEGNTQNIGSFCTVVGPVYD

SEQ ID NO: 7604 - protein, 290 aa, Streptomyces avermitilis
VPANINPTVRRRRLGAELRRLRKASDLTSAQVAERLLVSQPKISLLENGHRAISPRDVRDLCELYGVTDRQVIDSLMRMARESGQQGWWNTYGNIPNSVYIGLETDASSIHTYEPMVIPDLLQTPAYAHAVIETTVPPIPAQQADARLKVRLRRQHRIYDPARPLRLWVVLDEPALHRVVGRPDIMREQLEHLNALSAEPHITVQVLPYTAGAHPGRQGQFSVLRFADSPEAGMVYLERFTSDLYLKKPSEVQQYSMMYDHLQARALSPEGTRDFVTDVTKSHIDVASRP

SEQ ID NO: 7605 - protein, 35 aa, Streptomyces avermitilis
VWPGARGIGRGAGRTGRGIAPLLPQGERRFSVTGP

SEQ ID NO: 7606 - protein, 137 aa, Streptomyces avermitilis
VTLTATVTCSADPSRVLLGLTFFDGGDILGEVSVDSSGHAQYTTTFATTGTHTITAAYNGNANCFASNSMTTVQVSAAPVPPTPPGHGLCRDDCCGLINIHLGGIKTSVGVDRVRSSLARWLTPRLPYPARLQGLTR

SEQ ID NO: 7607 - protein, 60 aa, Streptomyces avermitilis
VPRCTREPSPVTVQDSANNASRPRCARWPKWVDWAGASLGRESPRRSVRLPDRLRRTFVL

SEQ ID NO: 7608 - protein, 351 aa, Streptomyces avermitilis
VKDSPPAAGAVRPAAVVAAVPVLTSVVPSTGPAAGNNNVTLNGSGFSGVTAVLFGTKPALGYTVDSTTKITAVAPSGTGTVAVTVKTPGGTSNSVAYTYAAQPSLTSVSPSQGPSSGGTTVILTGTGLSAATAVTFGSTPAAGYTVNSATQITAVAPAGTGAVPITVTTPGGTTGPVYFFYVNAPTVTSVSPGQGPASGGTTVILTGADLSAATAVTFGSTPATGYTVNSPSQITAVAPAGTGSVAVTVTGPGGVSNSVIYTYVASPVLSSLVPVLGPTGAGAGVTLTGSGLTTTTAVRFGAVSAAFTVLSDTTVAAYAPAGVPGPVLVNVTTAGGTSNSLTYTRVAPPVI

SEQ ID NO: 7609 - protein, 247 aa, Streptomyces avermitilis
MPISPNQGSSGGGTLVTITGTNLTGTSAVRFGTRSATNVTNVSPTTVTAVSPSGSGSVGVTVTTPGGTSNPIPFYYVGAPFKQTLSPTSGSTAGGTTVTITGTGFSSATSVAFGANTVAPTVVSDSQLTAVAPAGAAGSVGVSVTTAGGTNNGLSYTYVAVPTVTSVVPDEGPVSGGTSVTVTGTGLTSTSQVTFDGNPAPFTVISDTALSAVTPPGAAGLVDVVVTNDAGSATATDAFTYLAGPGI

SEQ ID NO: 7610 - protein, 88 aa, Streptomyces avermitilis
VREENGEVMNKVKKVAAVAVMVGGMALGGGVAHASDGPDVVIPNLQVVDCQQEFEGGAAFLPIQGAAAVGDNSQNIGNFCTVVGPVED

SEQ ID NO: 7611 - protein, 171 aa, Streptomyces avermitilis
VGSTDDARLQAVLSALWSAANVQGCFGQSDREPEEQDAVPCTVASLAEFGHLYGRVRLPTGQLVVCGCVAVRGGDESSDWLDLYVPVGALDHAGVAYWDGRPFFRSAATDDWLAAVGAEAFRSASFSLGVIGFEASGCTSASTMAGRLPEERDIGYLLPRGEVLHYGAANT

SEQ ID NO: 7612 - protein, 400 aa, Streptomyces avermitilis
VGVTPGQVKRAFKYRFCPTDAQAAELSRTFGCVRKVYNLALAARTEAWARQERVSYSQTSAMLTAWKKTEELAFLSEVSSVPLQQTLRHLQSAFIHFFAKRAKYPRFKSRKKSRRSAEYTASAFCYRDGKLTLAKMSGPLDIVWSRPLPEAAMPSTVTVSQDSAGRWFVSLLCEDPSVRPLPATDTAVGIDVGLDHLLTLSTGEKITNPRHELRDRARLARAQRSLARKARGDGANRRKARIKVARIHARITDRRRDGLHKLTTRLVRDNQTLVIEDLSVRNMVKNRKLARAISDAAWSEFRSMLEYKAQWYGRGVIAVDRWFPSSKLCSHCGTLQDTMPLNVRRWTCGCGTTHDRDVNAAKNLLAAGLAVTVCGAGVRPQRRTPGGQSATKQKPSQREP

SEQ ID NO: 7613 - protein, 163 aa, Streptomyces avermitilis
VGKLTVRALRAVLVVVLTGTLFVQAGMVWALVSGSDPEDGSLPLTPLRVITILGMVSVQVALVCVWRLVAMVRRGTVFSHAAFRYVDGVIGAIVAAALVWFAVTVINAPGQRDDPGVTVIMGGIGLAILGVALIVLVLRMLLAQAVARDVQAAHMQAELDEVI

SEQ ID NO: 7614 - protein, 73 aa, Streptomyces avermitilis
MPIAVDIDVMLARRKMSVGELADRVGITPANLAVLKNGRAKAVRFATLAALCEVLKCQPGDLLRWEAEDAAGG

SEQ ID NO: 7615 - protein, 211 aa, Streptomyces avermitilis
VSACAVWPQATQWNFSCAGRFPLAVCPHSGHSREVLRGLTAITSRPALSALACRIVRNTPQPASLTDLLSPALAAAPLGRKAPARPGSDYGAGALLMVRILRSSCAMKSALRTQYDAPVISHRAGSPGQLLVIACTVVALVTAPLSWYAAHTVRPDCVVAISKVTDGNGHHLPDVNGRVWSDNELADRAYQQAVDSGRCDPPHARWRQWLD

SEQ ID NO: 7616 - protein, 140 aa, Streptomyces avermitilis
MTDDAYLFLLDDPAVPLGVPPSVAGELSCMDTPAVRAWLDAQGVTTTSPALRILPPEQTAAIPEQAERLPVPLSEAELSRLRHHNAPEAVARLEEELLAYRDCTDGRDTLLRRALAAGIPLARIVELTGEEPAAVAASSG

SEQ ID NO: 7617 - protein, 156 aa, Streptomyces avermitilis
VVPTEVRPLPKTSRVLGVDWGVKETATTTSNAHDLPHAQHGRKAQAGLTRYDRMRARRRPKKGQAASKGYREAKKWRAKTYAKIARQRQDTGRKWAKKVVTDHDAIAVEDFRPKCGACQCWRPRTVFTRRRRPRPPVPHPSVPRCAPGEFRPQGPA

SEQ ID NO: 7618 - protein, 358 aa, Streptomyces avermitilis
VHDHAGGAEAVPRCVSAGGCQDGWDHRVMTLCSRDVPAAERFSWFCELVARDMAPHDIVTEHVQDFSASATLLSLGEGIGVSSVAFPAMQSIRSRRLIRRSDPELWVLALVVKGAMQREQGRNQVNPRPGDLVLYDSSQPYWASIATDDVAQSIVLHLPRRTVPVPEQALRRMVATALPSRTGIGALLSQLLGGLVEQGPKLEAGQTGRVASAVVDLTTAFLAGLSGADGPQTTAARRVAQLHQIKSFIRSRLGEPGLTPTAVAAAHHISLRALQYLFREDGRTVGAFIREQRLERCRAGLADPRLAGHSVAAIAVRAGFCDAAAFSRAFKARYGMPPGEYRRHCGGPPSQGRAGHTG

SEQ ID NO: 7619 - protein, 488 aa, Streptomyces avermitilis
MTDRVLELLRTRPDLAELAAFPFGFDVSRAYHVEAVHLASGAPLEPIAGDDTGGTYFLCGATAVLHASSEGDAVLLADSVGEALEILVRLPWWCENISAELDEEDLLAEVRAADHAAREEFAPELDAQRAALISGLGLPDRPLAELLAMSQSAAGRTEPDHVLLNSRELCAYRLEESFRQPLRDVVLGPGREVLERMRRGGLGAREEAAGDPVLRAGVLRAAQYDRRDGDLPLLRLLLEHESAARTERFEERRLAAVLVALHGREGDVSLLRSATGGQVTDSAEAVEWARAEEAKRYGRDVAAESEFTWIELARRQGRIERARVALIRMLDDTGPDADRLRELSRALERIGDYAQAARAQFNLLSLQDTAWDRASEAYVLARLERRRGDLVAAGRALERARAAVGAGGTTPGGADCQWHRRGLGRLITEQHLELTLAAAEAGDAELARATMGHGRLLLDTVGKESAKALSRLSTRAKWAVAGLRPPGA

SEQ ID NO: 7620 - protein, 79 aa, Streptomyces avermitilis
MATTHADALRSQRGIWIDAGTRDEWFLDLGALAFRDALTEAGVADDIVHFELFEGGHHAVEYRMPPALAWLAHRIADRP

SEQ ID NO: 7621 - protein, 85 aa, Streptomyces avermitilis
MNRSGSRDAFRSPDAQEVPSGGVDIPVRTETWTSSNTRFGAAPGRTGPHRAGLGPGALRKGRHRGGDPSESVLADLAGVCAERRY

SEQ ID NO: 7622 - protein, 141 aa, Streptomyces avermitilis
VSASLVETVDIEAPVAVTWALWSDVSRWPSFLSHVRLVEPLDERRFAWQLSLPGADKNFVAELTEVIPGDRIAWQTTEGVHHAGVVTFHRLSDTSSRVTLQIEYDPKGFVEHIGALTNLDSTLANYDLGEFQKLAETAAAG

SEQ ID NO: 7623 - protein, 551 aa, Streptomyces avermitilis
VTDVPNGRDPNGRDPNGRRALVPASPPGMLRRLQRARLLPRSVRVLRSLRVLPRSVRARSALAAAFAAAVLFTSGALLMRHQLYDERLRATSSVAQQQVTTLLSATANSSISGPWGAPYEIVAGDGMLLASSPELEPYEKDGHAFLTGPGRGGSLPLYTRRRFTFPAVAEPAARSLSGQTLTTVEGTVPASYLPGETQGRGVAAGARVRVYVLIVPDDAERAVGELDRELVVAVPLATALVAGVAWLATRRALRPVEAIRARTASVTAADPRERVEVPDTADEVAELALTINATLQRLEEAATAQRRFVADAAHELRSPLATLLAGLEVATAYPDRADWPAVVSAAGRQARRLSGLTEELLLLARLDAGAPPAPAERVDVAALAGRLSEEYAERAGGSPKVDLLVAAPDAATTVFAAPGDLERILRNLLDNALRHAVGRVLLTVARDSAAPGSVLCTVRDDGAGVAEADSERIFERFTRLDESRTRTDGGTGLGLAIARDLAARHGGLLVLAVQPKGSGACFVLRLPAGDPMSIRPRPFKGRGRSARSQRL

SEQ ID NO: 7624 - protein, 248 aa, Streptomyces avermitilis
VRILVVEDERELAQTLRLGLTAEGYRVDVAHDGREGLWKARTGDYAVVVLDLMLPLLNGYRVCAQLRREGITTPVLVLTAKDGDWDQAEALDTGADDYVTKPFTYLVLVARLRALMRRARGAASPLLAVGDLVLDVAARTCLRSGVAVPLTPREFAVAEVLARRPGEAVTKSEILHHAWPDEAEDLNLVEVRVSALRRKIDTAFGRQSLLTVRGVGYRLVDDRGETEEDAVQEPPAGRWDGAGRNSGD

SEQ ID NO: 7625 - protein, 513 aa, Streptomyces avermitilis
VLGAPAHRAASAAPVIRRTKGPDMPTRLTALLSPSRPSRPSRDDAAGPVAGTARPARGAGWATALSLALVCFVTYAALSVRLHQRMLTTGYDLGIFEQAVRSYAHGHLPVAELKGPGFPLLGDHFSPVLALLAPLYRVWPAPVTLLVAQAALFAVAVIPLARWAEEVRGRRAALVVGLGYGASWGVAQAVGFDFHEVCFAVPLLALSLTAVGRGRARAAALWALPLLLVKEDLGLTVAVVGLLIARTGERDDRRRGGALVLAGVLGSFLEMLVVIPAFNPGGTFAYSSSVPGAGSATPGAGELLLHYTVGLVTPDTKAQTVLALLSVTGFLAVRSPLLWAALPTLLWRFASDNQAYWGTGYHYSAVLMPVLFAAFVDALTRPGPVRYALAASAAVTVLLLPQFPLWQLTQPATWHTDSRLASARRLMDRIPDGATVAASNRLVPQLTNRARVSVFGLGGSRPDAEWIIDDSAQPQGWPIAPDDDRRLLSEVRNNGRYRTVADQDGYVLLQRRP

SEQ ID NO: 7626 - protein, 129 aa, Streptomyces avermitilis
MLTHIPPDGVAPGNGYSHVVVGEGRLVVISGQVALDEKGNVVGKGDAAAQARQVFENLRRCLAAGGATFAEIAKFTFYVTDVAILPEVRAVRDAHIDTARPPASTAVQVAALYRPELMLEVEALAIIPW

SEQ ID NO: 7627 - protein, 335 aa, Streptomyces avermitilis
MPQDIDFGLPAPAGISPGLEATRRHNLGWVRRLGLVGDGPSLAWYTSWDMPRLAACGFPHARGAALDLCADAMAFFFVFDDQFDGPLGRDPARAARVCRRLTGIVHGAGPGPGADACSAAFADVWARSTDGAHPGWVARTAHEWEYYFAAQAHEAINRLRGTPGDMESYLQVRRGIAGTDLPLSLGERAAGITVPAAAFHSPQLRIMREAAIDVTLMCNDVYSLEKEEARGDMDNLVLVIEHARRCTRDEAVTAARGEVARRVIRFEQLAREVPALCAQLGLSAVERAHVDTYLGVMEAWMSGYHAWQTQTRRYTGAPHVLPSTGPGYFDEVLPT

SEQ ID NO: 7628 - protein, 153 aa, Streptomyces avermitilis
VRALRSTARAHERAAAVTWVRPFPLADQLADVVLDVFAPRNPSEFHRVLRPTGRLVVVRPTGRHLAELRGQVPALVTIDPAKEQRLFTALTPFFETSRTEQVEYATFLTRTQALDLVGMTPSARHLNRADLAGNGLLPDQVTVSVLATAYRPR

SEQ ID NO: 7629 - protein, 186 aa, Streptomyces avermitilis
MCGWSTPHRSAAVAPVRLAGWAQYGYCASHSRYFWGLRLHLVCTLGGLPVLFALTGADERETLRDMLDTAPDVLAAHPGQTIIGDKNYFGREFERGLAERHLKLLRPARKGEAELTGSHLFKPLRQVIESINQTFKGQLNLERHGGKSPAGVSARVLCRILALTAAIWHNDQTGQPIKRSLTAYGH

SEQ ID NO: 7630 - protein, 312 aa, Streptomyces avermitilis
MDVTTLYSIGELSRRTGLSVRTIRFYSDSGVVAPTTRSPAGYRLYDLDALLRLELLRTLRELGMDLPTIQRVLDRELSVAEVAAAHADAMDVQIRTLQLRRSVLRVVASRGSSPEETKLMHRLTQLSGEERRRLIDDFMDGTFGTVDADPAAVAMVRAATPDLPDDPTGEQVTAWVELAELVGDEDFRARMRRTAVRQAAGRPLDIECDAGEELMEFTRQKVAEAMEAGIDPLNDRGAPVIDDLVHRFAEVLARTPDTEFRDWMAQQFEETHDPRVDRYWQLVWIVNGWHVVPNLIPVYPWLIQALRNSRDA

SEQ ID NO: 7631 - protein, 111 aa, Streptomyces avermitilis
VPVSLSPALEPFLDLLRCPTCRTGLHLGHGALRCPAGHTFDIARHGYVSLLTGTRATSGDDAAMARARDRFLSTGSYGPIRQAVARLAADAMPEQGTVLDVGCGTGYYLDD

SEQ ID NO: 7632 - protein, 256 aa, Streptomyces avermitilis
MARHGGRGWYGRVLAAAVGVTALAAATSVWTAQAGPVDGQHSARPAAPGSGTGRAPVSADIAHASDHGAQGVNITIDDGPDPIWTPQVLQVLRENGVKATFCMVGTQAQAHPDLVKAVVAAGHRLCDHTVSHDTTMDTKSHSYQSRQILDAERMITKASGGVRPLYYRAPGGAFTPYSRHLAASRGMRPLGWNADSKDFERPGADAISATVKNEIPHGPTILFHDAGGDRSQTVAALRELLPWLKQQGYSFGFPVR

SEQ ID NO: 7633 - protein, 193 aa, Streptomyces avermitilis
MAGTGRVGLTTERLVRAGAELADEIGFEQATPAELARRFGVKTASLYSHVKNAHDLKTKIALLALEELADQVSTAVAGRAGKDALTAFANAYRDYALIHPGRFAAAQFRLDPQTAAASAGVRHAQMTRAILRGYHLAEPHQTHAVRLLGSVFSGYVGLESAGGFSHSAPDSKESWTEILNALDALLRSWPTAS

SEQ ID NO: 7634 - protein, 72 aa, Streptomyces avermitilis
VTEPDGRPAGVRLCSSGGGAGAGQMCRSRCSVCVATGTGGVCLTAAARSGKAGQQGSSAGICMGIDLACLLL

SEQ ID NO: 7635 - protein, 397 aa, Streptomyces avermitilis
MRLLPARPRLLALGEPTHGEDTLLGLRNELFRQLVEQEGYRTIAIESDCLTGLAVDDYVTSGTGTLDEAMEHGFSHGWGTFAANRELVRWMRAYNVRAANDGRPACERLRFAGFDGPLEITHAASPRQALTALHSYLATRVDTNLLPCTATTLDHLLGTDDRWTHPAAMTDPAQSAGQSAEAGRLRLLADDLVALLDAQTPHLTTATSRDDWDRARLYGRTATGLLRYHYWMADTSPARMTRLVGLRDQMMAHNLLALAARGPALIHAHNSHLQRAKSTMRMGGIPLEWWSAGALVSARLGEEYAFVATALGTIRHQKVDTPPPDTVEGLLYALPQDRCVIDAPRLATALGDTRPAPRVSPWFGYAPLDPAHLADSDGIVFVKDVVQSRPRLFSKTG

SEQ ID NO: 7636 - protein, 255 aa, Streptomyces avermitilis
MGRNLQSGERLRPVDLARGHGLSTQAVRNYEEAGILPAAGRTPHGYRTYTSLHAGALRAFLALVPGHGHRTAASIMRAVNEGAVDEALRLIDESHAQLLDDRRTLQAVESALRDLEPTTGSGPGGGSGPAAGSGSGSGGTFIGPLAHKLGIRPATLRTWERAGLVRPRRDPLTGYRVYDEADVRDARLAHQLRRGGYLLEQIAPLIARVRAAGGLEPLEAALRDWHGRLSARGRALLAGAAGLEAYLHERRKTRS

SEQ ID NO: 7637 - protein, 331 aa, Streptomyces avermitilis
MLTTLGLDTAAETVYRTMLMHPQAGVAELAVHLEVPEGDVRDALDMLSELALVRMSAEDAGRLRAVSPDIGMEILMARQQAELAAQQQRVEASRAAAAQLISEYSELRPATRHPEVEQLVGLDQIRDRLTGLTREVSEELLTFAPGGPQTADNMAASRPLNGDLLGRGVRMRTLYLDSVRTDRATVEHARWLTSLGGQVRTVPALPTRLILMDRKTALISVSSDDTAAGAVVLTGQGTLTALHALFETTWAGAQPLGDTVPVDRHGLTGQQATVVRLLAEGHTDETIAKRLGVSPRTARRIASELMERLEARSRFEAGVRAVQRGWLPARA

SEQ ID NO: 7638 - protein, 110 aa, Streptomyces avermitilis
VPVCWDGRGMYLVHIHLEFPPRTQLPFGARDMIRAALTADDLVEHVAVHPRSPSRLTLGFYLLAARLEEAEERAARVSRRLAEDVPVLRGARLRGAGVPLVPLAFERTPG

SEQ ID NO: 7639 - protein, 258 aa, Streptomyces avermitilis
MTTQPLRTERSGPQTASLVTDLPFKPQLVKAVFRDVTSLHVSRPAAWAAASVTRTVLTEIIDGARSAAAEEARKRLIPKDLISAIDRNVEVEVGSAWYLHSPTFHGLMGEVRNADGALVSLRERRGARTPSGVAGAHRFEAGVRRLLASRGVRAVPAMVRDLDGIVSVFLTALARDAAKVVREGGVKRFGTVSLVVPGEPAPAPLLKDPLLALSTRRGDGRTVGGDDVLAAVTMQLFGDLRQRAITEAAEMTRNTSAN

SEQ ID NO: 7640 - protein, 195 aa, Streptomyces avermitilis
LRLHRVAPGIAAGILAPALLLATPSFAATAAPTAVTVPAVSSSANEPDADDLRVAIVRILADPDSGQRVTREANALLDANDPEAMRAWLETGYRIAQAEDDRVAITRLLADPDSGRRVIAEVNALLDANDSDAIRAWLETGYRIAQAEDDRVAIARILADPSISPALRAAANAALDDNTPEALRHFLEVGRYQVA

SEQ ID NO: 7641 - protein, 135 aa, Streptomyces avermitilis
VAVAPLRSQGTVAADVAGVSWRRAFEKGGLERGSWLSGHDRARRFLGAVVVWSERVVGRDGVRLVCRDRGGPGEPVVLLHGLAGHAGEWEVVASRLIARYRVVAVDQRGHGASERHPYAPTSTSACSNSPAASSA

SEQ ID NO: 7642 - protein, 148 aa, Streptomyces avermitilis
VLEAAQGAPASSGRRTRRPGLSEEVLRAYAYACAFCGYDGMLGRNPVGLEAAHIRWHSQDGPDTLANALALCALHHILFGLGVLGLSPGLRIQVSPLYVARSHAGHAVGILHRRPLAPPRPGHPSPGPEHIHWHHQQVFKHAPTPVAR

SEQ ID NO: 7643 - protein, 204 aa, Streptomyces avermitilis
MTLPSRRAFTAAAMASLLVGCAGPGAGQATTAARPGRTPSSSRAAAKPAHALGRSVPVGLQIPAIGVDTPLLRLGLAADGSVQVPPVTAHDRAGWYRHSPTPGQRGPSVILGHVTVGAYGDGVFRHLARLRRGERIVARLENGTAAVFAVTAVRTVPKADFPADAVYGDVNRPELRLITCGGPRNGDGYLDNVIVFAALSSASP

SEQ ID NO: 7644 - protein, 163 aa, Streptomyces avermitilis
LKRSRERAASELFAALYPRLAGWCRRLVDDDETAHEIASEAFTRLWARWTSVAEPRGFLYVTAANLVRDHWRKLERERRAVHRVTAEAALRPPSEQADPSVRLLVQSLPERLRVPILLHYYADMPIREVSVLTGRKEGTIKADLHAARELLRAHLRRSLDHTL

SEQ ID NO: 7645 - protein, 162 aa, Streptomyces avermitilis
VPTSGEALITHSDDGPDFEPDDPLAVILRPPSDYLGPPAGRYEAIRRGAARRRLLRAAAGAGLACAVAALIALPLHLATPGAPPSPTVPLAPPPASSSPTAPAPPASPEPVSPSPSAGSRTQSATTTPTRAAVPTRAPSATPASASLAPSAPAATPESSTRP

SEQ ID NO: 7646 - protein, 517 aa, Streptomyces avermitilis
VPDGDMLRSPDGRVRVALIRTLRPLAVLAATAALFAGITDLPAAADGTAVTKLTLGTDQFKMTDTNYESATNNLYNNVLTNHANLTDVVTTDYTKNSSGATDAWMNLRSMRACAGSETQALPPVNKKVAWCWSSAHADDTTPRWFPQGMSTTGTADGGDGAIQGKHVSAVAWHYKTFKTNSAGDLEANDGCKTNNLLKVSFIDRDTGKYRHVLLAEPTSTSSSASNFKFVTGHGGGIVWYANYLYVTDTANGIRVFDINKLAKVDTYGSGLNSYGVSGGNSSACGYPYVLPEVHYYKQASTPASCSTNAVDGTPDADALCYSWLSLDKTGAGPFKLVTGEWYGNVAGGRVVRYQLNPTSASAYPGLLNMSGGKTVIQDAYAASGYQGLQGGMTWTDDAGLLNFAFSKGCGTKPAVFSHTWAGDTRAVTSCAAGGNWAVGSPQALSYWPKLDTAQVDELWGLTEGICAGTSLRASYPYEFPAVSESGNACTGYNSSDNLSLRSVFAVGFTDPAVQNLH

SEQ ID NO: 7647 - protein, 366 aa, Streptomyces avermitilis
MDKQVHDPPSAGRPASPGCAPGGCLRCAGPRLAAGLHGAGRPRRCLRPCCSGPCRRPRRLVFCTPAGRPRVRRHRGARTRRGPDSKTSKDRSGVESVAGQDVRGILPEGLGAAVRDTAEEIAALLRGGADMGRGVPGSQWTVGQAAAHLAQAGELMADIAAGRARSWGDGTPQSLAAANERALAAFGERRAEPLAAMIVAQADACVTALEESAAGAALVSPLGPMGPGVLGSYLLTHMLGHGYDLARALGCAHMIDRARVELTLPFLITAMPRVSEPARTAGLSASYAIRLWGGGRFGVRVAGGAVAVGPRPPDRPDCTILIEPVTFLLMALGRRGQWSAIAQGRILAWGRRPWLAPRFPALFTAP

SEQ ID NO: 7648 - protein, 178 aa, Streptomyces avermitilis
MLSDLSPVIAASARWLLSAFPPAAGPLNDALAEAQAQHAATIAAALRYPTALDAELLNLLGPGGSGALDHVTGAAAHPLTDAAPAWRTQVDETVVSWAACLLADPALAAVAAACLAATHHGANGVGDARRLTIPSPRDHRAAPLLRHPDLLGPIADLHRESLLGLLHPGPALTSPGHR

SEQ ID NO: 7649 - protein, 629 aa, Streptomyces avermitilis
VAEARNTTEARARDGARGSPGVPFGAGPLRYLPIAEHGLIGDLRSAALVGTNGTIDWYCCPRFDAPSVFASILDAERGGSFELAADVVARTKQFYFPDTNVLITRFFADEGVGEIQDFMPVVDDSREADRHRLIRRVVCARGALPFRALIAPRFEFGTAPHTVQVQDGQALFESSSLRLALTSTVPIEVAGQDVWSLFKLHEGESAVFTIDRIGGDVTPRFCAVAEAEREFNATVRYWRHWLSRSRYRGRWREMVHRSALTLKLLTYAPTGAIIAAPTTSLPEQIGGERNWDYRYVWIRDAAFCVYAMLRLGFTDEAEAFMGFLSEYVRIEETQAPHLRGPLQIMYGIDGRRELPERELPHLEGYRGSAPVRVGNAAVGQLQLDIYGALVDSLYLYDKWGKPLSSAHWDSISELVDWVCDHWDQPDEGVWETRGGRKTFLYSRLMCWVAIERAMRLAQHRGLPADMVRWGCARDDIYRRIMRHGWSAGRHAFTQYEDSDILDASLLMMPLAKFISPTDPKWLATLDALGEDLVSDSLVYRYDPQASPDGLQGEEGTFSICSFWYVEALTRAGRLDEARLAFEKMLTYANHLGLYAEEIGPTGEQHGNFPQAFTHLALISAAFNLDRVLG

SEQ ID NO: 7650 - protein, 844 aa, Streptomyces avermitilis
MFCWIGEAATRRPRLVLFGAFVFLVLCVALGAGAGGRLKTQGYDDPRSDSSFAARVTAEHLGAAPNLVVVVQVPGGFVDDAAAQRAGEDLTRRLAAQPQVSAVSSYWRGRAAELRSRDGRSAMLLAHVDGTGEELGGRVKRLREALTAAGPYTGGSSAPGPSTAGPSTPGPSAAGPSAAGSSTGGSPAGGSSARAAAKGMPALKVHVGGPALVDAELQDLSESDLKRAEAVVLPGTLILLVLVFGSVVAALLPLLIGVLSIAGTLLVLSVLGRVTDVSVFALNLTTVLGLGLGIDYGLLIVSRFREEITGGHSARDAALRTVRTEGHTIVFSAATVCAALATLLVFPPYFLRSFAYAGIAVVAIAAVAALTIMPALLTLLGKRVNAWPVPWRRRVQAGCASRWWEALARRVVRRPVLAAVPVIGLLAVLAAPFAHAGFATPDDRALPAGSFSRQAGDLVRGEFGTRSAGALTVFTTSATPQVALDYAPRLSALPGVAQVVGPFGVYRDGRQVAASGPGQAGPSGTDRAAFHSVVPSADPRSGAAQRLVRAIRAMPTPADTHVHVGGPSAVLVDAKDTVAGRLPLALAVITLTTSVLLFGFTRSVILPLKAIALNALSLAAVMGAMVWVFQTGHLQSLLGFTPGPLSTTMPVLLFCIVFGLSVDYEVFVLARIKEAHDAGQDTAGSIVTGIARTGGIVTTAGALLAFTLLSFGTSQVSLLQFFGIGAGLGVLLDATLVRGVLVPALMRLAGGWNWWAPRGLRRDRPARNGPPVTGDPPARRAPPPPPARHAPPTPPVPPVPQVSQASQASQAPAGAGPAVPPVSSPSRRTPDVSRSSHPTQEGLS

SEQ ID NO: 7651 - protein, 501 aa, Streptomyces avermitilis
MTDNATDNATGIAIVGLGCRFPGAGDIQAYWKLLLSGQRQFSAVPANRWNHDTFHEPGRRRGGHAAYTDQVAFLDGVERFAGLHYGLPPARVRAMDPQHRLMLDVTREALDDAGWGRGGFDRENTGVFVGISVSDYKDLMTARIRAVSLADGSIGGATDPRILEAFRERAEELSTIHSFTLPGSLLNMAPATVSRQFGLGGPSFAVDAACSSSLIALETAVAHLRQGTCRIAVVGGAYLSLTPDGLVGFSQLGALSATGVCRPFDKDADGFVLGEGAGSVVLRPLPDALADGDRVYAVIKGIGSANDGASPEPLAPTPEGQLRAMRRAYADARVTPSSVGFIEAHGTGTRAGDRAEAQALRRLRTEYPDDDPALCYLGSAKALIGHSLSAAGIAGLIKTALVVHHRTIVPQPDTTPHPDLGIEAAGLRFAPAARPWPSSGGPLRAAVSSFGFGGTNVHVVLTPPPAPLGHAAGTAEVRPRATHRSLAPNPAPGTAPNPTSC

SEQ ID NO: 7652 - protein, 1244 aa, Streptomyces avermitilis
VLISAGSPRLLDGQIGELLDFLDRSPGTPPAAMAHTLGGREMLTARLAVVAATPDELAGRLRRARRQLADGVRGDLGDGAFAADAPLPPEQRRIAFVFPGQGSQRPAMMHDLYQRSGLFRAALDTLGAPAREHTGLSPAQVLYGQRASTPPGDAQLRQRPAGTDVCQPLLGSVQIAATRLLAACGVSPDLTLGHSAGEFAAAAAAGALTDEDTVRLLAHRGAALAQAETGARGGMLAVQSDKETCRRLVHGIDDVWFACFNHPRQVVVSGTVQGLAALRRACAAAKVAAVTLEVSNAFHSPRLASAEAAMRADLARRPVTRPPVAFVSCVSAALCSDPAELRELWARHACAPVRFEEAVRSAYAHGARVFLQVTGNRSLLASVRRSLAGHGDVRLAGTDGPAPDSGRGFLQALAHLAVLGAPVDPRALIPQQDRRLLDLPVARLDTQSYWIRQPRRPATPVNPVNPVNPVNPVNNEAPTAGVPLRPAPFGPCGAPRTEQPATGRTTAGETTGEATGETTGQTAGEADGQADGPATWQATGQEVLHEALTLLREQGALLTRLSEALGTHHATGPAAQSEALPIASTAPAASAPPAPAASGIPAVPAVRCAPPADDDPAAASADADRPAARNITDITQIREAAEATKVSEATEATEAGEAAEAAEAAETVFAHVARISAFPISHLHGRQLLTDDLGFDSLMLTDLFASLKRQWPFLTIDEKTYDRPTVEGLITMITDGSADTAPLTAPRTRPTGRREAADALAAPQAVTEPNAEPNAGPGAGPGAGPDAGPDGDALPDPPAVGPHAVPPTRTGLHAVPPAHTGLHAVPAARTGPATAGLPEQQTQIECFPEVTAHNERLATYSRLGLPNPYFVVHERGMTDTTVVGGRELLSFSSYNYLGMATHPQVNEAARKAIERCGTSVSASRLLSGSRPLHLELEAELAATLGCEAAITLVNGHATNVTVIGHLVGEGDLIVHDSLAHDSIIQGCRLSGARRRPFPHNDAAALDALLTQVRHHYRRVLVVAEGVYSMDGDIADLPALIEVKRRHGALLMIDEAHSIGVIGAAGRGIGQYFDVDRQDVELWSGTLSKALASCGGYVAAGRTVVDYLRYTVPGFVFSAGMTPANTAASLAALRVLRAEPQRVARLKENSALFARLAHRAGIDTGPSHDTPIIPCIVGDSAKTLQLAEALFEQGISVNPILYPAVPEKAARLRFFITCDHTPDQIHHTVRELAHGLRQADTAPAA

SEQ ID NO: 7653 - protein, 117 aa, Streptomyces avermitilis
MTSRHGTTTLWRPTGPKELDLVRELKWRAWPARLLGQPFFYPVLNEDYAVKIARDWNVKHDGAGFVTRFEVESQFLRRYPVRQAGGQTILELWVPAAELDDFNAHMAGEIEVVHEFR

SEQ ID NO: 7654 - protein, 192 aa, Streptomyces avermitilis
LPLPARRAGHRATLRCERPVQRGRCRVALSQRRPGPRDPQAAVRELLPRELRSGSFFPALLERRRRIDQALYAVIMEAYVRGVSTRSVDDLVKALGVDTGISRSEVSRICQDLDGELTAFRARPLDHVRFPYIYLDAPYCKARVEHQIVSRAVVIATGITEDGGREVLGVMVGDSETEVFWTEFCVTCANAV

SEQ ID NO: 7655 - protein, 169 aa, Streptomyces avermitilis
MLGAAYQRCRVHFLRNVFSLINKEAAEMAAATIRTIFAQPTADAVRTQLDTVAGMLGKQFPKVKAMLLEAKDDLTAFAAFPERHGKKIQSTNPLERINREVKRRTDVVQVFPNDDALLRLVTAVLFELHDEWIAFPRRYLPEGSMSQLYPAELPEQAPALAHTTSTTAG

SEQ ID NO: 7656 - protein, 75 aa, Streptomyces avermitilis
MASKPVRASLGEVWLTCQICRGDLFRERGVLLNSTGMEFMKLAWADENATGLICWRCGYVHLFVNKDIKLYRADK

SEQ ID NO: 7657 - protein, 279 aa, Streptomyces avermitilis
MQPRSRTAGRQGAGAGPGGGRHFSRPPGGTPYARRRSTGHVRAAGSGGIRPVISYADRCRGADSFDARAPGVPCGVIPRPLPGTFLVTAEGDMFSKRLIAAAATAVVIAGLGACGSETGNGSGSGGADLGSSWSDDAGRSGQDAAPHARPDTDTVRGLRDSVRHLSRKTAKATRPHLVNKCTPATRRAKHTQQRGTGTRKKTRTWYTTEHYQDCKKVRNGTETYTRTVRPQQWCVRLDDVDGDTSQDDRWYQVTRTTYDEALTMAEHTRIEFTPAGTGC

SEQ ID NO: 7658 - protein, 108 aa, Streptomyces avermitilis
LQLDVYGYVVETLYLAHQSGVARCGDTAVLHQRLVEHLAERWQMPDEGIWEVRGERRHFVHSKVMAWAVVDRTIRLVEAGALDAGLCALMELREAIRHEVCTRGFEPV

SEQ ID NO: 7659 - protein, 139 aa, Streptomyces avermitilis
VGFLSPGGPRVLGTVEAVRRQPATLEGFVRRYPTAGDHAGLDGLDGDEGGLPALLVVDGRRARSDRPPGQAHGLFGRFLALRTDLGLLAEEYDHVTGWQLGNFPQAYSHIGVIGSALLLQQLGSGAPAAEAEVLLAADV

SEQ ID NO: 7660 - protein, 411 aa, Streptomyces avermitilis
VSEQQIIVLDPTGSDPDAEHQALRERGSAALVDILGVRAWSVSDPALLKQLLTSKDVSKDGRAHWPAFAETVPTWPLALWVAVENMFTAYGDNHSRLRRMVAPALSARRTAALQADIEALVNSMLDGLDAFPAGEVADLRKHLAYPLPIAVIGKLMGVPADRRTEFRTVVDNVFATHLSAEEQAANTAALYALLDALIEIRRAEPGQDMTSLLIAARDEEDGSAFSDAELRDTLLLMISAGYETTVNVIDQAITTLLTDPCQLAHVREGRCTWQDVVEETLRHQPAVKHLPLRYARIDIPLPDGQTIKTGEAILASYAAANRHPTWHEDADRFDATRPSKEHLAFGHGVHFCLGAPLARLEVATALRLLFERFPDARLATERTALEALPSLISNGHTSVPVHLRPTSSASS

SEQ ID NO: 7661 - protein, 323 aa, Streptomyces avermitilis
VTSAAGASVPRRGPKLELLLLSDDERAESERCTRRATPARALALRARIVPACAGPDVPPFVAVAPELRVAADTVRKWRRRFLARRPDALAGEPRPGRPPTISVDQDTQLVVAAGRPLPGNRHGARAYRESGAARAVKNAPLLGDGGYRGTPALIPHWPRKDRPLTPQQQAGNAVHRRARACVEHAFSRRKTYKILRDCRLRGDGVHQAILAVARPHHLALAGQPHLGQGHSLHFPNTGLRDVIQPEQGRAGPGGGGAGTQVRCRRHPKGHRRDSSRGPQPGPEAGTGRAAGGALGRVSGGEAVPQPCCCLPGRAEVEVLGPGR

SEQ ID NO: 7662 - protein, 109 aa, Streptomyces avermitilis
LSSASEGVSSDDRTDLSEEIPMSLTLTAPYAEAPAPAPAPASAPASAPVLAPRERETLRHIAAGRTYLQTARHMGLSKHTVDAYLRRIRAKLNISSTAELTRLAISLGL

SEQ ID NO: 7663 - protein, 844 aa, Streptomyces avermitilis
MERLPTPAGQQADIPDASPAPACTATATISEQGIVTGWSEGARELLGYTPPQIVGHPAARLLADGTGEQARRETAGRERFSGQVALLHRDGHRLLRNLLAHRRTPQGPQPAEWLVVSAVTAASASPRTPDSQALREWVFSQSPCILAVFDTDLRLVTANTGMESALLLPEEQMRGLRLPEITPGPASEEAETKMRRALETGQTQHMQAYLHPTGVSAQRGWSTTLAPLKDPGGTVRAVCLAAHHRQQEHLARQRMLLLNDAGARIGTTSDIQRTVQELADVAVPRLADFAAVDLLDVPRRGGEPARLPATGPITMHRTALHTTPDNHTSHTSHTSHDGDDGDGGDTHPATPPAAGEKILYPAQSPVAQCLAQGHGALYEADDPALTRWAANDPTAAWTRRQGTHSVMVVPLRAHGTTLGVALFARSHRPEPFEADDLWLAEELTAQTAVHLHNAHRHAREHTTTMTLQRSLLPQKLPDQGALDIATRYLPAGSKAGVGGDWFDVIPLSGARVALVVGDVVGHGIRASATMGRVRTAVRTLADVDLPPDELLTYLDDLVIHLAADEGGGAEGTTETAAGIGTTCLYAVYDPTTRHCTIARAGHPPPAVVTPDGNVRFLNVPAGPPLGLGGLPFETLETQLPEAASSPSTPTDSSKPATTTSTKASTKCSTPSPAPPTTSTPSATESSPPCSPTAPTTTSPSSSPAPAPSTPTKSPPSTSPPTPPSSPKHANTPPPNSPPGTSPTPPSPPNSSSANSSPTPSATATHPSNSASSTTTTPSPPKSPTPATPPPTCAAPAPTTKEDAASSSSANSPNAGAPATPPPAKPSGPNKPSPPTNTEFRFRWV

SEQ ID NO: 7664 - protein, 83 aa, Streptomyces avermitilis
VLRARPGRDEGEREMVHRLASARKAPKVVVERCRTVELSWGGWLVPQIADELRCGVGQARTTHPNPQTPLHVHRLRTALIGLH

SEQ ID NO: 7665 - protein, 173 aa, Streptomyces avermitilis
MRGLMLDGRRKSIQAMAARLPDGNEQNLQQFVNQSTWDPVPVQRRIAERMLPLINPVAWVIDDVSVPKDERMSVAVAPQYCGALGKRANCQVAVTVHAATDTASCPLQWRLFLPKEWASDTDRRAITRIPPEVAQALSRWLTGWDDLLVDQAGRGRPWGARRRRTGGTGTRSR

SEQ ID NO: 7666 - protein, 239 aa, Streptomyces avermitilis
VGSTSPSYRGHRYPVEVISHCMWLYFRFPLSFREVEELMLQRGVIVSYETVRRWCAKFGQAYANGLRRRRPRPGDKWHLDEVFVRVNGELKYLWRAVDQDGNVLDILVQNRRDKAAARRFFRRLMKETRSVPRVVVTDKLRSYGAAHREVMPSVEHRSHKGLNNRAENSHQPTRQRERAMKGFRSTGGAQRFLSAFSGISPHFRPHRHLMTASDHRAEMTIRFAIWDQITGAASRPTTA

SEQ ID NO: 7667 - protein, 111 aa, Streptomyces avermitilis
MPRRTIRQSRTQQRDNALPGVPRRWRVRRRSVPVVEPPSEPDTHAILSVFTSHVLDMLPWDSQVTFAGVELACRGQVGWVAHRLACVRRAGGCSSPLAGSSPRTLSSSLAF

SEQ ID NO: 7668 - protein, 218 aa, Streptomyces avermitilis
MPPKSGQDAPNRHRVGGDRQHGEDWLSGGRSPSPDWRKPSPLGLGVAVDAVTNVAAPLLAGFAIATIGVVGADGGHFRWPGPVLLCLTLSALLFVTCVQFGFHARRHLYSFADISAWWSDEEMRDHRDLLREEQNADFQLWNRWRGRAYTAYSGGMVMLWLGVALVLVPPARSTSPDTEFRWAAAAVAVGAAVVEAVWSMYPQVRLWFQRRRVLRGNA

SEQ ID NO: 7669 - protein, 119 aa, Streptomyces avermitilis
MTDLVERLVPDELWVLFRRVVPPTEVIRPQGGGRRRAGDREALAAIIFVATSGCTWRQLPPVFGPSWQTVYRRFAQWSRARVWARLHRVILDELGARGELDWSRCAIDSVSLRAAKGGH

SEQ ID NO: 7670 - protein, 165 aa, Streptomyces avermitilis
VRDRLGQPAGGKRGPLTGPNPTDRGKLGSKIHLITDRNGLPLSLGISGANMHDSLGLEPLVRGIPPIRSRRGPRRRRPGKLHADKGYDYDHLRRWLRKRGIRHRIARKGIESSKRLGRHRWVVERTVSWLAGCRRLHRRYERKAEHCLAFADIAAALICHRRLTK

SEQ ID NO: 7671 - protein, 394 aa, Streptomyces avermitilis
MGGDLAGVRLWAGELEAVHERFVHRFSREEPRQSALAYMRGLVAPLERKNGWTLAEEAGHAGPDRIHRLLNRIEWDADEVLDDVRDYVVENLGDRDAVLIVDDTGFLKKGVRSAGVQRQYSGTAGRTENSQIGVFLAYATGRGRTLIDRRLYLPTSWTDDRERCRRAGIDDSVAFETKVAMAKAMVRRAIADRIPFGWVTADAAYGFSKGWRFELEQADVFHVMATTRHDTVVTRWSIDHPVHDLFPGLPRQKWKRRSCGEGAHGRRIYDWARVEVRPWHREDRRHWVLARRSVSRPEEISYYIAYCPAGTTLDELIRVAGSRWAVEECFQTAKQECGLDDYQVRRYPGWHRHMTLAMAAHACLTVLRARELDIGKAETDPPSSSTTASPRSDD

SEQ ID NO: 7672 - protein, 153 aa, Streptomyces avermitilis
LFVESGHHWSLRPRAPGFAGERLFQQRVSKSADIRLTAVGDHLTAVRIDGSPGIDWRRHYEALTYTPVPVPPEITKGVRAYLDAFGLVFGAFDFGLGTDGRWHWYECNPNGQWAWFPDNITAPITNALADRLQHPQGTFQSCCQAALVTGGEV

SEQ ID NO: 7673 - protein, 401 aa, Streptomyces avermitilis
VEGNVPEIWAGVDIGKTHYHCVVINADGKRLLSRRVANDESELLALIGDVLEISADALWAVDLNHGGAALLIGLLVSHGQPVAYLTGLAVHRASATYKGGEGKTDAKDAFVIADQARVRRDLGLLRPGDEIAVDLRTLTTRRLDAVFDRTRQINRLRAQLLEIFPALERALELTNRGPVVLLTGYQTPAAIRRAGASRIETWLKNRKVRGAAALAKTTVEAAQAQQTALPGEKLAAAMVVRLAKGVMALDEEIAELDALIEVKFCEHPHAEVIRSLPGMGAKLGAEFLAATGGDMDAFGSPDRLAGFAGLAPRPRDSGRVSGNLRRPRRYHRGLLRTMYLSAMVSLQCCPASKAFYDRKRGEGKGHKQALLALARRRLNVLWAMIRDGECFHTSPPVTRAA

SEQ ID NO: 7674 - protein, 374 aa, Streptomyces avermitilis
MTDPADLRRQLANTIPTDDPAWRHALQSVPREIFLGDALFRLTGPQWEPIHRDQTAPGEWLRLIYQDTTWVTQIDGVNAADACSPTTGRPTSSSTLPSLIVRMLDLAGTRDGDNVLEIGTGTGYSTAILCERLGDEHVFSVEYDPGLAAAAADHIHAAGYHPTLNTGDGLAGHKDGAEYDAIIATCAVRHIPPTWLYQVRAGGTITTTISGWMLASGLIRLTVHDDGTATGRFADDQISYMLARPHERPPRPTYYQHPGHTRPTRVNPALLDDWTGHFLAQLAAPSAELMNTTDGVILVDVATGSQAWTEPAGNSWHVHQHGPLNLWDQVENTLTTWQRAGSPPQSDLGMTVEPDGTQRVWLGAPDGPSWDLPV

SEQ ID NO: 7675 - protein, 344 aa, Streptomyces avermitilis
MAALWAAEAALTPGEVQAELASDLARTTVTTILSRLYDKGVVDRRGVAMVTTPCRTPRGSPPGACIPSSTVTLTGRPSWPASSPSSIRTTNSFCASYWRPTRDDRPLLIPLLLPFVMPLLARRALDRLAPATALWALTAAALVLAGACVTALGALVLTGLLKLPAFAALGELAHPLRTPTGYLVLPAAAIATGLLTIGAWTLAHSALRQTRAFRTARAEADRRPTAGDLCVVDSPHPDAYALPGRPHRIVVTTAMLRSLKPDERDALFAHERAHNQGATTASWSIGSAACRPGRMVSYLGACGARRAGPMRGRRGPRAIPVVCRPVPRSCRGRIVGVSLPSARW

SEQ ID NO: 7676 - protein, 228 aa, Streptomyces avermitilis
MRGPAFMTAPLFAASQLAVNVLSAQSLLAAFGVLGVGVVMFAETGLLIGFFLPGDSLLFTAGLLCTGSGQHGVKLSLAPLLVAAAVGALAGAQCGYVLGRKAGGALLARSRSVRLREGAQRAEELLERYGHAKAIVLARFVPVVRTVLNPMAGALGVPARTFTVWQVAGGLVWSLGLTLGGYALGSSIPNVDRYLLPIIAVIVAVSLLPLAAELYRSRRAAKAKEVRG

SEQ ID NO: 7677 - protein, 201 aa, Streptomyces avermitilis
MILAFDGSSIDGTAYTDVVDLAHRSPGWLDDMVAAWSTYGLAVFAALMAVGWWRARRVSPAAAVSALAVPAIVFAAYGVNDVLKLLVREDRPCQSLQVITLEACPAPGDWSFPSNHTAIAAAAAMALLFVSRRLGAVAAGAACAMAASRVWVGAHYPHDVAAGVVVGALVAALAMVTLRRQPDSLVRWITGTRLRPLVLAS

SEQ ID NO: 7678 - protein, 242 aa, Streptomyces avermitilis
MKRSDLGELAGSVGLGAWTAFGVLTMIVIGDGQPLYGDEDLLSWSVGHRPDVPVALARALTATGTGAIPYVLAVLAGTIAGRTLRQRAVATALCLTCLGAGQAARYGVMALVARPRPTRVDWATPASGWAFPSGHTTTAALTAGLLVIAVYTRSPPGRALLALVFGCWGALVGLTRVYLGVHWFTDVVGGWLFAVGWLGLCLCAAAWWLPEAFITGTTDIDQKPPEDHAPQDPGRRGRSRPA

SEQ ID NO: 7679 - protein, 220 aa, Streptomyces avermitilis
MRHKILVVEDDHALRDVLLRGLRDEDFDPVPAPDGASALRLATRDIAASVLDIGLPDADGRDVCQAMRANGFLSPVIFLTAHHRLTDRLSGFSAGGDDYLPKPFHLAELAARLRAAVKRAAPLPAATAGDLVLDPVRHSVSVRGTPVDLTPTEFRLLAALMAASGGIVRRRELVRAGWPEGAQVSDNTLDQYLTRLRRKLRTAGSDLTVTTARGIGHRLS

SEQ ID NO: 7680 - protein, 453 aa, Streptomyces avermitilis
MNSMFSRLVPRTLRGRLSLVALTTATLLMVVLTVAFNTVIRHRLQHQADDELHTRAAAVATTIDTSGPTVRVLETSNDQLLDTNVWIYAGTRLLEQPPSTTAHSTLAHAADSLARQDGTHCLTAEEPDPAQLCSLPVSDGRSTATVVTALDLSPYRSSAATLLWASLCLDAVMLACTYLLTRLAVGRALRPVATMTDQATQWSIVASEERFGAARRPTELARLGASLDAILDRIRAVLRHEQQLTGELSHELRTPLSRIIAELDWWQARPRSAAETEATHEVIADAARSMRSICDTLLNDARKGTTTTPGTAEILPALHRLAASLEAPVHVTVDARSDSVPLEAGVQAALLERIVSPLLVNAVRYATSHVTITASREPGGVRIDVDDDGPGVPESFAAQLFQPGRRADPDDGRGGAGLGLPLARRLARSVGGDVTYDPGHKPGARFTVRLPAG

SEQ ID NO: 7681 - protein, 266 aa, Streptomyces avermitilis
MKIAATTLGETAGDLFAQTLKLGYFLTTIALFLIFVVTLVVQLRSRRYNPFFYWTVILSTSMAGTTMSDFMNRDASAKFLSGGATSLGWGPQGLGLGYPVGAAILISLLIAVFAVWKLTGMTFVIRDIVTFRGEALFWSAILVSNTLGTSMGDFLSDSSGLGYAGGALLVSGMLAMLLVLMKVPVVPNVLLFWFAFVLTRPLGATAGDFLTKPVAKGGLDLGTAGSSAVLLAILVGLMAYAQVRERRTALSSPESAEQEAVTQRAA

SEQ ID NO: 7682 - protein, 276 aa, Streptomyces avermitilis
MTSETSETAAVHGSAPNAPGHRLRWNKVPEVTVYFWVIKVLCTTVGETAADLLNEKAGLGLTGVSLLMSVLLAVILVVQFRTTAYRPGAYWTAVALISVVGTLVSDNLTDNMGIPLETTTAVFAVLLAVVFVAWYRSERTLSIHSIDTLRRESFYWLAVLFTFALGTSAGDLVAERMALGYWVSAVLFALAIAAVAVARFALGANAVWSFWIAYVLTRPLGASMGDYLSQPTGDGGLGLGTVVTSVLFLAVILGLVVFLAVTRKDVTEPERLARTA

SEQ ID NO: 7683 - protein, 93 aa, Streptomyces avermitilis
MTIPHSHGRTCADHATHWLRRRLGRAVALAYLAAVLLPGPGRWLRHTHTLVGTGLPLYTASLLLSLVLFSAGLQVPVRALGQLLRRPRACWQG

SEQ ID NO: 7684 - protein, 232 aa, Streptomyces avermitilis
MILIVAMPVAAGATVWTGKGHGDQPTMVGLVLASTLVSPLTIPVTVGALAPLLSGGYPDALGPARDTMNSGFAFAQVVLPCAAGLMCRLVLPARLLDGAGRWVVPVALAGSAVLTYVNASGALGALLAHPRPLLLIAAPVVAAVVCAPSFAVGRLAARVLRLDAPAASSLTLACGMNNSSASAVLITTTLPDKPHLLLPVLAYGLLQKTAANRVVRMTRPHRPPGPPCPASS

SEQ ID NO: 7685 - protein, 460 aa, Streptomyces avermitilis
MRQRVVRVALTAVLVAMVLLAVPLALAIRFSLYADQRDALERAALAGAVRVSPDYATGDPVELPPPPDGGRLGLYDPQLRLRAGSGPRIGDDTARRALTGTVTRSTGGGELVAAVPVSHDEQVIGVVRVSSAVQDVRDRILVGWALLLGVAVLALTVAVLVARRQARALAAPLEDLSRHCRAVTGGDLTARAAPSAIGEIDQVARTHNEMLHSLAELLLRERNFTANASHQLRTPLTGLQLTLEAGLEHDDTRPVLEEALAATRRLHHTVEEVLRLSGSAGLPQPVAPDRPVTGLLRETEERWHGLFAREGRRLECDTGEVPDDVRVPGGPVAEILGVLLDNARVHGHGTVRVTVRDLDDALALDIADEGTADGDSARLFERGHTEGGAGTGIGLSLARDLAVSLGGRLSLANRAPTTFTLLLPVRAAGGHGAEDRNESDGRRGDGDPQDEAGQGGPGGR

SEQ ID NO: 7686 - protein, 222 aa, Streptomyces avermitilis
MARVHTFGVVGLVLAAAVTAGCSGATSGSGSSSSSSSSSGAATTAASTGGSSSGSGSSPAPTESNPPGDIPDNQAFIAYQPSGGAFTAFTVKVPEGWARTSQGSTTVFTDKLNRVQISAAATSNAPTVGSVAHQVVPQLRGHVSKFASPKVSTVTRKAGTAVLLTYQGDSANDPVTGKVVRDAFERYAFYRQGHEVDLTLSGPVNADNVDPWRIVSDSFTWK

SEQ ID NO: 7687 - protein, 246 aa, Streptomyces avermitilis
VNTMLVPPSDEALTARELYRFFRAGEEETLALRGVSLRVRRGETVAVVGPSGAGKSTLLSCLAGLDEPSGGEVRVDGVRISHRPETERARLRAHHIGVLLQTSNLVAHLSVRDNVRLTHSAVRGRPSASVGDLLAEVGLAGRAHALPRQLSGGELARAGLAVALANSPAVLLADEPTGELDGGTERMILQMLRDRAALGCAVLIVTHSAEAVRIADRVIALDDGRAHETTTSQARTQQQEAHDAAP

SEQ ID NO: 7688 - protein, 237 aa, Streptomyces avermitilis
MPPRDHAIPAGKPVTSLDEVLVDCRNAALTFGRGATAVVAVHGANLWVRSADRLAIVGPSGSGKSSLLHLLAGLEQTTSGTVTWPALDGPGGIGIVFQGDSLIAALDVVENTALPLVLAGVPDGEAHRLAAEALALVDAADLAERLPEEISGGQAQRVAAARVLAQSPRLILADEPTGRLDHTTGGHVLDALLTAADQTGAALVVTTHDPAIAARLTTRLAMRGGRLLTVDEPQEAS

SEQ ID NO: 7689 - protein, 882 aa, Streptomyces avermitilis
MNTAWAGGLARHRAGRLLAALAGIALAVALVAALGSFLTVSKATMTQRAVRSVAVDWQVEVQPGADPQAMLSLVRKAPGIRTAVPVGFAHSSAFTAQVQGSTQTTGPGMVLGLPDGYQKLFPGGIRPLTGGTSGVLLAQQTASNLHVAPGDTVGIRLPGTGVRQVRVAGVVDLPQADSLFQKVGAPTQSQPTAPPDNVVLLPSTTFTSLTAQAPAAGVTTQIHAARDAKLPSEPAAAFNTATRGAHNLEARASGAAIVGNNLGAALDSARQDALYAQILFLFLGVPGALLAAALTAAVAAAGGERRRQEQALLRLRGLRPGRIATLSGIEAGLVGAGGAAAGLGIAALLGRLAFGSASFGTSAGTWILWYALAFVLGAVVAAGAVLVPALRDLRGVTVADTRRAGRRTGSVWWMRYGVDFALLIGSWLIFRASSGNQYALVLAPEGVPSISVSYWAFLGPALLWIGSALLLWRLTLLALTHGRRVLARLSLPLAKNLAGTTAAVLSRRRRPLARSVVLLALAVSFAISTATFNATYKQQAEVDARLTNGADVTVTEPPEARTPPGAAASLKVSGVRHVEALQHRFAYVGSDLQDLYGVRPDTITSATSLQDAYFSGGTAGTLMRKLAKQPDALLVSAETVTDFQLSPGDTVNLRIQDAHTKALRTVPFHYVGVAKEFPTAPKDSFFVANASYVAQATGSDSVGAFLLDTGGTHQKQIAAHLRRQLGTSATVSDLTQTRGTVGSSLTAVDLAGLTRIELAFAVLLAAGAGGLVLALGLAERRRTFAIATVLGATRRQLRGMVLTEAILLTAGGLAGGALIGWALSEMLVKVLTGVFDPPPADLAVPGAYLALTAFAATVAVLAAALNGVRRAARPAVEELRDL

SEQ ID NO: 7690 - protein, 259 aa, Streptomyces avermitilis
VNAPPGSTLPSMRTPAAPDRSRYRVLVVEDDDTIGRHLETGLRSNGYTPTWSRTGTGALTESAQTQYDVLLLDLGLPDMDGLDIARTLRARLPDLLIIILTARTDDIDVIAGLDAGADDYLVKPFSLTVLLARLRAHLRRRAIAAPPQQPIRLGDLVLDVTARRCTLHDREVDLRPKEFELLAVLARHAGEAVSREVLMAEVWDENWFGPTKTLDVTMAGLRRRLADAANASPIPAALPRISTLRGHGYRLEPHAVPPV

SEQ ID NO: 7691 - protein, 324 aa, Streptomyces avermitilis
MSERNPILITGAAGEVGGVSRTTVDMLLEQGHPVRAFVRQDDERAHALRQAGAEVFVGDLLTIADVSAALKGVRRIYFSMSLSPYYTDAVSLMAAAARAQGDIEVFVNISEYEQSFMTFEKMTAPEEERRAWLGGLVANWSPQQRAHWVAEQVLDWSGLPTVNIRAAMFVENPLMTWLALEPLANGELRLPFGHHRLAPIAGYDVAELCVKILADPAPHISKSYDLNGPELKDMHGFAEDYAAALGRQVTYVPEDVETWNETYVDTVLGALPHTAEHLKTLTRLMGGGGYRGVTDQLETLLGRPPKTVRWALENHPRIRKLASA

SEQ ID NO: 7692 - protein, 344 aa, Streptomyces avermitilis
VEGSLTHRFVDVNGVRLHIAEQGQGPLVLLLHGWPESWYSWRHQFGALAAAGYRVVAPDQRGYARSEQPPDVASYTLLHLVGDVIGLIEELGEEQAVVVGHDWGAPVAWTTAMLRPDKVRAVAGLSIPPILPGGMVPPSITRTQYGEGFYQVYFQQPGVADAEFAKDIPNSFRRFLVGASGDNPLGREPSPLVIPDGLGLLDIMPESPALPAWLTEEDIQAYAEDFALHGERAFTGAFNWYRNIERNNELLAPFRGRGIDVPALYVVGDRDMVTSLRGPDGGPSLSEIFRGQGGPGNPLSAVAPQLQGPVVLPGCGHWTQQERPVEVNAALLDFLTRIDGSAPR

SEQ ID NO: 7693 - protein, 233 aa, Streptomyces avermitilis
MTAIKGASVFVTGGSRGIGKMLVEALYARGAGKVYATARDPRTVTHPDAVPLALEATDPASVAAAAEQAQDVTILINNAGASVRASYLDSPMEDVRRDLETNFYGPLLVTRAFVPVIERNGGGHILNAHSALSWLADGTPYGASKAALWSQTNSLRLELQPRGIAVTGLHMAYVDTEMTSGVDAPKADPRDIAVAALDGIEAGAHEVLADDITRWVKSQLSADLEDMYAQLKH

SEQ ID NO: 7694 - protein, 189 aa, Streptomyces avermitilis
MTTEVKQSPRERLLEAAAALTYRDGVGIGVEALCKAAGVSKRSMYQLFESKDELLAASLKERSAAFVAKALPPADDGRSPRERILYVFERVESQAGAPDFQGCRYLAVQIELKDQAHPASRVAYQIKADLMAFFRSEAERGGASDPDLLARQLILVFDGASARAGIGADNLTGLIVPTLTTLLDAADMH

SEQ ID NO: 7695 - protein, 432 aa, Streptomyces avermitilis
MSGIHPFRVLRAKPLWIANGVITGVLALLFTVFYVGANIDPVDHMKNLPVGLVNADKGAAVGGEQVNLGARITESIKKSTASGGKIDWKVMDEKEMKEELGKGKLYGALVVPADFTSATTALTGAATTGVPTRPTLTVLTNQSAGSVGSSLARTATTQAAENASLQVGKELTPQGGTGQAKLPAAARVLLADPAAVAVEDGHPLDSHSGLGLTAFYYALVLVVVGMLSANVISGQVDHALGYTHNDMGPLRLHRPLIRATRVQTLAISSTLMAGLSLLMGTLVMVGAIGLMGMDAAHLPLLWLFSVCAIAVSGIGALTLLAVFGTPGMLVVTLVFIGMAVPTAGATTPLQALPGFYRFLAEFEPLRQITGGIRSILYYDAQADAGLTRGWVMMAVGLTAAALFGFGMTGWYDRKGLHRIPAETEPAKTAAPA

SEQ ID NO: 7696 - protein, 727 aa, Streptomyces avermitilis
MFEGFGRLLYRRRKPVLILTLLFAVLSGAYGAGVFGSLTPLGFQDPGSDSVRAAKIAEKAFPQRTPDAVIVYRDEDRTVDDPSFQQAVVQQLASLPKSEVTGYLDFWTTRMPTQVSHDRHATYVALNLHGSSEKAKEDAYEAVKDKIPAPGLQTLQGGTVPTGHQASEKIEHDLRIAEIISAPVLFLLLLVVFGGLTAAFLPLLVGVLSILGSMAVLRTIANITDVSVFSMSLVTILGLAVAIDYGLLIVSRYREELAAGYTGEAAIGRTLATAGRTVMVSGTTVAAALAGLTLFPSTFLKSMSYGGVAAVLLAVLFSLVALPALLAVMGPKVNAFPLRRKKAGRPTAAGEGAWYRFGHGLMRRRRVVVVGAAGLLLTLALPFSKIEFGSINAQQLRSSSEGRQVFDAMEHDFDGDAVKSIDSLLVLKSDGTSKDQGAALKAYAERLGATEGATSARITGVEGTTARVSVTYDGNPISPHARDLVNRLKDVPEPPGARAYFGGESAVYDDTLDALGETLPWMLLYIAVMTYLLLFLAFGSVLLPLKAIAMNMLSLTATFGVLVWIFQDGHLHNLLGFDPTGNIEPNMPIMLFALIFGLSMDYEVFLVSRMREQYDKSGDSTEAVASGLQSIGRLVVSAALLMCVPLAAIGMSDVLTIKLFGVGMVFAVLVDVLVVRILLGTAVMRLLGRAAWWAPGPLARFYDRFGIKETDMPADDTAGERVPVATG

SEQ ID NO: 7697 - protein, 249 aa, Streptomyces avermitilis
MQEDLVRKWRVLTWGAADDSKPRRYREAFVTALQYDGAMARLKTHDEALRLRLLHRAAATVFDRGTAALSLRQLAADVKTSTTAVYSLFGNKAGLLRSLYEEAARLFAARLAAIRPTDDPAGDVIRLGLVYREYAIANPHLYAILFSDRSVQCPSESEPERPREAIETYRPLVDAVRRGQQAGQFGSESDPEVIALSVWGTAHGLVSLVLSGNEPPGLAVADCYERALGVLVAGWRVSEGEVQGFADVP

SEQ ID NO: 7698 - protein, 117 aa, Streptomyces avermitilis
MTSKVYWTTAPRSMMKKFGQIMRDLGADREEPGPSEAGEGPETGLPDQEITTWVDTTEFGSQKFDALAAHASQGQNIFFLRRSKERFTQLMSVETSVRVLDTTGAPPPENDLFAGLR

SEQ ID NO: 7699 - protein, 388 aa, Streptomyces avermitilis
MNRRTFLAATTASLAATQLAGPAYAYAYSSSPSGSTAVHYAVVARFWGAMPTGVTVSRRGRIFVNFPRWGDDVPFTVAELRGGKPVAYPDAEVNRQDASDLAGHFQSVQSVVVDGADRLWILDTGSPGFAGSSYGGPKLVAVDLRTDRIVRKILFPPEVVPANSYLNDVRFDLRRGAEGTAFITDSGGSNGIVVVDLATGRSWRRLTGHPSALPDERFLPVIDGEPFMVRPAGGEPTYYETGSDGIALSADGTRLYYCPLSSRRLHSVSTDALANPDATDAEVAATVEDLGFKPMADGLESDDKGRLYGGDLEHNAIWRRSPNGTYRTLAQGRDLLWVDTLSVASDRHLYAIANQLNRLSPFHEGKDLRRKPYLLVRLPIDAGPVRLV

SEQ ID NO: 7700 - protein, 172 aa, Streptomyces avermitilis
VSETLDSAATTIARWRSAEERGDVDAAVACLSPDVVLSSPLTDQFRFEGSDQLRDFLTSAFAAVKDVHYHTQTGEGDTYALVYRARVGSQSFEEVQMLRLDNQARITEITLFGRPMPALTALMHLMGPALARQQGRRGLATLMSVSTVPIHAMVSSGDRSMVAKTRPAARQP

SEQ ID NO: 7701 - protein, 270 aa, Streptomyces avermitilis
MTTNRPVALVTGASSGIGKQTALALVAAGFEVAGTGRDTSRVTPLQGVTFFDLDVVSDKLVTAVVQQVIERFGRIDVLVNNAGVGSIGAVEETSLAQAQGVFDINVFGVMRMVKEVLPHMRARGRGRIINLSSVQGFIPAPYMAVYGASKHAIEGYSQSLDHEVRQYGVRSLLVEPAYTNTGFEANSAKPDSPLQTYADQRHVFDRLMTEAIKAGDDPAVVAKAIVTAATDTKPKLRYAAGPMAGRARMLRFVPAWVLDKQIRSMNKLTG

SEQ ID NO: 7702 - protein, 213 aa, Streptomyces avermitilis
MTGTQTAGRRYGGRDAAQRQQERRTRLIQAGLDLFGTAGYASASVKQVCSHAGLTERYFYESFRDREDLLAGVYDELITTIIAETAQAAAAAAPDVDAQLRAGLEVFIRTLAGDARKARLVLIEVVGASPRLEVRRRDVLHEFAAMVAAVVGPLSDPEASSSRLAMTAMSLVGGVNELLVDWTLGHQKATVEELIDLCHTLYIAAYRAISDQL

SEQ ID NO: 7703 - protein, 303 aa, Streptomyces avermitilis
VAAPPKHPNTSSRRDHDKLARTQPLTGRVIAVTGAGRGIGRAVAARLAAAGAAVAIGDLDTRLATEAAGALSTRPGGRLLGLPLDVTDTPSFEDFLRTVETRLGPIDVLINNAGIMWVGPFAEEPEEAALRQFDVNVHGVLRGMKLVIPGMRKRGRGHVVNIASAASKVAPAGEATYAATKHALHGYSTAVRAELRGTGVHMSLVMPGVVDTELAVGTATGPTRRLTTDQVADAVLDVVLRPRFEVFVPRQVAALTRLAALLPGRARDALHHLLVPNQLAALSDRSVRAAYEQRTRTARHPES

SEQ ID NO: 7704 - protein, 378 aa, Streptomyces avermitilis
VTTTPKPAPSAKKAQDAAAPRPIPEFEGVHDVWPRGDRLSAVRSAAATYRERFVQQGRIHAVRSFDIAAAPYPTRFGFHGAALAVNPFVSIVNRMLVVQFDGFDGEPKTLVWEPTVAAGTAQAPFYAQLKRLAGDFLTEHVFARFYQDPNTVLPSCGLRPEDVDFVSFDHLHVQDVRMIMGSTRTIPGERAPREALFPRARLLVHRRELGTFESTHPMQWAWYVDGGMDGVPPERVTAFDGDVELGVGVSLLWTPGHTDGNHSLVLNTPDGVWVSSENGISADNWQPELSRIPGVRRHAAFYGHEVVPNANTLEDSLNQYDSMVKEKTLADPSRRDPRWLQILPSSELAPFKRHWPVRPSFLHGGLNYGELTPAGGRR

SEQ ID NO: 7705 - protein, 307 aa, Streptomyces avermitilis
MTGPAARRIAADGVELAAYQWGTSTAPAVVLVHGYPDTSAVWHPVADRLADHFHVTAFDVRGAGASHRPRGLRAYRMSRMEADLEAVLDAVSPDRPVHLVGHDWGSIHSWESVTGTRLAGRIASFTSISGPCLDHVGHLIRARLRPRHPDLPKVLRQAARSWYIAYFHLPLLPALTWRALGHRWRAFLTGSQGVPGHTPYPAPTLARDAVSGTALYRANMLPRLLRPRDRPTTVPVQLIIPTRDFCVTPVLSYGVEHWTGQIQRRPIDAGHWAQLSHPEEVASRIAEFAHRIEDGSRRTPDRTAHPI

SEQ ID NO: 7706 - protein, 303 aa, Streptomyces avermitilis
MFRAAHAHPERPSEPIDHHDLVLQPRDVTFDWSTTPLHWLPGEPFATHTFDVLHLMLPELERWFVRTFEQALPLITDDRLREDVRGFIGQEAMHAEAHQEVLEHLLAKGLDPAPYTRQSEWIFRRVLGDRPELTPAATHAHLLQRLALIAAFEHFTAYMGHWILSNGHLDRAGADPAMLDLFRWHGAEEVEHRSVAFDLLVHLDPRYRRRVTGMLVTAPVLTRLWIRGVRFLMSADPELDDRVEVRFRDYLAAARKDLLPPPVSFARSVLRYFRPGYHPTQEGSTQQAVAYLATSPAARAAAQ

SEQ ID NO: 7707 - protein, 366 aa, Streptomyces avermitilis
MDTSTPLTRPPDLYGRPRSDSFMQKLAALSDHAVTRLARRSTPPRHPQAAETPAIRELVVATKHQEAEDVVSLRLAAPDGGILPPWQPGAHIELHLPSGRKRQYSLCGDPADRHRYRIAVRRIANGQGGSAEVHDALSDGMRVAITGPRNAFPFAAEASILLIAGGIGITPILPMAREAARRGLDWRLVHTGRSRGSMPFAAELAELTAAAPGRVTIRPDDESGAPEAADLLSLSPATGAVYCCGPAPMIDGVRRAFGDSRASALHFERFAPAPITDGRPFELQLGETGRVLPVPYDRSALDVLHDALPDLPFSCRQGFCGTCRVQVAHGHVDHRDRRLTATERAAGAMLPCVSRAPEGERLVLEL

SEQ ID NO: 7708 - protein, 804 aa, Streptomyces avermitilis
VTQPDRILSDPCGTIVDMVARVEPDLTVEQIRDAVKQAAPSRTARRSLAKTLTADPALLTSRRPEGSRSVERLIHKLLAHGARQVAVPLCAGCGKPEPLPQRRGKLRVCAYCDATARAQQQPCADCGLPRVIRYTGRNGEGLCSSCQPKDNIDWAQRICDHIATVDPTVPAETVRQIITTITRGRPHYVRRLAWDLEDRPGMLTGNAGHGTPKVIALIDALRDAGAQAIVRPPCPHCGRTSVTLRNTLGDVRVCPTCYNTRKAVNCSRCKRRSPVARRSPDGQSICNHCDRTDPINHEECSGCGRLRPIIRRNSPTGPLCDTCYRPPVAICLLCGHARPCFGVAGGMPRCENCTRLREPCLDCGRTMPVKARTANGPLCETCFKKNPVSFKACTRCGTVERLRHHGLCHRCACNEELTALLAGPDGAVAAPLMQLHSTLMASNHVRVLDWLQKRNTAVSVLREIATAECSLDHESLDARTDKAVEHLRAILVAAGALPRRDEQLVAAERWIAAAVAAIADLSDRHTIQAFATWTHLTRLRKYSRRKPITAGQAVSARRSVKAAVGFLAWLRAEGLNLEAVGQRDLDRWLEGGPTTRQYARDLVLWAVRTKRATNISIPARLKNSPTQALDEDERREIAHRLLGDDQLDARDRVAGLLSLLYAQPFSVIIRLTADHVVVREKSVLLRLGKEPLELSPELGNLIQQIAADRRRDGQIGQIDAHWLFPGIRPGQHLSHITLAARLKRLGIRSLPSRTAAIRDLTAEVPAAVVNRLLGLSTSTATSWAKRTAKTSYAAEIARRSDSDK

SEQ ID NO: 7709 - protein, 112 aa, Streptomyces avermitilis
MTAKLDYRWKLREVMATRGMFSTISLQPLLAERGIDLSSSQVYRLVTERPERLSLKVLMALLDILDCSMDDLIEPVASASSAAKPKRAVGDADTSVGSFRPKRARIVPRSEP

SEQ ID NO: 7710 - protein, 380 aa, Streptomyces avermitilis
VARDVEAPIGSARLELVEGVRLLHPADAVLEAMLTGWGRQQRGGRHLQEKTVSDRIATIRRFVKFADAFPWTWGAADMDEWTTHLVAEKHLQPSTIRATQGAVRMFCDYLLDPRYDWAVECERRFGTHPIQVCHEWNTLDHLLDYEGDPDRRPMTRGELQQLFDHIDERVDLAIRRGRKGALTAYRDATLFKVIYGWGLRRTETARLDTFDWYRNPKAKEFGRFGMLEVRYGKSSRGQPPKRRSVCSTMPWAVEAVEDYTTNIRPRFKGHDRSKALWLSERGTRLSAKEIDERFSVYRKALKLDEDLVPHCLRHSYVTHSIEDGADPVFIQQQVGHEYASTTALYTGVSGDFANTMMRKAIDSALQRDLQDFGPGGRSRR

SEQ ID NO: 7711 - protein, 195 aa, Streptomyces avermitilis
MLYLATPSGADVRAAMQAGLLACMTTPAQGNVIPPGALYACDNGKFGKGWPGEQAWFAWLTATVNRYSRGRCLWAVAPDVPMDAAATLAESLPWLEPIRALGIPAAFAAQDGSEHGLIPWDSIDVLFLAGSTEWKTSPAAHRLAVEARKRGLAVHMGRVNSRRRLRIAQAFGCTSCDGTYLAFGPDTNLPASWPG

SEQ ID NO: 7712 - protein, 172 aa, Streptomyces avermitilis
MTTRLRHIGAAIMGILDPIPSTVPSPMREEEGAWVRAHAWTKGLRKIEDAYPCGFHRWCSCERGICPGCASGHHDRCVSAGGPRVDEHADTITDAQGFVVAVIRFRPGQRPCRWICPCPHPTAVEETAETGKPEKPPAAQHAVPAQRPAVAPEGQLPLFASGPQEHGDGEAP

SEQ ID NO: 7713 - protein, 335 aa, Streptomyces avermitilis
VRFPVQETLPFEDLPEVPTASPWCQRWREGRHSWAHVRDGGFDARRYTVDVIPDEEPAKGFVLAHHYSGSYPAVTVQFGLYDVVDGERRLCGVAVFGVPVSTAVLTKPLPELRPYTESLVCSRFVLLDECPANSESWFLANCLKRLLARGVHGVVSFADPVPRRTASGLLVMPGHVGTIYAATNAVYASRATARTVSQQRLDELCAEVEQIAELLVARPEAAGEAIEAFNAMTGHDYVALDFAEYYGSRSLEEFAKEAARPARPVVADINRDELVEIVRRLLTASAESGYYLRLLEANVSHPRVSDLVFHPSDILQDPSAEQIVDEALKYRPIAL

SEQ ID NO: 7714 - protein, 159 aa, Streptomyces avermitilis
MKIRRILTWLAATAATTALILFGASPASATVYWQTYSTNSNWHCGPTTKTPLSNYVVFQTCIVVTPDKTKGQAVLIVTNSSTKDVILRQGEVHSDELYGVNGYSTCTYDYTLSSGQSRACFGPTVAFSTCGDGYAWGVLHANSFDYAMGTETVRFVTTC

SEQ ID NO: 7715 - protein, 76 aa, Streptomyces avermitilis
MSRAKWVRTRCRHGSGSSPSAQRPVRCPVYVAGGCGHVVRAGAAACGPGRLPSTVRAPSRYRILCPYVRVRPAETP

SEQ ID NO: 7716 - protein, 205 aa, Streptomyces avermitilis
VYQAFTPQVRALRKETDGPLMFANVLGMRAEESPDRRNREMWRRTTDNSARIVDEWLPAHQVSTEEVWERTISAGLPYHWCYDSYPGAKDRGGSSRCSCSACTLANHRDLLLTAGRRPRMAELCALVERVRQVPFNPNITMAELIALSRRRDAPDPGVLVEETEDFERMERDVHAALRKPPTWDSKARTGPGEILHSAAGCDGCH

SEQ ID NO: 7717 - protein, 118 aa, Streptomyces avermitilis
MTMTTTQRILDLAAAAPASHGEDLVLLLAEANELYQQGLQELHREMASRLGGLATEDLMFAAETAGMPCDASQDRDEVILLLALVEWEMTPAAIAYAEMAEDAARRGVCLVPEEGREP

SEQ ID NO: 7718 - protein, 238 aa, Streptomyces avermitilis
MTSRREPRLADAAEIAAEQGLTPSRISQFYTERAENAAGRTFPDPVDKRGRARLWNHAEVTEWFADRAPSRLAEHAPPSLPPGTLLNAAEASRYLGYKNSSQVTTFVRDHPGYFPEPDVVEEKGTAANPYRRQLWKVETLQAWMATRPGRGRRAGAKEAPPLPDVPVDGDPEELLGASQAAALLGYKTVGSFSSSLSQGNLPLLKTTDGVAENAGRQNGRRRWTRRRILEQAAQRSKK

SEQ ID NO: 7719 - protein, 304 aa, Streptomyces avermitilis
MNSAAQSIPATAMAPTPAEPLTHQVLAGLAQHRIATTSQMRRMLRPDGTRQLMSRVLNRLRSDGFVDCTVLPDANRTRTNAWYLTQEGARLTRDLPVLRGRPPYPISSMTAASLKTPHTLAVVRAHLAFAADARRLGHEHGPWDWTPEVSHSIGEGERIVADAVMYYTVVESEHRRKLRAFVEVDRSTMSSERLAVKLIEYARLFQYEAQPVGRRRQASVGPAWLRWYPVFPRVLFVLTGASRVRLENRMSDLQAMVAQHPLVAGLAREVRLGAAVLEDLEQHGPAQDVWMPLVGGNSRPWTDL

SEQ ID NO: 7720 - protein, 318 aa, Streptomyces avermitilis
LNGVRGGQHPSWRSASSQFTPTPGAIHGEAHREEGQQQTSTAVRRPATEGLARPRRHPRAARHSSGRGHRRRAARHGRGPAHPGLRSSIEQGTAGAALLDGLDGTTKTFFEDFARRTIGHPRADSMASVSLTLVAANEQDQPIGALSVTAPGTIIERALEYGYSNVQAVILSVAIGKVHGLAVAEQARGQGLASFLLKRAWQVYDQLGYFLLHGSLETERDLGAFYKGCVYTVYAPGEGFACSPAGGLPAERPPAVHLTGPSTGANYLRPEASTRLGRDRAAPGLQARRLPAGPPERDPPRVGAEPPSPADRSSDSPA

SEQ ID NO: 7721 - protein, 475 aa, Streptomyces avermitilis
VTDTRRRPTPSGFTQHLHPFPADLGRWEAEHARALRTGHVRDHTCTAECEPVLVYERTRWGWLAWTIPGDGSQPELPHQIGVLTPSATPTQRLALRWLTRRPGRRISLAPGTPGSLRVVTVAVALFSLLAGLFAMADGIPADVALPAIVLAPLLAEHLPTTLDARAREHVRSVEGASACCYLQRLAALHTYLVQAAAVSDRYELRRSAQISQHLLWDAADLLQTQDTRSASCELIARERLMLQLTHQVAQVLRYPSARSAPADADQAREPERPPRPYRQAPQHTPGTSPPKGTPLMPQSNPAARTSDIYLLFAHEPYYPGPGTLEINTTVVAADTLLHPWILQPDGTRIHDLLTQGRQPREVIPLATLTHELNGGADWPTVGDWERVTADLVQLVQTQRCDALSLGLPAVARALICTGPENQVRAFNAAAGDFTVYGPDDRTKVLTEVGMFLTGVAAEQPFWPGDGLLPPLCQSA

SEQ ID NO: 7722 - protein, 473 aa, Streptomyces avermitilis
MTRFGAGIRRGVMAADQFTQIANGLFRDSRLSFKAKGICGYISTHVTGWHVTVADLVRVGPDGRDAVRAGLSELQRHGYLIREQLRHDDGTLGDIVYSITDHPAIADAALAQTAGTAFVSAPQAGAGFGAGVRRGVMAADQFTQIANGLFRDARLSFKAKGVFGYISTHRDGWRMSVTDLARRGRDGEAAVKSGLKELEKHRFLLRERERHPDGTLGAAAYFITDLPSLQNTSSQPLSGFPPVDNPTSVNRPTKNTNRKNTTKQKTNPLRPCDRGDAARTNARTVPSHATTSPKPPTPADEMHAGIRLLLDIGASRPELLLTGPALTDQGRVATVMLEAGWSAEQLRHVITSRPLPNLVRTSIGAIIAARLRAAQAYPPPATAARPGAAPLDEPFAEATRERSSTAAAARSVTQALTYRALVECAGCGVPATAPGDDLCPTCLGWPLCRTCPGPTRKRAHPDGDGRCTTCASA

SEQ ID NO: 7723 - protein, 312 aa, Streptomyces avermitilis
LTMSPGKQAAESGAAPAMAAGVELEKMRRRVRVSRLALFTAIAAGPVALGVAVMSGPTTVVAAPLDKPTAVRSAVASDPAGYAQLFVDAWLRSSADDANSAQARLAQSLAPDVDLPDPVAGAQPKPAAVTAVRSAQREDGEWAVTVAAQYADGRVRYFVVPVAADASGSSFAVTGAPGVVAGPARAAVSQSLFGVSVPSGGDLASAVGEFFGAYLTGAGEVDRYLAPGVKLSPVSPAPYTAVTVQEVWGAEEAVAAEEVPADGTKVRVRVQVEARDDAGRWPLAYDIDLKSRSGRWEVAALESGTGGGGGAR

SEQ ID NO: 7724 - protein, 106 aa, Streptomyces avermitilis
MLAGRLDETGDGWINMLESWATKGFKAGLMALVVIGMVQKFSLKAGLGALLLMVIALGLYDSRNDLADMFTDEVKNPSKGAPAVPGIVRGPDPLARVHSDGTGDGL

SEQ ID NO: 7725 - protein, 191 aa, Streptomyces avermitilis
VSAATMGRVGRFYTSARRHPWVLGKVADWKIPLGPYTPAQIAVAVGGGFLLVKTISWWSWMGPVPIVAWVLTVWAVRRPKIKGRAPLQAALGWVLLAWQPQGGRMGGRAARDRLSRPLFGGFTLEVAAPAVPVMATLRVDQPAADRKARRGPAVRPSARPRSAPQARPVSVGPVSGVQQLLALAEQAGGAR

SEQ ID NO: 7726 - protein, 893 aa, Streptomyces avermitilis
VRVPIRHIAGHLVWSTHGSVWALYRLHPGPDERGRREETVQGTYVPAAVRDEQLAKITHLIRSLSGAPRLFGLCAQVDPGEIALRMIEGIEPGETAADGGPHPWVENVEATLDLLGEQEMHRRTLWLAVPLQNEAAGGQMTASLGAMWADVAPMLGMRAAPVARREVSGYREQASRVEAALAGGVAFRPARPAEIVWMIQHTLHRGLEEPLLTEAETSDLYGGQLRAGMLQSPSYADLGQVRLQEGGVDLALDDVEGLSGGDRIGRSGRKAWWRLKTSSPLRRRWLQVESDAGVGYQAQLALAECPPAVSQDAADLFAQLETLDFPVDYTVDLTLVPAEKARDQVRRKKNELVDQADQYDARPTGMPASLTDAARDLGELDARLSRTSVEVEVQSVTVLTVWGPTAAVCDARARALAALLGGADYRAVRPAGLQEALFTLGLPGTARPGVVREFTQHQVSEDWALGGAFTAAEVGDPNGMFLGIDLDCGTTRPVMINVADAPKQDASASMGIVGDLGAGKSVLEKLISESVWARGGVAICIDRTPVREWATFARTAAAGRCQIIDAAQAEVSIDPLRMFDGPEGRHYALSYLTLQLGIGPMSTNGEVLHHAVERAAAGDAPSMHRVLQVLDEMAGAQAGKRQDAAATLAGLIRVVASNPLAAMVFDPALPPVRLDASGASDMIVITTTGLKLPPKAAFDKPEVLHQQPLEALIGRAVLYLIAAIARQTAFEDPERFTAVVLDELYWLTSSAEGTALVHEILHDGRKHGAGLLAGSHDAEELGPDRGLMAYRALARTADRERARRGLEFLGLDPHDPELLRLVTTGLSPVGQRGREGEFLIACPRQNTGRIKVVIPRIERISSSITTTPGRRTTAPGSAPLAGAATGDRPKELR

SEQ ID NO: 7727 - protein, 116 aa, Streptomyces avermitilis
MTSFAPSRSRRLAAAASALTVIAVAVGVLVLALGVSLPEAWWPRTGQAFAADAAKAPADPCDRIAGPAKAYCERGRHATSAQAGGDAAAWKLLSAATAIGALVIWRRRAHTRQGRA

SEQ ID NO: 7728 - protein, 910 aa, Streptomyces avermitilis
MFRPDRGTLRSVGFVLLVTGVFVMVNSQVVYAASSNSETGDLLTPLNITSSEGVPINGYELNAEGGSIVAFKTQALAFALSGLFTLIRMLVGLAGWAIEVAFRFPLLKILSRPAQKAADTYDNVVVDTLGLKGLLLAWAFVFAGFMIVRGRVGRGLGEIFLTLLIAAFAASAFVRPDTLLAQDGPLGQSQQVAAEVAQQSVNSYDWGGKLASKGPCEGMAGSAEITCLEREGEGPVSAAEVARPIQDSITNALIVKPYMLLQYGRILDPAKPADRRAYAVHLMWVTGGYKAGAKKDNEDKKDACAKIKGEAKKYCERDTDVVPGNNGSGTLPELTPGGELLDASHAIVTDEDREFYAFLQDMKKTGDVGKSCAAYAEKPTWWRVGGAALLLIATLFICGMLLSSAIVLLGTQGICAAAAAAGGVTFIAGMLPGPARQSVWKWLSIWGISALTVVGVCAFVPFFGIAVDATITNGPDLMVERILLIDVLAIAGTAGHRRLLTGITSFGRRMAMRMRYAKVGGTHMPGDTSELGAALAMNSPAALGGYGGGLRAFTGGGGGRFGLLGTRQRLMGALTSLFDGAGMPVDTGRVLADAGAEAGRGLAPLTAAAAVSGAGARLGAKGTHWLLIGRRPDKEQLAKWRKPTADGDPDAGGPDGGPDGGSGGGGPRRPGGPPDRYRDEDGQVVDRRTGQVLHDQNTDRTLLSTRAHNRLVRLRGYRILNRGGRAAYGTTVGLPANVRRARSGKSQYLLDARQQVQVWGNTVREDGRAWADTGRHVSRVLREHTDDSGGPGPFVTRRLPARPAPAPRPTGSSSSPARTRQASPRASASASPASVSTRPSAPPTSPPRLGSGAPRAAAGGRPGRTAPPGDGGAEGSASTGNRARMQELMRQAEALREMRARWQVEDGEDG

SEQ ID NO: 7729 - protein, 383 aa, Streptomyces avermitilis
VRTARRRKTQWGCVVVLLLFAAVCCAAPAGNAISAYVALKTGASADGGVAEGGTAADIPPRMLTAYKKAVQQVGKHVPKCQGMRWPILAGIAKVESNHAVGRNIADNGDIRPRIYGVLLNGSGAGGNTTAFPDTDGGKWDGTASGERAVGPFQFLPSTWEGIGEDANGDKTADPHNADDAALGAAAYLCGNGRDLTKRAQLKAAILQYNHSNEYVSNVLGWIDQYTAAAKDPDLKNVTGKVRTVIEAALSQRGVPYSWGGGNASGRSYGICCSPSGKSGASIKGFDCSGLTLYAYAKAGIQLPRTAAAQAGVGQRIPTSLGSDALNAGDLVFYADAPGHDSTIYHVGIYVGSGQMVNAARPGTVVRLDAVNAMSGYAGGARLL

SEQ ID NO: 7730 - protein, 215 aa, Streptomyces avermitilis
VTTSPARSPRLLLIATGVLVVAGVILLTVPHTQSAPSASAPPRAAAPTSHPSASASGGRTGQASGLAPAPASTASAQSASASALPPHGEGTAGDAVIHKSLEDAWPADLAADEERKLLAAGRGLLRADATGIGRAKWPAIFGDPDQAVAPAFATARFRIQAAIARRDGSPNKAVVHLVWAGTDRGGTYTDRRITDRYFTRTSTKGASTWTPQPRT

SEQ ID NO: 7731 - protein, 852 aa, Streptomyces avermitilis
MFTGIIHTVGWVIAYWYVPVAAAIVIWAVSETAVRRLARKASAERMALELVPSRHFDPGLEEIFRRGVQLARASTSMPWWAPRRTKAVQIRLRADGSSPLRYRIEGPAGGERLLSITPFGPGVTVNRARPLVDKPREHVVRAEFILRGKPTAPLREVPLDPDPLQPLIDAVCDLRAELGDLAEIRLDIQRAPKWALRARRVQLMSDARRRERREAQRAARWVRQDATGIEDSLAWQLQQLVSRKQDGGGRRLVMPPVPRRVDPQDALGKLAGDDHLVRVQLLVMCASNTEGRAEARLAQLQAAFDVFGGGSRWAMRGWRVGPWRFGADRWPSRRGFERRWRLGHCQPPRPNWVRLEELLGLLKPPTVHCRLPLLAADLPTFEFGNPELLLQGIYRSPDGRRRLIASYAKETLFEVGVGKAGGGKTERALAQAIGWAHAGGGLLFVDPHRDSWPRALPFLAHDALMQRIALIDLNAHGTSPHVSCWNPLGMHQGQTAHEVVEATADAFASALGWDDASAPRALTILTAALAVLVAVNETACQAGRPEDQATVFHLRALLTDPLFRAAALAGVEGRLEEETRSWWQTVFPTLPADSFAVVLNPIARLAANPVTRAFLGQPAGVYNIRGAMDSKMIVWVCPGGNGPTDRLITALLARDLLRAVRSRRDTPEGQRVPFRPYFDELITLTGAAPETIASMFEDFRKYKVHVHGMTQLLARLPNPVRLSLVQNASTLASTAGSQSAIAPITAEWGDRPGPDIVAALDRFEHYMSLTVRGARVGPVPITGPHLDEVFADYARPRQAAALERSARAMAGAAPLDQLTALATNQLNRVGDFLAQHAPTTRPAARLQKKGYQ

SEQ ID NO: 7732 - protein, 304 aa, Streptomyces avermitilis
VTTAFETLSSGRTPSPVEPLPHQLLAVLGQHRMATTGQLHDLLRPDAARQTVSTPLNKLRRKGLVDYAVLPQSNRSRAWYLTGEGARLVRDFPALRGRPPYPITSATAASLKTPHTLTVVRTHLAFVTDARRRGDEHGHLDWTPEVSHPLSDGEKIITDAVMHYTLIGDDQRTKLRAFVEVDRTTMSSERLASKLIEYARLWSYEPQPASRSRARQPAVPGAVWLRWYPVFPRVLFALTGASRYVLDNRISDLQAMVAQHPLVGTLARQVPMGAAVLEDLEDKGPTRNVWVPLAGGKPRPWTEL

SEQ ID NO: 7733 - protein, 286 aa, Streptomyces avermitilis
VDGHGVDRERSSLLTRRLSLLIGALVLAAAGTAHADDDPDVGAGKCQVIKFCVGVGVDDETGGKGTQTGSQGSSGSKTQCKLTKVNPKPPANHPVWNGADPKKSDLYFRACTDGGDGFVVVPQGQPAPQVDPQELAQRAVDSMTLLGPDIASPRGAGKYTVGVPTWMWVNQSATTFGPNTASASAGGITVTATAKVSKIVWQMGDGASVTCNGPGTPYQASEGMAQSPNCGHVYSKSSAGARSGKYPVTATSTWTIDWQGGGAAGQLTEIRQTNVQVAIGELQVVR

SEQ ID NO: 7734 - protein, 234 aa, Streptomyces avermitilis
LSKSQERLAASPNGVPQQGRVSGAVAPPRVSARRRRPGVIALSLALIAAGGAGVAVLLLQVGHRTEVVTVARDVQVGQVLSEEDLGKASIALDPAVKAVRAGDLDSVVGKRAAVELRPGSLLAPSQVTEDSLVKAGEQLVPIGLKSEQVPATALVPGQKVELVHVPAQGVEDTGKSSGLSPRTIAGRVVKASGAAPGSGVVVVDVATSADDGPIAAAWVSAGTLRLVLAAPDGS

SEQ ID NO: 7735 - protein, 275 aa, Streptomyces avermitilis
MAVIALAGCSGAPGVTTSALALLLSWPLEQGRKMILAECDPDGGAVLHGLLQGTLGDRYGLRNLSVAARKGESGDAFWRQLIDLSSDDGKQESPRDRLLLPGITDPAQAASLVSVWKALAVAFRGIDASQGHDILIDLGRTGAFGPSAVLAEQADAVVVVVRNTLRSLQSAQARVAVLEKRVGDVGLIVINEGPYPAGEVQRVLQVPVVATLPYAPKDAQVLSDGADQPRHFTKSALMKASRTCSALLVQRAAARRARLDPRAAFVGGGEVTRAR

SEQ ID NO: 7736 - protein, 497 aa, Streptomyces avermitilis
VRGKPLHPDPTVAPPPGRPQPAWPHQANGTAAGAASSTHALGTATPQVTVDYQVARHIAGQVAKQREELLKAKPDMDRASEQQRCLDWINEAVALWSDSAAMAPQEDEALRRAVYDLLFRAGRLQPYLDDERVEDIIIQGPDEVWLDYGDGERRMVGPIAESEDELLELLRELARSSGHNERTISTANPTLALSLQDGSRLQAITGLGPMTYAVIRRHRVSHAGLDDLVRLGTIDPILRDFLGACVRAEKNIMIAGKQKAGKTTLLRAMLKEFGPECRFATIQTEDELFAHANGYHRQVVSLVGRESNGEKDVTGRGAGEVTLLDLMHPALRMSLERIVVGEVRGPEVVAMMQALTNGSGGNLCTIHARRPDIIFDRIAELYALAQDNLSEQLAYRQTANGLDFIVYVDMTDETQIGGRRHRYVSHVLELTGIGENGRPATNTVFSPGAEFGELRAVPRMDPGCVDDLRRVGFDSAQLQQPYGAWQAPLQLKVGVIR

SEQ ID NO: 7737 - protein, 309 aa, Streptomyces avermitilis
MTLLWGLLSGMAVIGGLIGVVAGLVGTTAPRRAPLQQRWQALRAGKDQGEDVRLRRRTLAALAVVVFVAVWLVSGNFVGGALLGVAVVGVPWLISPAQMAQERIGQLEALSEWTQRLAGLLRLGMGLEQAMITSRQGAPDELAPQIVNLSDRLRLGWRPDGALRAFAEELNDVTADKVVAALILSVNDRGPGLAQALEDLAGTVRDEVAKKRAIEADRAKPRTTVRWMTVITVGVVVAGFFVPSYTKPYSTLLGQLVLAFLTVGFIGVLALMRQLGAFRRIPRFLITDPSSTVRLPLAGDGAGRAGRWP

SEQ ID NO: 7738 - protein, 294 aa, Streptomyces avermitilis
VNLFPVVLTGGAVGAGLALLVRELLRPQAALGPALQRSAPATLTMPEPELDREEVWGRWLLARLERLPGVRIPTINLALLGQGRGQFMLRKTTLAALGLLCPVIATIPWIIAGVSLPFYVPAGVGLLIAGLLFITPDLAVRDQAKRAREEFAHALSAYLDLVALKRAADAGPAEALEKAAEVGLGWPFLFLQGALRRARMEKIPPYQALTELAAEYDLPVLDDVADIMRGSATDGAAVYKALRARTAALNSELLADQAAEANAASEKMTAPGALLAVLVMLLMAFPAVIRMLTV

SEQ ID NO: 7739 - protein, 71 aa, Streptomyces avermitilis
MKHTAARTYRAVHWATTRLQEGLEEAKRRPDRGDISTTTVIIWVAAVTGAVLIAGTIAVVISKYNGKLTGL

SEQ ID NO: 7740 - protein, 142 aa, Streptomyces avermitilis
VMSPPARLKDWWQGRRWGDDRGDTSIQMAIIFPFVLIATVAVIQVSMWYYARQIALTAAREGLTAARAYESGPADGAAQAREVLGRVAGDSLRGYSVSASSNGQRVRVQVSGTAMSMIPGVPGLQVTQSASGPVERWTVPGR

SEQ ID NO: 7741 - protein, 153 aa, Streptomyces avermitilis
VNYVRYMARWARRLRSDEGSAAIEAAIILPSLIMFLWLAIAGGRLVTSGSKIDAAAEDAAREASIHRTAGAAQSAAHAAAAESLNDQGITCASTSVSVNTGGLSVPVGQVGTVTVTVTCTVDLSDLLLPGVPGARTLTSTATSVVDQYRQRGD

SEQ ID NO: 7742 - protein, 150 aa, Streptomyces avermitilis
MSFRQTGLSRARWDDRGGVTVFVAVCVLALIGIIGVAVDGGSKMRATERADYIAGEAARAGGQAIDPAEAISGTAIVVDLQDAQAAAQAYLRSAGATGTVSVSGDGKTLNVNVTGSYDTKFLSVVGIGSLSVTGQGKATLLHGVTAPEGN

SEQ ID NO: 7743 - protein, 1155 aa, Streptomyces avermitilis
MRTTHSPATAAGRTLGRVLKAVLSLLVLAAAVAGLPLLLAWVTPAIWASSHDDLTHLLDRQDTGAAFLLLLVAVGWIGWAQFAFCAVRELIAQVGGRSWQAPRRLGASQRAAALLVGSILVLLPTSSALASDAHASPATTEARVPGQAPAPQTAEPDQTLPDSASTPASRTSYTVRATRPAQSLWGIAERELGDGERWREIAALNEGRTMVDGQVFRAHGFLQPGWQLEMPDTAAAAGGIRTQLGRAAPTAEGKNEHVVTVHSGDYLSKIAEEELGDGGEWPRLFKASRGKTQPDGLPAISDPDVIYAGQQVTVPGAQPDPHTPPRDGDNGDEAGSQETTPPATQKPDGKQKPGDDRRDEQAPAPGTTTAPAPESSAPSTPASRPAEQPGQEQGSPSATASATPRPGTSPAPSAAAPSATAEAPGSADSSPATTASETPPPAPAPAPASSPLNLRTVLGAGTLLAAAITGALALRRTLQRRRRTPGEKIAIASETSPAEAKLAAAAEPGGAARLDVALRTLAHQVAHEKAADLPPIRAARIGTRTVEVLPEGLARKPQAPFVAGQAGWWVLPAEAVLLDEETAREVPAPYPGLVTIGSTESGDLLLLNLPQVAALLLDGNPVHITEVCTSLALELGMSPWASEAEIVTIGFGEDLPQLLPTSRIAHMRHARHALRDLSERLLEAHQMPETSHQPYLLLCASTLDADLAWQFADIIDKAQHVPVTLIAPASAAAASFPDAEILNASLSKPQQFDYIGSEITVQRLEHAAYLQITTALAISAQPADPAEGPWEEVPHEPDTPQRPRPLDLAKPTQSGDGEKPVPASPFTAGTGDSEIYPALLAASTDPASLKLLPDPKAPGKAPAEPGTEPAEMTPDGRAPQKAAEATGRPQETPAAEAVGEDTQAQDLHAPEIRVLGPVEVTGVATTGHGPSQARLAALLYFRPGRSADVLCADMDPVSPWSTATLNARLQGLRRALGNDPAGNAYVPRRRSGDDPYELSEAVRCDWARFTQLAQRALPQGTAGLPDLEKALGLIRGRPFGTRPLPWAEPYQQEMSTRIIDVAHTVATYRTPTGPHHDLTAARQAIATGLDVDDSAELLYRDWMRIEHAAGNRAGLHTAITRIQDINRKIDCSLENETEQLINDLLGPTGGRARGR

SEQ ID NO: 7744 - protein, 609 aa, Streptomyces avermitilis
MKSGADSGQQPVKTASQNQLLCLGRAQRLVISAVVLGGLTISGIGFAGSYTAVRALALKKGFGNFSYVFPIGIDAGICVLLAMDLLLTWIRIPFPLLRQTAWLLTAATIAYNGAAAWPDPLGTAMHAVIPILFVVAVEAARHAIGQIADITADKHMEGIRITRWLLSPLPTFLLWRRMKLWELRSYEQVIKLEQERLVYQARLHTRFGRAWRRKAPVESLMPLRLARYGVPLTQTAPTGLAAAGIEPVLLPPAPQPQPQAEPADTVGRGTGQVTAAALGNQPAAATGGEYIQALPTDENTRPATPPKAGDPSYPCDPSHAPRKQYERDRTAQQPAGKPNPTVVPDHDDSSQPEASDTPETPHHEEALDEEESRAREHSRLSPTYGYRLASAHGPLPSQYVLDHHEVTNPEGHPPSLEEPDTSLDSLLPQQPRDSRRDDGRSPEPAATSPVRGTRSEPGRTPRATPSAEHRAHSPEPALEETPDAEAGDSSLPDLTAVDHYYLAWNDFQQQHGKEPNGTELSAHLAQRGIHDRENHPIKPKTLTRYFLEFRIYDAWATHRARTSRTDSEPVLNDLAYQGITAQYNRPIQTTDLEKRLPGFERRWHALSCH

SEQ ID NO: 7745 - protein, 184 aa, Streptomyces avermitilis
VTVNVRHYGAADLDEIRETILDLHVEVRHRDFGLTGPFYDRDRFNERLSAYAARPGWSAALGYEDGQPVGFCFGTALAPDTKWWDSMKEPLPAETTHEDGHRTVSLNEIVVRKSWRGRSVAWQLHEAWLHGRTEERVTLLVNPAAGNGAVQARYEAWGYRSIGLQQPFPDSPVFAVMLRPTKLD

SEQ ID NO: 7746 - protein, 478 aa, Streptomyces avermitilis
VQRHRALDAQRRCSASLVNGRLRAGQRKKRRGPVGLGPEIFTFGGPESGVEDYRGAVTANVNLAAAMERSGLSQGELASRLNQRIEALTGKLGALSDRHVRHWLAGKTRWPHKRQRIVLEAEFGVSAEELGFIPPPRRTPALSEDDDVRRRAFTTATASLTAAALRPAHLSSGASRVGMVDANRLEENFARLVAADAATGLTVGLETRAVAHAQHALDLMAIGHASERVRRRLYFLAAAFMGTALWAALDRMETARAGRHLDRGLRLARLSGDAGMEMRMWGHAALLHLQQRQFPDALAAAQMGRETQVCRRDPLFRSLAAARLAGVQSGAGERAAAVRTLGQAEVAYERATPEQLRPAYMDFYDRAEFEGLAGLVMMRLGRNEESEAHLHRALSGLRPDYHRNRVYYTVLLATTQLRQGDADAACATALTKLPDDPDSLSGRTKALFARFDQDLTTEAAGAHFVTEWADRYSRGGIA

SEQ ID NO: 7747 - protein, 606 aa, Streptomyces avermitilis
MTSTALDALTSAIPRSVRTGHEVSIERDPASMPGHLTKADSVWPGRLRRIIRAGLKLWNQPALVETAELLTTELVTNAFRHGSGTDIGFRLLISGDHVVIEVRDGSPDRPVLRRASPEDEDGRGLALVSAMADEWGTTSDGTTTWCTLPLRKGSDHPMQRTATPVPSLREYPAIQLPGNPNTVTRARTIARSGLTVLDWQGDVHAATEVVAIRRTPQPATLLTEEAKGTVMDWRTRAMRLAGEVVRPESRWHEPVATVPRHEFVPRWWQSDGDAWLLRDGPAAPDAWLEAAYTDQTLVTRVDACPADHAAPGAMASGTPTSSSTLPSLVVRMYRHAMIAENSDVLVTTGTGYGTALACARLGHARVTSIDVDADLVKAASDRLVLVAGYRPQMAVGDITGELPGAYDRIIATVSVRPVPVSWLSALRPGGRLVTTIAGTGLILAADKTNEGGATGRIEWDRAGFMPTRHGADYGPPADDVWQEAAEADGEDVITSRYPLLYPPDAWDVMSMLELQIPGITYRRSMDGGNRTVWLLHPDGSWARATARGFLDSPTVHQGGPRRLWSDLDRIRNRLNREGALPVYGAQVTITPDGTTTLTRGSWSFTL

SEQ ID NO: 7748 - protein, 329 aa, Streptomyces avermitilis
MTRDDTPLITHLAGRDEELRLALEDLGLDRYLAAKRLLRATGTDWGLRTSRSQVLAVVAANSRAIESWCSEEPEDVDARMMWARVLTQRLLNAHRRGLSGQDLVNGVHTVWAACRAAAERWPEDPVPYVCYLALAQTDIDQRFPHSPVHWATPADAMLPPGPWRLLNWVNQRDPGSREAYHRMLQVFQARARGALDFAQWVASVAPEGSALKVLPLYAYVESYRLLRQRSQSVGVIAYWATEDKAHYARQALYGWFAHADPRSLSLLDLNYLAHGLTATGVGQATAVFEEIGNHVTPAPWIHVTPNPQWWQDDFRSARRRALTATSGRR

SEQ ID NO: 7749 - protein, 502 aa, Streptomyces avermitilis
LSARRTRVQLDDDAALRAHGYHPELARRMGGFGNFAISFSVICILAGGMTLFGYGLNTGGPAVMMWGWVGIGFMTLLLGMCLAEVTSAYPTSGGLYYMAHRLGGPRWAWVTGWLNLLGLLGAIAGIDYGCALFIGAFASLQWDLVPTPETTILIFAGILLLHGTLNALGVRLVNVLNSISVWWQISGVLLIGGTLTLAPAEHQSAGFVFGHFHNATGFTSPVYVAALGCLLAAYTFCGYDASSHLSEETSQAQVSAPKGIVRSIGYSWIAGFILLAGMLFAVQDYTGTQGSSTGVPPAQIFIDVLGTGVAKGLLMVVIVAQLFCGNAETAAASRMVFAFSRDGALPFSSTWRRVTHRTRTPIAAVWLSVGVALVLALPSLYSPAAYAAVTAINVIGITPAYVIPVYLRLRAGDRFQAGPWNLGGWSKPLGWISVTYVAVLTVVFCLPQASPVTAQSFNYAGLALAVVLLLAWAMWITKGKRHYKIPPLGSAAENTALAGEVM

SEQ ID NO: 7750 - protein, 306 aa, Streptomyces avermitilis
VMSGQISHHLSPTPAPGLVTLEELGHLVQGREIDTVMVAVPDLRGRLMGKNLDAHHFLTKLPGGPEMCAYILATDVDMNPLDGFELAGWHTGYGDLRVVPDLGTIRRLNYLPGTVLVHGNAVHPDGRPVAVAPREILRSQLRALAVHGLQARVGIESEFVLYKGTEAQLRRSGFRNPTPVSPDNLDYALDRPPALNAFFHDLHNALHEAGAPIEAIKTEGAPGQIEVAWPYGTPPWAHATPTPSTNTPSVTSPHNTASHPRSWPPRRPAPDPASTCTSPCGATTRRPSPCVHARSCPSYSSTPLPG

SEQ ID NO: 7751 - protein, 2386 aa, Streptomyces avermitilis
LGCDPCGMRATGVGVRVAARRTRFLSAGVAGAVLAGLLSTMSVVAPQQAFATADDPTPVVPSQSLGSVPAQQAEEVGKALPDPKWPNAAEATVDLSQAAPGDPGTVTPSPTTTGSENSTQVGDVVDVAPAPDPVGATTQLSAQRRADGDVSPSPSASSSTDASTSPSPEASTSSSPQPPDSVTSEPDQDPVSPDQVQVRVLDHQTVEPAGGIGLGLQVNRTDGVNAPGQVQVDVDYSGFQYAYGADFASRLRLVKLPACALQTPEAEGCTDREFVPVDNDTATGTLTATVTAAADTEVSGASTQLMREASASGASVYTLASGSSSDAGDYRASTLSPTGSWEVSTGSGAFTYNVPIQLPKPPMGSAPSLSLSYNSQSVDGRTSASNNQASWAGMGWDLNVGYIERRYRNCSEDGLPTIGDMCWDSPNSAKEPSGAVYVINLNGVTSELIQDNTGSGAYHLKNDPGWRVQRLFDGYGAGRDGEYWVISTQDGQRYYFGWGRSERTGTATASVFTEPVVGNDTGEPCHDQFPEPCTQAWRWSLDRAVDANEVETMYFYDKEYNHYRSVANSDKAREYVSSGYVKEIQYGWSSQIPDGKLPAKVELSHVNRCIERVQENDPLRDEPATCPTFDDKPTSYPDVPVDLMCDGTSADYNCAGKTYYPTFFSTDMLWDVKTYVSDQDGTGWDLVEQYQNKYGMPNPDGTIGKTLWLDYIQRKTYGDGDDIVLPVINFNRTDLDNKVGSAELNFPRIQEIHGDLGATTKVSYGFANACDIDHLPTQASNTQDCYWQKWTPEGETESKTGWFKKFLVTKVEVDPTVTTNQDGAPVMTTSYTYEGGAGWRFTGDPLVKDEDESWSDWRGYQETQVTTGADTGQKTKKYWLYRGLDGDRTSKTDTSATKTVTVNDGDGNNYADHAWLAGHTLSTSLRDDTDISHERTYHTYWSHNTAQYDGLPDAHFVRESKSTTNTKISGGWREHVVENEYDDSEAASTTFGLPMRTDDWGQSNVSDNRCTTYGRAYNTDNYDSTGAQRWTVVQDQVKHYSVGCSSIADSNQDGYTSTLYDNATSIDANKPVDGNATEVRTYTKAGRYRSSWTGYDKAGRIVWSEDGKHNRSTITYSPANTWPMNGITSTSPDPDGTATARGPLTFTEWTSRFWATPTTSKDANGNITKVTLDAAGRPVEVWKPTETGSSPSMKFSYTIPTSTNSAGVPDSADGYPHVASHTLQSGSTYLVSHAYTDGLGRARETQTPLPSDVDPATKQIVPFRQVAVTRYDSAGQVTGASAVFRNQGTAGSGGPSSPQPSDLPSYSDLVLDWAGRTVSSQIQVKGTPQKAGRVDTSYLGDYTSVTPVDSTATDTYTDVYGQVSKVVEHTASSAYTTAYGYTAKGELAQITDPRGNNTLYTYDWAAQRKTTDDPDAGLSSSEYNENGQVSQTTATTNDVQTVLTYGYDNLSRATSVRSGADELAAWVWDDPAATGGKGQITSAVSRDASGNTYTTKTGKFDERGRPLNTTVTLPTTVNGLAGDYTTSVTYDAADHITSVSYPAAGKLAAEKVTTTYDDYGQPTRLTSSLGGTAYIDNTTYDAYGRLVERDYGAEFGGNGIQAQRQYGYDDSNGTRWLRSIATTTTINDLVSEAQKDTYLYDNTGKLTELREQASGQTAQSQCLRYDDQSRLTLAYTHTTAGNCADTTKTTSDFKGTSPYQTGYTYDRLGNLQSVTDTNSAGAATTRDYLYPGYDDAGTWTTANADQPHGVRKINKVSAGTTTAAGTYTYYADGAMKQRVEGSTTTDYTWSRLGRLATVKTTKTSGSDLTRYTYDASGNLLVRTTPQETVASIGGTELRTTDGISATATRYYSFGATTVAMRTTDGNNTVNGKITYLMGDTQASTQIAVDAATGTATRRRYTPFGDERSGSLPTGTNHGFLGKTEDTNTGLSLLGARAYDPSLGRFLSPDPLSTPYDPQNLSAYSYSGNDPINYSDPSGLIKLNSDGTQCSDGWQKCGPGTVGGGGDTPTPAPTVQDQLVDLLPREENGWDADRLAQVWVHYGQTTQGGGYWDAPVGDGDRTGMACFGRTACSEAFRVWKETHDFAKAKRVAATFCVENPKRCGADNGAYDSMKEASEAVPILLAGEMGAAFSKVLKARGCSFKPTTRVLMKDGKTKPLGKIKPGDLVEAADPTSGHHREVREVTAVHLNHDDDLVDLSIRGLDGRIQTLHTTARHRIWDDTAQVWEQAGRLITGHKVNTSGNQHATITSVLAQRGAADMYDLTVEGLHTYYVLAGETPVLVHNGSCWSSTNRKTSVKNAFGHWKKHKSEFPNLNNAKEYVEAGTDFLRSTDPSVLTRTRANGDVIRFNPATDEFGVMDPSGVPRTYFKPDPASHGYPTNLDYFNAQ

SEQ ID NO: 7752 - protein, 81 aa, Streptomyces avermitilis
VHERVLTDVDPIQETHLSEPGLLVIDVAGMDDETVLAFQNAIAQTWATSTADRTTQDPGQPGVRLRLYADLRQVLAPTSPP

SEQ ID NO: 7753 - protein, 267 aa, Streptomyces avermitilis
VRSGRASAGREIVSMVGGQWRGVVERLAQQLGEAQAAGRRVKEAKATAARQSPSSTGLERAEYQRRLRAYVQTPEHKAAGHAIRVAVALMKAHDAALLRSAHTLLARRANGKRPPRRLPRPLVLPGGYASQWWISSIDSTYAGIWRAIPSPGPELRLGSTNDPLVQEVAKQARLLQASHVGYRGRDDLYEAFHPDGTREGGEPVAPIRGLSQETSRRANLALGRGNGIRIQPSRMEEAGQMHTDYFAVWDRSRAYAAAVLALLRARA

SEQ ID NO: 7754 - protein, 141 aa, Streptomyces avermitilis
MSLKKINTVLAAAFILFILWFGAEFILSPETTAPGFGLPSWPSGDGDGFLIIKGIRDVVLALVLGILLVTGHRRALGWALLVEALAAYGDMTAVLAHHGSVATALGVHCLTATLMVVNGLLIMRETRKVAAAPATPAPQPA

SEQ ID NO: 7755 - protein, 192 aa, Streptomyces avermitilis
MSVQERKQRERAERERLIVATARELAEQQGWDAVTTRRLAERIEYSQPVLYSHFRGKREIIGAVALEGAAEMAVAVRAAASSADGPRERVAALARAYLDFAARNPAVYDALFQLDGGLAYAQEDTPEPLKDAFAALLESLGEVAGNGVHPGLFTETFWAALHGLATLTRAGRLPPEDTEPRVELLVDRLAML

SEQ ID NO: 7756 - protein, 658 aa, Streptomyces avermitilis
MPGAETGDYRPLEDLARNKVNLTKVTTHCPEMLRVTGSLVTGQVRAYDLLRMFGREGRPTSLGQAFAEYGRIAKTLHLLRVVDPVDDTYRRQMNRQLTVQESRHKLARDICHGKRGQIMQAYRTGQEDQLGALGLVVLNAAVLWTTRYLDAAVDHLRALPPEEREHDVLNEDVARVSPLKHANLNCLGRYSSPPARHSRACAHCVTRRPSTSTRTMRAPANDAALGRVSGRDQGASQLPGRVPVWGTGPGDLRCAVWTRVTGSVAAGRQAGSGGGRGPRLRARRDGVSEHGEPVHQQLHPRLGVLRRQPSRPGQGRQAVQGRPERLGEQPRVDAVPGDLAEALQQRGEGVLERFRGVLLRVRQAAVELEQGVVDRRVACGEVEVGTGEGGDPLARAVRAGGRGPHRHGHLGSALQGDGADDLALAAEVAVEDGLAVLDALGEPAGGDRVPALLLGEFAGRRHDEALALRPFALLAFLYRHDSILALLDNQAAAVLALPHQLATLDARGVIMFNALEVVTTVIIGVMVGVEFSVAFVMNPILNALPEDSGQLGHAHGGRMLGAVMPVWYIGSLVLVAVWAIAGWRHHGTGLVVTAGALLMLSVIMSILLLVPINNRNKTWTPDNRPADWKQQMNRWERFHYVRVAVIIAAFALLVAALT

SEQ ID NO: 7757 - protein, 74 aa, Streptomyces avermitilis
MAVPGTPRDSLHILDALLNLDAGVKPEMAATDNASYSDMVFGLFTMLGFNFSPRFKDLGDQRFLAGGDARCGDR

SEQ ID NO: 7758 - protein, 68 aa, Streptomyces avermitilis
VDTIAAANAKLIEAQAKVPIVKFWGEGLLASVDGLRFVVPKRTIHAGPSPKYYHFTLQARHHLTERSK

SEQ ID NO: 7759 - protein, 167 aa, Streptomyces avermitilis
LIHTLAKCEWIKKSLPLCLIGDSGTGKSHLLIALGTEAAMAGYRVKYVLATKLVNELVEAADEKQLTKTIARYGRVDLLCIDELGYMELDRRGAELLFQVLTEREEKNSVAIASNESFSGWTKTFTDPRLCAAIVDRLTFGGNIIETGTDSYRLATTRARAEQQAVV

SEQ ID NO: 7760 - protein, 396 aa, Streptomyces avermitilis
VPQIWAGVDIGKEHHHCVVVDERGERLLSRRVFNDEPALLELIADVLALCEDTLWAVDINHGGAALLISLLLSHDQPMVYITGLAVHQASAAYRGQGKTDEKDAFVIADQARMRQDLGLLRPGDEIAIDLRTLTARRLDLVNDRTRQTNRLRAQLLEFFPALERALNLSKKGPVMLLTGYQTPTAIRRSGARRIGTWLKNRKVKNAAALAETAVEAARSQHTALPGETLAAAVVARIAKGVQALDQEIAELDALIEARFNDHRHATVIRSLPGMGTLLGAEFIAATGGDLEAFGTADRLASFAGLSPVPRDSGRVSGNMRRPRRYHRGLLRAFYLSAMASLRTCAASQAYYGRKRNEGKGHKQALLALARRRANVLWAMLRDGECYEVRPTVTAAT

SEQ ID NO: 7761 - protein, 319 aa, Streptomyces avermitilis
MARPEKDIPAAAPMEVAELARELRALRRSSGLTYKDLSDKSHYSSAALSTAASGKTVPKWEVVESFVRGCGFTGDLTTWQRLHKNALARAKTEEAAGKVKVRAAEAETGEPDGADERTEVHHPRLLGGLRKPVPAPEAVVPAQPDGLLTLVQQFMDAHMQLDARLPEDPQRVSSLTVDHVHTALALCTTPQDVLSVMRELVADKGLTIGALERRSRKYYPISGATFAHVLNGDELPTTEWLNIFLRACGVDQERTLIWHYTVTRIKIANLRHRKTPPPLTVTPVEPSISADYMRRLLVLTVGVMSVLGATVTAVIATIR

SEQ ID NO: 7762 - protein, 208 aa, Streptomyces avermitilis
MREGCSARGALTHLHLHRDSDEPYEPGVEMSPSSSSRKKRRRLIVSAVTANGAGAVAGVAAQAAISDPFFSALVAAFVAGVVGDLLLQVTRTRNGALGDAARPGEHGRAGRRELDNGHGGDDRAARHKTGDGNGRASGARPGCTRCTRPSRQDAHPAAPRVSPSEAVMTPRHLYHRHLHRGAKRFTRRVHERNARHGLRQPRGTHGAS

SEQ ID NO: 7763 - protein, 223 aa, Streptomyces avermitilis
VTAIDDLLADARIPTTRREGFDVGAALRRLAADAAAAAAKPNPDMVRAAQAGQRLSVVCRWILNKPDAADHVDRLAQEPETPADDGHLDVDGALVFACLLYLTEHRESAQFWWQLAAGAGHRAAAYCLHLHHLALGEVREARHWLHEVTDDVLDSEAPDSAFLATLEAVAMYVRRTGSSLAGAPTGGLEMEVDRLATAKADSCIIVQRPGRRLADLMHDFTRR

SEQ ID NO: 7764 - protein, 200 aa, Streptomyces avermitilis
MGNGDVSTDVSPQDGGHGQPVQAPPALPLDFEGFYLGHQEFFHDFSEIHLGSRRVAEQVVHQVFLEILGGWDELLQQGDLEQQTLSVLHRCVTRRLEEDGRSPAFLINGPIAKNLEAVRSQLELSNSAGGLYEAILELPTRQFTVIVLRHLLGYPTKRIARYMGLDSRTVDYHGRKGKERLRIRLGLPTAPGKDKKGAGQ

SEQ ID NO: 7765 - protein, 162 aa, Streptomyces avermitilis
VRGRCRWPDRRRHGLHSPGGAPQPSQPRSGGVERPNRSSKKMVPAALPEGPAGGRVVGEGGVHRLTDRVFVVGEQGLPPLFGLGGHPFTDRMQTCCLRGQVCGRILLRALFGGSPFGTGQPPYPLEVEGLGLGERAQGRPNCGASGIKGGVRDGEAPSPARS

SEQ ID NO: 7766 - protein, 1234 aa, Streptomyces avermitilis
VNGGGGCVEETSGPVAVFCKLLGRLVRECGIQQSDLARAVNRSTAAISMLLNGHRSTLPPWDDVARIVEYCHQRATTTPSAGLASDLAYWRHRHREAETDADHAPPRPRAAKPPALPPAQTIPDVPDDFVSAVGVLIGERTGFDRLAAELLEPLKLHGAVVTDLNAVLEGFADRVGASCGTTRTALLRAADLVTLVTAFCETVAASGIRYTTELGHEQADLTSDVVAELERVTLGSQRVRHPADLRAEIAAAYAYAADTVCDESGVGGQQPDKLAHRAWRRYEALLAQVTWECPELRLTSETQDPPEALDPSEPVTPDVSSSRGLAGLSRLLETFAQDNGAPTPAHQQQLRAPLAQVEESGPRIPDLEAGYINPAFRVAGRSGDRALARDDWWEVQPLWDDLEDFLAAHLLTEDATRAPLLILGHPGSGKSLLTKLIAARLPAAEFFCQRVELRHLPADLGVQEQLEEAVLRSTGRRTPWPDVTDPDTGVVRVVLLDGFDELLQAAADHMDPARHFAYLQSVQQFQQREADQARPTIVIVTSRTVVADQALTPHPSTVIRLEPFDADRIRGWLHVWNTTNRRYFSTHALQPLTWDVVGRHEELAGQPLLLLMLALYDASGNALHLLHGEDIQRLGLYERLLTEFVRRQVTKHNALPADTEAARVAHELQRLSVIAIGMFNRHRQGITATDAENDLAALLDPAPADATPLLFGRFFFIHEAQAIVTGHERRAYEFLHATFGEYLLTRLVTGELRHLLPTTSPDSDHPVDDGRLYALLSHVPLTDRAEVVRNTSEQLTRLTQAQREHLTSLLTSLFNQTPGDTHHRTHVPYRPALTHRTQQDAVYSANLLLLAVLAHPTLRASALVGSRNTVDCWRRHTLLWRSQFSDGSWDAFTRALAAEPFTDPATGRRDLLVGLSTHQPEQELAWTVNLATRDDTTAQTFQHLDGTAPAGLYRPAAFTYDLGAQHVLHAVAPVLHQMPAALETYHGVDRTRSLSLAHALISLLYRPANDPGPPGTPYAELLLMLRSLSGDGRLLAADILGRHLLHAAADLPAATVIDILDQLTTIQFTSAGGLSARTWLVLAQCVSDLAGRPDIPHVQLGRITRRFGADAPALDASGDPLTRLLCLFTEAQTSTMWHAADHPPGQAVLTEGITLLERIPHPRPPQAVVGLLRLARDLGADDWLAQHAEPLLKTLTHDGLHRLRPTDVDWLQPLVHDASLLDELNLVTRRWRQQ

SEQ ID NO: 7767 - protein, 294 aa, Streptomyces avermitilis
VRVDFKRYQQAAIKTLQPPAEGTDPVLVPLLGLAGEVGSLTTAYKKFLRDGPAFEQGKHQLREELGDVLWYIAALTHRFGLDLDDVAAANLEKVKDRWRTTPQEEHAPFDAGFPAHEQLPRQTSLTFTPTKTDDGRTVIVLTREDGTPAGDPLTSASHVEDGYRFHDIFHLAHATVLGWSPVTRFLLGRKRKSDPRADEAEDGGRAIAIEEGISALVFSYAARHRYLADIKHIDQELLATIGHMTAHLEVSICRAADWEHAILTGYAAWRQLRDHNGGIVQLDLDQRTLTVTQD

SEQ ID NO: 7768 - protein, 86 aa, Streptomyces avermitilis
MDDITSVVIDFLAEYEGVSPGELRSELEQDGRELPVDSLLVVEILTRIEERYHVAIPADREAAQATGSVRAFAAAVLDAIEERQQS

SEQ ID NO: 7769 - protein, 135 aa, Streptomyces avermitilis
MTPPLSDNRDRDPELVRLGERLKKTRDYLNMSQQFVSDSTGIPRSAISDIERGERRVDSLELKKLARLYRQPVAYFLAEEKDADASEYSLAGLPRALAQLTDGDARTVLEFAEYLTLRRAAEREDQNAEGGSPTA

SEQ ID NO: 7770 - protein, 298 aa, Streptomyces avermitilis
VNWALAHRIASIAAVQTHRDLGIDRTQYVHVHRALGAADVIGMAQPMPRLFGVYFSPADKGPAVMLNASLNAITQRHTAAHELGHHRLGHRTAADEELDPALRWGNGSWPEEEKTAEAFAAWFLMPLPAVRAALERICGSRPSHPEHVYRVARELGTSYAGTVRHLVNLRLLDAGRAGQWSKIAPADLRSSLAAGASLPGQAQVHVITAASAGQTVHADAGDVLVLHLDNALFDVLPKGVEPWTSDGTTPLASAVVTDELPPGEQGLIEVAVPTHGAALRLTVVREAPRAGVDETWPA

SEQ ID NO: 7771 - protein, 267 aa, Streptomyces avermitilis
VSGGLMHTFTVTERDVTQAWVAACNKLDRKDNPDRTGLHTVVRIADPTSDDPVFRAELDRLRTARGLWPLETVASTLFPAALAARSADPDDLAERYRRMYPVIKRYPGNHRGTYFGRLVFYPAASKTGIDQLSTVISRLRTQAAGTKIAAAYEIDIAAATDQEEAGADLLVHTAGKDNSYIGFPCLSHISLQLDRDRRVHAAALYRSHFMFERAYGNYLGLGRLLAYIAQQAELACGTLTVMAGHARLDGPVTQLRPLLTGTSRLAA

SEQ ID NO: 7772 - protein, 343 aa, Streptomyces avermitilis
MVTVLQERAEQRVLDCGPARKIRVAGRTLTVTPVFDTYWRFAAARQKVYEARLAGGAGPFTDDPILQRHRFTNCFRAADRVSQDLIGGVIYRGEQAWEEVFFRTLLFKIFNKTSTWRLLNGALGEVRWNAYDYRTYDRVLSQAFSAGQRLYSAAYIVPPPQLGEERKHQNHLRLLEMMMTADAPQRVLSAPTLEGAYRVLLGFPAIGPFLAYQFVIDLNYAAEMPFSEMDFVVPGPGARDGIRKCFGSAADGIEAEVIRYMADTQDEHFARLGLSFAGLRGRPLQLIDCQNLFCEVDKYARVAHPDIAGISGRSRIKQTYRQQADAMPAWFPPKWQLNGPPGH

SEQ ID NO: 7773 - protein, 95 aa, Streptomyces avermitilis
VELLWQCPRRKTLVDWPEDVDTRLDVLVRAAAAAGEQTSRSQVLAALVTAAEVRPAVISELLHSYRQMQADALEADNTRADLPSVRSPGRTRGRR

SEQ ID NO: 7774 - protein, 351 aa, Streptomyces avermitilis
VRCGGCRRPISLRKWGRGCVSWLPPPLAFRLHAGSTGWRAELWLPRRVGQGAGLKAVSEERFQDGLGHARRYVARHGHLAVPHADAPQDGFDLGRWLANLRAASAGLPPEYVRVLAELDVWWNPPWPISWQRAWHRARAHALAHGPVSGGDNLAGLPRWLERWLRRQIAEYSQLAAEQQQLLAQLGLTPAEIDRFHAWPARRRSVMHGLEATHDYAASHGHLAVSQLTSHDGFALGKWLNQVRHRQRTATQPTRLGRQLTALDTWWNPPWPLDWQRYYWATRHHLHGLPEGVVWWPGAPEEAQTQQWLHEQQASWQHLHNEQKALVGRLATDQSTGGSPRSDRPDSSPLSS

SEQ ID NO: 7775 - protein, 350 aa, Streptomyces avermitilis
VPRGRPQDLAWRQFVRPAAVPEPVVLAAAYAARMTQEWTSAMSFSSFAPPSGGQDEAAPVDPREAVEAVAMRWQAFSSRGAQVGWASQESLRQAGVTGYGPLINRVVEIHGLMGSIGEQLALARAAEQDAQRHQRTAAIHDPRQAAVLEHSRRMAVRALCEMSTHFVLGAAHGLANLVLRTVLCHPAAAYEVNQAKRLKKAQGFPPGTDLKEAWLTFSPTGDVWSTLLPAAAEASGLTSLQDLVARLCLLQVDPRFSALEQRRGMDYHRHRPQSLDHTSPRAGLWSYDPVHKVSTMRMPGASADAERDEETVHRISADALECLGAALTDIEPLMGESLRSCHLSWIPVNA

SEQ ID NO: 7776 - protein, 425 aa, Streptomyces avermitilis
VQQCPGATRLLTVVNEEGTTSHGSLIDDIVREGARRMLAAALEAEVNAYISELADQRDEREHRLVVRNGYHQARKVTTVAGAVEVKAPRVNDKRVDESTGERKRFSSAILSPWCRKSPKVSEVLPLLYLHGLSSGDFVPALEQFLGSTAGLSPATVTRLTQQWQADHAAFGERDLSASDYVYVWADGIHLRIRLREAKSCAFVLVGVRGDGTKELIAVKDGYRESADSWADLLRDCARRGMRAPALAIGDGALGFWKALAEVFPEARLQRCWVHKIANVANALPKSAQPGAKKALQEIYNAEDRDHALKAVAEFAKTYGAKFPKAVKKITDDVDELLAFYDFPAEHWVHLRTTNPIESTFATVRLRTKVARGAGSPAAALAMVFKLVESAQQRWRAVNAPHLVALVRAGAHFERGLLVERPTAAA

SEQ ID NO: 7777 - protein, 588 aa, Streptomyces avermitilis
VTELAIAEPRMNGPEGDTEFWHSIDWSREETSVKRLRQRIFRAAREGDMKQVRNLQKLMRRSRANTLTSVRRVCQVSTGKKTAGIDGQKALSPEKRGKTARQILADPMSHPQPVRRVYIPKANGKRRPLGIPVIRDRVDQARFKNALEPEWEARFEARSYGFRPGRGAWDAIEMIFNVAGRRTAKRLWVLDADLSAAFDHISHQHLMDSVGLFPGRRQIQQWLRAGVMEDGRFVSTPEGTPQGGVISPLLMNIALHGMGEVIGANRPWNAKTTSPTLVRYADDFVVFCTTENEAIKAKQDLAAWLEPRGLSFNEEKTRVVHLSSGVDFLGFNVGRFRQKLIIKPSRDALQRARKRISTTARENSGSPTESLVRALSPFVRGWSTYYRTVCSKETFNLLDAHTFEVLKRWAMRRHRRKPWGWIKRRYWGTFQPGRSSKWVFGTPEHYLPQASWMPIQRHTLVKDDASPDDQELEEYWGNRRRKRIQAVGEPKKILSLAYRQRGLCPRCGLDLIDGVGFDPDDVQDWANWFTGSLRAIHVHHLTYRSKGGSDHPSNLELIHTTCHRQAHAGDRKYDAHRRPQASLSRMRG

SEQ ID NO: 7778 - protein, 454 aa, Streptomyces avermitilis
MGTCHAGLPSPSRAWSSSLAHACLLLCERRWSGVTPEEMASVREDLEAFAAELFDGFFRADQRRWGQAYVRGLLLEGRRKSVEPMAARLGEDGNRQALAHFITSSPWDPAHVRARLAWRMQDAIGAEALIVDDTGFVKDGDASACVSRQYTGTAGKVTKCQVGVSLHLARDHASAAVNWRLFLPASWDPMSSEADPDKVARRTRCGVPDRVGHVEKWQLALDMIDETRSWGIDIPLVVADAGYGDATAFRHGLEERKLPYAVGISSRHTAHPADARPVQPAYAGSGRPPAMQYPEPAQTMKDLVTAAGRAAARAVSWREGSRPGKSVSGFKRMHSRFVALRVRPAGRGVRQSTDGPELPERWLLAEWPATEPEPVQFWLSNLPSGMPLATLVRLAKLRWRIEHDYREMKQALGLAHFEGRTWNGWHHHVTLVSAAHAFCTLQRLAQDPKDAAEE

SEQ ID NO: 7779 - protein, 397 aa, Streptomyces avermitilis
MCSDQGTHTSSTKAVRMSLLHHDSRSEALAQLSCFRGEFYSCLTARSDALFELADAVLCGDGPVRSLAELSLVGEHRRGHGGLYAALARGRIDAGRLRRALAEVPLPRAADGRLVLAVDVTCWLRPDAHTSPQRILCHTYGRGKDQHIPVPGWPYSIVCALEPGRSSWTAPLDALRLTPGDDTATVTARQLRDLLQRLITAGQWQTGDPDILIVADAGYDAPRLGFLLRDLPVQVLARMRSDRVLRRAVPPRLPHTQGRPPRHGGEFVFGQPDTWDTPDTETVTDTRLYGQATARSWNRLHPKLTHRSSWAAADGTLPIVEGTVIRLDIAHLPSGATPKPVWLWWSGTDATPADADRLWQAYLRRFDIEHTFRLFKQTLGWTSPRSAPPRQPTGGPG

SEQ ID NO: 7780 - protein, 78 aa, Streptomyces avermitilis
MVEVVADGREQLVVTGSRSREKAYLFTGEDLAAISPYLTDHIMRFGTYATTELTARPVAFDPHLDVEFETEEEVPAAA

SEQ ID NO: 7781 - protein, 567 aa, Streptomyces avermitilis
MPRRSVMATRELRVRRTRSRTRRTAGACLLVAGCVITSSVPSASASPQGGARLCATEPFPPSESTPPPILSGSDVWSFVSDPALHPMRVKVTANKPGTARGDIFVAPFSADQMVGQTGALINDNSGDPVWFRPLPSTNLQNADFKVQTYYDGRRDRGQPVLTWWQGTLALPPAYTNLPAGAPEQGGCYYIYDRHYRLLKTVFAHHGCYPDEHEFTLTRRGTALFIASKPVPMDLTPYGGPKNGAIENSEIQEVDLATGRLLFSWNALDHLDPADSEEPVSSASSSDGVWDAFHINSVDEGPDGRLLISARNMWAIYDVTKRSGRIRYQIGGRKSDFTFGPNADFYWQHDARFRPGNRISMFDDGCCDLPDGTPEQVSHGLILNLDVRSRKATVDRTYYHQPPLESPTQGNTQALSNGNEFIGWGQSPYYSEYAGAGNTQGNGLQNLLYDAKLPGSNISYRAFRNEWIGTPYYPPSTAARSDGGHSVVYASWNGSTQTRAWRVLAGSDPHSLSVVVRRAPRSGFETAITTNAPGPYFQVKALNAQGKVLGTSHVVTLSSRQSTRDTKR

SEQ ID NO: 7782 - protein, 282 aa, Streptomyces avermitilis
VPGRAPARPGRHLTFKSGRRFTVGGVTTYRISQLAERSGVPATTLRFYEDAGLLPADRTPSGYRVYGEDAVERLAFISSAKLLGLALEEIRELLDVREEGVCASVRARMLPLAADRIAETDGRIAELRAFSAHLAGVHTELSGPAPSGACGPDCGCTTTSPVAAGPVPITLSPTRPSRIAEPWRDTPVACTLGGAELGVRTEQWKQLVSKAEEREEIPDGVRLSFPAGAELAGEVAALAAAEQGCCAFFDFTLHLTPAALQLEVRAPESAAGMLADLFGATV

SEQ ID NO: 7783 - protein, 172 aa, Streptomyces avermitilis
VSALDFYAHVAVCGEVRGVGLGAGPEAWEAALGATCLDVPGGGLLRRDYGLVEINFSPDQPGRQGQMSCFGFGVKIQRLLYDQSPNTVPSPLSREYGEFAPRVPFKQLQAAILALGRTIELDKHNTSSDMDCYRVSASAARIHVVADPDPYGSGDPDPDGHQRGDVWSVDVW

SEQ ID NO: 7784 - protein, 94 aa, Streptomyces avermitilis
MGIGRRERMTSLLDTPYLVKEWELPSPIVLLSGDGHCWISLDYRACGPNGEPSVTWFDTDLDTELALASDFRMFVENLTAGSALGVDPGDSTSA

SEQ ID NO: 7785 - protein, 159 aa, Streptomyces avermitilis
VEAAPGSAGNVMPGADVIETAVALDGDGSCIAEARQLAVEFLTRVQSEYGVPVSARAMDLTQLVVSELVTNARKYAPGPVLMQLRLAGDLVEVVVWDSDPVLPVARAADPGRIGQHGLEIVMAISQEFEVQREPVGKRITARIALPDTPGADITGRRPQ

SEQ ID NO: 7786 - protein, 162 aa, Streptomyces avermitilis
MRARCWRKDCIGVPRQGTGAGWVRTRCARIRDPQSASPVEEVVTDTHEAARPGLSIDHQAVDGIRIVVLRGEIDHANRDSLHEALLIPEGEAEPRTVADFRGVTFMDSSGINVLITAHRAAQDAGGWLRLAGVQEPVQRVLALVGIDTLIPCHSTLEEALTS

SEQ ID NO: 7787 - protein, 173 aa, Streptomyces avermitilis
VRGSRHEHHATPAWHQTGRPRRHRHRHRRRNRSPHGCSPSNASSRTRQAATQHQAVADRTGDATIGPDPEVRPPERPQANQSRGGPGLLLALALPILMRAALFALDAFEDRLFPPPAPADDESLAADTRSLALTTSPPRPARPGSDTARARHCAYDAVGESPAGQWHESRLRS

SEQ ID NO: 7788 - protein, 379 aa, Streptomyces avermitilis
MLGRSFEELVGQDFHDLLHRDSYGHATPRTRCQLRDALLAGRTEHGDSEWFARGDGTLVRLSWLVAPFSSESEGAGALMLLYGSNRGVSDEGDDEVPAPLTELDRLALLAETTTQLTSTLDVDEAMRRLAALTVPRLADWAVIDLLTERDEVRRALVTEHKDGILVGREDLQGPMPPVPEESPMPLSRALRGAASSLAGPATYQGPPDSGIAVEQGRLFSETGMHSAVIAPIRGLRDVLGALTLGRSTRPDAFTAADLPLLEDITRRAGLALDNARLYQRQRKVAETMQRHLLPQLPTVPGVGMTARYVPAPHASSVGGDWYDAFALTDNSHALASATLSGTTSTPQPAWRRSATCCAPSHGPSPRPRPAPSSPSSTTP

SEQ ID NO: 7789 - protein, 173 aa, Streptomyces avermitilis
MAQIRNMLRAFTWSQPQATPSAVVTQLDDAVKHIAEVPMATMILATLTLGDDELWQLRWTNAGHPPPLLVSHDGRARYLTDAHGILLGTGTIRPRPDVFTVLPPRTTVLLYTDGLVESPHHSIDHGLERLRRHAASLAHRPLDSFCDLLLERVRPSDNDDDVAMLALRTPTRA

SEQ ID NO: 7790 - protein, 195 aa, Streptomyces avermitilis
VQGHRSNYVRPHCYCAACMGLGLRIGAFGPAVDEEGNTVPGSRAVYPWSALPAVIGGDVDRDERPFAWFTHFLEAAGPVVVDEGDGENLWPRGIQHDDALFCETGVTGEFGLADGVAATQFQPGAGRTALHLGRHPVEQLLPSWDHRVLRFPGQIGAVEVEDVVVLKDHFCCSSVPSHTLPGDGHAQEVRTGDRA

SEQ ID NO: 7791 - protein, 126 aa, Streptomyces avermitilis
VSDAVHIVLDDTAMAAAGQGNVLASRLIHRAHAESGWFLYAPACALVEADRARPGTAEHLASLPGITVLDLDLAAALAVARQKTWAAAHSQYAAQPTPERPDGAIIATTAPNRWKGEPVRVLDLTP

SEQ ID NO: 7792 - protein, 91 aa, Streptomyces avermitilis
MGRSTMMSDANVRIPEEAKERLAAIAAAEGLSLRAYLARLAETLLTPAERAERAEKALAALKEWNGYAPTAAEEQDLDSVLDRRLAQATGR

SEQ ID NO: 7793 - protein, 60 aa, Streptomyces avermitilis
VLSPGRAAPSLPTLPTGGPTPARTALGPPRTDSNIVVLALGWGAFIGAGIIAMYFLGHAL

SEQ ID NO: 7794 - protein, 146 aa, Streptomyces avermitilis
VGVRTAYKFNRSAARAVAAASLAWRTVRAPAGVNRRAPTPPISVISGPKTTDVDGSVARLAIVPAPNTPDLPSEHSPDGAGTGRVRFPLVQWVLAPRTTWQARRLAADFGEGMDARTAWVMARLARHPDERDYAMAHLDDERRIAD

SEQ ID NO: 7795 - protein, 104 aa, Streptomyces avermitilis
MTADDSHNRLEDDDYPAYTMGRAAELLGTTQGFLRAIGDARLITPLRSPGGHRRYSRYQLRIAARARELVGHGTPIEAACRIIILEDQLEEAQRTNAEYRRTAE

SEQ ID NO: 7796 - protein, 224 aa, Streptomyces avermitilis
MSVDLVGFLGVVLVAYVVPGPDFLVVVRSATEHPAKGRAAALGAQSGLCVHMLAAAVGLSLIAARSPAVYDAIRLLGAAYLVYLGVRAVLAARRAARERAAGREAVGGVEDGTDPRTPEEEAPAHGRWRSGFTQGFLTNVLNPKAALFFLSILPQFVHGGGSTSRQIFFLGTLDIVIGVAYWFALVAVAARLRAFLARPKVRHGWELTTGWLFIAIGIGVAAAA

SEQ ID NO: 7797 - protein, 118 aa, Streptomyces avermitilis
VVGVVGVENGPRGPVFFSFEPAGIVPDIVCLSKSISGYGMPMALTLLRPEYDVWKPGEHNGAFRGYNPAFLTGARALEGAALRPCGRGPARCAMRRTGEACCWRRPGPTTRWPRSCRR

SEQ ID NO: 7798 - protein, 767 aa, Streptomyces avermitilis
VRHGGRGRGPKRVGMRYLSLLVFGAGGALVLAQSSGQSVAAVGMGLLTALGGFYLAWKAFQQDRDQVTAMSLGTAVDQLAEAVKKQWDAEASVRRLNDPYPLPVAWRAADADLVQPWTLLADVARGWPGGPPGDPAQWPTDAAGLAGADAQIGEVFAQRVPTRRLVVLGDPGSGKSMLLIRLLHDLIAQRPDDGPVPVLFSLASWNPTHRPLQSWLADQLRHTYPGLRAPAPSAAPQAGQIDLAQALLDTRRILPLVDGFDELPPALHAIALDALNQALPAKQPLVLASRAAAYREALARSEVLVRPLNGAAGIHLLPLPADQAATYLRHDAGGEHTPAADRWNSVAAHLGTNTLVGQALSTPLGLFLARTIYNPRPDILGAPAPVPHPDELYDTTIFPTRAALDTHLFNAYIPAAYTRHQPNPLRWSPSQAYRTLVFLARHLETNRNGSPDLAWWELHHANPAYIRRLTAGLMVGLGPGLLLGLVYGVGLGLAAGIGLAAGLTYGLIGGGLGSAPSNIPSTRLRWSRRRFAGWLGAGLALGLVGGLAFGLGIAGERGAWLATGILPGEHGFVGWLAFGLALGLIAGLACGLTFGLTGEKPALTTMIGPATLLIQDLRTFLGGGLAYGLGAGFVGGFIGWLVSWLAFGAEDGLAFGQAFGLAFGLGASLEQTAWGDWVIAKAYLAMWRRAPWDLMTFLQDAHQHRGVLRQVGAVYQFRHLDLQRHLAQQPRSLPTYAGQPDSPSRLTGEQARSIHRRGNTRTGSLFD

SEQ ID NO: 7799 - protein, 104 aa, Streptomyces avermitilis
MATENCRRDLTAICKAADSGYLLQVVRDDGFEPLAEKHLSHWPDWPTFPVDAAHAAGCELIMLGYVIWPDTVTPDSLIGWRAVPDQQAWSAKVGTFAQVQAAGI

SEQ ID NO: 7800 - protein, 144 aa, Streptomyces avermitilis
LVYCRVGPSQGVAMYMPGPKVTAAVGAVLSAATAVVTNLVTTRWSPALIAAAVVLVIAGAAAAAASAAHGRSDSPPTARLTARRRGHLDRIRVAHGADAAVRIEATGSAAEVSNLEVNIDNAEAIAKATGRGTISNSSIVQRNS

SEQ ID NO: 7801 - protein, 1144 aa, Streptomyces avermitilis
VSQVFTDRREALAAVERLTGESSPLRVLVVQGVSGTGKSTLLRYVLHHGRRGLRTVRLDVLDVVLAPLPVETDVVLRLVRSLAIQLSTAGPWWRRRRLRRQAELIGAEHPATITMIARGHGQITGVSAVADGAAPTAQRREAWVQAMLSIAARVRRPVLLVVDTTELLYVFDDAAREDRARTAIGVGDWFVRDMLVRLLDVSARLRVILAGQDQLTMTGLPDSAWQELELSPWSQDDVVDHFAALGLGLEPARQAYMMSGGMPLIAAAIADLCQSGIGGEGAWLDQAAGQPTSTWLVDNILGRLSAEQRMLVQAACVLRVITEPALARLVADTPLSAGWFTALARHQLLQTAPATNRAPRLVMHATIRGWLLEHLARADRDRIPDRRQLPRWHRAAAEFYAALAEGRLSAEEMYHRFAAGDAAPTRCRLWEQAVLAAVTDGRLGDAFTLAQTATVAAAEPAQPTVPHPALALAFHAQAHIALLQGHLHQADRLAADADRHYQQVPDTFGQAQVAWMRGELAWREDRYDDAAAFWRRSLHTPGGITEPADRADLALALARAVCCIGDLPALDTAVDTARHLAADATAPAPHPTDTTAHRLPMIPLTPTTTAQIRPVTLLRLQATGAFLTSNYARADALITQGVRLAGTLGEPGRHEQALLHAVYASAALLRDDLDAAEEALKQGLQAARNCPNARCRINLLLRQARLARIRAQSGPGLPTHPNPAPAAVQISLKAATEAAHQRALSERYVQAALDLALDLTDRASQADALDNLGYVALDRGDLNTAHQHHEQALTLYQHTGNRLGQALALNNLGNVARERGDLDTAEQHHNQALTLYRQAGSRFGQASALDRLGMVAKESGDLDNAEQHHNQALNLYQQIGHRSGQVAALGNLGNVARDRGKPESAKQYYEQAMASFQQIGDRSGQATALDHLGKLARDRGDLDTAEQHHNQALALFQQIGHRSGQATALDNLGHVAEDRGDLNTAMQHFEQSLALERQTGDRLGQAHALDNLGHLAWCRRDLDTAEQHHNQALALYRQTGSRPGQATALMGLGSVARGRRDLVTAKQRYEQALTLYQQTSNASGQAAALNNLGMVAQDRADLNTAKQLYEQALALYRQTGHYPGEQQVLRFINQLDGLAPPSGP

SEQ ID NO: 7802 - protein, 251 aa, Streptomyces avermitilis
LTPKSDAAQSLVGDVRALTPPPGTHPLVGGIDAELVDAKHSISGQIPLAIGLVVVTTFVLLFLFTGSVVQPLRALALNAITLVATLGIMTRIFQDGHLSSLLGFTAQPMEMSMTVLMFCIVFGLSMDYEVFVTSRIKELHAPGEDTESAVTNGLGHTGRIVTAAACLLAVSFFAFGTAKLSFMQMFGLGSGLAILIDAVAIRGVLVPAAMRLLGDSAWYAPGFLRRFHGRFGLSESAPESAAEPEPAVSRG

SEQ ID NO: 7803 - protein, 198 aa, Streptomyces avermitilis
VEWDQVDLATADPQSVWKSVAMVPQDYTRWPLTCRENITLGMPSDEGDAAVLRAAEEAGAMAVVAHLPDGLDTSLARSWWGGHDLSGGQWQRIALARAFHKDAPVLILDEPTSALDARIEHQVFSRLRELSAGRTALFITHRLANARVADKVIVLEKGAVAESGTYDELLRIDGLFAELHRMQEGAERDIPTPRTTRI

SEQ ID NO: 7804 - protein, 129 aa, Streptomyces avermitilis
VTRSSSPSAAARNGYGRWHMPSGKLDQGDPLPAGAARELFEETGITVAPGHLRLVHVVHHRQDDEVERIGFFFEATDWQGEPVNREPDKCLALTWFTVHELPDGIIEYPQAGLRGYLDETGPLVAHNWE

SEQ ID NO: 7805 - protein, 462 aa, Streptomyces avermitilis
VISWLAGHESGASRTARGCRIQPSNRRPLVLQSSVPASMSSNSASLSCDCLAHRFGNAGDRPYRRPKYPSDMSDAEWAVVRDAMPVPGWLEGRGGQPESYCHRQMVDAVRYLVAGGITWRAMPADFPAWDRVYAFFRRWRDKGLTAEFHDRLRDRVRQAAGRDLEPTAGIIDAQSVKAAASVPAVTRGFDGGKKVNGRKRHIVVDTLGLLLAVMVTAASVTDRDAGQTLLARLRERHWRVTRVWADGGYTGRLVDFARDAWRIALTVVRRSDDTSGFTVLPKRWLVERTFAWLMHSRRLARDYETRTDTSEAVIKWAMSTVMRRSRRSRSVLLLAGGAFAPGEPTSDGCIQRVAVDALEDTTHGGLGRGDGAAVRLPAWATEPGQDVGRGVGGPLRDRGQGLRSGQDRARGQGEDEGEWVEPGSLLCANVQRTSPAYPGIFAAQAEPTSPLRAGLCRPWGTL

SEQ ID NO: 7806 - protein, 481 aa, Streptomyces avermitilis
MSSVMSSAMPSLPSSPTGPSRTGRRLLVALLAMLATAGSTVAEAGTPSGPAPGAAVRAAEPATPDRPSYDVKLRADGDGSHWAGRQTVSFRNASSRPLREVYIRLWGNGEDGCGTSGRPSPVRVSHVRGGTPGRPGVKCTALRIALPRPLARGERTAVSFDVALTVPARNNRFGREGAFRFLGNALPVLAVHDARGWHLDPYVSYGESFYTLASDFRVRLDHPSALKVPATGSTWTRPGGTGRTVTHSVAKRVRDFAWAAGPFRTATQTSPDGVRVKSYWSPNTPAAGVRLNRKDGVAAIDRFGREFGRYPYGEIDLVMTPGFAGGMEYPGLVILGTEEEGGATVHEIAHQWWYGVVGNDEYNSPWLDESFAQYANARYYRWDGFECSPDDSWPSATAALTNSMAYWSTHRGEYFQVVYGIGPCVLADLEHVLGAGTMARLIKKYAHDHWYGVSTTVDFKKAAQSMTHRDLGPFWRKHRIR

SEQ ID NO: 7807 - protein, 402 aa, Streptomyces avermitilis
VPARSSSLIARSLGQLAGTAPTVPDDLPGLLTCLAQVPDPRRDQGRRHPLAFVLSLAACAVLAGAKSLAAIAEWAADAPPNVLARLGGPCREPDRGPVAPAEATVRRVLQRIDGDALDTAVGSWLAGRERAAGQEENDSDRRPLPSLAVDGKTVRGARRTDGTQVHLLAAMTGTGLVTAQREVDATTNEITVFQPLLAPLNLHGTVVTFDALHSQTAHARFLVEDKHAHYIALIKGNQPTLHQWLKALPWREVPLLDKTRATAHGRDEIRRIKAAAVAGIAFPHAVQAVQIERRRRIVTTGKVTLERIYGVTDLTAEQADATEIARRVRGHWGIENKIHHVRDTTYAEDASRVRTGTAPRAMASLRNLAIGALRLANQTNIAAGLRHHTRDANRPLITLGIM

SEQ ID NO: 7808 - protein, 198 aa, Streptomyces avermitilis
MTPADPTSPPGTIVTRGLRRTYGDVEAVQGLDLTVAQGELFAFLGPNGAGKSTTIGMLCTTLRPTTGHAQVAGADITRSPHDVRRQIGVVFQESTTDDDLTAQENLRLYADLYGIYLYSARLLSVLGCPCLPLVCRHTPNDIDSHFARSDVPVSCSYALNLSESQAAGDGPAGRVGGIVMDLDAVDAQGRVVQVMCPG

SEQ ID NO: 7809 - protein, 87 aa, Streptomyces avermitilis
MMNFALAPEVSVTDTEHGTVLLDERTGRYWLLNGTGALALRALLDGTSPQGVVASLCQRFPDAGTAQVEQDVDNLLHALRTAKVAAS

SEQ ID NO: 7810 - protein, 636 aa, Streptomyces avermitilis
VPAVRLPHLLLTLVEGTGMEFLVLPDHPAGAAALALMPTAGPPPTHVIEHHSGRPWIVGCWNEEDVMVTAVGPHRVALLGRTTADADVLTRRLRDVRSVRDLDGLAATAAGSFHLVASVNGEVRVQGTLSAACQIYYATVAGVTLAADRPQALADRIGADIDEDQVALALLSPFGPPWPLSERSLWRGVCSPPTGHCLEIGRDGTGRTRQWWTAPDPDRPLGNGDMIRQALAEAVATCTAGQEVVSADLSGGLDSTSLCFLADADRHDAHLVTVHYQALGRSSDDRYWARQAEAALPGARHLLVGPGQAPDWYAPLAHAVHDREGPLTFVRSRATTEHLARLAAAHGSRRHLQGIGGDELFHPSPMALHALVRRHPLAALPHLRALRSMRRWPLTTTARTLASAPSYTQWLAACSNFPADRHDWGAGADWEPLPKLPPWATPHAAATVRRQLLAALAATPQPLATLPVQHEMIRLTRINGNATRRNSHIGAHTGVTFHAPFTDDRVLEAILAVRLEDRVALGQFKPMLGTALRSIVPAGLLSRTTKGDASAELYAGLRRRRGELLKLMDDSHLVRMGFVDADVLRTVLRGLHADTRPLMPLDSTLACELWLRTLSPADTARATAVPVPSPRTVKEI

SEQ ID NO: 7811 - protein, 132 aa, Streptomyces avermitilis
MGRAGPVAFLTDEQRRNYGTFNQVPDDGQLAGYFLLDRDARRRAMTCRGARSQLGYAVQLGTVRFLGTFLDNPEDAPAEVVAYVAEQLGHPGSVLAGYGAERTRWDHQIAIKDAYGYRDLKGDAWWKLRDGD

SEQ ID NO: 7812 - protein, 76 aa, Streptomyces avermitilis
VLGQGQYVPLDLMIEGESQRMSERDALRGLRALMWVVIAIEVPVYLVWLVEVSYLTGQQLPRGTEEEDGKPRADTD

SEQ ID NO: 7813 - protein, 157 aa, Streptomyces avermitilis
VQADAMAVAVMELQGAAAANRLLWEGPAERGRTFLLTLLAFAGGAARARIAGGTDVQSGLVGFGQAAELLSRERVASKQTVAAVREPLAQAATAAAPLMRCSAPAVVAATEQLLNALADVENTARLEAALEAFGRAVNVATPPRLSWWARRRAVSSG

SEQ ID NO: 7814 - protein, 544 aa, Streptomyces avermitilis
VILAECGELLKTMFPHLEGVLVEEVSPEGGVLHIVARTVESVPVPCPDCATPSVRRHSGYQRRLADGAVGGRQVSIELTVRRLFCDDQRCARVTFAEQVDGLTVRYGRRTPQLRCLLSAIAVALAGRAGERLAARLPVPVSRTTLLALVMALPDPYAETPRVLGVDEFATRKGHKYGTVLVDCETHAPIDLLPDRESATFAAWLTDHPGVEIICRDRGGAFADGARTGAPDAVQVADLWHLWHNLAETVKSLVSKHSSCLREPALASESPPEVLHPPLSHAGRLAERARRHHAAVHDLLGQGLTIRAVARRLELSRNTVRRYARAVTWEELATGRWQNLPSTLDPYKSYLHQRWHEGHTSGAKLHAELRERGFTGSYSVVRDYLRRFRRTSGDRPPPARPPGVRKVTGWITRNPDRMNDDDQQKLKAILARCPELEAATGHVRSFAAMMAIRSASRLPEWIATARADEHHGLRGFADGLLADLDAVILGLSTEWSSGCVEGRVTDIKLLKRQMAGRAGLPLLRKRVLLVAADRRQHRVTNQTAH

SEQ ID NO: 7815 - protein, 736 aa, Streptomyces avermitilis
MTPATPTPPSSTPPSWPQCGHGTTPEDPAGCRGIRVSGHTACLAHLSDADRDAYLAGLSPGNNVDHRGTSFSQDLLDALLDALRDPDTGDPRLGVARFRSATFQRDVGFRSATFQKWADFGSATFQGNAGFRLATFEGDAGFGSARFEGDAGFGSARFEGDASFVSATFEGDASFVSATFEGDASFVSATFQSAASLGWAAFQGDVKFESATFQGDAVFGGADFRGDARFGLAAFERNARFGLARFRGIASFWLVTFHGDAWFRSAIFRGDASFVSATFQSDTDLEAATFSDHTRFDRATFFGDARFVEATFRGDTSFVSATLQSNANFLGVTFERDAKFESSIFQGDATFVSATFECDACFEQVGFERSASLGPLVCAGRVKLSGAVFGCPVTLSFATRCLECRRTRWSSTAELRLRYATVDFAHAVFEYPLTIAAEADPFVLHNGRPVAEQSLIDAPDIEVRIASLRGVDAAHLVLSDVDLSGCLFTGTVHLDQIRLEGTCSFASVPRRTHWRRWRPLRFTQRRALAEEGFWRASQPTPVPGWNAAVAGAVHAGPAQLAPVYRALRKAFEDSRNEPGAADFYYGEMEMRRHDRTGSTRTERGLLHGYWLLSGYGLRASRALGWLAAAMLVTIVLLMGFGLPKDSPKQVATGTVPPGDGKVTLEIDKADPQNPTGDRFTSERFEKALTGTLNSVVFRSSGQDLTTAGTYIEMASRVTEPVLLGLAVLAVRNRVKR

SEQ ID NO: 7816 - protein, 137 aa, Streptomyces avermitilis
VGTRLRLRRADFSDGRCERKLTQKVPVSRPGGVQGLITNTYLSPTEYDLLASLPAAVLSKTRFSVPPLGVDVFDGPLQGLVLAEAEFTTDEETQSFIPPSECVAEVTDDARFTGGRLVETSRQELLGWLAEYGLRPQ

SEQ ID NO: 7817 - protein, 219 aa, Streptomyces avermitilis
LPHVVLRLRESSGCSYLNRLADANRLPVQFRPILLGHNRHHRRDDNRPGRWTPETLCRLSALTGRTAAELSHAIPALAVIGEPAENRLQSLSGQAVEVLRRPACRRCMARRGFHGLVVRTIPPHEAVCLRHQRWLLGDEQYRLHALPELQQANRRHCRLVRRTRASILAREYAVARDCLRDWFQDGKPSALRQRWNKRIDQLGEDPYGDETPVAPPSPG

SEQ ID NO: 7818 - protein, 119 aa, Streptomyces avermitilis
LVKMLEDPAAHGVDLDCTMVLHELTGDEWPATRAHAEEFVLPHLREHRVRLVQVARASRSLEITVIDDSRQPQRIVERGPWALWDEYESGGTVPQQGGIRLCSLHAKGNWRMPLSPTTC

SEQ ID NO: 7819 - protein, 200 aa, Streptomyces avermitilis
MGRFTTSLASSTPTRRTLGLFVALLLAVAAAYTLTGGQNTGIPEGDALNGGMQSAGDVGYEHAQVGEEYWAGLPLPWNESGKDIQITRAKFTHVPKGLKVIEYRAFNGDDTDGNVLFARTDGKGSVGDLFKARNYAGHPMTVKAKTGSHVYYVARVKVTGPIHDNLSGCSYWYRQGSTEFQQQLDCSTIVRLGKPLKYEG

SEQ ID NO: 7820 - protein, 766 aa, Streptomyces avermitilis
LGEPMSSVSRGRGTTTAIQVLSTIVLATGLTVAPQALTPGHPASAADVSCTTYSVSTYVFEPATSSNAASKRVLHKYMEWGPKSPDTDLLDTLYTASLPMTSKVFTGGGNGIIYEATGGGQVKSYKDNTATGGSLLTPVKTYSFNWSSAKQILANGHWILVIASDGTMDVYKQSSPDSGDGTITKVMDGAKSSVTSAIADADDAWMINSAVQWLKDGTIQQAAVTSLPPGPANLPPGPGIRLEAATSIATGVDAAQAWAPGPNAISTQSVTSDPDTTGQIRSFTTGPWTSADSDVRSGILGDVMADAGPCLTDPDQDTVPYFGTPPVADTDVPTAQESSDTAPSTPSNTITGRFTLGSGQPASGLTVMVTASDVDTGSDTATGGTEPLLGKATTASDGAWTLTLPSTLPANVKQAMDDNGGALNLNATTTATTSSGVQVLGADTLTAVPEQSKTALAAGTDASARAAEAINDNHTVPLIPDTVDDTAAKEPTADQEKQTFAAQTKADPQATGEMTPMWQSDHSTLAASYNPYLVGGKDISAETVTPHASGSCDTVKYKQTSKIKYTVVGEAHANWDSKASFDYDDTMNSAIDTAVNSNGDWKLGGSMQISSETGVSTGYPNKGSYYAHQYQVPIEYNKYKKQRICSGTVRATWYTIEPGRYKVPSGGSVGKIGKDVSAKDGSGNYGRAPKSYHAKVDNGTYFQLTRKKSAKFGNAVNFMGVGLGVTTGYDTNHKQKIIAGTRRNATHLIWGKNGPVHDKPGVFYSN

SEQ ID NO: 7821 - protein, 274 aa, Streptomyces avermitilis
MRTPILELALSFPGTDFARSTRTSCGLLTEQLPIGNERGSASTCRPPNSRTREPGPGDYCRRPASDDRQRGRQCRRFLTLAITSPHGEGGFLSGERCSPVRPWRPWSCPYDDLMRQADPKPYWNTNVARHPGILRAVPKTGTASATAAQPLLDYINRRYPLTQTTPLDANRFRANAVPEAEPGDIIAYDWQNDGEVDHLSLVVDIADGQYPEIAEWGVVDWNPLGVINRNATTPYAKRGWTYSEKNHNWLQSVEETRNVSAKLIHIDTRNVTTF

SEQ ID NO: 7822 - protein, 117 aa, Streptomyces avermitilis
MGVERGAMLDELVSAAAAAGGSAVVQAAGTDLWNGFRGRVAEWFGRGDAVRESRELERLDRSASELSTAGQDEVERLRVRHEAVWQSRIETLLEDLDGVERDQAVAELSKLMAQARP

SEQ ID NO: 7823 - protein, 347 aa, Streptomyces avermitilis
MCLEQRQGHRRVVPHPGDRRPARRDRPPPSRAASGPARGRTSNPLAPNGRESSMTNGRIHTDWVETVSQDGLHLMQTRLEVRVPTSEGRKFITCGLARKTYVVKDGIACRVSSYALGRDLGSPGNYDFEIVSATGGPPIRRFFNWDGVPAEILEGALFDAHEGLDDGEYIVRIAAGMTTSWDSGTGQSIELHVPCHELAFVVVGSAPQEVRARTGGPWAARPSVEIPVVDWRDQPTAEAAWEAYLNGSRISLDAYGIFSPQHLMRNQRDTALEILRSEGYAIPRTPEPAETPGTWLGHWGGAWMPADVLAALHTVPDDTAQRAWYQGAKESLDIAWDMHLLWTTDVF

SEQ ID NO: 7824 - protein, 154 aa, Streptomyces avermitilis
MTSPDEPVPQDRADQFRDPRRRVLRHRPHRPPPAHRRAAVMGQTLAAAGGLQRDLQRELTYDGLRAAEAKGSKGGRRPAVAAAKAETVRTAYLEGRSIAALARDHGVSRGAIRTAIADLQHLGEMEWIGPVGQGLFGATDGGRPSQAAAHAGLV

SEQ ID NO: 7825 - protein, 73 aa, Streptomyces avermitilis
VERWFGLLTDKLIRRGVHTSVKALEDDIRAWIDSWNENPRPFTWTKTADEILKSLTDYLSKVTPPATENQQGT

SEQ ID NO: 7826 - protein, 246 aa, Streptomyces avermitilis
VAELAYLAGWKHHDLGQEGAAQRYYQVGYQLACEADPHGHAAWMMRALAHQALSLKQPHHCVDLVEGALTRGLGHVDGQTEALLYITHARAYAVTDEKSAAARALLAAEDALLRDDVPQPSYSRVSGPAAGSVASHTARTLTDLADLADHAGTEQQHRDALIRWDLKKYKRVHALTYADLGDSLAAQARADEAVAAWSQALTLMEGMTSDRTRKAITSLRSPLSVYQRRKVPGAVELARRARQALA

SEQ ID NO: 7827 - protein, 168 aa, Streptomyces avermitilis
VAQRTTDDLPNALPPALESMTLLVAAVIVHDQATNRVVLLQRSENAKFAQGMWDLPVGKSEPGEPITETAVRELHEETGLTVKPEALMVAHIIHGSWGVEAPNGFLTVVFATHEWTGEPENREPRKHSQVRWVDADAIPEECVDTTASALHHYLSGGAQVSLDGWLPK

SEQ ID NO: 7828 - protein, 128 aa, Streptomyces avermitilis
VHALLILHAAGYRWEVVDSLAALRLAVPGRSAAYTARSRVTPLGVRESITARDQSSFFAARSFLSSTTCSSSHHAARLLQAQQDGTDEDDLRQIAAEALGEVYFRDNGRRAQSLEVKLTDLVDLKFEL

SEQ ID NO: 7829 - protein, 135 aa, Streptomyces avermitilis
VAFAELPDIPGALLRTSVLFLGERNQVRQSVTSVYTELTKEAGKRGGPAALRAFYRMQGALIGRAQGIAMGRAQGLLIGRAQGAIVAASVSIAGTQLYNRVRGRGCDSTAVPTPMPAGENGAGAEVPTQGQEDDA

SEQ ID NO: 7830 - protein, 270 aa, Streptomyces avermitilis
VGEDHSMASLDELPPYRRAQLLWRWAHEGVAFVEHLVFDAAKEPCCLPSPPPGPPGRTVAVPGDDGRFHLERAGLMLCGQAEATGAWGHRQHCGWVERWDGPQEWRGGRDDGTSVWGSLIVEWPVRASGPGVDPGSVDRPERCPGGAYELLHLWPPRPARTASVRRLRAALVDALGPDCHLCGLYPGAMVDHDHQTGRVRGLLCAYCNRLLEECPHLTDCPRADYLLAPPADALNLMYPAGQQWRPKESTRLRVIEQLGFDPFEDLRPPL

SEQ ID NO: 7831 - protein, 122 aa, Streptomyces avermitilis
VESCPGVAHHHGMGGQMDTARLRSLIDGVLLTQYRRYTEKELPALCERLGLPSPSAGDTKHKRLVASLKACPDDRLPDVAEAVLEQEELDQAERMALLASDTKIARLAAPRAPRVVRRPKKK

SEQ ID NO: 7832 - protein, 360 aa, Streptomyces avermitilis
LASRQIRSAPARRPSTLMRMSHKSIHEHLLISARKWARTAVDAYLEEPIDQDFAVHHMAVAVEHASKAYLASIAPVLLASEKQPSVDDLLVLSGNEDKTKKGRAGLKTIGGEGAILRAAQLLGPGHKGPAKLKELRESRNGITHMGWGQPVTECRELLAAGIEHINALLKALSTEPDGFWGTHLEACTALVAQAMSEMEIRYHAKLRQARERFAETTRRLSEAEIAELASSLSALPTAHSSRSKTEARTVESGSLTHWDHETRAPMSCSTLSARVSCMMCGPARAAMRRARPRRSSAARRCEPPPHRARRPGQSDRARTGRRPGTSAERLPGPAHRRRLPRRKGSPRLRRERTQVRGRLR

SEQ ID NO: 7833 - protein, 132 aa, Streptomyces avermitilis
VQGTARRRAGERSADDVDAEGAGQGGQLVVVSLADRAYAPTFGRAGLRRIRFHNLRHSTATLLLEQGVDLVVIKELLGHAHIGVTATVYAHLRLRLQRDAIDLLGNALRNPDETAIRPDDGDGPPLCAAPVH

SEQ ID NO: 7834 - protein, 2364 aa, Streptomyces avermitilis
VAVRRARLVSVGFAGAVLAGLLSTVSVVSPIQAAAASDDPTPVVPSQSLGSVPAQQTEEVGKALPAPKWPSAAEATVDLSEAAAGEPGTVSPEPSASASGGVGDGESTQVGEVVEVAPVAEDLGTEAQLSLSRLADESTPSPSPSVSDGSEPSTPPTAEASPSPEPSESASDEPIQDPVSPDQVEVRVLDREAVAPAGGIGLGLQVSRTDGVDAPGQVQVDIDYSGFKYAYGADFASRLRLVKVPACALQTPDAESCADREFVPVDNDTDSGTLTATVTAAADTGSAGASAQLMREAGSSSASVYAVTSSSSSDAGDYRASTLSPTGSWEVSTGSGSFNYSVPIQVPAPPMGSAPSLAMSYDSQSVDGRTSASNNQASWSGMGWDLNVGFIERRYRNCTEDGLPTIGDMCWDSPNSAKEPDGAAYVISLNGTTSELIQDNNGSGAYHLKNDPGWRVQRLFDGHGAGRNGEYWVISTQDGQRYYFGWGRSERTSTATASVFTVPVVGNDAGEPCHDQFPEPCTQAWRWNLDRAVDANEVETMYFYDKEYNHYRSVANTDKAREYVSSGYVKEIQYGWSSQITDGKVPAKVELSHVNRCIERVQENDPLRDEPAACPAFDDKPGSYPDVPVDLMCDGTSADYNCAGKTYFPTFFSTDMLWDIKTYVSDQDGTGWDLVQQYQNKYGMPNPDGTIGKTLWLDYIQRKTYGDGDDIVLPVINFNRTDLDNKVGSAELNFPRIKEIHGDLGATTTVSYGFANACDIDHLPAQASNTQDCYWQKWTPEGETDSKTGWFKKFLVTQVQVDPTVTTNQDGAPVMTTSYTYEDGAGWHFTNDPLIKDEDESWTDWRGYQEVQVTTGAGAGQKTKKSWLYRGLSGDRTSKADASATKTVTVDDGDGNNYTDDSWLSGRILSTSLRDDTGTSHERTYHKYWDHNTAQYDGLPDARFVREKETTTNTKVSSGWREHTVETEYDDTEGASTTFGLPMRTDDWGQSSVSDNRCTTYGRAYNTDNYDSTGAQRWTVLQDQVKHYSVGCSSIADSKQDGYASTLYDNATSVDANKPVDGNPTESRTYTKSGSYRSTWSGYDDAGRVMWSEDGSHNRTLTKYSPANTWPLNGVIVTTPDPDGALPAHTALTSTAWTSRFWGKPTSIQDANGNVTKMSLDAAGRLVEVWRPTETGSSPSMKFSYTIPTSTNSAGVPDAVDGYPHVATHVLQSGTTYLSSHAYVDGLGRARETQTPMGNGVDAATGNEVPNRQVSVTRYDSAGNVTGTSAVFRNQGTAGSGGPSSAKVEDLPSYTDLVLDWAGRAITSRLQVNGASQDAGRVDTTYDGDFTSVKNKVDAAADTYTDVYGQVSKVVEHTGSATYTTAYTYTAKDELIKITDPRGNDTSYTYDWAGQRTATDDSDAGVSSTEYDKNGQISKITSNGGKTVLDYGYDALGRKTAVRSGDTELAAWTWDGLNITGGKGQITSTTSRDTNGNTYTTKTGEFDVRGRPLKTTVTIPDTVKGLAGSYTTGFTYDAADHVTSVAYPAAGGLPAETVNATYDGYGRPLRLQSALQTYIRSTGYDAYDRLTDRSYGVDSVLPGIGAAAQRTYSYDDSNGTRELKSVATTTTLNKVVSERQKDTYTYDLAGKLTELREQASGQTAQSQCFLYDDQARLTNAYTHTTTGICADKTKTASDFKGTAPYQTAYTYDRLGNLQSITNTDSAGTATLHDYLYPGYDDTGTWTTANANQPHGVRKIDHKTGSTTTKSDQLYYFDDGTMKQRVEPGITTDYTWTPQGQLEAVKTTKSSGSELTRYAYDADGNILVRTTPQETVASIDGMELRTTNGTTVTATRVYASGTATVAMRTTEGTTATNGKVTYLMADTQASTQLAVDASTGASTRRRYTPFGDERSGTLPTGTDNGFLGKTEDTSTGLSLLGARAYDPNLGRFLSPDPLATPYAPQNLNAYSYATNNPISYSDPSGLCRRDICGDGYPVAGDGERAGYTGQHPGEHACTSCNSGNGGYLLAGVVPSDWDKAQEFYDRVAEIIVSWPAGWTDWNYKPHEDPLADLRVGQVVYNACEDVGGCPDGIDPQRDMLNAAVAIELPGTNGRGSSKKAAGPCKCFLAGTDILMADGSTKDIEEVELGDKVQATDPKTGETGPREVTRLITTTGDKHFNKLSIATEDGAEELTATHEHPFWSPSESAWITAGSLEPGMTLLTDDGDTVIVTGNRAFTQHATTYNLTVNDLHTYYALAGTTPVLVHNSSCSTNAQILGDNMTAAGTIRPAETAAHHIVASASPKAASARAKLASVGIDINDADNGVFLPRGSASPNLTGASVHSRIHTNNYYGYVNDMMSGVRTANEARDVLNHIRNQLNAGYWP

SEQ ID NO: 7835 - protein, 175 aa, Streptomyces avermitilis
VIPRTFPPAPAWSPDGHRIKAELDYSRGPEKTWVYGALRVRDGQQITMTASSRNSVFYQQFLQQIEDANPTGELWIVTDNLSSHNSLSTRTWLEDHPRIHHAFIPVGACWLNLQEGWWRIFRKAALAGRSFANPDDIEHATALATSQLNSRANPWIWGRPAPPTRRLRRRYVYTV

SEQ ID NO: 7836 - protein, 191 aa, Streptomyces avermitilis
MVLRARPGRDEDERAVVRRLSRARKAPRDAVMRARMIELSWSGLRVPAIAGELDCSQKTVRCWLHRFNRSGLQGLDDLGGQGRKRRITEEERSRIISLVKTVPPGRLRWEPVGELWAFDESGPPEWTLDSLAAAARAEGVEVGRSQVRRILLAEGVRWRRTRSWTRSKDPDFVPKGQGSSASTPTRPTTRR

SEQ ID NO: 7837 - protein, 424 aa, Streptomyces avermitilis
VDAHEVNRARATLALFVADVFASVPRKDQRAKGDCYLRGLMLDGRRKSIQPMAERLPDGNEQNLQQFVNQSTWDPVPVRRRIAERMVAQIGPDAWAVDDVSFPKDGKMSVAVAHQYCGALGKQANCQVAVSVHAVSDTASCPLQWRLFVPQEWAHDAPRRQKTGIPPEVGHREKWRLALDIFDELAGWGLVPPVVVADAGYGQNADFRDGLDGRGIGYVAAIRSDVTVHPHDAEPFAPPWSGNGRKPQPRYRDKPSSVAALATGHGRQAFTEVTWREGSRGPMRSHFLSLRVRPAGVKSRRLAQAAATDENCWDGVLPEVTLLVEWPEGAEAPTDYWLSNLPDTLSLAELVRLAKIRWRIEHDYRELKHGLGLDHFEGRSWTGWHHHVSLVTAAHAFLTEQRLAPKAGTADSPSTRPSTPSRTC

SEQ ID NO: 7838 - protein, 154 aa, Streptomyces avermitilis
VSPHLDAVRVERVWAAGGVVRIAACTRELTVACPDCGRGSARVHSRYSRTLADVAVGGRPVVIGLSVRRLFCDGPGCGRRTFTEQVEGLTVRYQRRSPLLQHLVQMAGVLLAGRGGARLLQILKVPLSRTSVLFHLMRLPLPAAATPRVLVGLR

SEQ ID NO: 7839 - protein, 148 aa, Streptomyces avermitilis
VAIHALTHEDLPRLLLDDLDRARGRLRVRRPGRADHYIYLEEITTALATAWLRQPHHSWPRTTNPHLLVSRISATDPTKPMLSTEVTKTVFERAGLPARRLREDRIYDEARHTADPVHLMRLFGLGKATAMKYVTATHPDKRPDPIAP

SEQ ID NO: 7840 - protein, 706 aa, Streptomyces avermitilis
VRAWMATRAMISWLRASSTRVRRPLRVSLGSGAGSRGAVVRVMWRAGSRKILRSRRSARKSDRSGGWTECRRAASVPSRTAVMWLLVISRRSVIPSAAQAFRTGAYSRDPFCCFTTGQDLATFFDCHRLAFAHFGGVPMSIVYDRTKTVVRRHVAPGEAVPLHPEAVAFAGHYDFDVDVLAAYRPQGKGRVERQVGIVRDHVLAGRAFSSIEEINAAFAAWVPLRRAKVHGTHGEVIGHRAVRDHTALRPLPTTPYLVTQRHLRHVGKDCLVAFDANLYSVPARKIRPRQLVEVRATKSQVTLHSTIADRDGQTMLAVHPRAVGRGARIVDETHWDGLAEEAAAAVGVSQAAGCRWFCHGGGMPPMDLAPQSGRYLSFHEREEISILKAQGIGVRETARRLGRDPSTVSRELRRNAATRGGRLDYRASVAQWKADLVARRPKTAKLAANDRLRDYVQARLSGQVSRPDGTVLGPESPRWKGRNKPHRGDRQWVMAWSPEQIANRLKVDFPDDESMRISHEAIYQALFVEGRGALKRELVACLRTGRALRVPRARSKRKAWAHVTPEVLISERPAEADDRAVPGHWEGDLLIGLERSAIGTLVDRTTRYTVLVHLPRQDGYGVVPRTKNGPPLAGYGAVTMKDALAATIGTLPEQLWRSLTWDRGKELSAHAQFTIETGVPVYFADPHSPWQRGVGVQVNVALARFP

SEQ ID NO: 7841 - protein, 208 aa, Streptomyces avermitilis
VPLERIVSTALQIVDDEGADALSMRTLAQRLGSGTATLYRHFDNRAALVAHVVDRMFGAVELNGDELLAMGWQQALRTVAHTMFEALARHRNAARLLVEEIPLGPNAMALREHCVAALLDSGFPPRLAAHAFATLSRYVLGFAIQVNGHGGGGQLADAQVSAVFQSVDPALFPATVTVAGSMPVPIEDEFSFGLELLLSGLAHLRDDA

SEQ ID NO: 7842 - protein, 449 aa, Streptomyces avermitilis
MPVLIVIAIYAVRIARAPLDPRLKKRHVGPLSVTTGAVMLYLAWDWLRPEGLSAVYFVGEFAGVLSAYLMSCTLVLATRLMWLEQWFGGLDRMYRQHKRYAVWSILLLTPHLLLHFFSGFDGSQYGYAHRTASVGMGHLLGAVSAIGLLLLVLISLGQVGRILRLPYERWLFLHRLTGLLLLSALLHGWFLDLIINGSTPLLAIYVTMATVGMTAYAYDELVLRHREPRADYTIHRVERPTPDILDLTLTPTGKTALPVTGGQFVYLRVGGWHEHPFSVAGTQADGSVRLTIRALGRGTRGLYTDVSEGHPATLKGPYGMFDHTLGGPRQIWIAGGIGIAPFLGWLTHPGAEPAQTDLFYCAATAEDAPFLSELTAAAAHRPEFRLHPTFSRSHGRLTAERIQAEAGPITPDTHVFLCGPASMIENLTRGLHRQGVPRQHLHAEHFAFR

SEQ ID NO: 7843 - protein, 136 aa, Streptomyces avermitilis
VPDPSHNSLVTPPRRRHPGSTLMILTITLACLIALIFGASGVLNTLALPKARELAAETGFSVAAYRRIGVLQLAGVAGVVLGLAVPPLGGLAGAGLLLLLAGAVVVHLRQGDPVAKLVPAAVCAVLVASYLAALFA

SEQ ID NO: 7844 - protein, 89 aa, Streptomyces avermitilis
MSRTLLRGAHVITMTPHRPDAEVVDFSERIVISQPALDGCCATPWSTIPSAICGAEPTSRPASRRNSPAPGRGRGTLRAGMDGRRQAPT

SEQ ID NO: 7845 - protein, 525 aa, Streptomyces avermitilis
MNNPQAIDVLIIGAGPSGSALAIDLVRRGLDVRIVDRSPHAFDGSRAKGIQPRSLEVLEDLGALDDVLAGGDTYPKLGLHAGPIGVPWKMFPHKEATPDVPYPNTWLIPQFRTDRALHARLSELGREVEFGKELTELTQDEDTVVAKVVGADGVEEIVARYAVGADGGSSAVRKQLDIGFVGTTDESDRVLIVDASVSGLARNRWHMWPGLGGKLIGACPIPDSDMFQWMIRLTPDEKPPQEIGAIIDRIHSHTRNRHIQLHEIHWKSVFRPNIRLAEHYGRGRVFLVGDAAHVHTPAGAQGLNTGMQDGYNLGWKLGQVLAGADPALLETYEAERQPIAAGVLGLSTEKWGGIAKLDPSSMKRGKDEQQLSLTYYGGPLAPDGMRTGTLHVGDRAPDAQLLGADGAETRLFNLFQGPHFTAIAYGPGAARDLELLDWPTTGAQLKRLTVGSAAGGGRAFSDPKNTLQSAYGLTGDTLLLIRPDGYLGHIATRDFLTTTQAAVRAMAPQAKTRTMSQPSHTYPLA

SEQ ID NO: 7846 - protein, 301 aa, Streptomyces avermitilis
MKYFVASVEDRKLTADSRKALRGSFIELSDGVTHYELTGPEDGEVVLMAGGLTIPLFYWDGLVSELHARGLRTLTCSAYGRGYSDRVQARYDETLFTRQLAELTDRLGLTARPLHLVGTSMGALVSMTYAAQYRSSLSTLTIVGPAGLAKPQLTSPHRLLRNDWLADLIARRRGRQILQGHLGHNVRDPELGGKLTEMVLDAFRFEGSLYAVFDTLQHLPFTGRDDLFRRTGALGIPTLLLWGDEDDVTPLTQFDTARALLKPQKHHVINKCGHMAPYERPRDVADQLVPFVSARTERLDS

SEQ ID NO: 7847 - protein, 277 aa, Streptomyces avermitilis
MSTWSEPQPDSRFVVVDGLRIHYKRAGHGPALVLLHGSASSLQHFDRATDLLSESFDVIRSDLPAFGLTGPRPDRDYRVPAYAATVTGFLEALGVPCYALAGNSLGGNIAWNVALDHPERLTGLVLVNATGYPEKTVPAGMRLTRNPLVRPLLRRVMPRGAIERSLRESVGPSSQIVDDAMVDRAHQLMSRPGNRSAFVDFCNTDQPDRSAQIPRITVPTLVLRSASIDGQHFARDIPGAQELVHPHGGHLLPEEEPEWVADAIATFLGSCADTPAN

SEQ ID NO: 7848 - protein, 80 aa, Streptomyces avermitilis
MDTLLPIRWTCQAEAVVAGAALCLGRLLRDSPERDDAEVADQVAEDLLRMFGLPGNEAHEICRQPLPDLETAADRQGATA

SEQ ID NO: 7849 - protein, 353 aa, Streptomyces avermitilis
LKPRTATIRTKGAQYMTLRRVLSGLSAAATLGAAAAISTRRRALAAVPHELRHPVLFLPLNFGNPVTLAIARRLVPLVGAATRPGVRVERRTLPATTDDLPVGVLTYQASGQAPRAALLWIHGGGTVMGAARQENTWCSRVADELGALVVSVDYRLAPENPYPAALDDCFRTLRWLHANAAALGVDPARIAVGGESAGGGLAAAVVQRAHDSGVPVRFQLLLYPMLDDRTALRVDPPNSAIYTWTPDSNRFAWTSYLGRPPQDRDDRPYIAAARRRNLDGLPPAWIGVGDIDLFHDEDVDYARRLSEAGVACELRLESGMYHGADALLDGKAPSMTAFRTAALDALRTALAKP

SEQ ID NO: 7850 - protein, 412 aa, Streptomyces avermitilis
MTAPDSLPLHALAEDNLAAASPDLLRAMVKTFADALMSAEADALCNAEYGQVSDERVNHRNGYRPREWDTRAGTVELAVPKLRQGSYFPHWLLERRRRAEQALISVVATAYLLGVSTRRVEKLAESLGVTQLSKSQVSAMAKHLDERVAEFRNRPLDQGPYAFVRVDALTQKVREGGRIINVHALIAVGVNADGHREILGIDVATAEDGAGWLAFLRSLTARGLKGVQLVVSDAHTGLVAAIGAVLPGASWQRCRTHYARNLLSQVPKSAQPWVATLLRTVFEQPDTDAVQAQMRHVLDALEAKFPKAAAHLVAAQHDLLAFTAFPREIWRQIWSNNPQERLNKEIRRRTDVVGIFPDRTALIRLVGAVLAEQNDEWTEARRYMGRELLAKARLHPIESETDETELPTELTA

SEQ ID NO: 7851 - protein, 115 aa, Streptomyces avermitilis
VICVALLVFCLIERQVRRALSHDQTMPGLYPDNRRARPTGRMILCHLGELWLRDRHCHRPANRGNHPRRPGPSTRPPRHRSDPSTLATDLTDPPVKHGTTFMRLLPWNQLLPNAG

SEQ ID NO: 7852 - protein, 365 aa, Streptomyces avermitilis
VSAVDALSSDREEHCPVILLGVDPHKSTHTATAVELESNQQVGTMRIEASLTDYRRLLAWAKRWPQRKWAVENANGLGRHLAQWLIARGESVVDVPAAATSRVRELSRGGRRKNDQIDAAAAATVACLQGDGRDVEPEDHTTALALLDERRVNLAQARVRTVNQLHALLRDLLPGGAPTQLSADLAAKLLRSVRPAGDVETVRKDIAWDLVAEIRKLDKQLTDNAARMQSLVEASGSALMDTPGIGPVMAARLIGRTRQAHRFPTSAAFANYAGAAPVEIASADKARHRLSRSGDRQLNSVLHTIAVVQIRMPNSPGHAYYQRKLSEGKTAKEAKRCLKRRLADHVWRVMIADERKAKSLPAHGT

SEQ ID NO: 7853 - protein, 384 aa, Streptomyces avermitilis
VIDTPIRTYIAQHTDGLAVSGSAVYAFWQAVGLFGLVGGFFHSTGARITYSLWGAASVGMVWSASPADGRTVATGIAVLAWTIASVFALRGLSLRPVIHTAFQPHIALLGIAAPALLRSTAALRTGLLVLAASLSLMPLTHDSGAWWALRLIAGAASALVFMIATSAMLAGLAAHMTGWAFGGVGAGIALSGLMVVAVQQAGSWQTAWFACAVLTVLLTVAAWNLVPRGAAATAPAATAAAERPRTHRWFTALLTSYVLEGIGYIIAGTFLVAALQQGAPGWIGSGAWIVVGLAALPSCAVWMRLARLHRTHETPGHNHNLRSLPNPGCLCVLSSPMGREGLGFSLVGDHDAPHVVGQAAFQAPLRFLRRLTLREFALVVRVSG

SEQ ID NO: 7854 - protein, 645 aa, Streptomyces avermitilis
MMRTGSLLSVRGRDTLPIFVGLGRPRDVGGVSLSAAKDESPRDIWTLARRRRINDPLAITFVTLLLGGLVALGWVSGNVERVNTMWVGAEVAADGSVRVTEVIDYDFGYPDATRHGVYRDVPGLYSDQETAKVVATMDGHRVPWEFDAGDYYEEPDGRREIATRVKVGDPDRSVTGVHRYRIEYTLTDVVKNGKLAWDAVGTGWRVDRSDVEIHVVAPYDLTGTRCVQGTNGSEDGCTAKKAAPGHLAVTLDKLKGREGVTLYTSRGAKLTGAKPALPALPSGKAVGAAVPHPLWVGLLAFLFALACALVTVQLLRFLGRDRIAEEGTDGAPGRTRRVDLDRRAASLTPSLVPPEGLTPAQGGILLSEGVGHHHKVAWLLGAAADGHITVEGTDQHPTLRRRDPADAPADPVARVVFGSIFSGRDTCTLGWYDPQFRSAWESLTRALEQWQADSGLWDAAAARRSRLGRPVGLAATLLGFVVAGLGAWVGGGRNAVGWPILAVGLIAVSVGYALRRRSWELETRSPRGAALWLRTEAFRRYLADPAALQADEPLDEERMELYTAWAVALDVGQAWEKAIADSTTVPEHRSAVTSRIAPALAVGLLLHTARASTAPASSSGGGGGGGGGGGGDVGGGSGGGGGGSW

SEQ ID NO: 7855 - protein, 527 aa, Streptomyces avermitilis
MARRKQVDPTMALLETAIKATAKGGIGKLRQRSRGQVPYYEEYPALKRETWRPDIRAAVLANQRVGLHRKLMKTAAAADLYPTSIGTDAIVYPSPGPSPLDILPLTNEGKPVPGTFRLGVSLIRSAVRNADDTTDDRWSERDWQQAAQRAFTALGEQHRNSPGSVGCCWLPACARACAWPATTDWTSAGSSRRPGPASATPCGNPLAPPDTDSTGLDTAADALVELLSALARRQHQHRSRTVARLTTVINSRLLPDDLQHMALYYRAKAHRDLGDSPASRAGMQAVADSQGRLAPAARRGLAHLARMAGDFPTALTTAHTLGWEGRHHRVQGDTWWPHGDMDRAAAAYAAARDEAEHHGVTGERGNSQAHRAFALAFTDPAVADSELALAEQLLAGVDLRATTLITHIAALARDAGRTDADIDDRAQVLRAEIRTAGVTYTELALDLTLAFHHAVRNDQDQVATTIAWLRENTRSGAFPYYSEIAAFMAGLPLPQASSTRWIDDEPATRQRWHALVTNRRQHLHTQR

SEQ ID NO: 7856 - protein, 202 aa, Streptomyces avermitilis
MTIGRVWFAAGVTQDLEIVAFESAEAFQAWLGQNHAVSPGIWLKLRKKGPGIAALDYTQALDVALCYGWIDGQKAKFDDQWWLQRFTPRKPRSKWSKANRDKVAALIEQGRMHPPGQAEVDRAKADGRWEAAYDGAKTATVPDDLTAALTADPAAAEFFETLDRQNRYAILYRIQDAKKAETRARRIEKYVAMLAKGEKLHP

SEQ ID NO: 7857 - protein, 121 aa, Streptomyces avermitilis
MSITLNHTIVPAVDNEAAARFFASVMGLDYRGADRHFAPVQVNDSLTLDFMSVENPVGHHLAFDVDPSSFDSILDRLRTAGVPYGNDPSEPDNGRIDHPLCPRGLYFTDDAGNLYEVMSPR

SEQ ID NO: 7858 - protein, 396 aa, Streptomyces avermitilis
VDRCCGMGSPEGIEAALAAKFGTLFPHLDERQRRLAIGAEARSLGHGGIRLVARTAGVREGTVSRGVTELESGEAPLGRVRRSGGGRKRAVDLDPGLRPALLALVEPDVRGDPISPLRWTTKSTRQLAAELTRQGHRVSADTVAAVLREEGFSLQGNAKTIEGAQHPDRDAQFRYINDQAKDFQAAGDPVISVDTKKKELVGNYKNAGHEWCREGDPVRVRTHDFPDADLGKAIPYGIYDLAADAGWVNVGTDHDTAAFAVASVRRWWHAVGRDTYPRSHRLLITADAGGSNGYRTRAWKFELAALAVETGLEITVCHFPPGTSKWNRIEHRLFSHITMNWRGRPLTSHEVIVNSIAATTTRTGLTVRAVLDTAVYETGVRISDGQLNALPLSRHD

SEQ ID NO: 7859 - protein, 124 aa, Streptomyces avermitilis
LVTELAAARAAQREADLHQRRGGDRQKTPAVGLYTGRRPGLTLVDRLLATILYQRFKLPQVVIAPLFTVTPVTLNPAISQTRRLLHDIGHAIEPAETPLATLDDLIDLATHLGIPAPEIKTASY

SEQ ID NO: 7860 - protein, 333 aa, Streptomyces avermitilis
VPCSALPATGRPPTLAGSCTTWAPACWLVLWDKGFDANAFLAAVHDTGARFLGRLRANRRTPVLSRLTDGSYLSVIGTVPVRVVEAQITVIYDDCSFTNSYRLVTTLTDARRYPAPALVALYHQRWEHESAYFALRHTITDGRVLRSGDPVGVEQEMWALLALYQALRTVMVEAAESRPGTDPDRCGFTIAIHTARDLVVQAADVIKPGALGTRTTASSATGSWPGSSRTGAPASAPEKSGHRSPGTPNAKTTAAPTKAAWSPTLTSPSSNPIPTCPPSRTTIDTHRPPTGADSASWTSFTQNPTASGTLATSPATSATSPSARCTDSSTDGP

SEQ ID NO: 7861 - protein, 157 aa, Streptomyces avermitilis
VPGRSRGRLSVAGLLCYRPALPARLCYRLRRHTGRKGERRSLGESDYIHLLDGAHHLLKAPLIVVWDRLNTHISKTMKALVAGRDWLTVVLLPGYAPELNPVEDLWAHIKRSLANLAARTLNELETLLRRRLKALQYLHGILDGFLAGTGLALDRPN

SEQ ID NO: 7862 - protein, 542 aa, Streptomyces avermitilis
LPVQCSTVTLTSSITVADGIFAPGHLGELTQQLPFELVDDVLERAGGAQHRLRLLPSRVGVYFVLALALFPQLGYVRVWDKLTAGLRGILHRRPSEKALREVRRRLGVAPLRLLFETLAGPVAQPITPGVRYRCWRTVAFDGCSSTKAPDRPRVCAWLGKHKHRYGTDGYPMLKIMVLCETGTRALLGAVFGPTPEKETGYAEQLLPLLDGGMLLLNDRGFDSDDFLAKAAATGAQLLVRLKGTRTPARWALLPDGSFLTRINGTRLRVIDAHIAVTTAKGLRLEGHYRLATTLTDHRRYPAVELVELYHERWEIESAFYSLRHTLQCGLVLRSQDVAGIQQELWAHLTVYQALRRAMVEAVETLPGTDPDRASFTVALETAKEQLITAANVLPDAGPGRITSALLHDLLPPRQARVNPRRVKCPISRYAAPPDQAQAFGASRITSIAVTVHSSAGTGSDGRRDHTLQLLRTNPLRTWRACEIARGIGLDDARGLRAELGRWVREGILRRTGRGIYTLEPEWITPDLHHPSVPPHLTTADRP

SEQ ID NO: 7863 - protein, 92 aa, Streptomyces avermitilis
LRERAVRMYRTADPKPQIKKLAVDLGVHPEALRGWIRQAEADAGERDDRLTTDERAELAALRKENAQLKRANEVLRTASAFFAAQLDPTRPR

SEQ ID NO: 7864 - protein, 305 aa, Streptomyces avermitilis
VTALLDEHPHLGVECVLRELHLASSTYYRWRHAEREPCERRRRDAELTEQIKQIHTDSGGIYGSPRVHAVLKREGVHVGRKRVERLMREADIAGISPRRKGFTRRDPKATLAPDLVERDFTAPAPNRLWVTDLTMISTGEGPLWLSAIRDAFSRRVVAWETSARADADLVLTTLEYALASREVEPGQLVHHADHGCQYTSVKLTTRLVRAGVEASMGSVGDSYDNALAENLWMLIKTECIRGRTFTTRAEANLALFEYIDGFYNSRRIQKRLGYLSPVEFEEKHYADQATAERTNLKPRQPALAS

SEQ ID NO: 7865 - protein, 165 aa, Streptomyces avermitilis
MRYPDGGGLTAEQRKRREEVRMRAADLFEGDVKVPCIARELRVSEKSVYQWRRAWALNGREALRSQGPPGYDCRLGPHLQAKLATWLDEGPAAHGWRDDQVWTAARVRTLIGRKFHLSYSISGVTRLLHRMGFSVQMPARPAAERNEDAITAWREATWQEVKPSG

SEQ ID NO: 7866 - protein, 302 aa, Streptomyces avermitilis
VTNNLDTLATALYARIDDELKASPWLAPWRPAIGITPTLSDAELITLAVMSALLGYTSERRWLRRVGRDFGHLFPYVPQQSGYNKRLRAAFSLLTSMIRIVARDTSLWSDDVWLVDSTPVGCGCSRETAKRSDLAGWAQYGYCASHSRYFWGLRLHLVCTLGGLPVLFALTGADERETLRDMLDTAPDVLAAHPGQTIIGDKNYFGREFERGLAERHLKLLRPARKGEAEPTGSHLFKPLRQVIESINQTFKGQLNLERHGGKSPAGVSARVLCRILALTAAIWHNDQTGQPIKRSLTAYDH

SEQ ID NO: 7867 - protein, 312 aa, Streptomyces avermitilis
MDVTTLYSIGELSRRTGLSVRTIRFYSDSGVVAPTTRSPAGYRLYDLDALLRLELLRTLRELGMDLATIQRVLDRELSVAEVAAAHADAMDVQIRTLQLRRSVLRVVASRGSSPEETKLMHRLTQLSGEERRRLIDDFMDGTFGTVDADPAAVAMVRAATPDLPDDPTGEQVTAWVELAELVGDEDFRARMRRTAVRQAAGRPLDIECDAGEELMEFTRQKVAEAMEAGIDPLNDRGAPVIDDLVHRFAEVLARTPDTEFRDWMAQQFEETHDPRVDRYWQLVWIVNGWHVVPNLIPVYPWLIQALRNSRDA

SEQ ID NO: 7868 - protein, 384 aa, Streptomyces avermitilis
MLDGRRKSIQPMAERLPDGNEQNLQQFVNQSTWDPVPVRRRIAERMVAQIGPDAWAVDDVSFPKDGKMSVAVAHQYCGALGKQANCQVAVSVHAVSDTASCPLQWRLFVPQEWAHDAPRRQKTGIPPEVGHREKWRLALDIFDELAGWGLVPPVVVADAGYGQNADFRDGLDGRGIGYVAAIRSDVTVHPHDAEPFAPPWSGNGRKPQPRYRDKPSSVAALATGHGRQAFTEVTWREGSRGPMRSHFLSLRVRPAGVKSRRLAQAAATDENCWDGVLPEVTLLVEWPEGAEAPTDYWLSNLPDTLSLAELVRLAKIRWRIEHDYRELKHGLGLDHFEGRSWTGWHHHVSLVTAAHAFLTEQRLAPKAGTADSPSTRPSTPSRTC

SEQ ID NO: 7869 - protein, 193 aa, Streptomyces avermitilis
MSDRNTLIRSLHDVGLAAWFGGSLMGAVGLNGAAKDQSETARARARIASSGWAKWTPVNAAAIGAHLFGGGGLLAVNAHRVAAQKGVGASTTAKTLVTAAALAATAYGRVLGKKVELAASSDPQDAKEAARHPIDIDSAQRQLAFAQWAVPALTGCLVVLNALHGEQQRPEEQLPGMWERARSAATPFIPQHS

SEQ ID NO: 7870 - protein, 412 aa, Streptomyces avermitilis
MTLAGTLAAAEAAAPVESLDVVARMLKEHLGAASVSFLITDFTGGSVVRLGAAGSVETDEPAQRITLRGTLYDDVIRTQRPSVEAKGQGALVRIVAPVTNRGDAIGLLELFLPAAPDAEVMREIGETAHALAYIVIANRSFTDVYQWGRRTTPLSLAAEIQHRLLPASLACEAAQFAVAGALEPADHVGGDTFDYVIDRDTVQLSVTDAMGHDVDAALLATLAVGALRRARRAGADLAEQARQADQAMREHGHKGYVTGQLLRISLIDGTTEFINAGHPWPLRMRNRQVREITPKIDMPFGFHAPHSYQVQSLDLRPGDRLVMLTDGMLERNAGSLDLSDLIIRTRALHPREAARTLIAAIVDANDGHLQDDATVMCLDWHGTNHSQRDAATGADLTDASRPSRTGRTTPGR

SEQ ID NO: 7871 - protein, 266 aa, Streptomyces avermitilis
MIAEDTQPPAHGREFQPRPDTTDALSTPVVDAPASATGQLAARQPAAGLEGGVERATAALKPRLRGWLHAGVFPLALVGGIVLIAVSRSAAAVAACSVYALSACLLFGTSAVYHRGTWGARGEAVLRRMDHANIFLIIAGTYTPLAVLLLPGGEQLVLLAVVWAGALAGIAFRVLWIGAPRWLYTPCYIVLGWVAVFYLPDFARTGGTAVVALVIAGGLLYTAGAVVYGLKRPDPLPAWFGFHEVFHALTIAAFTAHYTAILLAAT

SEQ ID NO: 7872 - protein, 110 aa, Streptomyces avermitilis
MTADNPHNRLDDDDYPAYTMGRAAELLGTTQGFLRAIGEARLITPLRSPGGHRRYSRYQLRIAARARELVDQGTPIEAACRIVILEDQLEEAQRINSEQRRAAARHTAGV

SEQ ID NO: 7873 - protein, 98 aa, Streptomyces avermitilis
VDFRPGPSLPPWWRTRPHCVLVAGARYSREIGEVCVCELPPAFDLSQPTISHHLKLLRQVGLIDCERRGTWVYYWVLPGLLDKLAAFRRVGRHPWWHA

SEQ ID NO: 7874 - protein, 255 aa, Streptomyces avermitilis
VSMVGGQWPGAVERLAQQLGAAQAADRRVKEAKATAARQSPSSTGLERAEYQRRLRAHVQTPEHKAAAHAISVAVALMKAHDAALLRSAHTLLARRANGQRLPRRLPRPLVLPGGYAPQWWISSIDSTYAGIWRAIPSPGPELRLGSPNDPLVQEVAKQARLLQASRVGYRGRDDLYEAFHPDGTREGGEPVPPIRGLSPETSRRTNLALGRGDGIRIQPSRMEEAGQMHTDYFAVWDRSRAYAAAVLALLRAHA

SEQ ID NO: 7875 - protein, 101 aa, Streptomyces avermitilis
VDIADAQKLAWENKINQGFNTTDIPLEFGLLNAEVGEAFTAWRKGLPDHGEELADVFLYLVAIAEMQGVDLGEEVRREIEKNARRVYTPGVGGALVRTGGE

SEQ ID NO: 7876 - protein, 231 aa, Streptomyces avermitilis
VCMEIGYATARGVPVILLTTDFQDYSGTPAGPGTVFPDPLLDILATRIIRAPRLGAPPDLPGSSRFADFAARNHAQIQHAIEVRVDAALQLPVPASSAVPSRTGSTVYAESSPYTPAHHKLPGTGARPGITVRRPTRFAATDPEAATRADWAAALSSDRIVVDACGPETPPNAALLIGASCATAQPVAAYLPRSTYTHASGREPNHRNLMIQYGVGHTLRSAEEVTAWIGP

SEQ ID NO: 7877 - protein, 102 aa, Streptomyces avermitilis
VGDRDEGADVAEPVAVEFTAPASSSRSTAYSTTAWRTRPTRRVTHTAVPRLYAEMVAKDRRLRLAGYEIYRFGGFELTAPGGEQILAAFFTELLGRHRKPPL

SEQ ID NO: 7878 - protein, 135 aa, Streptomyces avermitilis
LREEAEQVQAALGASERALQRLVDARATVAEVLAEPPSVVAEPVSGAVAGAVVPRRTGDMAASVLAPDYQQILSVLESEAGREGMRCQQLAVALGLQAVPAKVEGLRSKAKRLVERGWALQVRPGVFTALAMPTV

SEQ ID NO: 7879 - protein, 102 aa, Streptomyces avermitilis
MNAWRMLAPEIHPTPKSTKHVGRAQVVIGGTARETQVRFDAEARAWATTGPTTTAKNRAAVPAQPGPTQLQKPTAPAALPVRSDSSRRCRSDWDKAIGHLQG

SEQ ID NO: 7880 - protein, 104 aa, Streptomyces avermitilis
MEGRRRVRVADEVGIDADPDAIGARLLILLEEVNATMRQLARYWDKIRESGDPKTSPAIDALMEILFMGRRVRMHVFLVAQSATARALGGQEVREQFTTRILAS

SEQ ID NO: 7881 - protein, 78 aa, Streptomyces avermitilis
VRVGCASASCSGTTHSRINSRRSRDSSPYAMPPTARAEAAPIPPVSSVARVASPVLPKVLEGVREVATSRPRRTPKAR

SEQ ID NO: 7882 - protein, 126 aa, Streptomyces avermitilis
VGCPTARGARAADTHLRFSRDLVADLITQKLALEGVTFSWHPAERKPYVLVKKTRKSPAEAAFKDPKVRDLVAKAAEPAPIIGSGGKPVSVDLDADSPHILVYASTVGGKSVILRCIACQMIHRGS

SEQ ID NO: 7883 - protein, 206 aa, Streptomyces avermitilis
VRLFADHVSGPPSAERFAGPLWLRERPGGLNEIEWRLRPGLPAFVLYHARMTSSMSLLLACCGNAFDSTLAAMREGTEEHLPKEMAKHWTSFAHMVANGQRGDLSDLGITLVTDPVDGVKGGCVATIVSPRGSESELKDALTRVIRGAASAIGEGVEAAERSPRIHGLLAAQSDHAVLDDRLETIAATGFRFGATRSLLDLDWPTE

SEQ ID NO: 7884 - protein, 532 aa, Streptomyces avermitilis
MNTVGMAVSLLHQRALTDAAAYRSGRRRDKDVARRITGAMMRYEAFIALQRPLAEGLALFAEFDLSSFGTLPRLCPVLARVADYFGPGAIASFEPEEHQDAVTRNVLDVILGSTRRQRQVVTRRCDVLVRPADPEDGGYLPGYLLVKALWSAGIGVDARLGDPELFFSYAIEYLYTDLGLIAHLLDEDDNQRAVDKMIEYFVRRVIDFGRADHAANLDEFLASHRDRKMYTEFDAWARHSNRRWNVDDATADLGADRLIALHDETLEHAPDEDLVRNIALMFQRTVLSLGRHPVTVTVDERDRYTVTDGEQSVMSGTYASGLPVGTVVDGHVDVSIDAHTGCAAIVLSIGDDAPVYWFSDDASEDWRHSFQVARAALSRAEGEGEELLTLLRDVAKEASGVIYPLEIARDRATGATKVFTRLAAAVLNAAMANRTPDLDAVARSAAILEPAGLAGVFDRIRYVRALAWGGLVMSTGALPDVDTARRLFEEDRDIHRVAETFDEAMDLIRRTGVDKLGNPLYTVRDGRPVFIL

SEQ ID NO: 7885 - protein, 233 aa, Streptomyces avermitilis
MTWLDLPPHSRCSNCNRKFVHDGRRAVCLSRLNALLPPTPTASSPSTRSAPNRATTCAKISSLTRPRIAVARSLSVQRAGSSNEPSTSRFNAIRQHRAVRCRSAVRCLETSVSATKVRLPGLSRSDALELGEFVDRGAIAFHHEPVPEGSFGDLGVVTVVVAASAYTLKGMVSYLLYRHRGTSFEEVVEIEHPDGRIERRTLKWRDTSSESIDSALAKELASATGIPWDQDGR

SEQ ID NO: 7886 - protein, 285 aa, Streptomyces avermitilis
VIVSDAGYDVTCLAWVLRDLPVEMVGRVRSDHVMRLPKPPRVHGVNGRPPKHGPKFRFTKPETWPEPAITTVTDTTNYGKAETQAWDRVHPRLTHRSSWLDHDGELPLVEGTLMRLKVEHLSKDRDTPPVWLWSSKTGATPDDVDRFWQAFLRRFDLEHTFRFAKQTLGWTTPKLRTPEAADRWTWILIVAHPQLRLARTLAEDLRRPWEKPTTSDRLTPARVRRGFRNIRAHLACPTRVPKPRGAGAGRPPGAKNKHRAPRYDVGKTVKRPETLKAIGKPGRSW

SEQ ID NO: 7887 - protein, 377 aa, Streptomyces avermitilis
VSTPTATRLQAADADVTVLSNTAFVTDWSRRYFGPWWNAFEVPTSSVCAGPLVTADVDEKAYADLAALLASVPHSEATYAKARLLLARDSTGTITAVSPDEQLAYRSEQLGGHVTISGHAPQPVALAASRIAREMIRAALLRDGWTLLHASAVVRDGRALLAFGDKGAGKTTTALLVASRCAQLLANDRVFIKRIGADLRVLPWPSAAAIGLGLLDALGLYDVVRDRLQAGEHLHPTQHQDVTDALLAGRREPLWEPGGKRERKVQVFPDQFASWFGMELATGGRAAALLFPRIDPAAVPALVDGERTLGEDDFMSGATEDRYPDHFGLAHGIDGGGSDLARATVAEHLAALPHHQVVLGHDVGANADFLAKLSDSP

SEQ ID NO: 7888 - protein, 303 aa, Streptomyces avermitilis
VGSVGVVGAGAVGQTVAATLVASGICPRLLVVSRTVEQARALAADLDDMRQTTGSPVQPEARRVADLIGCHAVVVAVRAAFTNTRAADVRMGGALTNAPVIRALATTLRGYQGTVLVVTNPVDLMTRLFAETSGCPRVYGIGSNLDSARYRLTLAHLLDVPATTVHGHVIGEHGDGAVVCASSTTVNGTPAAVPLAEVRAELRTRPGQISAGVGRTRSGPAGAVLSTLRKALGLVDGTEELTAEHRGDWLGIPLRFTAGQPVACLPALNADEDAQLAATATKLRDAYQALRPSGPTPNSQETT

SEQ ID NO: 7889 - protein, 451 aa, Streptomyces avermitilis
VHGSSRQVGRSSTGQPGAPPQPPCAHPPGAPGGIHPLPLEAYVSTTAVSTSPGPVPPVPDADEVFAFAAREIAAAAAGLWPRADVDLGDHVPSVTGYVRRIRVDGRTLYAKYAFLGVSLVSLLRGACGPWPDVRAAQQAYVQRPGALMDREAAQLRLLAQLDSPRVCPVAGLARGVLFTESVTGPTLADLLLQRPHDAADLLEGLFGELRRLHRPSAARLLGPARGIGEHSIRGTFQRKFNGLSGPTYVERLGAERCAPGDRALVVGLLRDVVVRLHRLQATGLPQQASRRVLAYGDLKPEHVVFPEGTSGQPVFIDPGLLLAPPTVDAAKLISRTVLLLAAARPGAGTGQQAMRGVGAFAAARADVLPARVRRSWLRELLVLWLMDSVNILTTYLSAPGVLPMPGRGSALIGRAVDLCRMADQLSSELAAGADTRAVWESALGLAQAVAA

SEQ ID NO: 7890 - protein, 78 aa, Streptomyces avermitilis
VSTKRSLLHRDHPWIGRDVEDTATGRRGVLRAIAPDGDRPRPVAWLLPAGGGMEWTTDPGALANPAPLTADMHPKEER

SEQ ID NO: 7891 - protein, 135 aa, Streptomyces avermitilis
MTRTPDTRENITVAASASAAVLYVCAERSKLTPTLAADRAEAEGRDFAEARGLTITEVVTDPYGDPDPCHRDGWLRVRELAESGAVRVVIVRWPACIAPEPSHELRHREIRWLQDHCVQVRYSWEPLATGGGEAK

SEQ ID NO: 7892 - protein, 446 aa, Streptomyces avermitilis
MARRPRTPNAALAALMQSGGIGNAQLARRVNAAGRELGLRMHYDKTSVSHWLAGSVPKLEARPAVTEALSRLLGRPVTCAEVGWETEEKPAGERDFVAGVIDLSRADMDPTRRGVLKTGMYAAALAVPRYEDVAGRLESATAGRTVHIGRSDVETVRTMTDKVADILDQVGAGHARPMAAAFLVNTAGPYLRASGTDEVQRDMRAAVADFVYLTGWMAMYEDQQGLGQTYYLRALELAGAAEDHVTYCRTLRGMSLQATHLGHGKKGLELADAAAEAAPSAGPRLVAFLCGQQAAAAAMTNARNTALARLREAESALSRADDRRDAVGGYDQAAYFFHEAHVRWHLGDKDGSIASLRRSNTARSPLERQGRLHCLGVTAERQFRMRHIEAACQTWGTFLDEHVTISSARGDEHLKTMLKALPAYRRVAGVRELEERARHVATLKTA

SEQ ID NO: 7893 - protein, 429 aa, Streptomyces avermitilis
MGYTAVHPVWGRLDASMDDLGCDRAWTDVHRVKGLRLACPECGGRVFARASQHVVRHFYHQVRPPDCELANESPEHHLLKLELVVAARAAGWRAELEVSSEVRNWRADVMVFDEHDRPFMALEAQLSPMTQDEARMRTDRYARDGVAVCWVALQDRPWERVVPSLRVRSPRRRGETWTVWHGMARYDWAPRTLKAKAKWVHITCPLGDAIRWILDGRVHAHTGANGTVWWTAPAYEDLVLARAQMEAEAEAVRRVAAAERRRQEAEQRAAAAEQHRQDAERRALEWQAELLEWQAELQRLAGFFQRTGLDATVWEAFTQMVRSASGKAIMYGDQSPAHGNGLLVYARPRWTGDGFTLAGVVCPDLEALIEWPAELTILVPNQTWLSRIQAAARSPLKVAVLNPVTGRSTFIRVTAPDVVPVRPNGPDRG

SEQ ID NO: 7894 - protein, 274 aa, Streptomyces avermitilis
MYAAARQPEGEGQAAESRATGVYRERAERRRRTRGTGEARGDGWQRTEEDEQLLRLATRYSTLTLHQAAYACWGGRIEAARRRVRLMVEAGLLHRLAVADVGIRLESEGRTVLSEREVHAAEAVPGRAAELLADLGVHQVPVGVRRGEILAVPVGARAVHWPDLVVVLPGGRLAAFEVELTAKPAAALRTILRAYKQARRPVAYLATEPVVGQLQGGPGPGGRWVNGVAQELELLPPGGPGPGADGHLQVRPFTAVDPAVARRTAQQAARLRGG

SEQ ID NO: 7895 - protein, 462 aa, Streptomyces avermitilis
MPSPPRSTTDPPSILTPSLSRELPPKEQRPPVTVSARAVARASGMGRRPSAAQRRLSTTLPAADQQRVISMPPQDLRFRSGGDRMQHLSTPLARTLGAAALLSAAAAWGAASIRYEADGPRLDVLVPLALAAVFVVGWLMASRSAPPVKLLPSTAPPREKVPGKLGAVRRDWGLVAAAYLTVWAPFAAANSAYGGRGSQLGALYCLLTFIVGAVLSLCNLALLQSNLGRSQRMLKEDAAAGSVHAIRVRFGTPVLEMYRYPTGQGAGRIAASTTYGVELVHESDSGEQRTIRLRAMKAAQSDKVGDKHLTYAASQLVGHGGWLCWPARWRDIAGTNKDLKVPAAFASDSGHVVWGEMQQDDYAYYLRDGAAPLCETDPRLAVAPLPRPSRYFPKVHASHLRVAAVGALLAVPFLLDAVPYWAGLLLGVVSGALGLLAGMTMDGVGVDQEPWTVRTTSHPSLQ

SEQ ID NO: 7896 - protein, 412 aa, Streptomyces avermitilis
MTAPDSLPLHALVEDNLAAASPDLLRAMVKTFADALMSAEADALCNAEYGQVSDERVNHRNGYRPREWDTRAGTVELAVPKLRQGSYFPHWLLERRRRAEQALISVVATAYLLGVSTRRVEKLAESLGVTQLSKSQVSAMAKHLDERVAEFRNRPLDQGPYAFVRVDALTQKVREGGRIINVHALIAVGVNADGHREILGIDVATAEDGAGWLAFLRSLTARGLKGVQLVVSDAHTGLVAAIGAVLPGASWQRCRTHYARNLLSQVPKSAQPWVATLLRTVFEQPDTDAVQAQMRHVLDALEAKFPKAAAHLVAAQHDLLAFTAFPREIWRQIWSNNPQERLNKEIRRRTDVVGIFPDRTALIRLVGAVLAEQNDEWTEARRYMGRELLAKARLHPIESETDETELPTELTA

SEQ ID NO: 7897 - protein, 758 aa, Streptomyces avermitilis
MSEANPLKRAARKITNSLQDNGATPEEGIPGRPGPESPSVAEPTEPRDPLPPKPDQSGPDTVSPTGQPTGADQARMAQSGSYLTTAQSTRLYDTDHSLKAGPRGPVLLQDHHLREKVMHFDHERIPERVVHARGAAAHGVFQSYGTAASVTKAAFLSEDKETPVFVRFSTVLGSRGSSDTVRDTRGFATKFYTSEGVFDLVGNNIPVFFIQDAIKFPDVIHAGKPHPDREIPQAQSAHDTFWDFVTLHTEATHHTLWNMSDRGIPRSYRMMEGFGVHTFRLVNAEGATTLVKFHWKPKLGVHSLVWEEAQITNGVDPDFHRRDLADAIEAGAHPQWELGIQTFPDTPDQTFEGIDLLDPTNLVPEELAPVQPVGLLTLMRNPSNFFAETEQVAFHVGHLVPGVDVTDDPLLAGRLFSYLDTQITRLGGPNFPQLPINRPHAPVNDMLRDGMHQTAVHRGVAPYRPNSLDGGCPFLAGADTGAFVETPVRVPEAAKVREAPESFADHFSQPRRFWLSMSPIEREHIIAAYTFELGKCYEQAVKERALQVLANIDPNLCAEVATGLGLPAPQPTVPLAEVEASPALSQVGGTWPTDGRVIGIVIGPDGDLRGVSAVREAVLDASMVPLVVAPAGGVFGSGEGMVTVQRTYATARSVEFDAILLAGTPGVGGDAYGARDAKAFPAPAQQATGDPRVGLLVSEAFRHGKAVGAWAGGEAFLEASGVPLDAPGVVVGDSGTGALAQLTGLLGKHRAWDRFRAV

SEQ ID NO: 7898 - protein, 155 aa, Streptomyces avermitilis
MQTFLPFPDFAASAAALDPRRLGKQRVEALQLLRGLMVPGYGWRHHPAVRMWTGYEEALVRYGLEVCCVWTAAGRADTCAGSLMTDFTAHRADVGVRTQERLAADGELPPWLGNPAFHRSHRSALRRKDPGFYAPLFPDVPEDLPYVWPASDRSR

SEQ ID NO: 7899 - protein, 707 aa, Streptomyces avermitilis
VPDAASTDFPAGFGPEALESVLLQFARESGASLSAIYLLSPDEPALQLAVLSGISWRIAVPWARVTLEAATPVADAVRERHLVWIGSEEERARRYPKLALVLPHPFALAAAPITTGPTVWGGLVLHWPASHPPTLSSHERDAIAGVCERLGVIMRQAANSGHPVVPGLEPRILPPSQTRTAGHHEAQAAVGFAERLPDGCCALDVDGRITFITTAAADLLGVGVFDLLGARPWEALPWLDNHVAEDRYRSAALSRLPTSFTTLRPPDHWLSFHLYPDATGISVRIVPNPSAHTPDPPRLVHPAPPVEPGRANALYSLTHLAVALTEAVRVCDVVNRVADQVLAAFGARALALMTAQEGRLHIIGYRGYTADLMDRFDATPLTADTPAAHVLTTGIPCFFASFAELKRAHPAAVLQDGMASWAFLPLITSGRAVGSLVLAYDQPHLFTPQERAVLTALAGLIAQALDRAHLYDAKHQLARNLQAGLLPHTLPRIPGLEVAARYLPASRGMGIGGDFYDLIRLDETTAAAAIGDVQGHNVQAATLMGQVRTAVHATAGAAPGEVLARTNRLLTDLDSGLFTSCTYIVLDMTHHHACLATAGHPPPILRHPDGHVEVLHLQPGLLLGIDPAAEYPTTEVSLPPGTVLALYTDGLIEAPGVDIEDAIHSLANQLAHADTLSMEAIADSLVDHARQSAFRSDDIALLLIHSR

SEQ ID NO: 7900 - protein, 509 aa, Streptomyces avermitilis
MSGRRAALRLGQGGAPSATGARPGHPAVAADRYRPGEPAPGRPAGLARDRARRAPGQRLPRAVGLGRARDRVGKHPRARLLVHTAPPHGIPSRIGPLAGCARVDLSRCVHRDAGQRDDRQRDPGPRRRAECRPVLADMVGLVYRRCDGRTGGDAGPARFALSTPAEGRSAYPLGGGAAAPRSHLLHRFPGDRQHTPQVPRLPEPIWAAFRFQRAGAAPCALAVSTFAVIVACLLTATAGYWVLGRGTPRPNGTWAMGALLGSFALIFATYAPLFENAVEGVVPHVARLMSNCASLAAATAVLAVSFQLNLEPAEAQRRVRPRLVLFATSALGMTVLFTYEQMTHRSPQVYALYLLLFISYLGFAIVDFLVQAVSQSRSTRRSSVRIGLRMAAAGCAFTLVYAVYKLTVLISLGLGFHLVSDHSGCSSLVSTPCVFSVTSPALAALLICVGRTLTAVVYPVSQARRRRWEAQSFEALGPLWQDLSAAMPNIDPDFTRPLRTTPTSCSNVG

SEQ ID NO: 7901 - protein, 465 aa, Streptomyces avermitilis
VSLLHHDARHEAFDFTSHFREDLYTCLTRRGDTLFELCDAMLCEDGPVTSPVDLTLLAEHRRGHGALYDALNQGRIDAVRLRKALAMLPQPKAADGRLVLAVDVSAWLRPDAPCSPDRLFCHVSGRSGRSSDQFIPGWPYSFVAALETARTSWCQLLDAVRLGPDDDVAEVTAAQVRRVVTDLIGQGQWEDGDDDILVVFDAGYDAPRMAYLLDSLPVEVLGRMRADRVMRRPAPSPKEYAVSYPQGGRPPKHGKEFRFARPDTWGDPDAETVQVTDRYGAAKAMAWDRIQPRLTTRSAWIDHDSELPIIEGTLIRLQVDHLPGGGDPLPVWLWSSKTGMTSTDVDLRWQAFLRRFDLEHTFRFVKQTLGWTRPRLRTPEAADRWTWLVIAAHTQLRLTPARVRRGFRNLRPHLHSPARAPKPSTPGLTTTAPALFSSCRVAAAASSGPRTTVPAAGPRPRSRAS

SEQ ID NO: 7902 - protein, 729 aa, Streptomyces avermitilis
MRCMLLKAGVCGSAAVLALVTSPIVARAATLEPRIDLKVLVVDDGGPATGAITAELDSAGTPYTRVKLADSGRPQINAAFLSDTVSGRPRAKYQAVVLPNDNPFGAGSAEMATLATFEQTFGIRQADAYTYARPEVGLNYAQSPGYIGSLDGTTAQVTSAGNSGSFGYLAGSVPFEDNAPDVSESYGYLAVPLAQQQAGATFTSYVDAPIPGSSARGSLVGEYAHEGRRELVVNFVYNQYQEQYRLLSRGIVEWLTQGIHLGADRNYFAVHVDDVLLGDDRWNTSLNCTPGDVDCTPGGGATPDPIRMTAADAQYAKQWSAGHGLTLDMVFNGGGSEDYKAEHGGADPTADQLIADKSAFRWVNHTYQHPFLGCVQDVSVVPWKCSTDASGKIQWVSQADITSQITQNRTWAGGKGLALDNTELVTGEHSGMKVLPQQPDDNPNLAPSLNATGVKWLASDNSRDPQQRQIGSALTAPRFPMNVYYNAGHATEEVDEYNFVYTSRANGGSGICEGSSTTTCLSAPLDPQTGYTSYIVPLESRIALGHALSNDPRPVYMHQSNLAEDRIAYPVLDKILGDYTSLYAANTPLVNLRMKDIGTELKYRAAWAAAVKNNQVTAYRIGNTVTISSPNGTQTSATMPAGTTQKQLIGSTAFGAAYAGQLSGWTTPGTLQTSITLQLTTQATPAAPTGTGTGTGTAKVAAPAPALRVPSGVASPVPAGPGDTARRKR

SEQ ID NO: 7903 - protein, 560 aa, Streptomyces avermitilis
VINGHDGTTGTRRAQPSQRARRDTGIGGYGDLAVTDRTRPAFGDTPPSGTARAIAAINTGTTRVTMLTEGTYPHSHGGVSVWCDQLVQGMPDVNFQILAVTSDGREPLTWETPAHVSKVVSIPTWGPTPTGRAPRGRRLRGFLDTYEMFLLALLDPGPGSGSCAGPSTLERFAEGLYGLAARARSGELTAALRTEAAIRTLAAVWNRPHVPTHAARPTMHDVLTATDLLEHALRPLAAAPPRHGIAHAVSGGLAALPGLLAQHLHGTPLLLTEHGVYLRERYLGYGAGGYHWPVKALLLGFFRLLAQETYARAALITPGSHYNRRWEERGGTAPDKIRTVYNGVDPGAFPPAGPEPEIPTLAWAGRVDPIKDLETLIRAFALVRREMPQVRLRLFGGTPSGGQAYRERCQALSRDLGIAEAVAFEGRVEDIRDAYAAGTVVMLSSISEGFPFTLIEAMSCGRATVSTDVGGVREAVGDAGLVVPPREPEAMARAALELLRAPARRARTGEAARLRVIEQFTLRHTIDSFREIYGALGAGEDRTHLAEDPAPRARRAGGEW

SEQ ID NO: 7904 - protein, 450 aa, Streptomyces avermitilis
VVNRPGDDRTVLLRLPTPPQRPTWADDPLDELAERLADVCGAAVHPDEIAAVLESDGLTHQQITTRYSRRDLFAIAEELYTRVPRRFPDPGPGPDPWRTSPWQCLLRGMLFGLPGLAYLLGAGLLPGRVTGLAASALVAWAWNQALAHRAYVRLAAGGRRAAARCLLLGAPAGVTAAAAAALAVSGAGAAPAFAAGEALYLAAATVLLVLGREQHLLIALVPTAAGAACIPLWHPGPVPVAVLLLATVAAAALSAVREIVRSLRTTSSAAPGTPRLTASVPYGLFGLAGGALTLMAPAAGRPAAVVLTLSMGVAEWLLYRYRSLTLTALRHSRTPWGFRLRAVGVLALCLTGYLAVLAAPALVTGVPPLPLLALGAALWVALLLQAAGIAWPSAVACLAAAVAEVALSGGANRGPGLLSPATAELAACGCATAVLLAVACTRMGRTTAHR

SEQ ID NO: 7905 - protein, 335 aa, Streptomyces avermitilis
VTSSAPVTVAVTGAEGFIGSHLVEALIASGHRVRAMAQYNSFSSYGWLETLPQDVMDSVEVVLGDVRDAGSVQHLLTGTEAVYHLAALIAIPYSYQAPHSYVATNVTGTLNVLEAVRRLGIPRMVHTSTSETYGTAQTVPITEDHPINTQSPYSASKAGGDRLADGYYASFGIPVATLRPFNTFGPRQSMRAVIPTVIGQVAAGERTIALGDLRPTRDFMFVKDTAQAFLAVGTAPAEAVVGRTFNAGTGGEISVGDLVTLVGKLMGAELEVREDAQRIRPAASEVMRLVCDASRLRAATGWEPAHSLQEGLEQTVRFFSDPANLARYKTAIYNV

SEQ ID NO: 7906 - protein, 237 aa, Streptomyces avermitilis
MHAVILAGGKGVRLRPYTTALPKPLVPIGDQHAILEIVMRQLVNSGFTSCTIAIGHLGHIIRAYVGNGSQWGLRVDYSTEDSPLGTMGPLLTMLDRLPEHFLVMNGDILTDLDFRAVLRSHQADSAPLTIATYCRKVRIDFGVLTTDGKQVVGFTEKPTLDYRVSMGVYGLSRSTLDGYTPGLPLGFDELVLDLLRDGTPPAAHEFDGYWLDIGRPDDYDRANSEFTTHRDLLLKGA

SEQ ID NO: 7907 - protein, 299 aa, Streptomyces avermitilis
MRILVAGSTGFLGRHITEHLLALSGVRVLRAGRSPGADLRVDLTTATVSALAADLHALAPDAVVNCAGAVGGGPLLLAETNARGPAVLCEALTAADLPVRLVHLGSAGEYGTTPGQPLGEDSATCPQGAYGATKLAGSLTVAEAALDAVVLRVFNPLGPDSPGTSLPGRLADELLRAGPDGTVRVGDLSAYRDFVDARDVAHAAALATTAPGPLPRILNIAGGSATQVRKVAEGLARISGFHGRIDENGTGSQRSSAISWQQADITAAATALGWHPERTLDTSLADLWTSRTGTPPTPA

SEQ ID NO: 7908 - protein, 234 aa, Streptomyces avermitilis
VDLAHRHAPDPGMTHGRLLVPLYVHPAVDPAAWQALTRVPSRLYGVVLNVADGPGATRDPAFAAAAGALRAAGIRVLGYLDTAYGTRPHQTVLTELRHHVSWYGTDGVFLDQASAEAGLLPYYRVLGDEARDHGVGTVALNPGMHPDSGYASIADLLVTFEGNWQTYLTSAAPFWTAAHPSARFCHLIHGVPDGLCDLAARTARIRRAGVHCAVPGEGANPWAALPPAVRRGTT

SEQ ID NO: 7909 - protein, 177 aa, Streptomyces avermitilis
VCAAWPPAIGNSGSPASWAASTRSSSAPRRPRRRPSPHRFVKEVLRMWSPPLILVRRARASFDLGTTRLEKAQNYLVSPHMIHRDHRYWQQPDTFDPDRFLPGVPHGPTDRSCYVPFGWAPKKCIGNDIGTTQLMGLCYLICTRYRLSVPNSDTLPMACRFAPVPQRFNGRLALAWN

SEQ ID NO: 7910 - protein, 444 aa, Streptomyces avermitilis
MAEALNGSFKAELIEHQGPWRDADQVERSVVQWVGWYNTERLHSALDCLPPRGIRDPALPISGSNERRLKPRKPAATKLGAAHNGLYVTALGLLLAQYTFCGYDASSHLSEETTQAQISAPRGIVRSIWVSWIAGFILLAGLTSAIQDYAGTQSSSTGVPPAQIFLDVLGADGAKALMLIVIVAQLFSGSAETAAASRMVFAFSRDGAIPFAATWRRVSPRTKTPAAAVWLSVGSALVLAAPSLYSPTAYAAVTAINVIGITPGPPWRTRPRGSCGTAPSMPSTPSATSTGTGPHSWPSTTPSSTAPPFGRSHLCGHQPEAGANPRIRSNPYTTSLDAAHGYFAEGTRLTAVATLGGAAYRRYAQQTRRSSPPRAAGGGVMWIFLVLGLLPIVLLLWTFAGQVNQQMDSQFAGEVIALSVHRVTLTTGMRTDYVLTTVGSSPCR

SEQ ID NO: 7911 - protein, 344 aa, Streptomyces avermitilis
VIGVDTHKHVHVAAVMDTIGGILATLTIPTDTGGFQQLADWAGSFGDVVAFGIEGTGSYGATLTSFLRRAGHKVGEAGRPDRRLRRMNGKSDTLDAENAARAVLAGFATATPKTADGEAEMIRQLKIAHDQAVEQRATAMVTIKAILVHASDALRRETVGKTQISLARQLAALRPRRLEGPEDALRHTLRTLARRWQYLDAEAKELTKMIGDLVQRVAPQLLEPFGIGVDTAAEILVVTGDNPERIKSEAALAKLAGIAPVPTGSGMTAGRHRINHGGHRQLNAAIYRTVIVRMRFHHPTIGYVARPTAEGKTKREIIRCLKRYVIREVYHLLRPAPRRASAAS

SEQ ID NO: 7912 - protein, 542 aa, Streptomyces avermitilis
LPVQCSTVTLTSSITVADGIFAPGHLGELTQQLPFELVDDVLERAGGAQHRLRLLPSRVGVYFVLALALFPQLGYVRVWDKLTAGLRGILHRRPSEKALREVRRRLGVAPLRLLFETLAGPVAQPITPGVRYRCWRTVAFDGCSSTKAPDRPRVCAWLGKHKHRYGTDGYPMLKIMVLCETGTRALLGAVFGPTPEKETGYAEQLLPLLDGGMLLLNDRGFDSDDFLAKAAATGAQLLVRLKGTRTPARWALLPDGSFLTRINGTRLRVIDAHIAVTTAKGLRLEGHYRLATTLTDHRRYPAVELVELYHERWEIESAFYSLRHTLQCGLVLRSQDVAGIQQELWAHLTVYQALRRAMVEAVETLPGTDPDRASFTVALETAKEQLITAANVLPDAGPGRITSALLHDLLPPRQARVNPRRVKCPISRYAAPPDQAQALGASRITSIAVTVHSSAGTGSDGRRDHTLQLLRTNPLRTWRACEIARGIGLDDARGLRAELGRWVREGILRRTGRGIYTLEPEWITPDLHHPSVPPHLTTADRP

SEQ ID NO: 7913 - protein, 761 aa, Streptomyces avermitilis
MMGPFEQPRCGGSKQMRLDGKTAPSDLQLKIVLHGTRPPLWRRLLLPSDTSLGTLHDAIQVAFGWHGGHLHLFTDEFGRGYGDAARLTDIDLGFGRGVGDEDTTALGDVLAEEGARLRYVYDFGDDWEHGITLEKTLPRPVGAERTVRCVGGRRADAPAEDIGGVSGLAEVLGFLDTPDGAFDGPYGELVAELRAAGYDPAAFDRDAITARLAEVTPDTVSGKAKPPAGDRSGRGGVRRLTAEDVALCTCGQCGVGDPVDAGVDGPAEDVPVLRPVTLAPQEDLVAAVRGVPLFDAALRLAAWCHEGRQVTAGRVLRPALAREAVEELQLWKLAGHDSPYADAVARSRALKSLRSAKDVAVLDDPWWLAVDGEMITIRGGRASGGAATDFTGEDLLEFWAATMGDLLEEIGETGVLDGWHGELGELTAEIADGLVGLLYDAPDDAWVDGDDLRAKARERGENGPEFDLFRALFAASFRALGEGLALLGAVEYESGDGDDSAEETLRTLLNAVVGQKPGGSGTLPSASDWSRDDRRGDRMRLTPLGRYGLRAYLMECGVPAPLLGEYAEADAGALLQGLLGYSPEELRREVEGWLEHRTAADAAVGLLDACAGADHEAAAKRAVAQLVLADLDDPRALRVLRKAADSDVEGCRQVATATLGAHLEGEAPVDPARAEEAGLWLLIDGLSILAGAGETEELVRGFLENGNTAPEALEQRVDELWRVEHPATAQVLAELGEGLRGVDKRLAKRMRTAANKAQSRR

SEQ ID NO: 7914 - protein, 950 aa, Streptomyces avermitilis
MRSVPPLAAPESAAWARSLLNYGWAAVFLPGEPARLGRLLLWRPAGAAAAEGMAPTDIETEAAELVLPHGRSVRRRKVEGYALPVALAVAALSGAQPPHPSASAWQAAARFALRLLADGRLHPALTPAGYDTWQAGPFTAAQRRTLDALAGAFPPHAHCLPEPGPTPLRITKPSALVRRFCDAVADELVRTPAAPLAMGALPYAWRETRTVPVLHEWAEETAAAFTADVRVSLRVDVPEGRRRQFRAVLQLHTVADPALVVEAAQLWNEPAETEHLLGPRAEIETLLALRRGAHAWPPLDRLLRDAAPDQLRLTDDEAFDLLGDATDRLRAAGIDVHWPRELVKALTATAEIGQRSAPGSSAGGMLDANTLVDFRWRLSLGGDPLTEAEMDALAETRRPLVRLRDQWVVADPKLVARARRRRMEPLTPMEGLGAALTGEMERDGETFRCAAVGALGDLVARIRDPESRTPAPQPTALKATLRDYQKRGLAWLAEMCELGLGGCLADDMGLGKTITLLALHLHRQTEPATAGPTLVVCPASLLGNWQREAARFAPATPVRRYHGGDRHLKDLAGNEIVLVTYGVLRRDRETLAENAWSLIAADEAQHVKNPYAVTARELRALPGRARVALTGTPVENNLSELWALLDWTTPGLLGPLTAFRDRHARAIESGEDPQAAERLSRLVRPFLLRRRKSDPGIAPELPAKTETDRVVPLTAEQASLYEAVVRETMAKIAEAEGIARRGLVLKLLTALKQICNHPAQYLKEHSLRQSTPLNGRSGKLDLLDELVDTITAEGESVLVFTQYKQMATLLEKHLAERGVPTLFLHGGTPVTAREEMVDRFQRGEVPVFLLSLKAAGTGLNLTRATHVVHYDRWWNPAVEDQATDRAYRIGQDKPVQVHKLIAEGTVEDKVAKLLEAKRALADAVVGSGEAALTELSDADLAELVALGRQS

SEQ ID NO: 7915 - protein, 414 aa, Streptomyces avermitilis
MSPSIPGPRRAPARGRRAFAATWWGQAWVTALEDSTLDSGRLSRGRTYARQGMVGPTTVAPGQVKAPVQGSRPRPYRCSVHLSVLTDTQWDTLLDTIAARAGHLAALLGGEMPGELVDDARRAGVPLLPQSTELDPDCSCPDWGYPCKHAAALCYAIAATIDADPFVLFALRGRDREEVITQLRARRTAAQATSTPPAPAGLPAAGAYTAWGALADQPPSLPELPEPAPHTAALPAAPPPGTGLSAADLERLMADTAARAARLLTGDTTSLHLSQHEDAARIASSNCGPEWFHRLIQNTGAKPAAFARLTRAWRYGGPTGITVAEQPRTPDPTAMTAARTALTETLTEMTTPPVALRAWRNRLTLADHGIQLRLGPDTRWYPYLQDDDGDWWPAAPADPDPVTALTSVWQQTER

SEQ ID NO: 7916 - protein, 205 aa, Streptomyces avermitilis
VHRPRRAHVQTCGPHRSAAGEVLGCVVDLHEGVLTVRQALQRVGGELLIVAPKTQRSARRVALPAECVTALRGQCARQIADRKAAGANWKGTVQGLVFTTKNGTPIVPRNLNRSFEVLCVRAGVRKVRFHDLRHTCASLLHEQGADARMIMEVLGHSSIRVTTDIYTFVRLDSQRSAFDRVGDALRGDGNDPDDDDGAAGVLVAV

SEQ ID NO: 7917 - protein, 198 aa, Streptomyces avermitilis
MTTIAVLGNGRVGGNLATALTRAGHEVTVADRTPGAAADTARTAQIVINATPGAGSLDRLAALRDELRDKILVDVSNATNDGPDGLPADLIYPGSSLAEHLQEALPETRVVKTLNTMLFPVMTAPATLTQTPTAFLSGEDPQAKQTVRELLTDLGWHKEWIADLGGIQTARATEAAILFVPHVIGATGFTPFAISIAR

SEQ ID NO: 7918 - protein, 272 aa, Streptomyces avermitilis
MSETLQTTAVAASDADLLAQTANAVRAAGSALRERFGEVVRYQSREELMRALAANDDTALDILRPRLTSLRPDAGWVEDELDGGALPPGEWWVVDPAEGNVNHLHALPEWAVTATLVRENQPVLTAVHLPLTGETYTALTGAGAHVDGRPLHVSPAADLGLSIVATSQARPDEDEKVVRRVGSSITAMLFDALVVRTAVPATLHLVNVAAGRIDAFWQFAGARADLLPGALLVTEAGGQISDAQGRPWTPQSESFLAAAPGIHAEAVATLSH

SEQ ID NO: 7919 - protein, 310 aa, Streptomyces avermitilis
MSSTARITRMQLDLNLLAALDALLEEGSVAGAAARLHVTAPAMSRSLGRIRRTTGDQILVRTGRTMTPTPYAIAVREQVHELLHQVQGVLAPSRELDLATLERTFTLRWHDSLVALSGPALLAAVRGQAPGVRLRFVAESSIDTPELRRGEVDLEANANRPSAPDIRAENVGETRLVIIVRQGHPLTRVKTVTAQRYAAADHVTVSRRGNLSNALDDSLARLGLTRRVVATAPTEAAALEFARGSDLLISVPEATTRSAVADLGLVVLPLPLELPSAPIYLSWHQRYDTDHAHTWLRGLARTALAMGGAS

SEQ ID NO: 7920 - protein, 127 aa, Streptomyces avermitilis
VVYLLLAAVLFEECGYLAVWRKLTAALDSILVVTISGTALWDARTRLGVRPVRALFDLLRGPASAVRTAGARWAGMLVVAIDGTHFGRAGPVVCADSAVGVFRERGHSMPPLGTDLVSALNPVSARR

SEQ ID NO: 7921 - protein, 169 aa, Streptomyces avermitilis
MGWQRRVTHAPQSHTLSPRVAMLWEASRSVWATTPHPRQMKSPWSTRFRLSLREFNGERDHVHLLVHYPPKVAISRLVGSLKGVSARRLRQEFPNHIRKYPWGEHFWSPSYFAASCGGAPLSLIKEYINNQKRPSLGQQRRPVDPRGSEQRQKALPPGRERSGFRARSC

SEQ ID NO: 7922 - protein, 424 aa, Streptomyces avermitilis
LFPRTKQGRYAAGMDLSGVVSALQARLPELGERMAQRIRSDVDAYKDASLIPFDSLRRSCTANADLLLYQLGRAGAQDPSPARETGRLRAEQGVPLADTLHAYRIGFEFLWTDILAEARNRPEVTDAQLVSQSAEIWALFGRYAEAVAAAYRETTAELTSRRQARRSALVEALFTGVIADRTLWEAARELGLPDRGPYVVAAAAADAPGEEPLAGTEAALRQAQIPFAWRLLPDQQIGLAALPTATAESTCLSILRRAGARVGVSPCFHSLGDTPQALRFARLALAGLQGTGPGVARFDDNPLAMVVAAAPAEAAHLVEVVLQPLLDLPAAERARLLETLEHWYAAAGSATDAARSLFVHPNTVRYRLRRVEELAGRSLSDPRAAADIGAALLAVRRAGASPSDVIQHDLARNPERSRPGGSAF

SEQ ID NO: 7923 - protein, 495 aa, Streptomyces avermitilis
MANLAEFLVETARRQPERPALRLGGQVTSYAELDQRSARAAALLRAEGVRPGDRVALMLPNVPEFVVLYYGVLRAGAVVVPMNPLLKTRETEYHLRDSGAQMLFEWHQAPGEGAQGAAAAGVRHMAVEPAAFAGLLAGHAPLPEVSEPDSEDVAVLLYTSGTTGRPKGAMLTHTGLRHNTEVNAVDVQRMTAEDVVVGCLPLFHIFGQICAMSVTVRAGASLTLIPRFDPQTVLDAIARDRATIFEGVPTMYAALLQHPSEADVSTLRMCISGGASLPVEILHGFERRFGCVVLEGFGMSETSPVVTFNHPDRPRKAGSIGTPIKDVQVRLLDEKGQDVTPGEIGELAVRGPNVMKGYWNRPEETAATIPDGWLRSGDLAHRDEDGYLYIVDRKKDMIIRGGYNVYPREIEEVLHEHPAVALAAVVGLADAHLGEEIAAAVVLRPKAQATPDELRQFVKERVAAYKYPREVWLVDTLPTGPSGKILKREISAPTG

SEQ ID NO: 7924 - protein, 63 aa, Streptomyces avermitilis
LDAIRYLVAGGISWRAMPADFPDCGRVYAFFRRWREHGLIAEFHDRLRGKVREREGRESEPTA

SEQ ID NO: 7925 - protein, 51 aa, Streptomyces avermitilis
LAEWALRYEGITLGLLQQLVICGCIELPLLEGLLLACDSPLPRGTGLLVSD

SEQ ID NO: 7926 - protein, 1112 aa, Streptomyces avermitilis
MLSPAEPLRRPAQDGLWGGRVGAQTFSAAGHRALTEPVAQRALSGRGQEVPTAARTLIERATDLSLGHVRLHTGPAVRTAARAAGVAGFTLGPDIAVATGPGEGAPDRLLRHELMHAAQQTMTRRGGAAGTAPTELRAAAEEQAARAAERPERAEPPVAVGPHVAAAAEGWLNSTADVRNYGMTQLLDELNAVNEWLDRQTTSTPEDDTMLAAKAAIEAELARKNRAMAAPDRTRRGRRPRGAAPAAEELPQQVPMPRVLAERTSTVPADAVEARTEVDRITAWLQRPDLSRQDRALLRQELKELAPHLAADLARASGERRQARLTEAFTPVAEQSSGLVDNLRTIEGIRPSVEQPGMAYVIHRDEMLLFPQELADQVREQTVAALADAARGIRTMNAATDERMRHHLHLNYEEQPYVGFAGSVVGGEEPYEVQDRVRDPWLEAVAALRDFDKARRQGALVAMGEAVLAATAQAEQARAVVNAGVGKAEAAAGDIADALTTVRNLSYTVALAAGAIIAAPLAASAVAGMGATGLTATALTTAGTAGMVGAGGAGLGFVGGAGGEAVSGGSARQVLRAGLEEGQRVGIEGLQTGAGAGAATGFARNLGLHAVRMSRAQTMVRSAVAQGGGNVVGGLTGAALNAPPEGMTRAEAALRGVLPNLGLGALGGFAGGYSQGLSSPAMRRLVGVGLPAAAEGGVEYLRTGDAEHAFTTAARSAAIGSLLHERAGLGAGAERRAFEFGHGVRTRAGNIGRGIAARVRPLALGLSLGLSQVRALRMAGTGGTAPVVELGVPGARSSLQDVPTTQGADVVLAGDFAGPSAEQKAQPGAPSATVAEPTAQPGAPSSAAAEQPSAPGQTASTLGLDAARFAAPEMAKDLATLKNSYLRAIADLDAVRAQARTLGLSERETNAFLRMWGECPTPMTAEEVGQEMGAWSTLRKQSLPSAVSSAEETLPVTLKASVLPHYSSKSAFMEAMRRRLLAQRASGKESLLDFLLDADGQWQKGSFIARSGRPMRGRYALSDPDRQIVQAGHMLSDWYVKAMSRRDHLMLEDADLNWMSGFTEASGSVTSKSAVLIEGYPVDIPTARLWEAHGKLPAGTVSAAPVVEPPAF

SEQ ID NO: 7927 - protein, 504 aa, Streptomyces avermitilis
MTTQFSYPGVYIEEIESPVRPIAGAETSVTAFVGPALFGPTSPTTVESWADFEKEFGGLWQGSELSYAVYQFFLNGGSKAIVVRVGEGVEYAGVDLKNGVKLKAKAPGAAGKKLKATVTLDANDNKRYTLLISDGTTSESYDVTIDPALRNRWLDRQLATSQLVERDTETFDKRPDAVTDESFTGGKDATFTPAHVLGDATKLPHTGLAALADVEIFNLLVIPAQLAKPSGTDDRDTKWAPVVDAAVRLCEEQRAMLLLDPPFGWDSPETAVTGARAGMPVGGLAGRNAAVFFPKVVISDPLSGGNLEVGPAGTVAGVIARTDTRRGVWKAPAGTDDGGLLGVRSLAFRLSDQQNGTLNKLGVNCLRTVPVYGNVLWGSRTCRGGDAVSDPWKYIPVRRVALHIEESLFIGTKWVVFEPNDEPLWSSIRLNIGAFMNRLFRQGAFQGPTAKGAYFVRCDASNNPQDDINDGIVTIDVGFQPLSPAEFVHIRIQQKRDDATAQGS

SEQ ID NO: 7928 - protein, 176 aa, Streptomyces avermitilis
MAQFTVNAARLDPYKNFKFRVKWDNRYVAGISKVSALKRTTEVVEHRDGGDHSSARKSPGRTKYEPITLERGVTHDPEFEAWANKVWNYANAQAAPDQRDREVSLAGFRKDLVIEVYNEAGQKVLAYQVFRCWVSEYQALPDLDANANAVAIQQLKLENEGWLREASVTEPGEPSF

SEQ ID NO: 7929 - protein, 237 aa, Streptomyces avermitilis
VPGMSTVSAAELLDAWEAGWGRDPLRRGLALLGVARGTTPAAAADVPVGRRDRGLFALRAALFGTAVDAVSRCPECETEVEVAFDQEELLGRLGQADPEACDAVTVREGDREIRVRMPTSTDLAAVLDTGDPAPEEALVRRCAPVGEPAPAADVVAEAWVAADPLVDVRLGVGCPGCGLAWEEPFDIVGYLWAELDAWGRRTLLEVHELARAYGWTQAQTLALSPWRRQCYLGLVGT

SEQ ID NO: 7930 - protein, 298 aa, Streptomyces avermitilis
MTGPLARLVDRSRSPVAGLRPRPASRYEQRSPAAGPPVLEGGLEDVGPRPVTGPPTAAEPAAHRDASAVRVPGPTESAAHRHDPAVPATRVIEPADHGPSVTGLSVTETVATKPSSTDADLLGPDLTTRALSAVPALPVVREDAPARGDGTPQPLPLLLPVRVEAPVPPADSLRTTPELGRPAADPRTNLVRNPADEGPPPVPPPPRDNVRNTPVVLERPLLYPHARPPALATDAPPSTAPEAEPAVVVEVSIGRLDVRTPPSPAPPQTPARPPAALRADHARALENYLRRRAEGELG

SEQ ID NO: 7931 - protein, 396 aa, Streptomyces avermitilis
MSNSLALAAVTATLRARLFSRLGGPQVTVAPPNKAPDAASGDHVNLFLYRADLNPAFRNADPPGWQPGESPKPVLPLVLHYLLAAYSNDEGKAHELLGAAMLALHDAPVLSGDEIRAATATALPGSDLHLQPERVKITQETLSQDDIAKMWTAFGTPFRMSSAYQVTAVLIDSALPGAAPMPVLRRGADGRGPLARPGTGSPALLGIRYAAAGQVGALPGEQVALLVENLPAVALTARLRHLRVTQSVNVPLATPATGASEVALTLPATGLPAGLWAVDLGPAAGGSVRTNELALGVTPAVTALAAAAAGGTPVRTKVTVTAAQPVLPGQQAAVLVGARQLAVGLLTAAAKPVSVTAVLPSGKTRVRLRVDGVDSEIVDRAHGTFRTGPTVEVTIP

SEQ ID NO: 7932 - protein, 499 aa, Streptomyces avermitilis
VSLGVPADLRWEEANNRYLKASLTWLRARLEAVAHSDRASDAPDTKDAPPQTGSARRRRRGRTPELPPAAVDLPDGGPGGSRRGRAPEPLTAVPDAGDLDALATTRQDAAAPSDLAPPALVRLAERFGLTDFERDVLLLVVAPAVDPGVGAAIAAAHGDPQATAPTFALALRLFDDARWDVLSPLRPLRRWRLAEVVPAPAGPLLTAPLRPDDRIANLVRGLNHLDERLTSVLEPVADPAAGVASPASVRRAEDAVVAAVLADTPDGRFPVVHLVGSDADSAVLVAVRAFARLERELYRLRTGLLVRGGQGQQDPDTVALLWHRESLLMPVALLLDGTDADPDDPALVAAVRRLLSRSGGPVVLAARQVSPVDGRSTAVVDVDVPPPDEQRALWAAATGLEPAGAPAELAGQFRLGLPALHRVATAHRPEGLSAEDGGDRLWGGLPGRRPASPGVAGAAHRAPRSLGGPGAAGAADGGAAADGRSCAARRHRVWGLGLR

SEQ ID NO: 7933 - protein, 261 aa, Streptomyces avermitilis
VPRAHWADLVLPEQQTEVLRRMAGHVRHGATVFGDWGFGERTNRGQGVTALFSGPSGTGKTFASEVLAHELGLDLYRVDLSAVVNKYVGETEKNLRQVFDAAESGGSLLLFDEADALFGRRSDVQDSHDRYANIEVSYLLQRMEAYRGVAVLATNLRAALDPAFLRRLRFVVEFPVPGAEERRLLWAAAFPDSVPLADDLDLGRLADLPTTGAAIQAIALGAAFLAAACGRPVDTAMLLTAAHAEFRKLDLPLPVLAGEAP

SEQ ID NO: 7934 - protein, 226 aa, Streptomyces avermitilis
MTSSFLPGTPVVPRGAIVLLDPATGAVLRVIALQYNPDTLTRTLQPQGVGAEAGERSEALRLKGPALETVKVDVELNATDQLEDPSGADADSVARHGLLPVLAALDLLVNPTARALLDQDAAARSGAFEIAPVEAPLTVFVWSRDRVVPVRITEFTVTEEAFDSQLHPIRAKVSLGLRILTVDDLGFGHRGGALFLAHQRRREQLAALHRSARPATAVLGTPPGGG

SEQ ID NO: 7935 - protein, 105 aa, Streptomyces avermitilis
MFTPASRYHGVEVARYEPPDGGDPIPYVRRRLLPDPAGLTPAGFHTVSEGDRLDRIAAAAFGDPELFWRIADANPVLDPPELTDRPGRRLLIALSAAAAGSTHGF

SEQ ID NO: 7936 - protein, 368 aa, Streptomyces avermitilis
MASEMLLALRLGPVLAEPVPREVADALLSVQVTEGVGRSGGFQLEFATAKRSLLFAELLPQGALDPPARAQIVLTVLGRSTVLMDGVVTRHEVAPSAEPGQAKLTLTGEDVSRMMDVVDFSGVKYPGLPPEERVAVIVAKYTAYGLVPAIVPSVFMVAPNPLQAVPSHQGTDLAYVRQLAAQAGYQFFVAPGPLPGVNIAHWEPPNKLGLPQEPLLVNCDAASNVESLSFSFDGFSATQYVVLIQNPETKFPVPVPVPDVSPLSPPMGRRRPLPLKVQPIHGLAKLTPPQAAGVALARAADSFEVISGQGSLDVLRYGQPLRARRPVPVHGAGAAYDGTYYVRSVTHSIKRGAYTQQFTLTRNAFGPL

SEQ ID NO: 7937 - protein, 196 aa, Streptomyces avermitilis
MTNMDDIGYVESPGFFSPAQREDAEPPGARRFYGKYRGSVVNNVDPLGTGRLLVSVPDVFGLFPTSWAMPCVPLGGLQSGMFVRPPQQAGVWVEFEGGNPDHPIWTGFFWGGRAETPATAGTLVPGSPVFLVETSGKSKIAVSDSPVTPMKGGGVLLQSPSASITVDSAGVTITAANISLNGLVDINNGALVVKTA

SEQ ID NO: 7938 - protein, 115 aa, Streptomyces avermitilis
MPGFALTTAAALTCAHQGQLTLTPGQQQVLAGGAPVVTTADVNVVAPSCVLSSSTPPTPCVKVDFSLAASTRVFVQGRPLVVQPAGPGTGLGLSAAQVSQGPPVVSTVQQRVVAA

SEQ ID NO: 7939 - protein, 129 aa, Streptomyces avermitilis
VSAHPDYARTHLDFPFHVDARGRSAGTSDEGHVRDLIEQLLFTVPGERVNRPDFGSGVLQLVFAPGGQELAGAVEYSLQASLQRWLTDVIQVERVEVEAEEAELRITVGYVLLATGEPGTAVVERGTGP

SEQ ID NO: 7940 - protein, 939 aa, Streptomyces avermitilis
MTGVPDTRPCLPGERADRTRESGLGAVVAVDVDAPGRTLRVLLLGAAPDPVPGAECVRIEGPGRAVRAVSVRVEGSPPPTRRATLLVTVDRLGDRSPYTLRLVDPDRPGAPFPGFDPRHSGAEFTFTADCAEEADCAAVADSPVPATPVPALDYLVKDYASFRRLILDRLSLVSPAWADREVPDLGITLVELLAYVGDQLSYRQDAVATEAYLHTARLRTSVRRHLRLVDHRLHEGCNARTWVHLAAEEPAVLRAGTYWFATALPGVRPLVSEAQLRGATTYFERYEPVVAADLVLRPAHNEIRLWTWDGEECRLPAGTTSATLVDPGTGKERELELAPGDVLVLEEVRGPVTGVPGDADPRHRQAVRLTDVEEITDPVRGQRLLRVVWAEEDALAFPLCLATVGGERCCLFEDVSVARGNIVLVDQGSSGTPPLRLTAPTTATGPASCDDLGRPRPRTEAPLRWLPRLDTGPLTRRSPHPDPARTAAAQVRALEGIPARAAEAVADMYRRASAPPTDADLALARTLWGARAVADAGLETARDAAQRRAALTLLRARSAALLARRTARLTRLAARARAGVPLDTDTAAEVAAGWGPVLAAGLDPGDPRVAGPASAALVQDPRAALPQLTLTSAGEHWEVRADLLDSDSDDPHVVVEAEDDGTARLRFGDGQLGRAVTGGQEFLAAVRVGNGPAGIAGSGTVVHVVVSAPTDARVTAVRNPLPATGGTAPEPVADARLFGPTQYRHRLERAVTADDYSALAGEPAGVQRAATDLAWNGSWYEADVAVDALGRVDPPAALLDAVRDRLERGRRIGHDLRVDAPRTVAVEVRLQLCLAPDARRAAVERAVRARLGNGVGGLFHPDRLTFDSDLYPGRLVAEAMAVPGVVAAAVERLGRAEAPLPLVPDDGVLAFGPLEIPAGGADPSGPGAGVLWIDLAGGR

SEQ ID NO: 7941 - protein, 867 aa, Streptomyces avermitilis
MCATGEGSCCCTTGAGTPLPTDNPPGAARLRARAGTHATFLASMTRALSGSAHPELAELSTRDPADPALALLDAWACVGDVLTFYQERIADEGYLGTATERRSLVELGRLVGYRPRPGLAADGWLAYTLDPDPADVEVTVPAGSQVQSVPDPGAQPVVFETAEDLVARPSWGALRVRTRRPMPMTRECALGLRVVYVDGVSAGVAPNDRLLFHFDDGKLPTLRIVESVHADALAGTTAVALVRISDKFEKACRETVGRTGRAAFVRLDVLRVRAAPFGTAAPQKLKSTGEVGATAAAVPEFEEWPLDPALYTVGTKPEEERRRLWLDGDHPRILRGSWIVIESADGWGTPFQATDVRSRGLAHYGITGKVTVLDLPTTWYDNPADGTPLLSLHRGLTVHAQAEPLTLADGPFTDGLTGSAVDLDRVITAPPPSRTVLISGAPVDGGAPAGEVAHVLATHTVTDPNRPGATPYTVLELAAGLRHTYRRDTVTVWGNAVRATHGETREEPALGSGDASRPGQTFTLAAHPLTHVAAPAADGGQAELTVRVGESAWSETDEIAHAAPAEHAYELRADDTGTATVTFGDGRRGSRLPTGTANIAARYRVGLGRAGNLRAGQLSQLRAKPLGIDAVVNPLSTGGGTDADTDAALRGRAPLPTLAMDRLVGLRDYADFTLARAGIGRAAAARLTVGGRELVHVTVAGVDDAELDPDTAVVTSLLAAFRRYGDPGVPAAVAPRTRWNLVLQARIGIAPDRSAVLLEPRVRAEFERVFAFGARELGRSAYVAEAVAALQGVPGVVFVDVRRFGATLGTTPADAAEVTGVAQRVLARPARVEFGAAPPTEVVRPADLVVAAPGLPGFVVLNLEVAR

SEQ ID NO: 7942 - protein, 699 aa, Streptomyces avermitilis
MSSPPPDRLYDLLPAVHRGRDEEQGFPLRALLRIVEEQVRVIEEDLDTWYANWFVETCEDWVVPYIGALVGTRPPPPGSSPGAVRALSPRQDVADAVANRRRKGGAAALEAVALDSSGWPARAVELYRHLVRAQHARHVRLDRPATFAVRDPLACARLGGPFDDAPHLVDVRRPNSTQTRGLHGIPSLALFVWRLRAFPVTRAPAFCIDQRYSRYLVNVLGIDTRLFAPAPQGPAPARVSGPGDVPHPLGREEFEAAVTEYYGPGRSLEIWRDSPDNPVPAEQIIVADLTDWRYRPRPGQVVVDPVLGRIAFPADEAPEDGVWVSWHYGFADAMGGGAYRRPQTPVGERKLYAVGGEDDLGSITAALRQWRADKAADPSLHDALIEIRDSADYTEALRIDLDEDDRLEIRAARGERPVVRLLNQKANRFDALTVRATAKKPPPGTVADCPPPATRRPQLVLDGLVVSGRSLDVVGQIGEVLVRHCTLVPGWELDHDCRPRWGEEPSVELRRTTARLRVEHSIVGTIVVDQDETKGNPLTVEILDSIVDATSHDLPAVTAPEDRFAHAELTLRRCTVLGDVRVHALPLGENSIVTGCLHTLRRDTGCLRYSYAPVSHPGPPRYRCATDPARPHFTSTRYGHPGYCQLHTACDPLISTGAEDGAELGAFHDLYQPQSLSNLVGHLAEYVPLGVEAAVITAT

SEQ ID NO: 7943 - protein, 430 aa, Streptomyces avermitilis
VHGDFSNITFSPDRSYSTVFDLQGRVGLDANRNEQTAILLHYLRTAMADLVGPYAGPATSLGFEISDIGTGGFSIGAGRYYVDGILVENPAKVTYAEQPHAYIDLDDADRLPSGSYVVYLKVWERHVTEVEDPSLHEPALGLHQPDSASRAQVVWQVRALPLKSRQNPVHRIAAEHAPDRGTGVLDVRTSRDDSSADDPCTASPDASYTGENQLYRVEIRRGGTAADGATFAWSRDNGSVIHPVRPLGGTKMRLTSPARDRHTALEPGHWVEVVDDAISLRRDLGLPAGAPPLHRIDDIDPDTLTVILATTPDPPVSPDRHPYLRRWDHTPLDTDSGGAIPITEGPWIPLEHGIEIHFQPSAAREPAHEYRCGDHWTFAARRTLGTAIWPYPGGSGPHGVRYHLAPLAVVAGSKVSPLRTSFAVPLTSGV

SEQ ID NO: 7944 - protein, 641 aa, Streptomyces avermitilis
VPLCPLKEGPSMIRALIDRGRTGHDAAAVLHSRGHPLDAGIRQTMEMAFGHDFSQVRVHSDPQAHALTRRMNARALTLGDHIALGQDWYSPDSADELRALAHELAHVVQQRSGCAEPPAPSPHTETEHEAVAAADTVMGGGAARVRGRTGIGVARQAVESDPSDLSDTQLEQEWLLAAAWLVDHSMLESDYFTVAKYVKSLEDAMRGRAGGAHRAQSEGTLPLEPLRPSILQVPLRSPVGAAGSSGAVPAAPRPVVATPLDIPAEGVDMPWVGRGKGISSSELGYLRDSKYFWPRFQQSYGSAISLANAQLIASGQAPRVDATWIEHFPGHAAYVNDTLEHHHVGQGSRAVPLPSRLHDAYTVFHPQRRVVSTPQGGLRPIPPPRSHADAQTNLNSHVEAGRISGPGIDPTKPPTVPAVPPASEVAGQRATPPAAVPRMFGGGRIRGLVGGTILGGLQLLAGYLSAKLQDHFDQQRWERERETIQAQVERELDGMSLEITDRYLDAPGREVFAVVAITSTALRTVQVYATGIQSEVVDQTVYLGSKLASVELGSAARSERHEEVRQIAAPLNLGFPTTTYTTTTLYSFAVPSPDLIALRWRALERLRDLDLQAPASQTAQAAAAVQEERTRLSAWLRPSAD

SEQ ID NO: 7945 - protein, 73 aa, Streptomyces avermitilis
MSETPETPTAVLLITVWFEPASPTLRARVIQAVDVHTPGETMVLVGRDAVLGVVHEWLDACAHDRPNPPSGAT

SEQ ID NO: 7946 - protein, 274 aa, Streptomyces avermitilis
LAFREKPYEHREFPDAPEPSCAVASIGLVGCVGGGAMSTADTFAPRLCLLGRFTLTYGPTTLDVGTAAQRLLAYLGMRHHGTRTVVAGTLWPDVPEERAHGSLRTALWRLHRGREPLVCSEGDTLALAESVTVDARTLMNSALHVVGTSPPAPAPPRDLLFAGDLLPGWDEDWVLFERERLRQLRLHALDSLAHRLLAEGHHALALEAALESVRIEPLRESAHRAVVAVHLAEHNVLEAIRHYRAFKDLLRIELGIAPSLGFTSMLPACALIRD

SEQ ID NO: 7947 - protein, 944 aa, Streptomyces avermitilis
MDETTVVTGGVPGAGTGPAGDTEFPPVGRECERALLDGLLDALTERGGALLLSGDPGTGKSMLLGYTAGRCRTTVLRARGVESEAVLPYTVLADLLLPLRPYFTELPPGQRRALEGCLALADVAGPNPYAVCAGALGVLAAAGEVRPLLVVVDDLHWVDPSSRQVLQFVARRLTTERVALVMAVQPGAEEDGPWASVPRVALGPLAEDDCWTLLRRHGLDRTDPAADRLVRLSLGNPLVLVEYAGMLARMRATGATQWDEMWEAPGPLVERAWRGQLRALPHRTREALVYVAACRTPDLALLTKALAADGTDLDALDAAERTGLVRIRDGVCELRHPVLRPVVLGQCTTARRLQVYRRLAALSSDELRTWYLAAAAPGPDEAVAGRLAADAEQARRRNALAAAACAWHRAAELSPDPADAARRLLEAARDAFCGGTARDAARWCEQALVHSRDPRLTADIGLLRGQACTWLGDPARAHRLLVDAARAVEPVDRPRACLLYGAAVAPAMMDGRLRHASDIAARCQELADDGRDTQRRHAAVMRAKAQALGGDVPTGRAALLALLDESHSPVAMDIARGPEERQIAMDIAQGLSWTDDGEAARPVLDAVIECTRRDSSPTLLSYALLGRCEVEMWSHWQQARADAAEALRWAEEFGLLAMSGYALIQLARLDGLRGDTAACEERIARYEHWCGGRLRGLDMFARGTLGAAALTAGDPDTCRTHLEAAFRMADGMGLVNPSLMPWVADLAEASLRTGARERAVAVADWLAERAEATALAWPAAAYARCRVMLARTAQEAADWLATAELAHSKREMPFERARTRLVAGEVLRRFRRPSAAQEPLLAAQRTFTALGAAPWAARARAEVAAAGHRTAVRQTEPSLTELLTPQEFQVARAIGEGLSNVEAAAALFLSRKTIEAHLTRVYRKLGIRSRSDLARCMAHAGAVG

SEQ ID NO: 7948 - protein, 184 aa, Streptomyces avermitilis
MRSWMLTQIEALAHRTAVPPVAGDDPAAKAEVVRLLDVLGYDAVDIGALANAWHCEPGTLVYVWPYLGERSQRITKEEARLWFREIPGEPTPADWVKELIDQAVRGPVGGSFAALPFRTRWCPRRSPTSPPRWRRGLCPQVRRPRQRSRLKKAPSPTPPRPRRRLPRPVRRAPPGRRRRRGAQA

SEQ ID NO: 7949 - protein, 488 aa, Streptomyces avermitilis
MTSLKASHAADLVAALLFILSLAGLSQHRTSRAGVVYGIAGMALALVATVVVAARSITAGAVALIVLAMALGAAMGLWRARRVEMTQMPELIAVLHSFVGLAAVLVGWNSYLEVDSHGSAQTRIGANLLGIHHAEVFIGIFIGAVTFTGSIVAFLKLSARIKSRPLMLPGKNALNLGALAAFVVLTIWFAISPNLPLMIAVTALALALGWHLVASIGGGDMPVVVSMLNSYSGWAAAAAGFLLDNNLLIVTGALVGSSGAYLSYIMCKAMNRSFLSVIAGGFGIAAPSGGEEEQGEHREVRAAEAAEMLAQARSVIITPGYGMAVAQAQHPVAELTRQLCERGIEVRFGVHPVAGRLPGHMNVLLAEAKVPYDIVLEMDEINDDFADTSVVLVIGANDTVNPAATEDPGSPIAGMPVLRVWEAEQVIVFKRSMASGYAGVQNPLFFRENSSMLFGDAKQSVEEILHALSTDSRHDAAPAARQATVASH

SEQ ID NO: 7950 - protein, 518 aa, Streptomyces avermitilis
MSAQKPSHHPPRRIGVVAESVSGETRVAATPATVRLLLGLGYEVVVESGAGEASGFGDQAYADAGAGIGEAWDADVVLKVNAPSDAEICRLRKGATVVALLTPAQKPELLQALADAGVTALALDAVPRISRAQSMDVLSSMANIAGYRAVIEAAHAFGRFFTGQVTAAGKVPPAKVLVAGAGVAGLAAIGAASSLGAIVRATDPRPEVADQVKSLGGEYLPVEAVQESSTDGYAKATSADYDRAAAQLYHEQAEDVDMVITTALIPGRPAPRLLTAEDVAVMKSGSVIVDMAAAMGGNVEGTVPGRTVVTDNGVTIIGYTDLASRLPAQASQLFGTNLLNLLKLLTPGKDGQLTVDFDDVVQRAVTVVRDGDVTWPPPPVAVSAAPAAQPAAAPVAPEPKQSNLTPAWRFGLIGLGMLAMFLLVAFAPTQLAGNFTVFALAVVIGYYVIGKVHHALHTPLMSVTNAISGIVVIGALLQIGHESWIVTTLSFVAILLTSVNIFGGFAVTRRMLSMFSKG

SEQ ID NO: 7951 - protein, 239 aa, Streptomyces avermitilis
VRSPPRRRLSRLVYGTIHAGAARLLHRLRWSTDRRRLRLLRLRERLVGLPVNAASAPTAAAEPRDAAGRPPVRAATPADAEGITRMRSAYVLSAPFTEDWVRQCTDELAPRLTPEGAARAFVVDAPDGTMAACALGLIHPVLPAPAYPRGRAARVQIVATQPEFRRRGYARAVLSALLDHLGDVEDVTLFELHTSPEAAPLYRELGFSGSPALMWMTRHRERAGAVAGAQPDSTWMPPQ

SEQ ID NO: 7952 - protein, 145 aa, Streptomyces avermitilis
VCLYVTDEDDRPLQLHSVYSPGHPWHMIGGAMDLGERPWDAVVREGREETGMTAVGPARLLATVFGLPREGRSYSTLQLIFDGGRLTAEQIRGITLNSREHDEARVLPLAEWEALMPARDFVRLRAVEEARRTGVAAYVDTWGHA

SEQ ID NO: 7953 - protein, 255 aa, Streptomyces avermitilis
VNSPLTEHNSLWIRRFHPRPDSHVRLVCLPHAGGSASFYFPVSRSMPESVDVLCVQYPGRQDRRTEPLLDSVPALADKVYEALLPWTDRPIALFGHSMGASLAYEIARRLEQERGITPATLIASGRRAPSTHRDETVHLRDDDGLVAEMRGLSGTDPQLLGDEDVLRMILPAIRADYRAAETYTWEPGPPLTCPVTCLVGDDDPKVTVEEAAAWSGHTDGPFMLRVFPGGHFFLARHQTEIVRLMATQLEVLDRP

SEQ ID NO: 7954 - protein, 547 aa, Streptomyces avermitilis
VIAHQPLSRRRMLGVAALGAAALAGQTTITAAPRAAAATATSGSGGTFVPAVVVGTGYGAAVSALRLGEAGVPTLMLEMGRLWNQPGPDGNVFSGMLKPDKRSSWFKTRTEAPLGSFLWLDLANRDIEPYAGVLDRVNFDQMSVYLGRGVGGGSLVNGGMAVTPRRSYFEEVLPQVDAEEMYTKYFPRANSTLRVNNIDKSWFEQTDWYSFARVSRRQASNAGLSTTFVPNVYDWDYMRREADGAVPKSALAAEVIYGNNHGKVSLDKSYLAAALGTGKVTIETLHQVKTIRQQNDGTYLLTVEQRDTGGKLLGTKEVSCRHLFLGAGSLGSTELLLRARETGTLPGLSPEVGGGWGPNGNIMTARANHMWNPTGTKQSSIPALGIDDWDNPDTPVFAEIAPLPAGVETWVSLYLAITKNPERGTFVYDAAKDRADLRWTRDQNAPAIAAAKSLFDRINKANATIYRYDLFGKQIKAFADDFCYHPLGGCVLGKATDDYGRVTGYKNLYVTDGSLIPGSIGVNPFVTIAALAERNIERVIKQDIADS

SEQ ID NO: 7955 - protein, 232 aa, Streptomyces avermitilis
MTPLLTAFTAAHRPPNLFRPSFLTGGTLLLIPAPATPGLCMASLDKTLTIQQANQEFFRQFNGSSEDICGRNFRDVVHPSVQQPLVRQFSNLLEGKNHRFVTPVIAVGPGEESAFTVPLTAVAVRGGLPDTTAILVMMPTAGDAEQTRVVPKRKKILSTMDARILEGIAAGVSTVPLAASLYLSRQGVEYHVTCLLRKLKVSNRAALVSRAYSLGVFKVGTWPPEVVDDFVK

SEQ ID NO: 7956 - protein, 1096 aa, Streptomyces avermitilis
VLRHRTPGYVLDLDPEQVDAWRFERLVTDGRRLLEQRDPRTAHARLTEALGLWHGSPYAEFDSHPPLSDECTRLEQIRLTAVESRAEARLALGAAEEVAADLDGEARRHPTRERLVGHLMTALSRLGRQAEALEVYERTRSHLVEEFGVDTAAELRRVRNAILRPGPGASAPSKKLSPTPLESTRASPVPLAMNESGDDGVQNSEGFVGSWDGRTAVTPRRHGTTVETNDANGTDDADAAVEREGITGTGARPEARTDVPPGTRADAAGTQAGTAQWRPAPGPEHELAATPEAGKSPESESGWTAAPSPFTGRSQELDRLTTAAASAVVGHGHVAGVLGPPGVGKTRLLLELAARLESMEAPEKGSRLEVVWSHCFPGEGVPAYWLWTQILRRLSATRPDAFRDATEPFGALLAPLMPERSAARTEGPKGASDWFQARFLAHDAVCEVLLALAGQHPLVLFLEDLQWADTASLDLLRLLSTRCQGHPLSIVLTTRKFEAESDATLRRMVSDVLRGPRTETLQLCGLSLQAVGALVEAHAGSGVDPKVVEVLHRRSGGNPYLVMQLLSLVGDARKLRRPDAVDALLAHIPTGVREALRQRFAGLPEPVLRVLRLCAVIGAEVDTDLLHRTATRDEPVIAGLESAIRAGLLGEDPHHPGRLHFAHALVQETLVDELPREDRHRLHARVADALSARRRGQVQDEEIERVAHHSWHARSALPAAEVLPRLLLAAEHAEQSMAYEQVEIWLRRAVHLVGFLPPDDPATGRLEQDLHIQLGQVLATTRGYGHPEAETALTRGRALSTAAHAPEDPSVLWALCTAYLVTGRYDASRQFSGLLRDISRQTWEPVAALGATYGEGIVLHVRGMLPQALAELERGVGIADRFANKDHGLSRTFQHDPRVSCRSYNTFTHWLLGHRQTAGARRRELLSLTRYESRPSDRSFALYVDGVVAAWEGDTRTALASSDEGARVAGEHGLVYWKAMLGVVKGWGLAHAGDHEDGLALMHTSLAELGQSKTHIRHPLHLGLLGQAQHHGGRIEEARTTFRKLLAAVEQRRERVYLHPALPATPLLHELLGHGADEALTDRGPGRDGPNSGRRA

SEQ ID NO: 7957 - protein, 64 aa, Streptomyces avermitilis
MRITIDRDRCIGSGQCAMTAPGVFTQDDDALVALVPGHEDGAGDPRVHDVPMACPVQAVAIFED

SEQ ID NO: 7958 - protein, 416 aa, Streptomyces avermitilis
MNAALPMFERHDMTETEIRLTGSPAPSFPQDRTCPYQPPKAYEERRGESPLTQVTLFDGRPAWLITGHAEGRALLVDPRLSSDWGHPDFPVVVRRTEDRGGLAFPLIGVDDPVHARQRRMLIPSFGVKRMNAIRPRLQSLVDRLLDDMLAKGPGADLVSAFALPVPSVAICELLGVPYGDHDFFEECSRNFVGAATSAEADAAFGELYTYLHGLVGRKQAEPEDGLLDELIARQLEEGDLDHDEVVMIALVLLVAGHETTVNAIALGALTLIQHPEQIDVLLRDPGAVSGVVEELLRFTSVSDHIVRMAKEDIEVGGATIKAGDAVLVSITLMNRDAKAYENPDIFDARRNARHHVGFGHGIHQCLGQNLARAELEIALGGLFARIPGLRLAVPLDEVPIKAGHDAQGPIELPVVW

SEQ ID NO: 7959 - protein, 399 aa, Streptomyces avermitilis
MPEPTADAPTVPKARSCPFLPPDGIADIRAAAPVTRATFTSGHEAWLVTGYEEVRALLRDSSFSVQVPHALHTQDGVVTQKPGRGSLLWQDEPEHTSDRKLLAKEFTVRRMQALRPNIQRIVDEHLDAIEARGGPVDLVKTFANAVPSMVISDLFGVPVERRAEFQDIAEAMMRVDQDAAATEAAGMRLGGLLYQLVQERRANPGDDLISALITTEDPDGVVDDMFLMNAAGTLLIAAHDTTACMIGLGTALLLDSPDQLALLREDPSLVGNAVEELLRYLTIGQFGGERVATRDVELGGVRIAKGEQVVAHVLAADFDPAFVEEPERFDITRRPAPHLAFGFGAHQCIGQQLARIELQIVFETLFRRLPGLRLAKPVEELRFRHDMVFYGVHELPVTW

SEQ ID NO: 7960 - protein, 418 aa, Streptomyces avermitilis
MTKALYEIGETPPLGEVPRQMYASVIRQNRFGEPKQAFRTEVVDTPAVGRGQVLVYVMAAGINYNNVWSSLGEPVDVIGMRQRQGQPEDFHIGGSEASGVVWAVGEGVRSVTVGDHVLLTSGQWDEAAADIRMGTDPLVSESIKAWGYETNYGSFAQFCRVDEYQCHPKPAHLSWEESAAFLLTGPTAYRQLFGWQGNTVRPGDPVLIWGGAGGLGSMAIQLVRLAGGIPIAVVSSEDRSEYCRRLGAAGTVNRRDFDHWGRLPDAGDAEASARFLRGARGVGKKVWEILGERKSPRIVLEHSGQDSLPTSMYLCDNAGMVVICGGTSGYNGDVDLRHLWMRSKRLQGSHYADTRQCREVINLVGAGMLDPCLSVCDGFQDIGRMHQMMHDNVHPPGNMAVLVNAPRRGEIALELAAA

SEQ ID NO: 7961 - protein, 3352 aa, Streptomyces avermitilis
MSSKEDRLLEYLKRVTGDLRQVRERLREVEEKDDDPIAIVGMACRYPGGVRSPEDLWHLVAAGGDAVGDFPADRGWDVEGIYDPDPDARGKTYARRGGFLYEAGEFDPGFFGISPREAVAMDPQQRLLLETTWETFERAGIDAESVRGSRTGVFVGSGYQDYVNLLVGVGGESDGHLGTGNSASVMSGRIAYTFGLEGPAVTVDTACSSSLVALHWAIQALRNGECSMALAGGVQVMTTPTAFVEFSRQRGLAPDGRCKAFGAGADGTGWAEGVGMLLVERLSDAVRNGHEVLAVVRGSAVNQDGASNGLTAPNGPAQQRVIRQALASAGLSPAQIDVVEAHGTGTTLGDPIEAQALLATYGRERTEDRPLWLGSLKSNIGHSQAAAGVGGIIKMVMAMRHGVLPQTLHVDEPTPHVDWSAGAVRLLTEAVEWPETHHPRRAAVSSFGVSGTNAHTIIEQAPPAQDEGPAGALVDGPLAWVLSARSDAALRAQAARLRPSARGEVRPQDIGLSLATTRAAMRHRAAVVGDNREELLSGLEDLATGTPSSRVLLGRPAGGKTGFLFSGQGSQRIGMGRELYAAYPVFAAAYDEVCAHLDAPVDVDAETLHRTGGTQPALFAVEVALFRLLESLGVRPDFVVGHSVGEIAAAHVAGALSLDDAAKLVSARAALMQALPAGGAMVAVQATEEEVLPHLTDGVSIAAVNGPSSVVVSGDETAALAIAAGFAEQGRKTSRLKVSHAFHSPLMDPMLAEFAEVVRGLAFEQPQLPVVSNLTGQPVEAYTPEYWVRHVRETVRFADSVRTLHDLGVKTFIEIGPGGVLSGMAQGCADDIVTVPVLRADRPERQAVVTALAHLHTHGVSVDWHSFFAGARRTDLPTYAFQREWYWVDAPESAAAEADPVDAEFWETVERGDLQALAETLDIGAGDTFGDVLPRLSSWRRQRKEQSTVDDRRYRESWKRLGELGPAGIGGTWLLAVPAEENEQTAAVRTALTARGATLKTLVVDAASHRAGLAGELAGIGPVDGVLSLLVNGDPVLPTLLLVQALGDAGVDAPLWCLTSGAVAVSGSDAVRDARHAQVWGLGRTVALELPRRWGGLIDLPESVDDQAAVRLADVLEQALTGRWEEDQLAVRASGVFARRLAHAPARAATRRWQPRGTVLITGGTGALGGHVARWLARGGAEHLVLTSRRGADAPGAAALRDELEVLGARVTFAACDVADRDAVAALLAQHVFTAVVHAAGVADAGTVDATTPAAFAAALAAKVGGAAHLDELLGDQELDAFVLFSSISGVWGSGGQAAYAAGNAFLDGLARQRRDRGLTATAVSWGPWADGGMVADGDDEERLRRRGLRAMTPASAITSLQRALDRDETLLTVADVDWSRFIVPFTLGRPSPLLGDLPEVRAALAVDTPAAGHGSGALAESLAALSHQDRARALVDLVRTHAAAVLGHRGAGAVEADRPFRDIGFDSLTAVELRNRINKATGLSLPATLIFDHPTAADLAAHLLAELTGGQHEAVAAAATAAVLDEPIAIIGMACRYPGGVRSPEDLWELVASGRDAISRFPGNRGWDVEALYHPDPDHPGTTYTTQGGFLHDADEFDPAVFGISPREAVAMDPQQRLLLDTTWEAFERARIAPHAMRSTTTGVFVGSGYQDYTGRPLKVPDGVEGYIPSGNAASVISGRLSYTFGLQGPSVTVDTACSSSLTALHLAMQALRGGECSMALAGGVMVMAGPSAFTMSSRQRALSADGRCKAFSSSADGTGFAEGVGLVLLERLSDARRNGHEVLAVVRGSAVNQDGASNGLTAPSGKAQQQVIRQALANARLAPDEVDAVEAHGTGTRLGDPIEAQALLATYGKERSEGRPLWLGSLKSNIGHTQAAAGVGGVIKMVMAIRNGILPQTLHVDEPTPHVDWAGGNVRLLTEQTAWPDQDRPRRAAVSSFGMSGTNVHTIIEQAPQTATAAEVEQPPAAQDATAAQPLDVFPWALSAKTDRSLREQARRLLNHLDRTEGLTLPDVGRALVTTRTQLEQRAVVVGQDRHELRAGLAALADGKPADTVVQGTASASGKVAFVFPGHGSQWTEMARELLDTSPVFAEQAKACAEAFAPYLDWPLLDVLRAEPDAPDVADVEVAQPALFTVMVSLAALWRSYGVTPAAVVGHSQGEVAAAYVAGALTLDDAARIVALRSRSLTKLIGKGAMLAIAMPAERVRARLEKYGDRLSVAAVNGPAALTVSGEPDAVDELLAELEAEGVRVRKVRGATGAGHSTQVESLRPELLHLLAPVAPGAAEVPYYSTVTGTVLDTTTLDAEYWYRNARHTVEFEWTVRTLLADGHGVFVECSPHPLLADAVQEIAEETGADAVTGSSLRRGQGGMDRFLRSVSELHVSGVHVDLTAPFAGRPVRRVDLPTYAFQPQRYWLESADPVPAGTDPVEAGFWELVENTDLSGLADELGADDAALVGPALPVLSAWRRRSREKSTVDGWRYRVSFRRLTDHAAPGLNGLWLAVLPAGLADEQWAPCVVGVLAAHGAKVRVVELPVDCDRSQAAKRLAEELRGEQPAGVLSMLGLAPGCHPAHPTLSASLATTVTLLQALGDVDVQAPLWCATRGAVSTGVTDPLRDAGQAQLWGLGVVAALELPRRWGGLVDLPEELDEHALRRLAGVLAQHDEDQLAVRVDGVYGRRMVRARPADEESATPWKPRGTVLITGGTGGVGRHLARWLAGAGAQHLVLTSRSGPDAPGAQELHAELTALGAEVTIAACDMADRAAVARLLAGIESRHPLTAVLHAAGTARSSMLADAGLDEFAEAAASKVTGAIHLDELLDGRELDAFVLFASGAGVWGSGGQASYASANAFLDALALRRRARGLTATSVAWGGWAGGGMVDDAVQERGERRGLGVMAPELAISALREAVEHDEAALTVAPIDWEKFLPAFTVGRPSPLLADLPDVQRLLEAEQAVGEGTSAGAALATELAALAPVEQEERLLEHVRAQSAVVLGHASAEDVLPTAHFLELGFDSLTAIDLRRRLSAATGLRLPSGLAFDHPTPARLAKHLLTRLQSTGSAAAEERPADMLVQLYRHASENGTAAEAMGMLMEAARFRPSFERPEELDRRPAPVRLSQGDHPLALMCFSPYVVPAGAHQYARFAAPFRDRLDVWALVHPGYEKGEPVPSDPDVVFRLHAQTVRECAGGKPAVLLGYSSGGWIAHGVAAHLEAMGERPAAVVMVDSFSREVPFDHQVLNAMAQAHSQRLDFMRSGGEQLTAMGRYMRLFDDWAAPQIAAPTLLVRASEPMLAGAGDGDGRAAPPEHVDTIVEVTGNHYSMLEDHAGTTAAAVDSWLADAVTDASGPVAPADATTA

SEQ ID NO: 7962 - protein, 6145 aa, Streptomyces avermitilis
VDLSQTRRQLGELEAKDTEPIAIVGMACRYPGGVASPEELWQLVASGGDGVSGFPTDRGWDLDTIYDPEPGRTGRTYVREGGFLYDAGEFDPAFFGISPREALVMDPQQRLLLQTSWEALERAGIDPVTARGTRAGVFVGTNGQDHAYLQRQGDSDSEAHLVTANTAAVVSGRISYALGLEGPAVTVDTACSSSLVALHLAAQALRRGECSLALAGGVTVMATPNTFIAFSAQRGLSPDGRCRAFSSTADGTGMSEGIGVLLLERLSDARRLGHEVLAVIRGSAVNQDGASNGLTAPNGPSQERVIRQALENARLTASQVDAVEAHGTATTLGDPIEAEALLATYGQEHSDDRPLWLGSIKSNIGHTQAAAGVAGVIKMVMAIRNGVLPQTLDVDEPTAQVDWSAGGVKLLTEAVAWPESDHPRRAAVSSFGVSGTNAHTIIEQAPALDREPAAEPAGAPAAGALPWVLSAKSDAALRAQAERLLSFLEDGRSGGTGPGRSPADIGFSLATTRTAWDRRAAVVGESLEELTEGVRALASGTPSAAVVRNAARHGDKTGFLFSGQGSQRLGMGRELYDAFPVFAAAYDEIRAHLDVALDADAEQLNQTGCTQPALFAVEVALFRLLESWGVRPDYVAGHSVGEIAAAHVAGVLSLGDAARLVSARAALMQALPAGGAMVAVQAAEDEVVPHLTHGVGIAAINGPRSVVVSGAEDAVLAIVEVFTQQGCKTSRLMVSHAFHSPLMDPVLEEFAEVVRGLTFSEPRIPVVANLTGRLAEAYTPEYWVRHVREAVRFADGIETLGELGVTTFVEIGPGGVLSALVQGCFDDGTDIVTVPSLRADRPEPYALVTALAELHVSGAELDWHAFFPGARRVDLPTYAFQQQRYWLEAREAETATVDAVDAEFWASVESEDAQSLAATLGLNPEELDVVVPKLSAWRRRRREQSVVDGRRYQLAWQPLNGLSAGDLSGSTWLFAAPEGDEWAGTVRTALAGRGAHLIPLTVGADADRASLTDELTRVAGEAGSLDGVLSLLATDEIASPEHPALSQGFAQSVALAQALGDAGVDAPLWCATRGAAATGRSDDAPLSAVQNQVWGLGRALALEHARRWGGLIDLPAAVDERAAGRIAAVLSQGADAADGQEDQVAVRATGVFTARLAHARSGVGRPWSPRGTVLITGGTGALGGHVARWLAGAGAEHLVLTSRRGADAPGATALKAELEELGARVTLAVCDVADRDALAALLAEHTFTSVFHAAGVEQFAPFDELTPADFARTMAAKAHGAAHLDELLGDRELDAFVLFSSIAGVWGSGLQTAYAAGNAFLDGLAARRRARGLTATAIAWGPWADGGMVTDADEAHLRRRGVVTLPAALAVTAVQRALDCDDTAVVVADIDWERFIGPFTFGRPSALLSELPEVRRAGAVTAAVTAAPADVGATPLAARLAGLPEAERTHTLIDLVRAHVAAVLGHSSAAEVEPDRAFKALGFDSLTAVELRNKVNTATGLALSPTLVFDYPNATALARFLQSELLGSQAVVEQEQHAAADDEPIAIVAMSCHLPGGVDSPEALWDLVTSGGDAISEFPSNRGWDVEALYDPDPDRPGKTYARDGGFLYGATDFDAGFFGISPREALAMDPQQRLMLETSWEAFERAGIAPAQLRGSRTGVFVGMAYQGYGADVRRTPEGVEGHRLVGGASSVVSGRVAYTFGLEGPAVTIDTACSSSLVALHLAMQSLRNGECTMALAGGVTVMAGPSVFVEFSRQRGLSPDGRCRAFGADADGTGWAEGVGMLLVERLSDARRNGHQVLAVVRGSAVNQDGASNGLTAPNGPAQQRVIHQSLASAGLAPRDVDAVEAHGTGTRLGDPIEAQALLATYGQGRDGDRPLWLGSLKSNIGHTQAAAGVAGVIKMVMAMRHGILPRTLHADEPTPHVDWSAGDVRLLTEAVDWPESDRPRRAAISSFGVSGTNAHTIIEQAPATAELPPTPDSGALVPWVLSGKGEPALRAQAARLADHLDANDGWTASDIGLSLASRETFEDRAVLLAQGSDKLRQALTALAAGQPAANVTLGRARSEGKVGFLFSGQGSQRIGMGRELYEAFPVFADAYDEVCARLEAPVDVDAETLHRTGCAQPALFAVEVALFRLLESWGVRPDYVAGHSVGEIAAAHVAGVLSLDDAVRLVSARAALMQALPVGGAMVAVQATEEEVLPHLTDEVGIAAINGPRSMVLSGAGEAVTAIAEVFVGQGRKTSRLKVSHAFHSPLMDPMLEEFAEVVRGLTFHQPQVPVVSNLTGRLAEPYSPEYWVRHVREAVRFADGIETLGELGVTTFVEIGPGGVLSGMVQDCVDEAVTVPVLRGDRPEQQAVVTALAELHVHGVSPDWQALFPGAHRVTLPTYAFQRERFWLDGEGDLAAAGTPTDAADSGFWDSVEREDAESLAATLGVSADASLGAILPRLSAWRRQRREQSVVDGWRYRVTWKPLGALPQPGASGTWLLVVAGESEWTASVRTALDERGLELVTLVAGPGTDRGTLARELAGVGPVTGVLSLLAEDESASAGDPGLSHGLAATLCLVQALGDVGVDVPLWCATRGAVATGRSDRVDRPLQSQVWGFGRAAALEHPRRWGGLLDLPELLDARTAARVAAVLGQTAEDQVAVRASGVLGRRLVRAARATGPAQGWSPRGTVLITGGTGALGGHVARWLAGAGAEHLVLTSRRGPAAPGAAELVAELEELGAAATVVACDAADRDALRALLAQHPVNAVVHAAGVGDHVMIEDSDPAGFAGSVAAKAAGATHLDELLAGQELDAFVMFSSGAGIWGGAGQGAYSAANAYLDALAEHRRAHGRTALAVSWGGWAEGGMAGVGDGEEMLRRRGLPPMRPALAISALQQALADGETALTVADFDWERFIGPFTVTRPSALFSDVPEAGRALEAPAPGGAEAGNALAAKLTGLPAAEQDRTLVDLVRTHAAAVLGHDGTAAVEPGRAFNDLGFDSLSAVELRNKLTADTGLKLPTTLVFDYPNATALARFLRAELLGSRGAARQEQRTAAVGDEPIAIVAMSCRLPGGVGSPEDLWQLVTSGGDVISGFPEDRGWNVEALYDPDPGTPGKTYARDGGFLYDAGDFDAALFGISPREALAMDPQQRLLLEASWEAFERAGIDPASLKGSRTGVFVGMSYQGYGAGLPQVPEGVEGHLLTGSAASVVSGRVAYSFGLEGPAVTVDTACSSSLVALHLAIQSLRNGESTMAVAGGVNVMAVPAAFVEFSRQRGLAPDGRCKAFGAGADGTGWAEGVGVVLVERLSDAVRNGHEILAVVRGSAVNQDGASNGLTAPNGPAQQRVIRQALASAGLTEADVDAVEAHGTGTALGDPIEAQALLATYGQERPEDRPLWLGSLKSNIGHAQAASGVAGVIKMVMAMRHGVLPRTLHADEPTPHVDWSAGAVRLLTEAVGWPDTNRPRRAAISSFGVSGTNAHTIIEQAPVAEPAAVAPVEVSSATVPWVLSGKSEAALRAQAERLLTLTADGAEPSLTDVGFSLATTRAALEHRAAVVGADHGRIAEGLRALASGAPAPGAVLGRADAGQVGFLFSGQGSQRIGMGRQLYEAFPVFAEAYDEVCAHLDRHLDRPLRDVAFGENGHEDGEELNRTAFTQPALFAHEVAVHRLLESWGVRPDYLAGHSVGEIAAAHVAGALALEDAAALVTARAALMQALPAGGAMIAVQATEDEVLPHLTDDAGIAAINGPQSVVVSGTEDAVAAVADFFAREGRKISRLTVSHAFHSPLMDPVLEDFARVVGGLRFETPRTPVVSNLTGELIDAYTADYWVRHVREAVRFADGIRTLGELGVTTFVETGPGAVLSAMAQGCLDGAVAVASARSGSPEPEAITGALAQLHVHGVPVDWRAFFAGRGARRADLPTYAFQHQRYWLETTAPTAAAGTDAVETGFWETVEREDAQSLAATLELPVEQLDAVLPRLSAWRRQQRRESAVEGWSYRTGWKPLSGLRAHELRGNWLFLVTEDTEAFEAFEWTAAVADGLAARGARLVRVTVDPAADRGALLRQLGEAVRESPLDGVISLLGIDERHHAGHPALSVGTVLTLALVQALGDAGIDAPLWALTRSAMSTGRADAVPSAAQNAVWGLGRVAALEHAPRWGGLIDLPDTVDDRIAGRLAAVLAQSAEDQVAIRDRGVFGRRLSHTAARRNTRAAQGWSPRGTVLITGGTGALGGHVARWLAGAGAEHLVLTSRRGPDAPGAAGLVAELEATGVRVTVAACDVADREALAALLAEHPVNAVVHTAGVDHMEPLEAMTPGACADVLSAKAAGALHLDALLAGQELDAFVLFSSIAGVWGSGHQAAYAAANALLDGLAERRRAQGLPATAVAWGPWAGGGMAEADGADERLRRRGLIPMPAALAVAGLRRALDSGEATATVADVDWERFLPPFTVGRPSALLGDLPEAERILTADSTAGGPGTAAASPLADRLARMPETEQHALLVDLVRTHAAAVLGHNNAGEVEADRAFKDLGFDSLTAVELRNKLKAETGLALPPTLVFDHPNAQALARQLRTELTGLTIAAAPEAAAAPAEDEEPIAIVGMACRYPGGVRSPEDLWHLVAAGGDAVGDFPADRGWDVEDIYDPDPDARGKTYARRGGFLYEAGEFDPGFFGISPREAVAMDPQQRLLLETTWETFERAGIDAESVRGSRTGVFVGSGYQDYAARAFNAIDDSEGFFGTGNSASIMSGRIAYTFGLEGPAVTVDTACSSSLVALHWAIQALRNGECSMALAGGVMVMSTPRAFVEFSRQRGLAPDGRCKAFGADADGTGWAEGVGMLLVERLSDARRNGHQVLAVVRGSAVNQDGASNGLTAPNGPAQQRVIRQALTSAGLTAADIDAVEAHGTGTRLGDPIEAQALLATYGQERPAGQPLWLGSLKSNIGHTQAAAGVAGVIKMVMAMRHGVLPQTLHVDEPTPHVDWSAGDVRLLTEAVAWPESERPRRAAVSSFGVSGTNAHTIIEQAPPVPAEEATVTPAPALLPWVLSAKSSAALRDQARRLLAFVEDGMSLADVGFSLATTRSALRHRAAVIGESGDGFRRGLGSLAAGMPSPGVVQGRPGGKVGFLFSGQGSQRIGMGRELYEAFPVFADAYDEVCARLEAPVDVDAETLHRTGCAQPALFAVEVALFRLLESWGVRPDYVAGHSVGEIAAVHVAGVLSLDDAVKLVSARAALMQALPAGGAMVAVQATEDEVLPHLTDGVGMAAINGPRSVVVSGAEDAVLEIAEVFTRQGRKTSRLKVSHAFHSPLMDPMLEEFAEVVRGLTFHQPQVPVVSNLTGRLAEPYSPEYWVRHVREAVRFADGIETLGELGVTTFVEIGPGGVLSGMVQDCVDEAVTVPVLRGDRPEQQAVVTALAHLHTHGMSVDWNVFFAGARKADLPTYAFQHEPYWVDAPQIAAAAEAEPVDAEFWETVERGDLQALAETLGVGAGDKFGDVLPRLSSWRRQRKEQSTVDTWRYGESWKGIPDRVPEGPARIGLWLVPVSAAQLGDDWVTACLRGLTERGLAPLPVPVEPATGREDLAAQLTRAAGDETVAGVLSLLAVDCGAAPAAAALTVGVALSVLLVQALGDAGIGAPLWCVTRNAVGVSTADEATDPYQSQVWGLGRVAALEHAPRWGGLIDLPDTVDDRIAGRLAAVLGQSAEDQVAIRDRGLFVRRLSRLPAALSERSWSPRGTVLITGGTGALGGHVARWLAGAGAEHLVLTSRRGPAAPGAAGLKAELEEAGVRVTVAACDVADREALAVLLAEHPVNAVVHTAGTAEAGMLAETSLGDFAATVAAKALGAVHLHELLGDQELDAFVLFSSISGVWGGGGQAAYSAANAFLDGLAQHRRARGLAATAIAWGPWGEGGMVADAGDEERLRQRGLSVLRPDRAISALHGALSGGDGTVTVADVDWERFVVPFTIGRPSALLSDLPEVGDALAEKRTERAAEPSALKAKLSTLSEGERQRLLVDTVCAHAAAVLGHSGSAAVDPDLAFRDLGFDSLTAVELRNLLSADTGLTLPATLVFDHPTPEAIARYLRSELADETGPEEVSVFSELDRLESVISTAASAEQTVRSGVRRRLQELLSLVNSAGEQGAESADAQRQLQDATIDDIFDLIDQDLEIS

SEQ ID NO: 7963 - protein, 1835 aa, Streptomyces avermitilis
MNEDKLRDYLKRTTTDLRQARRRVRELEARAQEPIAIVGMSCRFPGGVGSPEELWRLLAEGEDAISQFPVDRGWDVDALYDPDPEQPGKVYTRQGGFLHDAADFDAEFFGISPREALAMDPQQRLLLEAAWEAFEHAGIDPAGLKGSRTGVFAGLMYHDYGFTPGVLPEGVEGLMSTGNSGSVASGRIAYTFGFEGPAVTVDTACSSSLVALHLAVQALRTGECSMALAGGVTVMAGPSAFVEFSRQRGLAPDGRCKSFAAAADGASWSEGTGLLLVERLRDARRLGHKVLAVVRGSAVNQDGASNGLTAPNGPSQQRVILEALAGARLSAEEVDAVEAHGTGTSLGDPIEAQALLATYGQERERPLLLGSLKSNIGHTQAAAGVAGVIKMVLAMQHGVLPKTLHVDRPTPRVDWSVGSVDLLTEAIAWPETDHPRRAGVSSFGISGTNAHIILEQAPEPEAGDPADDTAEGEGVAEELLRARTTVVPWVLSAKNGAALREQAQRLLSSVDLAAASPADVGFSLAATRSALEHRAAVVGADGEELRAILTALAAGEPAAQVVTGRAGADRGKVGFLFSGQGSQRIGMGRELYEAYPVFAAAYNEVCALLDLPVDVDAETLHQTGSTQPALFAMEVALFRLLESWAIRPDYVAGHSVGEIAAAHVAGVLSLGDAARLVSVRAALMQALPAGGAMVAVQAAEDEVLPYLTGEVGIAAINGPQSVVVSGAEDAVMAVAEVFAAQGRKTSRLKVSHAFHSPLMDPMLEEFAAVVRGLTFGEPRIPVVSNLTGRLAEPYTPEHWVRHVREAVRFADGVRTLHELGVTTFVEVGPGGVLSALAQGCLDDADIVTVPALRTDRPEPQALTLAVGQLHTRGVSPDWQALFPGALRVDLPTYAFQRERYWLKGTTAVDVSSAGLDSSGHALLGAVVETAGAQDVLFTGRLSPADLPWIAEHTVGGVPVLPVAAFVELALSAGRQAGFPYLEQLDVDAPLVLAEQGAVRIQVQIGADDDPDRRSVRVFSRPAAGSSGEPWVRHVTGKLTRNAPAPEFDQMIWPPTGAEPGDVEGRPGLRAAWRAGDELYAEAELPVTERDRADRYALHPVLLDAALGMATSDRAADPGEVLMPHAWSGMSVHTPGPGAVRIRIRPVGDDAVAIELSDADGSPVASVASVRTRTMTAQQVLASRVAHQDWMFEIDWVEHTAASAPATAAVADWAVLGDEGVHSDIDALRKAVDGGAATPAHVLLPCAPSEGDAAAATRGALAGVLSVVQEWVADERFSDARLVVMTRGAVELDGTALDLAHVAVSGLVKSAQTEHPDRLLLVDADDSVTNGGTVTDGGVDPALAAALAALDEPQAAVRDGKLYVPRLARITPPEEPTGHAWDPEGTVLLTGATGGLGRSLARHLVAERGARRLLLASRRGPAAEGVGELVAALSELGAHVDVAACDIADRDALAELLASVPAEHPLVAVVHAAAALDDGVITALTPGRLDTVLRPKADGALHLHELTRDLNLSAFVLFSSLAGVLGSAGAAGYAAANAFLDGLARQRRAAGLPGTSLAWGLWTDNGGMGDRITDADRNRMGRAGVVPFSPAEGLALFDAALTVDRPVIVPVRLDVPGLRAMARAGMLPAVLRGLVGDTGAAAGEAAAAGTTALARRLAGIPEADQEKVMLDLVRHQAAAALGHATAARIEPTTAFRDIGFDSLTAVELRNRLKAATGLRLKPTLVFDHPNPVAIARLLHKDLVLDLTAEAPPVLGELDRLEAQLAALAPQDAVRDKITARLKALLWKWTDTHQDAAANTADDGHGTDRDFDLDLDRIDAATDDEMFDLIDQELGSH

SEQ ID NO: 7964 - protein, 3564 aa, Streptomyces avermitilis
VANEDKLRHFLKRVTADLQETRRRLRDYEDAAGEPVAIIGMSCRYPGGVDSPEDLWELVAGGRDAVSEFPADRGWDLDALYDPDPESRGTSYAREGAFLRDLARFDAGLFGISPREALAMDPQQRLLLETSWELFERAGIDAASLAGSRTGVFAGVMNHEFLAALQNSPQDLEGYLGTGTSGSVASGRVAYTFGLEGPAVTVDTACSSSLVALHLAVQSLRNGECSLAVAGGVTAMVGPATFVGFSRQRGLAPDGRCKPFAAGADGTGWGEGAGLLLVERLSDARRNGHEVLAVVRGSAVNQDGASNGLTAPNGPSQQRVIRQALAAAQLTTAQVDAVEAHGTGTRLGDPIEAQALLATYGQGRPDDKPLWLGSIKSNIGHTQAAAGVAGIIKMVMAMRHGELPRTLHVDAPSVHVDWTAGAVRLLTERTPWSASDQPRRAGISSFGISGTNAHTIIEEAPSAEAFAQDTGAPEGPEEGAESAEPVASEAARPAAGGPVPWVISGRTEEALRAQAERLLSRTDAEVPPLDVAFSLATTRTALEHRAVLQGETPAELAEGLRAVASGSPARGVARGLSGTGGRVGFLFSGQGSQRLGMGRELYASYPAFAAAYDEVCAQLDAVVDVDSEELHRTGAAQPALFAVEVALFRLLESWGIRADYVAGHSVGELAAAHVAGVLSLDDAAKLVSARARLMQALPAGGAMVAVQATEDEVLPHLTDAVGIAAINGPRSVVVSGAEDAVTAIAEAFRQQGRKSSRLKVSHAFHSPLMDPILEEFAEVVRSLTFHRPQIPVVSNLTGRLAEPYTPQYWVRHVREAVRFADGVRTLNDLGVTTFVEIGPGGVLSALAEGCLDDDVVTVPALRADRPERVALVAAVSELHAHGVSPDWHAFFPGARRVDLPTYAFQYERYWLDASPAAPGGVRAAGLGSADHPLLGAAVSLAGGDERLLTGRLSLRTHPWLSDHAVLGTALLPGTAFVELAVRAADEAGCALLEDLTLEAPLVVPEQGGVAVQVWVGAVDGTGRRPLTVHSRPEDDSDLPWVRHATGFVTEGSEEAGAAAADRTLTAWPPTGSEPVDLDGFYDRLAALGLAYGPAFRGLRSAWRTGEDVFAEVALPDGTDTGSFLLHPALLDAALHAIGAGGADGSLVAEADGPLLPFAWSRVSVRATGASTLRVRLAPAGTDAVSLLVADGAGEPVASVESLTLRAVSAERLRKRSGDAMFTVERAPLTLPSDDADGTAVAYVPDLAALAEADGPSQPDVVVVPCPDGPEGATEAERVRAVSTDVLRLVQRWFAEDRTPRLVLMARCDDLAHAAAGGLVRSAQAENPGRIVLLETDRPDEAAALVPGVVLSGEPHVVVREGEVSAPRLARAASLATEDAVTGRADEAASALVEGAASRLGTVLLTGAAGALGKTLARHLVTGHGVRRLLLVSRRGADAPGAADLKAELAALGAEATWAACDLAERDALARLLAATPVDSVVHTAGVLDDGVIAALTPERVGAVLAPKADAVLNLDELTGPSTTFVLFSSAAGVFGNPGQGNYAAANAFLDAFARHRHAQGRPTVSLAWGLWEQEGAMADALDEAGRSRMARSGVLPLPTEDGLRLFDAALASNEPVLVPVRLDTAALRNRAAETVPALLRGLVRVSLRGTAQRAAAGSLAERLAGLAADERDEALLELVRGEVAAVLGHSSSRAVQPTYAFQDLGFDSLTAVELRNRLATATGLRLPATLVFDHPTPAALARHIGTELLGEAPAVTARAAARQTATAADEPIAIVGMSCRLPGGVRSPEDLWRLVASGRDGITRFPDNRGWDVDGLYDPDPERLGKTYARDGGFLHEAAEFDAGFFGISPREALAMDPQQRLLLEASWEAFERAGIDPATIRGSRTGVFTGLMYHDYGQGPRQLPEGVEGLLTTGGSGSVASGRVSYTFGLEGPAVTIDTACSSSLVALHLAVQSLRNGECTMALAGGVTVMAGPTVFVEFSRQRGLSPDGRCKAFAAGADGTGWGEGVGLLLVERLSDAERNGHRVLAVVRGSAVNQDGASNGLTAPNGPAQQRVIRQALASAGLKPADVDAVEAHGTGTTLGDPIEAQALLATYGQERPAGQPLWLGSLKSNIGHTQAAAGVAGVIKMVMAMRHGVLPQTLHVDEPTPHVDWSAGDVRLLTEAVAWPDSDRPRRAAVSSFGVSGTNAHTIIEQAPTTEELPLTSDSGAAVPWVLSGRTEAALQAQAAGLVSFLDDHDGDNDRDDVGEAAFAADVAYSLATTRAAFEHRAVVVGQTLQELRQGLAGVAGGATPPGVVTGTAHTGGKTVFVFPGQGSQWVGMAAKLLETSPVFRDRIDACERALAPHVDWSLTAVLRGTSEVEQDRVDVLQPVLWAMTVALAEVWRSFGVTPDAVVGHSQGEVSAAVIAGAISLEDGARVVVRRSLAVRELQGRGAMASVTLPDEKARELVGRWTGRLGIAAVNGPATVVVSGDTDALDEFLAHCQQDAIQARRVAVDYAAHSPQIERVEAQASEGFAGISPLPGSVPFYSTVTGGKLAADELGSGYWYRNMRQTVRFHDAIRAALADGHDVFVEVSPHPVQLAGIQDAIEAADADAAVVPTLRRRDGGRNRLMLALAQALVHGVAIDWDAVLPGARRVDLPTYAFQHERYWLEAGAPAGDVRAAGLDAADHPFLGAAVELPDAGGHLLTGLLSLQAQPWLADHAVLGTVLLPGTAFVELAAHAAAETGCDLVEELTLQAPLVLPEHGGVALQVLVGAQDDSGRRPLSVHSRAGDDGPWIRNATGVLAAGGAPSGTDLSNWPPADARPVDLDGFYDRMADLGLSYGPLFQGLRAAWRGHDAVYAELAVPDLAQTDAFGVHPALLDSALHALGAGGLVPAADGPLLPFAWSRVTVHGTGAAGLRVRLSQVGGDAVRLEAADGTGRPVVSVESLTLRPVSVEQLRPSSRDSLFTVQWAPLAATADARTPVVQAYDGIAALLAAPTVETGAQADTDAVVVPCPGGSGTDVERVRSVLAEVLWLVQWWQAEDRAARLVLVTRGAVAAGDESAQGDPVQAAVWGLVRSAQSENPDRIVLLDTEQNADVEQVAATVVPRLVASEEPQAALRGDALLLPRLARAAADAPRATPDFGTGRVLLTGASGALGGLVARHLVAEHGLRSLLLMSRRGADAEGAAELQEELTAAGAEVLWAACDVADRDALAEVLSGTPVTAVVHTAGVLDDGVIGSLTPERMEMVLRPKVDAVLNLHELAGDVSAFVLFSSLAGTLGTPGQANYAAANAFLDAFARRRRAQGLPAVSLPWGLWQRTGTMTEDLGGADRTRLARGGVLPLSDEDGLELLDAALALQEPLVVAARLDLAALRNATAPVPPLLRALVGGRLRRTDRAAAVPLAQRIAGLPESEREEAVLDLVRSEVAAVLGHSSAKTVQPDQAFGDLGFDSLTAVELRNRMNQATGLRLPATLVFDHPTPAVLAQRVLKDLPGGTAGTAPVFDELDRLGAALDGAGADGIDNITRTKINMRLQALLARWNGNEPADPGGAGGAEDEDDLSSASDEELYELLDDELGIS

SEQ ID NO: 7965 - protein, 7746 aa, Streptomyces avermitilis
MVESELNATGNRDCSASADSADGIAVIGLACRLPGAADPAAFWRLLSEGADAITDVPPDRWDGAVVADASAPDRTGIRRGGFLDSIGDFDAGFFGLSPKEAAAMDPQQRLVLELAWEALEDAHVRAATLRSTRTGVFVGAMWDDYATLHHRSGLTAISPHTVTGLHRSIIANRVSYFLGLNGPSLTVDSGQSSSLVSVHLACESLRKGESTIALAGGVNLNIVPESALGAAKFGGLSPDGRCFTFDARANGYVRGEGGGIVVLKPLARAVADGDPVYCVIRGSAVNNDGGGDGLTVPLQSGQEQVLRLAYERAGVNPADVGYVELHGTGTKVGDPIEAAALGAVLGTGREPGRPLRVGSAKTNVGHLEGAAGITGLLKAVLSLNHRELPASLNFGTPNPAIPLDRLNLRVQTEHSEWAAEDGRPLLAGVSSFGMGGTNCHIVLASGAAVEAGEGATAGGGAAPTFWPLSAKTASGLRAQAAALLAHTEAPLGLALPDVGWSLATGRTAFEHRAVVVGEVRDDFLRALRELSTGGIDAALTTGRAGPRGELAFLFSGQGSQRAGMGRELAESVPAFASALDEVCAHLDPLLPRPLREVMFAPVGTGEAAELDQTLYTQTSLFAVEVALFRLLESWDITPDVLMGHSIGELAAAHVAGVLSLADACALVAARGRLMQALPAGGAMIAVQAAEDEVRARIGERTDRVSIAALNGPDSVVVSGDEDLATEIADAFAALGRKTSRLRVSHAFHSPHMEPMLAEFRNVAEGLTFHAPRIPIVSNVTGRLSEEPSGYEGCTAAYWVRHVREAVRFADGVARLDEQGVRTYLELGPGGVLASMARAGADSESLFVPALRTRRPEAQALLAAVASLHVHGVEPDWDALFGGGRGARRKVALPTYAFERQRYWLDGDTTSPVATTGWAPVAPQPDAIAETDSAPVGALGRRLAGLAESERDEAVLDMVRAHIAAVLGHAEARQVETEWTFKDLGFDSLSSVELRNQLSEATGLRLPSGLLFDHPTPAALARHLAAQSLGGGDAAAAAPATVADPHEPIAIVAMSCRLPGGVSSPEDLWRLLASGGDGISGFPTDRGWDVETLYDPEPGTPGKSSTRHGGFLHEAAEFDAGFFGISPREAAAIDPQQRLVLETAWEAFERAGIDPATLRGSRAGVFIGATAQDYGPRLHEPADGVEGYLLTGTTTSVASGRVAYSFGLEGPAVTVDTACSSSLVALHLAVQSLRSGECTMALAGGVTVMSTPGMFVEFSRQRGLSADGRCKAFAAGADGTGWAEGVGMLLVERLSDARRNGHQVLAVVRGSAVNQDGASNGLTAPNGPSQQRVVRQALAAAGLAPADVDAVEAHGTGTLLGDPIEAEALIAAYGQGRDGDRPLWLGSLKSNIGHTQAAAGVAGVIKMVMAMRHGVLPRTLHVDEPTPHVDWSASGVRLLTEAVEWPARDLPRRAAVSSFGISGTNAHVIVEQAATSEEPARGTAVAGPVPWVVSAKSDVALREQAGRLLSFLDAEGVGGAGVRPEDVALSLATSRAVLERRAAVVGGDLAELRQGLEALASGASGAAPVGGAVGGRVGFLFSGQGSQRIGMGRELYAAYPVFAAAYDEVCAFLDAPVDVDSEELNQTGTTQPALFAVEVALFRLLESWGIRPDYVAGHSVGEIAAAHVAGVLSLEDAAKLVSARAALMQALPDGGAMVAVQATEDEVLRHLTDGVGIAAVNGPRSVVVSGAEDAVTAVGEIFAGRGRKTSRLKVSHAFHSPLMDPMLEEFAAVVRGLTFSESRIPVVSNLTGRLAEVYTPEYWVRHVREAVRFADGIETLGELGVTTFVEVGPGGVLSALAQGCFDDGTDIVTVPVLRADRPEPYALVTAIGRLHTHGISPDWQVLFPGARRVDLPTYAFQRERYWLDAPRAATAGAPDAMDAEFWDSVESEDRASLGALLGLEPTELDVVASKLSAWRRKRREQSTTDGWRYRITWQPLDDMVRAAPSGTWLYVVSEETAWTEAIRAGLTELGVALVPFAVGEDTDRDALARAFADAGQEQADGILFAAAQGEAGANALQRLVLLVQALGDAGIEAPLWCLTSGAVSTGTADLLTDPVSAQLWGLGRIVALEQPQRWGGLVDLPAELDSRALERLAGLLAQADEDQLAVRASGVYGRRLVRAPLSAAPADAPWSPRGTVLVTGGTGALGGQVARWLAGAGAEHLVLTSRRGPDAPGAAELKAELEELGAQVTVVACDAADRDALAELFGRYIVNAVVHTAGVLDDGLVESLTPERLNHVLRPKVDAALHLHELTRDRQDLDAFVLFSSMTGVWGNGGQGAYGAANAFLDALAEHRRAQGVPALAVAWGSWADGGMADGAAGDHLRRRGVRAIAALPAISVLHGALTHGETSMTVADVDWERFVPAFVGTRPCPLLLGVPEAREALEARARAAQSPEVPVSALVQRLLGATPGEQGRILLDLVREQAATVLGHTGKGAFEADRTFRETGFDSLTAVELRHRLNTATGLRLPTTLVFDHPTPTALARHLGEELLGRHGLETAAAQATAAAAADEPLAIVGMSCRLPGGVQSPEDLWELLSSGRDAMSGFPTDRGWDIDALYDPDPDRPGKTYSREGGFIQGADRFDAGLFGISPREALAMDPQQRLLLETAWEAFERAGIALASVRASRTGVFIGTNGQDYANGLRNAPEEIEGYALTGKAASVVSGRISYTFGLEGPAVTVDTACSSSLVALHLAAQALRSGECSMALVGGVTVMTTPDLFVEFSRQRGLSPDGRCKAFAAGADGTGWGEGVGLLLVERLSDARRNGHQVLALVRGSAVNQDGASNGLTAPNGPSQQRVIRQALASAGLTPADVDAVEAHGTGTRLGDPIEAQALLATYGQEHSDDRPVWLGSVKSNIGHTQAAAGVAGVIKMVLAMRHGVLPQTLHVDEPTAHVDWSAGAVRLLTEPVQWPGTTGPRRAAVSSFGIGGTNAHTIIEEAPAAAAAEPAREHRPVPVPWVLSAKSEVALRAQAERLLAFATDDVSPVDAGFSSATTRSALEHRAAVIGSDPAELRAGLEALAAGEPAANVVAGRAHSADKVGFLFSGQGSQRLGMGRELYAAYPVFAAAYDEVCALLDATVDVDAETLHQTGSTQPALFAVEVALFRLLESWGIRPDYVAGHSVGEIAAAHVAGVLSLEDAAKLVSARAALMKALPAGGVMVAVQAAEDEMLPHLIDRAGIAAINGPRSVVISGAEDAVTAIAEVFAAQGRKTSRLKVSHAFHSPLMDPMLEEFAEVVRGLTFSEPWIPVVSNLTGRLTESYTPEYWVRHVREAVRFADGVLTLHELGVTTFVEIGPGGVLSALVQGCLDDGTDIVTIPALRADRPEPQALTTAYAQLHVSGAEVDWHAFFPGARRVELPTYAFQRERYWLDAPASAGDMRAVGQGEAGHPLLGAAVPLADSVGHLLTGRLSKHTHPWLVDHAVSGVALLPGTAFVELAITAADAVGCDLLEELTLETPLLVPERGGVALQVHVGADDGSGRRPLTVHSQIDDGDAYAHEDDSERAWVRHASGVLTVATGGPVDGSLTAWPPVGAEPVDVDGFYDRLAGMALDYGPVFQGLRAAWRSGDDFFAEVELPGAERTDAGAYGLHPALFDAALHTVWLGAVEPEAGTGNGLLPFAWSGVRLAAAGASDLRVKVSRAGTGTSTVSLVLADGTGGPVAEVDSLTLRPVPADQLRAGSGSDDAVFGLKWTPVSLPSAPDGMRIETYEDLAALRATDPPADTEADAAAAADAVVVPCPTGTGADLATRVREVTHAVLELVQWWLAEERPGRLVLVTRGGDLAQSAVCGLVRSAQTENPDRIVLVETSSDAHAGAGSGVDDADLARVLPGLIASGEPQAAVHADDEVRVPRLVRVAVPDAEPELPGLGSGTVLLTGASGGLGGLFARHLVAEHGVRSLLLVSRRGGDAPGAAELTADLTAQGADVTWAACDVADRAAVRALLAGPGQSLSAIIHTAGVLDDGIIGSLTPERLDAVFRPKVDAALNLHDLAGELSGDLSAFVLFSSVAGTLGTPGQANYAAANTFLDALAEHRRAAGQRATSLAWGLWAQDSESAMTGSLDHTDLTRIQRMGLAAIPSSDGLRLFDAALALDRAVVAPLRLDLGGLQGTVPPVLRGLRGTVRGTARRTAQTAPKGSLGQRLAGLAEAEREQVVLDLVRTEVAAVLGHAGAQSVGADDSFKDIGFDSLTAVELRNRLNSAVGMRLPATLIFDYPNPLTLAHFLTGEAAGGEAATAVPTTLSTATGTADEPIAIVGMACRYPGGVQSPEDLWQLVFSGRDAVSGFPEGRGWDVEQLYDPNPDQWGTSYTREGGFLHDAADFDAEFFGISPREALAMDPQQRLLLETSWEAFERAGIDPATVRGSRTGVFAGVMYHDYGGRVHTSPPGLEGYLVNGSAGSIASGRVSYTFGLEGPAVTVDTACSSSLVALHLAAQALRSGECSMALVGGVTVMAGPSVFVEFSRQRGLSADGRCKAFGAGADGTGWAEGVGMLLVERLSDARRNGHKVLAVVRGTAVNQDGASNGLTAPNGPSQQRVIRQALANAGLSSDEVDAVEAHGTGTRLGDPIEAQALIATYGQERSEDRPLWLGSLKSNIGHSQAAAGVGGVIKMVMAMQHGVLPQTLHVDEPTPHVDWSAGAVQLLTEAVEWPASDGPRRAAVSSFGVSGTNAHVIVEQAATSEVTARGTAVAGPVPWVLSAKSDAALREQAGRLLSFLDAEGVGGAGVRPEDVAYSLATSRAVLECRAAVVGEELGEFRQGLEGIVSGAAPVGGAVGGRVGFLFSGQGSQRIGMGRELYAAYPVFAAAYDEVCALLDATVDVDAETLHQTGSTQPALFAVEVALFRLLESWGIRPDYVAGHSVGEIAAAHVAGVLSLEDAAKLVSARAALMQALPAGGAMVAIQATEAEVLPHLTHGVGLAAINGPRSVVLSGSEDAVLDIAEVFAQQGRKTSRLKVSHAFHSPLMDPMLEEFAEVVRGLTFSEPRIPVVSNLTGRLAEVYIPEYWVRHVREAVRFADGLHTLHELGVTMFVEIGPGGVLSALVQGCLDDGTHIVTVPALRADRPEPYALVTAVGQLHTHGISPEWQALFPGARRVDLPTYAFQRERYWLDAPQASGDVRAAGLGAADHPLLGAAIATADSDGAVLTGLLSLGTHPWLADHAVNGIVLLPGTAFVELAIRAGDETGCGWIEDLTLELPLVVPERGGVTLQVAVGPEDESGRRQLSVHSRVDDRSWLRHATGVLSSAEAPSAAKLGAWPPAGAEAVDLTAFYEGMAAAGLDYGPVFQGLRSVWRDGDDVFAEVELPDESAAEAAAFALHPALLDAALHALAAGGLVSLDDSPALPFAWSGVVVQAAGAAMVRVKLSRTATGSVTLAVADGAGDPVASVESLSLRAASAEQLPGAVGGDQLFGLEWTRFTLPSATDALMIETVADFDALRESEGTPDVVVVPCPAGSGRETADRVHSTTSEVLALVQWWLAEERAGRLALVTRPGDLAHAAVWGLVRSAQSENPDRIVLVEAEETDEAVRVLPAALASGEPQFAVRDGEVFVPRLVKATRSATGTATGTPDFGVGPVLLTGASGALGGLVARHLVAEHGVRSLLLLSRRGAEAPGAVELEAELAAWGAEVRWAACDAADRDALAEVLAGTPVTAVVHAAGVLDDGVIAALTPERMEKVLRPKTDAVLNLHELTSDLSAFVVFSSVSGILGSAGQGNYAAANAFLDAFAEARRARGLPATSLAWGLWEQGSGMADRLDQADLARLKRVGLAPIAVDEGLRLFDAALALDRAVVAPLRLDLGGLQGTVPPVLRGLRGTVRGTARRMAQTAPKGSLGQRLAGLPQAEREQVVLDLVRAEVAAVLGHASAQAVQPEHAFQDAGFDSLTSVELRNRLNAATGLRLPVTMVFDHPTPVALSRFLLAETLGVQEQAEAAIAAVTGTDEAIAIVGMACRFPGDVRSPEDLWRLVASGGDAISGFPEDRGWDVENLYDPDPDRSGKSYVRHGGFLHEAAEFDPAFFGISPREALAMDPQQRLLLETSWEAFERAGIDPATVRGSRTGVFAGVMYHDYGGRVKTAPEGMDAYLGSGSAGSIASGRVSYTFGLEGPAVTVDTACSSSLVALHLATQALRSGECSMALVGGVTVMATPSTFVEFSRQRGLSADGRCKAFAAGADGTGWAEGAGMLLVERLSDARRNGHTVLAVVRGTAVNQDGASNGLTAPNGPSQQRVIRQALANAGVSSEQVDAVEAHGTGTKLGDPIEAQALIATYGQERPGDRPLWLGSLKSNIGHAQAAAGVGGVIKMVMAMRHGALPRTLHVDEPTPHVDWSAGDVRLLTEAMEWPETDHPRRAAVSSFGISGTNAHVIVEQAPDTAELPPVPDSGKAVPWVLSGRTEAALRAQAERLLSLVPEMDLPPADIGFSLATTRSAMEHRAAVVGESRDELLEGLRALAAGSPSTRVVLGEPGAGGKSGFLFSGQGSQRIGMGRELYDAFPVFAAAYDEVCALVDAPVDVDSEELNQTGTTQPALFAVEVALFRLLESWGIRPDYVAGHSVGEIAAAHVAGVLSLEDAAKLVSARAALMQALPADGAMVAVQATEDEVLPHLTDGVGIAAVNGPQSVVVSGAEDVVVAIGEAFRERGRKTSRLKVSHAFHSPLMDPMLEEFAEAVSGLSFNEPRLPVVSNLTGRLAEPYTPEYWVRHVREAVRFADGLHTLHELGVTTFVEIGPGGVLSALAQGCLDGDIVTVPAVRTDRPEPQAVVTALAELHAHGVSPDWRALFPGARRVDLPTYPFQYERLWLEAPEEYTGTAAATGLGLGAAEHPLAGAAVALPGAGGFLVTGRLSLRTHPWLADHTVMDSVLLPGTALVELAVRAGEEAGCAQVEDLTLEAPLIVPERGGVAVQVWVEAEEEPGRCALSVHSRREDAPDDAPWVRHAVGRLTDALPEPPHGADLGAWPPAGAEAVDLTGFYEGLDGLGLGYGPVFRGLRSVWRSGDDVLAEVALPEGTEAGAFAVHPALLDAALHAVGAGGLVPVLDGPLLPFAWSEVGVRAAGATALRVKLSRTGTDAVSLTVADASGGLVATVGSLSLRPVSREQLLAAGGSGRRADDSLFGLAWQPAVLTETDAAAGLDVRSYADLAALSTEPALPDVAVVTVVPCPAGSGRETADRVHSTTSEVLALVQWWLAEERAGRLALVTRPGDLAHAAVWGLVRSAQSENPDRIVLVEAEETDEAVRVLPAALASGEPQFAVRDGEVFVPRLVKATRSATGTATGTPDFGVGPVLLTGASGALGGLVARHLVAEHGVRSLLLLSRRGAEAPGAVELEAELAAWGAEVRWAACDVADREAVSGMLNGLGEQSLSAVVHTAGVLGDGIVASLTPERMREVFRPKVDAVLNLHECTRDMGLAAFVVFSSVAGMVGSAGQASYAAANSFLDAFSAHRRREGLPAISLAWGVWEQSGAMTDGLVEADRARMARSGVLPLPPEEGLRLFDAALASDEAVLAPVRIDTGALRAGEAPPVLRALVPAAAARRTARAAAAPSASSLAERLEEMPEAEREKTVLDLVRAEVAAGLGHASDRTVRPEHAFQDLGFDSLTAVELRNRLNKATGLRLPATLVFDHPTPALLARHVFMAAAGAAEPALVDSLLADLDRVEQELVTTLAASEARDRILSKLQGLLAIAGEFGKAPAQEGPGTGGSDLESATDDEVFDLLGKEFGIS

SEQ ID NO: 7966 - protein, 344 aa, Streptomyces avermitilis
MPVEFLSHDQVSRYGRFASAPTPGELEQFFRLDAKALESARSKRAPANRLGWAVQWGCVRMLGVFPTEDLSVVPEVVVRFAAEQLGVDPGEFAAYGARRQNRYEHAWEIRDAYAYRESPAAEAQVREFLATRVWASWEGPRALFDRAVGWLVDNRVLLPGITTLTRLVAEVRAQENAALYRTLDEAVPEKLRQSMRDLLKVPEGRRVSELERLRRSPMGVSGSADRLAFSERIRMEAVAMFTAGPGSTDIAKELRVSVQSVQRWRSGLAGDRPGRGAVPQPVSVELSETLFAALDEERAKGFAPSWTIRYLHHDFPIFGQRYAYKWSQGCLHSFGRSAQGYRDQ

SEQ ID NO: 7967 - protein, 417 aa, Streptomyces avermitilis
MGEALITLCTRSTRLAATAGVLGGVLAVTALGGTSNAATSGNGAGNHPTSQARINQAGAQEASDARIEITPGQGTYSVGTNHPVSVTVTSGKLTKVTMTAVATGAEIPGTLSTDGTSWKPNGRLERATKYQIAAEAGDVKGRSTTGSATITTVSPANDFIGHLSPEDGSTVGVAMPVTVNFDKAISDKAAVQSEIRVSSSSGQRVVGHWFNDHRVDFRPENYWRPGSTVTVTLNRHGIQKTVTFKIGRSQISTVDAKTKQMTVVRDGKTIKTIPISSGSPEHPTYNGQMVISEKFRQIHMNGASVGLTEKNGKPSYDIKAVPHAMRLTDSGTFIHGNYWGTDSVFGEANTSHGCVGLKDVRGDSHGRQPAAWFFDHSIVGDVVIVKNSEEKTMLAPDNGLSDWNMSWSEWVAGSPAT

SEQ ID NO: 7968 - protein, 192 aa, Streptomyces avermitilis
VPAGGCARDGVPSTGTGVWSRWTARRWMWRTWANEEFFGRQAGGRGESAFAQARVVALAECGTHAVFGAVIGPAVGGRAELSRQLFPQLGEGKLLLADQGFYGFELWQTARATGADLLWRLRSSAAVPGLQVLDDGSYLSSIRAEADRTVLTAGAQSANRSDRLRRLRLPAGAGLVTLHEAERRPLPAFLLI

SEQ ID NO: 7969 - protein, 212 aa, Streptomyces avermitilis
MKYTTTAPTADCAVRPSRSRRSERPAEAADRAVPGHWEGDLIIGTGRSAIGTLVERSSRSTLLVHLPRLEGWGENPPVKNGTSLGGYGAIAMNTALTASMTQLPEQLRKTLTWDRGKELSGHAQFALDTGTKVFFADPHSPWQRPTNENTNGLLRQYFPKGTDLSRWSSTDLEAVAMAINNRPRKTLGWRTPAEVFEEQLRSLQQPGVATTN

SEQ ID NO: 7970 - protein, 312 aa, Streptomyces avermitilis
MDIAAIDRFEASQGRLASLAYRLLGSAADAEDAVQDTFLRWQAPYRERVEVPEAWLTKVVTNLCLDRLRSAQARHEQAAGAWLPEPLLDSDPMLGPADTFEQRESVSLAVLTLLERLSPVERAVYVLREAFSYSHAEIAGILDITESASQQHVHRARIRVAAERRRGSETDPASARRVVEEFLAAATSGRTERLVALLTDDVTAVSDGAGLSKRLLHYKTRERVASYVRAGFKPTPAKRRLAGGSPAFYIALVNGSPAVLAVVDDRVVGAVAFEVSDGKVASLRGIAAADRLARLNEAWRQHEPDAPAINAW

SEQ ID NO: 7971 - protein, 396 aa, Streptomyces avermitilis
MKHRIVVLGAGYAGAFAAGNLARRLSPADTEITVVNAVPDFVERMRLHQLAIGQDLAFCNLADVFASTGVRLRLARVTGVDPDRRTVAVTGEDGDGELAYDTLLYALGSSVAHHGVPGVAEYAFDVTGRSSALRLRERLAGLGEGGTVLVVGEGLTGIESATEFAESRPDLSVALAARGELGAWLSPKARRHLRQAFDRLGITVHEHTGIEAVEPTRAIAADGTSIPADVTMWSAGFAVHPMAAASGLEVAETGQIVVDRTMRSVSHPDVYAAGDCAYAIGDNGRPLPMSCASAGFTNMQATAAIIARLTGSEVPTTGLKYHGNHISLGRRDAIFQMVDGDGRSKPWYLGGRTAARLKSGVLKGAGWSIAHPTFGMPKRKRRLATAPDRAGVKVAA

SEQ ID NO: 7972 - protein, 172 aa, Streptomyces avermitilis
LEGNATTLVVVRANAGSRTGLGLRRGRNSFCRTGVADRCGHGSTWPRDYMLQDATVTAIRSVLALLRRVTEARRGGVSRESQLRHHADWFTSCASDEDAHALLQAGFGLGAPRHIAVPYADPEQIPGRTSWWGAEPVELARTLVQSGRTSARHGTGRIERNDAQRPGSAPST

SEQ ID NO: 7973 - protein, 111 aa, Streptomyces avermitilis
MSGAPQFLPSQSLPEVPYADFARSLGLGGVRVEKPGDVESAWRQALACDRPFVLDFRTDPAVPPIPPHATLEQIEAAATAILEGDSDRAGVVKQGFKAKVQEMLPGGHRNK

SEQ ID NO: 7974 - protein, 153 aa, Streptomyces avermitilis
LRSAVSKVEESIEVAVPVSTAYNQWTQFEEFPQFMGGVERIEQQTATLTHWVTKVGGVTREFDAEIVEQIPDEQVSWTTVGGDVHQAGVVTFHRLDDRRTKVMLQMDHDSKGVVDAVGDKLGVVKHQVSEDLKRFKSFIENRGQESGAWRGQV

SEQ ID NO: 7975 - protein, 209 aa, Streptomyces avermitilis
LEVAMSERHEPRHEPAGQTRPRLVPLPEEHWDARTRKLLAGAAHDPGGRIPNIFTTLVRHPDLYEQFMPFGGQLLRRGRLPARLRELLILRTSCNTGTRYEWGRHLTLAKAAGVTDGDINRITEGPEAPGWTDLERHLIRAADELNSGATLSDATWEALTEHFGDAELIEIVMLVGQYHMVAFFLNATGVELDPGFDSTGFTEGDRNHG

SEQ ID NO: 7976 - protein, 267 aa, Streptomyces avermitilis
MGEGHPEQAAPRLAGRKVLVVGAGTRPDGDPRAPVGNGRAIAVLAAREGADVACADVAAPAAAATAELVHSEGALSVAVVGDATDAKQSAAMVAEAVRRLGGLDALVVNVGVGLGTGLDGSSPEDWDQVLSLNLRAPFLAAKHALPAMADGGAVVFIGSVAGLRAATNSPAYDSSKAGLFGLTRHVAKEGGARRIRANLVVPGLIDTPMGRQASAQRASRTASFERIPLGRQGTAWEVAEAVAFLLSDRASYITGQSLVVDGGLSAV

SEQ ID NO: 7977 - protein, 214 aa, Streptomyces avermitilis
VAARRPPTKRDDQREASRRRLLNAALEILAEEGYRGLTVKKVGDRAGVSRGMVNYHFMSKAGLVEAVVADIRETFIDLLRSQPGYARMNGLESVLAKLDQLFARLAEPEPGVRARALLVLLVEAVGSADGMKDLMAEHLSLVRTGVEEDLRRGIADGSIRPDVDVVAQAFLVESIARGVLLQYQLDSARTRLVDIARAARETLVLGLTATRGAD

SEQ ID NO: 7978 - protein, 410 aa, Streptomyces avermitilis
VHRMKVRAIPTAVTAALLVTAAHPAAGAAAPAEAVPTRFTVDTTSDAVDADPSDGRCRTASGTCSLRAAVMAANSRPGSTIALPSGRYRLTIPPDPRLITGDHPDPTTGDLNVDAPTTITGAGARATVIDANHLDRAFRLRADTRMSDVTITGGEARQRELPFTDTGGGGIANERHLTLRRVAVTGNSAGYGGGVFNVPDSHLDLVDSTVSGNAAGEAGGIRFDDSGTVTNSTIAGNRVTDPGDRPGSLGGYGGGIDIRGLGTVEILDSTITGNRSSHHGGGINIAPAYLDSLPAPIPDIVDLPLGRLVLRNSIVAGNTADCAKAFAIIASRGHNIDGDGSCRLTATGDLPRRDPLVGPLADNGGPTDTTALLPGSPALDAADGCPATDQRGVARPQGTACDIGAYEYTP

SEQ ID NO: 7979 - protein, 620 aa, Streptomyces avermitilis
MRSSSSRPALATAVTVVAALLLSLTTPPVTAHADADHDSLVVRTDRGWVRGAAGRDRGRIFQGIPFAAPPTGDLRWRPPRPAARWSGVRDATASAHPCPQLPLTLLPDGGPVLPGESNRTGSTTEDCLYLNVWTPARTMVRPLPVLVWLHGGGNAYGAGSDYDGSALAARGVVVVTVNYRLGALGFLAHSALSAESADRASGDYALMDQQAALRWVRRNIGAFGGDRSRVTLGGQSAGSSDACVHIASPTAKGLFHRAIQQSGSCAADGGLTPPTLDAAERKGSDFAATVGCTDPATAAACLRAVPTTELIRSTGTGAASLWGPNTGPHILPRTPHAAWAEGRVNAVPTLSGNTHDEYRYFTALYVDLLGGGPLTPASYAALITLQHGDRAAAVLGTYPAAAYPSPNLAYSTVGTDQRFACPARADSRLYSSRAPVYAYEFADSQAPPFIPAPHTPQGAFHASELAFLFPTDAVPPLTPAQRRLSAMMTAYWARFAATGDPNVPWAPTWPRYTADGDRIQVLTPDRTGPTTGFAADHHCTFWQPPTPRGRCGDVDVGPGPGRVPERAAGPLTPWPTVSGSVWSRRSPSPALTPRTTASCTGPCRNASRTRPCCRSRAKRY

SEQ ID NO: 7980 - protein, 129 aa, Streptomyces avermitilis
MARFDDWVTDPEVTLDRVRAFVADPGRVGERFLYRYLVTTTSGTTGHRGVFLLDDRAAAVARALSLRAARRTLTASATARLLAHRERSAHIVATSGHLAACTPGAAGCCRRTARCPTWWTNSTGTGPCS

SEQ ID NO: 7981 - protein, 141 aa, Streptomyces avermitilis
VPMGAADPALRPRRQGLLRPDACACGDPLPSIKVRGRVADLLSFPRRGGGTVRIVPMAFETLLESIPDIDLFQIVQTSPTTLRVRIRSTTGADRERLWTAVRQELAALLGAHGADQVSVERAHEPPEQSPGGKYRVVMPHS

SEQ ID NO: 7982 - protein, 219 aa, Streptomyces avermitilis
MTEAPVQNRGARSRDAILDTAGELMARYGYAATSISMISAACGLPTSSLYWHFGSKDGIYIAVLERARTELLAALPPAEVPGADVIQRLDTFLAEVRDAFERHPHGLRLLLGLGMVQQDASAAAVAEVRQYRDALVVWARESVSAVFGLRDRPEVADELARFTLRMASGTAVALWFDPGTALETGSLRVALLALAAHHGVPVRDAPGEDAPSRGVTNGA

SEQ ID NO: 7983 - protein, 814 aa, Streptomyces avermitilis
MCSRCGMHDITFRGDGEFPEPGSEADVLLDACGRVAAWGPGAQQMLGCPAREAVGRSADEFLYDPADAADIVRRWEKGARRGSLVLRQRSGKPLAAQIWVRALTSANGDPQWLVQAARTAVLRTYEYGRALLKGLFTDSPFNIDIFDTQLRFVGLNIAERRAGVFQGTEYSGHTMREMAPPGLLDVDALEARQRRVLETGKALIDTEVVGHPVANSPREYVWSESILPLRDPSGRVIALGHVVSDVTQRVRSRERLVLTNEAAIGIGTTLDLWRTARELAEVAVPRFADICFVDLLDSVFPGREPTEGRPPRPPLFRRAACSGAAEDTGSDAAGEVKVGDANLWATAPGSPFLDALTKGESVLLADDQLQNCPAAVGLRHSPDDGPKIHSWLLVPMFARGVVLGAVVFLRSGNPRRFEPDDVLLAEEIVTRAAVCVDNASRYHRERTTALTLQRSLLPQRLPSASAVRTASCYLPASGHTGLGGDWFDVIPLSGARVALVVGDVTGHDLQSAVTMGRLRSAVRTLADLDLAPDELLTHLDDQMNRFLDERSDEGPLATGATCLYAVYDPVSRRCLLARAGHPPPAVLSVNGAVDFVELPGGPPLGLGGIVFEKREIAMDDGDVLVLYTNGLLQPRAQDLDAGLHRMRDTLSRTPPSATPQEVCDTLVRELLPTCHKDDVAVLTARVSGLASDRHVTWKIEAQDELVGRARDLTTQQMARWGLEEESFTTELIVSELVTNAIRYGEEPITLRLILDRNVICEVSDGSSTSPHVRRAQDTDEGGRGLYLITQLTRSWGTRYGERGKTIWAEQPLRC

SEQ ID NO: 7984 - protein, 366 aa, Streptomyces avermitilis
MDTTTTTATAAAVGWNLLIARDDLSIAELADAPVPEVRDGEALLRVDQVGLTANNVTYAALGDSFRYWQFFPASREGWGIVPLWGFAEVVDSRVEGIEPGSRYYGYLPSASHLLVRPGRVDERGFRDASPHRQTLPRPYNAYALTTGDLAYEADREDLQILYRPLFWTSFMLADWLVDNAWLGAATAVLSSASSKTAYGAAFLLQGRGCEIVGLTSRRNVAFTESLGCYDRVLAYEDVVQLPNRPTLYADFAGDERLTASLSAHLGDALVHHVVVGITNQEPGPAGTLAETGPGMFFAPDQMRKRTGEWGRAGLDRRFADAWQRFAPVAEGWVDVVHGQGPQALTQVWREVQSGRTAPRTGHVVIF

SEQ ID NO: 7985 - protein, 233 aa, Streptomyces avermitilis
VADRVGGVAAAGSADCRSGGRRRHDNFSTYRAHPWRRSEHTMDSGKRLFFSDREGLRREVARLERTHRRLAGTDEQGRPFTALDPAVRVWVLVTLYECMTAMRELSGRPLAPPELDQIYGEFRAVCTEFGLSDDLFPVTAADVPAYMDRTIRERLEYSEPVRYLLFDMLREAPAPRRLGHLKPAWPLVRTVAAHVIGALTIADLPEAFRERFSPPRTRRAALLSLILHRGIAC

SEQ ID NO: 7986 - protein, 338 aa, Streptomyces avermitilis
VLIAQRPSLTEEVVDEFRSRFVIEPLEPGFGYTLGNSLRRTLLSSIPGAAVTSIRVDGVLHEFTTVPGVKEDVTDLILNIKQLVVSSEHDEPVVMYLRKQGPGLVTAADIAPPAGVEVHNPDLVLATLNGKGKLEMELTVERGRGYVSAVQNKQVGQEIGRIPVDSIYSPVLKVTYKVEATRVEQRTDFDKLIVDVETKQAMRPRDAMASAGKTLVELFGLARELNIDAEGIDMGPSPVDAALAADLVMPIEELELTVRSYNCLKREGVHSVGELVARSEADLLDIRNFGAKSIDEVKAKLAGMGLGLKDSPPGFDPTAAALGADDDADAGFLETEHY

SEQ ID NO: 7987 - protein, 186 aa, Streptomyces avermitilis
VLFPGIDVRLEGVVVTGTLLFVDAAACGRPPYCPNCRWRGRRIHSPYHRSLSERPLAGQKSVVRLRVRRFFCDRKSCARRTFVKQVDRLTERHRRSSLGLKEWLTTVAVELGGRPGERVCRKLNLAAGRTHLVGLLEEPPVPGPRSAGRAHRCARPGDRLGPAPPHSVLTPSASRVPPCWYLFPIL

SEQ ID NO: 7988 - protein, 101 aa, Streptomyces avermitilis
MADVKVGLYVSLQAKPGKEEDVADFLRKGLDLVQEEPGTVAWFAVRLNATAFAIFDAFPDVSGRQAHLAGRLAAALMERAPDLLAQPPSIEQLDILAHKLP

SEQ ID NO: 7989 - protein, 58 aa, Streptomyces avermitilis
VFNDRLHLVHRGQANDSLWESVYDGSSWTTDTPIPGRHSWRGPALATYRGALHCLATG

SEQ ID NO: 7990 - protein, 820 aa, Streptomyces avermitilis
VAGQGQHRPHRRLPPDANGNLASTTDTEGKTTVFRYDAWGRVDKITTAEGRVTVFTYDDANRVTSMLRGTGFNSDGHTGPTWTYAYTSDSVTAAGTTTATDPETHATKYQHDSDGQVSDVTDAMGHKRSTKFDANHSIDTSTDAMGSGTTPGNVTDYGFNTRNNLETITQPTGGKTVNHWQTIAGADVPKDSTNPDGEKTDFTYDAVGNTMSVAQTGTGGGNVSYTYNPASPTCGGFAGQRCTEKTKMTAAKTVTTTFHYDSAGNLDTVTPPAPLAKITYTYDALGRTKTVTDARGVTVTYTYDNRDRTRIVDTTNKARVEYWYDGDGNLTQRTDSTGTIKYDFDPLQRETIRTLQDGSQTLLAYTPSGNVDYYQDPAGTVDYTWNEVNKLAELKDPAGRVTTYKYNNNDVRTTTTYPGGTVQKVDPDNSSRPKTIKTTSPKGTPVDLAYSYGYGTSGTTEGSKIRSSTDNVTGLKTTYTYDGAGRFSYAEEKKGTTLNSSWLYCYDLAGNLTSQGTAAGCPGATTYTVNDAQQLTAKNGSTTNWSYDKIGNETAGASTPEGTRTAEKWTDHSQLTSLTVGGKTYTGQYGSTDQSERIRLGDTYFHNGPIGLAGTSTAGVDTGFNREPGGTLNSMTTGGKAYCYLTDALGSVIALTDETGAKVNTYAYSPRGVTRASTSEKNPQPYRFAGGYQDVTGLYHYGARYYDPNIGRFNSPDPSGQEENPYLYAEGDPVNRIDPNGLFSFSDALDTGSDIFGVVTGCLAGVTAAAETGSIAYAAAVGGVVGAGVGSAVGVGLAVVGSCALGGAAGFYGAEILTYG

SEQ ID NO: 7991 - protein, 131 aa, Streptomyces avermitilis
MAGPPRSATRSRTTADREDSAHPAPDRADEPGYRRQIKVQANLQEGHHALARRAGQLYQRYQDGMEDQIGALGLVLNALVLFNTRYMDAALTQLRADGFEVRDEDVARLSPFMRHHINVLGRYSFQLPDLE

SEQ ID NO: 7992 - protein, 88 aa, Streptomyces avermitilis
VPDTQNAGPSTSVTAAAVSTAGSVYSMMAPTSPVMAPPSPGRRREPGSLGAVRAYDVIRMLSRDGRPTPLGDAITYYGGSRRLCTSCA

SEQ ID NO: 7993 - protein, 73 aa, Streptomyces avermitilis
LVVVAVGCALTSVPTAGGVVAEPVCVRRLTDQEGQKLQQIVRRGSASSVRFRRAMMLLASAGGNRVPVIAQLV

SEQ ID NO: 7994 - protein, 205 aa, Streptomyces avermitilis
MPTSTRRARERANTRERIIEAALHVLETEGIAALTIRRIATDVEYSAPVVYQHFANKDALVLELVAHGHRLMLSEFSQAAQEPDTDRRMTRIASQYVRFAGEHPHLFQVMNDPMVDADERRRVAEPVIDVLKELLTSWSAAHDVVLADFDQACEILWGTLYGIASLSYLGSVGNDRARYLAEQALHTILLGWRTETPANGRPASS

SEQ ID NO: 7995 - protein, 134 aa, Streptomyces avermitilis
MIYHINRVTMKATATPEQIEGVLESWRNQGRSNPAIKSFVVGRNHGGDYTYGAVFVVEHLDGLFAYLTHPTTYQTDHLGLHLVERLEIFDVSDDDDPDLNAKIQELHRRRNELNPQIAGMLADVPTYTGSGVDD

SEQ ID NO: 7996 - protein, 300 aa, Streptomyces avermitilis
MAKHVIIGAGSIGTNVARLLAEGGESVRIVTRSGSGPEHPLVDRVAADASDPSRLTELSRGAGVIYHCANPPSYTVWERLLPPLQTAAITAAKANDAVLALTGSLYAYGPQPGGRMNEHTPMAATGHKGRLRRRMWEQALAGGIRTVEVRGSDYIGKDANGIYSLLIKSALQKGKAAWITGHLDMPHTFTFNGDMAQALITLASEERAWGRPWHVPSAPAVTIRELARRYAVAAGRPPIKLIQIPRSVTRTAGLIVPIAREMAEMDYQWYAPFHMDATETTETFGLTATDLDTAVRNEVG

SEQ ID NO: 7997 - protein, 122 aa, Streptomyces avermitilis
MTDAFHIDVPHTDAALAVIALSGEFDIAAAPAVRARALELIANGHPDLVADLSGVTFCDSSGLGALVGIWRCAKDADGSLTLAAIPDRLSRLLSVTGMDAFLPAYSSADAALAARQGNRTTA

SEQ ID NO: 7998 - protein, 173 aa, Streptomyces avermitilis
VFAVKESRVRVVGEIAATPTGEALELVLHLGESLRGVRVESSDATARPDGLDFLAELPARGEWHTTALVRPSVEGEEAGGLFHPGAEPGESGPARRLCAWRESAPRITDIEDPEVHRTLRRSLEDLGAPAHLRPAAPRTHGGRRRCPLVHGPVRPRLAAVLVHGTAAGPCTPR

SEQ ID NO: 7999 - protein, 198 aa, Streptomyces avermitilis
VPPGSWPCSAATRCCPRTWHCRWTLHTTVNAGVKLWMLVVTAVRARARAGSAWQACRGARRSSQHSSEGVRRMDEKEFLRTVAERTGLSRQEAADLTWATLETLARRLSPGEARDLITELPEGLAEAVRRGTTDRIERFGHHDSVRRVAERTMLKEEEADRGVRTVLAVLREAISEKEFNDLMSQLGTDFSQALESAG

SEQ ID NO: 8000 - protein, 384 aa, Streptomyces avermitilis
VIMTADVPETSSGRSVRVALVADPGLPSEIARALAPRLPDHLRRAVGARVRWQVDTMTAPLSVSEQADVSDIAEAVRSHLDGAEWDVAIFLTDFPRRARLYPISVEVDTALRAALISLPALGVRRLRRRVRQAVVDVVRELVAHEETPRHPEVIGRPPREPVPDTRPGPEQPQRYVVPGLRGHTRLVAGMVYANRPWRLFGSLSRALAGVFATATVLFINSATWNLATALGAVQHAVITAGSAVALTLWIIVDHQLWERGTHLPARHHPLYPYNLVTLVTIALAVVVLAAALFATLVAVSFLLLDASVLRKFIGRQVGVGDYLFLAWFITAIAMIGGAFGTSLEGDEKVSDAAYGRRQRERQRMLRQMPRPERGERRGPDTTDG

SEQ ID NO: 8001 - protein, 213 aa, Streptomyces avermitilis
MATLLRRVCPHEGVRIAAVPAGFVLSRRPWTASVYRCAVVGPQSEDRREVEGSRTPVASASSRLRPCRRRLSVVRCPRRAVPSQAVRSRFRPGTTRFLGDVLVYQRHRDALHARVRHVIDDVHPGLGRGAARPVRIATHSLGGVIAVDMATANVPLWTESLVTFGSQATFFHQPVPGDLLCQMIAFRMRKHQEAETGALPPETGFIAHAGQGW

SEQ ID NO: 8002 - protein, 189 aa, Streptomyces avermitilis
VAIARAQLMARQPAENGENVNPYAPASGIEQRPGWSWLDEYLWCSCDIIADLAEGRLEQRPLVATVARLEAGERVLAVGPAQRVTWRALGDGRYMHQNAVAFGSPAFVLGSMASMATSALGNSARRRAAANDAQPRCGARTPGLHVLDVLDVHGTMLRWSMHLGTSSTRRPSSALRALLELVDLHVIAL

SEQ ID NO: 8003 - protein, 555 aa, Streptomyces avermitilis
MGFGEDELRALAGTRSFERGSGYVDAVRGLEVGDGSVTAVVHGTDIYEVELALGAGAGVSGRCDCPYGQEGNFCKHCVAVGLTVLRQAEAIPRQRADARTRASGLEAWLTALSRDELLALVREQVADDRELRRRLELRAAAARSDFGTVRERVLALIDPRPFARYGYVTYADAAGYARQVAETADALCALTTSGQAARAVGLAEDAIRALGEAYEEIDDSDGVVGQAIAAVAGAHLEACGVARPDPERLAEWLVGHVLGEWNDATDLDPLDYADVLGQAGLARLRQLAAEARRRSPRGWAEKYLMERLAKAEGDVDALVALYMKDLVPSGATHLRIAEELGAAGRPEDALSWAERGLRDTVDEAHVDGRLVDYVCARYTRTGRKAETVAVRRDRLLAERSLAAYQQLRAAARAADCWETERAAALAALREGTRQERGGWHRGPVLIDALLDDGDLDTAWREAADRADDRQWQQLADLSRETRPADALAVYLRLVELLKGPTGDRVYEQMARLLLDVRSCHRSLGTEDEFTAYVADLRAELKRRRKLITILDRHGL

SEQ ID NO: 8004 - protein, 226 aa, Streptomyces avermitilis
MTRDDQPDPRVCGPAPASFLAAAAALDTIDDALRAAQTTRDGEPSKPGQASSEQALAALLLLREVRDQLADWEPGLIEAAREAGASWADLAHPLGVASRQAAERRYLRVRPGKPGATGEQRVQATRDRRAADRTVSAWARTNAATLRQLAGQITALPDLPAAAHAPLADLTAALADNDPAALVPRLKDTHPYLASGHPDLAARVDDLTRRIDQLRQNSGNQRRNQP

SEQ ID NO: 8005 - protein, 144 aa, Streptomyces avermitilis
MLMRTDPFRELDRLTQQLLNTTGTWSRPSAMPMDAYREGEEYVIAFDLPGVSADAIDIDVERNMLTVKAERRPVTKADDAQMELSERPLGAFSRQLVLADTLDTEHIKADYDAGVLTLRIPIAERAKPRKIAIGGRTERKEISG

SEQ ID NO: 8006 - protein, 131 aa, Streptomyces avermitilis
MVMRWEAFLHQVKERGDYETTREAERAARTVLALLGAHLVGEVRAELAARLPESLALVLLNPLQAREPLSPERFVRATAAWIEGATEQTAAWDVSAVLSVAADAAGDELTRHILLQLPAGYDLLFGHPHPV

SEQ ID NO: 8007 - protein, 172 aa, Streptomyces avermitilis
VLTRSVRSGVYRLETSGLLPQCSRCGGDLIVSVVAPKNDTDGRPIQLQLCSACDAEKPAAGALLFWFASGGGHDTERSEEGARLLMEWTGEAMAEYGWYWPGTDVDAATSAPGLEHDEAAARDLMNPGTAGEFPEIDQRQQERDALRTELANAGSEQRTQLQAVWLLLGDHR

SEQ ID NO: 8008 - protein, 104 aa, Streptomyces avermitilis
MTTENCRRDLTAICKAADSGYLLQVIRDGSFEPLAQKDLSHWPDWPTFPVDAAHAAGCELVMLGYMIWPDTVTPDSLIGWRAVPDQQAWSAKVGTFAQLQAAGI

SEQ ID NO: 8009 - protein, 52 aa, Streptomyces avermitilis
MAPYAAWRGLWSARHQAYCYQPLGSAYDAIANCRRPLNAMRQMAQPPMSPCC

SEQ ID NO: 8010 - protein, 107 aa, Streptomyces avermitilis
VLAAAGVLSMPLIWLLDSPDAGQLVGASIQAAVGVAALIGALFQHPASRTDDTAARTGVARASGGGTAVTGVECPQGRGSGSAQTERTGNATAGGDGSSAVSSIDYT

SEQ ID NO: 8011 - protein, 167 aa, Streptomyces avermitilis
VTMTFTSAPKPVLVRAGEAETLQDGATSLITLLADANTTGSALTANRATLHKGSPGAPAHFHTRATEMFYVLSGSMRILLDDQVLTLGQGDFLTVPPTVPHAFAPAPDSEAEMLVVFTPGMDRFDYYRLLERVYQGEASVQDIRDSSEQFDNHYFESPVWQQELARR

SEQ ID NO: 8012 - protein, 196 aa, Streptomyces avermitilis
VCRPDETASVADTWEWDVRSSGRMAVSAMAVAMAALGVGSGAPASAAPTATPSCSGTECLSLKPTRLTASQASLNVTQMQLENINAMASDAVTGEPIRGAKIVFATTGGRTLGTAYTDYDGIAAIAAPENLGPGTLQELLGGYEAAMVGDGVHAPAGAHGAITIGTDQGPGVPGSPCAVCSDRALKQDVVPVDWSR

SEQ ID NO: 8013 - protein, 148 aa, Streptomyces avermitilis
MRRLQRPCAQARRGPGRLEPVAVRIFRRRSRTADRGDPARLRAETRESSGVAPVGPVNGYAVLETVAALPISTWRYLWEPEGVRHLGPMAQDWHAAFGFNQDDTTIPVVDGLGVALVCIQALHRRVEELTAEMDRLRQAASVNTSGAA

SEQ ID NO: 8014 - protein, 223 aa, Streptomyces avermitilis
MDHRSPVCTDAVWRLPVTVCRITQFLGEQTAGALLERAIDSAGDTLQPSMIRDREVVPDFRRSRSRHDFAAPELMAAIDEVLEAVEHTLGVSCQHTEPSYSLNAHNDGDFYRPHQDTSAEFAPRRLLTFVYYLHRTPRPFDGGELRVFDAALPLHTETAGRWQERTWRDWEPEHDSIVFFLPTAWHEVRPVSCPSKQHADSRFAINGWLCSPDPANRGNDASP

SEQ ID NO: 8015 - protein, 401 aa, Streptomyces avermitilis
MTTTPFISRKGMTRRSMLGAALAAVPLAAVAGPAWADPAAPAVTRLMLPVPTGPHPVGTVQLHLVDRSRPDDIAGPGHFRELMATVWYPARDVQRYPVAPWMPAGALQAFLADAGFSALVRLGPLTAGHVGAPVRRSGRRLPVVVFSHGAHSHQGDHTVMVQELASHGYAAVTVAHQYDTYTEFPDGRIAVPLHDGQAPTLPGDFAADLRFVLDCVEQLAAGCNPDVDHRELPAGLLGSLDPRRVGAFGWSKGGTATACATLADERIRAGLSLDGPMQMNPPLAGDLDRPFMMMSAVFTRATDPEAAAFWSHLRGWRLNIQAQGAVHVSYGDNEALFPQVAKLLGWSGQQLQDVIGTLDPDQAVKIQQAYPLAFFDEHLRHRRGHLLDGPSPAFPAVTFLP

SEQ ID NO: 8016 - protein, 260 aa, Streptomyces avermitilis
VLGAAVAGRSGGRRGRSRGSRRSARTAAPGRRPRRCRRGRPGRLRASAPRSRAYCSEVVDDGAQPGERRIRRRIGGRRRRGGADVTDGLADHRAHRRLIERMEAAGGERGESAGDQLRTSPRWIDGTGIRVRRPADGRKDREKFISGKNKQNAVKFMAVTDADGRLLFCSPAEPASCTDITHARQFSLVKLLANGPVVEILADAGYQGLGAQTGGCVVTPPHRKCKKNPPDWYEEMHERLRKAHSSRRIRVEHGIAHLKN

SEQ ID NO: 8017 - protein, 188 aa, Streptomyces avermitilis
MRKLIYGMNLTLDGYIAAAGDDIGWSGPPSDELFQWWLDQERAISLLLYGRKLWETMSAYWPTGDQQPNATPAEIEFARNWRDTPKVVFSSTVDKVDWNTRLVSGDAVAEITRLKAEDGGPMRVGGAALAGAAMRAGLIDEYAIVTHPVLVGSGTPFFTALDSWASLNLVETRTFPGGVVLTRYETRR

SEQ ID NO: 8018 - protein, 412 aa, Streptomyces avermitilis
VARWLDQGGVRRLRVALLDVVERGAGRDPQAGALEPISAVTALVTSTVNLMRPSTEPPQASVRLPHPPVHRDRLQPAPFLSSLAAEAGTYSPEVGELLARNVGDLLTTVVTERLGRDAAPTDAGRQTLLQRIRHFINAHLADPALSAEAIAAHHHISVRHLQRLFQAEGTTVNGWIRGRRLKECGRELSRPRRSRPAVSAVGLRQPRPLQPGVPRRLRHVAARMAGHGRCDRRCGSKTLRAWVSGRVLKSGAPVGRPRLRLGTRLRSGRAGLTGRLVGDQQAACQASTSSVLGLRRVGRRAERFESSESGPPTTGRPRRSSATGVRSGRRTGSGRTPRRRAVRRSGARRDGAGCGCRRRSGTHGARRPGRGVLVTLLQAAELLRRPLVEDGAVGRSFTVRAVARPAYTACVA

SEQ ID NO: 8019 - protein, 243 aa, Streptomyces avermitilis
VNEVLPQLNELLFSSVEGVLVESVEVIGTVVRVEARTTAGRAACVGCAYWAGRIQGSYLRFPRDLPTPGKCVVVPLRVRRFVCEEESCERMTFAEQVPGLTRRFGRRTERLRSTLVSVGLALEGRAGARMTDAFKVPVSRNTLLRLIASLPDPATAVLRVAGVDEYAQRKGRVYSIRVSSSGPVGPSVEGLSTKAPEKHLRRARVSSRLSRALSTTCRYARPSGSMARPGRCTSPPGRSPRCR

SEQ ID NO: 8020 - protein, 283 aa, Streptomyces avermitilis
VTDEQERVQPSGVWATAVGVARVRALETERENALFRDPLAQAFATAGGLWPSSPPLPDDEAARRRRLTVSFSIVIRTKFLDDLLQQASASGVRQVVLLGAGMDSRAFRMDWPEGTRLFEVDTAAPLDFKASVLRQERADARCERITVAVDLREDWPGALAAVGHDPAVPTVWIAEGLLIYLPEDAVELLLARISAQSAAGSRMGLTLGSRGVIERFGADAAPGSAASMWVSEMPDDPVGWLAGHGWEADSHTLRERAAAYGRPISTPPQREERPGGLISAVRR

SEQ ID NO: 8021 - protein, 48 aa, Streptomyces avermitilis
MQPNEIIEVLNRPISQELLARDVTRSHIGMSTTKNAPKLPWPPSRTGS

SEQ ID NO: 8022 - protein, 188 aa, Streptomyces avermitilis
VLRRDPDFSEFGGLTMSRTCHWLRPRDSSGHHRPHKEEGETCMAIQRMDNVGIVVEDLDAAIAFFVELGMELEGRAEVEGLFADQCTGLDGVRCDIAMVRTPDGHSRLELAKYRSPAVISAGPRNRPHNILGTHRVMFAVDDIEDTVARLRPHGAELVGEIARFEDSYLLCYLRGPEGIIVGLAEQLR

SEQ ID NO: 8023 - protein, 127 aa, Streptomyces avermitilis
LSPFPPIEHWNPDDRTFPHTCPKARGPDPRLPRRHRQATHQQMWLRLAALAGWPADQTANFEIEFWARRALYDAGEISTHTFWSGMLYGQLTAPPGSTLLYALRSTDAEMWTHTDEDVVRVSCLTEG

SEQ ID NO: 8024 - protein, 105 aa, Streptomyces avermitilis
MTLLSNVPHPLAEALDLSAWCSTLMTRTVYSARLGVNKPDPRAYEAAVVAAGLPHPENTLFVDDRLENCAVAAQLGLRTLHFNGDSQALASHIPQMVPATGIRRN

SEQ ID NO: 8025 - protein, 199 aa, Streptomyces avermitilis
VAALGAWLCFEDEAGFSMTPPTSRTWARRGHTPVIRVRGRSQRRISIAALACYKQGERSRLVYRSKRHVDHKRGGRRSFAWTDYRDLLIAAHQQLGAPIVLGWDNLNVHKDRRLREFINAHDWINCFFLPTYAPDLNPVEGVWSLLRRSSQANTAFTDPGHLMRALRHGLRQIQYRNNLIDGCLAETGLTLTTKRQQAQ

SEQ ID NO: 8026 - protein, 111 aa, Streptomyces avermitilis
VSLPKLSEKLFTVLEQELGKGPVAHGWPDQTWTLSRIKTLIGRRFHKSMTLSAIAQMLHRHGFSHQVPARRAVERNEETVTGWVKETWPQVETPWRRSGPGSASKTRPVSR

SEQ ID NO: 8027 - protein, 105 aa, Streptomyces avermitilis
VAGQCALPPPLPGVPSYKNAVSRQAARRSLPGSPSTPWRCWRPHRRGHCRRWSSTGTHDYVVVFDADTDAVPVFTALGRWVGMAESSGTIGTLTEIHERVNGGDA

SEQ ID NO: 8028 - protein, 107 aa, Streptomyces avermitilis
LYDGTPGSGGGNAHWPATGYYATTTRDCEDINLKVNATRSVRTCFKATGSCNAWSTARAKQWALAATDVSDGSDFYIQFSGTAKSTGYIAYREEDGMNHLATPDDCY

SEQ ID NO: 8029 - protein, 73 aa, Streptomyces avermitilis
VVSKRRSAAPGRGSRAAVLGMVLPASDVGDHEELVAAEVHHHPGVRALGVLVGGVLFRTPPRGPPAGNRSRTV

SEQ ID NO: 8030 - protein, 273 aa, Streptomyces avermitilis
VTTTASQEAFLQAFHAEYPAVTAEAFGRGHAPDGRSSYEILCDRVAGSMRVLDLGCGDGLLLEFLARRSGRQLAGVDLSPHSLALARRRPALSEAKLEEGRAQELPFADDSFDACVSHMALMLMSEIEQVASEVARVLSPGGVLACVVGGGAVGGEAYERFLALLRCTIEETPASQRIPALGDKRTRSREGLDEVLGPAGFTAVDWETVPIDLSAPGEQVWAAVSSLYDLGPLDRATLDRLREAFFAEVRDMTTSEGHVPCAFKIHLATARLR

SEQ ID NO: 8031 - protein, 75 aa, Streptomyces avermitilis
VEAGIDTRTWEERHEEIRTYARDAYELPPQFDPATEVNRIRAYLYDNYPQIAAALAVFLHEMPPTWREDLFHHLP

SEQ ID NO: 8032 - protein, 227 aa, Streptomyces avermitilis
MTRQEATHTQRIPLNRDRVLRAAVALADATGIDALSMRRLAQELDVVPMALYKHVANKEELLDGMADAVVGEIDPPAAGPDWQRVVRGRILSARRVLLRHPWAARVIESRTGPTPAVLAYLDSMAGSFRDGGLSADLTHHVMHAMGSRLLGFSQELFDTSGPSGPPDPGLAARYPHIAELAATAAHDGGSTVGGGCDDQFEFEFALDLLLDGFESLRRQGWTSARKT

SEQ ID NO: 8033 - protein, 253 aa, Streptomyces avermitilis
VYGVHHHRARGTEKMSPDRRTAVAAGSLFLLTEAAAIAGAVLYRPLLGAADGRLAQGADTRALLGVLCEVVLVAAVAGTGAALFPVLRRHGEGLALGYAFGRLLEAAVIALGIVAVLALVTLRRDAGAAAGADVALAAVHDWTFLLGPNIALGLNTVLLAYLAYRARLVPRFIAVLGLVGGPLICASAVAVMFGAYAQLSVAGSAAALPVFAWELGLAGWLIVRGFGPGSGATSQADGEVADPVCVSVRPTRA

SEQ ID NO: 8034 - protein, 100 aa, Streptomyces avermitilis
MTLTSQVHRSVASGVRSFRRVQPSICLIIRNGCSRSNLRRNACQRRSMPCPDPVADDHSQTGSGSCPPGRKSASRHFNVPLMRGSSPVWSVHVERVVRRG

SEQ ID NO: 8035 - protein, 128 aa, Streptomyces avermitilis
MKDTDLHAVGAETPTVFRADCPSRPILDQIADKWSMMVMALLERPTRFNELKRGLEGVTQRVLTQTLRRLERNGMIRRKVLPTSPVGVEYSLTPLGESLREPFGHLYDWTVEHSKEIQNCQRAYDSRG

SEQ ID NO: 8036 - protein, 277 aa, Streptomyces avermitilis
MRNDAYSTLRVSSEHGVARIILDNPPVNVIGATMMRELRTVLTTLADDSSVRVIVFSSADPEFFLAHVDMRIGEKMDALQELAASAPADVNVFQAVGELIRHQPQVTIVKLAGKARGGGAEFVAAADMAFAAAETAGLGQIEALMGIIPGGGGTQYLRGRVGRNRALEVVLTADLFDAETAASYGWINRALPADELDEYVDRVARNIAALPDGVIEAAKRSLPADDLKEGLLGENDAWAATFSLPAAQQLISGGLKDGAQTPAGERDLEGLMRSVAR

SEQ ID NO: 8037 - protein, 111 aa, Streptomyces avermitilis
VHDYSAALSAGTLAVIARVSLAIGKPFTLGIVKRTTPREAWGLKPFIQTNVIITAVWTAAFTLTAVVLAFMAHAGNAHSTLAMLIQVVGFAVPMIFTVRYVSRVQAKAGAR

SEQ ID NO: 8038 - protein, 271 aa, Streptomyces avermitilis
MSARFEEIDWRATFMGEISLRRRRDPVSGEDVYEVKLGDEYLMSSLFTAGEVELARLGLAELPDGPLDVAVGGLGLGYTARTALDDPRVRSLIVVDALAEVIDWHRRGLVPLGAGLASDPRCRLVRGDFFAMAAGSAAAARPVPADGAKVGGPVPAGGTARGASAAPRGLDPETPGRRFHAILLDVDHSPRHVLHPGHAALYRLAGLTAVAELLHPGGVFALWSNDPPDEEFGSVLAEAFTETAAHVVNFDNPLQGGTAANTVYVARRYDG

SEQ ID NO: 8039 - protein, 62 aa, Streptomyces avermitilis
MARGGSITAEYGLEVLNTVIYLPRGEIFPITSSATLCNGFSRHRDGSLQPPSHVGAGAVWRS

SEQ ID NO: 8040 - protein, 159 aa, Streptomyces avermitilis
MTGDWRMDRIGAALRGENPTVLRRLESGFAVIGDVQFLPGYSVLLVDEPGVQRLSDLPKARRLSFLSDMDRLGEAVEHVCQRLDPDFRRVNLEILGNTDPFLHAHVWPRFEWEPTELVGKPVWLYPGDRWSDEGFRLGPQHDVLRDGIESELDRLRSMG

SEQ ID NO: 8041 - protein, 74 aa, Streptomyces avermitilis
MSSNGPACVPACPRVGPHRLRHALAGEMLRQGAGLAAIGQVLRHQDLATTTLYAKVDFTALRAVAQPWPRTEAA

SEQ ID NO: 8042 - protein, 160 aa, Streptomyces avermitilis
MTVLREALADYLRLRRSLGHQMAETAWLLPDFVAFMEDRGQTTVTIAAALAWAKSREGEVVTTVSPRRVTAVRGFARQLIGTDPDTEVPPLGLLPYRQRWRPPFLYSDADIAAVMAATDTFDPPLRAATYRTLIGLLAATGLRVSEAINLDRPQPKTQLG

SEQ ID NO: 8043 - protein, 215 aa, Streptomyces avermitilis
MSSFNTHQRRVYDEDLPTRARHTNLRSCLVHFAPYGFRATYHHLCLSAGIPKDLEKDPSSLIRAVEELHHARQLWLADERAYANRRRADKARGFRQVKRDESWRGWQREWGNIAYCPEPTIHPDEPLPAVVERVLRSSVPPDEAPALTCRVCGNRDNTSVWYDGAYRIHQLCRECGVSLAVQRAKAPDPRLAADHARKWKEIWRLRNESPRSYPS

SEQ ID NO: 8044 - protein, 87 aa, Streptomyces avermitilis
MPYHTRIALHFDSRFRLGRVLNESAARTKSEYRHHLHLAAPYAGYWCQYVTDWVADKTRYRLTIDPTALAQRLAECPDLPITITLAR

SEQ ID NO: 8045 - protein, 285 aa, Streptomyces avermitilis
VVDLGFVGPSRPANDYRFLSVTDGDTPNIAMAIRMVSIDTPESHYGGAPATAQAALERAKTRLLDGTYDALPQDLRDYLVSRITPDAAQRHQSAGQAAAEAHTAMVASRLAHPDGSQRKMAVIATGELVEGNGRLLAYTAPWFTGSASDPLPPRDDPRRRTFNLDMVALGWAATFVIYPSIPPTKDLNLLLEEAEAAWTQQLGAWAQFGQDLLLGYEYRACIKLGTKELTDPAAAIAQAYQRVCVDLRTLTEVGLYGYHQVPPQHRLWIWATDLEQARKDLPISS

SEQ ID NO: 8046 - protein, 82 aa, Streptomyces avermitilis
MPAGTAGPAPAAGRELLGPGRQQRRDQRPPASEAHLNWSLITLMSRRLTRKGHPDGWKKTGPMRKPGPTTLNQPRTSREMDG

SEQ ID NO: 8047 - protein, 74 aa, Streptomyces avermitilis
MTKNKNVIEVEGKVVECLRSAMFTVELENGHQVLAHISGKIRKNYIKIMLEDRVLVELPPYDLTRGRIVFRYRN

SEQ ID NO: 8048 - protein, 216 aa, Streptomyces avermitilis
LRFHDGAVTDNGITLIDAWELPEDRIDESIARWRERVGLIHAAPGFRDARLHRRLFPESRLGLVNVAHWDSIEARDEALADPGFTASAATAASYATVNGGWYEVAAEFLAVGNGSGEGPGITIVNAFEVPAERIDEFLPHWLGRAELMTKAPGFRDNRLHRAVVPDTRFQLVSIAHWDSPDAWRTADNDPRFQQSLSTSPDFAIADPALFRLVVEF

SEQ ID NO: 8049 - protein, 286 aa, Streptomyces avermitilis
METASLRAAPPPRFHPMASSAGPEDRDTEARSRPATRPLLLRIVTVVGSSASFYLLLSVVPAYAQSAPGGGSDKAGLVTGALMLATVAGELTAPWLAARCGFRVMLGAGLLLLGAPALALTVSQSMPCIVAVCLVRGLGFAFTLVAGGALTASLIPPELRGEGLALIGVMAGVPSLVGLPLGAWLALHTEYGPVCSVAALIALVSIAAVPGLPGREATSAGSRYLVAGRVNSLAGVDFAGHTEQSNGLRAVILAKVRAWSTAVTRRRRPGGVVSTPCTNGLLQPPV

SEQ ID NO: 8050 - protein, 351 aa, Streptomyces avermitilis
MSTEDLSFPEDEKVLVTGGSGFVGAHTVVRLLREGHRIRVAVRGPAQEAQVLAALRQAGVDRADLLEFAVADLSADDGWAQAMDGIAHVLHHASPFPPTPPETEDEVILPARDGALRVIAAARSAGIPRVVMTSSFAAVGYTLTPDDHYTEENWTDPNTPGLPAYHKSKVLAEAAAWDYVKTNGGIELAVVNPTGIFGPQLVDRPSGSIGLIKALMAGEMPVVPVWNFGVVDVRDVVDLHLRAMLHPAAAGERFLANSGSSSLFKIANILREQFPAAADRLPATELTIDQVREAAKTEPALKDAAVLGGRIPEISHEKASSILGWEPLDVRDTIVATAEALIELGAVTLPE

SEQ ID NO: 8051 - protein, 194 aa, Streptomyces avermitilis
VTVTRTETTQRRPRADGQRNRARILEAALRLFVERGPDAPFTEIAKQAGVGVGTVYRHFPAREDLIEAAYRSELDAVCAAAAELLEQAPPQDALRIWMDRFVDYWATKIGLTEAIGAVVAAGRDPFAQSRGRVDEAVGTLLAATSAAGVTRPEVEPDDVVVSLSGIAMVAPVLQDRDQVSRVLDLLYEGIRARP

SEQ ID NO: 8052 - protein, 124 aa, Streptomyces avermitilis
MGAMLYVDRTGIPWRYLPHDFALWETVYGYFAAWQKNGIFDQLICILRQLVRPAEGRNGEPSACVLDAQSVKTSANVPAAGQGIDAGRRGYCFAASTPGAGALWPLCDPDTPDLDEDDDGSEDP

SEQ ID NO: 8053 - protein, 53 aa, Streptomyces avermitilis
MRASTPKSDRWVSPRMSPSGSSGSAVSRTLEVRAKCRPNRPMGRYGSLPRPAW

SEQ ID NO: 8054 - protein, 391 aa, Streptomyces avermitilis
VWRSAVTPCPVQPHPPYPARVSVPPGHRADLPRTGAQRRRHIMTTAADLSVFEQLDLPDTSLTRDTFAFAAQATPAFIHDHCVRSYVFARAHAQNQGLRAGTDYDDELLFVSCVLHDLGLSEEGSNGDQRFEVDGADIAAAFLRERGVEEERIAVAWDAIALHTSEGIASRKGTEVALAHLGIATDILGIQRESLPAGLADEVHALLPRQDLAHGFSDLIITQAVAKPHKASPTNFIGDLLRRHLPYGAYPNWYDLIDAAGWGDKPVGVTARRRAETPQQVGTLFMEYLEAGDVEGLVSLYEPNAHFVPTPGTHLVGTDAIREAMRQMVDSGARLKLEQREIRQVDDIALVSNNAILTGIGPEPVVSTTTEILRRQPDGGWVHAVDDPFFS

SEQ ID NO: 8055 - protein, 303 aa, Streptomyces avermitilis
VARKAGSGAGSKSERGAADSTPRWSGPRAPAVDEEPAMTSQHVVGRFFDVQGGQVYAHVREGDGPALIFLHYWGGSRRTWIPVLQRLDPGQGFVAYDQRGWGGSTSVPGPYDLEQLADDAQRVVDALGYSRYVLVGHSMGGKVAQILAARKPAGLRGVVLVAPAPPAPIGVTEQVQETVSHAYDNEEAVLQSIDLMLTRGGLTPELRRQVVEDSLRGGDEARLEWPRRGLVQDVSAGVSAIEVPVLVLAGSHDKVDPPTVLADHLLPLIPTATLTVLKDTGHLSPLEVPDQVAAHIGAFVAQL

SEQ ID NO: 8056 - protein, 333 aa, Streptomyces avermitilis
MAAPWTPCDIGAGRNIAAMNKHRVMVLAVDGVLPMDLGIPTQIFNARPNTPYELTVCGDTEETVTTSAGFTLGLTAGLEALAEADTIIVPGFEDFRRPPRPRVRAALKLAGRAGIRIASICTGAFAVASAGLLDGRTVTTHWASADDLEELYPRLRVDRNVLYIDNDTILTSAGFTAGIDLCLHLVRKDLGAAVANDIARDIVAAPHRDGGQAQYINRSLPTPQATTLANTREWALLHLEEDLTIPHLAGHAGVSPRTLTRLWRQETGVSPRQWLLTARSNRARELLETTDLQVEQIAVRCGLGSGANMRARFRDALGVTPTAYRRTFQHQAA

SEQ ID NO: 8057 - protein, 158 aa, Streptomyces avermitilis
VTPSASHPRPIAAPSSTRLPDGEGQTGRHGTWAYGSDAHTPVDAARLLAWPRLASQDAERPGDWARIERTCRDGHTATWRAAEARLGRWGPDGNVRLAVATAHPATLPAKATWYPATDLPRPGSPRVTESPCPPTTLAEIERIYGLRHWVEQSYKQVV

SEQ ID NO: 8058 - protein, 158 aa, Streptomyces avermitilis
VPMPSYSFVLNGERVTVEAPADMPLLWVLRDLLNVTGPKYGCGVGVCRACTSHLDGGEIQPCVVPVADCADREVTTIEGLADGNRLHPVQQAWLDCDVAQCGFCQPGQIMAAVALLKRTPRPSDADIDAIENVCRCGTYFRIREAIKKASVKFPRSGP

SEQ ID NO: 8059 - protein, 701 aa, Streptomyces avermitilis
LAPELSRRRFVIYTLAASTLTVAAPLGCDTPAAEGAESVRARSDVLVTGADDEMLVLEVTEANKVVVRLPRLEVGQGVTTAVAMMIAEELDARLVDVSIPLAEARRKGNQYTGGSSSVSSLYGPARELAALARAKLVTAAARRWHIPARFLRTEGTRVIAPDGRSATFGSLTASAARVGRPAVSSKPKPVSKHRVIGRPTPRIDARDIVTGRAQYAGDLAVAGAKPTVVARPPTLGGRVRTLDDRAARAMPGVRAVVKVAGGVAVVADTFHHAFKARDALKITWVPGPLAALSDAEIRARLQAAVPRFGTPPRGSAQTEAKFEFAFVSHAPMEVLTAVADVRAHSAELWFASQSPMDARDSIASAIGLPASKVRVHVLRAGGSFGRRLNHDAALEAALVSKAAGRPVKLMWSRADDIRHGRMRPADHHRIRASHAGGRVVAFAHSVATVSETNDGLSAGVRPAAFARAAGPLPSHSGLYNFGSISGDWGSVDLAVPIGPWRSVSSGTSRTAEEIVVDEVARALGKDPVAFRRTTLRGKAVRAVLDKVAAAGEWGRALPAGQAQGVAVHEEYGSCVACLAEIDATDPKNPRVTKVVMAADVGTAVNPSGLEAQLMGTAVDGISTVLRAGLHIDRGAVRESSYADFRYARQRHAPLHFEAHIMPSRRAPGGAGELGVPAAAGAVANAYARATGSRPRRFPLDF

SEQ ID NO: 8060 - protein, 188 aa, Streptomyces avermitilis
VKFMVQTLAAARRAAVRPPARAHLRRAEGRRGQRQQGRPPPAVTAEKADAVRTAYLDGQSIAALAREHGVSRGAIRTAVADLMPEHTTGPEDVPAPELPVLLDMPGKVADFLREADLPDDQRSALAGGVTVRRGQGYTLRVNAAPSIHRELLARSQPLDGAQAVPAQRKARREYENRVNALIAVGERS

SEQ ID NO: 8061 - protein, 55 aa, Streptomyces avermitilis
VHISEMFRPVRGTGHILDTLDVLHRDRLALRIHDGAFSAMDLTARPPRTGSCCPP

SEQ ID NO: 8062 - protein, 309 aa, Streptomyces avermitilis
MPIRRRCEETRATWFERIVTRGGVRLSCRDWGGCGRPVVLLHGLAGHAGEWDTLAGALSPRYRVIAVDQRGHGASERFPREVSRAAYVADVVAVLDQLALHRPVLVGQSLGGHTAMLTAAAHPHLAHALVLVEAGPGGPNPRVQAEIGGWLDAWPTPFPSRESAVEFLGGGLVGEGWAAGLEERDGWWPCFDREIMVASLAEIAQRSFWDEWARITCPVLTVLGQSGIISPQESETMLRRLPVATAASVPGAGHDVHLERPAVLRHLIQEFLEENAAPRGPARRPGRGRDRGPGRLRGGGRHLQPPPPA

SEQ ID NO: 8063 - protein, 215 aa, Streptomyces avermitilis
MATREYKQFCGLARAMELVGERWSMLIVRDLLSGPRRYTDLRKGLPAIPTNILSTRLKQLEEAGLATRRALPHPERAVVYELTDFGRDLEPALIALGRWGARTMTEPRPGEAITAEAVAMSFRTAFRPAAAQHVTVGFEVRMGEFTIRLQITDGVLAVGIGEHPAPDLVIERLSGHPVRELMSGTKTPDEALADGSLRVDGDPALLARFAAMFRF

SEQ ID NO: 8064 - protein, 243 aa, Streptomyces avermitilis
MSKTLPPAARGMTPARAAPGLLAAAGITAGPLFLAAGLAQGLTRDGFDFTRNALSQLSLGAFGWIQITVFFLTGLLVIGGAIAIRQELRDGPGGTWAPRLLGAFGASFLLAGVFRADPGAGFPAGAPVGRVTSLSAHGTVHMLAGAGGYLALCAALLVLARHFTARRQPGWAMLARLVPVGVLAGFAASATTVAAFTAGAGLGLLGFSAVTARLTLPAEREQPCSAARSNRTTPITARQETSA

SEQ ID NO: 8065 - protein, 69 aa, Streptomyces avermitilis
MTTPAKGPVSYFPAIEKKYGRPIAEWKDIIRTSPLTKHMELVAWLKAEHGLGHGHANALVAHTLAEGSR

SEQ ID NO: 8066 - protein, 68 aa, Streptomyces avermitilis
VQQVLAEPAWAKKLTDEDRRGLTALFWSNVNPYGTFRLDMDKRIDLGLTLPRPRTQAGAGDRSGAETR

SEQ ID NO: 8067 - protein, 361 aa, Streptomyces avermitilis
VSAWKVDGEGAGVRQEWSLEDVVACWTLVEGDRDLVANKSGPTRLGFCLMLKAALRHVRRYFITVDNLRAAVRKLVNATFAARDAAWWGQGTACASDSKKFGSWSSNFMTEYHARYGGNGVMIYWHVEKKNVCIYSKLKSCSSSEVAAMIEGLLRHCTDAEIEANYVDTHGASVVGFALTELLNFRLLPRLKNMGSIRLYRPDDSPPGWPALGASLTRPIKWDPIAQQYDQMVKYATALRLGTAEAEQVLRRFTRGGPKHPTYAALEELGRAVRTIFACDYLASPDLRREIHGGLQVVENWNSANTVLHYGKDGALTGPDKEHAETSMLALHLLCGPHSCTSHPAGAAGPGRAGLGEEAHR

SEQ ID NO: 8068 - protein, 245 aa, Streptomyces avermitilis
MSENHWENQPGTPPDVTPECGQESDGERLYLWRQIVHWRSGTGGSQCNPLIELDKQNHWSVMNGGATGASGWLLVPTDRKKGIECRDIWTHRDPNYWNAAWGYVRSPYGSPTTTGLGINSKDKRTQDQLHIHIATFQSDAKTYLDARSPSEIATTPGDWAKKLLTVPSDSKPGQVYRVLHVKDLATDNLFNLLQSNVVSSDQMGNQTMIVIPAKSGGFYVLNSDISLSQGAAFGTGTCNHLLKCS

SEQ ID NO: 8069 - protein, 150 aa, Streptomyces avermitilis
VGEPIFKLYRVRFTEPGVGKYLMRWGLTFPRPDKRAIQQDPEAVRIWREETWRAIPARAKAENGVVLFADQVGIRSDQVELHFLPSYSPDLNPDELVDADLKRSLPHTHRARNQTELASETRRFFHRRQHQPHIVRGYFCGRHVGYVIDE

SEQ ID NO: 8070 - protein, 240 aa, Streptomyces avermitilis
LDGAEDRCRTGASHRGGAGSPAGAGRRSSGGCAGAVVRYRVVHPPRPFCCGGGPDGADCLTVRSGPSTGPCPGPTGTGEQRWSQLPQGNQHSRARVGQHMQREWLFSLIPLTIGVVFLSFGVYGLRRAKALRRTGVTAPGRIVRHDVRRDDDGARYHHPVAAWTTPDGLECEHSSRFGRGSIGGRFGVGALVVVRYDPENPRRFEIQGWDSAIVDRTFTILGALLTAATLTVLLVRLLTL

SEQ ID NO: 8071 - protein, 205 aa, Streptomyces avermitilis
VTGITLAGKPAARLGRLAGVRSVRKAPRELDEERLVRLVARGDRAAFEELYRRTAPWMALRLRRRCADEQIVAEVMQETYLAVWRAAGAFAGSSAGGTAAGWLWTIAARRLVDAFRRRAHHAEPPVAAALPDAAPAAEEEALATAVGGDVGDALRRLAPELRQVLQAMVLDGLSVRETAVLLGLPEGTVKTRARRARIAMREALA

SEQ ID NO: 8072 - protein, 272 aa, Streptomyces avermitilis
MSVEHASMRIIDGYARGDTDIAADEVWALEAHLEACGVCRDRLSAAVTAEAPAVAALVGTVWSGLEPQLAATATMPRQRRWSARLSRWMTPTMMPWLAMVVSVTLLALLLDLVDTGFGEVSLVLLLAPILPVLGVAASWSRGLDPAYELTASAPRAGLYLVLRRTASVLAVVVPVLLVAGWVTGVTAAQWLLPCLAFTSTTLALGGVVGVTRAAVSLAAVWAAAVVAPTLATSRTTFALQTGSLPVWGLVLALGTAVVIARRGAYSVLGAHR

SEQ ID NO: 8073 - protein, 277 aa, Streptomyces avermitilis
MTIGKEHHMMSAVSAAGIAPTAYAWQIQATGLKVRVGRKRMAVNGVDLSLGTGVHGLLGPNGAGKTTLIRTLATVLRPTEGTLEMLGESAGGMGEHRALRRRIGYLPQEFGYYKRFTVREFVEYMAWLKEVPKADIPAAVQRAVERVGLADRADERMKALSGGMVRRVGIAQAIVNDPTILLLDEPTAGLDPAQRLRFRELLQELGTDTCVLVSTHLVEDVAAACTNVVLFAEGRLVFQGPPDELASVGGPEHMGDSPLERGYSAMLLNPEQGRGTW

SEQ ID NO: 8074 - protein, 464 aa, Streptomyces avermitilis
VNVRVLRIELKRSVAPWAGAVVLTTALAFLYLIPGSWWTGTTAWTAQWTSMALWTRSVLFYLWPLAVGLGALQGLRDHRSKMSELLTSTPRPARHRAATLAGATALTLASAFALLVLVGAVQVVANTEYTHLGWLPISLVGALSLVAGAVLGMGAGRALPSVLTPPALAMGAFVFTVLLQTSLGRTETTTATGLPSTEPNRVSLLSPAVQEVRDALVTLSASVHVGQTIWLLAMAATGFALLVAATPRARLLALTPVLAGAALALLVLPSDPRRMYVVDEAAAELVCDGPVCVTKTQQARLADLAGPGKEVLRLLHGALGSQAPVSVRENTAVLPEGSTPQWSRTTVLFDFDDDLIAAAKGEELTRALIAKGLVPGCTPVGWSGFGSDEFAQTVAVGWVLGDLRPLPGTPASLRREVNAKTRPVWKKLKALPRAEQLSRINAMRTAALSCKGDAFDALNGGASR

SEQ ID NO: 8075 - protein, 231 aa, Streptomyces avermitilis
VEETQGAAAGRAALADQRDAHRRALLQGRCVRRAERRCVPVRWLTLYARSRQIPASLAAVVISAVAVWALARNGSGGPGDPRLPALALATGTMAASIGLSGQDLALDRTAAIRWVPRRAAHVLLCGAVVGTALLTAQAMGEDMATTAFVVRDSAGLMGLVALGAALSGGRHAWTLPFAWLSFSFFAPPPTSVPMRVASWMLLPPGTAAGTWTALVLAVVGTAAYAVAGPRR

SEQ ID NO: 8076 - protein, 124 aa, Streptomyces avermitilis
MVVATPAKGKRLTDAVGAQNIAFSRPAGERVTAFGCPATTPQRGEELLYCPGNSQRAPEGEQRVPCDLGGGASGGPWLAGFNSAAGKGTVVSVNSDGEGDGGTPMYGPTLDKTARAVYDAAQRG

SEQ ID NO: 8077 - protein, 261 aa, Streptomyces avermitilis
VKIVSLGFRTDLMLLKMGGAVVTDHGTHLVVRTPANPGFHWGNFLLFEVPPQPGDAPRWSTLFEAEFPETQYRAFGVDGVAGLVGDTAEHQVLGVTAEVNTVLTADRLVSPVAAPHADVRVLTGDDDWRQALELHFACYGLPSGSDGRHFAERRVAGYRSLCEAGHGSWIGAFVEGRLRAGAGLFSDGSELARFQNVETHPDFRRRGLASAVIHHAAQRALLAPGIRKLVIVADPDDHAIRLYRALGFVDTERQVQLHRAG

SEQ ID NO: 8078 - protein, 110 aa, Streptomyces avermitilis
MDTDGQDHLPCPGAQAARRGSRPPPSVGQDLLDCELVTAPQQGVDVATDLPGLQRFAQRLERDLEAVIAGLAQPWIAGVVEGHVNRVKMLMRHMFGLAGFDLSRDRVLLA

SEQ ID NO: 8079 - protein, 96 aa, Streptomyces avermitilis
MINLQVRHESGTVLAGSGHGVAWDESLAEIDRSQFPMLAGVCPFADTVFNTWQLPMLVEELDRLPAARGGPWVDAVRALCRTAEEGSHRYVWFVGD

SEQ ID NO: 8080 - protein, 303 aa, Streptomyces avermitilis
MRMRPTLSWTPPEDLPPATTDVEPVARALSNGGVLVLSGAGISTDSGIPDYRGEGGSLSRHTPMTYQDFTAGVQARRRYWARSHLGWRTFGRARPNAGHRAVAAFARHGLLSGVITQNVDGLHQAAGSESVVELHGSLERVVCLSCGAFTPRRELALRLAEANVGFEPVAAGINPDGDADLTDEQVGDFRVVPCTACGGILKPDVVFFGEAVPARRVQHCRTLVDQATSLLVLGSSLTVMSGLRFVRQAAQAGKPVLIINRDATRGDPHAVTRIALPLGTALTTVAGRLDIPADDEAAAQTRQ

SEQ ID NO: 8081 - protein, 214 aa, Streptomyces avermitilis
VCRSDRLPRWGDRHGGASGAVVYVDSDAETASAAVSMAWRGEPGVVRAAPPTHSQRLKAWSCSGMRVASVRMDFELIEGAPEFGCLIAEVEETGERIRLTADGEPAGVLLAAAELATLEYWAARHNKGARPQDEPADEYPPGPTSYGPYIGYSHPHGGMTLTRGRLVVAELRDAETVAWLEEQAMYGRQGYMGPKQSAAFAEFLARQTPVGDEH

SEQ ID NO: 8082 - protein, 445 aa, Streptomyces avermitilis
VSPGGDHVTNSLGPDSGSRSGSHVMVRRGLTKSKCAQAEMVWVALVLLLTALPVGWCGLKDFKDALTFPGCVTGAALMVAALIMLVGVAAVVDCWIRGPISNFGVVALISTGVALLTNVLLAFQTWNDGERVVYKVLSIVLSVGSLLAVIQVWRRLDEIPTPKRVAAALIVSTIVAVANFSYQYLFQPHRREVAPLVQLNVGKAVLSADRKAFSVPVDIKLVNHSDVSFYVLGAEFHAMGEDVTVSPTDLDRSKWREGAEQWARYREKHPLTRREVYQPGKLVAAQQWIPAGHWVEAKDEALTRTVVQLPIDTHFDKLTFYATLSLARKDRLVMGNFGRPGYSWRGVELPHWVKAGQEDNDTIIQTADMQENNAIDHYTRESRRVTTYWRFGLHGVDVAPVIVPVGEEGRTFSEQTNREVRNRYGLIDVLAGPVEQTLDEIKSRR

SEQ ID NO: 8083 - protein, 300 aa, Streptomyces avermitilis
VCRTISFMRTWLASQCRDLTLTLMSEFSVGGMNTEHSLATPHLDVVVKGSGPALLLAHGAGGGIDGNFGLVLDDLARDHTLIGPHYPGAGGSPLATEPLDLDELADQLVASAVAAGQESFVVLGESLGSAVAVRIASRHPERVRALVLTAGFPVADPVLALAAQLIKTLAGAGQWRDMARLACLSCLSPTDLADIAPADLDALVTQTLAGMPPGTVDHFDLVSRVDVRADLGHLSAPTLVVAPTGDRLVLPQSSYRLAAGITGAKLIELPGAAHILNEADRTTWLRHVREFLGTLPAKSA

SEQ ID NO: 8084 - protein, 133 aa, Streptomyces avermitilis
MKEMVRHTGVHERLLRYYEQQGLLAPARLPSGYRIYSESDVETVRRIRCLLAAGLPTSLIAQVLPCIRTDDDRLVPTCPDLVAQLAQERERITRAIKELQASRTMLDTVIAAAPVQGAETLRSPQPDADEASY

SEQ ID NO: 8085 - protein, 373 aa, Streptomyces avermitilis
LVRYFFLDAADRAEPGRHTLLPAPATPTPPVTDRDHPVSSSRLPSGAGEGRVGPWRDPTSAQALAVSLRPSGRSHRPTQVRRPPMAAGASNSTANADWGKANFNDIYNCPDPRPYFATLRSLEYQIPHHGQAVFRALTYALRWLHPDRTPLNVVDLCCSYGINTALLNCRVTLSDLSTRYTSHHLSALPTRQLAAEDRTFFAARRRPEAATATGIDSAALAVGYARAVGLLDHAFAENLEVTEPSPALRRTLAGTDLITVTGGVGYVFTRTFTRLLDCMPTPPWVAAFVLRTVPYQPIADLLARSGLVTEKLSARTFRQRRFADSAERYAAFHALAVNGLHTADKEADGFYHTDLYVSRPAPDIAALPLARLL

SEQ ID NO: 8086 - protein, 287 aa, Streptomyces avermitilis
MSATQTAQLMDGTGHARRIVEEAAAKAAEISQRTGTAPCLATVLVGDDPASVTYVRMKRARCAKAGIRSRHIALPATTTTAELIDSLSGLSGDPEVHGILLQHPCGPHIDERAAFEAIAPAKDVDGVTMHSFAAMSFGLPGFVSCTPGGIMRLLEAYDVDLAGKHAVVVGRSAILGKPVGMLLLAKDATVTYCHSRTADLSAMVREADVVVAAVGRPRLIRGEDIKPGAVVIDAGYNPGNVGDVDFDAVLTRARLITPVPGGVGPMTIAVLLEQTVDAAANQLGVQQ

SEQ ID NO: 8087 - protein, 424 aa, Streptomyces avermitilis
VSGGALFWCAVGQDSAQRVNRLTPTPRRNHPSSVAVLCADCVRSRDVGDVVTRNVTKAGLLAVAMATMLGASACGGEAGAAAGGTGGTLPAHGKGEPVAPAGDGASSGSASTSPGTVGKLSGIAQTAASPITRHVPWNLDILDQRSRPLNGKFTTTATGKGVHVYVIDTGMDIAHKEFGGRARLGADFVGPKDSGDCFNEGGIGHGTFVAGIIGGARYGVAPKAELVRVQGILCESEGGGSPAAAEAAVVKSVKWVTAHAQKPAVVNMSLNFDHRSAAVESAVKKMVDAGIPTVVSAGNFHDDACKHSPAGVPGTIVVAASTSNDRAWSDGGSYGSGYGRCVDLYAPGQKVTAALAGGGTTTENDGATSWAAPHATGVIALYLSAHPHATAHEVHVWLDHTATRGVVRDVRSDTPNRLLNTGGL

SEQ ID NO: 8088 - protein, 225 aa, Streptomyces avermitilis
MRDSRNATASSDSRNPTGLSATTVRTRVTVPLRFGDGCTVTADLATFHHLADGQEHVAVILGEPAAGRPPLVRLHSECLTGDVFGSARCDCGPQLREALERIADRGGVLLYLRQEGRGIGLYNKLDAYALQDQGLDTYEANTTLGLPEDARDYTAAAQMLAALGIFELDLLSNNPDKAAQLRTLGLTVTQHVPTGVFTTAHNIRYLRTKVVRTQHTLPLTELTVG

SEQ ID NO: 8089 - protein, 348 aa, Streptomyces avermitilis
MDTMLAGRVHLDTKKFAMEEIPVPVPGPGEVLIEVKAAGVCLSDLHLIDGSITPLHLNSNVLTLGHELSGVIHSLGPGLKRDLAVGTRVALQAGQPCGECARCVSGGTCVSFRGRGVDYDGGWSQYTIAREDTVVPIPDTLPFDQAAIIPDAVSTSYAALVDTVQVRSAQAVGIWGVGGVGAHAVRLARMMGATPIIAVDPLPNARARALAFGADVALDPSDPGFVEAVLRATDGLGLDYAFDFAGVPRVREQASPLLGNHGALVLVGITTEPLKISEKMTFNLKNKKVFGHYGSSFDHVYELIRLAGSGRLDLAPSITDHIPLADVPEAIHRLENKIGDPIRLILVP

SEQ ID NO: 8090 - protein, 362 aa, Streptomyces avermitilis
MTGAPPQEREPVTTSGTIAVTNLHGQIDGLAVRLSRADTGETSAAPLAVAQGAALIDLLNLRGHILGRVADYERAAELAEQLVHVAPEDGTALLARARTRATLHRFAEAVADLGAAGRNGAEEATVDAERAVVLQALGCYADAMALIRKAAERQSDFTTLGALAVLQAERGEVSEAERLFGEARRHYQGTSPFPLAQLDFRRGVMWHREGDLDAARSCYEAARRRVPDYAPALGHLAEVELLRDDPQAAVALLRPLTWASDDPEYAGHLAAALHACDRFQEANQWRERAAARYGELVLRHPEAYADHAADFWLTVGADAERGLQLALQNLAFRQTARAHALFQRAVLAQNRVAQNRVAQAAP

SEQ ID NO: 8091 - protein, 389 aa, Streptomyces avermitilis
MADHFSGPRAIADPASDIADVYAFPSPERPGNLVLVLNTFPASAPTALFSDAITYRFRVRPVTPGSESADAAFNVGEDEYVFDFTFDAPQKVDGTDTLLQMGTCHAPSGRKIAFQVGNEVPTEAEELKIFAGSRLDPFFIDFVGVMVTEATGKLGFRSDASNVLEGLNALSIVLEVDAAVLGPAADSLVAVVGETVTSGGRPVRLERMGRPEIKNVIMSPKKFDTVNSDLEIRDLFNEEDAFSVRPDYASTYRARLNANLAFYDGLDGKTAWPLDEQGAHPLTELLLADFLVVDLSKPFSEDGCFEIETALLAGRPHTTCGGRSLNDDIVDTLFTLLVGGIDGERISDGVDQPTQPATHSFPYLNAPNPTPPDLGARLAAQMPPREEAA

SEQ ID NO: 8092 - protein, 442 aa, Streptomyces avermitilis
MSIEKGNALEIDDIQAAALEPRPTPYAGAYLALRIDDRRQGRELLRRLTPALDSVAAFDPERQVSLAVALSFQGLKALGVPEESLATFPEEFREGMAARAEYIGDIGESAPENWEGPLGSKDVHLVLGGLAPDAARLETVLLLVRDALRDLPGVVAIWQQDVHVGPDEKEPFGFRDSIGQPAIEGTGIPGTNPYEEPLRAGEFITGYKDETHGITPVPQPEVLGRNGTYVAFRKLHTRVADFRQYLRDRAKDPADEELLAAKFVGRWPSGAPLALTPDKDDPELGADPARNNAFMYGDDPEGLKCPVGSHARRMNPRDAVVTGEVRLHRMIRRGTTYGPPLPKGVLEDDGADRGIMFAFVGAHLDRQFEFVQRQWVNDGKFIGSPAERDPLIGVNDDGGFTVPRQPIRRRFKGLPPFVVNRGGEYCFMPGLSALRWIADLDT

SEQ ID NO: 8093 - protein, 226 aa, Streptomyces avermitilis
MSSMPWHSRTRSLMEESMNATVTKKAGKGATDGVVSEMATYFHIKPGHEQECAAACQRMVEALKQAPMAATIKTGLRDTRHVIFNNGTELLWATTFETEWEPYIDDAFLTVGFEHFVDWMQHTTEWDTKIAPWIEKSGGLESLTGDKTREGFDEHIIANMAGMRWILQDGQQKATAYWNPVSSLTMSEITKAERINAAFQEVLDDPAAEEALQHPALKPLLAQAAS

SEQ ID NO: 8094 - protein, 195 aa, Streptomyces avermitilis
VEDRTDPRLLRSRDAMVSAATALLTEGGLEAVTHQTVATRAGVGRATVYRHWPGLLDLRLAALEAGMPPLPPMPEELRAASGNDPRAELVHRLGVLAERWDDEQSGAVLAAILGGSRHDEGMRRLRESLLNQIADALRPAVAVAVERGRLRSDVTPETFAMATAGPLFFERFLAGNRLGRDTVEAVVDAAMRGWS

SEQ ID NO: 8095 - protein, 503 aa, Streptomyces avermitilis
MSQNTVAAARGVETAPKNGAVDPSHQRRWWILVVISLAQLMGVLDGTIVNIALPSAQRELGFSDADRQWVVTAYALAFGSLLLLGGRVADLVGRKVTFLVGLAGFAAASMVGGAANGFGMLVAARAVQGGFAALLAPSALSLLMTTFTDPRERAKAFTVAGSVAGAGGAIGLILGGVLTEYLDWRWTMYVNVVFAVVAFAGGAALLRRTSRDTSSKLDIPGTLLVSAGLFCLVYGFSNAETHGWGSVATWGMLAAGTVLVGLFGWWQSKAAYPLLPLRVLLDRNRGASFAALFVSGAGMFGVFLFLTYYLQQSLGYSALKTGFAFLPMIVASSSASAVAANVLVPRIGPKPVVPLGMAIAAVGLVWMTALDLNSGYVTQVLPQLVLVGIGLGAVIAPAMSLATSGVAAADAGAASAAVNTVQQVGGSIGVALLSTMASDAVTDYLSGRNPKDPDVLAQAGLEGYSTAYWWSAAVFVIGLGVTALLYRRGVPQQDENAAPVVHM

SEQ ID NO: 8096 - protein, 226 aa, Streptomyces avermitilis; identical to SEQ ID NO: 8093

SEQ ID NO: 8097 - protein, 340 aa, Streptomyces avermitilis
MGRRRPGAPTLEEVAAHAGVGRGTVSRVINNAAGVKESTRRAVQQAIQELGYVPNLAARSLAGQRADAVALVLTEPDWRQFAEPFFSEIVRSLGDALADTGMQLLLTLVRSDAERQRFLEFARGGRVDGALLVSVHDGDLLPDMLVEAGLPTVLLGRRSGDEYVSYVDADNVGGARSAVSHLLKRGRRAIATVTGPLDMHVAQCRLRGYQEALAMAGLRGEPSWVAESDFTEESGRRAMAELIERHPEIDGVIAASDTTAAGALQALHAAGRRVPEDVAVIGFDDFPLAQQTKPRLTTVRQPLEEIGRAMVRLLLEEVEEPAVAWHHVILRTELVVRESA

SEQ ID NO: 8098 - protein, 375 aa, Streptomyces avermitilis
MRPSPPHARSARGLFGALLTALVSLAALLTTASVAQADTSICEPFGSTTIQGRYVVQNNRWGTSEAQCITATDSGFRITQADGSVPTNGAPKSYPSVYNGCHYTNCSPGTSLPAQLSTVSSAPTSISYSYVSNAMYDAAYDIWLDPTPRTDGVNRTEIMVWFNKVGSVQPVGSQVGTATVAGRQWQVWSGNNGSNDVLSFVAPSAITSWSFDVMDFVRQAVSRGLAQNSWYLTSVQAGFEPWQNGAGLAVTSFSSTVNTGGGNPGDPGSPTACKVAYATNVWQGGFTADVTVTNTGSSPVNGWKLAFTLPAGQQITSSWSAGVSPSSGAVTASSLAYNAQIATGGRVSFGFQGSYSGTFAAPAGFSLNGAACTTA

SEQ ID NO: 8099 - protein, 136 aa, Streptomyces avermitilis
VTWMKSASQEPINDGDGKAALFPYGYGLTYDATDPTPTQGACTAQFRTVSSWQGGYQAEATVKNTGSAALTGWTVDWDPAGSTITSLWNGSLTTAQDRATVRNAAFNGSLRPGATTPFGFTANGPTDTPAPHCTSS

SEQ ID NO: 8100 - protein, 741 aa, Streptomyces avermitilis
MTHRTGRAPEHGPRPGRRRRRTTSVAAALVTLALGLAGQLAGHPAAAAEAHADNPFAGASFYVNPDYTDLVGTSAAQTSDATLKARMQKVGTYPTAVWLDRIAAITGGAANAGRKSLADHLDLALAQKKPGQPITATFVVYDLPGRDCSALASNGELPLTQAGLDRYKSEYVDAIANVFKNPKYRDIRITTVIEPDGLPNLVTNTADPECAQAKSSGIYVKGIQYALDRLHAIPNVYTYLDFAHSGWLGWDNNLSQTVQLYTDVAKGTAAGFSSADGLITHVSNYTPLEEPFLTDPDKTVGGNMVKSSKFYEWNPNFDESDFTGNVHRALVAAGWPASTGMVIDTSRNGWGGTGRPTTESSSTTLDTYVNESRVDRRAHRGLWCNVSGAGLGQPPQAAPSGSPDSHLDAFLWIKPPGESDGASSDIPNDEGKRMDPMCDPTYTAPNAGGNKTGALPNAPLAGHWFAEQFAMLVRNAYPAVLTDGGGTPGGDTTAPTAPTGLKATAKTPSSVSLSWTASTDDTGVSGYDLYRGGTKVTASPVAGTAFTDTGLSAGTAYSYTVRARDAAGNVSAPSASLSVTTDTSGGTPDPSGGLKVLYKNNDSSATDNAIRPGLRIVNTGSGSLDLSKVTARYYFTRDSGSPTVNAWCDYAAVGCSNVSLKVVPLTTPVPGADAYLEVGFTGGTLAVGQNTGDLQLRMSKSDWSNFDEVGDYSRGTSTTYTEAAAIPAYLSATPAWGAPPA

SEQ ID NO: 8101 - protein, 153 aa, Streptomyces avermitilis
MKLTKRISLAAASAAVAGGALLGAGGTASAAVPESAHIERPAVSIKADDYREDRGVNYRHNSEEDYRRDGYRARQHSDHFSDSDRYDRRGHSYYWDDEDRCWKHDSNYRYDWDRSDRRDSNRDDRDWNRYDHDWNRYDHDSNRSNHDRVLDNR

SEQ ID NO: 8102 - protein, 381 aa, Streptomyces avermitilis
MTAAPTATGGLRSRWRRTSGSMGRAEWGRAAGMAAFIIALHVIGWFTLVAIVAPEHYSVGTKGFGIGIGVSAYTLGMRHAFDADHIAAIDNTTRKLMDEGQRPVSVGFWFSLGHSSIVFVLALLLSLGVKSLAAPVREDNSELHHVTELIGTTVSGTFLYLIAIINIVILAGIWKVFRQMRSGHFDEAALEQQLNNRGLINRLLGRVMKSITKPWQMYPLGLLFGLGFDTATEVALLVLAGSGAASGLPWYTILCLPVLFAAGMSLLDTIDGSFMNFAYGWAFSKPVRKVYYNLTITGLSVAVALIIGTAELLGLLADKAGLHGVFWDWISGLDLNTIGFVIVGLFFATWAAALAVWKLGRIEEKWTAGLRPPEQQADRQR

SEQ ID NO: 8103 - protein, 205 aa, Streptomyces avermitilis
MTDREPQALDVLDDAGRKVLFTEARTANTFAEVAVADDELAMIWELARWSPSAANGQPLRVLFVRTPEGKERLGRHLDEGNRAKTLSAPAVAILAYDVDFHEQMPTVFPARGEMLRAAFADQTEKRESLAAYNSALQTGVFLLAVRAAGLAAGPMAGFDRAGVDEEFFAGTSWRSHLVVNIGHPGADPWFPRLPRVPVEDAVAYA

SEQ ID NO: 8104 - protein, 672 aa, Streptomyces avermitilis
MTTPHPAPYPEPFFTPDPKSAAHSRIADFARWAARHQGAEGIQDPTDYRALYQWSVTDLEGFWAAVWEYFDIDATTEYEGVLAEETMPGARWFPGATLNYVHHALRNLQPDAPAITALDETGAGYEITGRELRARVASVAASLRDLGVAQGDRVVGYLPNTPHAVIAFLATASLGAVWSVCGQDYVPKAAADRFAQLEPTVLITADGYLFNGTTHDRRAASLELAVALPTLKATVLVDHVGLAWPEGGDLGLTVPWEDAATRAEYLTIAPVPFDHPLWVVFSSGTTGLPKGIVHGHGGVLLEHLKMLGLHTDLGIGDRLLWYTTTHWMMWNLVVSTLLTGATTCTYDGSPAPQARPDVLWELAARHKVTVFGTSPQYLLAMSKLGIAPSVYDLSAIRVVGCTGSALPASAYPWVRDHVGAGVQLASTSGGTDIVSGFAGSAATTPVWAGELSAPGLGVALAAYDEEGLPVTDRVGELVVTRPMPSMPLYFWNDPDGSRYRDAYFGAYPGVWRHGDWITLTSHGSVIVHGRSDATLNRNGVRLGSADIHDVVERLPEITEALVIGAEEPDGGYWMPLFVVLADGVGLDDSLRAKIRDAIRAGASPRHVPDEILAVPALPHTKTGKKLEVPVKRLLQGAPAEQVLNPSAVDNPDLIAYFARLGAERNKRSAHHT

SEQ ID NO: 8105 - protein, 536 aa, Streptomyces avermitilis
VKAASQRPVVIIGGGPVGVMAGLLLARYGVRSLLLERHRDIYPLPRAVVVDDEIRRILQSVGVHEDFAALARPALGLRLLDARRRVITEFPRSMHGHHGFPETSMFDQPELERVLRSALARRPECELQGGVEVVSVTQDTDGPNDPTGPARVTFRRDGSDEEEHVWADAVLGCDGAGSLTRDSIGAVWEDLHFQESWRVIDVRTTRQVRTWEGAEQICCPNRPATFMRVGEDRYRWEFRLPEDENLDGPDGWERLRELVAPWVDLPPDASAGDDFEVVRQAQYTFRARLADRWRRGRVFLLGDAAHLTPPFVGQGLCAGLRDAYNLTWKLARVLQQGAHDGLLDTYERERKPHARHVIRVAVAVGWAMTGGQDRGAAFRRAVVGTASRIPGVTAAVSRDLSPALTAGPLVRRRPRLTGRVLAGTICPQPWVRHDGRRVRLDDVLGDSFAVVTAVPPTAQMTAVATALGAPTVHVEDLRDDGTLAGWLARGRADAVLLRPDRVVMDTVQAGTGDFTDTVAWAPLLHTARHTADARPA

SEQ ID NO: 8106 - protein, 312 aa, Streptomyces avermitilis
MSTNVLRTNDGWWVVRDERAVRVQTKAVTTGELLADRDAVREAAASAESGTPVADLVALPPVTTPCRVVAQMVNYRSHAKDSGFTGDIPATFFRKASGSVSGPHDTIIRPAHVKFLDYEVELGLVMGATLPVGTVVEEQDLPRYVAGLVLTNDVSARDVQLTKTQFYESKSYPTFTPTGPYLALLEPEDFAHLLNLRLQLSVNGVSRQDRTLADMIVRPAQALTLLARFQTLDPGDLLLTGTPGGTALKAPPKAAEKIAALLPPALKWKAFFKGQAKNPKYLRNGDLITATIATPDGRIDLGEQRTPVTDAA

SEQ ID NO: 8107 - protein, 381 aa, Streptomyces avermitilis
MSHTPVNRAAPQTPHQDLHSEQGALRGEHPGRSRNPVIKVADLAWLEFEKPDLDQAEVFARDFGFAIAARTEGELWLRGTFAGSPCMVIRRGRASRFIGPAFRAAERADLDRLAGTTGSTVRDIGVPGGGQSVALLDPSGLPVRVVHCAEQLPALPEQEPLILNFGTDHRRTNATQRPPREPSRIQRLGHVVLETRVFARTLDWYLDTLGMIVSDFLFLDGQRGRGPTMAFVRCDQGSVAVDHHTLALHLGPGTGYVHSAYQVTDLDAIGAGGEYLAERGYQRSWGIGRHIQGSQLFDYWRDPDHFMLEHFADGDLFSCDLEPGWAPMSASGLAQWGPPVTRDFLGASPSPAKLREVMTALRGDNELDPARLLGLMKAMSS

SEQ ID NO: 8108 - protein, 211 aa, Streptomyces avermitilis
MPTSAPPKNRFERRRAETRQALVRAARQILAETGDTSASIQAIAERADVGFGSFYNHFESKTELFDAAVTDALDEFGQVIDERVEGIDDPAELVAAGFRLTARMADSHPELMRILRDRGLAYIHSARGLAPRALRDLENGIASGRFTCRNATTALSALGGTLMSLVALRLARPDLDGDEAASDLAEMVLRMLGVPPDDAHQVTRRPLPDLD

SEQ ID NO: 8109 - protein, 481 aa, Streptomyces avermitilis
VDLTADSLLSRAAHELSPRADEVIHDVEQCLRREIPELWDEPDIAQMTRENVAEHVVALLFGIEHSIEPRRIDQPAADAERARRLAQRGKPVTAMLRAFPLAHARVLDRLLEELPRLTSDAESINAAARKLIALSIAYMARTSETGVLAFQEERDRQLQWRLSVVNEASVRVGTTLDIARTAQELVDLATEHFADAVTVDLLDMPSGDEPPAKGTLVVRRIAQQSVMDGYPETTSLEAIYGELPVSPQQVHRYPDGSPPARALATGRPSRHHLGPSASMLLVPLCARGTTLGVVQFFRHHRPDAYGDEDLLLAQEVAARAAVAIDNARRYTHARATALTLQRSLLPRRHPRSPPWRSPAATCLLPPSSAWAATGTTSSRCPVPGSHSWWATWSATASTPPPPWAGCGPPCAPSPTSTCRPTNSSPTWTTSSSACPPKSLPKPLPKRTPNPQGTSGPPACTPYTIPSPAAAPSPARATCCPS

SEQ ID NO: 8110 - protein, 339 aa, Streptomyces avermitilis
VVGDVVGHGIHAAATMGRLRTAVRTLADIDLPPDELLTHLDDVVIRLSAEVSSEASAQTDTESAGDIGATCLYAVYDPVAGRCTLARAGHVLPVVMARDGIADILELPAGPPLGLGGLPFEAAEIDLPEGSLIALYTDGLVEALDHDIEAGLTRLCHALAQPSASLEATCDTALDALLPAGRPHDDVALLLARTHTLGERQVVTWDVDADPAEVARARAHVSEQLTTWGLEELDFTTELVVSELVTNAIRYGRPPIQLRLIHDRTLMCEVADAGSTTPHLRRARVFDEGGRGLFLVAQLAEHWGTRHARRGKTVWAECALGAPELFSTGLDLEGIPGVV

SEQ ID NO: 8111 - protein, 252 aa, Streptomyces avermitilis
MCEAFTLRRSSSMPAVLIHGVPDTHRVWDGVRRHLIRSDVEAWDLPGFGTPRPRGFGSSKEECVDWLVERLERVGEPVDLVGHDWGCILTARVASIRPDLVRTWAGSSAPVSTQYDWHPLAKIWQDPVEGDRFMDELDPASFAKDLMENFDLPAEVAEEMVRRVDGTMRDSILKLYRSAETVGAEWEPELTNVSAPSLVLWGTLDPACPIAFADELGQAVRASQVVELDCSHWTLIQKPAEVAAALEAHWNA

SEQ ID NO: 8112 - protein, 268 aa, Streptomyces avermitilis
LERGQRRHGPVGRADGAELGQSAPCRRVGASTSPASTRAPTLPSTSRTSTSPLDHEPACGQTAAHEVHGRARLRAGHRGRDGPLFAAAGSAVSVSLPHFRYHPDPVASGSIGESAEVCACCNRSTGWIYTATFYTAHDVSGSFCPWCIADGTAAERFEGEFTDPYGLDGISQETLVQVTRRTPGLHAWQDPHWLVHCNDAAAFIGEVGYTELAAHPEALDQLRLDLRMGGWNDATQLEHFLTHLGQGASAMLFRCTVCGTHLAYADAS

SEQ ID NO: 8113 - protein, 284 aa, Streptomyces avermitilis
MTSASERGRRPLRVGNCSGFYGDRASAMADMARAGGIDVLTGEYLAEVTMLVLGKARAKDSTKGFAITFLQHLDAAREHLVANRIRLVVNAGGLHPAGLAAATRELIARHGHDLRVSHIEGDDVFGSLDGLGQAGHCLPHLTSGQPLSDWPHQPVQMVKEDAGDLGEMVDLLCCERVDEQAPHYLGMALGAASSKAVRPSGVSAAYMARDGPLWRSTRPRLHRRVSWWWRRLSPSPAQLIAELICTHGPARGFRQGDERRVIGVGCGSLEGNACAELGRHEASA

SEQ ID NO: 8114 - protein, 155 aa, Streptomyces avermitilis
VMSSRGGNRRRPTQGTHQQASGVVGTHSCRPSAGEKCVGHVVQRAGGLAERCREGIVLLGDFAWCMAPVLRAGFGIGIAGTELLARLLAEHDHLPAALGVREQRLRPFVTRHQGEALRMRHFFMPAHRFGYATRRTLIRAADTPVGSALTKTLVN

SEQ ID NO: 8115 - protein, 227 aa, Streptomyces avermitilis
MAGDERAQPLLPHAEGGGQVVVFGEQPGQQFGARDAYAKPCPEYRGHAPGEVAEQDDPFATALCKATGPLDDMADTLLARARPTGMRADDTTCLLVSPLSRAPAVAAPTGHHRRATAGPRGGSGVVEPVPGAENGDRLLEFAGVVVSINYQVGDTLPRLKHTVTTFQLFRYSAVTWNPHRIHFDEPYAREEGHGGLVAHSHLRAALALCHRGSRPQVARDEGCLPPA

SEQ ID NO: 8116 - protein, 348 aa, Streptomyces avermitilis
MDTMLAGRFHLDSKKFAVEEVPVPVPGPGEVLIEVKAAGVCLSDVHLIDGSLVPLFATSDTVTVGHEVSGVIHTLGPDLKRGLTVGTRVTLEAGKTCGQCAGCVRSRPCTQMRTAGIDYDGGWAQYTVAREDTLIPIPDNLPFDQAAIIPDAVSTPYAAVVTTAGVRPAQSVGVWGVGGVGAHNVRLARLAGAAPIIAVDPLPSARERALAFGADFALDPAADDFADQIRAATAGRGLDFAFDCAGVPAVREQAAAALGLGGVLILVGISPRPLTITEGLTFNYLGKQVRGHYGGSPESVTELVRLAEVGRLDLAPSITDHLPLAEAADAVNRLENKIGDPIRLILVP

SEQ ID NO: 8117 - protein, 1073 aa, Streptomyces avermitilis
MTTQPETDLRPIRSPRGVPLFGHTPQIPSTNPVEYFGKLSKQFPEGLYGMEIAGIEQVFVWDPDLVAEVCDETRFFKQIDKTPLAHVRDYAGAGLFTAHQHEEEWGMAHRVLLPVFSQRAMKGYFGQMLEIAQNLVGKWERKEGQPVNITDDYTRLTLDTIALSGFGYRFDSFAKEDLHPFLNALLQALVESLRRSQELPVMTKMRKADDKKYRENIRLMRDLVENVIKERREGKGTGEDDLLGLMLEATDPETGKGLDDDNVRDQVVTFLIAGHETTSGLLSFATYSLMRNPHILAQAYAEVDRLLPGDTVPDYDTIMQMDVIPRILEETLRLWAPIPMIGKSPLEDTVIGGCYGLKKGARVNILEGPLHTHPKAWERPEEFDINRWLPENRVNHHPHAYKPFGNGVRACIGRQFALTEARLALALVLQKFKFADTDDYKMDVKEALTRKPGGFELNVRARQEHERTVFGAADLQTDDTQAQAAVSGVGVNLTVAYGSSLGSCEDLARTIADRGERSGFGTTLVGLDELGDNLPTEGLLVVVASSYNGKAPDNAQRFDDLLAAGLPEGSLSNVRFALLGAGNTQWVATYQGFPKRIEAGLLAAGATRVIERGIADAAGDFDGMATRWMDTLWTTLAEEYAADTSETTGPRFEVQLLTEAEVRPAIVSEQAYPLTVVANEELVSDATGLWDFSIEPPRPAAKSITIELPDGVTYDTGNHLAVFAKNEPVLVNRALARLGVDRDQVLRLDQPGGGRTHLPVGTPVTTGLLFTEFVELQDVATRSQIQELAEHTQCPWTRPQLQAYTADTAEAEERYQKEILGKRVSVLNLLERFPAVELPLAVFLEMMGPIRPRFYSISSSPLANPRHVRLTVGLLEGPALSGDGRYRGTCSSYIAGLESGDVFYGYVRVPSPTFAPPADPATPLLLIGPGTGIAPLRGFLEERAHQHAHGTQVGLSQVFVGCRHPEHDYFYRQEMQDWEQAGIAQVHTAFSAVTGHPARFVQDAIVGAADTVWQAIQDGAYVYVCGDGRRMAPAVREALAAIYRKHTGSDDEAAQQWLAQLEADERYQQDVFA

SEQ ID NO: 8118 - protein, 218 aa, Streptomyces avermitilis
MATERKPPRGTRKRDVPLTKDGICAMALQLIDADGVEALTMRKLATALDANPMSLYHHVPNKDAVLRGVAHRVGSQFSAGQREDVPWQDQLRELARDFRELSHRHPKLMGYSFTRPDYVQPEDPFWQALIDILAAAKLPDEEIPRVAATLVGVFTGLLLGELNGALQRWATLPPAPSGPDGEDAPPPSKDVIDTMFNSALDAAVSGVENHVARVREGA

SEQ ID NO: 8119 - protein, 265 aa, Streptomyces avermitilis
MERAKRTPRGTRKRDVPLTEAGICTSALRLIDADGVEALTMRKLAAALDANPMSLYHHVPNKEALLGGVARMVGARFRTVTLEDAPWQERVRLLATDFRTLAHRHPNLMAYSFSQPDFIQPEDPFWVALTAVLAAAGVPQSEIPQLAALVCAVVIGVMIAELNGALHRWSNLQPATPASGEDGPTNEGFGEDRMFRLVLDTIISGLESRLTADHAGGREGQPPQNSGCASGRIPRQLRPPAAHCEGESPGNPVSGMAAGLDPEVQ

SEQ ID NO: 8120 - protein, 60 aa, Streptomyces avermitilis
MCTWRWPTEALPPTEVDWTAGLDADEHGRGLLIIDCLADAHGDWQEAGHAVHWADITTLS

SEQ ID NO: 8121 - protein, 109 aa, Streptomyces avermitilis
MSQYQLRVYTLRSPEALVAYENIWSQHIPGMAKHRITTHGVWTVPAAPGSEEPQLYALVSYRDADDVQERLEAYLSSPEFRADMEGFDISQIVGVAESVLTPTADSPLR

SEQ ID NO: 8122 - protein, 139 aa, Streptomyces avermitilis
MESLKTVMQEVAVQLVVSRTYSLSMCMSLRYEPTDPYVVRATFFTHTDEPTEWVLGRDLLADGLRGSAGCGDIRVWPAVGRGDKAMYIVLGAPAGTALLEVPVQDVKTFLESAEALVPRGTESGHIDWDREVANLFAKG

SEQ ID NO: 8123 - protein, 114 aa, Streptomyces avermitilis
MEGFAQAAPDAAHRLHAADGADRTHQEGKTMKRLTRRVAVTAFCVAVAGVAALGAGGTASAATSASVHGQRPAVSVDAGDYRWDHGVGYLLELGYSWDEIRGWHHDGRDEISGC

SEQ ID NO: 8124 - protein, 69 aa, Streptomyces avermitilis
MQTVVDLTRCQGYAQCVFLAPEVFQLHGEEGLLYATAVPDDQVERVRQAAAACPVQAILLGEEVSAGAR

SEQ ID NO: 8125 - protein, 454 aa, Streptomyces avermitilis
VPGDLKDGRIVIVGASLAGLRAAEALREEGFTGSLTVVGDEPHPPYDRPPLSKQVLLGQATADSTGLPMRQDPNADWRLGVRATGVDLLAKQVLLEDGESLPYDRLLIATGTRARPWPNPAEAALDGVFALRTREDAGGLAQRLTAGPERVLVIGGGFTGSEIASACRERGLEVTVAERGPAPLVGALGGTLSKLAAAMQRNHGVDLRTGVTVTALNGNGSFTGAELSDGSRVDADVCVVALGAVRNVEWLAESGLAAGPRGIACDAGCRAFNMYGIVTDDVFVAGDVSRFPHPLFGYQMLSLEHWGNAVEQAEVAAHNMVNPGPLQRPHLAVPSFWSTQFGLNIKSVGVPTYSDHVVIAQGSLEARRLAMVYGYQGRVTAAVTVDMAKALDYYRHLIETAAPFPPPPGAQDRAVAADLAIPSDVPDPKGLSHGPTVALTGYLPDRRLTLVQPG

SEQ ID NO: 8126 - protein, 399 aa, Streptomyces avermitilis
MASDTLLARITDYANRPDPYPLYAELREAGPVVRQADGSYLIGTYHEIVALLHDPRMSADPRSRTAPAPYEVTRKPSFLRLDDPEHHRLRNSAMRPFGPPHSPGRVDSMRGEIVQLTKELAEVFQEGRQIDVVDDFAYPLPVTVICRLLGIPDKDEQLFQDWTDTLVASADIGPEGDTAERDQAADQAQQEMGQYLVQLAEQRRGRPTGDMLSDLVNEPDPAARLSEEDLAANTILLFIAGHETTVNLIANGVLTLLRRPDQLDRLREDPSLLPRAVEELLRYEPPVHMRERVPLVDIDVAGTTIPGGTSVILALASGSRDPMRFSEPDRFDPTRPDNQHVGFGSGIHLCFGAPLARIEAEAALGALLPHLGTARLVQDPPPYRQNAMLRGPRHLPIQL

SEQ ID NO: 8127 - protein, 211 aa, Streptomyces avermitilis
MPMPAPRRNRFERRRAETRQALVRAARQVLAESGGASASIHAIAERADVGLGSFYNHFAGKPDLFDAAVADALEEYAQAVDERLHGVDDPAERVAGGVRLSARMAASYPEIMQILCHSQLGRIYAGDGLAPRAKRDVEQGMAAGRFTVADPVIALTLLNGGLLALLELWCNQPEADSDQAAGAMAETILHMLGLSPDEARDLAWRPLPAAA

SEQ ID NO: 8128 - protein, 859 aa, Streptomyces avermitilis
LTIKGSYLTISSEVDKAVHWADAAHAEAVAHLSTDGKNRMTKTDHTPLAEPVSPRETPDAAIAMLDAEGTVVGWTHAAEQLVGYSAGEVVGRSATHVLPPAEDVPSASVFAEQGRALDGWSGAVTVRHRDGHAIKMTLRISLLWGQDAGTRWLVSVTDIGTLSSGTSDEAVRESLLAHAPVGIAVYDPRLRCTWVNDVMERHDGTPRERRFGRRLRDSLPAVEAEALEVVMRQVLESGTTMVHEYRAWSSTDQRREHAFSASFFCLQDADGTALAVCSMSVDVTGNRRARERLAILSEASTRIGSTLEVMRTGQELADLAVPLLADHAIVDLMESVPFGVDPSAGTGTAANDRPPVLRRAGVASVDPGILKLLMRQEVIRPFPTSLFATVLRTGRSYLESVLDTYSGPWILHDPARTQMVRDSGVHSLMVVPIRARRCALGLAVFCRSEEPTPFQEDDLLLAEELVTRAALSLDNALQYARQRTAALTLQRDLLPHHVGGGAALDVASRYVPADIDHGVGGDWFDVIKLSGARVALVVGDVVGHGINAAVTMGRLRTAVRTLANMELPPHELLAHLDDTVKRLSEEDADAPDQLPPAVGATCLYAVYDPVTRRCTMSRAGHPPPAIIDPQGRATFPDMPAGAPLGLGLGLVPFESVELELPEGTLLALYTDGLVESRDDDIDVGLDRLGAALAESGSALEDLCSQVIETLPTQAPADDVTLLLARTRGLEPAQVASWELPNEPAAVRIARQAAARQLSEWGLDHLVTTEQLIVSELVTNAIRYSGGPIRLRLIQHQVLTCEVSDSNPSHPRPRQPHTIDENGRGLSLVAQLSHRWGSRSATDGKIVWAEQDLPSKALAA

SEQ ID NO: 8129 - protein, 809 aa, Streptomyces avermitilis
MDKENAKNAYSAGASQGSTGVSGSGPGGRRCACDGPAAAVLDDRGAVVGWTETAEDLTGFRAGEVCGRPVQELVADLPDHLRGATDMPESGRVRLRHQCGDTIDVTFRTTRVQGSAQVLVLAAPTHHVADHKQGTALLRALSAQNRITIALYDTDLATVQTNAKPDTPDGLPVQPGTRLSDVLCADDAENLEAVLRQVLETGVPVVRRTQQVSWRHNSARRHTLSLSAFRLEDVRARPTGVAALYIDSDDLRARRHLDLAREVAERVGGSLDVVRTAQDLADVLAPAFGDLAAVDLAYSVLDGEEPSKQLNGGNMGNAALAPATAVWPAGIKRGESIPPLPDHPLWRSFRHGEPAVFSLDDFIAMVGDPQLVKYLAPKDAHSMMVAPLHARGLTLGAISVWRCGRSDPFTEDEADLMKQIASRGALAIDNARRYTREHRAAVALQQLLLPPATTDTPAAETAGVHLPAGGEADISGDWYDAIALPSLRLALVAGDVVGHGMSASAAMGSLRAAIRTLADLELEPDELLTRLADLVQRLAAEAPSGDCDIVGGTCLYAVYDPVTRRCAMASAGHPPPVLVRPDGTAEAVGISPGPPLALSGMPYETTIIDVEPGSVLALYTDGLVERSDRDIGQGLRRLTEALAAYCRPDRALDETGRALLADLADQAPRDDGALLLARTRAVPAADTAHWEIPADPAAVAKAREWTTRQLTLWGLDDLLFATELIVSELVTNAIRYGRPPMDLRLIRHNALVCEVTDSSSTQPRLRRARTTDEGGRGLFLVAQLGGRWGCRHVQNGKTIWSEQVIQDSS

SEQ ID NO: 8130 - protein, 148 aa, Streptomyces avermitilis
MAVNLDDVDWAIIGQLQREARISLSELGRRVNLSSSATTERVRNLESLGVITGYHAVVDLAKVGYPVLAVVRLKYPGNRHQPLRRLLAERGEILECLRTTGDDCYTLKVAASSMEHLETLVDELAGFGSTTTSVVYSQTLPYRSPSRP

SEQ ID NO: 8131 - protein, 272 aa, Streptomyces avermitilis
MQLGVNVPNFGPGTDPGVLRDWARLAEGLGFDLLMVSDHVAVTPDVAERYPEPFYEPFTTLSWLAGLTTRLRLGTTVLVLPYRHPLLVARMAANLNQLSSGRFVLGVGVGWARQEFDALGVPFTARGRLADEYLGALRDAWRTETGDGTAPIPVWVGGHSEAAIRRTVRFGDAWHPLRLPLPLMRSVLANHSLPAFAPRIALRMTGTPVDDRERPAGVGTIEQILDDLDQLRLLGAATVVLDPYHGDPEETRRPHAAWQALTAVATHWRTPS

SEQ ID NO: 8132 - protein, 145 aa, Streptomyces avermitilis
VITIEDETLLRRAIGIAAHAVTLGDAPYGSLLTGPDGAILAEAHNTVRRDNDIAAHPELKLARWAARELAPAAAARTTMYTSCQPCTMCAGGIVRSGIGRVVYALSTEQLVELNPQSGDWPTVPQDGPVLFEEARAPIDAYYRPT

SEQ ID NO: 8133 - protein, 136 aa, Streptomyces avermitilis
MTPDTPRHQGRSDEAADAAPGPFRLFPAAPQDVPASGNESPPHPASRINTDPDTVERDLIKLVLTLVELIRQLMERQALHRVDAGDLTEEEEERLGMTLMVLHDRLNDLCGRYGLTMQDLNIDLGPLGTLLPPSDY

SEQ ID NO: 8134 - protein, 95 aa, Streptomyces avermitilis
MMTDPSDFGPAKPRPPDRGSLPDRQVALIDLLDRLLTGGIVITGDVTLSIADIDLVRISLRALIASIGTTTPSPWSRGGPLPVTSPGHPDQLPSP

SEQ ID NO: 8135 - protein, 271 aa, Streptomyces avermitilis
MTATVSYLYGVSAVPGGSYDVVAALRGIADAPVRLVPDEDANLAAIVSSVPADDFDEAPLAAHLEDLDWLEAVARAHHRVVDAMAARTTVLPLRLATIYRDDDRVRAMIRAGHRAFAQRLAHLAGHMEWGVKVYFDPPSAPTASTAAAPAAELSPGRAYLRSRHQERDSRQDAYRAAEQAARRVEAAARTQAVEHVRHRLQQGPLSHGSGENIVNNAYLVADGQAEDFRDAVQLAAEQSETIRVEITGPWAPYSFVSRQNEPGEMSEEAIT

SEQ ID NO: 8136 - protein, 149 aa, Streptomyces avermitilis
VTEPVPSNLGSFPSRASPSYGQGSSANLADILERVLDKGIVIAGDIQINLLDIELLTIKLRLLVASVDKAKEMGIDWWEHDPALSSHADGGRELAEENRRLREEIAGLRDAQALPSAEGPAEKPERPKKRASTAKSTRAGNRRTPRTER

SEQ ID NO: 8137 - protein, 74 aa, Streptomyces avermitilis
MRFSAGGGCADQEVSGGAPTMMNAAAGAVLLFGCLYEEAEEGHDAEPRTQRTSAPCRESALTDTADAESRSERP

SEQ ID NO: 8138 - protein, 83 aa, Streptomyces avermitilis
MGLLTHLLTLPLAPVRGVGWVMQQVAQVAEEQYYDPDPVLKELAELERALVSGQIDQETFDRREDELLDRLEEITRFREGTGA

SEQ ID NO: 8139 - protein, 240 aa, Streptomyces avermitilis
MAVYVYAITAASHPLRLDGVTGVGEPPEKLRTVNSRSLAAVVSDAPDGLRAKRRDVLAHEAVLERLMAEGSVLPLRFGAVTSDDQAVLQVLDERAASYQERLTALDGCVEFHLKASCDEDALLREILLQSPEAHQLNEQIRSGRAGPDLQIALGERVAGEVQLRHESFAAGAVEALRPLARDIRASDPKGGDFVSVSFLVDKARQEGFTAAEQDLANERGADFDFRLHGPLPPYSFVEAT

SEQ ID NO: 8140 - protein, 149 aa, Streptomyces avermitilis
MTVVPQSGGGGVAQGGGSGTLYDVLELVLDRGLVIDVFARVSLVGIEILKIDARVVVASVDTYLRFAEACNRLDLESGRKAPAQLTDLVGEVTEGGAKGKSKGALTGAVEAVTESFHQGHEEDREEEREPAAERKRPRPTRRPARRREE

SEQ ID NO: 8141 - protein, 122 aa, Streptomyces avermitilis
MPADRNGDSARPRKRTHRGTEESRVRSRGESPRPSQRLSASRAMLSAMQQLKELLGKAPESVSAVRPTDDGWEAEVEVLEIERIPETTSVMASYRVTLDADGELMAYERIRRYTRAQVDRRA

SEQ ID NO: 8142 - protein, 248 aa, Streptomyces avermitilis
VQLEAAKGDIVGLVGPNGSGKSTLLRTVYRSLRPADGVVRVGGDDVWELSARTAARRTAAVLQDAGTTTGLTVTEIVALGRTPHHGLMGRDGAEDREAVTEAVERCGVGPFADRDYATLSGGERQRVLLARALAQRPQLLVLDELTNHLDIRARFELLDLIRSTGITTLAVLHDLDLAARLCDHLVVLHEGAVVAAGPVLEVLTPDLLREVFGVRGATERHADGVVRITYAAEPLALDREAEPAPAER

SEQ ID NO: 8143 - protein, 323 aa, Streptomyces avermitilis
VVAVSIGAVNIPVADVWGILLHHVTGRGAAGDPALDQIVWTFRAPRVALAALVGAGLAVAGAVLQTLVSNPLADPVVLGFSYGASLGAVLVITLGGVALGGLAGLGVSGAAFVGALAAGALVFALGQRQGRLAPTRLVLAGVAVGYVLLSVTSFVQLLATPTELRTVMFWMLGSVAGAQWSQLPTVTAVVLTSTVVLTLFGRRLNALLAGDESATALGVDVNRLRAVLLVISALLTGTVIAVAGGVGFVGLMIPHLVRLTTGADHRRLLPLTALLGAVYLVLVDLLSRTVNRPNELPLGILTALLGAPFFLWLLRRDKGLDTV

SEQ ID NO: 8144 - protein, 347 aa, Streptomyces avermitilis
MSKKRPVAVALAGALCLVTAACADSSTDQDGATGDKASAAAAKSGYPAILENCGVSEKFTKAPGRVVVMNGASVAEVSTLLSLGLGDRVVANQQSYGMSEVPGRAKAIKALPNGKVKLNDAYDIPREAMIGLRPDLVLSTTSYGFDEKNGFATRDQLKEVGAHTYVSPQGCDQDTSKMTVADSYTLLRDMGKIFNVRDRAEQLIAASEKHIAEISAKVKGEKQPKVMVLFSNMAMGGNDFSSVVAKGIYNDILAKAGGSNAFASASKTSFADLSKEKVAATDVDALVVIGYNDPNPAAYAKKLLKEFPQWPAAKNNTYVALSDSMYLGPSNDLAVEKIAKALHPDKF

SEQ ID NO: 8145 - protein, 1440 aa, Streptomyces avermitilis
MDDTARRHPLLAAQEGIWTGQQLDPDSPAYNTAEYVLIEGPVDTAVFDAALHHVVAETEALNVVFVVDDQGRPWQATAPVGDWRLHTADLTTEPNPHAAALAWMGEDMARPVDLARGPVFGHALLRTAPEQYLWYHRVHHIALDGFGLSLVARRVAQVYTALAAGERAAAGGFGTLASVRDEERAYRESPRFAKARAYWADRFADRPPVATPAGRTALPARTFHRRVADLDAAQTQALRAVARDLQLTWSEVLLAVTVAQLHHATRAPEIVLSLPAMGRLGSVSLRVPCMVRNILPLRVAVTASDSLRDLAARISRELRAGLPHQRYRYEQLRRDLKLVGGQRRLSGPGVNIMPFEYDLRFAGHRSTVHNISAGPVDDLSVNVYDRSEGAGLRIAVDANPDLYDEADVAALQEGLLALLEEAVAAPDRALGDLCAREPVPVLDGGPLPGPVRPVLGLIADHAARHGGFVAVEHGGTSITYARLFGSARALARRLAARQVGHGDLVAVALPRGIDAITAILGVLLSGAAYSPLDPTAPRARRAELLDDARPDLVLTTSAFADRFGDRAVLRHDEPGPDSEAAQSTAPTPEDLAYVLHTSGSTGRPKGVEVGHHALAHFVAGATHRYGLHHRDRVLQFAPLHFDTSLEEIFLTLCAGATLVVRTDDMTESVPGFLDACARLRISFLDLPTAYWHELAYAVSTGAVTLPAEVRTVVIGGEAALPERVERWRTAVGTSVRLLNTYGPTEATVVATVADLHDPSLAPGDVPIGLPLPGTRAAVVDGELHLLGDNLAIGYRGDRPPDTSRFAPLDQIPGAPRAYRTGDLVRIGDDGQLRYLGRSDTEFKISGHRVHPAEVEGALLGHPRVRDAVVVGLVLGDGTRRLVAYVVPDGPAPAVALIRDHLRETLPAAMIPSAVEFLDRLPRTSSGKIDRNALAATTPDGHVPEPGAQAATSDSALVRTIAAVWQQVLGVAAVFARDDVFDLGAHSLQAIQVANRLGVELHRDLKVAWLFQHPTPAELARFLEQQEQPRSAPPGLPAALLADTVLDPDIRPGDGPRASGTPDRILLTGATGFVGAHLLAELLTSTGAEAVCTVRAASPAEATARIHQALETHLIHLPDAARERITAVPADLARPRLGVDEALFADLARTCGAIIHNAATVSIMREYATLRAANTESTRDLLRMAAVRSIPLHLVSTLSVAPPLDLAPEVPEAFLAAHPGLRHGYQQSKWAAERLLEQAAERGLPVTVHRLGRIVGPRTTGYVNERDFLWSVLRAGIPARIVPDLFDEETWTPVDHVAQALVHLCLGQRPPGATVFNHATARPVRLADVYDWLEDYGYPLRRMPLAQWRAELPRSSGDSGVAATMLAFFDAWEANPDDATGPELRLGRVRADNVVNGLHGSGITSPPVDRDLVFRYLDHCVTTGTLPAPAGKQSHLATPAK

SEQ ID NO: 8146 - protein, 85 aa, Streptomyces avermitilis
MPAPLTLEGFRADLAEFLYQRPDEVDLEENPMDAGLDSLRIVTLLERWRETGADVTFVELAECTSFAQWWQLLSARQRGADHADA

SEQ ID NO: 8147 - protein, 518 aa, Streptomyces avermitilis
MDRLHHPELQTLVQTTSFHARNQPTTPAVLFEGRTVTYEQLHRESNRIAHAVQAAGLTPGDRVAYLGKESEHYYEILFGCAKSGTVLVPVNWRLTAPEVSHILRDSGTRLLFLEEEFGPIVEKMPTAPPETVVGLGEPFVAWKASHPDTDPTPHVTPDTPVAQLYTSGTTGLPKGVVLAHRSFFAIRDALASEGLDWIDWRAGDIALIGIPGFHIGGLWWATQNFNAGTTIVAMRAFAARQAVDLIRDLGITTACVVPAMLRMMLTEPRVSAKDFTTLRKTVYGGSPISEALLEESLAVLDCEFAQIYGLTETGNTAVCLPPAAHVPGGSLMQAAGRPYPGVGSKVIDGEGRELPPGAVGEVCLATPAHMVEYWGLPGKTAETLVDGWIHTGDAGYIDEDGYIFIRDRIKDAILVAGENVYPAEIENVLEHHPGVAEAVVVGAPDERWGEYVHAFVVPAPGQRPSPRDLHTFLVPRLASFKLPARYEFIESVPRNPSGKILRRELRDRFWDDSARKVN

SEQ ID NO: 8148 - protein, 172 aa, Streptomyces avermitilis
MTTAQHPTDEDLLARVLVPYKDHCKYLRSAVVTESDTGRAVARCEFAIPESCYIDDTGHLNSVEVNICYNQMMYYLVAKSVKEGLLAGFESWTLDDFWKHQLPDILIARFASNFRRPVNPRAFSGEMEFQSVTRRAPAGGIPFLHAETAYRYWDADSGRCDGEAVLAFVNIP

SEQ ID NO: 8149 - protein, 296 aa, Streptomyces avermitilis
MRINERPGTAIGATVEGFDHATASDADIAALKSTVYTKKIAVLKGQDLSPQEFLELGKRLGRPETYYEPMYHHPEVTEIFVSSNVPENGKQIGVPKTGKFWHADYQFMPDPFGITLIYPQVIPRQNRGTYFIDMGRAYDRLPEDLKKEIGGTYCRHSVRKYFKIRPHDVYRPISEIIEEVERKTPAVVQPTTFTHPMTGETVLYISEGFTIGVEDQDGEPLDDELLKRLFQATGQLDETFEHDNIHLQSFEQGDLLVWDNRSLIHRARHTTTPEPTVSYRVTVHDERKLHDGIKVA

SEQ ID NO: 8150 - protein, 79 aa, Streptomyces avermitilis
MSTTYDRLVDILARLHDAPADRIRPEATLGELDVDSLTTVEISIRIERDLGVAVGDDELQPDLTLGDLAGLVDARQATV

SEQ ID NO: 8151 - protein, 330 aa, Streptomyces avermitilis
VTNEHLARRLDTDDAWIRTRTGIRRRHAVDPGQATSDLAVEAGRRALVCAATASVDAVVVATTTPDHSCPATAPAVAARLGLTGAAAFDISAVCTGFVYGLASAAGLIAAGVAERVLLIGADTYSTIVDPLDRANAIIFGDGAGAVVLRAGHPDEPGAVGHFDLGSDGAHEDLIMVAAGGSRQRSRPGEPSRQDRHFGMRGKEVYRHAVTRMAESARATLSRAGWKTDDVDHFVPHQANLRILHSVADDLGLPRERCVTHVESVGNTGAASIPLALADAAAGQTLRPGDRVLLTAFGGGLTWGSCLLTWPTLPAPAPPYDPHAQGERTTS

SEQ ID NO: 8152 - protein, 465 aa, Streptomyces avermitilis
VTEPAKAPLRKSIGLPLLVLASGQLVISLDYNIVYVALPDIGAGLGFSDHDLQWVVSAYVVATGGFLLLGGRAADLLGRRRMFLVAASLYAGSSLVGGLAQTPGVLVAVRAVQGIGGSLLFPATLSLINTLYDEGPDRNRALAVWGAAGAGGLCFGSLLGGVLVEAFGWPSVFFVNVPVAGTLAVAGWRLFPADGPWDRSRHFDVAGALTATGGITLLVFLLVQAPAEGWDTPAALASAVLSLGLLALFAVVERRSRDPLVPARLFADRGLLAAMGVTALFSATFSSVPYFLTLYFQTVHGYRAVATGFAFLVPAVVVAVGTQAGGRAVSAFGVRRMLVGGMALGAAGAAALGLALTADGSYPALLPGIVLLSVGQGAAWTGMWIAASAGVAPGDQGIASGLASTTLQVGGAVGLALLVGVAGGVGQNASGPGLLDGIRTAVFVIAGGIGCGAFALLALRRTTSP

SEQ ID NO: 8153 - protein, 250 aa, Streptomyces avermitilis
MTPEIENAFAAIRAEFGAESIRRVEQMLEPSGSERHPLQKAAKWIMPGLSPTPWHDPYAYAELAPVVHELEASHQAIKEELKVAWSARREAFSDYEHYLTRQDNWQALYLFREGGITEESAATVPIAYQVLKDVAVDTGKICPLLECHFSTLLPGAVIEPHCDLWNFSINLHLAVDIPDGCSITVAGETRSWEEGKCLLFDYSFEHEARNTGTRPRTCLLIDLWHPETTVPERRALVALITEIRRLMGED

SEQ ID NO: 8154 - protein, 239 aa, Streptomyces avermitilis
VRGRQVGRSERGTSGEGGSAHVERRRLLQSATTAIGAVSAAPLAAGTAHAAVPARARGEDGEVLRIRTVTFDGVEELDGVEKLQVFGPFEVFSVAARAHPVTVKPVTGGEAAEMTYSFGTRVAAAAWSPRDAALIVVPGGGFGRRDSPGVWAEFDKERLPSAPRHLARSHLAERGARVVDQRVVDDGDLVTAGGVVSSGIDGALRLLEGELEGAAAAHAEAIVEVERRGTVLRTSTAGQ

SEQ ID NO: 8155 - protein, 173 aa, Streptomyces avermitilis
MEPRSLMRVMRPTRNTWFVNALRTVAPPLGASCGALALMVAYTATGAAGDPPPRITVVDAHIVAVSAGSGSTAAYFEIRNTGPSKDTLLYADSPDLGVSLLRRTVRRTGTGRTEPVWAVDVPAGGTVRMAPGGLGVVILDPPVLKAGQKVPYLLWFRQSGKVAVRATVTAGVR

SEQ ID NO: 8156 - protein, 217 aa, Streptomyces avermitilis
VITPVLPVSREKRDAGRKAADQPGAMAWPDDAATAWALAARAGDPDAVDRFVRALHPDVVRYITHLSSDRQLADDLAQDTFLRALGSLHRFEGRSSARTWLLSIARRTVIDNVRYTAARPRLRDTDDWTVWAERAQPSGLPGFEDGVALLDLLDALPAERREAFVLTQLTGLPYEEAAEASGCPVGTIRSRVARARATLVALLVEAEESRAPAAVAA

SEQ ID NO: 8157 - protein, 225 aa, Streptomyces avermitilis
MTAGWCARAIRAAVFAAVCVLLAALGHVLMSGSTVPWWTMTAGFAATTGVGWCLAGRERGLALVVPAAVVAQGALHSAFSLAQSAASDTGAGGVAHGMRGMSMSATSMDAMDMRSAPMGCSEQPGQLGHLVHDMGGGSSFGMLAAHALAAVLSGLWLAYGERAAFRVLRAVAGWLAAPLRLSLALPAPPCRPRLVPTRERSERVPRLSLAHTIISRGPPAGMAVA

SEQ ID NO: 8158 - protein, 173 aa, Streptomyces avermitilis
MTGQQVWRPTRRRLTDTLIATLSPVAVCGLALGGLSTWTAYGNAGSPARIAVTGGRVYLPYGNAQDTAAFFRITNSGGSADRLLKVTSRAVDGAGTFSRHRMTGARSASAQTVASVAVPAGGSLAMSPHGLDVTVPANAGWQAGDLVSFTLRFARSGAVKTLAVVVRPGQDGT

SEQ ID NO: 8159 - protein, 751 aa, Streptomyces avermitilis
MGAEPMTALVTTDLSVGGMTCAACVTRVEKKLGKLDGVTATVNLATGRARVSHPTEVSVGQLVATVEKAGYTAALPEPPKKQPREGGRETEEARQERDRLLGTALLAVPVLVLSMVPVLQFRNWQWLCFMLAAPVAVWGAWPFHARAVRGLRHSAATMDTLVSLGVVASFAWSAYALFLGGAGDPGMRMPFSLVPSASDGVAHIYLEAAVGVPLFVLAGRFLEARARRGTGAALRSLAELAAKEVSVRDGDSERLVPIAELEGGQVFVVRPGERVATDGQVVEGSSAVDLALVTGESEPVEVGPGSAVVGGAVNAGGLLLVRATAVGADTQLARITRLVTEAQAGKARAQRLADSVAGVFVPVVLALAVTALGFWLGAGADPQAAITACVAVLVVACPCALGLATPTALMAATGRGAQLGVLVTGPQALEGLQHIDAVVLDKTGTLTTGHMSVARVTVVPDGLGRDAVLRLAGGVEQGSEHPLGRAVSAYARRELREQRLPDVGEFSAMPGRGVRGRVEGRLVEVLAPDDELPAALADALPVAEAAAHTPVLVRVDGVAEALIEVGDVVRPGSYRAVDRLRRLGVRPVLATGDREAPARAVAATLGIDEVHARCTPEGKAELVRELQEQGYRVAVIGDGVNDAAALAGADLGIAMGTGTDVAIGAADVTLVRGDIEALADAVRLARRTLGTIRANLVWAFGYNVVTVPLALVGLLNPMLAAAAMSASSVLVVGNSLRLRGWQPSPARRRTR

SEQ ID NO: 8160 - protein, 103 aa, Streptomyces avermitilis
VAGPTTELVRRDPTDAVRRDLETRLMEESRQSSLTGAGTALRRAAPPPALCGFLLLLALIFTVSYAVGAGAGPVAPGMHGGGTNRDGGGGGMDDMGNMQGGHG

SEQ ID NO: 8161 - protein, 99 aa, Streptomyces avermitilis
MPSSQLHVCRVAWPACSNGRGGTLVDVVRVMEALAEQGVTVLFKADAERMRDGVRPWTFVANGLPFHEDLLVRTDAASVEACLKICLPQLRARGLVIPE

SEQ ID NO: 8162 - protein, 277 aa, Streptomyces avermitilis
MPKATGTLAVPGAVLHYQIRGTGPLLLISQSGEGDADRTTDLVAHLTDSYTVVSYDRRGLSRSRLDAPERGATLAEHADDVHRLLASLTDTPALMLGCSLGAVIGMHAIVRHPEQIRTLIAHEPVAPRLLPDDERARHEHELVALQDLYLREGLAAALPEIARTLGIDPAATDTEPDLTPQPMNALRTANFDYFIRHDFTAVIHDTLDIAALKGVSTHIVPAAGRTTPRTVFDYRAATALATLLDRELQELPGGHNGNTSHPRTWATRIREILNAAG

SEQ ID NO: 8163 - protein, 171 aa, Streptomyces avermitilis
MNLVRCMLGGVNGVELFLLGRVLMKIGEEALPEPPGGAGRYAGSARLVLIVASDIAAHPDTAVGEIAARTGLPQSQVSAAVARLKEARSVQTAPDPADRRRVLVRQAAEVSERVAQVRAVGIEDALARALGSDAPHRLREVSEALDVLARNLLPQSGAPESPQADIVPPSR

SEQ ID NO: 8164 - protein, 152 aa, Streptomyces avermitilis
MAEHIAGLCTTRHTPYAPRALLRRPLGCPKPEKDLGGRPMTENENERATELGDAIEAVRQGLLKAAAQGSDDLRFLVKETELEFIVELRKTGSTGAGVKAWVLSGDGRLERSAGQTNRLTVRLGILAPESHPIDETHFGDKKDKGHPGPRQM

SEQ ID NO: 8165 - protein, 98 aa, Streptomyces avermitilis
MLETMGMTAFAERAGRELRAAGGTAHKRTAPARHEELTAQESQIARMARDGLSNPEIGTRLFISARTVQYHLRKVFTKLGITSRSQLDRVLPSGPGGA

SEQ ID NO: 8166 - protein, 188 aa, Streptomyces avermitilis
VPASPAASAQAIALLRELGATEIAHPGGTLLAHLQRVQEQLAVWEARTALQLAGLCHAFYGTDGFPAALLSLDRRDELAAAIGVEAEGIVYLYASCDRKATYPTLADADASFRDRFTGRARIPEPQLRRDFAELSAANELDLARIDPAFREKWGSELLALCTRFRPLLSQPAWSACHVVLAPDPPAQD

SEQ ID NO: 8167 - protein, 303 aa, Streptomyces avermitilis
MTLEDLRVFVAVCKAGSLSAAARDLDCTQSAVSQHVKRLERETGVSLVERQPRGVLPTHAGRVLCDAASDSIAGLDLALRRLGDLVNGDSGSVRVTTGGTTVRHFMSEAIVAFRQRYPKVSLEFQTETSSRNCFDALTAGNLDLAWVTIAGPVRGIEQRPVVALPWVLAVRADDPLAGRPCVNTAELTDISLIRLPHNSTSGARLDAAFAELGVRSSSDTSVADWDTALLLAELGLGHAVVPVLPGWQVPGDGPLRLVPIPDLPPLPVGWAVRRWDALTPLARVFADTVARSCKEKTANTRPK

SEQ ID NO: 8168 - protein, 268 aa, Streptomyces avermitilis
MSVAGMPGLALRPMDDKDLPPRLTHLTFHGPLSEARAARIIGRLARAAPSTVLDIGCGWGELMLRTLETVEGATGLGIDLNGQDIARGRENAKARALADRVKFVEESAAGTARGPADLVLCLGASHTLSDAQPPQHTTAALHALRRLVQPGGRVLLGENFWQRTPTSAELDAMWPGARAEEFHDLAGLVDLAVASGFRPAWIETASSDEWDEFESGYQSDVEEWLAAHSDHPLAAETRERVDRHRASWLKGYRGVLGLAYLTLVPVDH

SEQ ID NO: 8169 - protein, 491 aa, Streptomyces avermitilis
MHSKARRTRMLGAGLLATVMSLALLIPASGSAEAATTAVQATVCNKYCDGRDPSLSPQDRRPVTTSIYSRTIALHFDDTDAMGWASITNGSPTDEVWLDRSFDGGRTWTSGSRLGDTTIPSGQTGWRTLMYNVDDWNNLGVGALRACGKAGNRTEIACTAWARTTWNAGSRPTAAATALMQSYNLSSGLFDSTGWWNSANALTALINNIQVTGMSSYKYAIAKTYDLNLHAQGGNFTNDYIDDTGWWGLAWVAAYDLTGDSRYLNTARADADHMHRYWDSTCGGGVWWSTAKTYKNAIANSLYLELNAALHNRVPSDTTYLARANAEWSWFQGTAMINSSHLVNDGINVTTCTNNGDTAWSYNQGVLLGGLAELYRATGNSALLTKGRQIGDASTTSTALNSGGILREPCETGGCGADGPSFKGAYIRGLNAFNAQLSDRPYTSYIHRQADSAYANDRTPLDAYGLHWAGPLDTSDAARQQSAVDLMNAAS

SEQ ID NO: 8170 - protein, 536 aa, Streptomyces avermitilis
MTVPPSFLRPLSAAFAMLLLLVLAPALLVLRAAPPAQALDNGLARTPPMGWNDWNAFGCNVTEQLVKQTADYLVSSGLKGAGYQYVNIDDCWMTSARNSVGQLVPDPVKFPDGISGTAAYVHSKGLKLGIYESAGTATCQGYPGSLGHEQTDADSFASWGVDYLKYDNCNHQNVPDQQRYTAMRDALVNTGRPIVYSLCNWGLASVWTWGAGVGNSWRTTDDINVNFSTVVSIYKANVKLAPYAKPGAWNDPDMLEVGNGMSFTEDRSHFSLWSEMAAPLIAGTDLRKASAATLFLYGNKDVIAVDQDSLGKQGTEVSSSGGLHVLTKPLANGDVSVVLFNENSSAATITTSATAAGLPAASSYRLDNLWSHVVSSTGGSISASVPGHGSVMYRVSVGSGTSAGSTHPLVGASSNRCLDAYDNQTAPGTKIEIWDCGGANQAVTITAAGELRLYGGTQCLDAYDNGTTSGTKVQLYTCNGGANQKWSLNPNGTVTGTQSGLCLDVTGGDQASGNVNGTALELWTCNGGANQQWRLG

SEQ ID NO: 8171 - protein, 131 aa, Streptomyces avermitilis
LTTLPTTSAAAAERLGPARALTRAVAAYSALWRPFGTNDGSGLVREQVPVAADDKPYSYEWPYSQVHIAALDLTAVDAAYESEPAERTKAQEHFWHVGKGTTGCPGYASYPVVACGEGGEGGAAPRRRPAP

SEQ ID NO: 8172 - protein, 351 aa, Streptomyces avermitilis
MEGWSSTHVSSRPPHRQNTRPTMRDVAERAGVALVTVSRVVNGVGTVREETAERVMAAINAIGYQRNELARSLRPGQNSMTIGLLLGDLTNPFYASLAKAAVEVANRAGYAVLLSTADEDPEVERRAVGELIGRRVAGLIIVPDQGDHAFLNEINGHDHVPIVFVDRPATGAEADVVLVDNEDGGRKATQHLIDQGHRRIAILGAPSYYSTGRRLRGYRKALRRSGITPDSNLVVTLRRGTTEEASAATHTLLTSADPPTAVFSTTGFLTEGVLRACRQLQTSVAIVGFDDFKLADMLPTPVTVVTSDTEELGRHAARLLLDRIDGDDAPSRRTVLPVQLIARGTGEIGTQ

SEQ ID NO: 8173 - protein, 171 aa, Streptomyces avermitilis
VRSVTLKDLRDGTHRTLAARYVLDATETGELLHLAGVEHANGAESRATACPLADLALGRIVFPTAPLPPGMTDPRAAVDGDAGTAWSPGPDGRMVVDLDAEQHITEIRTQWRGGHAPASQVEFSRDGRTYGGAAQLSARGVLRTDSTPRDVALRVITSSAGPTSLIALTIA

SEQ ID NO: 8174 - protein, 123 aa, Streptomyces avermitilis
VRCVPSRRSFKVTDRTTSLSDSAEQGPQIPRLHRVDQGAARLPAAAPAYLPAQDAYFGALDRAGLTTVASTVKTGLNTSSSIGVRFTTQWASQSNDLITAYWPDILDGTKPLSDLQTMTDKSN

SEQ ID NO: 8175 - protein, 154 aa, Streptomyces avermitilis
VEAIIASAVAVLGTLLGSGITLAFQRSTAERSHEFTRREKLRQERLDAYSAYAGALVNYRRCLVHLWFCIHEQPPPGDADEVRIRAYDLRSNTQEALFRVQMLTDDEALSQSAEAVLTDVTGLYKTDSRSELDERRAQTRDDISHLVRAAKQHL

SEQ ID NO: 8176 - protein, 354 aa, Streptomyces avermitilis
MADETAVIGGVDTHTDFNQAAVIDPIGRHLATQAFPTTPDGYHRLLGWLCSHGEVIAVGVEGTGAYGSELARYLQDSQITVIEVDRPDRRARRAGGKSDPIDAYAAATAVLTGRAGGIPKARDGIVEAIRTLRVVRRSAVKARTQIINQIRSLIITAPGEVREQLRTLPPAQLIKHLARSRPGTQTSEPACAAKIALRRLARRHQYLTAEINDADAELQTLMTEAAPELVALPGVGIETAAQLLITASDNPERLASEASFAHLCAAAPVPASSGRTNRHRLNRGGDRRANHALHMIALVRMRYDQRTQAYVARRTAEGMSKKDILRCLKRFIAREVYKYLTYQHTPSKPLIPTA

SEQ ID NO: 8177 - protein, 285 aa, Streptomyces avermitilis
MTGGPKMTASYETIKARLDGTVLSATFNAPPMNLIGPEVVRDLVALLEELAHPTAPRVVIFDSADADFFFPHVDMTKVPEYTAEAAKAGGPGDASLGMLFRKLSQLPAVTIAKLRGRARGAGSEFLLACDMRFASRENAILGQPEVGIGAPPGAGAIQHLTRLLGRGRALEAVLTSSDFDADLAERYGWVNRAVPDAELDEFVAGIAARMSGFPRDALIAAKSAINAISLPAPAEVRADAALFQQLVRGEKVQQRTAELFKQGFQTRGATELDLGDALGHLKAVD

SEQ ID NO: 8178 - protein, 202 aa, Streptomyces avermitilis
MQVAVVTFDGFNELDSFIASALINRCRKDGLEAFITTPTPVVTSMNGVDVTGQRPMEFVTEADVVLIGSGVKAREVVADDRLISRLPLDPSRQLIGAQCSGALVLARLGLLDGMPACTDMKSRPFVEARDVTVLDAPFHAEGNIATAGGCLASQYLATWVITRMLGEDAARDVIGYVAPVGENQETVERAMRAVHAGEVVLR

SEQ ID NO: 8179 - protein, 146 aa, Streptomyces avermitilis
VTATFGPGGHVFLSWPLRSGLFRGGTGSASTRWHRLYAQWDSALLVERTGPMDVVFSSHVIEWRGPSPFYFVPVPEEQSADIREVASMATYGWGVVPVEARIGEIAFATSLFPKDGEYLLPIKQAVRKPQGLSTGDEVTVEMTVRL

SEQ ID NO: 8180 - protein, 317 aa, Streptomyces avermitilis
VQEVTRHEVSGQHIAHALDDISRRTRRRWHGMRYDDPSLEKLQEMRDELLDHIAARTVEDPALDESSRAALRTAAECSLGVLSVGCFPDGDQEIVFPLIGERLGSEDIAFGDVVEQAPTAGTWVDTFAICLVSGLVWDWQRVIGLLLREDYAPAIRDGVPYSKLNSASDPADLAAMDALCGYLTQAQGHLPRDWPTVPLCKPDTDERAEAARKLDAAGPLTSDQRLLRVLLEDDQHAFEQTLVAHLSEHRESVGSDPAPRTLLPVGALALTALAVQVHGWELDVRSGYLPHGMLGSPDTLRRAADAGGNDLGHWTAK

SEQ ID NO: 8181 - protein, 178 aa, Streptomyces avermitilis
LLFTNLDGVRNVVPVGHRQRRARPVGAGDVRAEKSLRYHLQEHGRLPLNEAVAVLSDVAEALADLKDREIVHRDLKPENILLLGGRRCLADFGIARYAEATIAKHTLKLAGTLAYMAPERWNNQRAASASDIYAPGVVAYELLEETPPFTGPYEHDYHDQHLHGPVRPSPQLRPSWRR

SEQ ID NO: 8182 - protein, 174 aa, Streptomyces avermitilis
LVMAKPSGVVEVLSLHRTEIFVDHCNARLIVHGGRLLFEACPRRRGHDSQGEGTHMRIRRALATTAATAALAGGLAAAPASADNSGEINAAAVCDLVPNYNQWDSVVVRHATAPFRDGPYAECDGTTRSASSYLDAYCRYKNSHGNVWYFTYYGWVYGTHVTRPNGEPVWCDMS

SEQ ID NO: 8183 - protein, 102 aa, Streptomyces avermitilis
VVGAPAAPAPRPWPTSCGCSFEHMVDAFGYGPEVFEEFRVAAVESAFLPLPKRRRLIDQVIRLGYGALRADGRGRAARRTTRGRVGAGSRRLNPAVQPPVCV

SEQ ID NO: 8184 - protein, 1077 aa, Streptomyces avermitilis
MRGPRGQWFARRFGRVPHTVVNRMDGGYVENLIQAGAIHGGVHFHVHRPESPQIHGLLRPVAVLFLALAAVALIVSDLGRRRPGPAWTVAACLLVVAAYLGVAHVRARRGRRGVFSERQLDIAATQLAGRLRTMYDREERLSRVHDPIPLRVRWSEGDPELVDHWENISRDSGQIPDIEGEFAEINEVYKRIPSRRLVVLGPPGGGKSALALRFARQALKGSPVPVIFPLASWDPRQQGLWQWAAALVSDRHPSLAARGAQRRAIAQALLETGRILPVLDGFDEIPTVTQATALAEFNASLGRDACFVLTSRSTAFEQAVAQSDVLTATAVVELERLTVDQLAEYLPRTSRKVKSGEGTLTTWDPVLARLGEEDGQARHVRRALSTPLMVGLARAAYSDTRADPMELLDPRQFPDSSAIEAHLFDRFIPSVYGGALADRTWEAEQAGIWLRFLARHVRAGGTQELEWWRLDTTTPRWVGWLAFVPLIAAITGVTYWSGLGEAHATFWPGGPIWLTEALLFLALLTTVWFATDPSAFPGPKHVRGSRALPFLRSEPSDTESVSSPWELLRRDRTAAWVKGAFWVLPFKERGGPLDLFSLALFLILPITWLWQSNIDILEPEQNVGRVTLLLNTFAWLLYEVGGSAWGRFNVARIWLAATGRLPWRLGAFLQDAHGRGVLRQSGGRYRFRHLELLNRLAGKDFSQRKKHSLRIRRLAFVVHMVIWVGLVAWLLAAAENAIGPSGPYSSVAPACSLLRGEQLEPAITDPWARADGSGRCHWTEQAPFNRDGEVTLSVTVARPGNGVSAVMVADRQLNVVSTLELAGVGDRAVISPRENEPGSAGWSARVGARTGNVFVDLTYTEVARDGQRVKAVAAILVRQVLANAGLGESPGTALVAVPRPPLPGDAPYTRYRRGVARSIDGPVWRPGDRSQLNGIQSLPFVFRGPRMSCAMQWICGIGILGHPRPVYGIIVFDLRECTGGPCSRRTIDGYVRDPKNKHAAGAPWKWADASTKIADFSCSRKPSKEWPDQNDLHCVEMVRAFRIGGKDYLLGLRTAVAKQHADLMRKTVNDIYTQTGG

SEQ ID NO: 8185 - protein, 75 aa, Streptomyces avermitilis
VSSALLHQAVLQARGPADTRVQDAPEAAAAIVNLCGPAPGLAYRRHPVRRSGLSTESDAVLADLDDFTVEENLQG

SEQ ID NO: 8186 - protein, 136 aa, Streptomyces avermitilis
MLRHRVVVRHLTRATVTSCCAAALALTQTVQAHAASRTVNFNYQHIWKTPEFETGIRGRIHFTVKKCDHPNGDMTVLLRRTDGFNYVVGSRNIKCRAGHTANWDDDPAGTYEFELGKLDDYKFFKGTATYSFNAAR

SEQ ID NO: 8187 - protein, 59 aa, Streptomyces avermitilis
VYCDAKFGISCAQEYRLLDVARVLGAIQAAVAASDPSADPALAALRHVVDDLAVKGLAG

SEQ ID NO: 8188 - protein, 234 aa, Streptomyces avermitilis
MEATRRFTADAGHELRTPLTSLGMTIETLQRNPTLPAPQRTRALEAMGAEHHRITALLTGLQTLARGDAHALPDRVPVDLGALLHEAVSHAARRHPTTYRLNGSTPATLTGWPVGLRLAVDNLLDNAALHGRPDGTVDIQLTHEAGTVRITVSDDGPGIPPDQRHAMKERFTRGPRTRAPGSGLGLALVEQQAHLHHGTLHLGQSPAGGLQATLSLPAADEPGPPGEPMADASS

SEQ ID NO: 8189 - protein, 232 aa, Streptomyces avermitilis
VVALAGLVIVARIDHRDRTDVDRQLTARAEKVRQDADKLLGQGDHEGADEGRDDYGGLLAGSQSLVRLISDGQVIAQRGETPPTPPPLPSRDGYSTIEADGQTWRTLTQPLNATGDRLEVLQDIDHIERRVADNTAIVVAVTLAAALATAVGVWLITRIILQPLQRLRTGALAISADTTGPQLPTVTGPQEVADLSRALNGMLANCAPAWKPPDASPPTPATSYVPPSPASA

SEQ ID NO: 8190 - protein, 228 aa, Streptomyces avermitilis
VLVVDDDPGVREALDLGLGLEGFTVRLAEDGENALEQVADRLPSVIVLDVTMPGLSGVEVVQSLRAQGRTLPVCMLSARDEVDDRVAGLAARADDYVVKPFSIAELAARLHAIVRLHAIVRLHESTAVRPLVIGDVTIEPARRVAARAGRDLHLTTREFDLLLALAHRPGQVLSRAQLLEQVWGYTWDVDTNVVDVFIGYLRKKLEADGRPRILQTVRGIGLVLRTGP

SEQ ID NO: 8191 - protein, 206 aa, Streptomyces avermitilis
VTQPTSPEPRPDQAIYLITGIPAAGKSTVAQMLAERLPQSVHVRGDQFRRMVINGRAEMTADPSDEALRQLRLRHSLTAKVIDQYFEAGFTVVAQDVILGDHLTQMIAQIRNRPLHVIVLVPQPKAIAARDAARPKTAYNAWEIDPLDRILQRETPRVGLWIDTSEQSPAETADEILTRATAETQTQEFNARTARHSDSSHTRLHR

SEQ ID NO: 8192 - protein, 301 aa, Streptomyces avermitilis
LSVVGFMRAPRGGALFITEVAQMTQCSGAAQHPIPPAVQEAYGTADLSSMPLFGGGFINFGYWQDIDLDQPLSEHDRICSQQALYRHVLSAMAPTEGLRALEVGSGLGVGAAVALEEYGFAHVTGMDIHPQQLRRAEQANSALLARRPERLLFAHGAAENMPFGDGTFDCVYSVEAAQHFRDLGAFAQETARVLRPGGRAVVTSFFVPDADPARTGRLAELLDTFATGLDVAHTVPLLTSSLERVGLTGVSVTSIGASVWPGWDRWLAGMWEPGTWPRNFLRAFREGTLDYFTVTAERPAV

SEQ ID NO: 8193 - protein, 53 aa, Streptomyces avermitilis
VSDFGRIYGEEAATYAEMLPDSLAARPLDRATPWRTWRHRRRRWTPRSSHSRT

SEQ ID NO: 8194 - protein, 411 aa, Streptomyces avermitilis
VRRKTSITLLSVGHACVDIYQGAVASLVPFFVAERAYSYAAVSGIVLAASLLSSVVQPVFGVLTDRWTMPWLLPVSTLLGGLGIALSGVGGPYALTLVFVAVSGVGVAAYHPESARVARIAGRGSHGGMGWFSVGGNLGFAAAPLMVAAVVATGGLRLTPLLVLPALVGAVLCLPVLRALEQQQSAGAGAAVWAGVDDRASFVKLSLAVVCRSIVFVGLSTFISLYAKERMGGSTAAGTAALFVLYLGGAVGSVLGGALADRWDRITVARWSYLLTAGSVAGVVFVPGPALYLCVALTSAGLYVPFSLQVTLGQDYLPSRVGTASGITLGLTVSIGGLASPLIGSLADATSLQAALSPLILMPALSWLLFRTLPEPVVPQPEPIVPQPGATAHPKGDDTDATLSHARPDHD

SEQ ID NO: 8195 - protein, 263 aa, Streptomyces avermitilis
MVGAGHRVALPINCQTMTKIRHEPVAPTRTQRLAPGAAIDPHRHDDHQIVYAGRGVLAVTTSAGSWVAPGTRAIWVPAGTVHAHQAHGELELHLVGLPADENPLALETPAVLAVSPLLRELIVAYTRTQDDHSPERARLRAVLLDQLRASPQQPLHLPTPTAPLLQTLCDILRADPADSRTLTELGREIGASDRTLSRLFRSELGMTFPQWRTQLRLHHALVLLADSTPVTAVAHLCGWSSASAFIDAFRRTFGHTPGARPRD

SEQ ID NO: 8196 - protein, 331 aa, Streptomyces avermitilis
MQTRTLGSTGPAVSALGLGAMGMSGAYGATDRAESIATVHAALEAGVTLIDTGDFYGMGHNELLLAEVLRGRDRDSYQLSVKFGQLRGPGHEFGGQDGRPEAVKNLLAYSLTRLDTDHIDIYRPARLDPAVPIEETVGAIKEMIDAGYVRHIGLSEVDAATIRRAHAVHPVADLQIEYSLLSRAVEAEILPTLRELGIGLTAYGVLGRGLISGHWSAGHSAGPGDFRAFSPRFSSENVEHNLALVEALRRVAEAKGCTVAQLAFAWVAAQGEDIVALVGARTRERLAEALPAMELNLTADDLAEIEKAVPPGAARGDRYPSAFMSGLGVGN

SEQ ID NO: 8197 - protein, 286 aa, Streptomyces avermitilis
MQRDQLADFLRHRREAISPGEVGIADGPRRRTAGLRREEVATLAGMSVDYVVRLEQGRSSQPSTQLLGALARALRLSDDERDHLFHLAGHRPPPADGVARLARAGMMRMLDLLGDTPALVLSDLGEVLAQNRAAVLLTGDLTGFLGDRRYVVYRYFTDPAARAVHPPEEREYHARQLVADLRAVAGRRSGDPTVAGLVDRLQTASADFRRLWAEHEVAVRRADRKTFQHPRVGHLVMDCETLVTPDQGQQLLVLTPADAEARERLELLRVLGIEEFPAAATDTPLR

SEQ ID NO: 8198 - protein, 162 aa, Streptomyces avermitilis
VPPPLRTETRQCLPLLTRHAPEIRSEGCTKCPPALDLRPERQVMTGSIAPVVWTFALDEDEDWVASREPAGDENLRRAVETLLLGIASAKAAETYLAAWHADSQQWGSGFSLATSSATAERVSTKTVRLIDLYGQFQDCDIAADEFGAMLQGYVAAGRAAEN

SEQ ID NO: 8199 - protein, 130 aa, Streptomyces avermitilis
MMSAHGARREAGHVSGIQAGRDVRIEQSMVALGRATVTGTQTPAEHAEAVTELCAAVGLLLDELRRNEEYYEDGAELVAAAEQVQTELARDEPRRNILLRWLGFIAPGVHATAAVAADLTMIQEGVNALF

SEQ ID NO: 8200 - protein, 476 aa, Streptomyces avermitilis
MPQPPSAAGAPPHFSYDVTRYLCAAMHTDIGLARKAVARIVHEPRRAAASSPGVDLGCVLRHALAAHTRQQRRDVVLLLLLVVMVVTLPFTYGASLLLGLLVAWVVVAAELLSVHYGVVSRKLKRENFDPKYAPRPPGVRDAARLEAIELRDRGNVIVSSRFEPFVGHGETFRSWSFALNTGRPEAGKQVIPFTIHELNAHISARVGALKLPGMDISDVLLVNGADLLIGIDDRTRGEVLRNLAGPPGAQVSDALLRELREDGKGQARPYLAIRVTGWSGELVSTLFLRCALLSGRDTAFIEGSNCLLAPVREKYRTVDRLLDSPTFGQWCQLVAEAGVRTPILLVRAPFAILGDLCAPFARRREQRRQERWIRLRSFDYGAEFSLREDASDWLFCRYFQALDRELYAKTIEHRVLDALVQFLEDHNIDSSDLIQRQTSIYNSGLFAGRDISIKDSSVRAGGSGHQWNNPQPVKQR

SEQ ID NO: 8201 - protein, 249 aa, Streptomyces avermitilis
MPTASMPTPGGTYAATVTKGGTGAVWHEWHESCDERQQCHSSVADPPGRMGDMTDAPLGRSAVYTILTTGYVGSTGPGVAATVSYVADGGRHVVFDPGMVASRDHILGPLAELGLGPDDITDVVLSHHHPDNTMNVGLFGRATVHDHKVEYLGDQWRNRDAEGYELTPSLRLIRTPGHSLEDITLLAGTDTGVVAFAGDLWWHSDGPADDPVAPDREVLRASRLRVLAAADLIVPGHGSPFKADITAPR

SEQ ID NO: 8202 - protein, 349 aa, Streptomyces avermitilis
MSPILPGGSATDEWHCCLSSQDSCHSCHTAPVPPFVTVAAYVPPGVGMLAVGIVAEVFGPHGEGLPGFDFVLCADRPGPVPTDLGVPLTVAHGLDRLAAADLAIALPWAGFRTPPGPAVLDALSAAHESGSLVAAHCVGTFALAAAGLLDGRRATTHWRFAELLARRHPDVVVDPDALYIDEGRITTGAGAAAGFDLCLHLLRREYGAAMANAVARDMVLPSHRDGGQAQYLTSPVPDDCQDERLAEVLAWAREHLHEPLPVAELARRAVMSKRSFARRFAAATGTTPHAWLRSLRLSSAEELLETTDLTIEEIAHRVGYGSAAVLREQFVRRRGVPPRSYRRSFTNAP

SEQ ID NO: 8203 - protein, 226 aa, Streptomyces avermitilis
MLLPRQTVQCALRDQSACGLASHGATFWPTTKQHESTTSRASGSTGQLRHNVTTAPGKSRCCLVGATAGLRASPPSGCRSRCRTSAHHFVDSYADMHDLAEDLPVPDGVPEAAATVLHTARELLRHSYVCYEFSAVAVMHFLIAVEIVLRDRIPDAGKKPLRKLIEQGAGAGVLTARQAEYLDYGRKIRNGMAHGQTTHTAMPPAVAVLMVTTSFAIVTEPCAPAL

SEQ ID NO: 8204 - protein, 124 aa, Streptomyces avermitilis
MATQVTATANAQRSASFLQIAIALQTLTIFLQAVSAGLLLTSSYGETLHSVGARVMYGASMLYVLAAVLAWKPGGGSPRPVWHASGFLVLASVQVLLGIAHVPSVHLPLGVLMFGLSVLALARR

SEQ ID NO: 8205 - protein, 304 aa, Streptomyces avermitilis
MGTVGSTDGIAGERHQLINVAYRLLGSVTEAEDAVQDAYARWYALPRSRQEEILSPGAWLTTVTSRICLDLLGSARARRERYVGAWLPEPLPDRTERDRAGGAGPTGPADPVDQIVLDESVAMAFLVVLESMTPAERVAFVLHDVFRYPFAEIADVLGRTPAACKQLAASARRRVSVARTPVTATGQADVVRHVKEAWETKDIAALVDLLNPAAVMTADGGGMVGTVLRPVEGGARIAQYMVAIADKAPGLELLERSVNGVPGLVAQRAGVVVTVASFDVSDGRVTRIWAVRNPEKLRPWAREG

SEQ ID NO: 8206 - protein, 258 aa, Streptomyces avermitilis
MERITDVPESPAQSADPARVNDYDSFAEAYSAETENNLVNAYYARPAMLALAGDVAGRRILDAGCGSGPLSAALRDRGAVVTGIDASAGMLALARRRLGDDVALHVVDLSDRLPFDDGAFDDVVASLVLHYLEDWGPTLAELRRVLRPGGRLIASVDHPFVAYTFQDPRPDYFATTSYTFDWTFNGQSVPMKFWRKPLHAMTDAFTTAGFRLSVISEPQPDPAAIELFPDAFHDLSTKTCFLFFVVEVPPSATGSDDY

SEQ ID NO: 8207 - protein, 281 aa, Streptomyces avermitilis
MNAVDPLMFDRRVAVVTGAGRGLGREHAMLLATRGARVVVNDVGTGIDGRGSSASPAHAVAEEILAMGGEAVADIHDVSTTAGAQALVATADQQWGRLDIVVNNAGISILRPLTELSDDECRRVLDTHVGGTLNMLRAVWPHMVASGYGRIVNTCSDALFGDTGLSVYAAGKGAVLGLTTSLAAEGAAHGIKVNAVVPIAGTRMSLEAVQGDEQMTSLLTSLFPARHVASVVAFLAHERVPCTGELLHAAGRRVGRIFLGATDGMLFKEDPTPEAICEHFL

SEQ ID NO: 8208 - protein, 51 aa, Streptomyces avermitilis
VTADTTTRSLDGGQVAKHRPDPWVQGQLLAFNPWIQDQLALFAHYGEPGHR

SEQ ID NO: 8209 - protein, 479 aa, Streptomyces avermitilis
MNETARTYDVIVIGGGPVGENVAERARAAGLSAVIVERELLGGECSFWACDPSKALLRPVVARADASRVPGLDPAVAGPLDVEAVLAHRDMMSSYWKDEDQADWLNAVSVDLIRGHGRLTGCKEVAVQTSEGDTIALTARHAVAVSTGTRAALPPIPGFDTVRPWTSREATSADKVPDRLAVVGGGVVAVEMATAWQALGSQVTMLVLENGLLERMEPFAGELVADGLREAGVDIRFSTTVTSMAREGGEDGEVRITLSDGRELAADEILLATGRAPQTRDVGLETVGLTPGDWLTVDDTFRVTGVDGGWLYAVGDVNRRALMTHQGKYQARIAGTVIGARAKGEPIDDAPWGAHVATADHAAVPQVVFTTPEVASVGLTSREAEQSGRRIEVVDYDLARVAGAHQYGDDYRGRARMLIDTDRNTVVGVTFAGPGVGELVHSATIAVAGEVPLDRLWHAVPAFPTLGEVWLRLLETYRG

SEQ ID NO: 8210 - protein, 156 aa, Streptomyces avermitilis
MNLKLEMIVLPVSDIDRAKAFYEKVGFRLDVDHTANEDFRIVHFTPPGSECSIIFGEGMTPIAPGSFQGLYLIVSDIEEARAELTGRGIEVSEIFHDAGGVFHGHEGGDVTHRGPGQERLAGLHPERASYGSFLTFSDPDGNGWVLQEVSQRLPGR

SEQ ID NO: 8211 - protein, 196 aa, Streptomyces avermitilis
MRADARKNRDHLLAVAGAAITEQGVDVSLRDIARRAEVGLATLLRHFPTREALLDALLHTSFDELTAKAGALETSSSPDDALVSWLRDCVAWTTEYRGAVVLMAAAIEDTESALHASCVTLRAAGARLLTRAQAAGMARTDIDGADLFALVEALAWLGDQPSLAPRADHLFAVVAGAILTSTASSDTEAGTPPSHP

SEQ ID NO: 8212 - protein, 430 aa, Streptomyces avermitilis
VAAGHSVDPACWREAFEGLMSRIAGRFTRVESRRRARKLVLGLLSDLPRKNCWTIAEWAGDRTPDDMQHLLERAKWDADQVRDEVGDYVVEHLHDDEAVLVVDETGDVKKGTDTVGVQRQYTGTAGRIENAQVAVYLVYAGRRGHAAVDRELYVPRSWTSDPDRCRAAGLGDNTEFATKPELAARTVTRFLDAGHRAAWVAGDEVYGDNPRLRTALEERGTGYVLAVACSHEVTTGAGRFRADMLARKVPKSAWQKLSAGAGAEGHRFYDWAAIDLTDPRPGSRQLLIRRNRSTGERAYYRCYSPAAVPLTTLVRVAGSRWRVEELFQSGKGLAALDEHQVRRYPSWSRWVTLAMLAHAFLAVLRANEHEGHPSPDELKPLTCDEIQRLFITLVNRTVFDPVHRLRWSVWRRRHQARSQTSHYRRQAAQA

SEQ ID NO: 8213 - protein, 158 aa, Streptomyces avermitilis
VAAPVSTPRQVAQRLPAVLCIGGLVQRGEVWWVQFDERRLVVLLSGDDASGFQVMQVVAPAGLDISGLGIEVTVGAGEGLPLEGVLRLAFPRPGFTPCTWLTTVSRDDLIERAAVLSSRKLSEIDDALRLAEQAQERTPATTAKLSEIRDALRRGELG

SEQ ID NO: 8214 - protein, 124 aa, Streptomyces avermitilis
VIIRHIPGSPESRCRAGIASLLVWVMQRRVVLADRAERLRKELAEIDAEVARLEAAEVVIGQFIEAEGNGQADDPAVVQELERVTTTPGAGGMLLVPHREPDMDESALRDQQHPGIGPRQPCDL

SEQ ID NO: 8215 - protein, 277 aa, Streptomyces avermitilis
LSVRCASLSAMELTQATVNDLLAQLGPGDSYMYLPSDLDPQDLTDLLDGRYGAARTLVLDGFTDPTVDESRGAALLVPFEDRAVKIRAWAYGDQWVGTGTARDAKGAERPVLVVAHREVPEPLAVAPDEDEDVDWMERLIRITGWTRPAQRPDVDWAEVESRLGTALPSDYKRMVETFGEGAFDGYLDLNQEPWTDLRRDGLLIWAGTEHEDLYCWRADGDDPDRWPVVVRSFDNKDVPFDCQAAKFVCRILIDPHHPFTMARYFDTHWFMNYRESG

SEQ ID NO: 8216 - protein, 73 aa, Streptomyces avermitilis
VPDDHPLPITPTTGTSISAPVHASPMTSEFRLNNAQWSAGIVEGHVNRVKALKRAMYRRAPFELLRIRILTQP

SEQ ID NO: 8217 - protein, 263 aa, Streptomyces avermitilis
MRADARKNRDHLLAVAGAAITEQGVDVSLRDIARRAEVGLATLLRHFPTREALLDALLHTSFDELTAKAGALGTGPGTYAAGPVGGREGGRCRRRVATARRNRRGHAGVRSGLVEGEGGDRKAVDEGDVERGETVVAHRLLAARDRRVGGRVVQSAQQLRRSGDLGGRPVTCPEVSPVLTVLKAEALADLGRAPVKGVSSSCSMVRQHRHPAGPPTSQLAGRRALCAPRHPHNHQLVINSGKGSAPRRLQDSVCSSAKIAITG

SEQ ID NO: 8218 - protein, 331 aa, Streptomyces avermitilis
MRAVRLHEHGGPEVLRYDEVPIPEPGPGEVLVRVHAVGVNPPDWYLRDGLTNLPPETRPKFSLPVIPGTDLSGVVEAVAADVDGLSVGDEVFGLLRFPSFDGSTYAEYVVAPASDLALKPAGIDHVHAAGAPMAGLTAWQFLIELGHDHPSPFQAAQHRPVPLGANMTVLINGAAGGVGHFALQLAKWKGARVIAVASGAHESFLRELGADEFIDYTKSRPEELVHDVDLVLDAVGGPDSKRFLRTLKRGGSQFPVFFGEFDEEETVKLGVTVTGTQVRSNGAQLAELGRLLDAGTVRVAIDSTFALADARAAHERAARGHIQGKIVLTVA

SEQ ID NO: 8219 - protein, 305 aa, Streptomyces avermitilis
LITPEPVTSLIGMTQNAVEKTPVTMLGLGAMGTALARTWLAAGHRLTVWNRTPARAAALAAEGARVADSAAEAVAANTLVIVCLLDDSSVDEVLAGIDLADTDLVNLTTSTPAQARARAEWANERGARYLDGGIMAVPPMIGVPEAGSYVFCSGSRELFERHQETLGIPAGTTYVGMDAGFAALHDMALLSAMYGMFAGVAHAFALIHKEDIDPTSLAPMLADWLVAMAPAVHQTADHLRSGDYTKGVVSTLAMQVAGTPTFLSTAEQQGVSPELLSPYFELMRRRLAEGSGEEDLTGVINLLVH

SEQ ID NO: 8220 - protein, 120 aa, Streptomyces avermitilis
MTTLNRPGAPDGHVCGIDTVMEVIGGKWKVLILWALHERPHCRFGELRRLLPGITEKVLSSHLREMEADGVVHRVSYDEVPPRVEYSLTEDGTRLNDALQPLAAWGRERSTARGLEEGAG

SEQ ID NO: 8221 - protein, 71 aa, Streptomyces avermitilis
VTVSKNINNPVGMGGGQRKKLSRAERQNNGPHRNLDRQGAADQKAELVRKMREKAGAAEGAGQAGDGSAQS

SEQ ID NO: 8222 - protein, 220 aa, Streptomyces avermitilis
MQPPQDPSNVTHVLVAAFPARLAGAVQSVLAVMPDARLAPAESFEVVEVQGETVAIPYRIYNEEPETGGSERPLTETQQMILHCLYSRHSDGRVRQRHLEKIMASSEPWVVPFVVQLAGEYVLEILDAIGLGVPGLAAPGSADRRLYGEFIERNPDFFARTERRVVSYWSCYYRRKYEVFGTYPGSALMEAFRAAASEHAGVQWPRRTPPPSATCSAGPP

SEQ ID NO: 8223 - protein, 248 aa, Streptomyces avermitilis
MDEVEVVVAHSERATLRVGDVFLKVDADQARIDVEVEAMSLAPVPTPEVLWRKPPVLAIAALPGTTLGRLGGPSTGSSAAWAAAGTAIRKLHDAPLPPRAGRAGRSIVALAAELDAECELLVTNGLLPADLVTRNRQVAEAALRPWTAAFTHGDLQIAHVFVEGNEVTGIIDWSEAGQGDALYDLATFTLGHEEHLDDVVAGYGTDIDLDVIHAWWSLRSLLVVRWLTEHGFDPFAPGCEVDVLRSRM

SEQ ID NO: 8224 - protein, 72 aa, Streptomyces avermitilis
VYRWVAEGAIALLHWFRRLRIRWEIRDDIHHAFVTLGCAVICRRRLRTALCREEGRAIAPGGWPARCVRTRS

SEQ ID NO: 8225 - protein, 93 aa, Streptomyces avermitilis
MTCWRRLRDWNEAGVWQRRHELLLSELRAADLLDPSRAAVDPGHIRAMKCGPAAGPSLVAGGKVGSKHHLMVEAHGIPLAAITTGGNRNDVSN

SEQ ID NO: 8226 - protein, 58 aa, Streptomyces avermitilis
VAWIEAHNRSHRQVGARVEHVFARMKTWKILRDCRLNGDGVHHAMLGIARLHNFALAG

SEQ ID NO: 8227 - protein, 143 aa, Streptomyces avermitilis
VDSPVHGAESASATAPGAGERTAARGRRCGPLRTALGPPFQDRVMLVVTYWRTNLTMRQLAPLFGGWKSAADQVIDQLGPHLALQPRRRFRNDAVLIVDGTLVPTRDRTVAKQSKNYRHSTNHQVVIDADSRLVVVIGRPLPR

SEQ ID NO: 8228 - protein, 89 aa, Streptomyces avermitilis
VSLLLQRPPAPSTRACSFNNGTWAPKQITLPEDLLTVPATGEAGHGTGRTGGSSTSPAGSVRSLTALAPARNTSGPVLRWEGRELARLA

SEQ ID NO: 8229 - protein, 187 aa, Streptomyces avermitilis
VVNRFFNPASGTRRQGGQPLRPVTGVKENLMDGIVLLKDDHKTVEKLFKQFEKAGDTAHTEKRKIADQVIQELTTHTWIEEKVFYPAAREAAPDTKDHVLESIEEHHVVLWMLSELKNLDPADERFDAKMTVLIENVRHHVEEEEKEWFPEVRKAMGRNRLTELGEQMEEAKKKAPHDPLAVPSADE

SEQ ID NO: 8230 - protein, 84 aa, Streptomyces avermitilis
MRAPEGTASLVRPALPVHKGVIMSATDPTRGSAQQMRQKVQEMEEAAQRASDPQERQKLQDKARKLREQSERQGGQSEGIDPTI

SEQ ID NO: 8231 - protein, 157 aa, Streptomyces avermitilis
MRWRLRPLIFLPASMPWLVSATFADVFTLCASTTAAVGPALWPCARRVLSRSGSRTCWVVPSDSHFRPYRSDVSDARWAWAGPGTAARVHDLREIVNAILYVNRTGIPWEYLRHDFPPFKTVYDYYADEHSHPMQQPPTAPVTKTSQNTNYPDQKPP

SEQ ID NO: 8232 - protein, 91 aa, Streptomyces avermitilis
VHDTTGGKQLLDDLAAAPPSVTKVWADGGYQNSIFNHGAGLGSDVEVVQGPRAKGFEPLPKRWVIERTFGWSMQHRRPARDSEPSRKDPAR

SEQ ID NO: 8233 - protein, 215 aa, Streptomyces avermitilis
MSDDSTPTPASFTATATAIEAIAQAMRTAHTADVASTDDPQQAIAALLLLREVREQLARWEPQLIETARKAGASWADLAHPLGVSSRQAAERRYLRVRPGETGTTKEQRVQATRGRRAADRSVASWAHEHAAALRQLAGTITALPDLPLAATDALTALHTALGNSDPAQLLGPLNEAGPHLRSAHPDLADRVTDIGRHTQEVRESEHRQRSSGGP

SEQ ID NO: 8234 - protein, 143 aa, Streptomyces avermitilis
VLMRTDPFRELDRLAQHLMGPGTWSRPSAMPMDAYRDGDQYVIAFDLPGIDPDALDIDVERNMLTVRAERRPLPRSESAQTELSERPLGVFSRQLVLADTLDTERICADYEAGVLTLRIPIAERAKPRKISVRSTGERQELDG

SEQ ID NO: 8235 - protein, 258 aa, Streptomyces avermitilis
MSSFSLAVRDSSTMLRRNLLHARRYPSLTLNLLLTPVMLLLLFVYIFGDTMSGGAGRSAYIAYIVPGILLMTIGSTTIGTAVSVSTDMNEGIIARFRTMAIHRSSVLFGHVAGSVLQAIMSVVLVGAVGVAMGFRSTDATVLEWLAAFGLLALFALAFTWIAVGMGLGSPNAEAASNNAMPLILLPLISSAFVPLDSMPGWFQPIAEYQPFTPAIETLRGLLLGTEIGNNWWIALAWCLGLTVLGHRWSKAQFNRDPK

SEQ ID NO: 8236 - protein, 321 aa, Streptomyces avermitilis
MTNLAIAANGLRKSYGDKTVLDGIDLSIPAGSVFALLGPNGAGKTTAVKILSTLITADGGQAQVAGHDLAAEAHAVRAAIGVTGQFSAVDGLITGEENMLLMADLHHLPKSEGQRVTAELLERFDLVEAAKKPASTYSGGMKRRLDIAMTLVGSPRIIFLDEPTTGLDPRSRHNMWQIIRELVTGGVTVFLTTQYLEEADELADRIAVLSDGKIAAQGTADELKRIVPGGHVRLRFTDPAAYQSAASALREGTRDDEALSLQIPSDGSQRALRSLLDQLDAAGIEADELTVHTPDLDDVFFALTGSTTVPAQPNQPKEAVR

SEQ ID NO: 8237 - protein, 223 aa, Streptomyces avermitilis
MQKFDTPAPVSAVVDIPAGRIQFIAADRADTTIEVLPANAAKSRDVKAAEEITVSYSDGVLRIGAPQAKNRALGHSGSVEVTVQLPAGSHIEAKAAAAEFRGVGRLGDVVFAGGYRSVKLDEAASARLTGLDADITVGRLNGPGEISTQKGDLNIAEAARGTLTLSTQMGDIVVGAARGVSAALDAGTSYGRINNTLQNTDGAAAGLTIHATTAHGDITARSL

SEQ ID NO: 8238 - protein, 244 aa, Streptomyces avermitilis
MPGGRLTQEERQQIALGLADGLAYAEIARGIDRPTSTVTREVMRNGGPTAYRADLAHRATEHRAHRRRQAAPRDPKAPPQPYGRDEEAVREYEEVFTTVIMASGAPKMMSRVLACLFTTDAGSLTASELAQRLQVSPASISKAIAFLESQGLVRRERDERRRERYVVDDDVWYQSMMASARSTAQLVETSRQGVSILGPGTPAAIRLENIARFLDFVSESIARAAEQAREILHTKPGTTPDSTT

SEQ ID NO: 8239 - protein, 524 aa, Streptomyces avermitilis
VTAVGRPGDSLAQYRPGAGGSRRAPGEAREEPADDRSPPPAGHRTAPSRPAPRGRHRAVDRATSPPRRRRNGAPAPSASGGRHAVRSVLMLRSVEDIGPPRPRMRTGRKRVRPELDYRLLFGATPSPYLVLAPDLVIVDVNEAYLRATGRTREDLVGQHVFEAFPDNPADPDADGVRNLGASLERVLATGSADVMAVQKYDIPVVARPGVFEERWWSPVNTPVVDRDGHVAWIIHRVEDVTAFVQARRFRSRGEGGRLSEREEGMEAELYARARELQRLNEELRAAHAREREVAVTLQEAMLHSPDLARHENVAVRYLPAIGSLNVCGDWYDTVDLTEGRFTVAVGDVVGHGLEAATIMGMLRSALSAASRGVAGPAQALEVLGMYARSVEGALAATAVTVLIDSRSKLLVYSSAGHPPPVLLHADGTCELLDKATDPPLGARPEPVPRPQASAPYRRGDALVLYTDGLIERRGEDIDTGLDRLGETLGGLTDLVPERLADALLAGLGVAGGGRDDIALVVVRL

SEQ ID NO: 8240 - protein, 307 aa, Streptomyces avermitilis
MRDIGSVGGHSSPPGTPLRGRVAVVTGAARGVGEALAQRLSAAGMLVALLGREEETLRRAAASLPNRNIYVEADVTDHAALEDAARHVDNELGPASVVVANAGIAAGGPFTRTAADLWQRVIDVNLVGSANTARAFLPQLTHTRGYFLQIASTAAFGSAPMMSAYCASKAGAESFAQALRGEVERDGITVGIAYLHWTGTAMVAGIDDHPVLQALRRNQPRFARRVHTPAQVADWLTTGITHRAHHIYAPPWLRWCQPLRPLFPAVVARITRRELRTRSHTELAADVTVLGAGGLADWNSFLSRKHL

SEQ ID NO: 8241 - protein, 215 aa, Streptomyces avermitilis
VDGAERLRGGPAAAVRDPQLFEEFYRRHVDAVMRFVARRVDDPHTAADLTAEIFLAVLDSVHTYRPHLGSETAWLYGIARNVVSSERRRVAREAERDLRFSGRRLLEADDIVRLEDRLDAESPGRHALAALARLPEGERAVMELVAVDQLTVTEAAAALGIRQVTARVRLHRARKALREEADVKAAKTNPVAAQASSPGAETPDASLLYVTRGEA

SEQ ID NO: 8242 - protein, 207 aa, Streptomyces avermitilis
MSMRTTFEDRLLGELKREIELREAGVASTGTAEFKTGEGRAKAAVGRLFAPLTPRRMAAVAAACTAAWLAAVIMPGSPAGSNAWAVDPVGDGSVKLTVQDQNISVAAQRELARKVRPWGVHVTVDVLAPGYVCERSKVASPLVASDEHGNRVPVIPFKSSWDVTLRRGNVLTFENTKGSSQPRAVEFYETRSEAEPCVPMKVVLPDD

SEQ ID NO: 8243 - protein, 421 aa, Streptomyces avermitilis
MEPPPLVPPSPNRTRSVMQQLPPATMSAGLSRLGWLDALRGIAALVVVFDHSSYAFMAEFRRELMPQFNTSRYGIMVFFLVSGYIIPASLERRGCVRTFWIGRVFRMYPLWAVAVTAVLALHLMGIAEIRTGLGRQSLAAVTVAHVTLLQELLGTPSLLLVLWTLSYEMAFYLLVVALFTVRLHRRSAAVAVTLAVLAAVCGTAGVVLPVSALSGAVGTGPLVAVASITMVVALCCASAVSPALRVFGGVLGGVLALVLAPFNGTVPLWEGLVILAVMFLGTAAYRAEHGQSTWRYAACTAVVVVACAVGSAYRYGDGPHFTRRGWIVAFLLAVLTFGAGLALRRRRVPRWLTGLGTISYSVYLVHPVLLAVTDGTIGRWRRDNLMLEVAFFAVLLPLCVLTYRYIEAPSQTWGRKLEHRA

SEQ ID NO: 8244 - protein, 187 aa, Streptomyces avermitilis
MIRLSLPITTERLTLRPFTPDDLEDLYAYQSLPEVARYLFRPPLTRDQCVQSLARRVAGTAWAEDGDDLVVAVCRTGGATVVGEVVLKLASARACQAEIGWIFNPAYGGRGYATEAASATASLAFAELGVHRLFARLDVLNSGSVRVCERLGMRREAHLVENDLDGERWGSEYVYATLAHEWKADRA

SEQ ID NO: 8245 - protein, 165 aa, Streptomyces avermitilis
MLGLRTLESDDWPLWRELRLAALTDAPYAFGSTLAEWQGSGDREERWRTRLSIPGARDLVALLDGLPVGMVSGVPGGEAENVELISLWVNPTARGQGVGDYLIQAVERWGAERGARTLRLSVMPDNRKAVALYERHGFTDTGESGNLLPAGVRRERVLAKSLATV

SEQ ID NO: 8246 - protein, 334 aa, Streptomyces avermitilis
MNRRVVYTRGGSPANVLTVIEEPEPAPGSGQVLIRTTAFPVHPGDLQAVEAYPEEATKPVPAGVEATGVVEAIGPGTRVAPGVTVGGRVTVFPQPGAWSQWIVADADALVAVPDELSDEVAAQMLVNPLTTVMLRREAQEHPAFGYDGLLVQTAAGSSVGRLLTGASLVHNLALVNVVRSDRGAAELRKRFPDVPVVATEHPGWADEVREAAGGRPVSVALDPIGGKLAESLLDLLTPGGKLVSYGQIGEEPISVHASTLLHKSLTLRGKNIGRWLSEASADRRASDVATAKLIALTLKDQFDVAATYGLDELGNAVEHAVRPGKIGTVLVRPW

SEQ ID NO: 8247 - protein, 221 aa, Streptomyces avermitilis
MPGSPRGLCTRSRKSTMSTHGTIGVLGAGEVGQAVADKAVRHGHEVLIGNSRGPRTLEALVGRLGPKARAVTAEEAVQPELVFLSVPFFAVPELTGLTTWAGKIVVDTTNQFAAANPWRGRYDVGDLTGSEWVARHLPGARLVKALNTLFATFIAADPRHAEGRQVAFYAGDDADAKTAVAGLLDEFGFAALDLGGLRDGGRLMQLDGALSAKHLLLQDVG

SEQ ID NO: 8248 - protein, 327 aa, Streptomyces avermitilis
MSSMLAIHLTQFGEPEQSLKVVDVPEPPAPAAGQALIQVEYAPLDHHDLLLARGVYPVRPELPSVIGNEGAGTVLAVGPGVTRIRPGDTVLLPFGTFAWSEQVLAEAAKLTAVDRAISLEQAAMLTINPTTAGLLVESRDLPAGSWVVQNAANSGVGRSVIAFAKERGLRTINIVRREELVTELEALGADIVLIDSPDVAVRVRAAIGDDPVLLGLDGVSGKATSLLLDVLTDGALLLIYGYMSGEPFTPDRNVLRAKNITTTKFWMYQDEYLPRHPDIGAESARLVAAGKLTLPSAPVHQAKDFAEALAYLQKNGKVLLDFNPHRE

SEQ ID NO: 8249 - protein, 156 aa, Streptomyces avermitilis
VSTPRSTPSLPPCLPQPDRKATTMTDDTAQATAVPSWVLKFMDAIDTLEFGEGFAPLTENTDMFFGTAHIHGAEAIKAFFVKIDAPLIITHEVLEFWTADDGVRLLRGEATMARKSEPDKVVRAPFTHIFYLDREEPVRIRTLRITAGPLQTDAVM

SEQ ID NO: 8250 - protein, 67 aa, Streptomyces avermitilis
MRDMPVLNTAGEEDSQFPVHVVRKMTDAIEGSTLRLLQHTAHLAARTNPEGVNAEIDAFLAALPAAA

SEQ ID NO: 8251 - protein, 173 aa, Streptomyces avermitilis
VSDRRSHVTFQHGQEFLAAISERWNYQILREVFFGVGRFGEIKRALGISANILTARLNSLTELGLLTKRAYRSDKPWYEYELTDSARELVVPAIAAITRWAETHATGGDITHHPLMHTVCGNPTNPYLACSSCHQPVEASTLRPVSAEEGGDQGTGGRGAASAAPGDPGSGRR

SEQ ID NO: 8252 - protein, 51 aa, Streptomyces avermitilis
VLGTHFPHPTAGRVITHGDAYRLSPVFATPQAWLPRTRVTSNVSELLLIQN

SEQ ID NO: 8253 - protein, 69 aa, Streptomyces avermitilis
LSLDDRMLMVTAYWSTNLTIRQLALLCGISKSAVDRIMKHLGPLPALQPRRRFAKDTVLIVDGTPGSRM

SEQ ID NO: 8254 - protein, 228 aa, Streptomyces avermitilis
VIGEPAQPGAKKYVLFDVDGTLIDAVDNQRRVWRVWAERYGLDPGEVYQVALRTRPMETFAQVAPDRDPQECLAALHELEDEDVRSGVYAAFDGASELLDALPPESWALVTSNYEHRVRGRFARTGLPVPSIIVDAASVEEGKPSPVPYLLAAKRLGADPQDCLVIEDAPSGVRSALRAGMTVWGVNAPVAVDGVHRHFGSLREAIRDILAVTSGTRPHEPRGSAAVE

SEQ ID NO: 8255 - protein, 301 aa, Streptomyces avermitilis
VTQRQERLFVLEASSGGRLFSVNPDGSDKKVIVTGCRIPDGVAIDVLAGHVYWTNMGLPPENDGSIERVDLDGGNRTTIVPSGVTHTPKQLYLEAVGRKLYWGDREGMRVMRCDLDGSHVETLVQTGQGEDDRRDETRWCVGVAVDPAGGHLYWTQKGPSDAGLGKILRAGISLPAGESAAERGDIEVLFEGLPEPIDLELDLAERMLYWTDRGDPPRGNSVNRSPMHPPDAQRTPEILLTHLMEAIGIALDPDGGRMYVTDLAGNVYAAGLDGSNRREILVAQGNLTGIAHAVLPTGTSF

SEQ ID NO: 8256 - protein, 328 aa, Streptomyces avermitilis
MNVHTPVHRVAIVGTGTIGASWATHYLVRGFDVTATDPGPTAETALRSYVEAAWDAAASIGLAPEASPDRLSFTADLRQAVADADFVQENAPERPELKVKLFADIDDATPPDAIIASSSSGITMSVIQAECRRPERTVIGHPFNPPHIVPLVEVVGGTRTAPETIRDVMSFYAAIGKKPIHLKKELPGHVANRIQAALYREVVYLVQEGVLDVADSDDAVSWGPGLRWGVMGPHLLWHLGGGEGGIQHFMDTLMPRMVASWQELGIPEFTPELKEEIVGGVLEEAGGRSVDELAARRDAMLSALLAVRAQHDPSGPSATAGRGPKEEA

SEQ ID NO: 8257 - protein, 260 aa, Streptomyces avermitilis
MSTAPEAADLVLHERHGGVLTITINRPAQKNAVDHEAAVQLAAAVDLLDADPELSVGVLTGAGGVFSAGMDLKAFAKGELPLLPSRGLGGLTRASVRKPLVAAVEGWALGGGFELVLACDLIVAAEDARFGFPEVMRGLVAAEGGLVRLPRRLPYHVAARVLLTGEPLTAVEAKEYGLVNELTPPGAALDAARELAGRVARNAPLALAAVKEVLRETQGLKESDAFRRQDELTSGLAASEDAREGAQAFAEKRAPVWHGR

SEQ ID NO: 8258 - protein, 410 aa, Streptomyces avermitilis
MTNESVFTGLKVLDVSSFIAGPAAATVLSDFGADVIKIEPPGRGDPQRRLSSVPPSPRAQANYSWHLANRNKRGMVIDLKSPAATEVLKRLVDWADVVITNFPHGTREKLHLGYEEVAGWNPRVVYADITGFGDAGPDAGQPGFDLTAAWSRSGLLASTRDAGAPPTVPVWGSGDYMSAIAIYAAVVTALYRRERTGQGASVGTSLLAGGVWATGTLVAGALAGGTPFELHDRKAPANPLINPYRTADDEWFMLVASPPHWPGLTRAIGHPELLEDPRFADIEGFVENAAALSELLDAEFRSQPFAHWRDALTRERVTYSLIQTPEEAAQDPQLRANDIVVPLEGVSGLAETISSPVNIRGVPKVPAKRAPDLGEHNDEILAELGFGPAEIAELRAQGAIPGPTEAEGPR

SEQ ID NO: 8259 - protein, 413 aa, Streptomyces avermitilis
LRETAVSGTTTLPAPSGPYLDKGLLPADFFAYEELLSDGEREQLESVREFLRTQVAPIVDDYWARAEFPFQLVEGFGRLGLMDWADPDSPESRPSNLLAGFLALELAHVDASVATFAGVHTGLAMGTILTCGSDEQKRRWLPAMSRFEKIGAFGLTEPHGGSDVAGGLQTTARRDGDTWILDGAKRWIGNATFADLVVIWARDVETRHVLGFVVEKDTPGFTATKIENKMALRIVQNADIVLDGCRVPEANRLQNAHSFKDTAKILRQTRSGVAWQAVGVMFAAYEIALQYTKEREQFGRPIGGFQLVQDLLVKMLGNATASCGMMTRLAQLQDAGVFRDEQSALAKAYCTVRMRENVGWARELLAGNGILLDYKVGRFVADAEAIYSYEGTREIQTLIVGRAVTGGLSAFVR

SEQ ID NO: 8260 - protein, 134 aa, Streptomyces avermitilis
VRQDCEVPGTDAGKPAGEREVYRVLEEVHTLAGCRMRDPVHRVRGILVHSTAVAAGPRTGAAEPGHVLAGRAYSSRKIREYLRERQIPHAYPEKPDRAGHRLPAARPDDVRPDSTMGDLLRGWLPPRARAPPGG

SEQ ID NO: 8261 - protein, 98 aa, Streptomyces avermitilis
VRRQVHEDSSRAGEAARMAWPRQALVEDFTDRVGAIDVPVLVLAGSDDKVDPPQILRDHLLPLITTATLTELDGTGHLSPLEVPDQVASHISAFAARL

SEQ ID NO: 8262 - protein, 80 aa, Streptomyces avermitilis
MWRQETGITPHQWLLTARINHARELLEVTDLGIEQIAAQSGLGTSTNLRARFRDTLGTTPSAYRRTFQETTMAGPQTRQK

SEQ ID NO: 8263 - protein, 56 aa, Streptomyces avermitilis
VAAARMSRKDVEDTMAFSALHGIRPMTEIVPLDRADEAYQKMLAGKARFRMVLTAG

SEQ ID NO: 8264 - protein, 350 aa, Streptomyces avermitilis
VIHRRCVGGRRNHGGRVAQGSSRSRLPQQGTPVTMSSTSSTPPWNVQRLPGADGRVFLVTGGNAGIGYFVAEQLSATGATVVLGSRNPAKAEAATASIRARVPGSRVRAVRLDLADLSSLETAVESLEVERLDAVVHNAGVALDDPPREETGDGHELMFGTNHLGHFALTQWLMPLLSAAPAARVVTMGSFAAKSERLDLDDLQSRKDYQPKRTYGRSKLAQMYFGVELDRRLRAAGSTVASVVVHPGGALDSLTPSRPPVHVRSTGARLSAAPAALLLQGKHAGAWPAVRAVLDPAVRGGQLWGPRVFGLRGEPRREPVWDHLADPSVAARLWDASCDLMGTDLSTISG

SEQ ID NO: 8265 - protein, 273 aa, Streptomyces avermitilis
LPGKSSRQLEIDGDRDGEAARVVLNGGDQAVVCEHRRVEPPDETAQLLVGSGELLLGRGELGDERRNLGDVQTRVRAELRANSRRAASLTAPVIAAVGFAVMLSGVVETMRVPYPAGDAVTLTGQVIVTPDGTPANTDEVVAANPVGKAALPTRAFARDEGGDLAVIDALGSRDTRWNKPGQTLLGKRMATFLGDEAGRAWSPPDLVRLPAPQRRATAHGRPGRRRPRPPARPGSRPRHPRPRRLPPTRPDRRAAHPRCPGTARQPVGQRARA

SEQ ID NO: 8266 - protein, 335 aa, Streptomyces avermitilis
LSSAMERMEILVLGGTAWLGREVSRQALDRGHRVTCLARGDSGPVAEGARLVAADRRDPAAYASLPGREWDAVLEVSWQPGFVRKAVAALGARARHWIYVSSVSAYASHGEPGADESAALLPATDREEVDRDRYGEAKSACETLTRTALADRLLIARAGLIGGPGDHSDRSGYWVARAARAPHAPLLVPDTPNAPTQTIDVRDLATWLLDIAEHRTTGTYNALGPAVPFAEWIELSRSVGGHTGAVITVPSQQLLAHGVAQYMGPDSLPMWVVEPGWEGWAARDGSAATAAGLRHRSRTGLLADTLRWEREQGLHRPRRAGLAPDRERELLASFG

SEQ ID NO: 8267 - protein, 201 aa, Streptomyces avermitilis
VSRPLERSLLAPPLRPHHKSPDVMGSSSDLVRGVIDDRRMMAVMENVVEKIKVRFRFIPREGWFPQDTEGLWATKLGDETASVQNAPFLQDGIAEGDVVRYRTDSDGLHWAVHRVSSSGNCTIRVVPVPTGPLGRRPQAVRQRLSAFGLGGEVFSEDFPMVAFTAPAGADFAGIKALLKRGRDEGWWHYEVGCGTDEWWNA

SEQ ID NO: 8268 - protein, 87 aa, Streptomyces avermitilis
VGCSVLIVHATERPRLVEIRDDLLARILEAEREGWLGEIEGLQSSLTHADETIAQLDAQIARKQGAVNLGVPTSREIVARTATAAAP

SEQ ID NO: 8269 - protein, 317 aa, Streptomyces avermitilis
MMLVNSPEPVIDANLAIALDALLAEHSVTRAAARLHTSPAAMSRTLARLRRILQDPLLVRAGQAMVPTPRAQSLRDEAAAVVRSLGALLSPGTGVDPADLRSTFTLQAADLVGAALAPGLLHLAQQEAPGVSFRLRAEELEAGTALRDGRIDLEIGSIDHVDPETQVEELVSLRMMAAVRPGHPLTEGPLTPARLAAAEHVAVSRRGRFSGPLDTALAEQNLHRRVSFVLPSHLAAMTLATRSDVVCLVPAAPPGAAPSPLTDDAIALGLFLLDIPLELPPLTIGMAWHPRHTADGAHHWLRNAIRRTLRTPGSPTT

SEQ ID NO: 8270 - protein, 297 aa, Streptomyces avermitilis
MIVITAPTGNIGRHLLSRLLESAPAAGEELRVIVRDPARLPDAARGRVEVITGSHADTEVLDRAFEGADAVFWLVPPDASLAPHDAYSGFTRPAVKALAVHGVGHVVGVSALGRGTPVADRAGLVTASLAMDDLIAGTGVAYRALANPSFFENLLEESDSIRDKGVFTDTVDADRKAPLVAVADIAAAAAGLLLDRSWTGTGSVPVLGPEDLSPNDLARIMTAQLGRPVRYERQPLDELYTTLVGYGLNEAFVQGVADMKRAKDEGLDAGVARTPDTASPTGFEQWCAQTLKPAVLS

SEQ ID NO: 8271 - protein, 121 aa, Streptomyces avermitilis
MPTEETEPPVTAFMLVKTTPEWLALTVQERVDAFTTQVLPAIEARTSGVRSRFYDTEFYSARVTDVWVWEAEDHHAYQLLIDALRETPFWDRYFEVVDLLVGTENGYARTYGLEPVATITT

SEQ ID NO: 8272 - protein, 77 aa, Streptomyces avermitilis
MRRRTLASRISSEMAVSVGRLDNQYSVGASAPSGHSISSRQSGRIPSHQPCSADAVALIGRSTALPAVRTYGGEAGT

SEQ ID NO: 8273 - protein, 210 aa, Streptomyces avermitilis
MNSIASVTLEVADTTAAARFYSTAFGLDSSHVRLRASEAPTTGFRGFTLSLVVSQPGNVDALVGAALDAGATALKPASKSLWGYGGTVQAPDGTIWKIATSTKKDTGPVTRDFDELVLLLGVEDVKASKQFYVEQGLTVGKSFGGKYVEFATGSGPVKLALYKRRALAKDAGVPADGTGSHRLVLSSAAGPFSDPDGFVWEATAPLAATA

SEQ ID NO: 8274 - protein, 481 aa, Streptomyces avermitilis
VLSRNSPVEEARAPRWRARSRRATAVVLLALVAGTELAAGPVAAAPHAADRVDGVWRLDGYGTVLSVEDGRLREYQTTAVSCLRGDTARRTGQAGNSVIYTGDDTTVYRIRPAAGKAGATLHFDGSVGDRRLRRLPALPARCTEAAPTGALATFDVFWQTFEENYPFFAAKKTNWQTVRDRYRPRVYDGMPDTELFALLREMVLPLYDAHVGIDAGDTGSFAQSRPGTMPPGPGLDQQAQRFVEQHDLAGMRLRTFANGRIGYARLPDGTGYLRVSGFGGYDGDSPAYARNSAVLDETLSQVIRPGLRGLVLDLRINGGGSDALALQIAERLTDPAYVAYAKRARNDPIDPGRHTRPQPVRVRPAADRFRYTGPVAVLTGGETYSAGETLTQALIQRPARTVRIGQNTQGVFSDVLERTLQNGWSFGLPNEEYLTPSGGKTFDGEGIPPDIRTGNFLEEIANGTHDSAFTQALAVIRRRAE

SEQ ID NO: 8275 - protein, 60 aa, Streptomyces avermitilis
VVRIGIPEPYATRRTEAMADRDNAFWGEAIPTMEEITGRKPRSLANFLSDYATAFARQPI

SEQ ID NO: 8276 - protein, 68 aa, Streptomyces avermitilis
VDVDLRKLRYCLVVAEELHFGRAAERLHITQPVPSRQIRALEQELHARLFTRNKQTTVRASIRLWLRR

SEQ ID NO: 8277 - protein, 277 aa, Streptomyces avermitilis
VGCGLAARWSATLMRLPHRSCGSGIRVLPAAFGEQPLLRPCFVQETSPMSELEIDAVVFDVLGTLVDEPAGIRAGIRELDPSLDDPRVEQLLSLWQQHIDREQRRILDGVRPYLTSDVLDLEAARLVADAVGVDDPAAVAALALSGRRLPPWPDTVAGLARLAERFPLIGLSNASRTALLGLNAHAGLRWHQALSAEDARTYKPDPAVYQLAVTVSGRPPERLLMVAAHAWDLRGAQSLGLRTAYVARPVGDPPTSSDGFDLHADDLAGMADRLDHA

SEQ ID NO: 8278 - protein, 58 aa, Streptomyces avermitilis
VAADEKAQANGEQAKGKVKKVVGGAAGNESLKGKGHAEESKGDLRAAKEKAKDAIKRK

SEQ ID NO: 8279 - protein, 56 aa, Streptomyces avermitilis
MVPVLLVLLLALILFGAGFALKALWWIAVIVLVVWVLGFVIRPAGSGGKRGRWYRW

SEQ ID NO: 8280 - protein, 117 aa, Streptomyces avermitilis
MSDSIWGYQPTTGHTAGTDLIGYKVEATDGSIGKVDKHSDDVNSSYLVVDTGVWIFGKHVLLPAGTVKTVDQAERKIYVDLTKEQIKDSPEFDKDKHAGDAGYHEQVGSYYQSHRRV

SEQ ID NO: 8281 - protein, 279 aa, Streptomyces avermitilis
MTVTEATRARTVALPEIADPSGVAPKDARQLSRLFFDRLAVLEEGTPEYQYARNTLIEMNVTLVRFAAARFRSRSQDEMEDIVQVGTIGLIKAIDRFELTREVEFTSFAVPYIVGEIKRFFRDTSWAVHVPRRLQEARIQLAKATEELQSRLDRMPTVKELSELMCLSEEEVNEARLASNGYTSSSLDATISSSNDGEAALADFIGTDDNALELVEDFNALAPMIAELDDRERRIIHMRFVDELTQAQIGEHLGVSQMHVSRLLSRTLAKLREGMLTTN

SEQ ID NO: 8282 - protein, 331 aa, Streptomyces avermitilis
MNGMIGSVFRTADVPADNRFDYWWELIGRTRSSEIISAHAADFWAEYRLMELGPVAVWSASFLPSRYRRSPRMVRQSDPETYHLTLLLDGGLALDHAGRTDTFGPRDLHLADSSRPYDLRSTGDREHHVVKGVAVDFPKALLPLPPHLVRGLLGRGLSGREGLGALLTDFLVGLDRQADTLQPSDAPRLGTVVLDLLSAWLAQVLDAETALSQETRRVATAESIRAFIRQNLHDPELSPPVIAAAHHISLSYLHRIFQQQAQGETVAAYIRSQRLEGACRDLASTSLRTTPIYAVAARWGFLHASDFTRTFRTAYGRSPKEYRLQALYVPE

SEQ ID NO: 8283 - protein, 133 aa, Streptomyces avermitilis
MMWKRIFATSAATLTLLGGSMLATAAPAQADGTCPSNALCIWDSTSFGGLRILTRSTNTCFNMGKFDFGYIRSYDNNLSVNGYVHNYAGSGVWYQARTLPAGGFSSDIGVPGLGGLAEDWVCMGSADLSDFVY

SEQ ID NO: 8284 - protein, 185 aa, Streptomyces avermitilis
MTPPHARTWGRRGQTPVVRVRGRSRRRISVAALCCYRPGERSRLIYRPRFHLLLKGARKSFAWQDYRDLLVRAHLQLGAPIIVVWDNLNTHRAAGLREYAGSHEWLTIIQLPSYSPDLNPVEGIWSWLRHGPMANTAFTDPDHLTRTLRRGLAHIQRHPELIDGYLTETGLTLTPDPPKPIRKGQ

SEQ ID NO: 8285 - protein, 179 aa, Streptomyces avermitilis
MRYADGGGLTAERRAAREGIRLEAGVRFARGDRTSDIAKDLRVSERSVEQWRRNWREGGIEGLKSKGPAKLPKLSDERFALLEKELAKGPAAHSWEDQRWTLERVRTLIGRQFQVSCSIAGVWRLLHRHGWSWQSPARRALERDEHAVELWKKDVWPQVEVPRRRSGPTSSSRTRPGSR

SEQ ID NO: 8286 - protein, 324 aa, Streptomyces avermitilis
VASADNGTVTRTALASDTEFTTGGAVELIGRSITLGAGESRHVRARLEATSSTTAVVGMTNAIRCVNSSGVTVGVKSASARNHEGYDTTSYATAGHLPIYADLLFTAPSAGTYRCGLVGSTYSTSGSAYHLTAVAGNTWIEISDTAQVGAGWWQNPSCESADTNGACTYVGGGAADSEAWVFYGDGTPASKWEAHPSARTVDAQANLELTTCPVGTASCASAMQDHPRGENAVVDLRFDFIQLDTTGHACATHQQSSRKTITDDAHHSVSYFALSDIPINSACGTRTFIMRIYVKHVEGQTLKIDGVQSGVTSLTNGIAFNRFS

SEQ ID NO: 8287 - protein, 377 aa, Streptomyces avermitilis
MASVDMVGGDAGERYPWVTIEAWAKGGEAERIGAVGEALAAEAQQIEERLRVLHRDLTFVQRVLALTPGRPFMERLLALSRQVRYSGASDERLLASLIAEAQSLDDALYVLRHPEGEEHHALRACLFHELLLRGAAPDKLVPHATQRPDFRPFHWSGLSWLPARLSEMEGPDLRAWLPNRRYQGGASGTVPTMKSPTPVDVAARRAGAAHRVREATPAHLADLIGRPAKDGRWCDHEARVFVLDEPVSPENLPGVVTTLPLDCLQGLGERDRFEGEACTLDSVWLTLFMTASAGGFGSAGVHGAWGRFSAWLSLAGLCGAEYPEASASEVEELARACTWYRFEADTEWFHNDLDDYGIVALSPDGRRIAVLAATDTD

SEQ ID NO: 8288 - protein, 453 aa, Streptomyces avermitilis
MGRFSSSGRAVVRTVTAFLLLAATAVAGPTATADSGSHSAPSADPAAIREWNVIATDTITASLGARPSGQAAIWHGFVSAAVYNAVVGIEGRYAPYKWHARGPSTASPEAAAVTAAHHVLLTYFPASRAPLDAAYAGSLAKIPEGQAKRQGVAFGERAAEHLIELREGDGRFAPVEFTASPAPGVWRPTPPAYLPFIDTWLGRLRPLLLTSPDQFRPGGPPALSSARYAEDVNEVKTMGAKSGSSRTAPQTETALFFGGNLVVQFQEAFRDYTARHHLGIAETARLFVAGNASATDAVVATWDAKLHYGFWRPITAIHLADTDGNPATEADPQWQPLLVTPPHPDYVSGHAAVAGAVTQTLSGILGTTRLDLNVSSEITGTTRHYEYADQFNKDMINARVWSGIHSRTADTAGCRAGNRVGAWTFTHYFQPLHSPRLHATPPIQPTCPLGSAS

SEQ ID NO: 8289 - protein, 148 aa, Streptomyces avermitilis
LHTHFAGLDEFVAELCLDRFARTAAKAQALSGLAGQGTVARNLDAVALALFDSGGPAMSGLAMTRPAAALRIREALVDGAPGFTAIQEAITGYLKAERGLGRVAETVDPRTVALAIVGTAHHLLMTSWPGAPDPRPHMARLVAALVDS

SEQ ID NO: 8290 - protein, 264 aa, Streptomyces avermitilis
VRVQQPLGAARLGGDGPARAEREGIANASFTRGDVQVYPFEAGAFDVAISRYGVMFFADPLAAFVNVGRALRPGGRLAFVCPADATLNGWVAAVASLRDFLPLGDFGRPGQPLAAPDRIRHVLTVAGFTGITINQAQTYGAWGHGAEDAAEFLLGTGPGRHLMEQADATARARARRTLTGLLRDHEAADGTVRLRSTSWLVTADRPADPSDTPQGRPPATGSSAEQAEIYLAHYAAVHGPSRGVGSRPPGPPQVAPAACWTVMP

SEQ ID NO: 8291 - protein, 362 aa, Streptomyces avermitilis
VRTVGVEEELLLVDPETGEPKALSTAVLARAEQVDPDQDVFEKELHGQMLEFATHPQTDMAALGAEIVRCRKEAARHAGEAGCAVAALATSPLPVSPSIAMNRRYQWMAEQYGIAMQEQLTCGCHVHVAVESDEEGVAVVDRIRPWLPVLVALSANSPFWQGRDSSYESYRSRVWGRWPSAGPTELFGSPERYHRQVADMVATGVILDDGMVYFDARLSHRYPTVEIRVADVCLHPDTAQLIATLARGLVESAARDWRAGREPEDHSVSLLRLAAWQAARAGLSGELLHPVTMRRLRAESVVRALLEHVGDALADAGDLDLAHEAVAELLERGNGARVQRELLERTGSLRDTVTECVRQTQG

SEQ ID NO: 8292 - protein, 129 aa, Streptomyces avermitilis
LQITASTVSLTVADVAASQAFLTAHLGYTVQAAADGFASLTRADAVDIVLLARGTQVLPPEQRDRHAAGLILAFTLADGLHDQEKRLREAGVEITMPLREEPWGERLFQITDPNGVIIQFVEWATSDDT

SEQ ID NO: 8293 - protein, 63 aa, Streptomyces avermitilis
MFELDRTTVSALTIGLGEVPAGRDVRDPAPRGGYDLRRLAADRAVRGRREPRVVRNIPRRRGY

SEQ ID NO: 8294 - protein, 217 aa, Streptomyces avermitilis
MGTEITSPAQPVGLRESKKHETRQLISDHATRLFLAQGFEQTTIAEIAAAARMAKKTVTNYFARKEDLALDHQEEFTASLANAVADRRPGESALAALLRAFHDSLATQNPVAGFSGPAFARMVADSPTLTACLRGLHDQREHRLAQALADATDTTPDDITVHIAAGLLGTVHRVLFQRIQDLTLAGHPNDRIAHTITAEATQAFDLLEPALAHYATA

SEQ ID NO: 8295 - protein, 346 aa, Streptomyces avermitilis
VTSPKRTRTTTSPVACPATGSPSSQATSAPSYPAVRTACRSTWTCRSRDIRRPAAPAVPRSPQSADFEADFPALVSRTLSDLTPGERHVLRSVSLLDSFDVPLVTRAAGTAHDAPALRLTERPFVRENPGTCRGAARPAPPGAHPDRWAVSGRPARSDGPAPTSRRPAASPAGRPNQHRGSAVVGTMEAVTPKEWLAVLAVSLDAVHHTGRAALRHLRAARGSNVGSAGGLGGDYGMAAYNAAKGAVVNLTRAMALDHAPEVRVNAGHPGFTLHSGITAGATPDTPVVRSFAERIPLGRVAEPDEIASVVAFLAGPDALYDRRSNPGRREPHRCYRAAPHRDVNAS

SEQ ID NO: 8296 - protein, 656 aa, Streptomyces avermitilis
VERSKDRRPVSLQDRARYWFDRTLARSTGTLMGWLVIICLAVVVPVSALLVWTDPGSPRSLSGRLAAVWRSSAETLRLGTVTGTPLRMLLSALLGLVALLCVSTLVGVITTGLAERLAELSRGRSTVLEQGHAVVLGWSDQVSTVVGELVAAQSSYRPRAVVVLAERDKTEMERALAAHVGPAGRTRLVCRSGPASDPGVLALVSPQTASTVLVLPSGEPTADAEVLRVLLALRAVLGEGTGGPPVLAAVLDDRYRAPARLAAGPRGTVLETDTVTARLIAQCVGRPGLSLVLRDLLDFAGDEFHLAEATAFHGGPFGAALLGHATSCVVGLLTAEGRTLLNPPAATLVAPGSRLVVLTRDDGSARPEDCRHLVEPSAIAMAQPPPEDAAHLLLLGWNRRAPLVVNQLRRTARPGSVLDVVTDRAVPGPTREPESGAARLAVRFQSADLSRPETLLGLDLAPYDGLIVLGPEPGDGPDRPDDRTLVTLLALRLLEERTGREMRVITELTDDRNRPLAPVNPGSDVIVSGELTGLLLAQIAQNRHLAPVFDELFSADGSTICLRQAGHYVRTGCETTFATVVAAARDRGECAIGYRRHDRRAIPPDHGIRLNPDKSERREWSADDQVVVVATEPTEPAPAAGQDTEEHQPGPADTRA

SEQ ID NO: 8297 - protein, 58 aa, Streptomyces avermitilis
VFVLGAAVLWLLGRPTAGRRKADRARRAQPEQAQNAAGVPVRATQELRALPPWSRPCR

SEQ ID NO: 8298 - protein, 312 aa, Streptomyces avermitilis
MLVGASACGGGSGDKANGDDAKASGKPGASASPSPKKPAGPPMLLETITPQTGTTVGVAMPISVVFTNPVAAKARAAVEKHMKVSASQPVSGAWHWFGDKRADWRPKTYWPSGTKVKIDADMKGVNNGNGRYGVHSYTHTFKIGDDVRADVSVTGHTMKVTRNGKVVRTLSINAGSAQYPTWNGTMAVIDKQEKVHMTSCSVGISCEKGSPNYYDLTLPWDVHLTQSGTYVHYSTGDPTPGSGSARGSHGCVHLSMSDAKWFYGQVKQGDPVTITGSPRAKAPADNGYADFNLGWDQWLAGSASGEKTTATL

SEQ ID NO: 8299 - protein, 201 aa, Streptomyces avermitilis
LQRAVPRAIMAVMARPRQIIECGDFVLRSWRGQRDFAPAFKLIEESLDHLRPWEPWVARHSEESTRDFLAKSESKWANGDVYNYAIAKDGTLIGMCQTYRGAEPQGRRIGYWLHPAATGQGIATRATAAMVTEMFTLPDVEYLEVAHDLANTSSAAIPRRLGFTEVRREQVTPPAAPSGSGIDVVWRLNRPTPPVDGSRRP

SEQ ID NO: 8300 - protein, 193 aa, Streptomyces avermitilis
VRSRAPTRCWWPGSTRPSDATALCWRWRWRTGCTGTGPRRFDRISAACFFRAVPPALLTQARPGGKILLTLSGWLYGYARVLLTVADDGTAEGQLRGDTVSFMSARRHAAPTYGNPAHWATGLPEKARTTRHSPERITIATDEALHLRFLAQSAVSDAQMTTVGDVVHLVDVVTGSRDPHPWRGQLGCTRGGR

SEQ ID NO: 8301 - protein, 223 aa, Streptomyces avermitilis
MQAFSPHGFHAEDYATLEPSRAKPNEAIYGYTNHDRSCMLWYHDHAMGMSALNVYAGLPGLYLVRDPVDERLGLPRGAFEVPLILRDRTFNQDGSLAYTMTAREGEDTPVFNGKAYPFLAVEPRRYRLRILNASNEPFWRLRFDVPRDVLLQPQLPFWLIGTDGGFRAPLKMLDFLISSAERYDLIVDFSGMPRTRSIRCHSFTGPLAYSPTVLARGEGRGSQ

SEQ ID NO: 8302 - protein, 436 aa, Streptomyces avermitilis
VEAPRALPHRELVVVGTRIDVRIRDGCQRPGQRVDVLLQRRGAWRPRGGRTPCRRVSRRRIRPRSRNTLWKHGRTHRSPTRLLRVPRPWVRLAQARRASAVRAAAGGGSVGRRPGDGPSGIAHRVKRSGHETVRRPAVPVSRRPGTGTHQGRHPRRHAPRDVTAAPCGDAPGGGRYGEAVFRPEEAGEGERIDFGALAYDGITMARLRALGVGPGWRCLDVGAGTGTVSRRLLAEAGVASVLAVDRDVRFLSARPVPGLDVLESDITAPDFAPGRFRLVHARFVLMHLPGHDRLITALAELVAPGGVLVLSDAIDLTSDRTPGTPYSAVMRAMWQGLRATIGTDVSWVPSYPHLLRGAGLVSVAAEVHVPPLLPGSPISHFWADTWERSRVAMLATGLVDDAAVDAALRYLGSDECAALSAGMLSAWGWKPEEGPR

SEQ ID NO: 8303 - protein, 101 aa, Streptomyces avermitilis
MFALGPREELKEHGADVTTLMPGATDSAFHARAGMNNTAFGSGMKKNSRKDVARQGFLALMDGRAEVVGGDAATKRTALKHRFLPETWKATQHARKAEPQP

SEQ ID NO: 8304 - protein, 265 aa, Streptomyces avermitilis
LLGATFLLSGADRLPPRAILSGLALAFAAGTAVLALPGLPVRAVFAVVLLQGLVASLGGGVRGGLLNEILPKDGYVLGRSVFNMLWGLVQMAGFATGGALLALLSPRTCLLLAAALYVMSALVTRLGLTARPPRFLGRPSLSATWRANALLWSSRPRRLTYLGLWVPNGLVVGSDSLYVSYAPQAAGTLYACGALGMFVGDMAVGRLVPPAVRSRLATPLRLLLAAPYLFFVLRPGVAMSAVAATVASVGFAASLVLQERLMAAS

SEQ ID NO: 8305 - protein, 69 aa, Streptomyces avermitilis
MSKQGPWAAPRLRRMRSYRTLFRAPEFAPFLLSFAAFAAAQTVGGLALATLVFRATGSPLLSAVSMFGP

SEQ ID NO: 8306 - protein, 78 aa, Streptomyces avermitilis
VLPEERDHRLHGRGERRLLAEEGGADADRDVRESCRRGAQDAAWVAVSAPPVAMTRKAMVIAAAVTSTAISAGTGSGT

SEQ ID NO: 8307 - protein, 690 aa, Streptomyces avermitilis
VVSVSVPHEPPRPYEVQPGGLPAAAADDGLAIALVDPAGRIGLWSSEAQTLTGHPPSEIIGRDVSVLADRATSHGSELVAQLVRAGDGVRTDWLRCFDGTCRSVRWRAVPVRLVAGTGLVAVASLGGQRIHQGDPAAVDLLLQSSPIGLAVLDKDLRYRFVNDALARLNGLPVAAHLGRCILDVLDLPDPQAYEDMLRRVADGGETIDSLHVAAIRADGTPYAAVGTLFPLRDADGHIVGQAGVVHDLGDARAELLDTARSQRRLELLSRISAALSQGLDVASVAAKLSAVCVPAFARTVNVDLLAGAVHRDPDLPTRTATERAGSAGPDASDGLRVHPLSTSAGSGHREPERDLPPPCAASAPVGECISSVAVVPFRVDEAQEQPHHGIAVPLLAAGQVLGAIAFTRPGGFDPDDVLTMRDIAARTAMAIDNALLYRRERLATLTLQRQLLPARLPDIPWAESAHRYLPAQNGTLAGGDWYDTVQLPGGRIGLTIGDVMGHGLGAAAAMGRYRSSARALLAVGLEPGQLLTRLDGLDDGADNDLPATCACAVYDGVTGDLRLALAGHPPPLLVRPDGSADILAADPGPPVGMGLDHVYEDAHHVVPAGSLLVLYTDGMIEDRSTFLDLEQGIAMLRRAVHNTEASLDEVCDALMAARPTNSADDATLFVTRLTRIQPVTVANRDAHLAN

SEQ ID NO: 8308 - protein, 129 aa, Streptomyces avermitilis
VAGYCARYGASLPGALVQRAAERGMTTLAPTGRDTVAGTVRFLFLTAAAAAGSRPVLGVDVARRPSRPAGPVCRTAAYARTRRRARDGAAPADHFARTELARTERGRVDLAVPLVSAAHAEADGALPVS

SEQ ID NO: 8309 - protein, 127 aa, Streptomyces avermitilis
MACRISELVIDVADPERLAAFWSKVLGYVELGREDDGSIQIGPPDAGFGGPQPTLVLSASSDPRPGKLPLHIDVNATDRDQDAELERLLALGARPADVGQTGAESWHVLADPEGNEFCLLRTRLQPL

SEQ ID NO: 8310 - protein, 281 aa, Streptomyces avermitilis
MSESAKVWLVTGASSGFGRAIAEAAVAAGDTVIGTARRTEALDDLVAAYPDRAEAISLDVTDGERIDVVAADVLARYGRVDVLVNNAGRTQVGAFEETTERELRDLFELHVFGPARLTRALLPQMRERGSGSVVNISSFGGQLSFAGFSAYSATKAALEQLSEGLADEVAPFGIKVLIVEPGAFRTNLFGKGAAYFSEENPAYAEKVGPTRQLVQGSDGSQPGDPAKAAAAIRLALDAEKTPLRLALGGDAVDFLTGHLDSVRAELTEWEKVSRGTDFDTE

SEQ ID NO: 8311 - protein, 304 aa, Streptomyces avermitilis
MNIHGRDLRYFTSVAEELSFTRAAERLFISQPALSKQIRMLEKQLGAVLFERDRRTVRLTAVGKALLPHAREVLAAWQAAEAAVEEVKTAERCTLVIGMSTSPGRGLLPALRTRLVSRHPDAQPVLRQVNWADPSAGLADGSSDVAFVWLPLPDDDRYQYAVVAREPRLVALPDGHPLAARAASDPEGKVDFTDLLEEPFLALPPEAGPLRDYWLALDARDGRQPRIGGVVASAEETHEAVASGQGVALLATGNASLVVRDEVIAVPVRGISPSQLAVAAGRDDTRPLVLAYLAAAREVGATTC

SEQ ID NO: 8312 - protein, 245 aa, Streptomyces avermitilis
VHPTSEPRLLDADEVRHFEEPFGTLMLELPPREPGFVLPTWKELTAVVEAARERDAGVHFDGTRLWERPRTWGVLLSPAVPGGVERALLGLERELPRLPEYVAHAEVVGKALGAAGVPWFRVNPEVPHTHRFQVWLSYDADVLADVAVRLAEETRVTLFHRWFPAPKRPPGLSVTEVAVAAEGLEWTERISTPVAFTWCSSLPTPPGINSCRVAEQPESHLCPERRRTLHWPTCCVHGFSRESGG

SEQ ID NO: 8313 - protein, 530 aa, Streptomyces avermitilis
VDVTVVGAGPVGLVLAAELALTGATVQVLERRAEPDEAMKAQSINMPTAEALDRRGLLPAAEKVQREMLERVGSFTRMVDDRTPGEGRRAPDSRFTGHFAGMVLDADLVDWSDPDLAAHTAADGARLVPQRELEELLADHVARLGVPVRRGVEVTTLEDTGDGVLVGTAAGAVRTGWLVGCDGGHSAVRRLAGIDFPGTDPELTGHLAVVDIADPEKLANGWAWSTRGAYRYGPQPGRVVTVEFDGPPADLPHARLRSRGGTPVAPVTLEELQTSLRRVSGTDVTLTALRGAATRWTDNARQAATYRSGRVLLAGDAAHVHPPFGGQGLNLGVGDAMNLGWKLGAVVAGWAPEGLLDTYDAERRPLGAWVLDWTRAQIGVLRGDAKSAALREVVGDLLSTRAGTTYAVKKISGVDQRIDLLGDHPLVGRFVPDLWLRDGSRLADHGHDGGFLLLDRTPEGAFARLAAAWDGRVSSVTDDHATPTGVLVRPDGVVAWASDTTGNAAVTGLEATLHRWTGAPSSSPEHEPVG

SEQ ID NO: 8314 - protein, 208 aa, Streptomyces avermitilis
VEQVIDTALGVIATEGYEALTMRRLAGALDTGPASLYAHVVNKADLDELLIGRLCAELVLPEPDPAAWREQIRGVCTQVRDQYLKYPGISRAALAMAPTDLETLRVSEGMLAILLAGGVAPQAAAWAIDALLLYVAAYCLEISIAKQRRVHDEADWVVDTDELQRRLAALPAETFPHTTRYAAELTAGESHDRFDFTLALMIDGLARR

SEQ ID NO: 8315 - protein, 163 aa, Streptomyces avermitilis
MKPLTEPEIRTAFVNCTKGEAKRLSVPRDLAERPWDDLDFLGWRDPQAPDRAYLATERDGRPVALALRCPSATSWQTRRSMCSMCMTTHTGGVSLMVAAKAGKAGQQGNSVGAYICSDLACSLYVRGKKDAGVGARLPESLTLDEKIQRTVANLAALIAKVTA

SEQ ID NO: 8316 - protein, 343 aa, Streptomyces avermitilis
VAEAQPSGVRLAFRTRATTIELDTLPTKRVYRGFPAPADGVYDLLVDGRLAAQATVADGNVRTIVDMVTQSTELREGPAGTARFTDLPAGGKDIEIWLPHTEITELIALRTDDPVEPAPDSGRRVWLHHGSSISHGSNAAHPTAIWPALAAAQGGVELVNLGFGGSALLDPFTARAMRDTPADLISLKIGINLVNTDAMRLRALTPAVHGFLDTIREGHPTTPLLVVSPILCPVQEDTPGPLAPDFDGGTLRFKATGDPAERAAGRLTLNVIRDELARIVEQRTADDPNLHYLDGRDLYGEKDYAEFPLPDEVHPDPSGHRRIGENFARLAFGDGGPFAAEAD

SEQ ID NO: 8317 - protein, 57 aa, Streptomyces avermitilis
MRSGTGCWAARSRRPDIARLSAFVRHHITMHGRYSLQLPDLPGGLRPLRDQDAPDDE

SEQ ID NO: 8318 - protein, 307 aa, Streptomyces avermitilis
MAIGVALNATDADNQIDATVRLAHEAAAAGLRSAWFGQTFGADSPQLAAVVGREVPGLHVGTSAIPVFGRHPLLVSSQAQTAQAATHGRYHLGLALGTKLLTEAGFGIPFERPIARLREFLTALRQLTETGAADFHGELLTAATPISARVPGAEGGVPLLVAAMGPQALRASGELADGILPYLAGPRALDEHIVPAVTAAAEAAGRPAPRIVAMVHGVVTDDADSVREKAVEQLAFYEQIPSYARVIELSGGQRAADVSVIGDERRVAAEVRRYRDAGATEVVFSGTEIAGDSDRRRTWALLGELAG

SEQ ID NO: 8319 - protein, 140 aa, Streptomyces avermitilis
MTQMPGTARCARAILVVVGTVNAATVAWLTAAAATLETGALGELVLGILLLAAIVSAALAIASFTIAAKFTHGSSKTRTGAAAVGWITILAGTIALLTDHPMGAAGAAAGTLLTALSTRTGTRDWFDRPRLPRPPRNANH

SEQ ID NO: 8320 - protein, 91 aa, Streptomyces avermitilis
VVVRHLLNRLLGQLHHCVMTTRQKYDEAIGFAPPVPPQLATTTVAGLDVTGACTRRPGRGRHRTCHREGRRGSRPAVMVRGSVTTGTDMPG

SEQ ID NO: 8321 - protein, 124 aa, Streptomyces avermitilis
MRTFTRKSIVVSHLSAKGMMRRDEAPTSRNRPPSLGPRRAGLLLLLLILLLVLLLLVLLLLILLLLILLLLILLLVLLLVLLLVLLLPCSGRRGPVILRRHTLRRRSLGLDLRGRLRGSRRLGH

SEQ ID NO: 8322 - protein, 182 aa, Streptomyces avermitilis
VPSDGVDSLPDSDDPDSDSLSDSLSGFDSLSGFDEDGLPGSDGFDDFDSLSGFDDLSGFDDSDSGDFDSLSDFDDSDSDFPPDSDGFDDFDSLSGFDDLSGFDDSDSGGFDSLPGSDDCDSLPDSGGRCTGGAVFLSCVPRSSPCSRVNQSPFSGPATTNFFTAWGAGATTTAPEGRYPGHA

SEQ ID NO: 8323 - protein, 161 aa, Streptomyces avermitilis
MAACGCCHCLRGCCSRHSGAMNADDRSLLAGARVATRLPAQDLERARRFYREQLGLEPVDERPGGLLYRCSGADFVVFQSTGSSPGTFTQMAWEVDDIEAVMTELRRRGVVFEEVDVPGFRTRGQVAEIEGNYPSKGARGERGAWFCDSEGNMLGIGEPVL

SEQ ID NO: 8324 - protein, 924 aa, Streptomyces avermitilis
MASRFARFRRLSSRSLVSRSPRSVAGQVLVLQVALVVLLVACGVLAVALQSKRDTDAEAKRRSVAVAQTFAHSPGVLAALQSPDPTKILQPLTEAGRKAAGVDFIVVMDTKGIRYTHPVPSRIGKRFVGNIGPSLEGKVYTESVNGPLGREVQATVPVENTNGKVVGLVSAGLKVKSVTNQVARQLPIILGAGAGALAVATGGTALMGRRLRRQTHSLAPDEMARMYEHHDAVLHSVREGVVIVAGDGRLVLANDEARRLLELPPDVEGRLVSELSSLDPDTLALLVSGREATDEVHFVGERLLAVNQRPTDRDGGPKGTVVTLRDSTELQAVTGRAEIAGERLKLLYDAGLGIGTTLDVLRTADELAQVAVPRFADFVTVDLADAVLHGEEPAPTATDLRRTAVCGIRDDHPLYELGQLIDFLPSTPQARGYGSGYSELVTDLSTATGWHAQDPERTKAIIDYGIHSLIAAPIQARGVVLGMANFWRSKQHEPFVEEEMSLAEELVARAAVSIDNARRYTREHALAVTLQRSLLPRALPEVSALDVGYRYLPAQSGVSGDWFDVIPLPGSRVALAVGDVVGHGLHAAATMGRLRTAVHNFSTLDLPPDELLSHVDDLVGRIDQDEAGTESAAGVVGATCLYTIYDPVTRRCVMASAGHLPPALVHPDGTVTFVDLPTGPPLGLGGMPFLTAELDLPEGAELVLYTDGLIEDRKRDLDVGMELLRDALAGHPDRPPEESCQAVLDELLPGRPKDDVALVIARTRGLPADRIADWDVPLDPAAVAGMRDAMSQKLDEWGLSELGFSMELVLSELITNAIRYGSEPIHVRLIRDRTLTCEVADGSSTSPHLRYAATMDEGGRGLFLVSQMSERWGTRYTPQGKVIWAEQALPEVIEEPGVASAATDAALSGEGAAGPEAWREDGSA

SEQ ID NO: 8325 - protein, 218 aa, Streptomyces avermitilis
MAIEAVPGTADLVHARIPDTTAAGMVILLNGTSSSGKTSMARALLDILDGTWFHMPVDAFHAMRCKRDISDEELQPEIDRTAKGFHRAVAGMAAGGNNLVVDYPLSRRWRLLDLLDLLVPEDTVLVGVRCPLPELERRESERGDRQPGLAAMQYGAVHSHELHDLDIDSSLHTPAECALRIRDFLPDRPRPTAFETLRRTLRRPHRPTAHTPAEAGPD

SEQ ID NO: 8326 - protein, 157 aa, Streptomyces avermitilis
MDARLNLFGNPVGAKFLRYINSAGKAVSDSTLPAATQELVKIRASQINGCGFCTDMHTKDATHAGETSTRLNLIAAWREATVFTDAERAALELTEQGTRIADAAGGVTDEAWANAAKHYDEDQLAALVSLIALINAYNRVNVIVQQPAGDYQPGQFG

SEQ ID NO: 8327 - protein, 479 aa, Streptomyces avermitilis
MSSTFRNYIDGAFADASDGRTLDVVDPTTGDVYATSPLSGAADVDAAMAAAAAAFPVWRDATPSVRQRTLLKIADAMEARADELVAAESRDTGKPLHLTRSEELAPAIDQVRFFAGAARMLEGRSAGEYMEGMTSIIRREPVGVCAQVAPWNYPLLMAVWKFAPALAAGNAVVLKPSDTTPASTVLIAEIIGGVLEELGLPRGIFNVVCGDRETGRLMVEHPTPAMASITGSVRAGIQVAQSAAKDVKRVHLELGGKAPAVVFEDADLAKAVEDLVVGGFFNAGQDCTAATRVLVHESVHDEFVAALAKAAADTKTGQPDDEDVLYGPLNNAGQLAQVSGFIERLPEHATIEAGGHRVGEKGYFYAPTVVSGLRQDDEIVQNEVFGPVMTVQSFTDEAQAVQYANGVDYALASSVWTKDHARAMRMSKNLDFGCVWINTHMALVAEMPHGGFKKSGYGKDLSAYGFEDYTRIKHVMTSL

SEQ ID NO: 8328 - protein, 133 aa, Streptomyces avermitilis
MSTTTVREIQDAADALVAAFAEGRLDDYFGAFAPDATFVFHTTPERLGSTAEYRALWQQWVEQDGFRILGCTSSAQLIQHFGDTAVFSHDVETRVATDAGEETVHERETIVFARADDGRWTAVHEHLSARTAA

SEQ ID NO: 8329 - protein, 511 aa, Streptomyces avermitilis
VTTSITEIETYGVERIPDEDRTARPIDLFRLAFGGANTFATCVLGAFPILFGLSFWQGLAATVLGLVAGALLLAPMALFGPANGTNNAVSSSAHLGVHGRVVGSFLSLLTAIAFFSISVWSSGDALVGGAHRLVDVPESDVTYGIAYAIFAGLVLAVCIYGFRFMLLVNKIAVLAASALFVLGAFAFAGDFDPGYAGAFASTADPLFWPSFIGAALIVLSNPVSFGAFLGDWSRYIPAGSPRRRVMGAAFLAQIATLLPFLFGLATASIIASKAAKYVDPAAPNYVGGLLAISPGWYFLPLCLIALIGGLSTGTTALYGTGLDFSSVFTRFSRVQATFFIGALSIAFIFVGRFALNLAQSISTFATLIITCTAPWMIVMALGYVTRRGWYDAEALQVFNRRQRGGRYWFTHGWNWRGMSTWLVSAVVALLFTNLPGQFVGPLGNLANGADISLPVGLALATVLYLALLALFPEPRAVYGPAGPRFVRASDAAVPPITGGTEEPVTEPAAAH

SEQ ID NO: 8330 - protein, 463 aa, Streptomyces avermitilis
VKAGSDGLGRSVSWAHASELADPTPWLLGAEVIMTTGLAVPRTAAGQRAYLERLDDAGVSALALSAQLHMPPLHDAFFRAAEERGFPVLEVPLAVPFIAVAQEVAASVQEDARHRLGAQLQVFGSLRWLVAENLDTPALLRRLEALSGYDVYLCTPQGRPLLPGVPTPDPGVLPASVDAPPTVPGGFVLPVPAPGGPAGFLVAYERQGAQPAGLAVVQHIATVAALRLAMVRNERETLRREGAETLAELLQEVLDPETARRRLARHAIEGDTVLLVVRHTTDEALLRCLEDHPHLLLTWGEDRYVLGAPELAVAVGELPVVAAGMSRPFLPGAALKVAQREALWAVSKAVESGRPVVRYGDDSTGRWLPDDPAVLTALVEHVLGEVLRYDETHDSQLLVSARTWMERDRRTETAAAALHIHPNTLAYRLRRFGTLAHRDLTSTGALAEVWLAIQAAGALGLTD

SEQ ID NO: 8331 - protein, 184 aa, Streptomyces avermitilis
MRVTAQRLRATSGPRDTATTPTSFSAADAGILLLRLAVGLLLAGHGAQKLFGIFGGPGLSATGKGFADMGYRPGDFFAGLAGASEFLGGLGLAVGLLTPLAAAAVVGVMINAMATTAPKGLWAEKGGLEYPLCLAVAAIAIAAVGPGLLSLDRPFRWRHGGWGPAAVALFLGGIGAAIVLALKA

SEQ ID NO: 8332 - protein, 467 aa, Streptomyces avermitilis
MHVTGTVPQSAPAPQETVAAPTPAEDSTGATSRHTRRFGLPVATALVMGNIIGGGIFLLPASVAPYGTVSLVAFGVLTVGAIALALVFGRLAERDPRTGGPYVYAREAFGDFAGFLAAWAYWITTWVSNAALAVAAVGYLDVLIPVNDHRWTACLAALTLQWLPALANFAGTRYVGAVQIVSTVLKFVPLLLVAVGGLFFFDPDNLGPFHASGGSVPGAVSACAALLLFSYLGVESAAVSAGEVKNARRNVGRATIIGTTGAALVYLLGTLSVFGTVAHDRLVQSTAPFSDAVNAMFGGTWGGWAVALAALVSMTGCLNGWTLLSAQTPYAAARDGLFPAAFARRRRGVPTVGVGVTVVLASLLTVYNYTSGSAKVFEILVLVTTFTATVPYLLATAAQIFHLLSGRRELVDRTRLVRDAVVTAVAAAFSMWLVAGAGYAAVYQGVLFLFAGVIVYAVLAARRQRAA

SEQ ID NO: 8333 - protein, 240 aa, Streptomyces avermitilis
MTSHLHALCFDANDPLRLARFWAGVLGWEMADDSYDGIALLPSDDTGFRIRFLSTREQKTGQNQMHFDLTSTSLDDQQQVVERSLGLGARHIDIGQRPEEGHVVLADPEGNEFCVIEPGNNFLADCGFIGALACDGSQDAGYFWSQALGWPLVWDQDQETAIRSPHGGPKITWGGPPLMPKTGKSRLHFDLAPPVQGDQQAEVDRLVSLGATRIDIGQGEVSWVVMADPDGHEFCVSTPR

SEQ ID NO: 8334 - protein, 205 aa, Streptomyces avermitilis
MAEMRAFRDAVSGWATGGPEGPASDLAVRLGVRTAVLLEGLSDLAAVEALAARRGRDLAAEGVCVVPMGGAMSVGRYAGLLGPPGLGLRLTGLCDEGEQRFYDRGLKRARAPRRGFFVCVTDLEDELIRALGTARVEEILRAEGDFRSWQTFMRQPAHHGRPRQQQLRRFLGTKRGRKIRYGRLLVEALDPEQVPAPLDDLLASL

SEQ ID NO: 8335 - protein, 127 aa, Streptomyces avermitilis
MAGLPFELDTEVALHLVDAFLSACGDPDARKFLSPLFSEVPRGGQTLCFRSAEEPAGGFSSWLITCAPDGVQVTRNLPTTSVADATVVAAPSDLLLVVKGRLRPEKPRMTVLGSRPLLDLWLSHAIA

SEQ ID NO: 8336 - protein, 196 aa, Streptomyces avermitilis
VAGLGLIPVILQALFLPRLPVTKAVTLRSLGVLLKSGRARVALVMTLLTITAQFAAYTFVAPFLQQQTGAGPTLISTLLLVFAAAGILGNFAAASALTKALRPTVPAVLALLAVSQLLMPLFGTWTVGAFLVLALWGLAYGAVPVALQTWLFHAGGPAGRGARGGGPRRAGLGAARKAEQGVLVALGALRGGRTPG

SEQ ID NO: 8337 - protein, 104 aa, Streptomyces avermitilis
VRTAVEAGLGEQLALPVEDAEQPLAPDYSAMLGARALLGIGIGGFWAIAVGVGTRLVPEQLAPRATALIFGGISIGHRRGRTRGPAPGPPVRLARPSSSWPGSA

SEQ ID NO: 8338 - protein, 92 aa, Streptomyces avermitilis
MTASAEVRPGSPVEGAADRYRLWVRTMFTDLAREAGVADAEGLARQLHLLYDGAGISARMDRDPSAATTARAAAAALFDAAVKDKELVDAGQ

SEQ ID NO: 8339 - protein, 484 aa, Streptomyces avermitilis
MSKVLTSLPAGERVGIAFSGGLDTSVAVAWMRDKGAVPCTYTADIGQYDEPDIASVPGRAKTYGAEIARLVDCRAALVEEGLAALTCGAFHIRSGGRAYFNTTPLGRAVTGTLLVRAMLEDDVQIWGDGSTFKGNDIERFYRYGLLANPHLRIYKPWLDADFVTELGGRKEMSEWLLAHDLPYRDSTEKAYSTDANIWGATHEAKTLEHLDTGVETVEPIMGVRFWDPAVEIATEDVTIGFDQGRPVTINGKELASPVDLVMEANAIGGRHGMGMSDQIENRIIEAKSRGIYEAPGMALLHAAYERLVNAIHNEDTLAQYHNEGRRLGRLMYEGRWLDPQALMVRESLQRWVGAAVTGEVTLRLRRGEDYSILDTTGPAFSYHPDKLSMERTEDSAFGPVDRIGQLTMRNLDIADSRVKLEQYAGLGLIGTGSPAIGAAQAAATGLIGTMPQMPEGSAEAIASRGEVSGDDEMLDRAAMEFGTD

SEQ ID NO: 8340 - protein, 284 aa, Streptomyces avermitilis
MRMRTLLTSLATATAVTGGLALAAPAAPASPVPTAAGVANTPSGQGSTNVVASPMADPSVAPGGNFDLSVWQLQEPVGSPGSPTTIPSSRLQGANGFQDAYFYTDTRDGAMTFWAPEKGVTTPNSNYARSELREMNRNGTAANWSLSGTHQMKATLRVVSVTSNVCVGQIHLGTGGSSTKPLLELYYRSSGDIVLGTENSPSGGQTLHTVGHVSVGKTWNYTIGVSGGHTIDLTVNGSTTHYAIPSSFDAYKQYFKAGSYNQSSSDSTTKGARVAFYGLTVSHS

SEQ ID NO: 8341 - protein, 556 aa, Streptomyces avermitilis
MQHERAGTSAGPEDLIDVAKLVTAYYALHPDPAEPGQRVAFGTSGHRGSSLATAFNEDHIAATSQAICEYRDSQGTNGPLFLGADTHALSEPARVTALEVFAANGVTVLIDSDDGYTPTPAVSHAILTYNRGRASGLADGVVVTPSHNPPADGGFKYNPPSGGPAGSEATSWIQDRANEIITGGLKDVRRVPYTQALAAPGTGRYDFLGTYVADLPSVLDLDAIRAAGVRIGADPLGGASVAYWGRIAEQHGLDLTVVNPLTDPTWRFMTLDWDGKIRMDCSSPYAMASLIEQRDRYRIATGNDADADRHGIVTPDAGLMNPNHYLATAISYLYSHRERWPAGAGVGKTLVSSGMIDRVAADLGRRLVEVPVGFKWFVDGLADGSLGFGGEESAGASFLRRDGSVWTTDKDGILLALLASEITAVTDKTPSEHYAALTARFGEPAYARIDAPASREEKALLAKLSPAQVGADTLAGEPVTAVLTRAPGNDAPIGGIKVTTDNAWFAARPSGTEDVYKIYAESFLGPDHLSQVQQEAKLVVDAALGADAPGAGSDMA

SEQ ID NO: 8342 - protein, 83 aa, Streptomyces avermitilis
MSKFKKAAAVAVMVGGMALGGGVAHGDNNQTIGNSCTVIGPDAGDGHRYGGQADVIIGNLQAVQCNQDFDGGAVFAPIQGLST

SEQ ID NO: 8343 - protein, 42 aa, Streptomyces avermitilis
VRPKREARPPAPRQGARPGAQVPGCPRCPGHGSRKCRNCNAK

SEQ ID NO: 8344 - protein, 580 aa, Streptomyces avermitilis
MRPAHALKEGHMDDMDYYDLGTHSRSVTTSSPEAQLWFDRGLVWSYAFHHEEAVACFEAAATADPGCAMAYWGIAYALGPNYNKPWEFFDEQDLVRTVERTHAAVELAHAKAAGATPAERALIGALRARYPQAEAVEDCSVWNGPYADSMRTVHELAPDDLDVTTLYADALMNLTPWQLWDLPTGEPAEGARTVEARAVLERALATDAGRRHPGILHMYIHLMEMSPAPEAALPAADRLRDLVPDAGHLQHMPSHLEVLCGDYRGVVADNSRAIAADEKVLARSGAMNFYTLYRSHNYHFKIYGAMFLGRSQVALETAARLESSISEELLRVESPPMADWLEAFLAMRVHVLIRFGRWADILRLPMPADPQLYSMTTAMLRYARGVALSATGRVAEAEAERTLFHAAVARVPETRMLFNNTCADILAIASAMLDGELEYRRGNFDAAFAALLRSIELDDNLPYDEPWGWMQPTRHAYGALLLERGRVAEAEAVYRADLGLDDTLPRASQHPGNVWALHGFHECLVRLGKTGEAQIVAQQLRIAAAQADVPIEASCFCRLEAVSGSGEADGCCATEAGRGQ

SEQ ID NO: 8345 - protein, 79 aa, Streptomyces avermitilis
MADLSQLLQQGMRRRHLTAQALAERTGIRTPRIRVFAQDGARGPVHPTEAELAELAAALALPLPEVLDAARTPAEASQV

SEQ ID NO: 8346 - protein, 439 aa, Streptomyces avermitilis
VTEDRLCARTGAAGGPTDDAERTGTEPVTPQIDYEALFSAVPTPYLVLGPDLIILDVNDAYLRVAGWSRQDLVGRYLFDAFPDNPADPGADGVRNLDLSLHRVLRSKEPDTMTVQKYDIPVAGQAGVFEERWWSPVNIPVLAPDGQVVWIIHQVEDVTAFVVPHTDRPQADGEALSGREAVEELYARARELQRLNEELREAHARERQVAVTLQEAMLRSPDLARHRDVAVRYLPAVGSLNVCGDWYDVVDLPDGRIGVAVGDVVGHGLEAAAVMGMLRSALSASVRAVDGPAQALEVLGLYARSVEGALVTTVAQAVIDTINHRIIYSSAGHLPPVLLHPDGTCDLLNRATDPPLGARLEHVPRPEADLPYTQGDTLVLYTDGLIERRGEDIDTGLHRLTEALARHRRLSPERLADALLARLDVAGGARDDIALILVRL

SEQ ID NO: 8347 - protein, 175 aa, Streptomyces avermitilis
VFVLREVFGFDYDDIAVAVGKSRVTVRQVAHRARKHVRARRKRFEPVGAAKAARITEPFMTAAATGDLEGLLSLLAPDVTWTADSGGKTTAARRPVVGAEKVAAVLMSIFRMGRLTDPRIKVVNCNNTPAMVIYSGDHPEGVFLVEIIDGRITSIYAVRNPDKLVAVAVPRRISR

SEQ ID NO: 8348 - protein, 376 aa, Streptomyces avermitilis
VTALAHASGLRSLVNPRPKFVERIRLHQFVARSGDATIDYGTLLGGGQLVVDSATRIDTAARTVRLASGRALDYDYVIYAVGSTAATPSMVPGAVEFALPIAEFESAQRLRARLEEVPRDAPVTVVGGGLTGIETAAELAEQGRTVTLVCGRTLAPSLSAPGRRYVAKWLTRHGVAVLEAGVVTEVRPDAVVLADGSADGAVRPSALTVWAAGFGVPELAAASGLRTDPLGRLLTDETLTSVDDARIVAADDAAAPSGRPLRMSGYAAGPLGAQAANTVLSPIAGTEPTVIDLAFTGACVSLGRRAAIRQLARKDDTAVNVYIGGRMGAALKEVTCKFVVPKRIRREARKPGSIGWPKGGPRPERPTSASQEVTSP

SEQ ID NO: 8349 - protein, 131 aa, Streptomyces avermitilis
MGAVRSSRRAKEGNSVVSEEIWGYHPASGYQTGTDLIGFKVEATDGSIGKIDKHSDDVGAAHLVVDTGAWIFGKHVLLPAGTITRIDTAERKVYVDRTKDEIKDAPEFDRDKHTGDPGYLEQFGKYYGQHM

SEQ ID NO: 8350 - protein, 69 aa, Streptomyces avermitilis
MSAAGESGNRAQQMREKAQKLTEAAERTTDPQERQKLQEQARGLQEQSKQQGQPGQSRSKGTAGGGRNQ

SEQ ID NO: 8351 - protein, 118 aa, Streptomyces avermitilis
MIHAADVREWRNRDVVDTEGHKIGVLEAVYVDTTTDEPAMATVRTGLPTRHRLTFVPLEDAIAGPGYLKVGYVRALVKQAPSIGTDDVLPADQEEAIFKHYGLPYEPGAAGERQLARR

SEQ ID NO: 8352 - protein, 92 aa, Streptomyces avermitilis
VFVLLLILIVVLFGLGFLSPLWWVAAAVLVFGATRYGRGGGGGWISGDGSDLGEYRDYENRRDRQDRWDRRYSRQHRARWTREDRRDRERRG

SEQ ID NO: 8353 - protein, 59 aa, Streptomyces avermitilis
MVWILLLLLILVVFGFGFTMQALWWVAAVLLVVWIVGVAMRGRGGGGRGVGRRYGHSRR

SEQ ID NO: 8354 - protein, 57 aa, Streptomyces avermitilis
MSVGQTIKHKTQAFKGRVTERIGRTTRNRRLQREGRTDQISGNLKQSGDKAKDAFKR

SEQ ID NO: 8355 - protein, 94 aa, Streptomyces avermitilis
MYAAVRRYEGVTDPAEAARLVNEGFVGLMREVPGFVAYYWVDAGNGVMVSTSVFQDRAGAEESISRASDFVRDNLASLLPNPPQVMAGAVVASA

SEQ ID NO: 8356 - protein, 358 aa, Streptomyces avermitilis
MDHPDPRHRARRATYGSVSTHLSLLSDHRLGEVVAAATPLGSGIGGRSAELEVGGTRVFVKRVPLTDIEMRPKNVRSTANLFGLPMFYQYGVGSAGFGTWRELAVHTMTTNWVLGNEYEGFPLMYHWRVLPDIPPQGFADIFGGIDGAVAHWEGSSAVRERLEAIGRSTFSLVIFLEHVPQTLAAWLGDQRGAASEGEDSQGYAWAEEALTRGAAFMSSRGLVHFDAHFHNVLTDGRLIYFADFGLALSSGFELSQDEAEFLTDHLAYDGCYIANHLLRHHLPDGVRGKVEHEAFLHNWIAGERSEGVPPAIAAIIDRHARAAVVLDGFHHRLLNVSKRTPYPAADIERARPGGRSAG

SEQ ID NO: 8357 - protein, 407 aa, Streptomyces avermitilis
MTTAVALVVTLAVGSGTAASAASSSGPIPSAAHGAVRFDLPEPTGRQAVGTTELHLVDRDRPDPWVADRDRELMVSIWYPARSTSGYSRQPYMQPGAARFVDESGSFGLARPGEVDWAATRTDAASMAPADDRSRRPIVLYSPGLGIPRALGTSTAVELASRGYVVVTVDHTHETTPVEFPDGRVELQKEPMAGAETVKKAVDTRVRDTRFVLDQLAVLRAGRNPDAEERRLPRGLGRALDLDRVGMYGHSAGGVTAAETMRVDRRIDAGIDMDGTLQYNSTEFLPVALEGLDRPFMLMGKASQTHLNKPSWQSFWDRSTSWKRDLSLERGGHFSYTDAQTIVPAVDERLDIPAQTREQFIGTVDPERSTAAQRAYVTAFFDQHLLGRPRHLLDRPSPTHPEVRFVR

SEQ ID NO: 8358 - protein, 96 aa, Streptomyces avermitilis
MVPHCAEHPFQFAYSRGGFEQTYFNVGRRRESRRAGGRADLLVRELLDARIVGRDTPEYDADPGFNADGAHTVRIIADHFGLPSPPLDLGPVDSST

SEQ ID NO: 8359 - protein, 142 aa, Streptomyces avermitilis
MSPRWEPDPDIRRGNHVVFNLHAHLVFVTKYRREIFNGEMLTRCEAIMSDVCESFGAELREFNGEGDHVHLLVHYPPKIALSRLVNSLKGVSSRYLRAEYTGRINRIGTGSVFWSPSYFAGSCGGAPLDIVKDYIENQKRPA

SEQ ID NO: 8360 - protein, 404 aa, Streptomyces avermitilis
MIRAYKFLLRPTVRQAQALAEMLRDHCSLYNAALQERRDAWRHPSKTTVKYGGQSAQLKDIRAFDPERQGRWSFSSQQATLRRLDKAFAAFFRRVKSGETPGYPRFRGVNWFDTVDFPKDGDGCRWNSTPHDPATRVRLQGVGHVKVNQHRPVAGRVKTVSVKREGRKWFVVLTAEQDQPEPLPATGSAAGIDLGIANFLADSGGGFVPNPRHGRRAADKLQAAQQALARFPRRKAKDRTANHRRAVGKVAQLHGKVRRQRLDHAHKTALGLVRAHDFIAHEDLRIRNMSKAPAPKPDPDKPGTFLPNGAAAKAGLNKSINDAGWGVFLTILHAKAESAGREVIAVDPRDTSRTCPECGHTAKENRPTQEKFHCVACGHHAHADTVAATNVLRAGLVRRNANPA

SEQ ID NO: 8361 - protein, 181 aa, Streptomyces avermitilis
MTNWIQGPFPGHEVNVVFARGIPLDTLTRGLRDRLREPLVYGEANGWAWAVHDMHNWDAEDYDDVDYSGMCPEGAEIVVFVTEPCSAKAFPPAFEYHRDGRAILCFSFEDIQQRVGENPDYLSAELLAANLIGPTAECGQQGDDGHDCFDHHYDDHERLVTVIADCFALPAPPLSAEVTAK

SEQ ID NO: 8362 - protein, 90 aa, Streptomyces avermitilis
MLRKGPFSGTRLSGASNWIHRPGRSPGSVNHSASKSMRRITCCKCRSRERSGSLDGSRSTPPMGVATLIVPWRPKRRGSGTNCLSFASER

SEQ ID NO: 8363 - protein, 299 aa, Streptomyces avermitilis
LATGRTADTRPAIDAALVRRLVETQFPQWAELSLELLDPAGSDHVIYRLGEELSVRLPRHAGAAGQARKEAEWLPRLAPHLPLAIPVPAGVGEPDLDYPWPWAVSRWLDGEVATAEALADSSEAAVELAQFLTALQRFAPEDVPAEGALKNVAVRPLADRDRATRAAIAKVDDVFDTAAMTELWDAALSAPGWGRPPVWFHGDFHTGNLLTFDGRLSAVIDFGELGIGDPARDLTIAFTLMSARSRAAFRAALDVDDATWARGRGWALATGLNAYTTYAAVNPRVAAQTTRQITEALIG

SEQ ID NO: 8364 - protein, 67 aa, Streptomyces avermitilis
MATGTVKWFNAEKGFGFIEQEGGGPDVFVHYSAINSAGFRELQEGQKVNFDVTQGPKGPQAENVTPA

SEQ ID NO: 8365 - protein, 339 aa, Streptomyces avermitilis
MKFTNDLYIASAASWLPDVVSVDEAIAAGLVDDEHRNLGYESIAVADGVAGPEMAVRAGRLALERAVGIERDEVGLVLHSSCGFQGHEMWPAAAYVANETVGPAAPGFDLQQRCNAGLGSLCLAAGYVDAGFTSAVLLTTGDNFAPPWVDRWNVQLNFIFADGGTALVLSGRQGFARVVSATLGADNSLERWNRGTAPFATAPGLEMPLPLRERGLQHAVTPEAEGSWERYEAALMDTTRRALSEAQVGVEDISRVVMPLIHRGVSPENYELLGFTEKQSTWDLGRLVGHVAAGDQFLGLEHLVKQGTVGPGDLVLLVAAGEGFSYSAAVVEILDVPSW

SEQ ID NO: 8366 - protein, 1030 aa, Streptomyces avermitilis
MSALRVTSPSVEYVQRPLGLDAAHPRLSWPMASAAPGRRQSAYQVRVASSAAGLSHPDVWDSGKVVSDDSVLVPYAGPPLKPRTRYFWSVRVWDADGGASEWSAPSWWETGLMGASQWSAKWISAPAPLTEAPSLEGSSWIWFPEGEPANSAPAATRWFRRTVDLPDDITGATLAISADNVYAVSVDGAEVARTDLEADNEGWRRPAVIDVLDHVHSGNNTLAVSASNASVGPAGWICVLVLTTASGEKKIFSDASWKSTDHEPADGWREPDFDDSGWPAAKVAAAWGAGPWGRVAPVASAANQLRHEFRLPHKKVSRARLYATALGLYEAHLNGRRVGRDQLAPGWTDYRKRVQYQTYDVTSSVRPGANALAAYVAPGWYAGNVGMFGPHQYGERPALLAQLEVEYADGTSERITSGPDWRAASGPIVSADLLSGETYDARKETAGWTSPGFDDRAWLAVRGADNDVPEQIVAQVDGPVRIAKELPARKVTEPKPGVFVLDLGQNMVGSVRLRVSGDAGTTVRLRHAEVLNPDGTIYTANLRSAAATDTYTLKGQGEETYEPRFTFHGFRYVEVTGFPGKPSTTSVTGRVMHTSAPFTFEFETNVPMLNKLHSNITWGQRGNFLSVPTDTPARDERLGWTGDINVFAPTAAYTMESARFLTKWLVDLRDAQTSDGAFTDVAPAVGNLGNGVAGWGDAGVTVPWALYQAYGDRQVLADALPSVHAWLRYLEKHSDGLLRPADGYGDWLNVSDETPKDVIATAYFAHSADLAARMATELGKDAAPYTDLFTRIRKAFQTAYVASDGKVKGDTQSAYVLTLSMNLVPDALRKAAADRLVALIEAKDWHLSTGFLGTPRLLPVLTDTGHTDVAYRLLHQRTFPSWGYPIDKGSTTMWERWDSIQPDGGFQTPEMNSFNHYAYGSVGEWMYANIAGIAPGRAGYRQVVIRPRPGGEVTSARATFASLHGPVSTRWQQRSGGFVLTCSVPPNTTAEVWIPADHPDRVQHTHGTFVRAEDGCAVFEVGSGSHRFTV

SEQ ID NO: 8367 - protein, 125 aa, Streptomyces avermitilis
MHFYVDVSWLLDVQEAALGREDMSVSDYSALVAAIARHKTKLPTLAAADPDAAWRAAALMHTIVRLEPLPHRNSLFAAFIAAQYMDQSGEGIDPPYGALSDLVSKIRDTRLGILAVADQLRTWKV

SEQ ID NO: 8368 - protein, 74 aa, Streptomyces avermitilis
VSFTDEELEGVRAAAAAEGKSLKQYLHDLGVREMQRKQFVAGATAWADRLRREFDDAFADEVPPSERRDGAAAA

SEQ ID NO: 8369 - protein, 348 aa, Streptomyces avermitilis
VTGRSQGQRPTLEDVARQSGVSRSTVSRLINGSPRVSPAVAERVRTAVAELGYVPNQAARSLVTRRNDAIAVVVTEPQNRLFVDPFFDRHLRGIRQELVRQGAQLVLLLIEEPDDYPRVGNFLGGGHVDGALLFSLRGDDPLPEMVDRMGLPAVFGGRPVLSPEDRGHRYTYVDADNRGGAREAVRHLVAQGRERIATITGPLNQAAAVDRLDGYRDVLPDSAPDLIVEGDFTLRGGVDAMAELLARCPDLDAVFAASDLMACGALRVLKEHGRRVPEDVAVIGFDDLPPLVETTEPSLTTVHQDIEGMGRLMARLLFERIPATPLDDGDHSLHRVITPTRLILRKTA

SEQ ID NO: 8370 - protein, 344 aa, Streptomyces avermitilis
VMRVGIIGAGNIGHMHAEAVAACENTLLTGVFDLDRERAQSLARASGTVAFASPDELYKASDGVVVASPNRTHADYAREAVAYGRSVLCEKPMAVSLLQAADMRALAAVAPGVCAVGFNYRYLNVIREARNRIGEGMLGRVVHVDVAFKRASALTRQHFTWRDSAAEGHTSGALGDLGVHLIDMLHHLFRSPVDLASCQVALRTKVAAKGGHAVEVDDHAFVSGRIEGGPSFTLTASKASQPEETGFTLAAMGSRGDLSHDSQDGPVLHLRTGIDWEQVKLLGPSRLDDPRGEVTGWGDSFLDQLHDWAGAVTASQRSGTLADFEDGYQAQQVLQELLRIGGRM

SEQ ID NO: 8371 - protein, 283 aa, Streptomyces avermitilis
MPHSVPPLTDIGPLPTASTVRTVVFSDFDETYLAHSGTPEQVRSRQALENYLEDAGERHGLLFGWVTGSSLSSVLGKARRHGLRFLPHFIACSLGTELHVISEAGIQPEPGWQRRMLTTGEHLEGLAEEAFRELRTRGVPLVPQSCRAPGSRVISYYYFAQDPERDARQLALIRRTADRLSLGVNLSRCNPAAGDPDDCYDVDFLPRDCGKRHIVEYICRLYAVSEADAFAFGDSGNDLEMLTAVGRGLLVGNCTEEARARYPQVSARSHADAILSELRGVLP

SEQ ID NO: 8372 - protein, 449 aa, Streptomyces avermitilis
MTTFLNDSFTGDSTSIHRLVGEVRRHEVPVYRCSRSLANRALSDSLAEDVGRLDPSGPDSVFAVDPRRAAGDPVPFLPKSRLWTRDEQRIAVEHFARVVADGELTSGSAIGEFEDALAEFLAVPHAVATSSGTDALIIALRAVGVSHGDEVIMPANSFAATENAVWACGATPVLVDIDPVRHTLDPALVETAITPRTRAILPVHLYGRFADVPGLAEIARRHGLGLVEDACQAIGVTGVGQHSDAAALSFNPYKNFGLTGKAGAVVTRDAEVGVSARRFAYHGFDPERKNVKEDAFGLNAKIDNSTAAVALGLLPRLTLNSYRRAFLAKRYLDALEELAADGTAVLPAFTPDHAWHLFGVQVAAGREARDAIQARMRTADAVETDIYYPVLTHRQQTPLHRKHFAHVALPLTEQVHARVLHLPLHNNLSLSEQDRVIEALHAAFRATAH

SEQ ID NO: 8373 - protein, 381 aa, Streptomyces avermitilis
VKVSLVIPTYNSKDLVAPCLVSLNHQRLDEADEFEVVLVDDGSTDGTGEVVDSLPLTYRIRRVYVPRTEKSCRSAARNAGIRAADGELIVFVDGDQIIDPLFVQEHIRCHRGRPAIVAIGFRDYQAPGAVDLALLERSFTPEAFPPVADQDERAQVTATLSQNMGNLATGWHFFYGCNVSVRKEHLLAVGGFDENIQKWSFEDVELGYRLHRRGLAFVHNLYSRVYHQFHPESDQERYADWRENFEYFTSKHPELEVRLQWVLDSYFDPGRTSRPSWFDAYLRFEFACRAVAERLPIGHSYEVLVVDADNLDSAEREIARVGAAHDLIVVDITDDRELPTAVQAMRTGRELLYFKEPSPELLQQAAKSFGCAALLKYAAEV

SEQ ID NO: 8374 - protein, 491 aa, Streptomyces avermitilis
VGRARVARRRRWNRNPLDSQGENHCGGSGGAERNVIVPPKVNLGVFSLSWPIFLQLTFTYCMGLVDTWALGRISDAAAASVGSVNTVTTFVLMMFSFLGQGGSLVYARMLGQGKHRKVQECYSVALLLHILLGVVASAVLLIWAREMAQLLGLRGPLLSYGTTFLQVVGGSCALHSLVAMFGGVMAANGFTRAGMFAAVLTNIVNIVLIYLLVLLPAGPRWGVRGIALSTALATAAGLLFSAWLVFFRIRIRFRRPPSAERLREHGALLMAFALPTMLEPAFWQAAQITTTRIIAAVGPDELAARMYTLSITNMIGMFGSALSQGLQIAVGHLAGAGELDRIRRITRTTRLVGVGVALTLALLAGLSGGWIMDQFTDSPEVAESGRLLLWCGLLYLPGSSLIMTTASTLRAVGHVTYPAAVGILVLWGVFIPLAYALSLPLGLAIIGVMIAMAIDENLRALLLSIRWRHISAPQRAHRIVGKPKSAPVAGS

SEQ ID NO: 8375 - protein, 117 aa, Streptomyces avermitilis
VTTPRRHADHLPASGVPDARVFREAMSRLAAAVTIVTAQDEAGGYWGFTATSVTSASSCRSVTAHSRFPEGKNHGAPSPANSECARIPARLSAKYGSGSLLALLSQANEFAVVPAPG

SEQ ID NO: 8376 - protein, 411 aa, Streptomyces avermitilis
VIDLADLDLFTDGDPHEAWRVLRRDRPVHWNATGGDTASGVGPSGFWALTRYQDVHDAYVDAGLFSSRWGTVMGGSHRRDADSASGRMLIASDDPQHRLMRQQVHRAFLPALMDRARRVVRDYVNAALDRVLKDGGGDFATDVAPELPAGLLAAMFGLERRDALHLLALTRSMIGFQDPRYHSDSTPPAVLVSSQVEIFDVMMDLMETRRRAPSDDLVSILLGASINGRRFTEDEVLYNCLNVAVGGNETTPFTASAAVQAFMDFPDQAQRLLDDGGLLPTAVEEIFRWTSTNAYVQRVATRDVELHGQLIRAGDPVTLWNASANRDEEKFPNPDRFDVRRTPNRHIAFGVGVHRCIGMGAAQMEIALLLKEIVRRGITFEPAGPPARLRSNFMLGLTCLPVHATVAQDAS

SEQ ID NO: 8377 - protein, 602 aa, Streptomyces avermitilis
VPSTLSELFERTALRHPTAVAVSDGDARLTYRELEEATRASARELIARGVSPGDTVAVHMPRGVPVVVAVLAILRAGAAYLPIDEVYPAQRRDQMLRDGAVTHVLVAPGWVERMAQTGLSVLEWPSTPSGPAADGSCGDVDGRAAVPPASLAPSQPAGAACVLFTSGSTGTPRAVVLEHRQMVDFALADTLPLLRPGDRTAQSSSISFDTFTFEVWRSFAGGAEVVVVPGIPELMETDLGKELRRRRITAMLAPAIALNHLARHDREALSGLRLLCSGGDVLLPATCRALREGGFTGELFNLYGPTEATVACSGFPVIDIALLGEQVPIGHSFGRARLHVLDERLRPVPAGVPGDLYVGGPGVGRGYLGRPGLTARRFVADPFAGDGTRMYATGDRVRSGEDGALEYLGRTDSQVKIRGHRVEPQEVERALCRYEAVSEAAVLSDGEPGEKRLVAFVVVGRENFLLRELRGHLRATVPAHLVPAEIIVLDAMPTDAHGKRDRHRLADMLGDHASRRNRYVAPRTDTERFLATIWEDLLNVESVGVLDDFFTLGGHSLLAVRVRLLLRRQLDVPVTPEALFEHSVLEEQARLIDGLRKEALTP

SEQ ID NO: 8378 - protein, 267 aa, Streptomyces avermitilis
MQSTGRWLLRPPSPEARARLFCLPYSGTGASSYRRWPTRIGPLEVCPVQLPGRENRIRHTPFRTVPEFAAETAEALTPHLDRPYVLFGHCMGALLAHALATRIEDLGLPRATLLVVSSAAAPHLHAQRRYRAPEPGVSGIYHPSMTDEEFADELNHVSQALGGGEILPELLPLALRVLRADVELCYGYRIPAPRPVHSPLTAIGWTADPEVSPETMHQWNAYGNTRHRVLEGGKLSYLAAPTALTRVLEDEFADALSGATTTTGGAP

SEQ ID NO: 8379 - protein, 245 aa, Streptomyces avermitilis
VIDLFHCFGAKPAHRVDTSLAAEMLRASGCRHLAVNTHTIDQVTAGDDLPVGYDTATLGSVMALVGEELALSPVLNINHPTSAAEAVKRTRQAAQLTGIRVIKLEVLDPGFKLSVNAEVVEAARELTADGFEVWPLITPDARTFAQCVELGSTMVRVMGSPIGARRGIEPQHLEPMGEMLVDSPVPVMLDGGIGSTADVEQAFALGFQSVLVNSCLFADGTDPVTALAGFRATVDRVASGTPAAH

SEQ ID NO: 8380 - protein, 303 aa, Streptomyces avermitilis
MDGLWQERDLPFGSNSVQHGTAVFEGIRMYTTPAGPVLFRLDAHLERLLDSAALLGIPHAYDLAALRRHVRDAAAGSGLDNAYVRPVLYTREPRLGVNLRDFHFTLGTEIWALPPDDTPSRPVRVTVSPWRRPSQLTFPVRAKATGTYVVSALARTRAAADGFDDAIQLDPNSGRVAESTIANVFLVRDGRLVTPWLEDSVLAGITRDTVLTLAGDLGIETAEAPVQPGELLAADEVFLTGTASGLVSVAGLDTHTYAAGRPVTDALSRAYREAVLGDGPHRPSWLTPVSRPTPSTSRLRGVS

SEQ ID NO: 8381 - protein, 231 aa, Streptomyces avermitilis
VGGGRGAYSRMVAELREHGHCHLPALAGRDSRFAETAAARFTDLADDLWNQLEAELGLGRSPDRLVLFGFSMGALIATEMAARLQQRGTGAGGLVVAGCPPPHLLAGRAVHTLPDEELTAALAAQGTVPSMVLDDPELLSVMVPVWRADCAAVASHPRRPVVLDCPVHALGGTEDPLAREADVTVWPRLGGAGSSVRLLPGDHAAVLDRQDLMAAAVLAAADRPSEVGARW

SEQ ID NO: 8382 - protein, 429 aa, Streptomyces avermitilis
MTTDTPRSSLDALGPERRRLAERLLRERTRANGTATPETTTPHTVATPDRAVPVAGPAPEAGAPAAGIPSNGAESTPRVSLFFFSADTDDHAWDKHALVLECAELADSLGLDAIWVPERHFDPFGAPYPSPGLLLAAIAARTSRIALRSGSVVLPLRDPLLVAEEWGVLDSLSRGRMGISLASGWHADDFVLNPEGYERRKDVLEERLADLHTLWNGASITRKGPGGRPVEVRTYPRPERTPEVWLTSSRNPDTWRTAGRLNLHVLTALLEQTIDEITERVGLYHQALTEAGHPTDGRQVTCMLHTHLASDPASVEQRVRGPLIRYLSAHMDLFSKYAAGGGAGIDPDEVTEADRQALLEHGLRRYMGTSGLFGSAESCLPKVERLGAAGITELGCLVDFGLPREQVLESVEELGRLRVALRETAGAPK

SEQ ID NO: 8383 - protein, 1052 aa, Streptomyces avermitilis
MARRHPGSCDSEGRSVTRIPAHEHPDSIAITGMAARLPGAHNVTEYWRNLREGVESIVRHSREEMLANGARRDLVDDPYYVNASAPLEDADRFDAAFFGYAAREASIMEPQHRVFLECAYHALEDAAYDSRRDDALVGVFGGSTMNTYILHNVMPHAEDVVGLVGDLQTMVGNDKDYLTTRVSHKLDLRGPSLAVQTACSTSLVAVHMACRALVDDECDIALAGGASVRMPHAAGYLANPGGTSSPDGHCRAFDADAGGSVVGSGVGVVVLKRLADALRDGDQIHAVIRGSAINNDGQAKASFTAPSVDGQSRAVARALRRAGVDARDIQMVEAHGTGTPLGDPIEVAALTRAFRDWTEDTSYCWLGSAKPNIGHLDAAAGIAGLIKTVLSLKNRKVPPVVNFRRPNPKLALDSSPFRVATELTRLEGDEPLLASVNSLAMGGTNAHVVLEEAPPVRSGGASRRRRHPVLLSAKSGEALEDLSQSLGQWARENPHADVADVAHTLATGRRELPLRRALTAHDLDDVAYGLSTRGSRSQREAQARGSVRTAFLFPGQGTQLPAMGARLAQGDPVFAAHLDRVIGLFQERAGVDLLPVLRPDASTLEEARTTLTATEYTQPALFAVEWALGRTLMDYGVRPYAMLGHSVGELVAATLGGVLDLAPAVELVARRGRLMSETPEGAMLYVNLAEEEAAKLLDDVPGDLTLAAVNADQLVVVSGAPQEVEELAARLRADGVSCGRLEVTRAFHSPLMDTAADTFRQAADSHELHAPQGLVVSNVTGGYLTAQEATDGDYWGRQLRHTVRFNDGLNTLVRDGVSVFIELGPGHTLTRLAAGLGTQAASLTTLAGEGGEEPQDLLDLLTGFWLEGGDVDWSEFYAQEERLRLSLPLYPFARTRHWLDPLPVKTVRTEQAEAAPRAQATPEKPAPRKEIGTTPAQRYVAALWTELLGTDEFGLNDSFFEIGGHSLMAMQMVTRMRKEGAEGLEMTTLFELPTVVGLAEQLERLGVPVPDSGAARTSEDDEETAALLAEVAALSDDEVQARLAELEGDTGA

SEQ ID NO: 8384 - protein, 574 aa, Streptomyces avermitilis
MTAFAGTSVRAEQDSTAAALARQQAGLLITSPADFVVALYGAWEAGLGVLPLPVDFPDERLRHMVEDCRPAALIASADQADRAARLAAVAQPAIEVVVLDAVADGDEHAPGPSRSHVPEIPDAAAFTVYTSGSTGRPKGVLIRHEQIGRLIAWCADTWQLGPWARVAQTLSLGFDFGLQELFTFLPFGGCVVVPGQEDRLSARAYARFLRRERVSVLFTTPSFADELIAAGEPLPDLRLVLLGGEVLKGVTAEGMRVLAAPDCRLFNGYGPTEATVNCLMYEIPRPPEGAEPPRLVPVGSATAAARIDLVDEQGRPVPVGALGEIRIGGPGVADGYLRRPELTAERFVRCQDTDEVLYRTGDLAYARHDGVFVVVGRADRQVKIRGHRAELGEIERTLRSAPGVVSAEVRVIGTPARLVAYLVGTGIDLGAVRDHVAARLPPAMLPEQGVLLERLPTTANGKLDEAALERLAEERHAQRLPDAASPAEIEAAVCAAWAAALAAPDVAPDVNVFDLGAHSLVVTRVHGRISAALGVDFPVHEVFEYPRPRDLARRLAALRRVDRDGPPTPWQLRQ

SEQ ID NO: 8385 - protein, 1148 aa, Streptomyces avermitilis
MRETRLTRTSTPLDLVGAIRARAEREGTAVALSWLTDLKDRTDSRTCAELDDAAAAVAAALLAEAAPGDRVLLVQPPGLDFVTSFVGCLYAGCVPVPVYPLLDTAEDRAKVRRIQQDSGSRVTWTSDAGMAEYVADALATPALWRTGEDRYVPSESPAPDTLAFLQYTSGSTAEPRGVMVTHGNLTANLTAIRDAFRHTADSVVLSWLPAYHDMGLIGNILHPLHTGCHAYLASPIDFIRNPTAWPAAVHTYGVTTSGAPDFAYELVARTVDRDGLPAGLDLSGWRTAYSGAEPVSTNTLRRFAEALAPAGFRDDAFVPCYGLAESTLLVTSVPVGAGASTRICREGEEVVTCGVPRDCEVAVGGADGTPLPAGEVGEILVHGPAVAAGYWNRPDLTSEVFAANVSGSDKKWLRTGDLGFLQDGELHVTGRIKDVIIVRGRNHHPQDIERLVVDLCPAVRPGCVAAFAAPDDQGVVIVAELRPGQSLTDDDRARIAGAIATSFGLAPHEIVGVPRGTVPKTTSGKLRRGECRTRYLAGDYADHRFDHGRGPTPGDTAPTAAVRRAVREVLGTGVGDDRPLTLHGLDSLGAVRLTELIARHAGVDIPVRDLLEGATVAGLMERVGTAEPAPVRAGDEASGALSKAQESLLFLHMLAPDSDAYTISFACEPGPGTDHDLFEQALRTALEHQPELHVRFTSSGADGRREPVSTRRMRDALALTPVPVAEDRLAQQLSEAAALPFDPEQGPLLRLYRWQTPTRRVYQVVVHHLVTDLWSLSLVLRDLGSAYSALIAGRPVRLPEPGSYDAYVREQRAYLDSEEAGERDAFLREVLPRRAASLGVRTDFPRTAVRGSRGARVEARVPAPAVPGPAGQDPVSLLAVLWAATLRRYGTPAPVVVGVPVTGRTGGRHGAIGGLCTNTVPLALDVEPDRLLEPLVAAARAQLTAGMDAGLYPLARAVEAVRPDREPGRTPLVETLITYQENPLPDVRGLLEALSGSETELALDTLVLRTVPIERRSCRYDLDLVVTPGPEGLHLTLDYAADLFTERTARAVLDTFCAALAASERTYGARLADLTVLSDHDAALLERIGRCATPPLEPSLLQRVRAVAEHTPGAPAIQGPHQVWSHAEFTRQVERVAHALRLVDDGRS

SEQ ID NO: 8386 - protein, 641 aa, Streptomyces avermitilis
MTDSASVAATVDQVPSAYSPPPGTQPRTQPDNRASLHERFEACVVRFPDRTAVVAEDGRLSFAELDRRSDAVAAALAARGAGPETVVGLCLGRGTGLVVGLLGILKSGAAYLPLDPAHPSERLSYTLRDSGALLVLVDSTTVGRLPTGSDARALRVERLSVPSTTSGDLRALPQHPAGLAYTLYTSGSTGRPKSVAVQHGSLPRLLDALERGMLTGTPPGRVGWNASISFDASVQQWLRLFRGDTLVLLGEKTRSDPAELAAAIDAHSLTDLDITPSHLAPLLDHFSPAPGRTPLRLLIGGEAIVPSLWTRLRDLAAAGGVIPVNLYGPTECTVDATSAPVADAPQPHIGAPLPGVRVYVLDALLRPVRQGETGEIYVAGTGVARGYHARAGLTARRFVADPFAADGSRMYRTGDVARPGPDGLEYLGRTDGQVKLRGYRIELGEIEGVLSRETDAHQVIASVRDDCPGGRGIAVHYVPGRGGPGAAELHRVARAHLPPYMIPSAIVPVDRIPTTAAGKADRAALPPPADHGLDPERERPDHVPPQSATEIMLAEVWSDVLGVRPVGATDDFFQLGGQSLLAIRLAGRLRRARGRRVPLVAVFENPRLRDLAAYLDRSGAGGEGPTGPDERPDPRARAGER

SEQ ID NO: 8387 - protein, 543 aa, Streptomyces avermitilis
MAGLDCVVIGYNEGNFDDYRVMSERAGPSSPESQIFRKEHLVVDGRPMPWMDAFSTLRNRVTGRHDRYHVGEVFNLAALYLTSFLRRRGVSAEPVSLYSGERDRLADLLAQRPTVVAVTTTFYVNILPVVPIVEFIREHSPDSHIVIGGPLVDNLCLNGITGTVQDLFDAMGADSYVQESQGETTLARLALALKEGRDISAVDNVIHCTDGMWQLTRRRPESNDLDDSSIDWSGFSPELIGVTAQLRTARSCAFKCSFCDYPSRAGALAAASVDTVRKELRAMAELGVKNIVFVDDTFNVPPKRFKEICRMMIEEDLGLRWYSYFRCSNARDEEAFDLAAESGCSGVFLGIESGDTEILANMHKLAQDSQYRVGLERLNERDITTFASIIVGFPGENARTVSNTVDFLNETKPTFWRAQAWWANPRSPVYQNKEALGIEGEGYSWSHATMTSSEAADLTDSMFDRVTGSTWLPLYDFDFWSLPYLAGKGVGVGELTPILQLSEQIMRVRDTGGSDGTSQLRSLERQFAAAVGALDSAPARFRF

SEQ ID NO: 8388 - protein, 273 aa, Streptomyces avermitilis
MHNPPARRPTSRPGTRDQAHLFPCHARPTQRAQLGLHQLPHPHGSPLKSADQSLAATESPYTLRMIREAYLQGAAAAADLMGRPSVAAAWNEPSVLPGYRVAGLCGHLARNIVLVEPLLAAPAGGAHPIPLLDHYTGDDWLDADPQSGEHLAIRERGKKAAADGPESLAERVSGAVSRLNRAIPAQPADRVVDLPGMWSLTLDDFLLTRLVEVVVHCDDVAVSVGVPTPELPTAYYEETIALLSRLAMRRHGPIALVRALSRSERAPGTISAF

SEQ ID NO: 8389 - protein, 72 aa, Streptomyces avermitilis
MSNPFDDTDGTYLVLCNEEGQHSLWPADLDVPKGWSTVHGPAGHASCVEYVEEQWVDMRPRSLAAAMDQPAR

SEQ ID NO: 8390 - protein, 550 aa, Streptomyces avermitilis
MEDNAPLSFGQEALWLAEELVPGLSAYVMLAGWELTGPLDPQALQRALTALVDRHELLRSALVPVDGRPEQVIRGCAPFELRRVDLRDRDGQEQDNAIAGDLAGLLEKPFDLSSPPLLRGVLFRLAARRHTLVLVTHHIVWDGDSDVLLRRELSELYAAEVQGRRPQLPELTAQYADFAWWQREEASPALEASVEHWAQRLRDVRAPELPTDRPRPALRRFTAAFCQIPIPAAAVRGVTKLARTASVSPFVVHLAVFDVLLARWADEPRAVVGTPLAGRGEPELENLLGYFVNSVVLVADCDPGLTLSELLVAVRTDLSSAFEHGDAPFHHVVDRINPARDSSRHPLYQVAFQYVPESEPLRLIGVDVTEVSERLLHRSEVTTEFDLLAEVREEADGQHILNLRYATDLFDATTMDGVARAYVEILDAAVATPDSTLARLAEAAMSLPAAGTKPSRRPENVPHRVPSSDATPSVAPRTELHGRIAAVWAEVLGLPEVDCSANFFAMGGSSLLGAQLVRRLSAELGLNLELIDLFDSESVDGLVEFLGTAR

SEQ ID NO: 8391 - protein, 530 aa, Streptomyces avermitilis
VNTAPLGSSLRTLSDVLRHSARQFVERPALSAGPVRLTYAELDRCVDALAARVRAVGIRPGDRVGLSVARGPLALVASAALMRAGCAYVPLDAAHPSRRLRHIVDNAGLHVVVCDESGRAAPDIAALTMLHVDGDDLIPGPFAGAAADDTVPGSGSVAYVMYTSGSTGVPKGVEVTHANVLAMLAGALPLFDFADREVWPLQHAHGFDVSVWEMWAAVAIGATLVAVPRAAQQDPESLAELLLRHRVTRLHIVPSVFHHLAEVVEEEAVNLPLRNVTFCGEALNYRAIQSWTRSQPGPQPAWCNVYGITETTVYNTFKRLTAEEVTRAASATPIGTAYDHSPAVVLDEELRPVAPGRTGEILIGGSQVARGYVDMPELTAERFLQLPDRPGRWYRTGDLAHTDEAGQLHYVGRQDDQVKIRGFRIELGEIDHALRAVPWIGDAAAVVQSTARGEPALAACVVVTEQAADLRDAADDRQNEALLDRLRKELAAVLPDHMLPGRVVCLDRLPLNTNGKTDRRALAEDLSRRS

SEQ ID NO: 8392 - protein, 740 aa, Streptomyces avermitilis
MNATAPARLRTPDGIVEVASDALDRPVVTAPSWTAAAFGLGWTVARHRREQMDFMRRRSHGRLAEVLGPQAVQADVRQRVLGLAHVARACWELLPMSQRHTLRAYADGVNAAAPNGPGGAWTPVDCIAVTQGVFQALSSDGQDVRMVEVMRRTLPAAVVDFLLDPQDEFAVGIDGTVPDVCRSALPVAELKALMAEPPGPAGPLVVSDGRPIGSNAWAVTDGDTAVLANDMHLELTSPSLMYAARLVVGDTGVTGVTVPGLPAIVAGTNGRIAWGFTRLPADTCELRELTPGSTPGTYRHEGRDRPFTVRRERVSVMGGDDVEVEVRETRWGPVVDQLRGRPLVLSANLTDPTALDFALVGLYESANVAAAADLLNDCGMPPLNAVLADTAADVAWTVTGRHPRRAGGPRGFSDSERDPWPTPRLAPHELPRLVTPPSGHVISCNNGDAAGRTAGLGWNFFPGTRSRRAAAALAAGGPHDEARCGALQLDVDAELYAYYRDLALRYTPERAPVPLRALRDEVLAWRGTSHHDEYGLALLVLFRELLREELFAALTRPCRRYDEAFTYCYNGHERPLRRLLDALAADMVPKPWPGPAALVVGMLGSAKTLLTKRTGSAEPTRWGSVNALAPTPLGGAPVHGGPPGGHAGERGVGLSGCPESLRVTQPDFGAAMRLVVAPARPEDGLLTIPGSPAGTGPVDLDHIARWTQGKTHPLPMREDTPYGDGVRGPGSLRTPTGRTL

SEQ ID NO: 8393 - protein, 551 aa, Streptomyces avermitilis
MDTGPVPHGRRDARTVADFARRFWQDLLHVPDVDDDAHFFALGGHSMLATRLMSRMRKALDADLPAGLIFDHPVFADFVTRTIAALGEDSAPADERPRTSGRVTGPVSPQQERLLRIEDALGPSPVHSIVVPVALDSPVDGAALRLALHALLTRHGALRLAFPTPDGGGAHQQVIVPPWAPADVELVERDMPVSIEGQAEDAAILKDVRLAHLKPFDLMRGNLLRAQLFRRRHAADLLVLHLHHLAVDGVSQTVLLDDLAEAYTQLVTEGRVHMDNSDALTHIDYALHRGGRQGDMAADSRRHWTRVARDLAADLAAAAEPAPRGMRYVRRGAELDTSVLHGLHAWAGTEGATDFVVATAAVATALAALLGRRHVGIGTLLDNRAHAAHERTVGPFANSTLLAVPVPDGATPRDIVRATQAQLAEARRCADSPLDDLLGPPCAAVGLCPDDLVDAVVAFDRPYRAPAESALRMSPLYDHGDLLVPSALGPRLSVTLFAHDTGTLRITVEHTEDPADPQRPDAVLSALVDTLRLFAEAPDATVAPSPAAVPR

SEQ ID NO: 8394 - protein, 265 aa, Streptomyces avermitilis
VPTRDDTHHGSATATGLWFPAPPAPGDCAVRLLCLPYAGGSPVMYRTWDKALAGTADVLPLCLPGRAHRWGEPLEHDLHRIADDVAEATAPLQKDLPLALFGYSLGALLAFEVARGLARRGRPPLLLIVAACAPPRECGALSPKHTLPDEEFIALLREMGATPQAILDNEEMLSLLLPMLRSDFALADRYRHTPGPVLSTPIVALAGRDDPEAGPEVMAGWARETQQPLRRLDLDGGHLFIEEDQPTVIALVRAALRTALAHKER

SEQ ID NO: 8395 - protein, 473 aa, Streptomyces avermitilis
VTSLTAHHEDFPVVPAERTEPPLKQGVDPQRARLVEALRARRRTQTPQTLPMTATQQGIWLAEQLSPGVSGYHDTAVLRIDGPLDAEALRLALGDARAVHEAMRCRVIEADGEPRQSFDAPTPELAHTDLGAVDAQTRAARIERLTALTATEPFDLEAGPLWRARLIRVESDEHVLILVFHHLISDGWSHGVLLRTLLSHYAARAQNTALPPTPDTSAYRRWLLSRVTQEQAAVDSGRAREVATLLAEAPYRAALPGLKGPPSDRLAAAVELPVSDVTWASFDRACRRAGATRHMGLTGLFGHLLSRTLRSERTVLASPVAIRDDPDSAHLMGCLINVVPMVLVPRPTADPAAALAAGREAVLTALRYADVPYRDVARVLGPLTASDDPVTNVGVEEFNAPQEPVRVGDVVVKPMPRGHVRLRHDLTLSVARSGASAQLLHPVQNWNVNEIQSLAQNLAELISDTAASVTPEK

SEQ ID NO: 8396 - protein, 74 aa, Streptomyces avermitilis
VPVAEVPVPEADPHQAREVFLTGTASELVPAREIDGHRFEPCGPVFGRLARAFHDTVRGRAFGDLGWSTGVSEQ

SEQ ID NO: 8397 - protein, 461 aa, Streptomyces avermitilis
VVGDEQIAALVRHYAGRPAALGGSSAATALSPQQSDLWRAARPLVSTPVFLATVVFRLRGPVHRTALAAAVRRLSLRHDLLRTVFENGPAPAAHLGEPPELRVVEAPDAAADTAEELVRGIARTPFRFGEEPLFRVTLVCRAEDDYLLVLTCHQLVIDGYGQSLLLQEFTSLYRAEIRGEPDDLPEIKQPYRETARLLRNPDPEVRRGDEEFWTSRLRDLPVMSLPGDRPGPEGATLAPTGAVETVLPDPDGAVVAGLRRLRVNLFALFAAGTMAMLHGYTGQTDLWVATVVDNRLTPESQAHVGPLAGPRVVRVGFAADATFGVLARAVQREVWATMERQHIPFHDVITAATGDGADMRNLGSVGITVTPSIQLPDWPLGDMEPLEFDPLEGEPSTGSPLALLVEEQAGRYRLRLEFDESRFSHGRAHDMMTTIADAVVAATADPQRSLASWRGPTSADD

SEQ ID NO: 8398 - protein, 541 aa, Streptomyces avermitilis
MIADHPARHPSPVEQWNETRYDYSATSRIMDLIDSAAVKYADDPAVRTTSGVALTHGELAAESSLLAERLAAHGVLPRTPVGLLVDHVPEAVVAIHAILRADAYYVPLDPRWPARRMAEVLKASDIGHVLVTEPYRGRASDIGDDMTIIAVRHGSEPEVLARSASRPSVRRHEAGPAEPDELAYTIFTSGSTGRPKAVAVRHTSVVNLIQWFNRRNSVDPSDILLQVAAFSFDLSVYDVFGVLAAGASVLLLPDAELEELEEIAIALVEHPVTLWNSAPAMFTAVTLLLDESSRQHRDRLRRVFLSGDWIPLNTLEVLRREFPRATLVALGGATEACVWSNDFVVDEVDPSWRSIPYGHPMQNSRYYVLHDDLTPCDIDEPGELYIAGVCVAAGYLGDPALTADRFLPDPWDQGDGFTMYRTGDRARWTSNGWVEFLGRMDSQVKIHGFRIELGEIEQVAMRVLDVDEAVALKLDDGDSPYLALALRASGELDAKTVKEKLGEWLPRYMEPRRVVVCRTFPVGQTGKVDRAALRKLFQPAG

SEQ ID NO: 8399 - protein, 297 aa, Streptomyces avermitilis
VIGAGAAGLTAATMLGRSMRSTLVISQPRRRNSPASSVNNVPYADGAAPADIYRKMEQDAGRYGVTLLWDEVTSVRAYEDHVVVEGGANPGLRCRRLLLATGRVDVLPAWLPDGVWGRSAFDCPYCHTYERSGSTFVCVGTGDETLKLAALSRQFAKRMTVLVGDPSASRGRLAGLLSRHDVEVLCDEVVRASADPAGGVILETAHGRTLSADTLLLGDVARPYRKFAEDLDLELSADGFPETSLYGMTSNPLVYSAGNVEGSPYFMWTGAASSGINAARAICEDLAFASELLDDWE

SEQ ID NO: 8400 - protein, 656 aa, Streptomyces avermitilis
MEQTGPFVVHTAADSYTRDLRDPALVPMLGVDDSRLAALASLMGAPARRKDPDVSGALVVAPAGSAATAVGRALADRFGGSFVTLSTGGLGRILDARLEATQVVFVALHDEIDLDMVTESLEVVSAYRHDGRHATIGFVIGPDLPELSWLLAKGLSCHLRKPPERSRLTVVPWLRQQAAASGIPASDGADAAPEWVIGDRASRAVLEPMLSEQYTGLVSFASAGREHALILSDTVICGDHAGHRAPSAQGAAAPSCAFSDRCFRDGVRARDVIKAARVQADIVFANSCMAWRPGTGLVAAEYQLAGAFQYGIPAAYIGAVHQMLPNLTINDLVGTAVAAGTDAGRTCAAVNDHLRDSGRELPYFAVLGLPWVTAGGGSEPPPTTDAGPSVDAHEGVRDVKPQLLRLGRTVRALSEFGPTGFMPPDGIVAMEAEILELARTLKRTALGADLAEKAVGPLRRLGSLIADAELSAVADFHEFGKMSHSALNEMWEGILDTSVRPIDDACPYCKGRLAELVARHPVYEQVGRRALICNVCGPTADSPLEPVIGEVVIECPSIWKRPGTVTVDVLMTPAASVSQEITAAGAIHTSGAANFGMTFPDAQRIAIRPGSPARMRVDATLSAEAFTHHEHFVRFVAVAEGLVHYASRPVAVAPAA

SEQ ID NO: 8401 - protein, 435 aa, Streptomyces avermitilis
VLPRSGQDMRRGTVVIVEPYSSGNMLAPAFRQGGFSPCAVTLSGLSAPNSATLRLSDFDEHIAYDGGELGPPVGRLRALDPVAIVPGTHTGVKLADELAAVLTPKLANAPDLGSARHHKGDMIAAVAAADLPTIRSLCTSDVGDALTWITRERLSGRDLVVKPVDSAGTDSVRFVPGGHDLRAVVTGLLGSANRYGSPISEVLVQEHVKGVEYAVDTFSYEGRHTVNDIVRYHKVSSRRHIALYASMEILPMDAPGNDAIIGYVKGALDALGITFGAAHTEVMVTEDGPLLIEVNARLSGGGHPWTCELATGDNSVDRMVRYLAGDRNIPDGYPLQLTTLAIFFAVRSAGVVSGLSRLDAIVDLPSCYHLQVNVQDGDYVPETSDLFDAQRLGMAVLAHSDPAQVAADHREVRRIAAEAGRPGGFTIDPNRGGME

SEQ ID NO: 8402 - protein, 82 aa, Streptomyces avermitilis
MSDDEPTSTVDTTAVLLGIWQQLFRDQQVGLEDDFFDLGGHSLLATRVISQVRAALGKRVMFKDITECRTIALLSARIDEKR

SEQ ID NO: 8403 - protein, 916 aa, Streptomyces avermitilis
MSVPDTPVQSLRSSSEPVLCEMFASLFGLDSVDADADFFDMGGTSALATRLVGQIRTVFPGDITFGDVFEKPTPRGLARVLDQAAAASPRPRPAGRPARIPLSPGQSTFWFYEQLRGPSADHNILLSLKLTGPLDRDALAWAFDRLIDRHEILRTVFPRDQGEPHQVVLDPAAARPGLRVVDVAGGQISEELSRRAALPFDLTTEPPLRAWLLAISPEEHVLLISLHHIAGDGWSTAPLWRDLSAAYLARRDGLQWQPQPLAVQYADYSIWKRDLLGRESDSQSIIARQARYWAQTLAGLPEELPLPVDRQRPARLTARADGVRFTVSPDAHRRLLAQAAAARATLLTTLRAAVAVLLAKLGGGGDIPIGGLVSGRTGPGLEDGIGFFVNTQVLRCTWDGDPTFETVLARVRQAEIGAYANQDMPFDRIVDLLNPVRLASRNPLFQVMVVLDEGIGAGRDLFGCVAERQEVDLLGLPTFDLSFNFALPEAHEGAGAGIAGWLGYSPDLFDRSTVERIADYATHIIDAVTANPATPLSAFAVPLPVDARPARRTAVDTTVPVTADTATRPRTPRLDALCGAFAQILGAEKVGVDDNFFGLGGHSLMAVRLVSRIRSTLGTELPVRVMFEQPTPAGIDRWLDQAEAGSGTPGPAADGLDVVLRIRPEGDRTPVFVMPPALGLSWCYTPMSRWLADGFPMYGLQSRGIRGAGPVGRTLTDIATDFVGELRRIQPNGPYQLLGWSFGGNVAHAMAVILEAAGEEVSMLALLDSYPWDGEQTDPTLNVESAAADPQLTTEELRRVLQASPGTAAAVPDEYLPALAQVFANNRGALLQHRSGRFGGDVLMFTAADSVAQGMDPRSWQKFVDGSLKTWSVNGNHYEVFGPEPLETIMSVVNAELTAHHGRNRARATQERGVAG

SEQ ID NO: 8404 - protein, 155 aa, Streptomyces avermitilis
MKNMSATAIDLDDLDLFVSGDPHAAWARLRREAPLHWNAGPDGTGHGALTRYADVETIRAGDTVTLWNAPANRDPDAFAEPDRLDLGRTPDQHLAFGVAHHRCVGMGAARREIALLTEEIVRRGLRCEIPGPVRRPRSNFMPGITHLPVTVTDVW

SEQ ID NO: 8405 - protein, 654 aa, Streptomyces avermitilis
MRRGMCRGRAYVPLSEVSGGQKSAGESAGAEEGGMRRRTPPIAVLTGEMLTMDRLGTLGLSGLVALAAVLPASLAVTSGALAGRLATSHGKDLFDGGGGAAALALGAVFLLMQVVPPLAQAVAESLGRRLHRGLAERVLTALERPADLGRLEEARTREIVSAADRGLNGTCVRDAVVGAVNVGIARGGAASGVLLLLAYRWWLAVLLAVAYGYAMVIVSRMYQRALESAEGTPALMRRAMYLKNTLCGASAGKEVRTFGLTDWLLDRYTTEWRKAIARTRGDRAGAARVSLVSGVVVLAAQGLAFVLLVADAVDGRVGVGRFVMFAVAGVGLLGLGIVTPDLLNIEVGGTVLAAVRQLEAHTAPPDAAPPTPRGPGTGGGDALVTPSLTAPPSTAMPQRSIVFEDVGFRYPGSGTWVLRHLDLTVPAGTSLAVVGVNGAGKTTLAKLLCGLYTPTEGRVLVDGTDVRDLPPGTWWNCCAALFQDWVRWRLPLRDNVALGAPHRPATGPELAAVARAAGLDEVLRDLPDGWSTVLSREYGGVDLSGGQWQRVGLARALWALSAGGTTLVLDEPSSALDVRGETELYDLLLAAAEGRTIVLVSHRFSTVRHADTIVVLADGAVAESGSHQELMDKGGRYAHMFTVQADRYVERGED

SEQ ID NO: 8406 - protein, 600 aa, Streptomyces avermitilis
MTRPGRPRCGPLRAALALSLEADRRATLITFVSFGLRPTVPVVILYLVRVVVDAIVSHDQTALWTAVGAATLATGLSMGSITYAIELNVRMIEATAAVVDRRLMRTIGGLPGVAHLDNPEVLDRVEMLRQERVHLSEGGDVFALVVGAVVRALVTGLVLAMVQPLLLFLPLLALPSLLASRRGQRKRSDAVARSATTSRLAGHLYTTGTSLPAGKEIRLFGLGPALRERYRTAAADADATVTRAVWGGLALNCAGGALFAVGYCGALFFVLHDFARGTTSLGDVVLVLGLVTSISTQLGQAVVFAGFLHQVLSASRRLLWLERYAADVARPAPTAPAPGPRLSTGIRFEGVHFQYPDTGTSVLRDIDLELPAGTVVAVVGANGAGKSTLIKLLTGLYEPTRGRITVDGVDLREAPLEAWYARTSGCFQDFSRLEFTVQHSVGAGSVPHADEAARVWEAVKRAAAADLVERLPNGLATELGASFDAGTELSGGQWQRIALARACMRRAPCLLVLDEPTAAIDPLAEDALLSAYVDAARQSAAAAGGITLFASHRLSTARGADLIVVVDSGRIVQLGRHGDLMAQRDSIYRDLYERQARAYA

SEQ ID NO: 8407 - protein, 534 aa, Streptomyces avermitilis
MADGVATTVGAVFCDLLNVPACAEHESFFQLGGDSALATRALALLGKEYGVRIPFAELYRDASPAAVARVIHELRAAPVAPRRSLADVARRRRRTWFPLALSQRALHKMNAATGGAGLFNNVGVLRFTGDIDVLALRGALEDTVSRQSALRLVFGVHDGRPAQRFADIGPDVTEADLRDGGEPALRARVRRERLRGFDLTGAGPAARFVLARTGERAWVLVSVFHHIVFDGMSQGLFVDDLAHAYACRLGEASARPPLAMDYADFTEWQHATLCSDRLEAHLDAMRASLRRSPTPSLSPAGASGRARSFISRARPFTVDAHLTRALRALAARCDTTLFVVLLSAVLDFTARRTGDGTPAAAIQTSNRGLAGTEGTVGCFANSVHVTVDRPGGTTAAHLVRLTKEAMAEALTHQEMPTEVSLSILAERGKLPSGPNTLPQVAFALQPPRDERRDLPGGRLDAAYVTQEGDAVDPTSLALVLELFTENGQLNGVTHHRLADWSGTAFAAAEQDLLAAFARCGGAGSDLEHLSRQKG

SEQ ID NO: 8408 - protein, 73 aa, Streptomyces avermitilis
VPTSFSRILNEDDLTEVRNQYLEALEALEAEENAEQRGEERDEQPARTHEAGAASVTAPTEQAAAAEADAEEE

SEQ ID NO: 8409 - protein, 311 aa, Streptomyces avermitilis
VDFVTIDDPSVKSRLERDGVVLIDSLLSKDEVAETRAQLERYEREVLADVPRVHYEFHEDGVLRNMTEIQRYDEWFNRFGNQDRFFDLFRGVVDWDPALFYLETFPKRPGCKPLRMHQELFAGPVDPPQYLHLWIALDDVTNDNSGMVFYRGSHRFGLAPHIFHPDGLPEVQPELLERIEHMRVEPDIPAGSAALFDGGTIHGSKANITDRRRLSLVVAVRGRDTVVHGDLDIFASIITRFFREEIGVAKCSAEDDFYSLGGDEPARSRVLKRIVDYYGVELTADQLDQRRTPRALAEKLIELTGWHELNT

SEQ ID NO: 8410 - protein, 321 aa, Streptomyces avermitilis
MRHRTLGAGGPVVSEVGLGTWRPLSRDGRRGAARLVGAARDLGITLFDTAGSYGDAEEALGIALRGAPRESYVLSTKVYYEPGGTVAGLSRAAVRAGVERSLRALRTEHIDLLSAHRFDDRTPLAETLTAFGELLEEGKIAHYGFSEWTAQQIAAACAAATEVGVRPPVASQPQYSVLWRVPEKAVVPLCQDLGIGTVAFWPLAQGLLTGKYAPGEPPPADSRAADPTGRLVMDHFMAEPILERVQLFARLARHQGMTPAQLAVSWVLNRPGVTSALVGASTPEQLNQTASAAGVLLSEPTMELIDKIFAGCVYDDVAGTG

SEQ ID NO: 8411 - protein, 96 aa, Streptomyces avermitilis
VPATRHLRRRRPSRCDAVVDHVDAGCRARCMIRDRDGKFPQLFDEVLEDAGIEVVLSGVRIPRMNSVMKRWVQTCGRELLDRTLIWDRRHLLRALY

SEQ ID NO: 8412 - protein, 595 aa, Streptomyces avermitilis
MFSAGGCTYLAVNTHTIATVTRGDDLAVGYASAMLGAVHGLVGDELGAYSGAEHQPSEGITVELNDSNRTAVKPGGTYVHAVGNTPPNWNLLSAVGNVVETGMVLQLITPSPYVAFPDLQNHWNEDLLASEPELVATDPQTIVYRLRPEACWNDGTPVGVEDFRYTWRVSSGHHSPACLPSTHAGYELIESVEGDHDGRTVVVTLAPGKAFPDWDAMFSYLYPAHIAARAGDLGTADGLAAAFASFDQVVPTWSAGPYQVEHIEPGVEVVLVANPNWYGRVVPSLDRVVFRVVSDPVALVDAVRHRVVHGMSTPHPTKALVDAFRDMPGVRYELSQGLIWEHLDLNTRNPFLADAGLRRAILTAVDRDEILAETVGTFHPDVKPSNSHNFYLGQPAYRDVITGTGQGSGDIAAAERLLHAAGYTIRDGRLRTPDGSAVAVLRFRHAPGDVMRRRTGELVRDQLRHIGLEVRIEPTDRPGTMVAGDYDIVAFNWIGSPLRVGPARDMWTTGGGMNFGHFSHAEVDRLIGEANETLDLVKAHELLNRADEVLSHEAYSLPLCQKPSLLVVDDRFANVRANPTNGLVIYNAQEWGLRA

SEQ ID NO: 8413 - protein, 321 aa, Streptomyces avermitilis
MAQPFPPVEPYAHGLLDVGDGNRIYWETSGSPDGKAALCVHGGPGGGGRRGSRRMFDPEVYRIVLFDQRGCGESLPHASDPAVSLVHNTTEHLIADMERLREHLGIERWLLYGGSWGSTLILAYAERHPDRVSEIVIVGVTMTRPEETDWLYHGVGRLLPGPWEAFRDALPVADRDGNLVAAYNRLLNSPDDAVRTKAARDWCAWEDAVIAHEALGKPGQYSDKPDDALMAFVRICAHYFADDAWLEDGQLLRDAHRLAGIPAVLIHGRLDLGSPLKTAWELSKAWPDAELKVIDDSGHTGSPSMQDAILESTERFGKNGR

SEQ ID NO: 8414 - protein, 143 aa, Streptomyces avermitilis
MSKAAPTNTRTVVEELLRRIGEGDPERIADLYAEQGDWKLDWPEAEHGRTATPWIRHRSTRADVAAHFRELAAHHVPEHAATEVERILIDGNDVVVLGEIRQTARPTGRAYRARFALHLTVEDGLVTRHHVYEDSLAVAQAFA

SEQ ID NO: 8415 - protein, 176 aa, Streptomyces avermitilis
MADVIVLNGGSSSGKSGIVRCLQAVLPDPWLALGTDTLVDAMPASMQASDAGIEFAPDGEVIVGPEFRTLEAAWIEGVAAMARAGARVIVDEVFLGGADSQQRWQKALRDLRVLWVGVRCDGAVAAGREIARGDRVIGMAASQADVVHRGVVYDLEVDTTHAESMECARAIATHVR

SEQ ID NO: 8416 - protein, 165 aa, Streptomyces avermitilis
MTFTSAPKPVLVRAGEAETLQDGATSLITLLADANTTGSALTANRATLHKGSPGAPAHFHTRATEMFYVLSGSMRILLDDQVLTLGQGDFLTVPPTVPHAFAPAPDSEAEMLVVFTPGMDRFDYYRLLERVYQGEASVQDIRDSSEQFDNHYFESPVWQQELARR

SEQ ID NO: 8417 - protein, 319 aa, Streptomyces avermitilis
MPRTIWSGAISFGLVTVPIHVVSATEDHSVRFHQYHLEDMGRVRVRKYCELEDREVTQDEIGKGYELSKDTVIPVLDEELRELPLPTAKAIEIEAFVPLASIDPMGIGEGYYLQPDGQVAAKPYKLLRQALERSSKVAVAKYAWSGRERLGMLRVREEAIVLHAMRWPDEIRDPSELAPQGIELSEDEITEAEQLIDRLTRDDLEGEEFQDHYTEALHEVIEAKQEGHAPPEARETEEEPGKVLDLMAALRQSVAKAKASRGESGEADVHELPRKKTAARKTAKQQPAKKTSAKRTAAKEPTKKTAAKKTTPKKPRRSA

SEQ ID NO: 8418 - protein, 89 aa, Streptomyces avermitilis
MPDSPTVGRRERKKAAMRRTIADAAPELFLEHGFERVSVRDIAEEADLSATTLFAHFPTKGALVFDRDEDVEAELAAAVRERLKGHSVR

SEQ ID NO: 8419 - protein, 374 aa, Streptomyces avermitilis
VDSPTPASARISIIGAGPGGLTCARILQQHGIPVTVYDRDPEANSRNQGGSLDLHEEDGQLALREAGLLEEFFALARLEGQEMRQMDPAGRVLDHHLPDEGETVSPEIDRGQLRDLLLRSLVAGTVQRGRTLESVSGPADGPRTLTFTDGTAVEADLVIGADGAFSRVRTAVSSATPRYTGVSFLEAWFDDMEHAHPELSQLVGKGSAHIADGERGLFAQRNSGGHMRVYIMQRVPVDWIAANGLRPEDTEGIRGHLLSEYAAWSPQILRMITDNDGAYVDRPLFALPVPHIWEHSPSVALLGDAAHLMPPLGVGVNLAMLDASELALALVHSSTIDDAVHSYEKSMLPRSADMAQKLEGGAEHLLSVPDSDEI

SEQ ID NO: 8420 - protein, 272 aa, Streptomyces avermitilis
LGSPDTISAGIASTVTLEIPVEPNLRYHRFMATRDSTDTPRRRIVEAAVELLENGGPDAMSTRAVAAAAGMQPPAIYRLFGDKEGLLEAVAEHGYAQFLERKRAQLDPAPQDPVEELRRGWDMVVEFGVCRPELFAVMNRATGRGSDAAHRAGLEILHGRVRRLAAGGWLRVDEELAAQIIQATGQGAVTTWHSTPADRRNPALLTVLRESMVAAVTRAEPTVPTAESGPAAAARALRAALPDDADVLSDAEQRLLREWLTRLAADGGAPHA

SEQ ID NO: 8421 - protein, 286 aa, Streptomyces avermitilis
MIIVTGATGKLGRRIVERLLERVPADRVGVSVRDPRKAQDLADRGVRVRQGSFDDPASLVHAFEGAEQLLLVSLDRTGQECVSGHRAAIDAAVKAGVGRILYTSQMGAAHDSRFQACRDHAQTEDLLRATGLPWTALRNGFYASSALQFLESARHTGDIALPADGPVAWTGHDDLAEATAAILAEEHRFEGPTPPLTGPAALDFDTVAEIASQTTGRPFTRTVVPDDAFREQVLAHGAPAPIGNLMLSIFAAARNGEFTAVDSTLAELIGREPATFRTQLEHAWAE

SEQ ID NO: 8422 - protein, 327 aa, Streptomyces avermitilis
VPHPHARLTVHGRRLLVDRVRAGRPIAHVAEEMGISRTTAHKWVRRWRAEGDPGLYDRSSRPLTTPHRTPADVENRICELRRDRKLGPARIGPVLGIPSSTVHRVLTHYGLNRLRWMDRPTGQIIRRYERSHPGELVDVDIKKLGNIPDGGGHRIMPRQQAAGNRQATTDVRRGGSPVIGYSFVHTAVDDHSRLAYSEVLTDERKETAASFWQRANTFFAEHGISVERVLTDNGSCYRSRLFGQTLSATGIVHKRTRPYRPQTNGKVERLNRTLLDEWAYVRPYSSNAERTEALTDFLHTYNYHRCHTALDGQPPISRVNNPAGQYI

SEQ ID NO: 8423 - protein, 109 aa, Streptomyces avermitilis
MSVVKINVLTVPAEQRETLEKRFAARAHAVESSDGFEWFELLRPVEGTDDYLVYTRWRDEESFQAWMEGPMKAAHQGGNAESGERPKPAASGSTLWSFEVVQQAAPKSS

SEQ ID NO: 8424 - protein, 198 aa, Streptomyces avermitilis
MRITKYTHACVRLEHDGRVLVIDPGMWSEPAALTGADAVLVTHEHADHIDVLRLAGLGVPVYAPAEANIPRLEVTGVPSDAEFTAAGFRVRAVGGRHAFIYGGQPDCANPGYIIDEAIYHPGDSLHVPEQPVETLLVPAQGSWMKTAEAIHFVKTIKPQRAFPIHDAQINDRGLSSVNGWLAGETDSGYRYLAPGESV

SEQ ID NO: 8425 - protein, 1354 aa, Streptomyces avermitilis
MSTQPPRPSRRSVLATGSTLLAGFGLGVTLPQTSYAVTPSRPTGERGELATYRPVSVSSTDYAPTPAEFVVDKVNSVGVKGTGWRAADGDPQWISVDLQTDCTVDSVHLTFEATADDPVFVPSTSGNPRDRTTGQEVLSSCAVEFVVETSRDHHAWTTVHRTTSGKGGMVEIPLDKPVTARWVRLTVTKRSNANPLGLNGFEVYGSAGGHRPSATGWTDWGTHDHRAPALKAAADGTVPLESGWTLTMDDWAGGKGAQLSRPDVDTSRWLPATVPGTVLASLVDQGHLPDPVAGFNNLHIPEALSRHSWWYRRGFELPRALRTGPGRHIWLEFDGVNHTAEIWLNGQKVGGLTYPFARSSHDVTKMLAGNGEQALAVKITPMPFPGSPGDKGPAGLAFVDAGATMMNQNSPTYLAASGWDWMPAVRDRVSGIWNHVRLRSTGHAVIGDPRVDTKLPDLPDTSRAEVTIVVPVRNVGSASKRVTVTAAFDDVRVSRSVTVAGGESADVTFAPSTYAALRLRDPELWWPNGYGRPDLHDLTLTASIDGEESDRRTTRFGIRQFGYEYTVPLPFGGSSDRYTQPVLLGVQKARYVRIKCLTRATDWGFSLWTLSVVDSTSAGTDLALHKTATASTEDSGNTAAKVTDADPGSRWSSAFEDGQWIQVDLGSVAAFDRVDLTWEKAYAKTFVVQVSTDGSTWTDARSVDNGAVPLPFNSGAASLQTVDFAARTSRYVRINCGARATSWGISLWTLSVVDSSSPGTDLALRRTATASTEDSGKPASNATDGNPDSRWSSEYQDDQWIQVDLGSSVSFDRVAIVWEQAYPKTYVIQVSDDGDAWTDVKSVDNTPDPLKISVNGVRVFCRGGNWGWDELLRRMPAARMDAAVRMHRDMNFTMIRNWVACSNREEFFASCDEHGLLVWNDFPNAWAMDPPDHTAYNDLARDTVRRYRIHPSVVIWCGANEGNPPEAIDKGMREAVRSEAPDVLYQNNSAGGIVTGGGPYGWVEPERYFSPATYGSGDFGFHTEIGMPVVSTAESMRNLVGDEPEWPISGAWLYHDWSTRGNQAPQNYRAAIETRLDTAEDLDDFTRKAQFVNYENARAMFEAWNQNLWQDASGLMLWMSHPAWHSTVWQTYDYDFDVNGMYYGSRTACEPVHVQADPKNWQVIAVNHTPRRLKDVTVTARAYDLGGKQLGSTRRATVSVPSSATAEAFTAAFASSLPDFHLLRLSLQDGRGRLLSQNTYWRYRRASDMKALNKARTVRVSADIGQVTRAGSRRTATARIHNRGSAVAAMVRLSLLDSRTDARVLPTLYSDNYVWLLPDESRTVTLSWPADALPSGRPALRVEGYNVPRTVARS

SEQ ID NO: 8426 - protein, 506 aa, Streptomyces avermitilis
MGLPRSISEARLHDEDQDKRGPSRRLRGRPQSHRATHCDGFHHRCARPLDWATCEGSGLDPRQQCATLEVPMDYANPGGAKISVAISRIPSEKPQARRGALLLIPGGPGGSSLNNPSGKGQKLPQEVRDAYDLIGFDPRGLGRSTPVTCGLEYGDLATSKLRPWPAPDGSITENMVTAQRMSDACARNGGDLIRHISTANNARDIDRIRAALGEQKLSAWGVSYGTYVGAVYSQLFPHRTDRIVLDSNDDPDHTRVARAWLAGHEAGVEDTFPEFAEWASAPGNPDRLAEKASEVRPLFLRLAEKLDREPIPWPGANPQELNGNVLRQTMLDSLYAPSGFPGLARLILAAQQGTVPPAPQAPPESVLQNAAAVGAGTLCNDIEWPKTAAAYEKDVAKSRAAYPLTAGMTRNAMPCAAWPFTPQEPPVRITGHGPSNILLIQNRRDVATPLSGALKLRNALGERATMVTVNSTGHDAYLANGNECGDRTVSHYLATGERPHRDTYCG

SEQ ID NO: 8427 - protein, 119 aa, Streptomyces avermitilis
VADQPGLTAGGNCQLFAYEVLGLFGLTPPPLRSSELWGDTETTVRVSAPQPLDLLLFNASASAYGAHVGVWAGDDAVLHLCAEVGHPTVWGLADFAARERYRVLVGTKRVIGRSSNTLE

SEQ ID NO: 8428 - protein, 607 aa, Streptomyces avermitilis
VSAQEERDALTLPLALYDYALHLLRESRDGVPPPRGYSLPQRPEPDEAPPSHEAAEIAVREALSPLPEDSATLHRRFARHGIRDLHKHLIRSAVFNLSLPNGQHDAARSLGRQLTRTGTTVPAVTAGLALLIRYGEPEDVPYLSALGLLREFTRPAVDALDPLDRQSAAIVWLVTHTGRDELRPLLRALWTGDQQAIRTELEAFPATPRFLSTTAARRIAEATRLPDLLDHHPSDAALLARAGRLLVRMGCTRDNPTDLLVYRDALTVYERVVTRAGLLPPTLDHHATLLSLALDLSSGPGVLLDWPPGRRAALLESLGLLLAEPRWASLADTGAGEADQRLRAGWIQRTGRQPFTRPATPGRLRVEVVAGDPVDREPVETRILVDGRPLVPAVFARGPARCPEYLLDEGRLRAGPEPREVQLAVASCTEGCCGALYVTIRRDGDQVVWEGWRRPPTMPGSREPAPALPAYRFDAAAYDAEVARAETDRSWPWPARSTARLIKAGLMERPELLSRWDARRGWISSGFDDPDTTVVTFWYVPGLAAGKPVGDPLQFRWVVPDDGTPPEAQAAAALRRLAEEDPKTYGQVCGGSRERAEELGFGWPDRA

SEQ ID NO: 8429 - protein, 204 aa, Streptomyces avermitilis
VGWFVNLGIIGQAAGLFAVTNIDDILILALFFAQGAGHRGSTRKIVIGQYLGFTAILAVAIAAAFGATFLPESAIPYLGLLPLALGLKAAWQAWKNHRDGEDTEEADAKGGGPSPLEVAAVTFANGGDNIGVYVPVFATAGVGGMSVYAVVFLVLVAIWCFAGRFFATRPVIAKALSRWGHVLLPLVLITIGLLILVQGGAFGI

SEQ ID NO: 8430 - protein, 125 aa, Streptomyces avermitilis
LVDVSSERTGRGLAVALVVVEMAILALIGLSWMGSYWSWDPQHHGDPPGPYLKKAAVVPIAALVAMAVAGIRRMRAVAVSQAVMFIVICGTTLCLKAPGERVYEDSYRNACHAGMGCGDDSPTTR

SEQ ID NO: 8431 - protein, 67 aa, Streptomyces avermitilis
MASGTVKWFNSEKGFGFIEQDGGGPDVFAHYSNIASSGFRELQEGQKVNFDVTQGQKGPQAENITPA

SEQ ID NO: 8432 - protein, 167 aa, Streptomyces avermitilis
MPALHARPTSNAFNPAPAGETPVVGLGSGRHRRKARITGRLRLRMIAYRDVEFLSSRTPGDTGGGEEYLLLVHVRKVVGRVDYRICTACAEAVVTGVVIEERFHDTGLGARALAHLRFRHPGMAWRSALGLPTTRDFKRRMRLPTKGEDGLCSHVRRALPVPAPVAA

SEQ ID NO: 8433 - protein, 77 aa, Streptomyces avermitilis
MLGLARSAHDLVVFLEAAAGPPDPGELLDDPSGVEWRGGRPLQWTSIACGRTPDAGRRMRSVGRGAADGDVRRWTDG

SEQ ID NO: 8434 - protein, 191 aa, Streptomyces avermitilis
VGVSLSKGGNVSLSKEAPGLTAVLVGLGWDVRTTTGTDYDLDASALLVDTSGKVLSDQHFIFYNNLKSPDGSVEHTGDNLTGEGEGDDESVKVNLAAVPAEVDKIVFPVSIHDAESRGQSFGQVRNAFIRVVNQAGGQEIARYDLSEDASTETAMVFGELYRNGADWKFRAVGQGYASGLSGIASDFGVNV

SEQ ID NO: 8435 - protein, 119 aa, Streptomyces avermitilis
MRRFIRSTITGLTAGLLAVSSGVAAQAASREAEEGWDSPPACVHINSDWRYTFVTNDCSSAYDVTVVYRDGANVPCRVASPGDIISFPGYGTQGNTVLGVALCAVAGRKDGRLEATPRL

SEQ ID NO: 8436 - protein, 204 aa, Streptomyces avermitilis
VITSALPTSRAAYDRPASADESITAWALAARGGDPEAVERFVRALHRDVVRYVAHLSADPQAADDLAQDTFLRALGSLHRFEGRSSARAWLMSIARRAVVDSFRHAAARPRLSDIPDWQLAVELAQPCDLPGLDDGIALLDLLAVLPDERREAFVLTQLMGLPYAEAAEVSGCPIGTVRSRVARARATLIGLLTEADASAALAA

SEQ ID NO: 8437 - protein, 228 aa, Streptomyces avermitilis
MTAGWCCRTVRAALFAAVCVLLAALGHVMMSGTAVPWWAMTVAALVTGGTGWCLAGRERGLALIVSVVVVAQGALHSAFSVAQSAAHSAGSVGADSMPKGSMGSDMSSVHMDSVHMDSMDMGNMGAGHLAHLGHDMGGGSSFGMLAAHSAAALLCGLWLAYGERAAFRILRALAGRLAAPLRLLLALPTPAHRPRIRVRRGSSDRTPRRLLLVHAITSRGPPVGTAVI

SEQ ID NO: 8438 - protein, 132 aa, Streptomyces avermitilis
MNFVSIRVITDDVARLVEFYEQVTAVSATWSTPDFAEIVTPSCTLAVASSRTVALFGSGSARPASNRSLITEFRVADVDAEYQRLTPLGCEFVQTPTTMPWGNRSLLFRDPDGNLINFFTPVTPDAVRRQDR

SEQ ID NO: 8439 - protein, 350 aa, Streptomyces avermitilis
VTTSTARVLALLEILQEGGIRTVPDLAARLNVDERTVRRYVGHLLDLGVPVDSVRGRYGGYRLAPGYRMPPLMLTDEEALAILLGLLAGQRAGLVTTSAAASESAAAKLRRVLPKALGRRLESLLETADFTARPRSGTAPEAGVLLDLAEAARHRRPVAISYTDRKGRGSDRTVLPYGLVAHSGRWYLTGADPAGGEVRTFRLDRIAAMTVQSGSFVVPAGFDPAATVLESLAHTPWTHEVSLRIQDSVQHIRSRLPADIATLSVIPATATPDDANLADTGDTSSDGPSALAAADERVGWVHVGIRAERLDWIPPVLAALDRPFVIERPAALRDLVRALARRLDEHATAG

SEQ ID NO: 8440 - protein, 183 aa, Streptomyces avermitilis
MAHLTACGYPVPKVYEVSDSDLVLERLTGPTMLEALAQRPWRVRGLGRMLGDLHDRLHGLPAPAWLPKRFGTGGDDRVLHLDLHPGNVILTGRGPVVIDWSNAGAGDPAADVAMTMVTVGSADVPGLAARLGRGLLLRAIQDGCATDPTPRVQEAVNAKLADPNLTTTEAAWLRNRAAVSAGP

SEQ ID NO: 8441 - protein, 364 aa, Streptomyces avermitilis
VGKGGESIPDEEWERFLREAEAGTEGAPEEPSARARMAARRREETDRPEPRRSHQPARRQRGKGWYAIGLLAAVALLVVALDPGRVTGWFGGGGGESSPLAVESERPDQPPPTEAAAQQATLEEPFKGSPAAQWGDGTDGIGLPKPQATGWMSKAQVAQALERTRDFLNASSLDPGVLRGDKPKKAIALINPHQQDVQDYLATAFRSPSRENDPRLLFSRFEKAKVRLVGDVVKTRGRITYREGKRGAVEVTTDVTYVYPVVRAAAGSDEVARTIVRREVVMSWDDPAKVVIEPGTFSLVSYKVDTTNGGCDTLTGYLTPKFDAERATSSPGDGPEVDPYNRSKSMETRMREAGDAGCGTATRS

SEQ ID NO: 8442 - protein, 336 aa, Streptomyces avermitilis
MRYIKLGTTGLEVSAITLGCMSFGEPDRGGEPWSLGADASRDIIKQALEGGVNFLDTANGYSAGSSEEIVGQAVKDFTRREEVVLSTKVWMRMRPGPNGAGLSRKAIFAELDASLKRLGTDYIDLYQIHRWDYDTPIEETLEALHDAVKSGKVRYIGASSMYAWQFAKALYLADLNGWTRFASMQDHYNLIHREAEREMIPLCADQGIGVIPWSPLARGRLTRARDTATARAETDAGGKILYRDEDQAVAERVHEIAGKRGLSPAQVALAWVMRNPAVTSPIVGVTKPAQLADAVAAVDVELDEDEAAYLEEPYQPHEAAYLEESFYKRQPVAGSR

SEQ ID NO: 8443 - protein, 106 aa, Streptomyces avermitilis
VSIGTCARAFGSPCVHEHACVRCSLLRPDPAQRTGLVDIRDNLIARIDEAEREGWLGEVEGLQVSLTGAEEKLAQLDRRRGSHAVVDLGIPTPSRGAKDSTAKGDC

SEQ ID NO: 8444 - protein, 513 aa, Streptomyces avermitilis
MSDAHPIRSREPGLSVGARIIAVVVLVAIGAVSAWLQHDARGRDAEPRTEFTASNPPAGLPTALTTGQHLRWSRCTSPPTARTGYDCATMKAPLDYRKPDGRTIDVALIRRKATGPNARRIGSLVLNFGGPGVSGVSGLPEFLNQYEPLLDRYDLVSFDPRGVGATIPVRCGKTADDGADACAEHSGALLPYIGTSHTARDLDLMRYLLGDERLHYFGVSYGTALGAVYAHLYPSHVGRLVLEASVDPTEDLDEEQVSQVKAVQAAFDRFAAHCAARIRHCPTGDGPEEAARRMARLADRLKKKPAPAGGGRNLDADDLAHAVSEHLRLGTDGWAPLAKALTALIDHSDGRPLSKSADDIGSADRAATPRDDSHAARTAITCADSSLRPDFERLDRDKARVTAASPVFGAAWSTGVYLCYDWPFDGERTTLQVNADGAAPVLVVGGTGDPITPYPGARHMARALGDGVGVLLTAEEEGHGTYPQNRCVKETVDHYLRTGRTPAPGTVCRGSMS

SEQ ID NO: 8445 - protein, 207 aa, Streptomyces avermitilis
VASPVAYAEAVASDTRRPVKEGQLTPHSLAFYMDVVASGTVLGAHPTDSPDRVTAMLGSDFAENSLDDHSMWRDYGMAEFFWIRETPDHPWEGHHFTLQVHRLSYSGGSIVNRAIRDRYGRFDRHLRFDKLERLLGKHGAPLEDAPDVNAPTFTRHWQPASQVSVMVFRAHEEWRQRRRGDDRIGDVYAIQSPARHRGPGRAAPAAP

SEQ ID NO: 8446 - protein, 312 aa, Streptomyces avermitilis
MVMRVFVAGGTGVLGRRLVPQLVARGHQVTATTTSAAKLGLVERLGGEAVVMDGLDAVSVGEAVAAARPDVIVHQMTGISMAHAGKPDLKHFDRWSVPTVRLRTEGTDHLLAAAEATGVAHFVAQGYANWNGIREGGWVKTEEDALDLHEGTAAYTAMAALRHVEDAVLKADGAVMRYGAFYGPGATDDQLVLVRKRQFPLVGDGTGYASWVHLDDAASATVLAVEQKTRGVFNIVDDEPAPESEWLPWLAACAGAKPPMRVPRWLARLLAGDVVVTMMTEGRGFSNAKAKRELGWELRYPSWRQGFKEGLS

SEQ ID NO: 8447 - protein, 307 aa, Streptomyces avermitilis
VTRTEEFEELRPLLFSVAYRILGSVSEAEDAVQETWLRYELSPARPASARAFLSAVVTRVSIDVLRSARMRREEYVGPWFPEPLLTDPYEDPEQSAELADSLSMAALLLLERLSPLERAVFVLREVFAFGFPEIASAVGRSEAACRQLAVRARRHMDAGRPRFEADRKEREELAERFFEALREGNVDGLRELLAADVSLVGDGGGKAPQWARGFFGVGQVSQMLATLFPPFFRIGGVVDPHQVNGQPGALFRDRDGKVLNTWTLDILGGQIQAIRTVSNPDKLGHLGPVADAWAVLRETQQVRPDPE

SEQ ID NO: 8448 - protein, 193 aa, Streptomyces avermitilis
MIRIGIIIGSTRPGRNGDRVAQWVRDLAAEHAGDAADFELVDLKDHALPLLDEPVPAAMAPGRQPHTRRWAERIGSCDAFIVVTPEYNTAPPAALTNAIDYLYEEWGGKAVAYVGYGIFGAVMAVQKLRAQAGPLRMADIGPQVALSLREDFVAFADFQPQELHVAEVHGLVDELLAWAKALGPLRAASPAAA

SEQ ID NO: 8449 - protein, 255 aa, Streptomyces avermitilis
VIEHATHQKIALITGANKGIGRAAAEQLAALGMTVLIGARDPRRGEEAAAALRAAGGNAHQVTLDVTDQATARAAAQQIDERFGHLDVLINNAGITGSGQVSPEDAHDQVPSSVNLDMVRAVFETNVFGVIAVTNAMLPLLRRSPAPRIVNVSSAAGSLTIASDPDGPLTGLPTSAAYTPSKTALNALTVQYANELRKNGFLVNAADPGYVDTEINNHSGYLTVAQGAAALVRLATLGADGPTGGFFSEDGPVPW

SEQ ID NO: 8450 - protein, 376 aa, Streptomyces avermitilis
MDTTPLPARTEVAIVGAGPAGLALAVTLAASGIDFVVLDRLAEGANTSRAAVVHARTLEVLDELGASEELIARGIQVTRFAVRDGSRRLLTVPFDKLPTAHPYTLMVPQYETESVLLARLRALGGDVHRPHEVTSVVQDEDGVTLTMSTGQTLRAGYAVGTDGMHSTVREASGIGFTGSAYSESFVLADVVMDWAPGPSEVSLTFGTAGLTVVAPLPGGHYRVVATVDDAPDTPDLAFVQQLLDERAPGQAKVTGLAWSSRFRVHHRVADHYRVGRVLLAGDAAHVHSPAGGQGMNTGIQDGHALGRAFATGQLDGYEARRRPVAQRVVAFTDRMTRIATTHSAIARGARNIVLPLLGHTGLPKKLATELAELNYR

SEQ ID NO: 8451 - protein, 193 aa, Streptomyces avermitilis
MTSGTEITSTDKRSDRTRAAILRAARERFAAQGYERTTIRAVAADADIDPSMVMRYFGNKAQLFDMALAIDLRLPDLTAVAPDELARALVRHFLDRWEGDPADDALLVLLRSAVTNEHAAARMHEIFATQIAPSLASALGPELAARRAGLISSQLLGLGLTRYLLRLPAVTALTRDEIEDGLAPAIKATLESS

SEQ ID NO: 8452 - protein, 194 aa, Streptomyces avermitilis
MGLGYPCGCAPRGDRAMGDVEGRRIVAGVSGSLGSLAALHRAAHEARRSRAELLAVLAWEPPGGDLAHRRSLLASPATDFRQEAGERLLAALRTAFGDAGPGVPFQGLVARGTPGRALVETADRADDLLVVGAGYRGRMHRALFPSVARYCVAHAACPVLAVPPSPLQGELASVHRRISLRLPLDARELTDGRP

SEQ ID NO: 8453 - protein, 138 aa, Streptomyces avermitilis
MSPVEYSEDPEPSERFPAGLLHVPVRSGPAGCTARFFRTPLGGRTAVGFTSAAKLTATLGTDQACIRLSEPALRALAAPLGVTALTVDPPFSAPAADRTAATIREHENSWRRLHPRRVGALRVTGAAAVVACLNLLIG

SEQ ID NO: 8454 - protein, 466 aa, Streptomyces avermitilis
MSVSVPSSLPSALPPSVPALPPSDPQTLSRLLGDTDGLSVWPRSARPEADGDVCVGGVSLTEAADRFGTPVYVLDEQEVRERCRTYRTAFPEADVVYAAKAFLCRAMAHWVQEEGLGLDVCSAGELALAVTTGFPPEKIVMHGNAKSPEDLRTALRLGVGRIVVDSASEIARLAAITPCDTRQKVMVRVVPGIAAGGHTKIRTGTDDQNFGLSLTDGSAQHAITRILDQPHLELVGLHCHIGSQIAAVKPYVAAVRRMVGLMARVRDQHGVILPQLNIGGGHAIAYRPGDETMNVGVLAGRVRAELEDGCARARLPVPRLTIEPGRAVVGPAGVAVYRVLAVKRTGEHTFVAVDGGMSDNPRPALYGVRYAPRLIGRPSSAPSRFVTVVGRHCEAGDVLADGVALPGDVRPGDLLAVPAAGAYHLSMTSGYNLVGRPPVVAVSDGIARVLVRRESLDDMSRRDVGL

SEQ ID NO: 8455 - protein, 222 aa, Streptomyces avermitilis
MNNSVTNTARLLWAGLRSLLVLTVVTGVLYPLAVTGVAQGLFSDQANGSEIKADGKVVGSSLIGQAYNLPLKKGQETPEPDLKWFQGRPANGLGTNSVNTQYSLILSGATNRSGDNADLIKWVKDAKAAVVKDNSTADHKVKPSDVPADAVTSSGSGLDPDISPEYADLQVHRIAEQNHLAVAPVQKLVDEHTDGRTLGFIGEPRVNVLELNIALKELVATS

SEQ ID NO: 8456 - protein, 694 aa, Streptomyces avermitilis
MSTATPTRAPHSDVPTGHKDEGRVGAGLFDPKQLLKSLPDAFRKLDPRVMVKSPVMFVVLVGSVLTTVFSFKDPGDWFGWAISAWLWLTVIFANLAEAVAEGRGKAQADTLRRAKTDTVARRADGTVVPGTELRVGDLVVCEAGDIIPGDGDVVEGVASVDESAITGESAPVIRESGGDRSAVTGGTKVLSDRIVIKITTKPGETFIDRMIALVEGAARQKTPNEIALNILLASLTIVFLLAVATLPPFADYAGTHLTMVVLVALLVCLIPTTIGALLSAIGIAGMDRLVQRNVLAMSGRAVEAAGDVSTLLLDKTGTITLGNRQASEFVPVTGTTEAEVADAAQLSSLADETPEGRSIVVLAKETYGLRERHQGELSGAEWIAFTAQTRMSGVDIDGRKIRKGAAGSVIAWVREQGGEVSEDADTLANRISEAGGTPLLVAVEDADGARILGVIHLKDVVKEGMRERFDELRRMGIKTVMITGDNPLTAKAIAEEAGVDDFLAEATPEDKMALIKREQSGGKLVAMTGDGTNDAPALAQADVGVAMNTGTSAAKEAGNMVDLDSNPTKLIEIVEIGKQLLITRGALTTFSIANDVAKYFAIIPALFAVVYPGLDKLNIMQLSSPDSAILSAVIFNALIIIALVPLALRGVRYRPVSADRMLRRNLGIYGLGGLVAPFIGIKIIDLLISLIPGL

SEQ ID NO: 8457 - protein, 554 aa, Streptomyces avermitilis
MSPVLAGVLQLVALIAALALAYRPLGDYMAKVYSSDKHLRVEKWIYKGIGADPDTQMRWPAYLRGVLAFSAVSVLFLYVLQRVQGSLPGSLGFRSIDPDQAFNTAASFVTNTNWQSYYGEQAMGHVVQTGGLAVQNFVSASVGIAVAVALVRGFSRSRTGELGNFWSDLVRGTVRVLLPVSVIAAIVLVACGAIQNFSGIHSVGQFMGGSQQWNGGAVASQEAIKEAGTNGGGYFNANSAHPFENPGPFSNLFEIFLILLIPFALTRTFGRMVGSLRQGYAILATMVTIWIGFTALMMWTEFAHHGPAFQIAGGAMEGKETRFGVGGSSIFAVATTLTSTGAVDSFHSSFTGLGGGITLLSMQLGEIAPGGTGSGLYGILIMAVIAVFIAGLMVGRTPEYLGKKIGTREIKFAACYILITPALALVFTAAAMALPTPGHSMTNSGAHGFSEILYAYTSGANNNGSAFAGLNADTQWFNTTIGIVMLLGRFVPMVFVLALAGSLAEQKPIPATVGTLRTEKPLFTGLLVGAILIITGLTYFPALALGPLAEGLAS

SEQ ID NO: 8458 - protein, 161 aa, Streptomyces avermitilis
VPAFRVPRVRRAQHAEVALGAVLGVMLIGLSVLISRFHLQPVEGVTVLAQLADASLGHNWAFYVVQFATMILLALSANTSFGGLPVLLKLPARDNYLPHVFALKADRQVHRHGVLTLAGVVAALLVFSGGDTNTLVPLFAIGVFIGFTIAQVGMVRHWRAE

SEQ ID NO: 8459 - protein, 139 aa, Streptomyces avermitilis
MTDMSPLTITTRDAPTGPVLEITGDLDHETSPELRHAIDRLTLARGQLLVLDLAGLRFCDSSGITLLLAARNLAIEAGVDTVLAAVPANTARVLGIVGLDQVFAFYPDTRAATAAHPPTAVIADTTPRGTGSRADQVES

SEQ ID NO: 8460 - protein, 415 aa, Streptomyces avermitilis
MCRDRDVEQDADATDTVFTSLLEDSAEELYEQAPCGYLSTLMDGTIAKINTTLLDWLGLSRRDVVGRMRFTDLLTVGGKLYHETHFAPLLQMKGEVNGIALDLKAADGQRLPVLVTSKVKTSHDGEPMLVRSTVFDARDRRAYETELLRARRQAEADRERLQEALAVLQQSLLPSTLPTVPGLEVASHYHTASPDLIGGDFYDLFPLDGTRWAFFLGDVCGKGPKAAAVTSLTRYTLRAAALHEPDPVNVLATLNTVLHERYTGSEPRYCTAVFGFLEPQSDGCAVHLASGGHPPALVQRADAYADYLPTPGGMLIGVLPRAQFTAARTVLLPGDTLLLYTDGLTEARIGPRRELYGDDALRAFTAARTPAGPQALITALTGLLAGFGEGLDDDTALLAFGVPASLPDQPLRVDD

SEQ ID NO: 8461 - protein, 267 aa, Streptomyces avermitilis
MDIRRRNNVVVTGRPDGPVVLLAHGFGCDQNMWRLVVPALADDFRVVLFDYVGSGRSDLSAWSEQRYSSLEGYALDVLEVCEELDLRDVAFVGHSVSAMVGVLAAQKAPERFSRLVMVAPSPRYIDEDGYRGGFSAEDIDELLTSLDSNYLGWSATMAPVIMDNPDRPELGEELTASFCATDPDIARAFARTTFLSDSRQDLKSVAVPTLVLECAQDVIAPREVGAYVHAAIPGSRLVTLDATGHCPQLSAPDATAQAITAFLGATR

SEQ ID NO: 8462 - protein, 828 aa, Streptomyces avermitilis
VRRRETVVLWNRPPEGIHTMATQSTAHEYLDEPFDITHAAVVRIDAHGLIEGWSKGAQTLLGYRASEILGRPAASLLTGEADLASAMSEPRRTGNGWEGLIAVRHRSGHHVELALRACPFQDDGGRRSWLAVVTPVSAPRRWALEQAVLHGLLDQSPIGIAVVDTDLRYQMVNRVLEDMDGVPVQLRIGRRVGEAVPGEADSTLEWQARQALGSGQTLLMFQHAVPEPGEPYRQDRERVRLCASFRLQDRTGHLLGVCHTTVDVTDHDRARQRLALVNEASSRIGTTLDLDRTVRELAEIVVPQVADFVAVDLLDTVLAARDLTPVAVDGETALRRAAHLSIQEDHPEVVVAAGEPTRYPPTSPQSRCLATGRSIRHPVIDGSTPWLAQDPLRKAKLDLLGVHSHLVVPLQARGMTMGVATLLRWKHAEPFDDDDQLLVEELAARAAVCIENARRFAREHNTALALQHSLLPHGLPEQSAVEAAYRYLPTDTEAGVGGDWFDVIPLSGARVALVVGDVVGHGIHAAATMGRLRTAVQTLADLDLPPDELLARLDDLVIRLADEADAAAGGALVIGGTCVYGIYDPISRKLVVARAGHPSPAIAHLREPVEFPDIPAGPPLGLGGLPFESAEIDVEEGSVIAFYTDGLIEASDRDVDVGFERLCFALAHPDRPLDEICDTMVRMLLPEHPHDDVAFLVARTRALGADNVASWDIPAVPSAVHTIRQMTNRQLSAWDLDDAAFTTELIVSELVTNAIRHASPPLSLRLIRERALICEVSDSSNTSPHLRRPLGTDEGGRGLFLVAQVAQRWGTRYTPQGKTIWAEQPLPS

SEQ ID NO: 8463 - protein, 229 aa, Streptomyces avermitilis
MALPRSPAAALPGPQWAEQDSWSYRDLDQAPLSAECRDELETLRAEAGGGRPPGGWPAGWPAPPLVVRESLFLCLFRAALARGELRYGRFVWQDLDSELGVHYQESRAALLNGIVLIGLRTFCDQISGGEAAQMELVVPMAVGTPNEPAGLVVAAETTARGPELLVDVWGETAVAACWQALIAVCRYVASLAGEDQYCRPLVPGGVHAADGFLTVVPQAMHAVDRQGPR

SEQ ID NO: 8464 - protein, 3338 aa, Streptomyces avermitilis
MTLPTLPPELVQLAVALGVLRREPGDGADPRLEVDQAFFADPGKQLSGVLSDPVRRAAALELAAALLGSAKNAALETEGAQPGRTWIPLPTGDGATAGRLYLVVDASGDTVALSLAGRATLRAAEVECAASVVVPMVATGPGGTRFLPGTADGDIRVAVSLRLPPAPGDFGLGGLRVGADVPTHALGRPRLRLSLTGLRLPGEPARDLDIDDGSLPGRLGELIPLLADLLTGLLRSRGTIDPASAGRLRLLLTLFGLGDTSVIPPLPLAELPGSGPLVFADWLRAVFLPKPGEPVPPPAARAWLETLGQLLGLRLSLPLRGEGTTASPYLLCLSPLPGVRVCVRLVAQAADDGLELRLGLSAAAEVSGAVSAHAAADLLALRLGGGADVLWLPEVRVHVEVSGAEGHLLRRPAPPQPVTLMVGTLSAGFSIGSDRAVRLLLEAADVVLDGHPYSRLDLSSVEALAAAAAQVGVDALHDALETLFSNDEDGGGRRATALLVLLALRKPALDWPVGLPPLTEIVGNPAYALLRYHSRVLADAPHRWGAIAAQLAVLVRAPAPTGEGSAVDPWVVSVGDVGLPARPALLLWQDDAEGAPRLTVGVRLVSAPLPISGGAVRLSAALDAVRLTLPAVDPPSAVALTAAELRLAWGEDLSFDAGPVQLKAGSLLLAAGWRQGAGWGARARVTGASVTVEGDEVALPDPLELATGVDPLLPGPGSALWPALTRLAGLALLRTTPREGLDPRSLLAALLGWLPARGRLRVPGEEDTGIDLAALIADWPPLPLAGLVTDPVETVRSWLGDVLAGSGGADRSVAAIALLRELFARGGPERIRQVAVAGDGTHERPWRLPLDDSGPELLIWLDPDGPGLDGLGEVLDALVPADLTAALDGSAPLPGVERLTAVLSGAARFDSDLAELLDERPDSAADLWALLNHAAGSDGLLPVSAQVLPGTTHPTVVLPRGHLCAPETFELSDHLPGADPTRTVYVSSDLPGIRPWPGQPGAAGAHLLDLRTPGLAAESFGLGGLAATGPWYVLLPPTEEATVRLRPAVAEFRRLAGAPVVLVAHSLAARAAVQVWSEGGLAQLVTLGGPLSDTARPGPLDGLEQPGVHDAFRLLQSLVGLLPAGSSTDGSPLAELVATWAAVTGDAPSGLRSVPFPVSAFTPVALPSAAPAPVLSVVTQFTREELHGALTALVAAVAAQVRRRLPGGGAVPGRSRATHLGLGLSFRSTAAAAEGIVCGSELRLDAWRVPLPAAQRSAPTVTPRLHVRLTLRRPGGWLLDGRPGAGARTGPQPRLRGADLLVGIGPRLDDASVSAVLHDAALDGVGHGRLAITPHTLDAAARRFLGLLADTLSPRPTAGPVRDLVDLLVQAGVAVLTAEERVELRPDTLERVIADPAGLIRTLLSDPAVRGTLRRLAGLPDGGAGLLSAGGLEVGVTPDCVITVSTPERGLPLAGIATVHGTLVVGPERAPALTLRVRSGQVEAAVLPEPDLPALARLVMLTTGGEAIRWGLQSLRDRGILLDPLLDVLGLLAHDPRRPDAPGSVRSPVPLITAPGRRLVEVLGADRPGEPFLLAPGHLARLIDAVAQLIGLPGGLTALSLPGGGSVSVAEDGTDLEVTLRLRDGSGPAALESAVHWRLRPGPTVTAWLTLSAEQSGPGGFGAGLELEVGPEVKVAARLTPRAGAPRLDIPLYPLTPGLGALAELGQQAAQYALPMLLDVLRDLADPADPGDPRLKQIAAALAGLLAALELTDADGAASIEQLKLLASAPADEFGARFRRHPSEVTAALKALARALIGDAAAQPPVLWRSPGGRVVVDLDAAPGGVPRLTVTADGLHPVPGTDAEVSFAATTAGPAPCHLSWSVVDPDALFPGPVDLMPFVRVTLGGVDDRVEAGLWLDPPGTTDREALVLRLPGSPTLVHRRGAADSAEVAAAVPKLIRRIAVPLAADLALTPAPVTDLLKAPVGNDSTVGKVLHSARILTGTGSPPGAPWRLADGLLDAPTPRVLSALAGFLTALAPRLGPVRLQLLEAEDGPGQRRYGLGLELVETPYPLLELGDVVVALSADGSWEPPAAGAGTAHVEVWLGSLPDTLPGPDPEFSPALRLRGLGLQVGGAKGPLLDQGLRIDALSLHGSYARDASGFQHAGARLELRGLAVPFGSAGGGTNPVAAKILQPEAAGGDATAAAPGFDPALVVWKQGQDPVALRLSAGAGSGPWWLSVEKQLGPLYLEQVGLSVAYDGDRLREVGVLVDGGVALGGLAVGVDDLALHVPWATPADPATWRLGLAGLAVSYSGPSVSVVGGLRRRERDGGVEYAGMLKVEAAGFGLTAVGAYGTYPVVGTAERYTSMFGIAAIAAPIGGPPAFFITGIGAGLGLNRGLVLPGKVTDVGEFPLVAAMDPSSQLVREPMKALDSMGRTFPPRRGAFWLAAGVRFTSFTVVESVAVLAVTFDHDVEVVLLGLCRMELPNPAKPIVSIELALRARFSAREAVLSVEAQLTDNSWLLNRDCRVSGGFAMVIWFRTGEFVLSLGGYHPRFAKPAHYPDVPRLGIHWRVSDAIAIKGESYFTLTSSCVMAGARVEAAFDGGFVQASFVAGVDALVSWDPFFYDVGVYVAVSARLEIDIRVWFVHVRITIGFSIAAQLTVQGPDVRGVAVLDLDVSKVEVAFGAVDAPGSPPPLGWAAFHDKYLVAGDPHGETMSLTVRAGGAARDPGGATGAPEDGSRERPLLLTSEFTLASTTRTASNRAGGEVLSGPALDLGPMRRVDVVSEHRVEMVRLDADGKPVGTPVDLASTAVRGNVPDGVWRWFDDVELDEGGVREAFTGLVLSAVTRLGGGLTTGSVDEVDPGPRRPLPLSDDRDPAGVRSAAMEAAVRWSRTQSGANTLDRATEFLVRGAGFAAFGRCLSGEPSRPSDFALALLPADRISPPRLARITEGLVTPARPPLPLTPRQAPQQPDPEPPRVAPPVLLASLRPPVGPVRRDGRTTVRVPRWPRRAAPTLAEAREQALPTAAQLFTRPALADRVGASGATARDRGRRFSRSGEEREVLRGLLSVDRSAPWLRSGERDIVDGGPVRLGAGQIQVWRLRRAAEDVRAERPRLAVTGDQRVRIVALDRAGAALVDSEVAGTAEVPVPRGTQLLALIGLGTTPTANRPRRAGLSGWHPGSFGAQVMPGTVLVPGARVSTAAPGSKRGLRPARVALVTGFDLVGRQGLTTTELPASTHSVVVVLSAAGPVKDTDGLLLGLDGAQRARGATEPTPPLAVEQGGQTVLLYPVTPQGGSPVSVTTGHDERWRPSGVLGSAQPAERVARAILRYGLPALTGDLAGEGSGRSAVTWIGDV

SEQ ID NO: 8465 - protein, 522 aa, Streptomyces avermitilis
MTELGEGQFRLHGFARPPVTAGPHLVRMTQSVDQGDPIAPVERHALVTAPQFALPPGELRSVFPPPEAVGPFDTRFAQVALRRRTLPWERLVTVGLDPQRRPWLALVLLTQSEGDVVTGVPVSTAVPASLHGALGISGASGTCDRLDTTRDVVQALFPRPDELELLCHVREVSLGDSELSVGDDDGFLAVVICARLPRPGLAYRACLVSLEGRIAELPAATGDPASGPGGAEAAPGGAGVSFPVLAHWRFRCAAEPGDFDSLMKGLHVGSLGTVRGKCPAVAPSGHTVIGHTTRRGEETAAWYRGPLTPREVPRRPAGSPCLTADQGRAVAADGLEDLTVAAAHEVGRLLALSSPRFLASLRDWRRRTLAADAVAAALELLPEVRDLGLTRLTVGQGLGLALIGTLVDGREPLGAPVPLADAEWALPQFPPDVIVSGTGLPRDLVRQILGDLPVLTDPDPTPPASPLDQTFDGLRQTPDQLAPLRDALRERVRWIARQAGLDPDTTLFDPAYAPTTLEELFP

SEQ ID NO: 8466 - protein, 287 aa, Streptomyces avermitilis
MSTRYRSEAAVEQVLTAAAGKVSAGEPPPDDVLDWLARLRLLEGVPFAYLVTDERLLPLESARFFFLDRNWTDAAVDGALSAGPSTTRDRAHLVARHGRIRDAVDASERNVWIKAARPGLSYDAEPVGTVTGFLLRSRAVSGWPGLRAQAFHEGQPVRPLRIERLAPAVLLALFDGLPTRVLVEEPHQGLQFGVDLADGGVFTVARRPPEPEGAATVLFRPSGCGVVDVRRLWADLGHTTAADGAATFALHLVQRPYQQEFSGTGEGPLFSPSISLDDLAAAFEESP

SEQ ID NO: 8467 - protein, 1198 aa, Streptomyces avermitilis
VTEAFPLHPAFAVTARTGLTAAASRSWAAGLHRGPRLLVPVDVQALVVHEGHAEARADIGLRLFDGLSRDPSAPGPRTSAPFTPAAPLGPGVHLHWALPDALTHAVADSPGAEPVWQPLPDRWVVVRLGHYTGQPRAVQAWVLEAEKGGSGALDGWQPGGARAYRTPQLRPEQLTAVCGGDPAWAAAYDNVAERFAHYDDWSTVPALHRRALAYVVVGWYSRPELDPVAAADTPAAFRALLDRLGWQVDTARLTRAQAEAERSTTQAEALGRRSADLPPPASPALAGLLGAQQPAADPHAWWPRQTVFHGVVYGVHADSASAVDPRPEPGAPRVAIGATSAEALAALVAGELNRPDTEILYQAFAHGLATTLGEPDGLPRIEEEIHARGFVARPGAARAERVATGDPFTGLRPTTPPTPALDRVRADTASGIPDFVVGRAVLADLHLIENQPERVAPPADPRRTETVQRPLPRRFHPQDPVLVMRGLRRSLRHGYDGVRTPGERLACRLTGDTVTRLAGVIDGRDLLARGLDHGSLPAEAEALVVEAAVEDPYADYIEALGRLHRYGLPPEEAARRLRAEGAMMVWSLAFPSRAAPLTHLSLKDGTGSSPVGITLWRQAWVPLWCEWELEWNPHPDAGDWELGELDFDPHSAAGFSQTGATVLRGRSSLVSAPSRALGDEISRFLAEEDRLDLRGEGRIDDALASRLRRLSADQGVPDLVSAGFDGLRERMLGFTDDVALTPGVPPAPTEPPDLLRAGFARLRQLRVVDAFGRTVDLLDPATPPAYVGSGLRGPARDVFALPPRVNQPATLSFRLVDASDELREAGIDQQEGAASPLAGWLLADHADGAVEFFAPGGRALGQLAHDALSGAVVWEGPPGHRAPVGAPPSAAFGGQPRLRHLLGLAEGLIDRDSRERATGVSRSDTPLDALLRIVDTTSTTVGAGGLTGSEHTAQLVGRPIAVVRARLMLDIEPEGEHPALSPAARAGRAAAWAWLAGRRFPVRLGALTRLDDGLLAYFVDDDYGLIHPVHADVARVATPSGRHRGDFAALGQRATTPRPIGTPTVADGSALSLLPGRSLRLTLLMDPAAKVHATSGILPRKSVDLLRDWFAEDLARLVPSVRVGPVLVDPATIRMPLTPAPDGERLWTRRTAPLSWRDDPVVAATQQALLPEVPAWAQEGYLRLAPEAREAPQDGGTG

SEQ ID NO: 8468 - protein, 828 aa, Streptomyces avermitilis
VLIRPRVPRPDEPALTEVDQFGSLAGLVVGPLPADFTLVTIGRVTVDGRGTDALRVAAEVDRAYLTGETAWVLPPTSAGYFRQETRVDLRTDLPSPRYLDYRILAGTPRRVAAEQPVRLETATLDGFLELAEEGESERPAGRTHLEYLTSVRKLRVDSELDQYRQRMIQNRRNIPPYDQTPGSSWELPRRAARLAALLRVQHGFERLDLAQVLAGIDGADRQTPGPLDPAPRADLALTWSGDLGRALAAYVRARHAPGVPAADRGRSLDHWVARHASTPRLLGDIDGVNLGESFDPHRSLAAQLREYYDGAVDRRCTAFVAATRTSAGAPALPLAPGFGPPRFADAAVGFVAGEIVAFAVDFLRFALGGAFESVRSRAEAMLAPDSPEVLQLTHRLLHFVEAGLAAELSPPSDTALVILRRDGSPIPGFTVRLIPPSGGRHSGIAATTDALGTLMVPDAGTRAWTVACADHELAPAAEATDPVPVTELRPGRTPLDLPRHHRLPPGTTTELVAREVLVLVCPRCDAALRVVEPPPRSLECPRDGYDLSELRTTVITDIGRFNAPVSGQRPHRTPLRLTSCGTRPVDTAHGPVAACWDESRFLHPASGDYELWAMTPRGPLTVSVVGRATWGAAPPQIDPPLRTWDFHEAASGPLAPPPYRGSPVPLSENRPLASVYRWITIHHSADPVTYTHEGPRTIQRAHFADDKADIGYHYIIDGAGTIYEGRPLGIEGSHAELFNAGNLGIVLTGDFGPRWQNQWARYDHPTPKQLTTLDVLVDVLAVRFGISSVWGHQPRKKQSRAPASTQCPGEYLMSHVDELRLVYPGDPF

SEQ ID NO: 8469 - protein, 235 aa, Streptomyces avermitilis
MTRPADPPGAPVRVLIADDQALLRGSLRVLVDTEPGLVATSEAATGTEAVRLARQDPPDVVLMDVRMPEMDGIEATRQICGSPETADVKVLILTMFDLDEYVYAALRAGASGFLLKDTPPSELLAAVRVIAAGEALLAPAVTRRLIAEFVHRPEPSRPLRRTLDGVTEREREVLTLIACGLSNTEIAERLYLGIATVKTHVSHLLTKLATRDRAQLVIVAYESGLVTVARPPIGS

SEQ ID NO: 8470 - protein, 341 aa, Streptomyces avermitilis
MRGRGWRSFSNRGWRRGSQPRAGRGGSLSSRTITGMIEVTDLTKRYGTTTVVEGLTFQVRTGRVTGFLGPNGAGKSTAMRMMLGLDRPTAGEVRIDGAPYQRLRDPLRTVGALLDARAVHPGRTALNHLRWLARSNRIPPRRVREVIELAGLRSAVRRRAGTFSLGMSQRLGIAAALLGDPAVLVLDEPVNGLDPEGVLWLRHLMRDLAAQGRTVFVSSHLMSEAALTVDHLVIIGRGRLLADTSMSEFIDRYTDVGVRVRTPEPRRLRDVLVGAGITVTDCSDGSLKVAAAAERIGELVAAHAVTVHEVTRKTVSLEEAFMRLTAAAVEYRAESPGGVRR

SEQ ID NO: 8471 - protein, 434 aa, Streptomyces avermitilis
MTATRGRASGCRRSGFDHRWTEAERRTPGYGRAVHAGTAVDPDDHPILARRLSRRRLIALDGVLVFAYACALLSTGPTGISSSSAPPLPAPVPWERLVLIAAATAPVAVRRIWPLPVFAVVLAVTAVAVVRDAAWDPFLSAAFALYTVAVTVPSRHWWQRWLPGLAIALLTVAGLAGAARAGEAFWWRGSPGLLLLGFAALLGAWQLGRAARQRRAFAVRAAEQLAQRAVTEERLRIARELHDVVTHSMGLIAVKVGVANHVLHIRPQEAYDALQVIERTSRTALNDMRRMLGVLRTSEGERQSAALGPLPGALALPDLVGQAGAQLTMRGVESLPDGVALAVYRIVQEALTNVAKHAGPEARCRVAVDANGHGVRLEITDDGGDRSPLAPKPGGHGIVGMRERVALYGGTFAAGPRPEGGFAVHASLPYEENT

SEQ ID NO: 8472 - protein, 257 aa, Streptomyces avermitilis
MTSNSPRAVLAAEWIKVWTVRSTSFTLLLAFVLSTGLGTVVAFSWRGHIERVVNFSPLFAGLYGVTLGQLALVVFGVLLVGSEYSSGSIRTSLSAVPRRGLLYGGKVLAGTLAALAGSTVTVIVTFAGAQAALGPYGITLTAHGVPAAVVGAIVYLTLICTLSMGIAAIVRSSAISLGVLLPLLFLGSQGLGNVPALKPVLQYLPDQAGLELMRIAGPPGDGRFGPDYGPSTALVILLAWTAAALTGGYLVLRRRDA

SEQ ID NO: 8473 - protein, 949 aa, Streptomyces avermitilis
MQGVSCLHPPRKPEELTLVDRETQFRALRLALTECAAGTVKLLVAEGGMGCGKSTFLGEALHTAAASGFAVLRAAGLPADHRQPLGVLQQLLNDPAPEDTARTAVRPMPVQHVRGALERLAAGAPLAIGIDDVQDADPESLHCLMRLTRHSPTSRILLLCTALACSPAADPVLEAELMRQTAFERITLDCLSLDGVTGLVSDRCARPTAPPPADYCLTVTGGNPLLLRALLEEHSEADAPSAPRPAEPSALHSPPQAAPPRPVVGGRFYQSVLACLSRTETAIRQTAGALAVLGGRARADLLPQLLGASPASVTRGLRALEATGLTTSGRFRHPVAEAAALDALDPSRRAHLHRRAAALQHHDGAAPRDVARHLLAARHAAGPWAVSVLRDAAEQSLAQDDVASAVSCLELAYGACVRERERPEIRIRLAAAFGRTNIAVAEEHLADLVATLREGELTGHQTALLVPLLVNHGRLGEAREAMDRLNAADDARGLCADGGFPMAAPWPSTAHLAARRDPAARRDPGTRRDPADKPFLPRQSGAPQPRPEDGRGQQPTAALWALPGNGTSEAAAHAAEQVLRSSPLTDSTLVLLVNAVRILARTGRYDTADIWCHRLLGEATRRRCPGWQAHLLAVRAELSLCRGLLADAKECAQRALTHVPGHSRSVFAGGPLACQVLACTAMGRYDEATQLLSHPVPEALFHSVYGLGYLRARGHFHLAMNRLPAAVRDFLTAGRVAREWGLDHPVLLPWRTDAAEAFLRLGETKRADQLLTEQLVSPHSGNPYVRGTALRLRAQTAAPAERLRLLSEAVSDLQSSGDRLALARALADLGAAYHSRNEPVRASATVRRAWQLAKECGAQALCDSILPSRGTKDRGPDGRAAATEALLSESEMRVATLAAGGNTNREIAGRLCVTVSTVEQHLTRVYRKLNITRRRELPTRLRHLADQAN

SEQ ID NO: 8474 - protein, 302 aa, Streptomyces avermitilis
VRECGRGIPVAVTRMVESLITSGTPCLLSEKGNFIVADLKGRAALVTGASRGIGRAIAQRLAAEGLLVAVHYGSQEKAAAETVEAIERVGGEAFPVRADLRRDDAVDTLFAEVENRLDGRPLHVLVNNAGVQSPPAPEGAGGKGEDVTSVSGVTAAEFDHLFRINVRAPFFIIQRALRLIGEGGRVINVSSALTRIAWPLLPYAMSKGALEMIAPRLALELGARGITVNTVAPGITATDMNRAMRDVPGVEERISALTALRRLGRPGDIAGVVAFLASDEGRWVTGQLVDASGGLCIAPAMS

SEQ ID NO: 8475 - protein, 283 aa, Streptomyces avermitilis
MMAVPEQTPPSSLEVGDYYDRLTDLMNRALGGNTHLGYWPQPGDGSSPGKAADRLTDLLIGKLRGITGRRVLDVGCGSGKPAVRLALSAPVDVVGVTVSEVQVGLATALAKQSHVADRVVFTRADAMELPFPDGSFDAAWALECLLHMPSPAQVIREIARVLRPGGRLAVTDVALRAFGRTGMKRGECTSQLLAVPALVHIDEYAGMIADAGLELHELTDIGDQVVGPSFAALRDHVNEHLDEYAAAFGIGVAEMRKVVAQCTTLPWTPDIGYVVLTARRPGE

SEQ ID NO: 8476 - protein, 3972 aa, Streptomyces avermitilis
VQRMDGGEEPRPAAGEVLGVADEADGGVVFVFPGQGPQWPGMGRELLDASDVFRESVRACEAAFAPYVDWSVEQVLRDSPDAPGLDRVDVVQPTLFAVMISLAALWRSQGVEPCAVLGHSLGEIAAAHVSGGLSLADAARVVTLWSQAQTTLAGTGALVSVAATPDELLPRIAPWTEDNPARLAVAAVNGPRSTVVSGAREAVADLVADLTAAQVRTRMIPVDVPAHSPLMYAIEERVVSGLLPITPRPSRIPFHSSVTGGRLDTRELDAAYWYRNMSSTVRFEPAARLLLQQGPKTFVEMSPHPVLTMGLQELAPDLGDTTGTADTVIMGTLRRGQGTLDHFLTSLAQLRGHGETSATTVLSARLTALSPTQQQSLLLDLVRAHTMAVLNDDGNERTASDAGPSASFAHLGFDSVMGVELRNRLSKATGLRLPVTLIFDHTTPAAVAARLRTAALGHLDEDTAPVPDSPSGHGGTAAADDPIAIIGMACRFPGGVRSPKDLWELAASGGDAIGPFPTDRGWPTEQRHAQDPTQPGTFYPQGGGFLHDAAHFDAGFFGISPREALAMDPQQRLLLETSWEAFERAGIDPLSVRGSRTGVFAGALSFDYGPRMDTASSEGAADVEGHILTGTTGSVLSGRIAYSFGLEGPAITVDTGCSASLVTLHLACQSLRSGECTLALAGGVSVMSTLGMFIEFSRQRGLSVDGRCKAYSAAADGTGWGEGVGMLLVERLSDAVRLGHRVLAVVRGSAVNQDGASNGLTAPNGPAQERVIRQALANAGLSVADVDVVEGHGTGTTLGDPIEAQALLATYGQRAGDRPLWLGSLKSNIGHTMAAAGVGGVIKMVMALREGVLPRTLHVDKPSPQVDWSAGAVRLLTEAVPWPGDAAGRLRRAGVSSFGIGGTNAHVILEEAPAAGGCVAGGGVLEGAPGLAISVAESVAAPVAVSAPVAESVPVPVPVPVPVPVSARSEAGLRAQAEALRQYVAVRPDVSLADVGAGLACGRAVLEHRAVVLAADREELVQGLGALAAGEPDRRVTTGHAPGGDRGGVVFVFPGQGGQWAGMGVRLLASSPVFARRMQACEEALAPWVDWSVVDILRRDAGDAVWERADVVQPVLFSVMVSLAALWRSYGIEPDAVLGHSQGEIAAAHVCGALSLKDAAKTVALRSRALAAVRGRGGMASVPLPAQEVEQLIGERWAGRLWVAAVNGPRSTAVSGDAEAVDEVLAYCAGTGVRARRIPVDYASHCPHVQPLREELLELLGDISPQPSGVPFFSTVEGTWLDTTTLDAAYWYRNLHQPVRFSDAVQALADDGHRVFVEVSPHPTLVPAIEDTTEDTAEDVTAIGSLRRGDNDTRRFLTALAHTHTTGIGTPTTWHHHYTHHHTHPHPHTHLDLPTYPFQHQHYWLESSQPGAGSGSGAGAGSGAGSGRAGTAGGTAEVESRFWDAVARQDLETVATTLAVPPSAGLDTVVPALSAWHRHQHDQARINTWTYQETWKPLTLPTTHQPHQTWLIAIPETQTHHPHITNILTNLHHHGITPIPLTLNHTHTNPQHLHHTLHHTRQQAQNHTTGAITGLLSLLALDETPHPHHPHTPTGTLLNLTLTQTHTQTHPPTPLWYATTNATTTHPNDPLTHPTQAQTWGLARTTLLEHPTHTAGIIDLPTTPTPHTLQHLTQTLTQPHHQTQLAIRTTGTHTRRLTPTTLTPTHQPPTPTPHGTTLITGGTGALATHLTHHLTTHQPTQHLLLTSRTGPHTPHAQHLTTQLQQKGIHLTITTCDTSNPDQLQQLLNTIPPQHPLTTVIHTAGILDDATLTNLTPTQLNNVLRAKAHSAHLLHQLTQHTPLTAFVLYSSAAATFGAPGQANYAAANAYLDALAHHRHTHHLPATSIAWGTWQGNGLADSDKARAYLDRRGFRPMSPELATAAVTQAIADTERPYVVIADIDWSKIEHTSQTSDLVSAAREREPAVQRPTPPAELHKTLAHQTSADQRAALLELVRDHVAAVLRHADPKAIAPDQSFRALGFDSLTAVEFRNLLIKATGLRLPVSLVFDHPTPAKLAVHLQNQLRGTAAESAPSAAAVTAEASVTEPIAIVGMACRFPGGVTSADDFWDLISSEQDAIGGFPTDRGWDLDTLYDPDPDHPGTCYTRNGGFLYDAGHFDAEFFGISPREALAMDPQQRLLLETAWETIEHAGINPHTLHGTPTGVFTGTNGQDYALRVHNAGQSTDGFALTGTAGSVISGRISYTFGFEGPAVSVDTACSSSLVALHLACQALRAGECSMALAGGVTVMSSPGAFVEFSRQRGLAADGHCKAFSAAADGTGWGEGVGMLLVERLSDAHRNGHRVLAVVRGSAVNQDGASNGLTAPNGPSQQRVIRQALANAGLSAGDVDAVEAHGTGTTLGDPIEAQALLATYGQDRAGEGPLWLGSVKSNVGHTQAAAGVAGVIKMVMALRHGLLPRTLHVDEPSPHVDWSAGAVQLLTETVPWPGGEGRLRRAGVSSFGVSGTNAHVILEEAPADDVPGGPPAGEGDAGSDDEAAAGSPGVWPWLVSAKSQPALRAQAQALHAHLTDHPGLDLADVGYTLAHARAVFDHRATLIAADRDTFLQALQALAAGEPHPAVIHSSAPGGTGTGEAAGKTAFICSGQGTQRPGMAHGLYHTHPVFAAALNDICTHLDPHLDHPLLPLLTQNDNDNEDAAALLQQTRYAQPALFAFQVALHRLLTDGYHITPHYYAGHSLGEITAAHLAGILTLTDATTLITQRATLMQTMPPGTMTTLHTTPHHITHHLTAHENDLAIAAINTPTSLVISGTPHTVQHITTLCQQQGIKTKTLPTNHAFHSPHTNPILNQLHQHTQTLTYHPPHTPLITANTPPDQLLTPHYWTQQARNTVDYATTTQTLHQHGVTTYIELGPDNTLTTLTHHNLPNPPTTTLTLTHPHHHPQTHLLTNLAKTTTTWHPHHYTHHDNQPHTHTHLDLPTYPFQHHHYWLESTQPGAGNVSAAGLDPTEHPLLGATLELATDGGALLAGRLSLRSHPWLADHAVGGTVLLSGATFLELALHAGTYVGCDRVDELTLHAPLVVPVDGGVSVQVGVAAADGEGRRLVSVYARGGSACGGGGASGGVWTCHASGVLVEAAAGGVVVDGLAGVWPPRGAVAVDVDGVRDRLAGAGCVLGPVFSGLRAVWRDGGDLLAEVCLPEEAWGDAAGFGLHPALLDGVVQPLSVLLPGGTGFGEGAGFGEGVRVPAVWGGVSLHRAGVTGVRVRVSAVGRGGGREAVSVVVGDEAGVPVASVDRLELRPVDMGQLRAVSVSAGRRGSLYAVQWAEVGPVPVCGQAWAWHEDVGESGGGPVPGVVVLRCPDAGAGGGGGGGGGGGVGEVVGGVLGVVQGWLGLERFAGSRLVVVTRGAVVAGPEDGPVDVVGASVWGLVRSAQAEHPDRFVLLDLDTDTGTDLDTGAGAGWGVDGGRVAAVVACGEPQLAVRGERLLAARLKRLESSGDVPAQRSGDTRARRSDVPAQRSGGVPARRSVDVSGREVLPWLSGGSVLVTGGTGVLGAAVARHLAGVCGVRDLLLVSRRGPDAPGAEGLRAELAALGAEVRIVACDVGERREVVRLLEGVPAGCPLTGVVHAAGVLDDATIASLTPERLGTVFAAKVDAALLLDELTRGMELSAFVLFSSAAGILGSAGQGNYAAANAALDALAYRRRAAGLPGVSLAWGLWEEASGMTGHLAGTDHRRIIRSGLHPMSTPDALALFDAALALDRPVLLPADLRPAPPLPPLLQDLLPATRRRTTRTTTTGGADNGAQLHARLAGQTHEQQHTTLLALVRSHIATVLGHTTPDTIPPDRAFRDLGFDSLTAVELRNRLSRTTGLRLPTTLAFDHPNPTTLTHHLHTQLQPQPDNAVAPVLAELDKLESALSALDKTDSASERVTLRLKSLMLRWNAPQHPTAESADDDEKFTSATEAEIFKFIDNDLGLS

SEQ ID NO: 8477 - protein, 6239 aa, Streptomyces avermitilis
MQLANEAKLLEYLKRVTADLDRTRRRLYEVVEREQEPIAIVGMACRYPGGATSPTRLWHLVKSQTDAIGEFPTDRGWNLEQLYDPDPDRSGTSYTRSGGFLYDAGDFDAAFFELSPREALAMDPQQRLLLETTWETFEQGGIDPRSMRGSRTGVFVGINPEDYTTGYTHQPSNAVEGYLLTGSAASIASGRISYNFGLEGPAITIDTACSSSLVALHLACQALRSGECTMALAGGASVMATPFVFTEFSRQRGLAADGRCKAFSAAADGTGWSEGVGMLLVERLSDARRNGHRVLAVVRGSAVNQDGASNGLTAPNGRSQVKVIRQALANAHLSPADVDAVEAHGTGTTLGDPIEAQALVEAYGQDRPNGRPLWLGTLKSNIGHSMAAAGVGGVIKMVMALRNGLLPRTLHVDEPSPHVDWSAGAVQLLTETVPWPGGEGRLRRAGVSSFGVSGTNAHVILEEAPAHNIPSDTPADDVPGESAADEDAGSGDEAAAGSPGVWPWLVSAKSQPALRAQAQALHAHLTDHPGLDLADVGYTLAHARAVFDHRATLIAADRDTFLQALQALAAGEPHPAVIHSSAPGGTGTGEAAGKTAFICSGQGTQRPGMAHGLYHTHPVFAAALNDICTHLDPHLDHPLLPLLTQDPNTQDTTTLEEAAALLQQTRYAQPALFAFQVALHRLLTDGYHITPHYYAGHSLGEITAAHLAGILTLTDATTLITQRATLMQTMPPGTMTTLHTTPHHITHHLTAHENDLAIAAINTPTSLVISGTPHTVQHITTLCQQQGIKTKTLPTNHAFHSPHTNPILNQLHQHTQTLTYHPPHTPLITANTPPDQLLTPHYWTQQARNTVDYATTTQTLHQHGVTTYIELGPDNTLTTLTHDNLPNTPTTTLTLTHPHHHPQTHLLTNLAKTTTTWHPHHYTHHHNQPHTHTHLDLPTYPFQHHHYWLQPPGKPSDPSPSEGREQATTPSTPLRDVLVGKSPQERDEELLRLVRTHAAAVLGHATPEVIVPNKAFKELGFDSLAAIQLRNRLLADVDLPLPATLIFDYPTPMALCQFLRAAIVGADTGTTTRLPLTAVPADEPIAIVGMACRYPGDVRTVDDLWQVVSGGHDAIGGFPTNRGWDLDTLYNPDPDHHGTSYTRSGGFLYDAGNFDPDFFGISPREALAMDPQQRLLLETAWESIEHACINPDSLRGTPTGVFAGLTYHDYAARFPTAPAGFEGYLGHGSAGSIASGRVAYALGLEGPALTVDTACSSSLVALHLACQALRSGECSMALAGGVTVMSTPAGFVEFSRQRGLAVDGRCKAFSAAADGTGWGEGVGMLLVERLSDARRLGHRILAVVRGSAVNQDGASNGLTAPNGPSQERVIRLALANADLTPADVDAVEAHGTGTTLGDPIEAQALLATYGQDRPGNEPLWLGSMKSNIGHAQAAAGVGGVIKMVMALRNGLLPRTLHVDEPSPHVDWSAGAVQLLTETVPWPGGEGRLRRAGVSSFGVSGTNAHVILEEAPAHNIPSDTPADDAPGEAAADDVPGEAAGDDAGTGGEATGPAAGSPGVWPWLVSAKSQPALRAQAQALHAHLTDHPGLDLADVGYTLAHARAVFDHRATLIAADRDTFLQALQALAAGEPHPAVIHSSAPGGTGTGEAAGKTAFICSGQGTQRPGMAHGLYHTHPVFAAALNDICTHLDPHLDHPLLPLLTQDPNTQDTTTLEEAAALLQQTPYAQPALFAFQVALHRLLTDGYHITPHYYAGHSLGEITAAHLAGILTLTDATTLITQRATLMQTMPPGTMTTLHTTPHHITHHLTAHENDLAIAAINTPTSLVISGTPHTVQHITTLCQQQGIKTKTLPTKNAFHSPHTNPILNQLHQHTQTLTYHPPHTPLITANTPPDQLLTPHYWTQQARNTVDYATTTQTLHQHGVTTYIELGPDNTLTTLTHHNLPNTPTTTLTLTHPHHHPQTHLLTNLAKTTTTWHPHHYTHHHNQPHTHTHLDLPTYPFQHQHYWLESTQPGAGSGSGSGSGRAGTAGGTAEVESRFWDAVARQDLETVATTLAVPPSAGLDTVVPALSAWHRHQHDQARINTWTYQETWKPLTLPTTHQPHQTWLIAIPETQTHHPHITNILTNLHHHGITPIPLTLNHTHTNPQHLHHTRQQAQNHTTGPITGLLSLLALDETPHPHHPHTPTGTLLNLTLTQTHTQTHPPTPLWYATTNATTTHPNDPLTHPTQAQTWGLARTTLLEHPTHTAGIIDLPTTPTPHTLHHLTQTLTQPHHQTQLAIRTTGTHTRRLTPTTLTPTHQPPTPTPHGTTLITGGTGALATHLTHHLTTHQPTQHLLLTSRTGPHTPHAQHLTTQLQQKGIHLTITTCDTSNPDQLQQLLNTIPPQHPLTTVIHTAGILDDATLTNLTPTQLNNVLRAKAHSAHLLHQLTQHTPLNAFVLYSSAAATFGAPGQANYAAANAYLDALAHHRHTHHLPATSIAWGTWQGNGLATGQVSEHLRRRGMFAMPPELAVTAVDGAIASGRPSLLVADIDWKKLGPVLSSKSSVLLEDLPQAQGTEEARSTVEQTESTNLRQLLMGRSRSEQEEELLSLVRIHSAAVLGRDDSEAIPPGRLFRDLGFDSLAAVELRNHLAAQTELALPTTLVFDYPSPTKLAQFLLSEIAEFQPDNSTPLPRPRAELDEPIAIVGMACRFPGGVTSADDFWDLISSEQDAIGGFPTDRGWDLDTLYDPDPDHPGTCYTRNGGFLYDAGHFDAEFFGISPREALAMDPQQRLLLETAWETIEHAGINPHTLHGTPTGVFTGTNGQDHAAHIRQAPSGTEGFVLTGAATSIASGRISYILGLEGPAVTLDTACSSSLVALHLACQSLRSGECTMALAGGATVMTTPITFTEFARQRGLAPDGRCKAFSAAADGTGWGEGVGMLLVERLSDARRNGHRVLAVVRGSAVNQDGASNGLTAPNGPSQQRVIRQALANADLTPADVDAVEAHGTGTTLGDPIEAQAILATYGQDRPGNGPLWLGSVKSNVGHTQAAAGVAGVIKMVMALRHRTLPPTLHADEPSPHVDWSAGAVQLLTETVPWPGGEGRPRRAGVSSFGVSGTNAHVILEEAPADDVPGGPPADEDAGSGEEAAAGSPGVWPWLVSAKSQPALRAQAQALHAHLTDHPGLDLADVGYTLAHARAVFDHRATLIAADRDTFLQALQALAAGEPHPAVIHSSAPGGTGTGEAAGKTAFICSGQGTQRPGMAHGLYHTHPVFAAALNDICTHLDPHLDHPLLPLLTQNDNDNDNEDAAALLQQTPYAQPALFAFQVALHRLLTDGYHITPHYYAGHSLGEITAAHLAGILTLTDATTLITQRATLMQTMPPGTMTTLHTTPHHITHHLTAHENDLAIAAINTPTSLVISGTPHTVQHITTLCQQQGIKTKTLPTNHAFHSPHTNPILNQLHQHTQTLTYHPPHTPLITANTPPDQLLTPHYWTQQARNTVDYATTTQTLHQHGVTTYIELGPDNTLTTLTHHNLPNTPTTTLTLTHPHHHPQTHLLTNLAKTTTTWHPHHYTHHHNQPHTHTHLDLPTYPFQHHHYWLELPSAQTSPGQRRSRRSAPDTAESEFWDAVNEEDLQSLAETLDIDASALDTVVPALSAWHRHQHDQARINTWTYQETWKPLTLPTTHQPHQTWLIAIPETQTHHPHITNILTNLHHHGITPIPLTVNHTHTNPQHLHHTLHHTRQQAQNHTTGPITGLLSLLALDETPHPHHPHTPTGTLLNLTLPQTHTQTHPPTPLWYATTNATTTHPNDPLTHPTQAQTWGLARTTLLEHPTHTAGIIDLPTTPTPHTLHHLTQTLTQPHHQTQLAIRTTGTHTRRLTPTTLTPTHQPPTPTPHGTTLITGGTGALATHLTHHLTTHQPTQHLLLTSRTGPHTPHAQHLTTQLQQKGIHLTITTCDTSNPDQLQQLLNTIPPQHPLTTVIHTAGVNLFAPVSETDAESFSSVTAAKATGAAILHELLLDHETLEHFILFSSGAGAWGSGNQCAYSAANAYLDALATHRQTHGLPGASIAWGPWAGKGMSAGDAAHGYLEKRGILPMEPRMALAAFHRARAQRPNSNLIIADIDWERFVPAFTARRHSPLIEDIPEVRQAAQELEAAASTAKTTTAQPIATSLRERLARLTSSKQNQVLLGLIRTGICTVLGLRNPEGIEDQRAFRDLGFDSLTSAQFSKELAKETGLPLPPSLVFDYPTPQECAAHLRTQLVDLDDEEDAALSNALPQVAHRRTVEDEPIAIIGMACRFPGGVRSADDLWELLASGKDAIGVFPTDRGWDLDTLYDPDPDHPGTCYTRNGGFLYGAGHFDAEFFGISPREALAMDPQQRLLLETAWETIEHAGINPHTLHGTPTGVFAGINAQDHAAHIRQSRDVETIEGYALTGSSGSVASGRVAYTLGLEGPAVSVDTACSSSLVALHWAAQALRAGECSMALAGGVTVMSSPGTFVEFSRQRGLAADGRCKAYSAAADGTGWAEGVGMLLVERLSDARRNGHRVLAVVRGSAVNQDGASNGLTAPNGPSQQRVIRQALANAGLTPADVDAVEGHGTGTTLGDPIEAQALLAAYGQHRPHHRPLWLGSLKSNIGHAQAAAGVGGVIKMVMALRNGLLPQTLHVDEPTPQVDWSTGAVQLLTQPVPWPADPAGRPRHAGVSSFGVSGTNAHIILEEAPTPQDSDTDDEPPANAPALPHPLPLPVPVSARSEAGLRAQAQALRQYVAARPDMSPADIGAGLARGRAVLEHRAVILAADREELAQALTALAAGEPHPHITTGHTRGGDRGGVVFVFPGQGGQWAGMGLTLLTSSPVFAEHIDACEKALTPWVPWSLTDILHRDPDDPAWQQADVVQPVLFSIMVSLAALWRSYGIEPDAVLGHSQGEIAAAHICGALSLKDAAKTVALRSRALAAVRGRGAMASLPLPAQDVQQLISERWEGQLWVAALNGPHSTTVSGDTKAVDEVLAHCTDTGLRAKRIPVDYASHCPHVQPLHDELLHLLGDITPQPSTVPFFSTVEGTWLDTTTLDAAYWYRNLHQPVRFSHAIQTLTDDGHRAFIEISPHPTLVPAIEDTTENTTENITATGSLRRGDNDTHRFLTALAHTHTTGIGTPTTWHHHYTQTHPHPNPHTHLDLPTYPFQHQHYWLQPPTTTTDLTTTGLTPTHHPLLTATLTLADNNTQLLTGRLSLRTHPWLTDHTVAGMVLLPGTALLELALQAGERVDCPRVEELTLHAPLVIPHTEDVTLQVTVRAADESGHRALAIHSYSGTASSADREWTRHATGLLTHHADTDHRADTHTDACLGGSWPPPGAQPIELGDVYGRMAADSDIAYGPVFQGLHAAWRFGDDVLAEVRLPEEALRDAPAAAFGVHPALLDAALHATALTPQNGDGSTENVAQESMPDRAAHQARLPFSWSGVSLHTAGSSVLRVRLSRSPQHGNAVALTAADEDGRPVVTIESLALRPVSTEELRAAADRTPEHESLFRLDWVSVPVPANAPSPTADRPWAVIGAGLPHLPGLTEHEHVTAYDEPADLLLALDRGAPPPGVLVVGGVAHTEAREYSAEAPGERGTEACEARPDVVHVGVVHTAAVHAAAAQMLARLQAWLGDERLADSRLLVLTCGAVARASGDDATDLPGAAVWGLVRSAQSEHPDRITLLDFERGTEAEPGQLATALNCGERQLAVRPGGLFTPRLVRAPRVADAVPAVPAVAVPSAGHAAVPAAGPFLPGGTVLITGGTGVLGRLVARHLVEAHGVRHLLLAGRRGPDAEGAPELRAELGGLGATVEVVACDAADRQQLADLLTRIPDDRPLTGVVHSAGILDDGVITSLSPERLGAVLRAKADAALLLDELTRGAELSAFVMFSSASAVVGSPGQGNYAAANAVLDFLAHRRRAEGLPAVSLAWGLWEEGTGMTGHLDVDDHARISRAGMRPLPTAEALALFDAALADGEPFLMPARLDLTAVRSGAASAPVPPLLQGLLQLPRSRSAAAAPGHGAPAADEAAAWRERLARQSAGERRQALLRLVRSHVAAVLGHSGADGIDASRAFRELGFDSLTAVELRNRLTAATGLRLRATLAFDFPTPAALAEHLGERLLPDQEATGEQAGDQLSGGSEEDVRSLLTSIPIGRLRDAGLLGPLLTLADTGRGASGAAAGPEDAPPSGQDTPAPVSIDEMDIDDLMDLAHGHGTAPAREPADAEDSSSSRNRTHHTHEGETA

SEQ ID NO: 8478 - protein, 347 aa, Streptomyces avermitilis
VNPSEPLGLPNERVVDTRPSDATLSPEAGLNRSGALPRELLSLPVVVWAGVGLLFLALQAYVFSRWAADGGYRLIETAGQGQGGSKDTGTTDVVYPVISVVCITAAAAWLFRRCRVERRLLFDALLFLGLLFASWQSPLMNWFHSVLVSNASVWGAVGSWGPYVPGWQGAGPGAEAEMPLASASVCMSALIVTVLCSKALGWIKARRPAWRTWRLVLAVFFIGIVLGLSEPLPSASGISVWARALPEVTLWSGEWYQFPVYQAVGSGLVCCMLGSLRFFRDERDESWVERGAWRLPQRAANWARFLAVVGGVNAVMFLYTCFHILLSLVGGQPPDQLPDSFQAPAAY

SEQ ID NO: 8479 - protein, 456 aa, Streptomyces avermitilis
VMSQSTSSIPEAPGAWPVVGHVPPLMRQPLEFLRSAADHGDLLKLRLGPKTAYLATHPDLVRTMLVSSGSGDFTRSKGAQGASRFIGPILVAVSGETHRRQRRRMQPGFHRQRLESYVATMAAAAQETADSWSAGQVVDVEQAACDLSLAMITKTLFFSDLGAKAEAALRKTGHDILKVARLSALAPTLYEVLPTAGKRSVGRTSATIREAITAYRADGRDHGDLLSTMLRATDAEGASMTDQEVHDEVMGIAVAGIGGPAAITAWIFHELGQNAEIESRLHAELDTVLGGRLPTHEDLPRLPYTQNLVKEALRKYPGWVGSRRTVRPVRLGGHDLPADVEVMYSAYAIQRDPRWYPEPERLDPGRWETKGSSRGVPKGAWVPFALGTYKCIGDNFALLETAVTVAVVASHWRLHALPGDEVRPKTKATHVFPNRLRMIAEPRSVVRLEEPAAMGA

SEQ ID NO: 8480 - protein, 5532 aa, Streptomyces avermitilis
MDTSSEKLVDALRASLKANQTLRARNEQLAAAMEASSEPIAIVGMACRFPGGVCSPEELWELVASGGDAIGEFPAGRGWDLEGLFDSDPDRSGTSYARYGGFLYEAGEFDADFFGISPREALAMDPQQRLLLETSWEAFERAGIDPLSMRGSRTGVFAGVMYHDYGSRLGTIPEGFEGYIGNGSGGAVASGRVAYTLGLEGPAVSVDTACSSSLVALHLACQSLRSGECTLALAGGVTVMSTPHLFVEFSRQRGLSVDGRCKSFAGGADGTGMGEGVGMLLVERLSDAVRLGHRVLAVLRGSAVNQDGASNGLTAPNGPAQERVIRQALANAGLSVADVDVVEGHGTGTTLGDPIEAQALLATYGQRAGNRPLWLGSVKSNIGHAQAAAGVGGVIKMVMALREGVLPRTLHVDEPSPQVDWSAGAVRLLTEAVPWPGDAAGRLRRAGVSSFGVSGTNAHVILEEAPAAGGCVAGGGVLEGAPGLAISVAESVAAPVAVSAPVAESVPVPVPVPVPVPVSARSEAGLRAQAEALRQYVAVRPDVSLADVGAGLACGRAVLEHRAVVLAADREELVQGLGALAAGEPDRRVTTGHAPGGDRGGVVFVFPGQGGQWAGMGVRLLASSPVFARRMQACEEALAPWVDWSVVDILRRDAGDAVWERADVVQPVLFSVMVSLAALWRSYGIEPDAVLGHSQGEIAAAHVCGALSLKDAAKTVALRSRALAAVRGRGGMASVPLPAQEVEQLIGERWAGRLWVAAVNGPRSTAVSGDAEAVDEVLAYCAGTGVRARRIPVDYASHCPHVQPLREELLELLGDISPQPSGVPFFSTVEGTWLDTTTLDAAYWYRNLHQPVRFSDAVQALADDGHRVFVEVSPHPTLVPAIEDTTEDTAEDVTAIGSLRRGDNDTRRFLTALAHTHTTGIGTPTTWHHHYTHHHTHPHNHHLDLPTYPFQRQHYWLDAPTGAGDVAAAGLEPAEHPLLAATVQLADTDGCLLTGRLSLRSHPWLGDYEVGGAVLLSGSAFVELAVQVGERVGCTRIEQLTVHAPLVVPVGGGVSVQVGVAAADGEGRRLVSVYARGGSACGGGGASGGVWTCHASGVLVEAAAGGGVVVDGLAGVWPPRGAVAVDVDGVRDRLAGAGCVLGPVFSGLRAVWRDGGDLLAEVCLPEEAWGDAAGFGLHPALLDGVVQPLSVLLPGGTGFGEGAGFGEGVRVPAVWGGVSLHRAGVTGVRVRVWAVGRGGGREAVSVVVGDEAGVPVASVDRLELRPVDMGQLRAVSVSAGRRGSLYAVQWAEVGPVPVCGQAWAWHEDVGESGGGPVPGVVVLRCPDAGAGGGGGGGVGEVVGGVLGVVQGWLGLERFAGSRLVVVTRGAVVAGQEDGPVDVVGAAVWGLVRSAQAEHPDRFVLLDLDTDTDTGTDLDTGAGAGAGAGWGVDGGHVAAVVACGEPQLAVRGERVLAARLTRLESSVDVPAQRSGDVAGREVLPWLSGGSVLVTGGTGVLGAAVARHLAGVCGVRDLLLVSRRGPDAPGAEGLRAELAALGAEVRIVACDVGERREVVRLLEGVPAGCPLTGVVHAAGVLDDATIASLTPERLGTVFAAKVDAALLLDELTRGMELSAFVLFSSAAGILGSAGQGNYAAANAALDALAYRRRAAGLPGVSLAWGLWEEASGMTGHLAGTDHRRIIRSGLHPMSTPDALALFDAALALDRPVLLPADLRPAPPLPPLLQDLLPATRRRTTRTTTTGGADNGAQLHARLAGQTHEQQHTTLLALVRSHIATVLGHTTPDTIPPDRAFRDLGFDSLTAVELRNRLSRTTGLRLPTTLAFDHPNPTTLTHHLHTQLLGSDSTASIPAPRAAAVPADQDEPVAIIGMACRYPGGVTSAEELWELLASGRDTVGEFPTDRGWDLEALFDPEPGRPGTSYTRCGSFLYDAGEFDAGFFGISPREALAMDPQQRLLLEASWEAMEQAGIDPTTVRGSQTGVFAGLIPQAYGPRLHENAAADTEGYVLTGTSGSVASGRISYTFGFEGPAVSVDTACSSSLVALHLACQALRAGECSMALAGGVTVMSSPGAFVEFSRQRGLAADGHCKAFSAAADGTGWGEGVGMLLVERLSDARRNGHRVLAVVRGSAVNQDGASNGLTAPNGPSQQRVIRQALANAGLSAGDVDAVEAHGTGTTLGDPIEAQALLATYGQDRAGEGPLWLGSVKSNVGHTQAAAGVAGVIKMVMALRNGLLPRTLHVDEPSPHVDWSAGAVQLLTETVPWPGGEGRLRRAGVSSFGVSGTNAHVILEEAPAHNIPSDTPADDVPGGPPAGEDAGSGEEAAAGSPGVWPWLVSAKSQPALRAQAQALHAHLTDHPGLDLADVGYTLAHARAVFDHRATLIAADRDTFLQALQALAAGEPHPAVIHSSAPGGTGTGEAAGKTAFICSGQGTQRPGMAHGLYHTHPVFAAALNDICTHLDPHLDHPLLPLLTQDPNTQDTTTLEEAAALLQQTPYAQPALFAFQVALHRLLTDGYHITPHYYAGHSLGEITAAHLAGILTLTDATTLITQRATLMQTMPPGTMTTLHTTPHHITHHITAHENDLAIAAINTPTSLVISGTPHTVQHITTLCQQQGIKTKTLPTNHAFHSPHTNPILNQLHQHTQTLTYHPPHTPLITANTPPDQLLTPHYWTQQARNTVDIATTTQTLHQHGVTTYIELGPDNTLTTLTHHNLPNTPTTTLTLTHPHHHPQTHLLTNLAKTTTTWHPHHYTHHHNQPHTHTHLDLPTYPFQHHHYWLESTQPGAGNVSAAGLDPTEHPLLGATLELAEGDGCLLTGRLSLRTHPWLAGHAVGGVVLLPGTAFAELALHAGESVGCDHVDELTLHTPLVIPEVGDVTLQVAIAAPDESGRRMMTIHSRGEGGSGGADASASAWTRHAAGVLSPAKDDDTASYELLAGPWPPVGATPVDLNTAYDQMADAGFAYGLAFQGLRAAWRYGDDILVEARLPEEVSGDAAAYGLHPALLDAALQGTGLLSVAGPGTPVVPHVWNGLRFRTHGAVSVRACLSTLGATGAAVCVRITDDTGVPVASVDRLELRPVDMGQLRAVSVSAGRRGSLYAVQWAEVGPVPVCGQAWAWHEDVGESGGGPVPGVVVLRCPDAGADGGGGGGVGEVVGGVLGVVQGWLGLERFAGSRLVVVTRGAVVAGPEDGPVDVVGAAVWGLVRSAQAEHPDRFVLLDLDTDLDSGADADAGNEAGMGSGLDGGRVAAVVACGEPQLAVRGERVLAARLTRLESPVDVSGREVLPWLSGGSVLVTGGTGVLGAAVARHLAGVCGVRDLLLVSRRGPDAPGAEGLRAELAALGAEVRIVACDVGERREVVRLLEGVPAGCPLTGVVHAAGVLDDATIASLTPERLGTVFAAKVDAALLLDELTRGMELSAFVLFSSAAGILGSAGQGNYAAANAALDALAYRRRAAGLPGVSLAWGLWEEASGMTGHLAGTDHRRIIRSGLHPMSTPDALALFDAALALDRPVLLPADLRPAPPLPPLLQDLLPATRRRTTRTTTTGGADNGAQLHARLAGQTHEQQHTTLLALVRSHIATVLGHNAPEMIPVDSAFRDLGFDSLTAVELRNRLGEATGLRLPTSLVFDQPNAATLARHLRRELMGDDAEGETPSQVALHQVAADEPIAIVGMACRFPGGVCSPEELWELVASGGDAIGEFPAGRGWDLEGLFDSDPDRSGTSYARYGGFLYEAGEFDADFFGISPREALAMDPQQRLLLETSWEAFERAGIDPLSMRGSRTGVFAGVMYHDYAARLHHVPEGFEGLIANGSAGSVATGRVAYSFGLEGPAVTVDTACSSSLVALHWAAQALRAGECSMALAGGVTVMSSPGTFVEFSRQRGLAADGRCKAYSAAADGTGWAEGVGMLLVERLSDARRNGHRVLAVVRGSAVNQDGASNGLTAPNGPSQQRVIRQALANAGLTPADVDAVEGHGTGTTLGDPIEAQALLAAYGQHRPHHRPLWLGSLKSNIGHAQAAAGVGGVIKMVMALRNGLLPQTLHVDEPTPQVDWSTGAVQLLTQPVPWPADPAGRPRHAGVSSFGVSGTNAHVILEEAPAAAGGAAGGGVSVGAPNPALPVAESEPVPVPVPVSARSEAGLRAQAQALRQYVAARPDMSPADIGAGLARGRAVLEHRAVILAADREELAQALTALAAGEPHPHITTGHTRGSDRGGVVFVFPGQGGQWAGMGLTLLTSSPVFAEHIDACEKALTPWVPWSLTDILHRDPDDPAWQQADVVQPVLFSIMVSLAALWRSYGIEPDAVLGHSQGEIAAAHICGALSLKDAAKTVALRSQALAAVRGRGAMVSLPLPAQDVQQLISERWEGQLWVAALNGPHSTTVSGDTTAVEELLTHCADTGLRAKRIPVDYASHCPHVQPLHDELLHLLGDITPQPSTMPFFSTVVGHLVWYTTTLDAAYWYRNLHQPVRFSHAIQTLTDDGHRPFIEISPHPTLVPAIEDTTENTTENITATGSLRRGDNDTHRFLTALAHTHTTGIRTPTTWHHHYTQTHPHPHNHHLDLPTYPFQHQHYWLQPPTTTTDLTTTGLTPTHHPLLTATLTLANNNTQLLTGRLSLRTHPWLTDHTVVGTTLVPGTALLELALQATTTDHLEELALHTPLVIPREGAVDVQVHINPPDDTDTRSLTIYSRSENAPAAAPWRHHATAVLGTKTSRIETGRSHDDLSMWPPAGAVRCADEELAALYGDYEANGFVYGPAFRGLTAAWRLGDEVFAEVRLPEQVHGEASAYNLHPALLDAALHAAAFAPSGSLPQGSVPFSFTGVTLHAANASSLRVRLSPADPNSGHAAVSVLVTDDTGTPVASVEALAVRPLAADELRAAERAVQRAELFDMKWVEVPSDVLVSGGASVVVLDGADDLVGLAAEEDGVPGVVVLRCPDAGADGGGGGGGVGEVVGGVLGVVQGWLGLERFAGSRLVVVTRGAVVAGPEDGPVDGPVDVVGAAVWGLVRSAQAEHPDRFVLLDLDTDLDSGADRDAGNEAGMGSGLDGGRVAAVVACGEPQLAVRGERVLAARLTRLESPVDVSGREVLPWLSGGSVLVTGGTGVLGAAVARHLAGVCGVRDLLLVSRRGPDAPGAEGLRAELAALGAEVRIVACDVGERREVVRLLEGVPAGCPLTGVVHAAGVLDDATIASLTPERLGTVFAAKVDAALLLDELTRGMELSAFVLFSSAAGILGSAGQGNYAAANAALDALAYRRRAAGLPGVSLAWGLWEEASGMTGHLAGTDHRRIIRSGLHPMSTPDALALFDAALALDRPVLLPADLRPAPPLPPLLQDLLPATRRRTTRTTTTGGADNGAQLHGRLAGQTHEQQHTTLLALVRSHIATVLGHTTPDTIPPDRAFRDLGFDSLTAVELRNRLSHTTGLRLPTTLAFDHPNPTTLTHHLHTQLVSKGLTAAAEPDAATTPPGLPSLLSELERLEAVVLSSTTSSAAPLDDGARTRLASRLHSLAQKLNGDDTAPDLAETSDEEMFALIDREVGFESQ

SEQ ID NO: 8481 - protein, 4881 aa, Streptomyces avermitilis
MANEEKLRDYLKRVTADLLNVRRRLQQIESGEQEPIAIVGMACRFPGGVESAEDFWELIASGRDAVGEFPVDRGWDVEAFYDPEPGRAGSSYTRRGGFLEGAAEFDAGFFGISPREALAMDPQQRLMLEVSWEALERAGIDPATLRGSRTGVFAGLMSQDYATRLLSVPDDLAGYLGNGNAGSILSGRVAYTFGFEGPAVTVDTACSSSLVALHLACQSLRTGESSFALAGGVTVMSTPGMFVEFSRQRGLSPDGRCKAYASAADGTGMSEGVGILLLERLSEAERRGHRVLAVVRGSAVNQDGASNGLTAPNGPSQQRVIRQALACAGLSVADVDVVEGHGTGTTLGDPIEAQALLATYGQRAGDTPVWLGSVKSNIGHAQAAAGVAGVIKMVMALRAGVLPRTLHVDEPSSQVDWSSGSVRVLADEVEWPGVEGRLRRAGVSAFGVSGTNAHVILEEASGGAGGGAGRLQELGPGVVSGSGVVPWVVSARSELALRGQARRLRGVVAVGGGADGVGVSPAGVGRALVSERSVFEHRAVVVAEDRDEFLHALDALAGGRPVPGVVEGRTTSGELAVLFAGQGTQRAGMGRELYEAYPVFAQAIDEICAEADTARTDPGAPGLRDVLFAPQDSPEGRLIEDTGFAQPALFAFEVALFRLLETWGLTPDYVLGHSVGELAAAHVAGMLCLADAVALVVARGRLMQGLPSGGAMVAIEASEDEILPLPDEYASRVAHAAVNGPRSIVLSGDEDAVLDLAQQWAARGRRTRRLRTSHAFHSPHMDAMLGDFRRAAEQVTFSAPRIPVVSNVTGAPLPAETMCTPDYWVEHARSTVRFADGISWLQEQGVTTCLEIGPDGTLSALAQDSLSAPARAIPALRPDQPEARSVMTALAELFVAGTAVEWAGVFEGTAREVGDGCGVELPTYAFERERFWLDVEEGSAGGSGVSGMWGGPLWEAVECGDAGVVASLLGVDEGASLGAVVSALGEWGRVRHEREVVDGWRYREVWRPVSGGGVGGLSGAWLVVSEGEAGPVDVVAEGLERCGARVVRVEVEAGCVSREVLAGHLREAVDGEAVGGVVSLVGWGSGVVQAGVASVGLVQALGDVGVGARLWCVTGGAVSVGGRDAVWGPASGVVWGLGRVVGAEAPDRWGGLVDVPELVDERVVDGLVGVLAGVGGGGESEFAVRSSGAFVRRLVRAPLEEAVAEREWRPRGTVLVTGGTGELGAHVARWMARRGAEHLLLVSRRGESAQGVEELRADLMGLGARVSVVACDAADREALAEVLRSAVPAECPLGVVVHAAGVVDDGVLEGLSSERVTGVLRAKALAAWNLHELTRGADLSGFVVFSSAAATFGPAGQGSYAAANAYVEAIVRHRRGEGLPGLAVAWGPWAGGGMAEGAVGQMRRRGLAAMTPETALVALGQALDHDETCVTVADIDWDRFTANSLPGSRLSPLISDIPEARLARETTGLDTATASPDSFSARLKAMDTAEQERALLDLVRTYAATVLGHSTPTAVRPERAFRDLGFVSVSAVELRNRLNAVTGLLLPTTLIFDYPTPSALAGYLKEQLEEGAGGQRDIAPPVPASRVDVDEPIAIVGMACRFPGGVESAEDLWELVASGRDAVGEFPVDRGWDVEAFYDPEPGRAGSSYTRRGGFLEGAAEFDAGFFGISPREALAMDPQQRLMLEVSWEALERAGIDPATLRGSTTGVFAGMCSQDYADLVRRATEDLEGYAMTGLSSSVTSGRVAYTLGLEGPAVTVDTACSSSLVALHLACQALRSGECSLALAGGVTVMSTPGAFVEFSRQRGLSPDGRCKAYGSGADGVGWAEGVGVLLVERLSEAERRGHRVLAVVRGSAVNQDGASNGLTAPNGPSQQRVIRQALACAGLSVADVDVVEGHGTGTTLGDPIEAQALLATYGQGRSGERPVWLGSVKSNIGHAQAAAGVAGVIKMVMALRAGVLPRTLHVDEPSSQVDWSSGSVRVLADEVEWPGVEGRLRRAGVSAFGVSGTNAHVILEEASGGADGGAGRLQELGPGVVSGSGVVPWVVSARSELALRGQARRLRGVVAVGGGADGVGVSPAGVGRALVSERSVFEHRAVVVAEDRDEFLHALDALAEGAPTAGVVQGVAGPAADGKIAMLFGGQGTHWEGMAQELLGSSPVFAQQMSDCAQALEPYLDWSLLDVLRGAPDAPPLQRVDVVQPVLFAVMVSLAALWRSYGVHPDAVAGHSQGEIAAAYVAGALSLDDAARVTALRSQALAALAGQGAMASVGLPVEKLEPRLATWGDRLVIAAVNGARSAVVSGEPEAVDALVEELSHEDVPARRLMVDWASHSPQVEAIQGRLLELLAPIRARTGDVPFYSTVTGERIDGTELDADYWYRNLRQVVRFRDATQALVRAGHTVFIEACPHPAVAVGVQETLDEMGDLDSLVVGSLRRGEGGLRRFLMSVAELFVGGVAVEWSGVFGSVGRGVAGGCGVELPTYAFERERFWLDVEGAPRGSGVSGQWGGQLSEAVDTVRGGMLRDCLAGLDPAAQAETVLDLVLTHAAAVLGHGTADAVVPERAFRDLGFDSLTAVELRNRLNTATGLRFPRTLVFDHPRPVALAAHIHEQLSGGSPTTGTALALALRAPAPRVDVDEPIAIVGMACRFPGGVESAEDFWELIASGRDAVGEFPVDRGWDVEAFYDPEPGRAGTSYTRCGGFLQGAAEFDAGFFGISPREALAMDPQQRLMLEVSWEALERAGIDPATLHGSTTGVFAGVSQQDYAELLRRGTQDHEGYALTGVSNSVVSGRLSYTFGFEGPAVTVDTACSSSLVALHLACQALRSGECSLALAGGVTVMSTPGAFVEFSRQRGLSPDGRCKAYGSGADGVGWAEGVGVLLVERLSEAERRGHRVLAVVRGSAVNQDGASNGLTAPNGPSQQRVIRQALACAGLSVADVDVVEGHGTGTTLGDPIEAQALLATYGQGRSGERPVWLGSVKSNIGHAQAAAGVAGVIKMVMALNHELLPTSLHIDEPSPHIDWSSGGVRLLTEPVPWQQNGRPRRAGVSAFGVSGTNAHVIIEQAPVEAHVISEPVPAEAHVIVEQAPVEAPHVVDATGPADLTEPQEEAAEPECVADAVTEMSAEPECVADAMSEMSAECVAEAVSDKSAEPECVADAMSDKPALLPIPWLLSAKSERALRGQARRLRQFAARASDARPADVAHALAAQRSVFDHRAVVVAEDRDGFLQALDALAEGRSADGLIEGSVGPRGGHSGRRRGKTAMLFAGQGTQRVGMGRQLYAAHPAYADALDQVLAELDGHLDQPLRPLIHASADLADVADAADVLDRTRYAQPALFAVQVALFRHLERLGVRADFVAGHSIGELAAAHVAGVLPLAAACRLVAARGRLMEQLAPGGAMVAVRASEAEARQALDGREARVSVAAVNGPASVVFSGAEDEVGNMADWFAERGRRVKRLRTGHAFHSPLMDPMLEEFQQVAASLTYSEPAIPMVSTLTGDIVAAGELSDPEYWVRQVRRTVRFGDAISRLHTDGVRTFMELGPDGTLSALAEECLEATADSHPADDDTGTPQENLLIPLLRPDSPEPGTLLTGLARLHTHGAAAVNWPAALPERDRARHLDLPTYAFDHHRYWVDTSAGHPGDLSAAGLGTAGHPLLGSAVALAESQELLFTGRLSLRTHPWLADHAIFGTVLLPGTAILELAVRAGDEVDCGTVEELTLRTPLVLPEQGSVILQLSVGAPQGPQTPEEPERRTFALYAREDDGLSSSSAAATGTEWTCHATGVLTGTARPAEEHTQEPWPPADAAPVDLDGWYEQLAGAGLGYGPVFQGLREVWRRGDEVFAVVTLPESTEGQAADAARYALHPALLDAALHPVVLRHEGDAAADGHGWLPFSWTGVTVAASGASTLHVRLTVRTDEDAVGLLATDASGRIVISAGSLAFRPVSAEQLQAARTGYHDHLFRIEWRPLHLPTTPARTADWALIGPGARRTAAVLERNGASWQAYPDPAALAEALAAGAPAPGMVVISCEPDGASAPTDSALTDSALTDSAPAGSAPADSTALADATRQATTRVLALLQEWVADERLAACRLALLTHGSVTATPDEPVSDLAHAAVWGLVRSVQTENPDRFLLADTDDTDASRNALPLLAGEPQIALRNGAVRIPRMTRVPVRQPQPSTTDADWDPEATVLITGGTGVLGRLVARHLATAHGVRHLLLATRRGTAADGAADLVAELAGLGAEATVAACDIGDRAAVAALLDQVPAQHPLKAVIHTAGVVDDGILTSLTPERMEAVLHAKAFGAAHLHDLTRDAGLTTFTVFSSAAASFGSPGQGNYTAANAFLDALMQHRHTQALPGRSLAWGLWGEADGMTRNLAGTDFARMARGGLLPLSNAQGLALLDTADRLGPFGDGLLLATRLDAATLHAQATAGALPRILHGLIRIPARRSADHGIATDTPATLRERLAGLTIPAQRTGLLLELVRTHAAAVLGHPTSAVTAADGALPDDLVPADTEFRDLGFDSLTAVELRNRINAVTGLRLPATLIFDQPSPAALADHLATRLTAEAGTPDEPAPAAAAAGAGSAGSAETGQQRSTGSEKQQTRGGTSTETVESLFWIGHDTRRIEESMALLSAASFFRPAFTDPSDIPEPTFVRLAQGEARAQGEALARGETRPALICLPTVAAVSSVYQYSRFAAGLNGHRDVWYVPAPGFLEGEPLPSGIGAVTRMFADAIVRFTDGAPFALAGHSAGGWFVYAVTSHLERLGVRPEAVVTMDAYLPDDGIAPVASALTSEIFDRVTQFVDVDYTRLVAMGGYFRIFSGWSPPDITTPALFLRGRDGEQMPPPWGVPHTVLDIQGNHFTMLEQFADSTARHVDEWLTEIASVRR

SEQ ID NO: 8482 - protein, 237 aa, Streptomyces avermitilis
VCVDRDGRGAGVTADLARTRGARAAWPEVADVSDGAAMERFAERVAETYGVVDLLVNNAGIGMAGRFLDTSVEDWQRTLGVNLWGVIHGCRLIGRQMAERGQGGHIVTVASAAAFQPTRAVPAYATSKAAVLMLSECLRAEFAEFGVGVSVVCPGFVRTSFASAMHFAGVPRLEQERLRALFAGRGCSAEKVAAAVLRSVARDSAVVTVTAEARLSRLMSRFTPRLRAAVARMDPPS

SEQ ID NO: 8483 - protein, 412 aa, Streptomyces avermitilis
MSDHFLFMSAPFWGHVFPSLAVAEELVHRGHHVTFVTGAEMADAVRSVGADFLRYESAFEGVDMYRLMTEAEPNAIPMTLYDEGMSMLRSVEEHVGKDVPDLVAYDIATSLNVGRVLAASWSRPAMTVIPLFASNGRFSTMQSVLDPDSAQVSAPPPRFSEQMELFGLGALVPRLAELLVSRGITEPVDDFLSGPEDFNLVCLPRAFQYAGDTFDERFAFVGPCLGKRRGLGEWTPPGSGHPVVLISLGTVFNRQLSFFRTFVRAFTDVPVHVVISLGKGVDPDVLRPLPPNVEVHRWVPHHAVLEHARALVTHGGTGSVMEALHAGCPVLVMPLSRDAQVTGRRIAELGLGRMVQPEEVTATTLRRHVLDIISDDAITRQVRQMQRATVEAGGALRAADETERFLRRTRRH

SEQ ID NO: 8484 - protein, 334 aa, Streptomyces avermitilis
VTGGAGFIGSHFVRRLLTGAYPAFTGAEVVVLDKLTYAGRLENLAPVLGSPSLIFVHGDICDGPLVADLMDGSDMVVHFAAESHVDRSVADAAEFVRTNVLGTHTLLRAATDAAVDRFVYISTDEVYGSIDSGSWTEDAPLEPNSPYSASKASSDLLARSFHRTHGLPVIITRCSNNYGPHQFPEKLIPRFVTHLLNGTKVPLYGDGENVRDWLHVDDHCRGIALVAERGRPGEIYHIGGGTELSNRELTARLLDLLGVDWSMVEPVTDRKGHDRRYSLDISKISAELGYAPRVPFEEGLAQTVQWYVENRTLWEPLTARPELPVSDGASGAET

SEQ ID NO: 8485 - protein, 299 aa, Streptomyces avermitilis
MKGIVLAGGTGSRLYPLTRALSKQLLPVYDKPMIYYPLSVLMLGGIKDILVISSPDHLEQFRRLLGDGSRLGLNIDYAAQQRPGGIAEAFLIGADFIGQDQVSLVLGDNIFHGMGFSHLLRSHTRDVDGCVLFGYAVTDPERYGVGEVDASGKLLSVEEKPTAPRSNLAITGLYLYDNDVIEVARGIRSSARGELEITDVNRAYLAEGRARLVDLGRGFTWLDAGTHDSLMHAGQYVQVLEKRQGVRIACLEEIAFRMGLIDADDCYLRGVELAGSGYGEYLMSIAAEAAVRSPGCAYS

SEQ ID NO: 8486 - protein, 343 aa, Streptomyces avermitilis
MGRFSVCPPRPTGILKSMLTTGMCDRPLVVVLGASGYIGSAVAAELARWPVLLRLVARRPGVVPPGGAAETETRTADLTAASEVALAVTDADVVIHLVARLTQGAAWRAAESDPVAERVNVGVMHDVVAALRSGRRAGPPPVVVFAGSVYQVGRPGRVDGSEPDEPVTAYARQKLDAERTLKSATVEGVLRGISLRLPTVYGAGPGPQGNGVVQAMVLRALADEALTVWNGSVVERDLVHVEDVAQAFVSCLAHADALAGRHWLLGSGRPVTVPHLFGAIAAGVSARTGRPAVPVTAVDPPAMATAADFHGTVVDSSAFRAVTGWRPRLSLQEGLDHMVAAYV

SEQ ID NO: 8487 - protein, 194 aa, Streptomyces avermitilis
LVVEGAVEFTPTVFPDERGLFVTPYQEPVLSEAVGHRFPTAQTCQSVSRRGVVRGVHFTATPPGQAKYVHCARGRALDFVVDLRTGSPTFGQWDSVLLDQERFRSVYLPIGVGHAFVALEDDTAMVYLMSSGYVPQNEHALSPEDPDLALPLGHHLGRAPILSERDRRAPTLQQALRRGMLPEYRASRGLDEKL

SEQ ID NO: 8488 - protein, 469 aa, Streptomyces avermitilis
MSVRADADHTEPSTAHRAARRRPARVPRPLRRRGRHRRRTSLDAFTGWWTRRSGAHRFRVERIPFHGMDAWSFHPGTGNLAHRSGRFFSVEGLHVRGGEQPFPEWQQPIIHQPEIGILGILAKKFDGVLHFLMQAKMEPGNINLVQLSPTVQATRSNYTKVHGGAAVKYLEYFTQPRRATVVVDVLQSEHGAWFHRKFNRNIVVETDEDVPLDDDFRWLTLGQIGELMHRDNLVNMDARTVLACLPTPFDEPAALHSDAELLSWYAAERSRHSVHARRVPLAGIPGWTTGAESIAHHADRYFRVVAVRVEASNREVAAWTQPLIEPCGHGITAFLTRRIGGVPHLLAHGRVEGGFLDTIELGPTVQYTPRNYAHLTGPARPRFLDLVLEAAPDRIRYAAVHSEEGGRFLHAQARYLFVEADESQAPNDPPPGYRWCTPGQLTQLLRYGRYVNVQARTLLSLLTTRAVEL

SEQ ID NO: 8489 - protein, 257 aa, Streptomyces avermitilis
MTEREFTDPRIVPHESEQERAAREQLTKLLVDSPIPPKYLIDNLSVYMRRNQLADLLSMDALYRMLPEVPGVIMEFGVLHGRHLATLTALRSIYEPYNSLRRVIGFDTFTGFPDIDEADEVSTSAVPGRFAVPDGEVEHLRQVLAAHEANEPYGHTQRSFVVQGDVRETVPQYLAEHPHTVIALAYFDLDLYRPTRELLDVITPHLTRGSILAFDELTHPKWPGETRALSEAFGLDHAPLRQLPGREPPVIYMTWGA

SEQ ID NO: 8490 - protein, 347 aa, Streptomyces avermitilis
MMPTTAEPAPVQSDSNSSAPLHTELGRTRLRISRLALGTVNIGGRVEEPEARRLMDHALAQGITLFDTANTYGWRVHKGYTEEVIGRWLADRPARREQVVLATKVGDPMGSGPNDHGLSVRNIVAACDASLRRLRTDWIDLYQLHHIDRRAGWDEVWQAMDLLITQGKVRYVGSSNFAGWDIASAQEAARRRNALGLASEQCVYNLVTRHAELEVIPAASAYGVGVLVWSPLHGGLLGGVLRKTRENTAVKSAQGRAVEALEHHRTTIAAYEDVCADHGLDPAHVGMAWVLSRPGVTGLVIGPRTEQHVDGALHALRTPLPEPVLARLEELFPPVGRGGSAPDAWLS

SEQ ID NO: 8491 - protein, 250 aa, Streptomyces avermitilis
MTSVQTSDNWLRRFHPAAEAPTRLVCFPHAGGSAAYFHGVSRALSPAVDVLAVQYPGRQDRRHEPLIDSIDGLAARVREELAPWTDRPLALFGHSMGAMVAFEVALRLTADGAAPSVLFASGRRAPSRYREESVHLHDDAGIMAELSRLDGTDTQVLTDPELREMVLPALRSDYRAVETYRYQPGPPLPCPVVALVGDSDPKATVDEARAWGDHTAGPFELSVFPGGHFYLNAHAEAVTELVRTRLATIR

SEQ ID NO: 8492 - protein, 527 aa, Streptomyces avermitilis
VTRIGLVVLALAAALAAGAAAGSISPWWWFAAVPLTLLGLLGTWDLLQRRHSVLRNYPVLGHARFLLERIRPELQQYFVERNFDGRPFDRDVRSIVYERAKGTDAEQPYGTEQDVYQPGYEFLIPSMAPRPVPQTPPRVRIGGPDCSRPYDMALLNVSAMSFGSLSSNAILALNGGAAAGGFAHDTGEGGLSEYHLRPGGDLVWEIGTGYFGCRTQDGEFDPKEFADKAAHEHVKCVSLKLSQGAKPGIGGVLPGPKVNSEIARVRDVPEGRTVISPPYHREFSTPRELVLFIARMRELSGGKPTGFKLCPGSRRQFLAVCKAMLEEGTAPDFIIVDGAEGGTGAAPLEFADHVGTPLTEGLLTVHNALVGAGLRDRIRIGASGKIATGTDLVKRLLQGADYGNAARAMMFAVGCIQAQRCHTNTCPTGVTTQDPRRARALDVGDKTLRVQRLQEATVASALQIMASMGVTDPSQLRPHMLHRRIDPYTERSYDELYEWLRPGQLLAEPPAAWAADWHAADPDRFTV

SEQ ID NO: 8493 - protein, 587 aa, Streptomyces avermitilis
VARTVARVIVDALSELGVRQVFGVVGDALNPVTDAIRTTEDVEWVGCRHEEAAAFAASAQSQLSGTLGVCMGTVGPGSVHLLNGLYDAAKSRTPVLAIAGQVPLAELGSDYFQEVDNDALFSDVAVFRATITSPDQLPQLLETAVRNALGRKGVAVLTVPGDLGDRELSADRPTRFSLSTPVSRPEESAVRRAAELLDRAERITLLVGRGARAARADVLTLADRLAAPMVLTLKAKEGFEGEANPFQVGQTGLIGNPAAASALQDADTLLLLGTDFPYRDWYPDGRTVIQVDSEAAHIGRRVPVEVGLVGDTGATVRDLLGHLATAPPGTEGARDRSHLEDARKSFGKWRASQARLADPAHDKGLVGRVRSALDNRAHDIRPEALAAVVDRVADENAVFTSDTGMATVWLSRFVEMRGDRRLLGSYNLGSMANAMPQALGAQCLDRGRQVVAFCGDGGLSMLLGDLMTLKTSRLPVKLVVFDNRRLGMVKLEQEQAGLPEFGTVLDNPDFAAVATAMGITGIRVTDPAELEESVRRAFATPGPVLLDVLTNPDEIAVPAKPTVEQGWGFAVAKVKEVVRSHGDSDGH

SEQ ID NO: 8494 - protein, 399 aa, Streptomyces avermitilis
MDGGDLELGELLAAAEAAPPGESVDVIARNLRKRFGAERVSFLFVDLIGQRLVRLTPAVEGDAVEHAEPVGLRGSVYDIVLQSQRQHVEPDGQGGQRVITPVTNRGDCIGVLEVTLQYADDTVLRQVGEAAHALAYIIVTDRRFTDLYHLGRRTTKTSLAAEIQHQLLPSASCCEAAQFTLAAGLIPADDIGGDTYDYTLDRDTLHLSITDAMGHDTDSALLATLLVGALRGARRSGCDAALQAHHAHQALLNHSRGLATGQLLCVDLETGMCRLVNAGHPWPLRLRDGIVEEVKLAVNLPFGVSAPTAYRVQELPLRPGDRLILLTDGMQERGAAAVDLPALVHDTRAFHPREAVRALTAGVLETCDGNLKDDATVLILDWHGTPGAPRYGDTPMQAR

SEQ ID NO: 8495 - protein, 57 aa, Streptomyces avermitilis
MSAGEKAKAKAEQVVGKAVRKAAHAMGQETTAAKGAALEARGKARDTKERAKGSFRH

SEQ ID NO: 8496 - protein, 56 aa, Streptomyces avermitilis
MVPLLLVLLLALILFGAGFALKALWWIAVIVLVIWLVGFFARSSGAGGKRGRWYRW

SEQ ID NO: 8497 - protein, 94 aa, Streptomyces avermitilis
LDHQREARQPRFGGTLKIKCSAATAPFRHDRDRPGGLLPDQSSAARTRWVPYRLVGVPRRRRPAHVLRKPAALGQRGELVVTARAVALQRFRWT

SEQ ID NO: 8498 - protein, 135 aa, Streptomyces avermitilis
MAKYLLLKHYRGAPAAVNDVPMDQWTPEEISAHIQYMNDFAARLEGTGEFVDGQALAPEGTFVRYDGEGRPPVTDGPFAETKDLIAGWMVIDVDSYERAVELAGELSAAPGAGGKPIHEWLELRPFLAAPPTITE

SEQ ID NO: 8499 - protein, 381 aa, Streptomyces avermitilis
MNEALLRSLTPSVLGILVRRGADFAAAEDAVQDALVEAVRVWPADPPRDPKGWLVTVAWRRFLDATRADTARRRREDLVDDEPAPGPAPTVDDTLQLYFLCAHPSLTPSSAVALTLRAVGGLTTRQIAQAYLVPEATMGQRISRAKRTVSGVRFDQPGDVATVLRVLYLVFNEGYSGDVDLAAEAIRLTRQLTAAIDHPEVAGLLALMLLHHARRAARTKPDGSLVPLAEQNRSRWDTQLIAEGVEIVQAALARDRLGEFQAQAAIAALHTDAPTAEETDWVQIVEWYDELARLTDSPVVRLNRAVAVGEADGPRAGLAALAALDDSLPRHAAVAAYLHERDGDLATAARLYAEAAQKAPNLAERDHLTRQAARLNARGCR

SEQ ID NO: 8500 - protein, 104 aa, Streptomyces avermitilis
LPTGRPCGDDRRAGGALTPVINLGRTAPVIDLGATSCIARTHTSESHGIRRGCTGGAALSCQRSAMSSRRPSENSHHDKGSQSPLTKASTVAPRPRTVTVVPGG

SEQ ID NO: 8501 - protein, 377 aa, Streptomyces avermitilis
MKAVVYKGAFDVAVEDVEKPSIQHPNDVIVRITSTAICGSDLHMYEGRTAAEPGIVFGHENMGIIEELGQGVTALKEGDRVVMPFNVACGFCTNCVDGFTGYCLTVNPGFAGGAYGYVAMGPWQGGQAEYIRVPYADFNCLKLPPGNEHESDFILLADIFPTGYHGCELAQVRPGESVAVYGGGPVGLMAAYSALLRGAKKVFVVDRVLERLQKAEEMGAVPINFAEGDPIAQIKEQTEGIGTDKGVDAVGYQAMAHGTDREEPATVLNSLVGTVRPTGALGVPGLYVPADPGGPDEQAKQGMLLVAIGKLFEKGLRVGTGQCNVKRYNRYLRGMITEGRAKPSFVVSHELPLDQAPSAYDKFDKRIEGYTKVVLHP

SEQ ID NO: 8502 - protein, 146 aa, Streptomyces avermitilis
MAGASNKTTNGQSPTANARAAKKTVAEGAATPAKEAQQAATEATKNAGDAAGAVGRGSKEVLAGLGGAASEKAREAARTVQGTVVSAAEQTVGKAGLVWTLLKARKVVAAAAGAGTATVVLCSYTLGRRAGLRQRGPLSRLSGGRL

SEQ ID NO: 8503 - protein, 141 aa, Streptomyces avermitilis
VVTKQVRRAPEDKDVTRADSLAREIFSGVANKWALLIINVLGEQTLRFTEVRTAVDGISHKMLTQTLRGLERDGLVHRTVYAEVPPRVDYRLTEAGGALRDTVNGMCAWTRRYLDEIEAARRRFDAQHNDAAHPPHTGTKD

SEQ ID NO: 8504 - protein, 153 aa, Streptomyces avermitilis
MSILKTYARLWTDSLDSALPLLTELTGVQPDLRLAFHSVELAAIGDFLVIAGPADERAKYAHASATVVVEDLDALATTLKAADATITTPTTSGPTGRFLYARHADGAEVEYVEWVPELVRRLIHQGSLARTTPRTTSGKAEPERGSSVSSSLG

SEQ ID NO: 8505 - protein, 402 aa, Streptomyces avermitilis
MTPRHQRDLSRRKLLAALAGTAVAVPAAAMGAPHALATVASDNGGAAPRAAGALPLTIVNRTGSFANSSVHLYIVGNEDGKQVRVTSEGTLAPISLADNGADGFTDYAIALSGSGETRLSLPYMSGRIYVALGDKLKLKAVADGNGNAALQYPAGWVESDPNYRVLHDCAEFTHNSAGMFCNTTMVDMFSVPLSIRLTGTKDQTTGTLRDGGRARVFAAVKSVPEFERLVVDDLRVIAPGHGLDAGIFAEDYFAPYIDEVWSTYTGKDLTVTTNAGAFTGRVRGDKLTFTGPASVSFSKPSTRDVFFCDGSLAAPNDGTTGPVAAVLGAGFNRSTLVNDSAQPTTDPAAFYGSALANHYAKAIHAATEDGKAYGFAFDDVADFASYIQDTAPTGINLTLTPF

SEQ ID NO: 8506 - protein, 332 aa, Streptomyces avermitilis
MSASGVEAGRGSGVVRGERLSALAQQHGALVALLVLALVASFSFDSFATGDNIENLAMTSSFLAVVALGMTFVIVTGGIDLSVGSVFALGGVLAAWGSRYGALVALLLPLAVCGLIGCVNGLLIARTRLAPFIVTLAAMLAARGLMLNITDEGATTYLVDKETVFVHLGQGRLLGVGAPVWITGALFLAGAVALRRTRFGQNVYAVGGNEDAAALMGAPVARTKITVYTLSALLAGLAGALNAAWLASGVTILGYGMELDAIAAVVIGGTLLSGGLGFVSGSLVGVLLLKTIQNIINQIGSLDSAYQQVVSGGFLVVVIIAQTWLARRRRVA

SEQ ID NO: 8507 - protein, 321 aa, Streptomyces avermitilis
MADVALRNALPADRAAAVRWLQEYGVYAGVVVLLLFNVAFTDHFLSAANFRTQAVQVAPVLVVALGMALAIGTEGIDLSVGSVMALSTSLLSLYLGYGPWVALLTVVVGGVVIGLANGTLIAFVGVQPIVATLALMVGTRGLALVMLPQLKDVRDPTLLSLGSGDVVGVPYLVLIAAALAVVVAFVVRRTTFGRQLLAIGDSRPAAQLAGLPVRRVLITVYVCSGVLAAVAGFLSTARLSASDPTSLGQLMELSAITAVVVGGTPLTGGRVRVGGTVAGALLIQLLTATLIKHDLSPSWTQLAQAVVIILAVYAARERGKR

SEQ ID NO: 8508 - protein, 522 aa, Streptomyces avermitilis
VTASPVSAEVLAVRGLTKRFPGVTALDDVDFSVRAGEVHALVGENGAGKSTLIKVLTGVHRADEGGVFHRGEPVAFGTPLEAQHAGISTIYQEVNLIPLMSVARNLFLGREPRTRLGLIDFRRMHTEAHQVLTAYGVDVDVRRPLRQLGVGAQQMVALARAVAVDASVVVMDEPTSSLEPREVHTLFGVIRRLRDQGIAVVYVSHRMEELYAVCDSVTVLRDGHHVHTGPLAGTDRLTLVSYMLGRDLGEVRSEGTTKFSGTHDTGGEPVLRAENLTRPHQLRAVSLEIHPGEVLGLGGLLGSGRSETAKAVAGALALADGRVTVAGVPVRTGSTVAAIRAGISLLPEDRKSEGIVPGLSVRENIALAALPQLSRYGLVAESRMDAVVDTFMKRLRIKASSPHQKVGELSGGNQQKVLLARWLAMNPKVLLLDEPTRGIDIGAKAEVQQLIDELAEDGLGVLLISSDIEELIEGSDRVVVLRDGAAIAELRADDVTADRLMRAIAQAAEEEASTEEEAATHG

SEQ ID NO: 8509 - protein, 371 aa, Streptomyces avermitilis
MKSNSAFRRMPAMSRRTSATSLLAAGLVAGLALCTGCTKSESDASGSNSSAAGGDSSQVVATPGADSKTCDIATFGGKKLDLKTATVGFSQSEKEANPFRIAETASLKAEAGKRGVKLLTANAQSQFSKQISDVQDLIAKGADLLVIAPLNSDGWEPVLRQAAAKKIPIVTVDRKINATPCTDYVSFIGSDFTEQGKRAADEMIKATGGKGEVAILLGAAGNNVTTERTKGFEDRLQEKAPGLKIVFRQTGEFAREKGQSVTENLIQSKPGITGVYAENDEMGLGAVNALKSAGKKPGDVKIVTVDGTRNAVQGIVDGWIDGVIESNPRFGPLAFQTLDSFTKGAKVGQDIVIQDSAYTKGNATSDIGKAY

SEQ ID NO: 8510 - protein, 337 aa, Streptomyces avermitilis
VRVSLKDVAERAGVSIKTVSNVVNNYQHVTPGMRARVQQAIDELGYRPNLTARHLRKGRTGIIALAVPELGNPYFAELAAAVIDAAAEQDLTVLLDHTRGEREREILVSQGFRAGVIDGLILSPLELEAEDLRGRAADVPLVLLGEREYDLPYDHIAIDNVAAARTAVRHLLGRGRTRIAYLGARTDSANRPAHLRLQGWQEELSAAGVPTPEQLVGPTGGWDRSDGAEAMARMLDAGVRPDAVFAYNDLVAIGAMRVLSERGLRVPWDVAVVGFDDITESRYGAVTLTTIAPDKQAIARLAVESLLRSLRRESADGGRELTAAFRLVERESTLGRR

SEQ ID NO: 8511 - protein, 883 aa, Streptomyces avermitilis
VQHPRQGPPSRHTRRSLGRSLALTMTAVLGAAGLALSPAASADSGPTTADPTEAHGLKGEYYTQSAPGAFDFAELKATGFDPGLDFDSLESRLSAATGRADDVSVRWTGEVVPEKSGPTTFSITGDNGFRLWVDGKLTIDHWVDDWDREQTSQPVDLTAGRAYDIKVEYFEHFGGSNLHLRWTPPGGSKSAVPQSAFRLPDGFDYNGALSATVLGDGRTVRLDFPQALASAPATVLDHLTVTSGGKWPLSSVKTDPSDARALLVGLGEPVVGNKAGTAKGGVNVTYDGKGALADTSGTPVKAFWSSGPNKSTYELRTKWADQVGPKNALPEYPRPQLTRKAWQNLNGTWQFAGAKAGEEPPTGRTLAERILVPYPVESQLSGIERHEDRMWYRRTFTVPADWKVGHGKRLRLNFGAVDWQSEVYVNGTKVAEHKGGYDKFSADVTDALKPGRTQELIVGVYDPTDAQGGENPPLGKQRLDPSGIWYTPSSGIWQTVWMEPVAADHVDTLKLTPDVETSTLTVEPKGVRDGLAVTATAYDGKKKVATVRGRTGTPLTLKLAEPRLWSPDDPFLYDLKVDVGADRVGSYFGMRSIAVEKVDGTPRTVLNGKPVFMMATLDQGFWPDGLHTAPTDDALAHDLKMHKQMGFNSVRKHIKVEPDRWFYWADRLGLLVWQDMPAMTAGVNPNAASRAEYEREMKQLIDEHISSPSVVMWVTFNEGWGQYDEARIADQAKAWDPTRLVNSMSGLNLGVDGGTGDVMDEHGYPSPALPPHPDGRRALVSGEYGGLGLGVPGHAWSVQMSYVDVDPAAYTDTYLARLDEVRRLACRGGNGAVYTQISDVEGELNGLMTYDRKIVKPDVQRLRTAHEALIEAVAQSTLPCATS

SEQ ID NO: 8512 - protein, 273 aa, Streptomyces avermitilis
MGTFTTDDGTEIFYKDWGSGPPVVFSHGWPLNADAWDVQLRLVAENGYRAVAHDRRGHGRSGQPWNGNHMDTYADDLSQLIGALDLRDAVVVGHSTGGGEVARYIGRHGSGRVAKAVLVGAVPPIMLKTDANPEGLPIEAFDAIRAGVLSNRAQYYWDLSDQFYGFNRPGAEGTDGVRRAFWLWSMQVGLKAAYDCIEQFSEQDFTEDLRRIDVPTFIAHGDADQIVPLVASAPKSAELVKDATLKVYSGAPHGLTGAYEQEFNADLLNFIRG

SEQ ID NO: 8513 - protein, 568 aa, Streptomyces avermitilis
MGEGETGRRVVDNRFELEARLGGGGMGTVWRARDLLLHRSVAVKEVRPPDVDFAEYDPDGAHLLRERVLREARALARVEHPNVVTIHHIVDGGEGTYPWIVMELVGGGSLADRLARGPMTPAEAAHIGRGVLAALRAAHAAGVQHRDVKPANVLLRPDGSPVLTDFGIAAIRESTTLTATGSIIGTPDYMAPERVTGDRGGPGADLWSLAMMLYVAVEGHHPLRRGTTLATLAAVLHDDVPHPVKAGPLTPVLTRVLVRDPAARPDAEAFDRMLAAVAEAGPGAEPTSYPLAPPVPAPPPATTESGLVGASRNPRDHLRRPAREPRDAVPDPRPPLGSDADRLGTRTVTRRPGRARLIVVASVAGASLVGGLVWRTLPGGQDGAAASPGASRETEHAPAAPTTVTQKPTDQESDSETTDLLTPAGIRASIKAIEKETGRDSFGDFSVYPDHVSASVMVEGSRTRYDTYTYRVDRGVEKGIIKGTLAGGRQPVSLKNFQWDMVPALLARAERALKVEKPTARYLLVRQPDNVFGTPAGMAVYLSNDYREGGYLEADTQGKVTKVMPAAG

SEQ ID NO: 8514 - protein, 111 aa, Streptomyces avermitilis
VLKEIATRFRTREVRSGQVLFEAGQPVTEAYVIAHGRFTRYTAGKYGEEETIGVVTDGDQMGDEAIGQSDPLWLSSVRAETAGVVLVLPWDVVTEFTERVPSLAAHLVGLR

SEQ ID NO: 8515 - protein, 384 aa, Streptomyces avermitilis; identical to SEQ ID NO: 7868

SEQ ID NO: 8516 - protein, 261 aa, Streptomyces avermitilis
VEQIERLRREHKWSAARITFELSAQGIQISRRTITRHLEQLGLSRRRFIDPDGESNRTARQIIAHRPGHMVHIDVKKAGRIPDGGGWRVHGRGSTQAKSAERQKRRTGRRGYIYLHSAIDGFSRLAYTEALPNEKATTAIAFMHRARVWFAAHGITTIERIVTDNGACYRADAFARALLGARHQRITPYTPRHNGKVERYHRILAEEFLYARSWQCEQERSDALRVWNIHYNYHRPHGAAGNQPPAIRLPMTVTNVLSSYT

SEQ ID NO: 8517 - protein, 77 aa, Streptomyces avermitilis
MTGKRPSLHRNAPLSVEGRRRLVERCKSRPIAHVAAEMGISRACASKWVNRFRRYGELGLHDRSSAPRHQPTATPAR

SEQ ID NO: 8518 - protein, 463 aa, Streptomyces avermitilis
VKISSHAVAGMLGTWQEGPGPAHQRLSDRLRLLILDGRLFLGAALPSERDLAVALGTSRTTVGTAFRTLVEHGYLATQARTRATVRLPDDTTPEHLVGTDAETIDLSFAAPAAPVEILHAAFATALEQLPRHFERHGYDRYGTAELREAVARWYQRRGLPTRPDHILITNGAQHALALLTRVLLSPRDKVLIDHPTYPHAITTFTQARARLLPVAVTSSGWDTEQLQAAGQAANLAYLIPDFHNPTGMCMPTSVRQQLRLACPTVVDETMTDLALDVPSPEPLALHMPTAISIGSVSKSVWGGLRTGWIRALPSLLERVEQARPTTDLGTPVVEQLATAVLLNEHQTQRPDTLQQLRSQRDALWQALTEHLPNVHAPQPAGGVTLWAAFPGPVSSRLAAMAPDHGVTIAAGPRFGIGGAFERNIRLPYTLPSSQLAQAIRRLAQAAQALAQGATGTHTLAPIA

SEQ ID NO: 8519 - protein, 205 aa, Streptomyces avermitilis
MNRKGEADVPVQAGHVGEPSLNGGFVDYDLAPREYELSLTQTVLRVHTRVADLYNEPMNQTEQQLRLTIEEIRERQEWELLNNREFGLLHNADYGQRISTFTGPPTPDDLDELLCMRRKTRLFLAHPKAIAAFFRQCNRRGLVPGTANIDGHELPAGAASRCSPAARSRSPRSTPAASSRCAPGRPTKASSASIRPASRRSTSPV

SEQ ID NO: 8520 - protein, 89 aa, Streptomyces avermitilis
LLPCGKIPVTPQHTSSIIALRTGEADQGVIGLYQTGIPEEYQPGLNVRFMGIDTAAIIRYLVTAHFSLAILVPDAAGILENVQIGRTAE

SEQ ID NO: 8521 - protein, 691 aa, Streptomyces avermitilis
MEHRMSASPLPGTSFAPPGPHDIAGTVRARRGGAIPGLRYRPAVPADPAKVAETDRRLEAWARRLDVFPEAWFGDFAGFQFGRAVVLQHPGAADVERLTVAGKLLLAENIVDDCYCEDRGGSPRGLGGRLITAQSAIDPYHGTPEAEEQWRHGMQADGPLRSYHWAVKDYATLATPSQTDRLVHDIARLHLGYLAEAAWAETRHVPRVWEYLVMRQFNNFRPCLSIVEVACHQHPPLPPAELLVTTTDSTSNALRGATVDHRPRRRHGSTGTDPVHVPVPRRGLLERRGEPGQPRTRQDRRSVPPPLRGRGRRLLRARRARPLAAPREDHRRAAPTGTRPGRTAGRPPQPPLPRRPRLRRRLRSRRRQRRGAPAVRLPRRRRHDLRQAGRLRQRTGPQAGHRRQGALPPPQHARHGPADRGVRGLVEQRIHHVRRAGAAVRRTCQAAASRRTLCGDHRVLQRHLREGLTRSVPHQRPLHLRHPSTVGILPGHGPQPAGPRARRGSHRSRAVLLGAAQAVRPAGHRHRGLVPDRVQERQLPVPADRGRPRLRPQNAAPVPPPRHDGGPGVRPPGEGHCPTDVTEWPTATPRPPRYPDDGRSVARPPGRDRLSATYRRSPAGSPPRRTSRGGRRAARRCGPRPRARPGARCRATAGPATAAPTRPAPPAGRGRSARLHGSGAGRAPRRWSAGC

SEQ ID NO: 8522 - protein, 298 aa, Streptomyces avermitilis
MHCEEPLLTTAPDAVTAAPVPTQSTYQSRVADYWNAEENPVNLELGKIDDLYHHHYGVGAVDYSVLDEPDPSRRHERITAELHRLEHAQAELLAGHLSPLSPADRVFDAGCGRGGGSVVAHLRYGCHADGVTISAKQADFANEQARKRDIGDKVRYHHRNMLDTGLPTGAFAASWNNESTMYVELELLFAEHARLLRRGGRCAVIIGCYNDTYGRASREVSLINAHYICDIHPRSAYFRAMARNRLVPVHVEDLTGAALSYWELRKRSDRLATGIEDSFRTAYKNGSFQYLLIVADRV

SEQ ID NO: 8523 - protein, 937 aa, Streptomyces avermitilis
MSGTHGQTFEELRGQLQEAAATFSDGPDALEGILLGIVDDVDRAVREPLEIFPVCHHSPASALAMARRLREKRPKVVYLELCEDMAPLLTELRNCRLPVAVQAFATEVDGFPADWSPLSVVAPITEASAEYQAIAYALDTPGVELVLVDRSSDHVFQWDSRGTHSAEAGADPGASDAPPVEEEAALHGDAVGVEIGDLRPRFAELEEHLLHHGRVRHWSEWWHQYVELPLGDSDHDTYRQVMLLIGSLFRRLAPGDPHRVRVDEDRERYMWTRMREHLAATGTDAADCLYVCGAFHAASRVAEFGVHGTDTFEIGPRSATRWQHGLIPSSHAAIETQFGLASGSVSIAATVWAKNVRRTRVEPFRLAGQAGAKTSKAKKTAVAAAPVPAAANSDKLTGFLRRPPVLDRLDETELLGWSVEIVRAARRNGYLASTADAIAVFETSILLAGMRDRARPTPYDFQDAAVTCIEKDTVPGRRDVRRLVDIMMGGDRIGQVGYDALPPLARDVHDRLAPLNLKLQQRGVQRALLDISSQPQLEQCSDVLWMLRYLMPQGTARPIMGERRLGERPIQESWDLALGTHQRALIELGYEGVSIEQVLEQRLRRTAYGPHATTATVLEAIEDATLHLRSRRLTDELGTRALEVLSAERSVDGAPEVLRRVRRLLAYYRTSEPVLPPWIESFVKTGYAHYCTLLPTAFTDDDATVRQVAAMLGFLFGMESLALSLGCDRTQLELSVAQSHPQEPSKVALLWAAQVQLGHLSRADLRTRCDELLDNPMVVPAYPRYLSGFVHALEPVPGLADLVVEAVSNAFGRLPDPVLLPWLPTLISTLRSNGAELAPLLIREAGRIFPGRLGELDAWVPPWRAQPLPDTARPGGRAGEGRNVALLAAHPATCDAVASLLGCDGTWQTADPGPAGGQLIGRHPDTAVALESLLATP

SEQ ID NO: 8524 - protein, 371 aa, Streptomyces avermitilis
VMSDLLRAPAEIKYAEELDWLESIDDNPKPFSWRLSPKMVRLFILGSERSDGLEREISQKWFGDRSFVERSIVTLASDRGLLLIGDPGTGKSWLAELLSAAICRNSTLVVQGTAGTTEDHIKYSWNVSMVIAKGQSRESMIPSPIMTAMETGAIGRFEELTRSTSDVQDALISILSEKYVSVPELDSDSVVFAQPGFSIIATANSRDRGVNDLSSALKRRFNFVRIPVMTNRKSEAEIVRFRTEELLRRHQIELDVPPTLLDVLLQSFADLRASAAAAGSDDEKLESALSTAEQIGVLEDAILHSNFFGERALTARTLASSLVGSLARREPEDLAILNKYLHGVVEPRGKEEGGSWPEFLEGGRDAIATLS

SEQ ID NO: 8525 - protein, 478 aa, Streptomyces avermitilis
MTERTTEHTPEQNAEADSDENRRQVLYWRLLARLFDHEEQATLESASLAVVEDIGLPSGLLDPGTSVDSIVQRHPELASEFDGLMVPEPEPDDDGRDRAAEVRRAALVSKVLLNVFAAGSGTVTAGQLSRWQSDAGWLERALGCRPGELRGGRPGGGRAGRGAGPAGTGGRGATPDLGRLIPAIGPELGAIEADLVKRMHLREVLADPTLAAQLTPSMSLIEQLLRDKNNLSGVALANAKALIRRFVDEVAEVLRTQVAQATAGALDRSVPPKRTFRNLDLDRTIWKNLTNWSPEEERLYVDRLYYRHTARKTTPQRLIVVVDQSGSMVDSMVNCTILASIFAGLPKVDVHLIAYDTRAIDLTPWVSDPFEMLLRTNLGGGNDGPVAMAMARPKITEPRSTVMVWISDFYEFDRSQPLFEGIEAVHRSGVKFIPVGSVTSSGRQEVNPWFRERFKALGTPVVSGHIRKLVHELKTFLA

SEQ ID NO: 8526 - protein, 466 aa, Streptomyces avermitilis
MRTDLLTEPMAGLDEALAAVDGFDRTLVGGLLRPQPAQAADLNQLACAVAGTPLASRVAEAADKAAAGAASEDHFVALAAARTALLGSVHDALMTRVDEVIGRTRGEATASTPGERHMVNLLAAARSWLCDLARAGWQGIDHEVVSASAQVVSSMLPDPSLRRLATLLDGFAAELAASCPGAALKRMPVRRWGDVWSRAMLLTVPGAADAPTTAPATGRLLPLGVDVHEHATAAQAQVHAVFEPADGSAPRLVRASVSVPKPDTVVGAGVWQLLRPHMSLLAAAGEGRSMELHAMPITAEGDLIWSDEQGRPGEPADPFATARVVLPTATAAHTAPLHRHPAGIAVPVFLEGYAVHKDGDVLTFNTAGHGHGHGLAVEADRVPTTGPLTPEAVALSNACIGLLRWDTGAFSVQPLAVETTVRKKAVAVHAGAWAGGTADKTGAKAEKAATEAVAVLRERAGRLLRK

SEQ ID NO: 8527 - protein, 201 aa, Streptomyces avermitilis
VNSACDRRCQWSPLCSAVSRRSGARAPWCKGDGALSDWEKSSMARVIPPARPRKLAKVPFVELADGRLQGVVSSGSDIERVYVSSVAAGSYAFACSTNNNRPCGGARGSFCNHIKALINEAVLQYGVERVVRYLRVDIADEERSAQGIAAEMSGTNPPQGDAKAAAWVFSRFLRHLAYLELAPTTAPLPEMQWFPPTRAVA

SEQ ID NO: 8528 - protein, 307 aa, Streptomyces avermitilis
MPTTPPDGRSGIDAALVSRLIAAQFPQWSGLPVTPVDIDGWDNRTYRLGDDMTARLPTAAGYVPAVTKEHEWLPRLAPSLPVAIPPILAMGVPGEGYPFPWSVRGWLPGERADRGRIDDLSQFAVSVAEFVLALQRCDTTGGPLAGEHSWYRGASPAHYDDETRRCLAALEGRVDTDRAATVWGAALAAPWDGNPVWFHGDVGAGNLLVADGKLAAVIDFGTSGVGDPACDLVIAWGMFSGDSRDAFRRAVGQDEGTWARARGWALWKSLLTLAECIDTDPEQAAVNRRLIGHVLEDHRRFAQPSVA

SEQ ID NO: 8529 - protein, 151 aa, Streptomyces avermitilis
MRTHTVKTLVTLCAAVSLAAATGSSSAAPPTARAVKQQPERTVLVDCFWKPNVRPTDFILACGDGNSRLSSLKWSHWNLNSATAKGFNLVNDCKPYCAAGKFHSYAVVVRLDHPQPWKKRPQVQHYTQMSLVYTDNRPDGFERTVTYPLWN

SEQ ID NO: 8530 - protein, 148 aa, Streptomyces avermitilis
MSVAALPASADQDRQPHRQRVEISNVHYDAPGRDDRSNRSLNQEWVDITNTGRHSVNLDDWTLSNRDGRTYTFHHLRLEGHSTVRVHTGNGRDTHRDVYQDRRHEVWNDRSDTATLRNDHGRVIDTASWGRGSHERRGGHEGHGHSRR

SEQ ID NO: 8531 - protein, 393 aa, Streptomyces avermitilis
VPRTPSPWHASFSRGAHTRARAGYSVSMARLPKIGHKDHEARRSDTTDAAPAPASGRPETAQETDEQFGPDEQVEQAAPEAPTKLPKRSWGAVLKGSLREFKDDELTDRAAALTYYGVLALFPALLVLVSLLGITGKSTTDKVLTNVQKLAPGSARDIITRAVEQLQNNAGTGSVVAIIGLVLAVWSASGYVAAFIRASNAVYDIPEGRPVWKILPIRVGVTVVLMVLAVISALIVVFTGGLARQAGDALGIGDTALTVWSIAKWPVLVILVTLMIAILYWASPNAKVKGWRWITPGSFLALVIWMIASAGFAFYVANFASYNKTYGTMAGVIVFLVWLWITNLAILLGLEFDAETARQRAIIGGHPPKAEPYTQPRDTRAWDEQDRRRMDDV

SEQ ID NO: 8532 - protein, 142 aa, Streptomyces avermitilis
MSHEQQYQDESQLPATTAQLNHTAVYAGDRRLSAEFLAAILGLKVGAPFGPFLPVDLGNGVTLDYYEKTGEPIQSQHYAFLVPDAQFGGMIARLEAVGVTYYADPNHTEPGQINRLFGGRGAYFADPDGHNMEIMTRPYIRP

SEQ ID NO: 8533 - protein, 431 aa, Streptomyces avermitilis
VNRHISFERLHNFRDLGGYTTADGRVVRWGRLFRSDSLGKLTGEEWERFLALGIGTVIDLRYPWEIDAKGRVPEHPAFTYHNLSIEHRPYDQAGLGPDVETGPFLAEKYMEVAHDGVKELRQVVEVIAAVATSTDESVVFHCASGKDRTGLVAALVLALLGVPESQIVEDFTLTELATERLLADWRADHPGQEPTWPGYGRAPADVMRLFLDALTHQHGSMADYARDLLRIDEGLIAALRRNLLEPAAEPELTFRRADHRDLPELVRLRDSAARWQIARGIDQWKPGQLGEDHFRARLADGEIWIATLGPTGPTAGAWELWWDDPAAWGPQPPSAGYVHRLMTDRRTAPPGTGRLMLAEAERRIAETGRTLCRLDCLASNPRLRQYYETAGYTVVGEQSSKDGGLGNTYAVTLLEKTVPEALTPRSTKPAR

SEQ ID NO: 8534 - protein, 144 aa, Streptomyces avermitilis
MNESELSPEGGRPVDLYLDLLRIRMAPADYELLLRMVEPALKAVEDQSAGPIELSLEGAEGSTVSQEIRDEASLVLAVAVTGRLDNQIVEIETEEVGPVRIVTDADTAVDPDRRREIADFIGERHRQDEELRGIAEVSGLPTDV

SEQ ID NO: 8535 - protein, 223 aa, Streptomyces avermitilis
VGDTPRTDRANNADVEREFQVFYAAHYAQLVAQGTMLSDSLQEAEDAAQEACMAAMAKWDTIRSPYHWTKKAMSRKLVRDRQMRRARWYRRLLPQSPPDLEIPVPPRSSVDERMRALDVLAALRQLPPRQRQVMILLAECELDHQEIAELLGTTPNNVGVNVHHARRKLRLLLGQGSEPVPTGDSLDSVRRDDPLYALIHSTAVWLRQGIHAKQRADRKEGNR

SEQ ID NO: 8536 - protein, 91 aa, Streptomyces avermitilis
LFARSVRGVSPTVLTPALMTSTGLLGRGRTGAYGQHGASRASVDEDRVRAAVPDEIHEHAGAGLLGRPCGLPPHHVPGQAQHPSHGEQQYR

SEQ ID NO: 8537 - protein, 624 aa, Streptomyces avermitilis
VSHHIRLALAAILLVTFYAAVALTILIWVTLVILMFDVAGSVWATTLPVTGFLFCAGTAVPVYALGDAARRSLFLVDTPSTPSLEVGRGRAAALHALVDDLAERLGISEPVRIRLHTAVGAEAVDEDTRFLGLSAGNHVLSVGLPLLAALPHRQIRAVMAHELAHLSLRHHRVRAFTLRLETSLTVARESLISFGTANGLVGMYVGLPQAMIGLYIRLFRWLVQPVRRRQELEADHTAARLCGAPTLAEALANRAVVEPLWIEFHRMYLDAAPDGVLPADPFRAFARTMADPGVQDRLPALRARMVEAPAAQNEFGPSHPHLAYRLRRLTKGHEPAAAIACRPDAALLPDLLPGQIAGLLARYVGASTLPWQDWIDRWVDARNAVLVEPLCAAVRTLVGPEHQPVALHQVLHLLEAGQRMPLARALAGRVPEAHREPDDPLALLSAALLALVKSRLTERPGPGSPLPQLVRDAVLQPSHVSRLSLHLAGCGVDETAPAQDTPETGQHPSDEPEQAGYSTAKVSGGIPEAGRRVISSVRAVTLTVLIVVVAVGGLRWTTRDKPAFVPPTRVTPTYSPVYPISPPLPSQPYAPLPSASAYPFNPEDRFRLPSPVLTPPDFYLSATP

SEQ ID NO: 8538 - protein, 366 aa, Streptomyces avermitilis
MSLYTVGVEEEYLLLDPATRLPMPAAEQVRAAAGLEPIAGEDEIQPELSEAQVEVATPVCTSLDEIGGHLVRLRHVLGRAAESNGCRLAACGTPPIKEESPPPLTNNPRYRAMRAQAPQLVAEQLVCGTHVHVGVPDPEIGVAVLNRIRLWLPVLVAMSANSPFWAGHDTGFASWRTVIFGRWPVSGPPPHFADLADHEKRVQQLLTCGVIFDPGQLYWQARLSSRYPTVEVRCLDVQLRADDAVMFAGIVRALVATAINDAKAGVPVPSCPPELLQGANWHAARHGLSGSLIDYEGRRRSAGDVLSQLMDHIGPALDAADDSREVASLVHRLLREGTPADRQRRALLRGGLRAVTDLIITESAVT

SEQ ID NO: 8539 - protein, 456 aa, Streptomyces avermitilis
MVHRHVGAGCAGLSVLATLVLTGLPAAAAIEPPGPAPAPSAVQPLGAGNPSTAVLGALQRDLHLTDTQAKTRLVNEMEAGTRAGRLQNALGKHFAGAWVHGAASADLTVATTHATDIPAITAGGATAVVVKTGLDDLKGAKKKLDSAVAHGGTAVNTPVRYVDVRTNRVTLQARSRAAADALIAAAGVDSGLVDVKVSEDRPRALFDIRGGDAYYIDNTARCSVGFSVTKGNQQGFATAGHCGRAGAPTAGFNEVAQGTVQASVFPGHDMAWVGVNSDWTATPDVAGAAGQNVSIAGSVQAIVGAAICRSGSTTGWHCGTVEEHDTSVTYEEGTVDGLTRTTVCAEPGDSGGSFVSGSQAQGVTSGGSGDCTRGGTTYYQPVNPILSTYGLTLKTSTAPTDTPSDPVDQSGVWAAGRVYEVGAQVTYAGVTYQCLQSHQAQGVWQPAATPALWQRL

SEQ ID NO: 8540 - protein, 544 aa, Streptomyces avermitilis
VPDAVVIGAGPNGLVAANLLADAGWSVTVLEEQDEPGGAVRHDNGVDPDFTTDLFSSFYPLAAASPVLAGLHLEREGLRWSHAPRVLAHPLSDGRCAVLGRDLDDTAASLDTFADGDGAAWRELHDVWERLRPDLLDALFTPFPPVRAGARLAARLRAGGGLRLARSLVLPVRRLGEEEFRGEGGRLLLAGNALHADLAPEAAGSGGFGWLMSMLGQTYGFPVPVGGSGALTSALTQRLHRRGGVLRCGQRVSEVVVRQGRAVAVRTAGGETVPARRAVLADVSVPALYGTLVGSAHLPAQVLADLRRFQWDFATFKVDWALDGPVPWQADAASAAGTVHLADGVDELTRFAAQIAMRQVPDRPFALFGQMTTADATRSPEGTEAAWAYTHVPHRIAGDAGDAGLAGTWDAREQELMADRVERQVERFAPGFRSLIRARRILAPPTLQSLNANLYGGAINGGTTALHQQLVFRPIPGTGRPETPVANLFLASAGAHPGGGVHGAPGANAARAALRKHLPSGLTRAQRLLTRRNRKGERDTGFGG

SEQ ID NO: 8541 - protein, 158 aa, Streptomyces avermitilis
VAVRHRVIKRSPRDVWAVLADGTRYGDWVVGTSASYPVRGEWPQVHSAICYEVRIGFLTLTNETVVRACVDGRELELEAQAGPLGSARIAIEVRPWGEHSLVIIDEHPLKGVGGTLHNVGVEALIQLRHRSMLGRLAEVCEKEHQGTEQARGASPLRS

SEQ ID NO: 8542 - protein, 292 aa, Streptomyces avermitilis
VKDGPLHGRTVVVTGAARGVGAALARHLSRRGARLALVGHEKDALDALVAEVCTRAIAWEADVTDDAALDGVAREVRGRLGIPSVVIANAGVAEGGPFADSDAASWRRVIDVNLTGSAITARAFLPDLLTTAGYFLQIASLASIGAAPMMSAYCASKAGVEAFAHSLRAELAYQRVAVGIAYINWTDTDMIRDADQQAVLRELRAHMPPPARRVYPVDTVATRLVRAIERRRTSVYVPAWLRAAQVARAALPPLVMRLSRHALPRLAAREVLRPTGLLGAGGQADRTSGAGP

SEQ ID NO: 8543 - protein, 116 aa, Streptomyces avermitilis
MLSHSIEHGVLVITLHTDPGIGRRAALSHEITDLVHAYSPLPVVIVLDMPEVGSATVSAILRAQRMCHHLGVLMSVSTHSAATRRILEANCDTGGTRLVVHARTDVAIAAAFTAAA

SEQ ID NO: 8544 - protein, 139 aa, Streptomyces avermitilis
MAQLVREIMTSDITMVEPQTSVVEVARLMREQDIGAVVVAENGRLRGLVTDRDLVVRALADGGSVDDRTVYSACSAELVSVAPDDDVDRAVYLMGARAVRRMLVVEDGRLVGIVSLGDVAVARHADSALGDISAADPNH

SEQ ID NO: 8545 - protein, 93 aa, Streptomyces avermitilis
MVGILAWILIGLLAGAIAKLLLPGKDPGGIIVTMLIGIAGGLLGGWLGKVIFKVDSIDGFFDLSTWIAAIVGSLILLLLYRAVTGNRRSHRHA

SEQ ID NO: 8546 - protein, 175 aa, Streptomyces avermitilis
MRSTQMRRLGLAAVFALVLALFGLAPSASAADPGPADLTFATDSATTQPGGTVKLSMTITNNKTYDIWFIYQTIEPTWLTTQRPDLKYSFTGCSLATAAGSTPCSGTGPANLGTNYGATIPPGQSRTVTLTLQVAADSGCNGNIGFYSYYYAEFSDSTNTSGGPAYTPETRVLCS

SEQ ID NO: 8547 - protein, 711 aa, Streptomyces avermitilis
MKRTIRTTALTVGALIASLGLPAGAAHADATTPRIDLRVLVVSDGGPSTDAITAELDAAGTPYTEVDLEQSGRPVIDAGFLADTVDGRPRAKFQAVVLPNDNPFPANSAEMAALASYEQTYAIPQVDAYTYARPEAGLQYPVHGGYSGTVDGVQAQVTAAGKAGPFGYLDAAVPFEDNSPTVGESYAYLSTPAAGADFTPYVDAPIPGKSTRGSLVGEYRHDGRRELVVTFVYNQYQQQFRLLARGIVEWMTGGVHLGASRNYFAVHVDDVFAADDRWDTELNCTPGDIDCAQGEGVPNPIRMTPSDVDYATAWESRRNFTLDLAFNGVGSVEQREENNGVDQLADKLIADRDRFRWLNHTYTHAFLGCRQDTSVVPWKCATNTDGSTEWVSRAEVSAEIANNRLWAQSAGLPLDNDELVTGEHSGLKLSPQQPEDNPNLALALADNGVEWLGSDNSREPDQRQVGPATTVSRYPMNVFYNAGRAAEQVDEYNWIYTSRAQGGSGICEDHSDTSTCLTAPLATTTGYADYIVPLETRIDLGHVLANDPKPHFIHQSNLAEDRIAYPVLDGVLDGYNDLFADNTPVVNLRMKDIGTELQRRAAWKAAIQAGQVTAYRIGDTVTVEAPDGVAATATMPTGTTNGSAGFGDAYAGEVSGWTTSAGRPLTFTLPSSVPSLSATVAGQDKAPATRTTPHTRVPAGVTEQVPYTPEH

SEQ ID NO: 8548 - protein, 513 aa, Streptomyces avermitilis
MHVHHGARRPGATRVTLLTEGTYPHSHGGVSVWCDQLVGGMPDIDFDVIAVTGTGREPIVWDIPGHVSRVAAVPMWGPAPEGRAPRGRRRNRLASAYEQFLTALLDPCAEDRFGTALYVMARAAADGMLSPFLRGDRAISILTAVWNRPGLAVREARPTLHDAITATALLEHALRPLATPLPRDGVAHAVSGGVAALPGLAALERHGVPLLVTEHGVYLRERYLGYRTAPYRWPVKAVVLGFFRLLAEETYLRAALITPGNRYNRLWEEQGGADPESIRTVYNGVDPAAFPPAGPEPDAPTLSWAGRVDPIKDLETLIRAFALVRSQLPEARLRLFGGTPRGGEAYRERCEALAAELGHAEAVTFEGRVDDIKDAYAAGNVVMLSSISEGFPFTLIEAMSCGRATVSTDVGGVREAVGDTGLVVPPRDPAAMAAAALKLLGDPERRRSMGEAARLRVIEQFTLRQTVDTFRSIYLELSAPGRTTRRDPWTPDADAGLSTTAGPAAARMGSLAG

SEQ ID NO: 8549 - protein, 468 aa, Streptomyces avermitilis
MSGPMALEPGGTEQDTLALRLAEDRPLAPRPPDDHTVALRLPGRGTDSDAVDRLAAELADRIGPAVHSYEVAALLESEGLTAETIQERYGHANLFALASTLYARVPRTYPEPPRPADPWRPDHVRCALRGALFALPGLAYLLTGRLWHAERDTSVLIVAGLVSWAWGQALGHRAYLRMTTGRREAGRTLLKGAPLGAAAATLAGAVFAGAGTVALIAAAQSVYLSAAGVLLVLGRERLLLAALTPVIAGAVVLPWWEPGPVLRAGLPLLALLAATAAAGWSLRVTLAASPAPGATRPGLLRSLPYGLFGLAAGVLVLLEGRRHPYAVIVLTLSMGPAEWLLYRYRGMSVAALRATATPAAFLLRSAGVLGFCLLAYLLPLLPAALLTGAEPAPLLLLAATLWTALLLQAFGVAWPPAGVCLAAAGGAGAITLFHLPPGAAALSLCCGAAALCLTACALRLLGRPAAHA

SEQ ID NO: 8550 - protein, 264 aa, Streptomyces avermitilis
LTPAPLAAVTGAEGFIGSHLTEALVASGHRVRAMAQYNSFSSYGWLETLPADVLDHVEIVLGDVRDPGSVRGLVEGADCVYHLAALIAIPYSYQAPHSYVDTNVTGTLNVLEAVRALGTPRLVHTSTSETYGTAQTVPITEDHPINTQSPYAASKAGGDRLADSYHASFDTPVVTLRPFNTFGPRQSMRAVIPSVIGQVAAGARTLTLGDLRPTRDFTYVKDTAQAFLAVGTAPAAQVVGRTFNAGTGGEISVGDLVGGLIGQG

SEQ ID NO: 8551 - protein, 72 aa, Streptomyces avermitilis
VNGRLPRRGAEDAQRIRPANSEVMRLVADASRLNAATGWSPAHDLEQGLAHTVEFFRDPANLARYKTGIYNI

SEQ ID NO: 8552 - protein, 237 aa, Streptomyces avermitilis
MHAVILAGGKGVRLRPYTTALPKPLVPIGDQHAILEIVLRQLAAAGFTGCTIAIGHLGEIIRAYVGDGSQWGMAVDYATEESPLGTMGPLLTMRERLPESFLVMNGDILTDLDYADVLRQHRDSGAPLTIATYARKVHIDFGVLTTQAGRVVGFTEKPSMDYRVSMGVYGLSRKTLDGYTPGLPLGFDELVLDLLKTPNLPHAYDFDGYWLDIGRPDDYDRANAEFTTRKSLLLKGA

SEQ ID NO: 8553 - protein, 308 aa, Streptomyces avermitilis
MRILVLGFTGYLGRHVVERLRALPGTRVLGGGRSAGAEFGIDLATARPDTLAKALASAAPDAVINCAGATGGDAVTLAEVNSRGPAVLCAALREAAPSARLVHLGSAAEYGPGTRGIRVTESAATRPLTPYGATKLAGTITITTSGLDAVVLRVGNPVGPGAPLTGLPGRVAGLLLASGGDPDAVIRLGDLSAHRDFVDVRDVARAAVLAATAPAPLPRVLNIGSGSAVPVRDLVAALTHVAGFPGRVEEKGGGSARSAEVSWQCSDIGAAGDTLGWRPSYTLDASLAALWAAVREGPSPRLDGGRAP

SEQ ID NO: 8554 - protein, 220 aa, Streptomyces avermitilis
VSLLIPLYVHPAEDPGAWHRLITAADRTYAVVLNPANGPGTSPDPAFAAAAGALRAAGARLLGYVDTNYGARTAAEVADDVVRHREWYAADGCFLDRVTSAPAELPLCKRLVQTVRRLGASPVVLNPGVHPAPGYARLADLVVTFEGHWSTYVSAFSRPAWTLRHPPERFCHLVYGVPEALVPLAVRTARERGAAVCGPVTGEIPNPWTRLTPALGETEQ

SEQ ID NO: 8555 - protein, 152 aa, Streptomyces avermitilis
MNSDHDGPDRDHQRPAGVSDETVEALGALSKALETTERARGHLYSFHQLTGGADLELGHAVELLRRAGHHRSADRVEKEILGRNVIPGHWTFQIIESYNDTYYEPFKALERSVLNELAEGRDHLYEAEMKEARRTHGHRDHTARPDSPGTPT

SEQ ID NO: 8556 - protein, 120 aa, Streptomyces avermitilis
VPHPAERSRHGRGWFEKLAEAASNLTSSPVFYCFCLLLVFAFIVAHAVGLELTWQLLIGDIMTAVNLLLLALLKNSERRAEHAIQHKLDSIAAALLEQREGHSRQAHEELRKAIGIEDEF

SEQ ID NO: 8557 - protein, 182 aa, Streptomyces avermitilis
VSLIERRQRSSDEARTSQEGRASDSGTRADEGESEQERVNRRWQEILQETRVAQTGVQILFGFLLSVAFTPLFRELGTFDRGVYVAAVLLGAAATGALIAPVSIHRFLSGQRMKDELVAAAGRLMMGGIVLLALTIGCTVLLILHAVLPSSLAEILAGAVMLWFAFCWYLLPWILRSRADKG

SEQ ID NO: 8558 - protein, 500 aa, Streptomyces avermitilis
MLPPRPGATRFNGARPPTTAVVGGGIAGLAAATALAERGVRVTLYERQPDLGGRLSGRPVGLRDGSTVTMSRGFHAFFRQYYNLRGLLRRTDPRLERLTALPDYPLRHSAGLHDSFRRVPRTPPWSALGFVALSPTFGLRDLIRMNPVAALPLLDVSVPDVYTRLDAVSAHDFLRSIRFPEAAHHLAFEVFSRSFFADPRELSAAEMALMFHIYFLGSSEGLLFDVPDEPFPTALWDPLAGYLLRHRVEVRTSTSVESVAPTRDGGFAVATPEETGRHDTVVLALDAGGLRSLAGRSPTLADAPWRERMARLRNAPPFLVSRLWLDRPVARDRPGFLGTSGYGTLDNVSVLERWEGEAARWSARTGGSVVELHAYALPEDAVREVEQKRMLEQLCRVYPETRAATVVDERHEWRADCPLFPVGGYHDRPTVRTPEPGLVVAGDLVRTGLPVALMERAATSGFLAANALLERWGVRGQTLWTVPDGGRSAVLRRVARWGSA

SEQ ID NO: 8559 - protein, 243 aa, Streptomyces avermitilis
MTLLRDADLAAAFDRAARSYDTLVAANPGYHAHLRRSARRLGLPHGGSGTRVLDLGCGTGASTAALAAVLPGAEITAVDASAGMLERAAAKPWPDRVTFVHAPAERLTEAGVEGPFDAVFAAYLFRNAAAPDSVLTAVHDVLAPQGRLAVHDYTLSGRARDRTVWTVVCGGIVLPVATALGDGRLYRHLWRSVVEFDTADEFAGRVRAAGFDCVRVLPLPGWQTGITHTVVGRRAGTDTATGR

SEQ ID NO: 8560 - protein, 397 aa, Streptomyces avermitilis
VLEADVAIVGAGAAGLSLAHRLACPVRGAPRISVVLLEAPPGPLRPPRRTWCFWERGPGRYDAAVTASWQRLRVRAPGGRPIEGDITPLRYKMIRSDDFEALMAHDLALSGGVQRVEATVEAVEGVPGGAEVYAYTAAGRPLPVRARWVFDSRPLGSLPAARTTLLQHFHGWFVRSDLPVFDPGTVELMDFRTPQPPRGLSFGYVLPTGRRQALVEYTEFSPAVLPRSAYEAALRHYTRDILHLPGLEIVSTETGVIPMTDAPFARQTAASVFRIGAAGGATRPSTGYTFAAVQRQTRAVAAALCRGRRPLPPPAHSARSRAMDAVLLRALDSGRIGGAAFFARLFSRVPMERLLRFLDGCTHLHEDLSIGVHTPVLPMLRSAAELPYLPRRPFPGP

SEQ ID NO: 8561 - protein, 379 aa, Streptomyces avermitilis
VGRLLDRFLAERVARAAALDPVFAHDIAERVARFTLDGGKRTRSQFVWWAHRACGGPAAGAEAALRVGAALELIQTCALVHDDVMDGSRLRRGRPALHTDVSAQYADAVLPAPGTRFGEAAAILAGDLALAWADDVVADTDLAPDPGRRVREVWSCLRMEMVAGQYLDIQGQATSSHSEARAMRAACLKSALYSVQRPLELGAALAGADTATTQALCSAGRCVGLAFQLRDDLHDVFEEPRRTGKPSGGDIRAGKPTYLVAVARARAEAAGDRGALAVLRRSLGCADLSDADLARVRDVLVTTGARDTVEAEIDRLVAQGLRHMGAASLAPEGRRHLDALLRSAAGAPSVRRQAPDASRSENGMPVSLLLTATAEGASR

SEQ ID NO: 8562 - protein, 513 aa, Streptomyces avermitilis
MNRTLRGRTDHVVVVGAGLAGLSAALHLLGAGRRVTVVERDLLPGGRAGRLVRGGYLIDTGPTVLTMPDLADEAFAAVGDSLRDRVDLIPLHPAYRARFADGSTLDVHTGAEAMEAEIERFAGAREAAGYRQLRDWLERLYRAQMRRFIDSNFDSPLQLLTPDLARLAALGGFGRLDARIGRHLRDERLRRVFSFQALYAGVPPARALAAYAVIAYMDTVAGVYFPRGGMHALPRAMADAAAQAGAELRFGQDVTRLERAGDRITAVVTAYDRIPCDAVVLTPDLPVTYRLLGRAPRRPLRIRNSPSAVVLHAGTDRTWPGLAHHTLSFGAAWGRTFDELTRTGGLMSDPSLLITRPTATDPGLAPPGRHLHYILAPCPNTDIGPSAAAWGDLAPRYRDSLLTELEARGLDGIGSAVEEECLVTPADWAAQGHAAGTPFSAAHTFAQTGPFRPRNLVRGTANAVLAGCGTTPGVGVPTVLLSGKLAAARVTGGTRRTPRRMPASRTASGRTLS

SEQ ID NO: 8563 - protein, 342 aa, Streptomyces avermitilis
MTDRELDAAGITDPSLRKAYTHCRRLNARHGKTYFLATRLLPVERRPAVHALYGFARWADDIVDSLDTTVGPAVRSAALGRLQESLRTGLREGHSTEPVVLALAETARRYAIDHQHFSDFMTAMRSDLEVTGYETYADLRGYMHGSAAVIGLQMLPVLGTVVPREEAAPHAAALGVAFQLTNFLRDVGEDLDRGRVYLPADLLRAHGVDRDLLRWSRDTGRRDRRITRALKAVEGLTRGVYREAAPGLAMLDPVARPCIRTAFVLYGGILDAIADDGYAVVHRRAVVPRRRRAAVALDGLVRLGVARLGSRADARLPTLPDPWRLPALVPRSSPRPAHEEVA

SEQ ID NO: 8564 - protein, 359 aa, Streptomyces avermitilis
MTPDRTDRPARRRRYPLSLRRHPIRWEDQRPTWRDARPAVIAEALKRAQARPSGNWYVVGATRDVREDRPLARTVAGLEVVVWRDGEGRLVAGPGVCPHLGAPLRDSPVRCGTLMCRWHGLALSGTPFAGWEPLPVHDDGVLVWVRLDEVGGERPLEAPVVPARPALSGAVSAVYVGVGICEPEDVVANRLDPWHGAWFHPYSFVDLTVVTPGETVAPEEGETEGVETGGDEAEGAETEDGFTVDVSFKIAGRLVVPVRAVFTAPEPRTVVMRIAEGEGRGSVVETHATPLGPDDRGRPRTAVVEAVLASSDRRGFAVARAMAPVLRPLMRAAAGRLWRDDLAYAERRRHLRSTGRFPG

SEQ ID NO: 8565 - protein, 699 aa, Streptomyces avermitilis
MSGEHTLARRTRTRRLLGTIGVTALATGAALVTAPPTNAQTPAAAATAAVTVQPDPSYRADRFEGWGTSLVWFANATGDYPAEIREKLAELLFDDDGLALNIARYNIGGGNAPDVKDYLRAGGAVEGWWNAPAGTTREDTDWWSADDAADWNPNADATQRWWVDRIKNDIDHWETFSNSPPWFMTASGYVSGGFNSSEDQLKADSVDDFAAYLAGATKRLEKAHGIKVDTLDPFNEPNTGYWGTRLGSDGRPVGGRQEGAHIGPELQQKVIRALAPALKKAKTGTKISAMDETNPNLFAQNWNSYPQDVRDLVGQMNVHTYGTGGRTSVRDLAKAADKPLWMSEVEGDWGDGQSFTDMRPGLGLAQQMVDDLRELEPKAWVFWQPVEDYDNMKPGGESAKGGNWGSIQLPFSCTSADTLATCPVHTNTKFDTARNFTHYIKPGDRLIRTDDTSSAAAVSTKGNAATVVHVNKTTSARTVTIDLSKFGHITRDATVTPVVTSAAGKLERQAPVEVTGSRAAVTVPAQSVTSFLVKGVSGVAKDAALLCKGHTYQLTGVQSGKALTVADDGTQLVIRTAGTDAAGTGQQWQVRQISGDTGNRQRYVFTNPAAGKRLAVRDGAPVLEADRGHRDKATQWIMSTTGDGTWTLVNAATGRLLEVGGQATTDGAAVTTWTPNSGSNQRWSVTDVTDQNGSRSSGL

SEQ ID NO: 8566 - protein, 680 aa, Streptomyces avermitilis
MISTLLSQLNGPDGDRTPRLAYGADYNPEQWPREVWEEDIRLMREAGVNIVSVGIFSWARIQPAQGQWDFAWLDDVMDLLHAGGIGVDLATATASPPPWLATAHPEILPVTASGETVWPGARQHWRPTSPVFRTHALRLVRKLAERYADHPALVAWHVSNELGCHNIYDYSDDAARAFRDWLRARYTTLDALNHAWGTAFWSQYYSDWDQILPPRLAASHPNPTQQLDFKRFSSDALKAYLRAERDLLREITPEVPVTTNFMVMGRTKGMNYADWAQEIDFVSNDHYVSPGPQDRDELSFSANLVSGIAGGRPWFLMEHSTSAVNWQPVNLAKRPGDLARDSLLHVAHGADAVCFFQWRQSAAGAEKYHSAMVPHAGPDSEVFRAVTALGGTLRTLAPVAGTEREPARVGIVFDWESWWASEQDSHPTSLLDYRREALDWYSALLALGIRADVVTPQADLDRYQLLITPVLHVVPAALAKELTRYAENGGHLVTTYFSGVVDENDHIWLGGYPGALRDLLGIRVEEFGPLLDGDTVALDDAATGTLWTDRITVTDPEVEVLARYRTGTYAGHPAVTRRAVGRGSAAYVSTRLGPDGLTALLPKLLGPAAVGSELPDGVGGDVELIVRRGAGSRYLFLVNRTDGTVPLTGLAGELLIGRAEDDGTVVLSPRDVAVLRQPTR

SEQ ID NO: 8567 - protein, 445 aa, Streptomyces avermitilis
MRRTTRRLMRGLAVLSVLALGATACGGSDDDSADQKPVSAGDIQAALKKGGTVTVWAWEPTLKTVAADFEKKYPKVKINLVGERSGDKHYTALSNAISAEKGVPDIAQVEYFALGQYALTKGLTDLTPFGADKLKAKYTPGPWNAVSEGDKVYGLPMDSGPMALFYNKKVFDKYKVAVPTTWDEYVEAARKLHKADPKVYIAADAGDAGLTTSMLWQAGSRPYQVDGTKVKIDFADAGAKKYTDTWQKLIDEKLVAPIYGWTDDWYKGLGDGTIATLPSGAWMPANFVTGVPKASGDWRAAPLPAWTKGDKASAENGGSSLTVPELAKNKELAYAFVEYANAGDGVQTRIKQGAFPATTAELQSTEFQNTKFDYFGGQEANKIFADSAANVADDWSYLPFQQYANSIFNDTVGKAYISKTKLADALKSWQDASVKYGKEQGFTVE

SEQ ID NO: 8568 - protein, 318 aa, Streptomyces avermitilis
MSSTSSPVTTDSQPASVPATGPTKGAPRLRTPRKHVPGRPKRSVPLTLLTGLVLLYTLVPLAWLVISATKTQEGLADSSGLWFAHDFALWDNISQTFTYDDGIFVRWLLNTLLYVVLGAGGATLLAILGGYALAKFTFPGKRAVFAVVIGAVAVPGTALAVPTFLMFSKMGLTDTPWAVIIPSLVSPFGLYLMWVFATEAIPVELLEAARIDGAGEVRTFFQVALPLLAPGIVTVLLFTTVATWNNYFLPLIMLKDPDWYPLTLGLSAWNAQAETIGGDVIFNLVITGSLLTIVPLIIAFLLLQKYWQSGLAAGSVKE

SEQ ID NO: 8569 - protein, 308 aa, Streptomyces avermitilis
MTTLQPSAAVSRPPARPPSKRDRRSWTGWGFIGPFAVVFAFVFLAPIVYSIYLSVFRTQLIGGTTFVGLDNYQQALHDDQFWASLGRVSLFLAVQVPIMLGIALLIALALDSGRLYGKDFFRIAIFLPYAVPAVVATLMWGFMYGTRFGLVGDINEAFGVTLPDPLSTDLVLASIGNIVTWEFVGYNMLIFYSALRVIPNSLYEAAEIDGAGQIRVITAIKLPAIRGALVIATIFSIIGSFQLFNEPNILRPLARNAITTDYTPNFFTYSLSFNGQQHNYSAAVAIIMGLITMVIAYAVQLRGMRKGA

SEQ ID NO: 8570 - protein, 359 aa, Streptomyces avermitilis
VNTADSGSTSVPRALTRMDEQSARRRQSASMADVARLAGVSSQTVSRVSNGYAGVTEETRQEVLAAMKELGYRPNSAARALKRGEFRTIGVITFNLSTTGNMRTLEAIATSAAQEGYAVTLLPVAVPTQDEVHGAFSRLGELAVDAVIIIMEVHLLDAATISLPPHVQVAVADSDAGDRYTVVDTDQAGGARAAVRHLLELGHRTIWHLAGPEESYAAQRRADAWRAELIEAGRVPPAVVRGDWSAESGYQAGLRIADEEDCTAVFAANDQMALGLLRALHERGRRIPEDVSVIGFDDIPEAGSFLPPLTTVHQDFAEVGRLCVQGVLRRMRHDAAEHGTTLVPTKLVVRDSTAPPPSR

SEQ ID NO: 8571 - protein, 105 aa, Streptomyces avermitilis
VTTYVITIPGTFLRDPSDDVRSALVRLLRPADPHHTSLGQQEDLDLLTVNDDNTFSIRLEVTADDSRNAEEDAKRTAASALREAGFAPDEAPLGPATVTGIDNQA

SEQ ID NO: 8572 - protein, 759 aa, Streptomyces avermitilis
VRTVTRPSRTGTWDRFTASDPGLLRLMAGLRTVGAIALTLAVLALLRADVSHMVAGSMAAMVATFAVKDKQRREQAVTLALGLPVALTAMSLGALLNTHVIAGDLFFIALIFAAVYSRRFGDRGMALGLIGFQVYFVSLFVRATFSALPGLCGTLAIAFACSAVVRFGLVVETPERILERLRRAFRARLAQLVSAQIELLDAGPARLEKALEDVRLHTARLHETALMIQGRLDEGTSDSATASLVQRRVADAEIAAERLGVLLLSARSAERADTLTLHLPNAPLPAPGDWPRAQDDVTATLRRDLHALRMLVLRPVSHDRGPAVAHLRNRLLGYRDEENLPRASAAVQDVFRGIGEAARSVLGLRLAVDGPQDESDDTPATTRSREELDAEDVAIAGAEEKEPDDDGPTGLKRPTTRSAVQVSVGSALAIVGGEFLSSQRWYWAVLTCWVVFLNTASTGEILVKGYRRLLGTVLGVVAGVALAGLVGNRTWLAFVLVLLFIFAMFYSAPLSYALMSFFVTAMLGLLYTLLNTYSPEVLVLRIAETALGAACGVIAAVLVLPVNTDRRTDELLGTVLSRLGDVTDAAVEQLSGGPALDLLDKARDLDTALDDLRSSTQPLTHPITPLRARRQTARYLVALLETCAYHARSLAATAELLPYSKTVAADPRLKRAGRRIADNIGVLVARVEDEGSEGVVETGASLAAMLEADTEGATRPDRVTSRVLRHLQRLDEGVVGLARPLGVSVSSPDRESSRGRVGS

SEQ ID NO: 8573 - protein, 272 aa, Streptomyces avermitilis
MNRRPRRAAHVFVSTLAAGALLTTAGCSEDGNSRGSSEAVSSPSAELSASPLVKESPAASTAPALTTEQAQTALLTNTDLGSEWTQSKAAESWRATMVKGKTNLAECQKLLDALVSGELLGDPSGSRAVTGFADSDNDAQMRYEVAAYDHAALDKSFDWLKSVPVTCDQFTATDTPVGTQTVQVVETSLPSAGDDRQGLQMTATGALEGTPFTLTMDIAAVRVGDNAISLTNGGLGGADSDSTSQAVQLGAQRLTDVLAGKTPAEQPPGQQD

SEQ ID NO: 8574 - protein, 357 aa, Streptomyces avermitilis
VTVTRVGLVMHGGRAQAGDAARIVRGWCAERGVHCADIDVWRDDTRHSAREEVAAAGNPDLIVTLGGDGTFLRGARLAAENDALVLGVDLGRVGFLTEVPAAAVCEALEAVQEDRITVESRMLLTLRASRRLQVPTGMEALLRYGRGPLLPPPRVRTDCAEGDDWGIALHVTALNDIVLEKLARDRQVSVGVYLAGRLLASYSADALLVATPTGSTAYSFAAGGPVVSPRAEALIFTPVAPHMAFNRSVVAAPDEPIALRVLDRSGPAAVSVDGQLRGVLDPGDWIGVYAAPRRLKAVRLGPMDFYGRLRERMNLTDAPAAVADGQAAPLWPVTSAPPADLAHLTLPPGPGDTPSAS

SEQ ID NO: 8575 - protein, 264 aa, Streptomyces avermitilis
MHIDLKGRTALVTGSTQGIGAAIAVGLARAGARVGVNGRSRERVESAVASLAVEAPGADLVAVTADVATEEGAAAVEDALPQVDILVNNLGIFGAKDPLEITDDEWRRYFEVNVLAAVRLTRMFLPGMAERGWGRVQYLASDSAVAVPAEMIHYGMSKTALLAVSRGFAKQAAGTGVTVNSVIAGPTHTGGVEDFVYELVDREVPWDEAQRTFMRERRPQSLLQRLIEPEEIANMVVYLSSEQASATTGGALRVDGGYVDSILP

SEQ ID NO: 8576 - protein, 791 aa, Streptomyces avermitilis
VRRLPAQRDSRPPAPRRAALSAPFTGRPSQKEKPLSRPPRSSHRRRYTAALALTTAGTLFAAGFQTGVASAAPRDPGHAKIAATPRAGAAPAKLSPAKHAALLKSATAAVGDTAKSLGLGAKEKLIVKDVAKDADGTTHTRYERTYAGLPVLGGDLVVHLRNGGRTTVSEATKATVRVPAVTAKVSSATAAGKAVAAAKKADAKHPKIDGAPRLVVWAAGAKPVLAWESVVEGVQHDGTPSELHVITDATSGKAVFDFEDVRTGTGTGQFSGTVPLGSTLSGSTYELVDADRAGHRTYDLNQGTSGTGTLFTDDNDVWGDGTQSNRQTAGVDVAFGAAATWDYYKDVFGRNGIRNDGVAAYSRAHYGNAYVNAFWSDTCFCMTYGDGASNTHPLTALDVAAHEMSHGVTSATANLTYSGESGGLNEATSDIFAAAVEFHADLPADVPDYLVGEKIDIRGNGTPLRYMDKPSKDGSSRDSWDSSLGSIDVHYSSGPANHFFYLLSEGSGAKTVNGVSYDSPTSDGKAVTGIGIENAQRIWYRALTTYMTSTTNYAGARVATLQAAADLFGAYSDTYLAVAAAWAGINVGDRIALGVNIAPIADQTSGVGQEVSLQTDAYTTNSGAGLTYAATGLPDGLTLSDTGLISGVPTTAGTSEVTLTVTDSTGTAASVSFSWRVAHIYANGTRVDIPDAGAAVESPIVITGQTGNASATTQVYVKIVHTYRGDLTVDLVGPDGTVYSLLNHSGGSADNVDQTFTVDASAQPVDGTWKLRVRDTASIDVGYLQQWQLTP

SEQ ID NO: 8577 - protein, 314 aa, Streptomyces avermitilis
VSGMSALELIRIVSRDSPMALAQVARVRAELAALHPRTRTEVVAVKTTGDKWMGDLSKVDGKGAFTKEVDAALLAGEADLAVHCVKDVPADRPLPAGTMFAAFLKRDDIRDALVHPGGLTLDELPPGTRIGTSSVRRVAQLAAAYPHLECVPFRGNANRRLEKLAAGEADALLLAVSGLERIGREDVITEVLEPETMMPPIGAGILALQCREGDTGLIETISELGDPGTHREATAERMFLHVLQGHCNSPIAGYARTERNGELSLRASVFTLDGKTVLNAHEWAGRLDPATLGTSVAVALLRQGARELIDDIPH

SEQ ID NO: 8578 - protein, 314 aa, Streptomyces avermitilis
VTADTQVDVTADTQQDGTSMPGTHSSRRATRGLATAVAAGAVLTAFASATPAEASTAAASVGGSQVTCTSQRPGLAGRLSQDIADALRGRHGASALALYDRSTKTSCAYRADAAFDSASVVKVTILGALLRQAAEEHRRLTPREVKLTTAMITKSDNASTNALWHQVGAAGVRHFLTLAGMRDTVPGPKGYWGRTRITAADQLKLLRLLTSDNSVLDRNARAYALRLMNRVIPGQRWGAPTGAPSTTTVHVKNGWLPRETNGWRVHSVGVFTGGGHDYGMAVLSHGNRTMDDGIATVERAARAVNHDLNLPTAS

SEQ ID NO: 8579 - protein, 91 aa, Streptomyces avermitilis
VTDLDVSALGKSTVRSTVLVNPVPADHYYVAGHPVREATGAHVEVSITAGTNNADEKARFIAGAYNGITQFDHYRHAPRPVATPDGRNRMP

SEQ ID NO: 8580 - protein, 190 aa, Streptomyces avermitilis
VILPHAGSALAATDAICDAATRHDATTGGTVRLAADPTVRQGLLPSLPRHWSEHLPAIRVRVFEGSGEETETWLASAAADAAVVVDPPAGSGAQEYTPAHRVRDLGTLISMAQAGLGVSILPEVSRPLIPRDLVLVRVAPHHSRRLAPCGPRKRPWPPQCVLSWTPWPGFRRARPASCADLMAPTGTPLP

SEQ ID NO: 8581 - protein, 426 aa, Streptomyces avermitilis
VTIQLYEDRPAGRHAAVPHGSLLRRVYAPRAFDALAFSMSTYAMPLLVLATTDSARLTGLAFALEWIPRVAAFGLAGDLVDRRGAAVVFFLASLARAIVVAAGAVALIMLQRGTAETVVVMALAAGTGTLTQFSFIANEAVGAIVSRRTDTQAHKVQAVLIGIDQTATLTGPALGGVLLLAGPTRMLVVLGVLSCLAAALALQTPPTPLRGSGRHNKRPEAGLKAGWRTLRSLPALGCLVAGLSISNLALGLLQSASPIIVVERFGLSPAAVGTLWSAAAASTLLAVAVCRFALGRLGLWGVGAVCSTIASAACLALAQAPTYLAYVVLMALFMAGDGGLTVVLRTLRSLLIPAAVFGSTLSLTILLLLLPFPVAGILVAVTPPWALGHVIAVCAALQAVALGIVFLRLRTDPVLRASGKPEQATA

SEQ ID NO: 8582 - protein, 481 aa, Streptomyces avermitilis
MRRLTVRLFTAVLAALALLTMGTPAHATAPASPSVTFTNPLAEKRADPHIFKHTDGYYYFTATVPEYDRIVLRRATTLQGLATAPETTIWTKHASGVMGAHIWAPEIHFIDGKWYVYFAAGSTSDVWAIRMYVLESGAANPLTGSWTEKGQIATPVSSFSLDATTFVVNGVRHLAWAQRNPAEDNNTSLFIAKMANPWTISGTPTEISQPTLSWETVGYKVNEGPAVIQHGGKVFLTYSASATDANYCLGMLSASASADLLNAASWTKSSQPVFKTSEATGQYGPGHNSFTVSEDGKSDILVYHDRNYKDISGDPLNDPNRRTRLQKVYWNADGTPNFGIPVADGVTPVRFSSYNYPDRYIRHWDFRARIEANVTNLADSQFRVVTGLAGSGTISLESANYPGYYLRHKNYEVWVEKNDGSSAFKNDASFSRRAGLADSADGIAFESYNYPGRYLRHYENLLRIQPVSTALDRQDATFYAE

SEQ ID NO: 8583 - protein, 511 aa, Streptomyces avermitilis
LRTVFGISNLLSPEGTHVFRTRHWFVLGAALLALLASLVPAQSVAAAGGRPYTNPVKAQKGADPWLEYYNGNYYLVTTSFTNELTMRKSPTLAGLATAPSVQIWSDTTSGRNANFWAPEIHFFNGKWYLYYSGAQSGAACCDTQRTHVLESAGADPMGPYTYKNSLTGSNLNPGGWLIDASVLQYNSKLYLVGSGSINGSTQSLVIAPMSNPYTLSSSSFTVISSPTLSWETSGAPVNEGPEPLYHDGRTFLTFSASYCQTADYKLGQLELTGGDPLSPASWTKKQNPVFQRDDAAGVYGPGHNGFFTSPDGTENWIVYHANSSASGGCGNGRTTRAQKFTWNADGTPNFGTPVATGTTLAGPSGETAATPTAYTIVNRNSGKCLDVEGGNTADGTDIFQWTCGGGANQKWRIEDQGTDTSRLVNVATGKVMDTADCSTADGADLRQWSWLNNNCQRFRLVHTGSDYVRITNANSGKVADVADCGTGDGTDVRQWTWLDNACQQWQLKPTV

SEQ ID NO: 8584 - protein, 224 aa, Streptomyces avermitilis
MPAVTTAASSRPADRLAVDRVVRRRLPVALLAVVTVALAMSAWHAKDPTTWLLETVWAWVGLPLVVLLRRRFPLTSLLYCLLAAHALVLAVGGHYTYAEVPAGDWVRDWLDLSRNPYDRFGHLMQGFVPAVLVREILTRTSPLRGSRWLAPLTVCACLAFSAVFELLEWAAAVAGGHAADAFLATQGDVWDTQWDMFCALIGAVCSLLLLSRAHDRRLARLDGR

SEQ ID NO: 8585 - protein, 180 aa, Streptomyces avermitilis
MRTGSTEQLSAERTGRTPSAGVEKATPLKALGRVPWQDIKDSSGSAAAIPLLLSSVAWGDAATARAALSDLRERICQYGFVVEQATAATVPFLWELAQLPQVSCRAQIIQLLRNIADARQWESTAALYPKLLNHRENPVVWERQARQAVRARRSVVEQLLAEDDAEITQATTELARALGA

SEQ ID NO: 8586 - protein, 76 aa, Streptomyces avermitilis
VPTAPNGVQASSLAARWIKSRHSNAEGNCVEVAALDGGGIAMRNSRDPEGPALVYTSAEVAAFLAGAKDGEFDHLL

SEQ ID NO: 8587 - protein, 306 aa, Streptomyces avermitilis
MSAESHRVSRLEPYLDRAEPAPTLLKMLVGVQLAGCRDDAGLSQEQAARALGFSPAKLSRIEAGKGRRPPTEGDVRALLQLYGTDAYEASVLLKLLQRAGEPGWWQRYDKRLMPEWFDRLVGLQEAAATIRTFEIQYVPGLLQTPAYTRAVVQRGLPTASAVEVQRRVELRTRRQEMLLRADAPRLWAIVDESVLLRVLGSRDVMREQLEHLIGMARRPEVTVQIVPLDVTNASAPAIPVTYLRFDGLDLPDIVYLEHIKSANFLEDRDETEEYRLTLDRLADEALDPHESLNLMRATLEQRYADT

SEQ ID NO: 8588 - protein, 272 aa, Streptomyces avermitilis
MQSGKQLSTSIDATVPTAARMYDHYLGGKDNYAADRAACEELDKVVPSTRPLAVNNRRFLRRVVGTLAAEYGIRQFLDHGSGLPTQDNVHQVAQRVDPTAHVVYVDNDPMVLVHGRALLEQDERTVVIQADMRDTEGIFSHPDTKRLIDFSEPVAALFVSVMHCLPDGDTDGPPALARRVAERLVPGSFMVMCQLVSEDAQIRDFVTDFMDRTTQGSWGRVRQEKDVVDLFQGMDILEPGLVDVSTWRPDSEVAPRQLTQEWIEFGGVGRIR

SEQ ID NO: 8589 - protein, 285 aa, Streptomyces avermitilis
MHTRRIGDVEVSAVGLGGMPMSIEGRPDETRSLATIHAALDAGVTLIDTADAYHRDADDVGHNEALIAKALGSHDRGPDVLVATKGGHLRPGDGSWTLDGTPRHIKEACEASLRRLGVEAIGLYQFHRPDPEVPYAESVGALRDLLDEGKIRMAGISNADPDQIRQAHEILGGRLVSVQNQFSPAFRSSEPELRLCDALGVAFLPWSPFGGSSRARELGSAYAPFARIAEVHGVSPQRVCLAWMLAKSPVVVPIPGASRPDTIRDSAAAPDLVLTVEELAELDAA

SEQ ID NO: 8590 - protein, 297 aa, Streptomyces avermitilis
MRMGLLGTGPWAQAVHAPALRGHDDLEFVGVWGRRPEAAASLADRHGTRAYDDVDALLADVDAVAVALPPAVQAELAVRAARAGCHLLLDKPIATTVPDGRAVVEAAERAGVASVVFFTTRFQSETEAWISEQGAAKGWFTARAQWLGAVFTSDSPFAASPWRREKGALWDVGPHALSVLLPVLGDVRRVAAAARGPRDTAHLILEHAGGATSTLTLSLTAPPAAAGALVELRGETGVTVLPNSSTSALDAFARAIDALRTAARTGRPHPCDASFGLRVSEVLAEAEARLAGDSPAQ

SEQ ID NO: 8591 - protein, 269 aa, Streptomyces avermitilis
VSEQDSPSGGSAVLNTGVAHNARVWNYWIGGKDNYQVDQEVGEQVAAMFPVIRDVARADRAFLGRVVRHLTAECGMRQFMDIGTGLPTLDNTHEIAQRIAPDARIVYVDNDPTVLVHARALLRSTPEGATDYIDADAHDPETIIRGAAATLDFGRPVAVMMLGILNFVLDTARARDIVRRIMAAVPSGSHLVLTHPTTDAGLGGEGNVAAMKFWNDNATPPITARSREEVAAFFDGLDLIPPGIVSCSRWRSDSTADVLPQFGVVAVKP

SEQ ID NO: 8592 - protein, 399 aa, Streptomyces avermitilis
VFERFRRRALAPLVTTALAAALLTIGGPPSAEAAVPATIPLKVTNSSGRGEPVYIYNLGTLLTTGQQGWADANGAFHAWPAGGNPPTPAPDASIPGPAAGQTKTIRIPKFSGRIYFSYGQKLVFKLTTGGLVQPAVQNPSDPNRDILFNWSEYTLNDSGLWINSTQVDMFSAPYAVGVQRSDGSTVNTGHLKSGGYNGFFTALRGQPGGWANLIQTRSDGTVLRALSPGHGLETGALPASVMDDYVNRVWQKYSSSTLTVTPFTDQPNTKYYGRVSGGVMNFTNSAGAVVTSFQKPDADSIFGCHKLLDAPNDLVRGPISRTLCAGFNRSTLITNPNQPDTTTAGFYQDVVTNHYARKIHAQMADGKAYAFAFDDVGNQESLVHDGNPLQAYLTLDPFS

SEQ ID NO: 8593 - protein, 683 aa, Streptomyces avermitilis
MHGYSTGSGDEITAAPGGLLDLLQVAAVVLNGDGRIVLWSPEAQQLLGYAAEEALGRYADDLLVSPDSQQRARELFAQVRSGSSWAGVFPLLHSDGTERRVEFRTMRLHDIHGQMHLLGLAANATTVRGVERDLALSHSLVNQTPVGIAVFDTELRWVGVNPALERINGLPEEAVLGRRVGEVLPNLDVEVIESRMRHVLVSGKSLLDQQTVGRTPADTQDRAYSESYHRIEDSDGRVLGLAMAVLDITERQQAAAEAAQAREHLAVIADAGVRIGTTLDLSQTARELADVAVPQLADLAAVDVLEAVVAHGVTAAVTGEAHAEFRALAVAAGYLTDAIHAADPVGELASYSSSRIITQCVREARPILVEHVDPGMMRRIARDSHAAQALRVAGVHSYLAVPLVARGEVLGTLSLYRTINARPFDEQDRVLASEFAARAAICVDNARLYGRERSAALTLQRSLLPPAPAQQEGLDIAARYLPALSEVGGDWYDVLPLGRGRTGLVVGDVMGKGVQAAAIMGQLSSATRALARLDLPPAELLRHLDDIAGSLGDAIATCVYAVCDLRQGTCELSSAGHLPPVMVRPDGGAELLDVPGGVPLGVGGVDFGTVRHELAPGTLLALYTDGLVENRTESIDTGMGTMTRLLQGARNSLEATSDMLLSALRPEPDDDVALLLVRTRAEG

SEQ ID NO: 8594 - protein, 245 aa, Streptomyces avermitilis
MSGPPPSGPSSADGTSDEAWPELADRLAVMARDLLAQESLQATVDRIAFHAVGLIEGCDVSGILTLSRKNVQTLTATDDVVRRSDAIQGELGEGPCFNAVTDEEPVQRIPDLRTAGDRWPRYAPQAAELGIRSAMGFRLFTRHHTLGALNLYSFRPNAFSERDEHLGWLLASHAAVAFAYARTEEQLQTALRSRDEIGQAIGIVMERFHLGQDEAFELLKKTSQDLNIKLRDVATKITPSDGTPG

SEQ ID NO: 8595 - protein, 147 aa, Streptomyces avermitilis
MTGPAKNLPQLFLEAKRWFDDALLASMRAAGEQPVSIAQGAVFAVLDDEGTSISELARRIGITRQTAHQAVHGLIGMGLLEQVSDPASARSSLVRTTAEGTRVHQRAQTALALIEQVLADRIGADAATALRRALSEPWGQPPSVEAP

SEQ ID NO: 8596 - protein, 145 aa, Streptomyces avermitilis
MTQNRNVDGVPEGRGMTPAEFRVVREFLGLTGGWLAEHVGVSPNTVERWEQGEERIPAAVRGALGDLGRLTGEFVAEVVNSLVDLPEPGIVTYRDDAEYHAAHPESGYPAAWHRAVVARVAQEIPGLSIAYASDVVSEDVKVSAE

SEQ ID NO: 8597 - protein, 521 aa, Streptomyces avermitilis
MSGDQHAATNGFVAPPMPSAPPPAPPDRPRAAAVALLNLSGLGIGYALIRRWVPMAACWIATGVLLLLALPADPDGVGGGLLTVYVVVLLLAAVHGAFVGLRTRLVWPPRSPVAVLLGLALLAVPVGGSVLYRSAREEATQQMLLDRLERADGLVRSGGQKSFGTAQSDYREALRVYGGLRADHPDSRAARKVPGRLTSFYETVGAAYARKDYCAAIAPLTYLRTVPRTLDKKDLGSLAAWPDDRLAASLYECGTDGLAGADVTWEGHFSTLLTTFPDSPQAKKIEPEVRAAVDKEAGNLRGSEPCAAVERLQGLSSQVARLPGDKAGVADALARDAGRAGKSADAGAYACGVDQYKDGEFDAARTTLSEFADSNKHDKNRARARKIAIAAEVALKVPAAGKRLPTTASGGSISVTVKNDSPDDITVLYTGPVTGSFTLKGCGGCTAYSTASTLLLGFNPCNDSGKHYPQRTITLPVGTTYFLHKPMGDSSATPASDTAKLRSGYLYTECAYTTKGFGLGS

SEQ ID NO: 8598 - protein, 307 aa, Streptomyces avermitilis
MATPVRRMPPMRRRRAFDLRSTALFFGLLAVVLSVAGFAVRAAARVVEQRPGLVMILCLIGVPAAVVCRQGRRRFSAARAARRVAAALDDATHTALDALETAQPVAPAPAPVPDRLATPVPTSRDTTVVILPGEAEGTVELETIDHEAIDHEEFDDDAFDYDALDADEFEQAVAALCERDGCSDVEVVGGAGDLGADVVATAPDGRRVVIQCKRYCDTNKVGSQDLQRFGGTCFTVHQAQVAVVITTSDFTTPATEYADQCGILCFDRQALLAWSDGTGPQPWGEEVAVGDPWAGDGPLEGPCARQG

SEQ ID NO: 8599 - protein, 319 aa, Streptomyces avermitilis
MGTAVHVPQTRDMIGEELSGDEALTALRRYGGLRLLVDSFARFRYADGFSHARALGFQVVLGMVPFTIALVGVATTVHTESVGQIVELTLARIVPGASADVVKDALAGTRRTAHASLWSTVALWVGLAFAVLNLASAMGQVERGANRIYGVEQDRPALHKYGRSVLLALAAGVPMVLGFLVLVAGRAVGESVVEAFGWSHGRLDWWGPLEVPLGAALAWIASAVILRWSPRRVQPGYTWLAFGSAVHLVLWVGATWLLALYVAKSGSFGALYGPLTAFVALLLWANLTGVALFLGIAFAAQLEAARAGITSAVKPDPGP

SEQ ID NO: 8600 - protein, 403 aa, Streptomyces avermitilis
VTYDVGALRAQFPALRAGTAHFDGPGGTQIPEPVIAAIADAMSNPLSIRGAEVLGETNAETIVQEFRQAMADLLGAAAPGIVLGRSATQLTYDFSRVLARTWAPGDEIVVSRLDHDANIRPWLQAAEQAGVHVRWADFDPATGELPAAAVGEVLSDRTRLVAVTAASNLIGTCPAVAEIADLVHRSGALLYVDGVHYAAHNFVDVTQLGADFFVCSPYKFFGPHHGVLAASPELLETLRPDKLLPSTDAVPERFELGTLPYEFLAGTRAAVDFLAGLATGAAVTGDRRDRLRSAYAAVERHETALRERIEKELSLLDGVTIHSRAAERTPTLLLTFADRSATRAYHFLARLGVHAPAGSFYALEASRHLGLGDSGGLRVGLSPYNDASDAERLLEGLTAFLAS

SEQ ID NO: 8601 - protein, 292 aa, Streptomyces avermitilis
MERYASAVSGVRERLGAMLFSRVAGPEGPANRDRIHHAPGPRWFGPDRPIRTVHGDASMYIGGLRALLLQSLHPLAMAAVAAHSGYQGDPWGRLQRTSTFLAVTTFGTADDAQAAVDRVRAVHEAVRGTTDRGEPYHAADPHLLGWVHVAEVDSFLRAHQRYGEQPLDDAGCDGYVDDTAHIAAALGVLNPPRNRAELVERLHAYRPELRATAEAAAAARFLLLHPPLPLAVRPPYAVLAANAVADLPPWARGPLGLPRVPVLEPTAVRLAGHALTRTIRWVMTAPSAPRPT

SEQ ID NO: 8602 - protein, 95 aa, Streptomyces avermitilis
MTSYGSPSTASSGSRTNGLAIASLICGIVGVFFLSVILGPIAIVLGVVALRQAGGKGGGGMAKAGVVLGIVDLILFAVFMAVAASNGGFAWYVGG

SEQ ID NO: 8603 - protein, 404 aa, Streptomyces avermitilis
MLESVAAEPRRAAATDQAGTEARKQRLRRRLERLIGIAATEGNELVPLRNGDEIFPAMLRAIRTAEHTVDMMTFVYWRGQIARDFAAALAERARAGVRVRLLLDGFGAKQIEEGLLESMNSAGVEVAWFRKPLWLSPLKQNHRCHRKVLVVDEHTAFTGGVGIAEEWGGDARNPSEWRDTHVQVRGPAVDGIAAAFAQNWAECHDELFDERDRFTEHEQSGRATVQVVRGSASFGWQDMQTLVRVMLASAEERFRLSTAYFAPDSYFVDLLCATARRGVQVQILLPGPYTDQRACRLAGQHYYGTLLDAGVEIRQYQPTMLHTKIMTVDGVAALIGSSNFNRRSMEHDEEIMLAVLDETFTAALDRDFEEDRERAEAIVAARWKHRSPVQRLKEAIVAPVRRFL

SEQ ID NO: 8604 - protein, 357 aa, Streptomyces avermitilis
VSAARPADCAEPAVPVRRPCPGRPYRDLSSAPGTAVRAEPTTPLPPFALRTCACQTPGRDMSVNALTAVPSARSIPATSAFRGRIGCDARSGHYPVPGRYRLHLSPSCPHCLKIAVAHSLLGLEDACPVTLLPAVPDGPGGEHSALRPLYEASAHRYAGAAVAPVLSDDWSGRIVSTHAPDIMRDLARRFGGERPPLYPKGMEAEIEAVGHLCEQGINATAQRAGRADADDAERDSALGSLLRTLRSLEGRLARQDYLLGDRLTAADIELWVSLVQLDTVHRWHLDASAVHRVADHPALWAYARRLAGDPAFGAHLDLDGIARRHHAHCRGLEAAGAAVQIVEWAAHAPDRTASRQG

SEQ ID NO: 8605 - protein, 189 aa, Streptomyces avermitilis
MRVRGHQVLILTCAAALLGATAACGGAGTATKRPGTARTAPSHARFDAEISLPDGRRVGMYYATGRGLVEQHRGTGSAAWSTPHLLHRTTSDPCQSLRLKAFGTTVAAIANWGVYCADGEPPTESLAAVGTGNLSEWDTDVTPDFDGWDAVKASEETGELSFTNGSVESVTRLRWRRTEGFSDVEEIPR

SEQ ID NO: 8606 - protein, 226 aa, Streptomyces avermitilis
MDLKHAVAVVTGANRGLGRHIAEQLLERGATVYAAARRPETVDLPGAIPLRLDITDPESVREAARTASDATLLVNNAGISTHTQLVSGDLESVRLELETHFFGTLQTTRAFAPVIEANGGGAILNVLSVLSWVHPAGYGAYSAGKAAAWSLTDSVREELAPRGITVSALHVGYMDTDMAEYVAPEQKTAPALVAAQALEGIEKGLPEILADDLSRQVKQQLSAVAG

SEQ ID NO: 8607 - protein, 185 aa, Streptomyces avermitilis
MGRVSKEQARENRQRVVATASRLMRQQGTDGVSVADLMKAAGLTHGGFYKQFASKEALIDEATAHAFGTVEEQLGDGLQAHEGDSAAARTAFIDHYLSPEHRDDMADGCPTAALAADMARGPEESAAHETYVEGVRRFAARLAGADDDGLARLSTLVGALVLARAVKDDPLSDDLLEAARRQLLP

SEQ ID NO: 8608 - protein, 346 aa, Streptomyces avermitilis
MIRFTMMPGEDGDCLLLEYGDGTFLRRILLDGGRSGTYPRIRPTLAGLDGLVDVLVVTHVDQDHLLGVLALLNDPDRSVEFGDVWFNGFDHLLEFEGFGAQDGEKLTSALVEQKLPWNDAFGGLSVEVGRELVWFDDGSTVDVLSPDRGQLESLAPDWVKECAKHGLIPGRDPDEIPLVPGFEHFGGVNVEELAARPFRPDTSKTNLTSIGLLFEFEGKRIILTGDADDRRLVRSIRPRAEAEGGRLHVDVLKVAHHGSDHNLSKDLLDLIDCDRYLISTSGARHDHPNAIAVARILKHGGAKKEIVFNYRDRAAIWDVDSLKDRFGYTVTAPAPDAEDGFVSFEL

SEQ ID NO: 8609 - protein, 426 aa, Streptomyces avermitilis
MSGCLSVTVALALDESDLSAGAKVVGNIYSTDGNGVTHRNVVFPCGMSAVPARYEVDPGRYIVSATLPSGTVLSRDAEAREGEDTPVTLRTAPSPYASHSWQYLMGNIEAYETYHDSATIPVPRSRGSRSGVWEGLVQPGHAVFVGDPKPTSYHFDSMLKLADGPAERPTVFEIAQSAPRSVPSLALGDAAARLYRFGAHGPVDEHGTPTRWGGPTGPRQFLVVSLAGKEYVVTLPAPWGSAQIEVLVNERQSPTGSAVSVAVRDRRVGPALGYMSRGAFDAAATLVRDAEALLYAKMENPLAAVAGAYVLVGSELTERPQRWDPWLDHLRHEFDWMGDGSLLWAMRQLRRAHTETQLRAARDGLVEAFDRGVPVFTLGLSRLIHGLSEFPDDPECARRLDQARRLSWRVDLREPFVIVALRGRPQ

SEQ ID NO: 8610 - protein, 390 aa, Streptomyces avermitilis
MAGSVIHLDENAGPPATHGLVVGVGKYPHLEGGEAPVADSDGMRQLSSPPLSARAFARWLLAEYHDPQRPLGSVSLLLSEEQPAPFVNPRTGTAHEVEVATIDNILAAVTQWYDRGDSHVDNRLVFYFCGHGISQGDDMALLAADIFADPHNPLNGALDFAGLMNGLKRCKASQQVFFLDACRSNSDVLIEASGTRFAGRTPLGAGARPLDLPRRFHIPYYATLSGDQSHARPGQVSLFTEALLKSLAGAASDDPEGDWRVNTAHLLEAIDHFMHQPCFAGMVAGVQVPAVGELPVFVLHQLAGPPVVPVYVGCDPAQDNAEAEFVCLEGGRERLRRTLNDVDDTDPESEWAIELSFGDYDFEARLGERDVRTKTITVRPVFRRVHLVKS

SEQ ID NO: 8611 - protein, 388 aa, Streptomyces avermitilis
MAENPGGTNLVVCLDGTGNQLKAKGNTNVIRLYEMLDLADPERQIAFYDPGVGTFSAAGAWTPVSRRLSRLFGLAFGSGMKTNLAEAYTYLMNHYAPGDRIYIFGFSRGAYTARALVGMLKTIGLMRPGMENLVPYAVSVYAKNKDWTQKDWDQLHHFAGAFSNAVDGRIGIPVHYLGIWDSVKAAGVLRWNLRWPYTRQLPNVRRIRHAVSIDEKRRPYREYLVTAGTKKQTAPASVEQVWFAGVHSDVGGTFDDDPRLPTVSLKWVVDGALAAGLLVKTGAYAREVTLGPEHALGEVHRMGRIWALLSYRHRRVPPDAHVHASVRARLAGDPGYGDRIPATAVWADSDWLSPSPESAPRRATPDDGTRAASGPLGGRTAARRPPRW

SEQ ID NO: 8612 - protein, 126 aa, Streptomyces avermitilis
VSRSERSSLLLAGLLATAGVAHFAAPRQFDATIPRALPGKPRTWTYASGIAELALAAGVALPRTRRAAALATAAFFVGVFPANVQMAVDWRHRPAPLRTAALARLPLQVPLVLWARGVAKGAEGRS

SEQ ID NO: 8613 - protein, 155 aa, Streptomyces avermitilis
MTRRVDVGDKVEDFVLPDETGTPRQLSDLVADGPVVLFFYPAALTAGCTAEACHFRDLAAEFAAAGARPVGISGDPVDRQQEFAGQHTLGFPLLSDEDGTIRERFGVKRGFSLAPTKRVTFVIAEDRTVLEVVRSELRMSAHADRALTALRAHRS

SEQ ID NO: 8614 - protein, 427 aa, Streptomyces avermitilis
MSAASYRRRAAGVVSAVILAVCGPLTVSSSAQTQAQAPTGTAGTPAAAQSKHSVVTWGASADRQSAGPADRSYRLIVRTSVGGTNMRIRLSNAFGDHPVTFANAYAGLRKQGAELVHGSNRKLSFDGAASVTVPAGETVLSDPLPGKLAAQSDLVVSLYVTGAQGPTTGHGMAMQTNYATAGDHAAEEGAANWTDPMGSWYWLDAVDVETSTAVSSVVALGDSITDGWASTTDGNRRWPDYLARRLQAASGSTVKGVANEGISGNKVLADGAGEAALKRLQRDVLSQPGVSTVFLFEGINDIKAHSGVTVEDMIAGYQEIIDRAHTAGKCVVGATVMPFKGWYEYDDASEAVRQGVNDWIRNSGALDAVTDFDKITRSPYDQQRILPFFDGGDHLHPNDKGMQAMADAVDLKALGCRATGGTQAARG

SEQ ID NO: 8615 - protein, 804 aa, Streptomyces avermitilis
VDIQQTAPRDNKPSRRGFLALAAAGAATALGGLPAFTASAAPFRPTESPMLSAADAAKNQLWWGAPGSSHSMIEQGLPVGNGRLGALASNDPAHELLMITDATLWTGHLNDKLQSDGQFPYGRDDFGSLTLLAKLTVAIPDHDLGSVDNYRRSLDMAQGLVSTSYDISGVTYRRQVFASRPDDAIVLYFSQQGGGAYTGTVSLAGTHGESTTANSAGRYASFGASFANGLKYGAAVTAHSSTGRVRVDGTSISFSGCKDLTVVVSGGTNYASDAAAKFRDPSVDPQRLARTKVLKAAGHPTSTLLHTHVADFRAVFGQLDINLGTSSAAQRELDTWERLQARHRDDLPDPELEAAYLQFGRYLMISGSRGSLPMGLQGPWLDGNDPDWMADYHSDINIQMNYWMADRAGLSECFDAFTDYCLAQLSSWTDVTQRLFNDSTNRYRNSSGKVAGWTVAFSTNPYGGSGWWWHPAGNAWLCQSLFEHYEYTQDRAYLKKIYPLLKGAVEFWDARLITTTVTDASGAKREVLIDDSDWSPEHGPQDAKGNTYAQELVWGLFGNFHTASELLAKDAAHRKTVDGLRERLYLPVVSPKTGWLEEWMSPDNLGETTHRHLSPLINLFPGDRIRPDGSTPKDIVDGATALLTARGMNSFGWANAWRSLCWARLKNADKAYQLVVNNLKPSVNGTNGTAMNLFDIYEVETGRGIFQIEANFGTPAAIVEMLVYSRPGHIELLPALPAAWAASGSVSGVGVRGGFVADLSWKNGKVTRATLKSVGGRRTTVVAGGASRKISLKPGESVTLRNLG

SEQ ID NO: 8616 - protein, 608 aa, Streptomyces avermitilis
MGSSSYAVIPGAAPRSGRRSIRAVLVLALTAGVATVVPAAQADTSTPAAAPVAAKPYMGWSSWSMQSSKYPGLNPDGDYSYLTEANVLKQTDALASKLKKYGYDHVNIDAGWWMDKNWKTQFDQYGRQTPDPVRFPHGMKSVADHIHSKGLKAGIYLPVGLEKGAYGDGKTPISKAPGCTTADIVYSDLRTTNGWDNAYKIDFDKSCAQKYIDSQAQMFADWGYDFLKLDGVGPGSFKSGDNYNNVADVAAWQKAIAATGRPIHLELSWSLDIGHAADWKKYSNGWRIDTDIECYCNTLVTWENSVNDRWDDAPAWSSKAGPGGWNDLDAIDVGNGEMDGLTKAERQSYMTLWAINKSPLFTGDDLTKLDSYGVSLLTNKEVIAVDQNTSPVARPVTPVGDQQVWGTKNADGSYTVALFNLGDSPASVTAHWASFGFTGNASVRDLWNKTNLGTHKNKITEALPAHGSRLFTIKPGGGTLATTGYEAEAAANTLSGNASVGGCDACSGGKKVGNLYTGGKLRINDITVKKDGIYTVKVAYVSGDPRSVTVLSNSGNGTSLKFPSTGDWSTAETVSVQLALKAGSNTITFDSGSGYAPDIDRIVVPQSV

SEQ ID NO: 8617 - protein, 273 aa, Streptomyces avermitilis
MLGGIALLWLVPLLWAMYTSLRPYSDTAKHGYLSWPHSLGFDNFTDAWDQSGMPHFFWNSVLITVPSVLFTLLFSSAVAFFVSRFDFRWNIVLLMLFTAGNLLPAQVLVTPLYRLYLLVPLPQWMSDSLLLYNSAWGIIAIHIAYQSGFCTFLLSNYMKTIPKEISEAALVDGAPVWRQFFQIILPLCRPAFAALATLESIWIYNDFFWPLALIETGDKRPVTSALANLQGAYFTNPNLIAAGALMTAIPTLLVYFALQRQFISGLTIGSGKG

SEQ ID NO: 8618 - protein, 317 aa, Streptomyces avermitilis
VSSAPSVSSAPASPAPRKARPRRLGPGDRIFLTVIIGIPLAALLFFVWLPALASLWLSFTTWDGIDLVDIHWVGLDNYQEIFTNYPPFWPAVRHNVAWLLFTALLPTPFGIFLAYQLDRKIRFTRVYQTAIFLPMVLSLAVVGFIWEIIYNPDTGLLNGLLNAAGSGHHIDWLGNPDLNLWAVLVASGWRHTGYIMILYLAGLKGFDPALKEAAALDGANGRQTFLRVVFPALRPVNVIILVITVMESLRSFDVVYVLGGGIGSKPGMELLSLLITDNILGESSHIGYGSALAVVLLVVSLAAIGTFLVQNFRKEDQ

SEQ ID NO: 8619 - protein, 447 aa, Streptomyces avermitilis
MTQQSRNPLAARGPGRPPTAGVTPGRRSVVGGVFGLGAAVLGAPLLTACGGGAGADPKTVTFGSNGADATPKSAYAAVTKAFTKDSGLTVKTNTVDHDTFQKSISTYLQGTPDDVFTWFAGYRMQYFAKKKLCSPLDEVWDKIGAGFSDATKQLSRGEDGKYYFVPLYNYPWAVFYRKSVFKERGYQIPQKWSEFIALAKQMKKDGLSPIASGYGGGDSWSILGAFDYVNMRTNGYDFHMSLMRGKVSWTDKRAVATLDHWRELAPHYQQGAGGRSWQDAAQSLLDKKSGMAVIGLFLGQQITDEKIRSDIDFFPFPEIDATHGQDAVEAPTDGFMLSRRPKNEDGAKKFLEFLGGARTEEVYMGVDPSNLAVNEEADTGSYNALQKKSADLIASAKHISQFADRDSDPGFISTVVLPGLTQWLGHPDDGAGTLKKIESQRSRFFTA

SEQ ID NO: 8620 - protein, 392 aa, Streptomyces avermitilis
MRSTSRTEAFPAHTPAAAQIFTTVLSHGPLTRSEIAGRTRLSAAAVTKAVRPLIEAGYLVEDADDDARQPSLGRPANPVQVDGGRALFIGVKVTGDELIAVLTDLCCRIRVARHLPLTSRDPGAVLASITALVQELLTEADGFGVAVHGLGIAVSGDVDRAAGVVRYSPFLEWSDVPLAELASLATGLPVTVDNDVRALTVAEQWFGAGVGLSDFAVVTVGAGIGCGLVVHGHVVSGAHGVAGEIGHVAIDPAGPPCHCGNRGCVEAIAADSAIVGRIREVTGIEVADTAEAVDLAHAGNPGAREVYARAGDAIGRGIATVANLLGPERVIISGEGLAAYDLFAEQIREAFAAAAFGSAARCDLQTRPLPFEEWARGAAATAIQSFIRSDTY

SEQ ID NO: 8621 - protein, 710 aa, Streptomyces avermitilis
MSLISFAPHSGVWLLTTPHTSYALRIDASGAPCHLAWGPRLTLAAAEELAVPEPPAASSFEGRPSVGEELPVDGGVRYGPPSLQVRFADGSRAFEWQPTGHRVHESADGAHELVLFFRDRRYPLQVALHYRVRADTDVIERWTVVRNGGDEPVTLLRADSAAWTLPPLADYRLSHVTGQWSAESRLRRDRLPYGETVLTSRRGITSHHTNPWLMVDSGEATEDHGRVWSAALAWSGSWRITTQRTPDGRTGFTGGVGHDGTGVPLTPGEEFTAPAFAGLFTADGFGAASRAWHAYTLAHVLPHPDEPVPVLYNSWEATGFDVDEVGQKALAERAAALGVELYVVDDGWFGGRRSDRAGLGDWTPAPDRFPDGLGPLADRVRELGMRFGLWVEPEMVNPDSDLYRAHPDWVLHLPDRSRSELRNQLVLNFARRDVADWAYGWLTELVGAHRIDFLKWDMNRAFSEAGWPGQQDGADRLGTQYVRHLYGVIDRLRADHPGLRIESCSGGGGRIDLGILGRTDQTWASDNTDAADRLWIQHGFSQIYPARTMGCWVTDAPNQFTGRGLPLRFRFHAAMAGALGIGGDLARWSEEELREGAALVTEYKKVRHLVQHGRLDRLSPPSGQSPAVVQYTSADGSESLVLAWRGVPRPGDADLPVRLRALTPAARYRDSRTGTVHHASVLGDYGLRLDLPAGDWSSVAMHLVREPEAV

SEQ ID NO: 8622 - protein, 215 aa, Streptomyces avermitilis
MAGGLLLSGAIAALFTTALPVGDPSGGFTDPPPDKIVIKVATVNGSGCPAGTAAVAVSPDNTAFTVTYSNYLAQVGGNADPTAFRKNCQLNLLVHVPQGFTYAVASADYRGFAALQRGATSTEKASYYFQGSSNTASITHPFSGPYNDNWQATDTTDWAQLVWAPCGVQRNFNINTELRVNAGTSTPGSSSFMTMDSTDGDISTIYHLAWKECPK

SEQ ID NO: 8623 - protein, 194 aa, Streptomyces avermitilis
MPPHSPSDLPRAPGPPPAEALSYGPAGATCPGDESWHADGEGYRRYDRTVVIGHGDAHWRAAADAVLHWGIKRRSGFRVTPRSGAGERVTEGAEYRITAAIGPLAVHEPVRVVAVVVTPERCGFAYGTLPGHPVSGEEAFVVHRTPDGAVALTLRSLTRPAPSGPWRALFPLLLVAQRFYRRRYLRSLRAVAPR

SEQ ID NO: 8624 - protein, 1447 aa, Streptomyces avermitilis
VLRRGFQAFHRSSWGAGRGTRVGMNSKTAEAESRTPGDQELRQLLAGLTAVRDGDFGTRLPDDTDGLLGEIATVFNGMIDQLSVFTSEVTRVAREVGTEGTLGGQAEVPGVSGTWADLTDSVNAMAGNLTTQVRDIAQVATAVAKGDLSQKIDVPARGEILELKETVNTMVDQLSAFADEVTRVAREVGSEGRLGGQAQVPGVGGVWRDLTDSVNLMAGNLTAQVRNVAQVTTAVAKGDLSQKITVDARGEILELKNTINTMVDQLSAFADEVTRVAREVGTDGRLGGQADVKDVRGTWRDLTDSVNFMAGNLTAQVRSIAQVATAVAKGDLSQKITVDARGEILELKDTINTMVDQLSAFADEVTRVAREVGTAGNLGGQATVRGVSGTWKDLTDNVNVMASNLTGQVRSIAQVATAVARGDLSQKITVEAKGEVAALADVINTMVDTLSAFADEVTRVAREVGTEGRLGGQAHVPNVAGTWKDLTDNVNSMANNLTGQVRNIALVTTAVANGDLSKKIDVDARGEILELKTTINTMVDQLSSFAAEVTRVAREVGSEGRLGGQAEVEGVSGTWKRLTENVNELAGNLTRQVRAIAEVASAVAEGDLTRSITVDASGEVAELKDNINSMVGSLRETTRANQEQDWLKSNLARISGLMQGHRDLAVVAELIMEELTPLVSAQYGAFYLAEETGRGTQLRLIGSYGYPDDTQRPDRIPLGRSLVGQAARNRRPITVDDLPPAYVTISSGLGQISPTALKVLPIVVDEQVLGVIELASVTRFTQIHEDFLGQLMETIGVNVNTIVANGRTDELLGESQRLTAELQSRSEELQVQQDELQRSNAELEEKATLLATQNRDIEAKNLQIEQARQELEARAQQLSLASKYKSEFLANMSHELRTPLNSLLILAQLLAQNPSHNLTPKQVEYAGIIHSAGSDLLQLINDILDLSKVEAGKMDISPERVALRRLLDYVEATFRPMTSQKSLEFTMSTAPGVPVDLLTDDSRLRQVLRNLLSNAVKFTERGGVGLHIEPAVDQNIPAAVHRGGAVVAFHVKDTGIGIPEQQLETIFGAFQQADGTTSRKYGGTGLGLSITREIAHLLGGAVTVDSTPGQGSTFTLYLPVARADFEELAQGAQPGEASQGDGAADHPRGSQALTGAGGPTHRRRRILVVEERPRGLLTLVAESTVANLTRGHHGGDPREVIDVTTTVDAQEAAGALAAEPCHCVVLELGMSGGEASRFLDALDGDPALASVPVLVHNGQRADVTLDPALRSRSAARSLEIFSSLDELRERIALHLSAEEPGDVLPLVRPEKPQPEQTLVVDGTFTGRTVLVVDDDARNLFALSGILELHGFKVLHAENGRKGVDTLLAHPEICLVLMDVMMPEMDGYAATTEIRSMSQYTDLPVVAVTAKAMPGDREKALQSGASDYVTKPVDANDLIACVRRWLSA

SEQ ID NO: 8625 - protein, 832 aa, Streptomyces avermitilis
VTTPHQPGEPARGEEPFGSPTRPPAFVELPHQSTSPSEPSATADGVASAEAQSVAGRLATTVERLRREVWAAQAAADGRALLELAKGILIERLGFGPTEAARHLTALAERAGVPPLELAVDVINQAARDRLSEIATELVADSAALPERADARDRSSTAVRLRAAESGALAADDAQSVADSLLQHALAPLGASAVAVWAARADGSLTLAGSAGFSRAESARWCYIPPGVATVARQALTERGTQWFPSLTEADVPSIGRSEFPDGGRVAVPAGTGGRIHGVLEISWPAPLAPQPPQIVRQVEALAELCAHTLETQTPLAGPSPVGEPRALAASSELVHLAEGLHDPALVLVPHADDNGYLVDFRIDYVNGRFLDPAGRPRSAVNGALFLEAYPMAAGDSELFEQIERVYATGEPFRAQRMTLTALVEQVPLSAVADIHVSRHGSSLILIWRLENEAARLASLLQNAQRLGRIGGFEENLLTDEITWNSQLYALFGRPTYSSPVPVQELAAHAHPDDTVAIGRFLRTIVHHRRPASAAFRLQRPDGVTRHMRVVAEPVLDADKRLLAVRGAYQDISAQHWTEVALAVTRDQLAHTEQQAAERNRLALQLQHAIMPPTQAPLEIPQLQLAVRYRPAETDQLVGGDWYDAVVLPSKLVLLCVGDVAGHGIEAATSMVVLRNALRGLAVTGAGPAQLLSWLNIVAHHLTGAVTATAVCGLYDPSRRVLRWARAGHLPPVVVRGPEATPLPLVRGMLLGAVAEATYEEEEVSLEPGDTLLMYTDGLIERRDVSVEEALAQLLITARAQTPSLSHQLDRLLTYSRSDTDDDTCIVGIRVS

SEQ ID NO: 8626 - protein, 295 aa, Streptomyces avermitilis
MTAVAAPAATRTTGQHPTAPAHEVELDAIADPLAVSPKDARELSRHFFARLSVLEEGTQDYQYVRNTLIEMNLTLVRYAASRFRSRGSGEMEDIVQVGTIGLIKAIDRFELSREVEFASFAVPYIVGEIKRFFRDTSWAVHVPRRLQEARVELAQATDELSRRTGRTPTVRELAELMSLTEEEVIEARKAANAYRSSSLDASLSGDGSADNESVLADFIGREETALELIEDMHSLAPLVAQLDERDRRILHLRFVDELTQAQIGERLGISQMHVSRLINKIITTLRAGLLSECTG

SEQ ID NO: 8627 - protein, 57 aa, Streptomyces avermitilis
VAGDQKAKAKMEQAKGKAKAAAGRAVGNERMAAEGQAEKSKGDARQAKEKTKDVFKH

SEQ ID NO: 8628 - protein, 110 aa, Streptomyces avermitilis
VSDNISSFVPTAGHTPDADLAGYRVEAADGRVGKVDKQSRLVDSQYVLVDTGVWIFGRKVMLPAAGITGVDHEEKKIVVARTKAEIKGSPEFDEGKHLGDPAHRDQLDGH

SEQ ID NO: 8629 - protein, 66 aa, Streptomyces avermitilis
VPPTRGDAMLGIVAAVLFFIAFLINAADIATNDVFTSTNFMLIGLALLSLHVAGIGSGWASRSRRR

SEQ ID NO: 8630 - protein, 125 aa, Streptomyces avermitilis
VSTEQAPLSIDVTLPREDVALVTVKGFLDVDTGTELHHHLANQMHHGRRHLLLDLSAVPFMDSSGINIILKAYKETRRVEGSVRLIDPAPAVQRILDLTGVSLTVPSAKSLDEALAETGDATDRQ

SEQ ID NO: 8631 - protein, 158 aa, Streptomyces avermitilis
VTSSSTRPHPTEVARVTSEAAELLEILWGRASTAPVSASQLRVLFILEHNEGINLRTLADALGSSPPSTSRLCDRLQAVGFVERAVSATSRRELCLYLSHRGSSFLAEVRSRRESALESVLARMPAAKRTALLQGLEAFCATAAAQIQEHEGADARTA

SEQ ID NO: 8632 - protein, 395 aa, Streptomyces avermitilis
VNRFVAVERALRTAAPHQLLDALREVLRNRYAAESVEFLLADYGVTVLQPLSPEVSATGPVPLHDSRAGRAFGAQEPFLEEPADGLARVHLPVTVRGDRLGVLTVTLPSEDVKDSLPELREIAEVLGHAVIVAERDTDVYVQARRKDRLTLAAEMQWQLLPGRSCSRPEYALGAQLEPAYAIFGDNFDWSADPDRLMLYITNGMGEGIEASLLTSLGINALRNARRAGIPIEDQAALADQAVYAQYRGTSYLAVLLVEFELSTGRMKVVDAGSPRMLRLRGRSVEAVDFEAQLPLGMFEETDYVAQEFHVEPGDRLVFVSDGVHGVAAPGGETYGEKALTRAITATRLLSAAEVPHAVLRELSGHRGGPSPADDALVVCLDWYGRRGASPAPEGD

SEQ ID NO: 8633 - protein, 299 aa, Streptomyces avermitilis
VTDQEPVAHHEAPTQALGDFLRRRREQIAQRWADEALFRTVFTVSRDEAVEAAGAVVEALAAVAFSERIENLGATGFAAVREQLGRMAAARSRAGASADQIADDVSALRPSITELLNADLSEAPDEDARELLITLTVLLGTLRLVVLETVLTAGEELIERQRLQLLEVATPVIKLWTGIVAVPLIGTLDSARSQVVMESLLDAVVAQQARFAILDITGVPTVDSLVAQHLMKTVAAARLMGAECIVSGIRPAIAQTIVHLGIDLGTVVTRASLADALGYALHRQGAVIVDQASAGGIQQ

SEQ ID NO: 8634 - protein, 139 aa, Streptomyces avermitilis
VIGDPLGRPGIHVPVLKLGNVLLVTLQGDLHDHAAEQLQQDIGEAVASSAVTGVVIDVSGVEIVDSFLGRVFAEIAATARLLAAQTIVAGMRPAVAITLVELGLTLPGLRTALDAEQAMRLLTGTPPHLPHVPGRRESA

SEQ ID NO: 8635 - protein, 131 aa, Streptomyces avermitilis
MDLAWVRQHVRQAAAELGFGLVDQTKLVTAASELARNTLIHGGGGQVQCTPLEIGRSRGLRLTFSDEGPGIADIEQALGDGYTSGGGLGLGLGGARRLVHEFSIDSRPGEGTSVTVICWSAGAPHTREETR

SEQ ID NO: 8636 - protein, 357 aa, Streptomyces avermitilis
MTRVREVPVHDSTRVRDVRVAAEATARQAGLDEDRTAAAALVATELATNLLKHAGGGRILIDSVDAYLGPPTASPDPVVQIVAIDHGPGITDLPAALGDGFSTASSLGAGLGTCRRVADAFDLHSSPGRGTVALARIHGAAKSRAERHERRADAPVRAGGINIPLAGADVSGDAWACVRAADRVTLLLADGLGHGPGAAHASDAAVEQLHRSAHLSPPELLAQLHTALRDTRGAAVAVAQLDLAAGSLSFSGIGNVGARLRSGDSWKPLLSHPGIVGAHRPARMPHHRVPWTDDSLLVLHSDGLPSRWTPPPAVPLGALDPAVTAAAIVRDASSSARPVRDDTAVAVLSSTPPDPRP

SEQ ID NO: 8637 - protein, 580 aa, Streptomyces avermitilis
MTHTWYISTVTDAAGARIAVARLAAAHGVPVLDRTRLVTALTAQLRQCLTKGGAWRLVLETVAPAAGQEHGRLDVTLCPGRDGTAAERPAWHAAVDFTEPGDLDAVARVAADPATLADALFGADEDTARVMEKLTEQEALVAFHREELHQTNQGVLALHAELDAAGEAQRELFAAEREARQEAEKARHRLTFLADASAALTSSLNHEEILRRLPELLTPAYAESVDVWLFADEDKQRQSPRPAAAVTAARTGRPQYAAEHPGGLPGVDDVPPSALRPDRPLLCIPLPIRRAPLGVMTLTPPGERWDPDDAVMLLELARRAGIAIDNAQRFEHSRDIAETLQRALLTDLPTTPGLHLAARYLPATHGLNIGGDWYDAFRQPDGSLITVIGDVTGHGLHAAVMMSQLRTALRAYAVDGGSPGQLLTRLHLFLHHLQPDLYATAVIARFRPDEPTVTWAAAGHPPPVLRLPDGRVRTLDAKPGAMLGIPLGQDIGDHTVRMPPGSTLALYTDGLVERRAHGIDPGIGRLATALSALRGPDLDEDLDASADRILDPLLCDSERDDDICLLLCHIDSEPVPALHS

SEQ ID NO: 8638 - protein, 168 aa, Streptomyces avermitilis
VRDEREPSDAADAGRRPEAVARQVADAVENLVTLWTAAAEAVSPRLSAYQLKALRAVWHRSELNLTALADTLGIALPAASRLCDRLEAAGLLERMSHPRNRRELQLRVTPHGRRVLLEVAERRSRSLATVLAAMPPAQRTSLEHGLHAFHEARARPGAGGDRHRRAQE

SEQ ID NO: 8639 - protein, 144 aa, Streptomyces avermitilis
MSTKPRRESPLPTEDVRSLTAAFDGDLRNVTDARLAAEGFLRTLARASPPTSPECEHDVLLVVNELAANAVQYAPGPFTLRMRTTFDGVHVTLRDTSTTRPAPRPFHPSRGGGGIGWHLVQSLCTQVSVVVHPEGKDIHVFLPW

SEQ ID NO: 8640 - protein, 166 aa, Streptomyces avermitilis
VQDVRNGVLSWRGRPLRPRGGERWPARTARSPGLAARLLGREGNGVSIDGPWFYEPATGHMEGQDLTGFTVEATDGTIGQVDRQADDVGMRHLVVDTGVWVFGKSVLIPVGVITGIDTQARQITLACTKEEVKAAPLFRTDSETLDPEYLGSVGAYYRELPRDRTE

SEQ ID NO: 8641 - protein, 131 aa, Streptomyces avermitilis
MTTSSSPYFTTTADADSTVAVVRVAGDLDYESCHAFVRATELLLAERRETGPPLSALRLDFAELSSVDSMGLSALLMVRRRTDAAGVSLYLDERPACLERLLEITGTLDHLTAPCVADDAGEADEQRPGTG

SEQ ID NO: 8642 - protein, 161 aa, Streptomyces avermitilis
MVISLWQQVSKEQAPGRHATPRCRVTWEGGTATAVEGRTASSNFLSEVQEADGTPLPDRLVGDIQLVVSELVTNAIRHAPGPCGLQVELSADGRAVRVAVWDTSSKMPTPRPRDACRIGGHGLEIVRAVSRSVIVQPGSPGKQVTAEIELPQPARGESASW

SEQ ID NO: 8643 - protein, 641 aa, Streptomyces avermitilis
MHNFGLPPSATPVMTGGLADSVFETALGNPGLPQIARRSHDSPGTWTQVSAAQLRDEVVDLARGLIASGIRPGNRVAIMSRTRYEWTVLSCALWSLGAEIVPLYPNSSHEQVAWILKDADCVGVLVEDEQGVMTVGSVCAGLPRLRHVWQLDSGSLDELVERGRPVPAATVDSLRRIVLPDSTAVIAYTSGTSGHPRGCALSHRSLASTCDTLLDGWRHTAASPGEQPAVLAFLPFSHVYGLMVQGLCLRGGLLMGHEPDLRAESLAAAFRSFRPTYLYAVPSVFEKIYKSFLTAAERTGRGTLFERAARTAQDYAEAAEQQRLGTGPGPGFDLKLQHALYERAVYRKLRDSLGGRICGAVSGGSPLNRELTLFYAGIGIMVHDGYGLTETSGGITAQPVGREKFGTVGRPLPGTDIQVAEDGEILVRGPSVFQGYVNDIPGTRASLRDGWLATGDLGRLDSEGYLSITGRKKDTIVTSSGKSVAPSVLEERLRVHPLIHQAVIVGENRPCVGALITLDPDYLPHWRTMVAAQADAPSREAREQNAVLQEVTRAVAAANSFVSRSESIRVFRILPEPFDPANGLLTPSMKLRRDVIVRRYATEIDAMYQSSARTRVKSLSDEPVSWEEHEENEDDVFRRVR

SEQ ID NO: 8644 - protein, 245 aa, Streptomyces avermitilis
VPCTPGSAAIRPPKSLQQEIHVNHHRKPRTSSVFSQRAVRVGLFAAGAAGMATAVPAQAATGVPQHSAVAADQTFSRADFRHHSQTKDSFTVRQLGTVNAATVRNQANAVGVGCSVDDRCRSVALSFQIVTMSGDQTHLNAVNRGDAVNKHCDGCQTLAGAYQFVVSTPRPFSLDAQAQRQLADIHRRLDDLTRSTLPATEVKARADALAGEVNTVLHDAVAGAPKGDERPTVTVHRHLDGWPGH

SEQ ID NO: 8645 - protein, 586 aa, Streptomyces avermitilis
MTLLGDKTASPYDTGTPVPGPGGMAVTYEQVATGGLPVAGLERPVVPRLSAGLKLHGEYQGSGFTEPKYIARRGDGQVVQLSRLLHLVASSVDGSRDIETIAHRVSGRFGREVSADNVRYLIEQKLDPLGVTVPEGREEEDISAPRSDLLLALKGHRVIFNERRVATIAGALAWLHRPVVVLAVLAGIAVLDVWLFAFFGAITPVLEVLDQPVLLLVVFVLTVASLVFHEFGHASACRYGGARPGCIGCGLFLIWPSMYTDVTDVYRIGRVGRLRTDLGGVYFNVVFMLAMAGAYALSGQAFFLAAVYLGHFEILEQLMPAVRLDGYYILGDLAGVPDLYGKIKPILLSLVPGRTGRKARKEVAALKRSARTIVATWVLTMVPLLLGELGYALWNLPRIVATMTRSLTEQLLGTGGAFAHGEIAAGLVGVVGCVMLLCPMAGVVYLSVKLGGRLWRGAVKSTAGRPRLRVALCALSLAALSGLAYAWVSGMTPEPLPKRPPIAPILQPGVSTSAPPARHATTPGPDDNTPVRGVHHGSGRRGHAGRFGRPVRLGEPVGLQEPAAQRVGDRVRGDRREADRQPGRER

SEQ ID NO: 8646 - protein, 80 aa, Streptomyces avermitilis
MVNVKGHAMSMDASELEAESAELLPGREALGRLKFSFGKTVNVTKHVANVSAHNESAALNDHSSWSVAQSQAAQSINITQ

SEQ ID NO: 8647 - protein, 102 aa, Streptomyces avermitilis
LDSTSDGVGHDPGGPDRVRREHFSIPEGELIMMDPRELEAESAELLPGREALGRLKFSFGKTVNVTKHVANVSAHNESAALNNHSSWSVADSGAAQSINIAH

SEQ ID NO: 8648 - protein, 131 aa, Streptomyces avermitilis
VANALQQIIRDRLDSERWSYGEVARRGNIPRSTVHHLATTDHMARMPQPATLEGLALGLGLPLGAIRQAAAEACGIHLYAAGAEPPRAAGGTSADPDVEVLIASLQRLSSDDRRHVAALVESLLNRAPGTS

SEQ ID NO: 8649 - protein, 98 aa, Streptomyces avermitilis
VSRTPRVIWGEQLLFVHGGPTTAIVKGPTGESVVLLSGELPANLTDASIGELLDLAAAVLTEGELALFEQCLTTLRRGEGPTPQRIEVNGAVMTVYRD

SEQ ID NO: 8650 - protein, 276 aa, Streptomyces avermitilis
VRIHISADMEGITGLVGADDVQPGGRDYERGRSMMAEDVNAAVRGAVAAGATDIVVNDAHGPMRNLLPEALHPAARLIRGRPKQMGMLEGLTREHDAMICVGYHARAGALGVLSHSFMGHEIEDMWLDGRPVGEIGLAQATAATLGVPLVALTGDDAACAEATAWDDSITTVPVKYAHDRFAAELRPAAEARQAIEEAVTAALSAVPEAPLVPANPRTLTVRWQSASVASTLLGIPGVTTPDSRTAEAHGELPALYRLFGVWMRVAASLGNQPPYC

SEQ ID NO: 8651 - protein, 306 aa, Streptomyces avermitilis
VKPVAGHIGAEIRGVDLAGPMDDSVVAEIRAAVLRWKVVFFREQRLDHTSHVAFARRFGEPVSLRSRGSASPPDFPEVETTADRLELGERYGMDHAEWLRRRRHSLLRGWHCDHGARIDPPAATVLRAETVPPYGGDTTWSNLAAAYAGLSKPVRDFVDGLRAEHRLGVGYQARPGDDAYVRHLLDHQTASEHPLVRVHPETGERVLFVNGYYVEQIQDVSRTESRALLDMLLGEATRPEYTVRFRWEPGSVAFWDNRATIHLAPSDTAHLDHPRVMHRVMLAGDIPVGVDGKPSAPIAGTEPERW

SEQ ID NO: 8652 - protein, 176 aa, Streptomyces avermitilis
VREPNVIGDWQEYEDEYAGLRVRVHGLEEAEPPRGRDDAAEGLTYFRFRVTVENRASEPVDIHFEDGQLDIRTGPDGVSAFLDWRNSQFIEGFDLYPLRRATAVLYAAGADTSLTRVDIQIHLKADDEWTGRYLWSGDMSLPVGSAESGVRCEGAVESLVGQVSNFLREEAEQGPG

SEQ ID NO: 8653 - protein, 227 aa, Streptomyces avermitilis
VVGEFTPLDQRSSRAQPRSPPGGEGGVWGRVAHHAHRCRSSPPVNHGAPPAGPAVAGRIPGMAPITPARALLLLVCGLVCLLTASGALIGALFGGAKAALVAAACAGVAGLLATLLVRRRALAHFAAAQREAGVRGYAEGIAHGVLLHVTAYEAAVFPHTGPTGVTPEERAARRTVAYRMAALEEVPRLVREAAADALAVLDEADRARAEEAVAQLASVVRRQYARP

SEQ ID NO: 8654 - protein, 469 aa, Streptomyces avermitilis
VTVEDRGIPSDPPAPSRRGILRALLALPATALVWGEMPGAVGSAAAAAPSKGYATRYTIVPFLNSDDGVVNVYQSDDATDFRLLKATAYTPPSNRIRDASVFKHTNGYYYLTYTTHTWQDVSTTIGFARSSDRVNWTFLYDHTVPLTNLSRAWAPEWFVDSDGSVNVIVSCSATDNEWIFTPYLLKATNTGLTSWSAPVALSGIGANHIDTYIVKIGSTYHAFTKNETAKYIEYATATSLTGPYTISRTGDWAGWGSYREGPSVVRLDNGGWRIFFDGYGDGTYYFSDSYDTFATWTAPKALAGISGTARHFTVVKETVSGGVSLSTGVSRSFQSVNYPTRYWQEQSSLLNLPVVSSAASSAEKAASAFTVVAGLADAGGYSFRDAAGNYLRHYDYRARFDADDGTPTFAKDATYVARTGTAAGSVRFESYNYPGYYLRHYNYQLRVDPTDGTDQFRQDSSFNPVTAWA

SEQ ID NO: 8655 - protein, 579 aa, Streptomyces avermitilis
MPAFMADSGEHTAVRDPIGPVPPASGEDDSRRPAGLGRRLRRYRRWLLVCAVAALLAQMAVAMITTAVEQTPTIDEPVYAGTAVVYVQQHSLRYNPEHPPLGKLIIATGMAVARPHLAPGFVGDQGELGRHLLYESGNDPWRVMFWARLPVIVVTLLLGLVVFAFARDLVGAVGGLAALALYAFSPDVVAHGSLATLDVPAAGFVLTAAWLVWRARRRPLPYLPLAGLATGAALATKMSTLPVVPVLMCLAGWSFWCARRTDGPEPRERARLAGRAAAVAAGVALVAVVVVWATYLVVDPRLRWTASGHVPTVHGLRGLLVEWLPFPEAYRDGMRVQFGFENATWHGFLFGRLYSGSLWYYLPAALIVKTPLGMLGLWLAGVGVMAAVPRLRAAAGYVVLPPAVLLAAAMTGSRDLGVRYALFMPVFLAVAAACVLALRRWWAHLAVAVLVGFVAVSSVRTFPLYLPYSNEAFGGPAETHLRLHDSNVDWGQDLGRLADRLRQRYPGEKVWLVYKGSGVPAAYGITASDPRKVAPGRVHGLLVVSDSSIAKAEGRFARLIDSSEAIDEVGHSITVFRRK

SEQ ID NO: 8656 - protein, 454 aa, Streptomyces avermitilis
VATVPVALAALLAAAGPAAAGTVGSSGAGDPYFPLAGNGGYDVRHYGLSLGYDPSTGHLDGKAVITARATQRLTRLDLDLSGLKVTGITVDHTKAAFRRDGQELVVTPRHALHRRQEFRVTVTYQGKPKPVTDPDGSLDGWIPTDDGAFVAGEPQGAMTWFPANNHPSDKASYDITITVPKGRTAVSNGVLLGQRTAHGRTTFRWRQSEPMAAYLATATVGTFKVERYTTPDGLKVYNAVDPREATAATPVLKKLPSVLAWESGVFGPYPYKAAGAVVDRAPNVGYALETQTRPVYDSAPDLSTLVHESAHQWFGDSVTLTRWRDIWLNEGFATYAEWLYAEQHGGRTAQQIFDALYASPAGDDLWAFPPADPGSGAHIFETPVYARGAMALQKLRTAVGDKTFFRVLRTWATDHRGGHGTTAEFTRLAERLSGKDLDQLFHTWIGTAGKPSSP

SEQ ID NO: 8657 - protein, 114 aa, Streptomyces avermitilis
VAQPPAAERAAGAGIPAPSILVLSPFASCVVQLVRHEPFTLDRRVRHFVGFPHLTHFVYCTGFGELGLLVRARPVRFRTAHRYAEPDGPDQSAGDHQTANKSGKHVEYITRRGQ

SEQ ID NO: 8658 - protein, 448 aa, Streptomyces avermitilis
MYRATRNSVDTSESSTDDSTGPDTAAPSVPPAPARGARPGWRRWAMDTRPLRRPAYRRLWSSTIVTSVGSQLTAVAVPKQIYDITGSSAWVGYASLAGLLPLVVFALWGGAIADSMDRRKLLLITNSGIAVTSLLFWTQAVTGVDSVFVLMALLALQQAFFGLNSPARTASIARLVPADELPAANALGSTVMQTGLVAGPLLAGALIPVIGLSELYLLDALALCATVWAVVRLPALPPLTTPASGRAGWRAIAEGFRYISLHKVLLLSFLADIIAMVLGMPRALFPQLAAQTYAPYGEGLALGLLFAAIPIGAVAGGLMSGTFSRARRHGLMVIAAVVAWGAAVTGFGLSTNLWIAVAFLAAAGVADMVSMVFRGAILLSAVTDEMRGRMQGVFTVVVAGGPRLADVLHGTAGSVFGARAAVAGGGLLVVVATLALAFATPALRTYRI

SEQ ID NO: 8659 - protein, 203 aa, Streptomyces avermitilis
MTNALTTAAAGFGTGLSLIVAIGAQNAFVLRQGIRRDAVLAVVGICALSDALLIALGVGGVGAVVVAWPRALTAVALVGGAFLLVYGALAARRVFRPAGLRAEGAPEGSRRRAVLTCLALTWLNPHVYLDTVFLLGSIAADRGSLRWTFGLGAALASLCWFAALGFGSRLLGRFLARPSAWRVLDALVAATMLTMGATLIAGV

SEQ ID NO: 8660 - protein, 318 aa, Streptomyces avermitilis
VMAELPLDLVRTLLAVVDEGTFDAAASALHVTPSAVSQRVKALERRTGRVLLMRTKPVRPTESGEAVVRFARRLARLELDARAELGMTGSEEPTRLSIAVNSDSLATWFLPALARVPEELRLSYELRREDQDHTAALLREGLVMAAVTSSPDPVTGCSVQSLGRMRYMAVAGPGFAARWLGDRPDVPLRQVLADAPVVCFDRRDDLQDGFVRGLRRGRGGASALRHFVPTSEGFVDAVAAGMGWGMVPQVQAEPLLRAGRLVHLATDRPIDVPLYWQQWKLDSPALSAVAEAVASAAAAALDGGSQWPHVTSAVTGRG

SEQ ID NO: 8661 - protein, 747 aa, Streptomyces avermitilis
MSTASGDPTTGTADFFAAPLADASLPEEWESGQQAVTEQATNPASGTDEMSAPEEQVTRTSATPLPGAPNGAAALPYRPTRGRYRSSGGGFHLELRVDVDSTAGGPKVLNRISGDFFSTSGATTTYYGSLVVHAPTVTRSATQVVISGLGTYTWQAGAPIVRVTIPRRRINQPQGTATVQFLTTSNQPGAGYTCGYVSPYFRTVQWEQDSVTGRIPFLSYDTGSLPQPPNSPARALTVPRAYAEAGIELLMSGTANTIADSPGGWTNTELHGAMQTNFSLWRDAPQWKVWLLVAGSYEGMAGVRGIMFDAADSFQRQGCAVFYDLIKGTDAESQRAQLRTYVHELGHSFNLLHSWQKNLAQPPAPLGPQNGFGDLSWMNYPQNYLPPTGTGGAAAYWGAFPFQFTDNELVHLRHGFYRDVVMGANAFGIGAADIEPELFDEPLADESGLRLDLRVTKSGFAFGEPVVVELKLDTTDLRGRSTHDHLHPDDELVHIAIRQPSGRTVLYRPLLRRCVDQDATVRLDTDRPAIYSSAYIGYGRDGHYFQQPGTYQLRASYLASDGSRIVSPVLRLHVRHPVSQSDIELAELMMGEEQGTILALRGSDSPSLQAGNDALQEVIERHANHPFAVYARLAKGLNFEHEFKSLSPDKAGLNVRPPDTKSGIEQLSQVVKVSEQGKGVDNLTLNLATRRLARAYARQGDLEEAGSTLDRLVRHFDTPAFKPYVVDAVRSQADSTKARLLAEFGDS

SEQ ID NO: 8662 - protein, 191 aa, Streptomyces avermitilis
VRGLCGSIAYRPRTGAGKEPDVLDLVLYGPQGPQPLGGSAPVRAKVRNSGERAVWIAGVLDGSEDGIRFPHYLPAVTLADGGRTVARPGPAEDPLVGPLRVGHLLRLAPGESFDPTAGAGCLPLTTFAAFAPQAPGRYRYTLTLSTEAGRPEEWLGGFGLPSGAEREELLDLIARVPRITVSAAPLILEFR

SEQ ID NO: 8663 - protein, 278 aa, Streptomyces avermitilis
MPHSIPQPGLSFCLAAHPVPAPAGSGRPATATLDVSPQARVAAQVRSALEAVFEAVEETRADTAALLAQVAGLGRRPATVDLAGLRPGLHLRLARQELVSGVGFVAAPGLLGDVPTWLEWWQTGADGALRPLLLDLDPRQSAYSDYTHWDWFALPRDTGRRAVAGPYVDYLCSEEYSLTLSAPVQVEGRFAGVAAADVYLRHFETAVMPLLQRLPGPAHLVNARGRVAASADPAHLAGSLTKGPDFAAVLTQARPEHFDGLHLMPCDGVPLVLVMAER

SEQ ID NO: 8664 - protein, 432 aa, Streptomyces avermitilis
VIRGAPTESGIPSPSAPSFHLSPPHPHTVEISLRLHRSFKAAAAAGALLLVSGCGLFTESDASSSAYGLNPPDLKAQSKLGKTEGQVNLIAWAGYVEDGSNDPKADWVSSFEQRTGCQVKSKVAASSDEMVKLMKTGNYDAVSASGDASLRLIASGDAAPVNTDLVPNYQDVFFGLKKQAWNSFDGQPYGIPHGRGANLLMYNTQQVKPAPTSWSAVFDDASPHKGHVTAYDSPIYIADAALYLRETQPGLNIENPYALDQDQFDAAVALLKDQNANVGEYWSDYLKEVSAFKSGDSTVGTTWQVIANLAADEGAKVKAVLPIEGATGWSDTWMISAKAKHPNCAYKWMNWIISPKVNAEVAEYYGEAPSNIKACDEISDDAFCDTYHATDEGYWKDIAFWTTPIEQCLDGRTEVKCVPYAKWVQAWTEIKG

SEQ ID NO: 8665 - protein, 498 aa, Streptomyces avermitilis
VRKRERGTVLGVDIGTSSSKGVLVDQDGTVLATAVRPHTVSRPRPGHVELDARVWWDEFASLARELTGRGSEVTAVGVSGMGPCVALTDEADTPLHPAILYGVDTRATEQIARLEAELGREAVLERCGSLLSTQAVGPKIAWLAEHAPDVIARARRLYMPSSYLVRRLTGAYVLDHHSASQSVPLYDSVAQEWYAPWARHIAPWIELPRLGWPGDIAGHLTAEAAATTGLPAGVPVVTGTIDAWSEALSVGAQCTGDLMLMYGSTMFLINTVTERLLVPQLWSTVGALPGTRNLAGGMATSGVITDWLRELFGGPEHSALLAEAEAAGPGAKGLLMLPYFAGERTPVADPDARGVIAGLTVEHTRGDLYRAALEATAFGVRHNAEAMRAAGADVHRVVAVGGGTRGGLWTRIVSDVTGLEQEIRTVTLGASYGAAFLAAQAVGDADIDAWNPVREQVAPDARLRPRYDDLYDLYLRLYPATRDIGHALARQQRDIAAS

SEQ ID NO: 8666 - protein, 225 aa, Streptomyces avermitilis
MKGDLFSSDHMVEPAVAPGMTVQNAKSIKYAVNGDMLARQGAMIAYRGNLQFERKGQGVGGMLKRAVTGEGLPLMTVRGQGEAWFAHEAQNCFVVGIEPGDVFTVNGRNVLCFDSTLTYEIKTVKGAGISGGGLFNSVFTGHGKLGLICEGNPLVIPVSQQQPVYVDTDAVVGWTAHLHTSLHRSQSIGSMLRGGSGEAVQLKLEGDGYVVVRPSEATPQKVQQH

SEQ ID NO: 8667 - protein, 594 aa, Streptomyces avermitilis
VRRPHIRGVAIAIAVTTAATLPAVPAVADAPALAAAAASSPVDAARAAAFAHASATGVSRGDTLEAKDVLTDPDGKQHVRFVRTHQGLPVLGGDLVVHLTKRSTYLGVTRAADHTVKPAAAGQAKLTPAQAEQKAAAAAQGDATEAALVVDARDGGSALAYQVRVTDSKTTEATGSRTVVVDAVTGRIRSNTPDSDEFISPSLAQTLRERGETANPATGTADSALTGSSLLTGISGAASYPRKASGTGTSLFVGKVGLSTTQTARTSFLLKDSTRWGTETRDAKGQYLEAFSRGKKFTDKNNKWGTGKTSSRQSAAVDAQYGVTKTLDFYKKTFGRKGIKNNSTGARAMVHFGTKVGNAFWDSACGCMLYGDGDGDLFKKPLVVLDVTGHELTHGVVDATAALEPTRVDRDGNQFGEPGSLNESLADIFGTGMEFATNNSKDAGDYLVGEKLGLDQKFLRRLDEPSRDKLEGTIDYWSPETYDTEVHAGSGVSSHAFYLLAEGSGRKTIGGVKYNSPTSDGSTVTGIGRAKALAIFYRALTRYMVSTTDFHDARNATLKAATDMYGADSIEYQTVDKAWAGVNVTSANTPSTGR

SEQ ID NO: 8668 - protein, 344 aa, Streptomyces avermitilis
MTTLTTALKAGPEAPAILHRCRELVAPALAEAVGGMHPWMREMADYALGRGAAGGAPAAHSQGKGVRQALAVLGAEAAGGPAEAGVPAAVAVELVHTFSLLHDDIMDGDAMRRGRPALWKAYGTGPAVLAGDALFALAVQTLTTASAPGAAHRLSAALGDLVRGQADDLLFAHRPWTGPEAVSVAEYEAMAEHKTGSLLGCALALGAHLAGAPEETAAVLDRTGRHLGVAFQIVDDLLGIWGDPAVTGKPVHGDLRQGKKTFPVLAALATPSGSALEGLLTARDDTAVVRAAAVVEQAGGRSAALREARRHLTVAHGLLASVQPAPRPAADLRTLLSALSRRTI

SEQ ID NO: 8669 - protein, 352 aa, Streptomyces avermitilis
MYGKAFAPEYQGALTTLSVNSSLTDVLAAGTEQLRAAERAGARGEAARSGLAVAEAHRRLGQVADAERAWKASYRTAREAGDTGAMAWALWSGGTLARQRGALPLAWRLLRLAAELGKHAGDVVVRGYSLAGMAETGRIQGDYEAVTTLHEQLLAEARKRGEARHTVWALEGIAQIHRNTGSYDTAYAMFEEAAAIAAGAEDRRGHAWALRGLADIVSVRDRDPERALALLGEAEVSCREMNLVSALAYNHKMRGNVLYRAGRYAEAREVYAQALAEFDGMSEPRGRALARLGLVKSLARLGRDRAETGAELDELVGVLDGIGLRHGRELIRGAREELGLAPRSSAGREAGR

SEQ ID NO: 8670 - protein, 208 aa, Streptomyces avermitilis
MSTHLQGSLFDQTDELGLGPLDGLRRTVLGAGAWIDLLPGWLSGADALFERLAADVPWRAERRKMYDQTVDVPRLLAYYRAGDTLPHPVLAEARDALSAHYVAELGEPFTTAGLCYYRDGRDSVAWHGDRIGRGAREDTMVAILSVGAPRDLALRPRGGGDVLRRPLGHGDLIVMGGSCQRTWEHAIPKSTRAAGPRISIQFRPSGVN

SEQ ID NO: 8671 - protein, 195 aa, Streptomyces avermitilis
MTTPSAATPPAAAPARRDAEATKAAILRAARHLLARHAHADITLKAVADRAGVSPPLILKYFGNKDALFARVMSFEADVPDLLDAPLDDLGRHMVRHVLVGQTERGADPVLRIVFAPLQGEQGDILRANFRAQVGDRLAERLAGPDAGLRAELAVSALLGLGVMFGIARGTHLRAAAIDDIVDRYAPAVQMHLTP

SEQ ID NO: 8672 - protein, 518 aa, Streptomyces avermitilis
VNSYSPPFFTSAAAPGVTMVPISTPSDRSATPDGPAGRPGVRDRLTVPVLAFGGILMAVMQTVVVPLLPDLPRLTGASAGAVSWMVTATLLSGAVLTPVLGRAGDMYGKRRVLLAALALMTLGSLLCAVTSDIRVLIAARALQGAAAAVVPLSISILRDELPPERTGSAVALMSSTVGIGAALGLPIAAMIVQYADWHVMFWATTGLGAGGLALAWWAVRESPVRQPGRFDTLGALGLAAGLVCLLLGVSQGGQWGWTSPRIVGLLVACVLVLTLWWFQQWRAPRPLVDLKLASRPRVALPHVAALLTGFAFYGNSLVTAQLVQAPKATGYGLGLSIVQTGLCLLPGGVIMLLFSPVSARISAARGPRVTLALGAAVIAVGYAVRIADSRDLWMIIVGATVIAVGTTLAYSALPTLILRAVPAGQTASANGVNVLMRTIGQAVCSAAVAAVLVHHTSLVGGAPVPTLHGYLLAFAMAGTVAVMACAAALVIPGDPDSHGTRRARGRTRPSHDEALEGA

SEQ ID NO: 8673 - protein, 401 aa, Streptomyces avermitilis
VKIACVGGGPASLYFSILMKRQDPSHDITVHERNPAGSTYGWGVTYWSGLLDKLRGSDPESALAVSENSVRWSDGVAHVRNRTTVHHGDEGFGIGRRRFLDVLADRARSLGVRIEYEHEIGADDPLPEADLVVAGDGVNSVLRGRYADHFGSETVLGRNRYIWLGTTKVFDSFTFAFVESEHGWIWCYGYGFSDGHSTCVIECSPETWTGLGLDRASEADGLALLEKLFADVLDGHELIGRAQSDGAAQWLNFRTLTNRTWHRDNLVLIGDAAHTTHYSIGAGTTLALEDAIALAEALSAHRDLPGALAAYERERKSALLHIQSAARLSAQWYENLPRYIRLPPPQMFALLGQRHSPLLPYVPPQLYYRIDRAAGQLEALRRLKRWLGPRLARTVQARTGR

SEQ ID NO: 8674 - protein, 155 aa, Streptomyces avermitilis
VTHPPAGPVLAALVSRATGGRYWRLDRPGAGLDAEAMHIPPGAAAEPPGDRSRDVLVIALDGGGRLRTPGGWLELAPPAAVWLPPAAGYRLHAGEAGLHCVTVRPRRPAAPPALPTTGATGEPACLLHQVCAECGRMATESDARYCNRCGNPLER

SEQ ID NO: 8675 - protein, 118 aa, Streptomyces avermitilis
MPELTRRHALGAAAALAAVAGTQALAAPSASAAGHHGGPQPFDEVYQGRRIEGRATGGGHHHGSGYGVFIDGMELHVMQNVDGSWISVVSHYDPVATPRAAARAAVVELQGAPLVPFN

SEQ ID NO: 8676 - protein, 274 aa, Streptomyces avermitilis
MTVRKNQATLTADEKRRFVDALVALKRSGRYDEFVTTHNAFIMGDTDSGERTGHRSPSFLPWHRRFLIEFEQALQAVDPSVALPYWDWSTDRTARASLWAPDFLGGSGRSLDGRVMDGPFAASTGNWPVNVRVDSRTYLRRTLGGGGRELPTRAEVDSVLAMSTYDMAPWNSASDGFRNHLEGWRGVNLHNRVHVWVGGQMATGVSPNDPVFWLHHAYIDRLWAQWQSRHPGSGYVPTGGTPNVVDLNETMKPWNDVRPADLLDHTAHYTFDTV

SEQ ID NO: 8677 - protein, 236 aa, Streptomyces avermitilis
MIGGMSERVVAACDGASKGNPGPAGWAWVVADGEETPTRWAAGALGTATNNVAELTALERLLSAMDPDVPLEIRMDSQYAMKAVTTWLPGWKRKGWKTAAGKPVANQELVARIDELLDGRSVEFRYVPAHQVDGDRLNDFADRAASQAAIVQEPAGSEYGSPEPPKSPDTVAAGSAGRGAPAKKRASARTAKTSTRTIKAKFPGRCVCGRPYAAGEPIAKNAQGWGHPECRTADDV

SEQ ID NO: 8678 - protein, 163 aa, Streptomyces avermitilis
MKPLTGSTTDQAPADPAATDDVLATQPIGYWSGLAHTAVTRQLRDAMARIDVTQPQYWVLNRVHGGPAAPGREEVVTQLTPLADGPHEIARVVDQLLHRGWLRIDAGQRLRLTDTGEAARKRLRELVTELRAVVHEGISDEEYVTALKVLRTMIANVEGDAGC

SEQ ID NO: 8679 - protein, 265 aa, Streptomyces avermitilis
MAVYPEGKPCWADAMFSDVEGAKTFYGDVLGWTFGESSSEYGNYTQAYADGKAVAAVVPPMPGQEGHSAWCLYFASPDAAATARKIRDNGGEVLMEPMQVGDFGTMALAREPSGAVFGVWQPGVHKGFEATAVPGAYCWAEVFTREPEKPDAFFPAVFPLTAQQIEDEAVDFRIFSVGEDAVLGRMKMTDDFPPEVPSFINVYFTVEDVDAAVAKATEHGGILRFGPMDSPFGRFAALSDPQGASFAVIDIKTTQGELPKLTDVS

SEQ ID NO: 8680 - protein, 334 aa, Streptomyces avermitilis
MWAWEVERPGPIEDGPLRFVERPVPVPGPGELLVRVRACGVCRTDLHVSEGDLPVHRPRVTPGHEVVGVVAGRGADAGGYAVGDRVGVAWLRRTDGTCRYCVRGAENLCPASEYTGWDTDGGYAEYTTVPAAFAYRLPTDVDDVALAPLLCAGIIGYRALVRASLPPGGRLGLYGFGGSAHLCAQVALAQGATVHVLTRDPASQRLALALGAASAGGAYDTPPEPLDSAILFAPAGGLVPVALRALDRGGVLSVAGIHLSDTPPLCYERELFYEKELRSVTSNTRADGREFLELAARYGVRATTHTYPLSEAQQALRDLKAGRFDGAAVLVNDV

SEQ ID NO: 8681 - protein, 433 aa, Streptomyces avermitilis
VRLRPARAWMDPGVWWRRWPAMDDVDSANAPSGAFDAVEAIGTTLDERTTCAELATYVCRKTGEAAAVDLLPVDVPAAPPMPHAPQPALTRVATAGRSGLLASWGVEGPRPLAVRALDEGHPITASMDLSGRVPRQVMTVPLLAHGRLYGVLLVVRQGPAFTDRDTAVTHFAARLAAVHLGHARQHGTVRSTALDLQRALLAEPGRPHPNLSLATRYLPAGGGALVGGDWFETIRLHYGRTLLVMGDVMGHGLEAAVDMNAYRSMLRYVASTDLPPHRVLRRLDAAVAEDGIRRPATCLLVRVDPARGSVALASAGHLPPVVFSGDGTGELLDVPVGPPLATGVGGYEPATRPLAADETLVMFTDGLVERRREDIDVSLARLAGLRLPPGAVVEEILSRLLAHLDARNAEDDVAVLAARIRRRPMVNRDAHAG

SEQ ID NO: 8682 - protein, 302 aa, Streptomyces avermitilis
MRKPWIVGIVLGVLLLGACGDPASGPEGAPPAPEVRGTSAATRQGAAASPRASASVRAPTVLYLGDSLAMENQKVLGGLLRDGLHAKYTSAPYSGTTLCDYLEGTAVRSLVPAADKAAALVRSTHPDFVVLQFWGNSWGYTPCMDGITYDAARSKYFARYAADAKTLTEQIAAAGGARRPKVVWVLQGPDPITPDRVRRVNALYEERARTSDGLVADAGKAVSPATGRYTWSQYLPCTAYEHAHAAYCTQPGRDRTALHRDDDYLHFCLAPTTSTPKPCPARSPGILRIARAIARAIGAHLG

SEQ ID NO: 8683 - protein, 854 aa, Streptomyces avermitilis
VNPSLGRRHFLAATGTAAAAATVATGGAGAAHAATGAAPTTAGTGTDTDTGTGTGTGTRPFPLGAVTLLDGPFRDNQRRNSAYLRFVDIDRLLHTFRTNVGLPSDAEPCGGWEGPGVELRGHSTGHLLSGLALAHASTGEEALRDKGRRLVAALAECQSAAPAAGFGTGYLSAFPESFFDRLEAGSGVWAPYYTIHKIMAGLVEQYRLVGVGQALEVVLRQARWVDERTAKLSYEQMQRVLETEFGGMNDVLADLHALTGDPRWLDVAERFTHARVFDPLAGNQDKLAGLHANTQIPKMVGALRLWEEGRADRYRTVAENFWQIVTDHHTYVIGGNSNGEAFHEPDVIAGQLSDNTCENCNSYNMLKLTRLLHFHAPDRTDLLDYYERTLLNQMLGEQDPDSEHGFAIYYTGLAPGSFKRQPSFMGPDPDVYSTDYDNFSCDHGTGMETPAKFADTVYSHDGRSLRVNLFVPSEVVWRAKGISWRQTTRFPDRSSTTLTVSSGRAAHRLLIRVPSWAAGARATLNGRALPDRPQPGSWLALERVWRTGDRVEVSLPMRTAVEATPDDPDVQAVVHGPVVLAGAYGDRANPWLPRLDVTSVRQEAREPLRFTARADGEEVTLLPVARVHHQHYSVYWLTGEPPSPPPEFAAWHRFDETTGSTAADATGNGRTARLSGGTSWSASGHDGGAVSLDGADGHVALADDLLAGAAAHSLATWVRLDGNPGTWSRIFDIGTGVTANMFLTPLSGSGTLRYAITAGGAGGEQRIDAEPLPTGRWVHVAVTYGSGTAVLYVDGTEAGRNVNVTVEPRHFGNHLRAGYLGRSQYADPYLKGALDDFRVYGRTLTATEVASLAS

SEQ ID NO: 8684 - protein, 160 aa, Streptomyces avermitilis
MPAEGFTTCLWFDGQAEEAADYYVSVFKNSRLGRVGRYPEGGPGPAGSVMVVEFVANGQKFVALNGGPQFTFSEAVSFQIFCDDQDEVDHYWNRLTEGGGEGGPCGWLKDRYGLSWQVVPAKLIGMIGDADPEKAARTSKAMMEMGKLDIAALEKAYEGE

SEQ ID NO: 8685 - protein, 217 aa, Streptomyces avermitilis
MTPLTTGWHPALSPRAEEGDTPPSRFDDHLAAQLLAQRIVLLGTQVDEVSANRVCAQLLLLSAEDSRTDISLYINSPGGSVTAGLAIYDTMRLIPNDVSTLAMGFAASMGQFLLSVGAAGKRFALPNARIMMHQPSAGIGGTTADIEIQAENLEFTKKAIERITAEHTGQSEETISRDGDRDRWFTAEQAKEYGMVDRVVESLDDVRPTASRRRMGL

SEQ ID NO: 8686 - protein, 200 aa, Streptomyces avermitilis
MGSYTIPNVVERTPQGERSYDVFSRLLSERIIFLGTEIDDGVANVVIAQLLHLESANPEHEIAIYINSPGGSFTSLMAIYDTMTFVQAPISTFCVGQAASTAAVLLAGGDPGRRFVLEHARVLLGQPASGGRQGTVSDLSLQAKEMIRIRSQVEEVLSRHTRHDIATLRADMDRDKVFTAQEAVAYGLADEVLSRRLAVV

SEQ ID NO: 8687 - protein, 151 aa, Streptomyces avermitilis
VSNQAPNEARVIALRPASAPPRSPNAARVPVTAPGRAPQRPGQRPAAPAAKEPLWRDLVGDVLRRERLAQERTLKDVADAARISMPYLSELERGRKEASSEVLAAAAQALGLGLTDLLSLAHHELTRHTRTRPARGRTAPTARYDGMCLAA

SEQ ID NO: 8688 - protein, 489 aa, Streptomyces avermitilis
VRKNRSAALAAASFLLMTGAGIAAAPSAYAGTPGGTHANDRNSDFNGDGYEDVLVGAPGATVSGKKGAGLVTVQYGSSRGIGTTNAARFSQSTADVAGAAETGDAFGRAVATGDLDGDGYDDAIVGVPGEDLGTTKDAGGVAVLWGSKSGLSGAASDWLETQEPTADEQFGSALAAAHFTDETPGDLLAVLDRDDLELFGYDSAAQASLKQRSQQRLSARADQRDILPTSLTTGDYDDNGYADLVVSGVTVGDEPGHGWSSLLTGHADGLSYERDLRGGPVAASGDINNDGYDDLVTGEPHSPNDVYGETRTGGVVGVRLGGPDGPAADPDWWTQESAGVPGTAEVGDGWGTDLSVADTDGDGYADVAIGASGEDIGTVADAGAVWVLRGSAGGLTAAGAKSWDQNSADVPGVAEKGDKWGAQVRLTDPNRDGRFGLLASAPGENAGDGFVWVLSAGTGGITASGSWTYGADTLGAPSVAAAFGAAIDE

SEQ ID NO: 8689 - protein, 75 aa, Streptomyces avermitilis
VLMAHPAVLRNLVEQYETLRALHAENGSTEVRQRMDDAAYTLCVSTGTKDVEAALVAARRRLPLARTKEDSLLTT

SEQ ID NO: 8690 - protein, 295 aa, Streptomyces avermitilis
MDTAMSRSMVKDEATRTATGEGSLPHIVDPRTVAPRDARELSRQFFRRLSELEEGTHDYQYARNTLIEMNMSLVRFAAGRFRNRGDDMEDIVQVGMIGLIKAIDRFEISREVEFTSFALPYIVGEIKRFFRDTTWAVHVPRRLQELRVELAKAREELSSRLDREPSVAELATLMNLSENEVVEAQIASNGYNSSSLDAALSGDDQEGEAVLADFIGEEDDGMQLVEDFHTLAPLVAELSDRDRQIIHMRFVEEATQADIGARLGCSQMHVSRLIKRIIEQLRTGMLSDLHRVESA

SEQ ID NO: 8691 - protein, 497 aa, Streptomyces avermitilis
LPTGRSVDTQGVGPVASERTAWLRQGGGTGRRVATAFEAGRSGTSGWRRTVGGGLVWVGAAALLGVSGQRTARRAAMRGIGAVAMASAVTRTLARPTAHRAEAPHAAGPAASAAAFAAGVVLEAPRYGLLVAPAAAALTAARIRSGARHPGDVAVGTAIGIGAAALTARWWPVKPETAAAAAPPRRPAPALADGAGLHVVVNPSSGVSRSTDADDAVGRLRSLLPKAEFLVPQEGQELPELLERAARQAKEAGGALGACGGDGTINAATEVAARLGVPLAVFPGGTFNHFAVDLGNQTMEDVARAVCDGDAIVADVGCARVPDGPEQLFLNTFSLGVYSDLVHAREQLEKRIGKWPALVVGLARVLAAGSPVSVSVNGRPKRLWLLFAGNGIYHPAGFAPTYRTQLDDGLLDVRAVDAGTPLARTRLLLAVLTGTLHNSRVLTTAQVRGLRLEVLKGDPRFSYDGEVTRAAAPRLVLDKRTRAVTLYRPAEKDQWLR

SEQ ID NO: 8692 - protein, 152 aa, Streptomyces avermitilis
MIESLDGAVIPTDFDMPVEPLRRAAHYTGELGSIAEARAFAALFLEQLRSEWCAPIDARADGDLLLVVSELVTNADRHSHGPYILELEGTDASVTVTVYDSSAALPRRYPPDPGRVGMHGLEIVHVLAAAVTVERVPVGKCVRAVMELPKQS

SEQ ID NO: 8693 - protein, 476 aa, Streptomyces avermitilis
MRCRSSLRREEELVSVEPPAGRPTGPPSGPLSGPTQQRPVQPSGRPVRSSSGGDAGSGGSAGSGGGGGPSGPLGPGDAGKEPERWWKSAPRVALMATAVVVAVVAALVLTRSHGTSTAGKGGEVFLQAAGKSGPYPFTESTANESSTAPLTPAPASTSASAQAARGIDGSEPGLYGGTRKVSSCDVEKQIKALRAAPEKNRAFASVEGIAPSEVPAYLRSLTPVQLRVDTWVTNHGFRNGVATPYQAVLQAGTAVLVNSRGVPRVRCACGNPLLYPVPQTTRPRQTGDTWASYRPQNVVFVTPAPTAINVFVMFDPDHDEWFHRRRGDKGRHDEKTDPPRHRPSPSLSASMLPPDSSSPKPHSPSSKSPEPSSSSPSVPSSPNSSRESSPESYSEPPTTEPKTTEPPTTEPKTTEPPTTEPESTERKTTEPPTTEPPTTEPTTTEPPSPGVVSPETTSESDTTYSAPEPAATPPSY

SEQ ID NO: 8694 - protein, 418 aa, Streptomyces avermitilis
VARPGRSAFARHGWVQALATVLAGLIVMVVTAALGLLAAGAAGLPGNAFVSVDAATVVTAVGGTVKLSGDAGAIADTKAGLTVMPLSVSLAGVLTIAAGFLRHLRHRAVAGARELAGWSARIAVVWLVALVGLTFTARHTFTISLGNGMIGDIGELFGVAPKVGFTTDVPLTLLFGLLWLVGVFVLALLVSRGAPLPARVVRFQESVRPAAYAMVVLLLAYVVLGIVIGLVVAASRGHTAETFAVILLGMPNLVWLALTIGLGATWNGRVDGPFGLPMPHLLDEVLRTPDVATLDLRSLAHYDGRVWWLVVVDAVLILAAAFVMAVRSPARIRAWQHALHMAVALTLTVLMICLVARVYAHFGLSLLGIGDIDGGLSGVLFLKPRLWTALGWAVLWGLVTGFLGALLARPVHRRGEVA

SEQ ID NO: 8695 - protein, 339 aa, Streptomyces avermitilis
VPPTSRPLRKLGFLTIGLFDGADPGRGHESTLGIIELGEQLGFDSAWVRHRHLQYGISSPVAVLAAASQRTRRIELGTAVIPLGWENPLRLAEDLATVDILLGGRLNPGVSVGPPMHYDQVKEALYPDTADAEDFGYERVRRLLDLVRGEPATDFSGVEGFEVFSDRVQPHSPGLGRRMWYGGGSLRSAQWAGEHGMNFLTSSVVKAEESEDFAGIQLSHIRAFRAHHPDGDRARVSQGLVVIPTDSASPEQRAKYTAYVEKRTPRTVTPQGPARMMFAPDIVGTSAEIAERLHAHAAFQEVDEVAFALPFSFEHADYVQILTDIATRLGPALGWQAAT

SEQ ID NO: 8696 - protein, 324 aa, Streptomyces avermitilis
MAGPSHGTGLSSERPSELIGKQIASYRIEREIARGGMAVVYRARDLRLDRTVALKLLAPELALNDTFRRRFTHESRVAAAIDHPNIVPVFEAGETEGVLYIAMRFVSGRDLRHLLDREGPLPFSAGVRIALQVASALDAAHDHGLVHRDVKPGNILVARGTDSDHPEHVYLTDFGLTKRSLTVTGFTIPGQFVGTLDYVAPEQICGKPVDGRCDVYGFGCVVYEILAGTPPFCRDDEMALLWAHQHDEPPRLSRRRPDLGPQVDEVMAKALAKSPEDRYDSCLAFVAALRTAGAGAGPQRHPPKRTGPTTIPEPPRWARPVFRR

SEQ ID NO: 8697 - protein, 198 aa, Streptomyces avermitilis
MTAPGFRPTHVVPQDGMPAWEAPDVARPTVPLDALLPVQLVDRRGDWGHVVCANGWSAWVDGRLLVSVPQPPPAAPGSPVRAEDPRPLLAHVEEALGRYRGAAEELAGGSLDGESFRSLTHGLRIGVVVDGESMWLYDAEHERWEYCDGTRLSTYAAEGDTPGPVPAEPTRVVQDAVPDGSRSADGLARYFPDDTDDL

SEQ ID NO: 8698 - protein, 780 aa, Streptomyces avermitilis
MGERPVAPTAPELVLETETGSTVMSPSRDYHVGRDPSSDIVLDDVRVSWHHAVLSVEADHWTLEDEHSTNGTYADGRRIHEWGVGPGSEIRFGNPSDGPRAVLVDCARLATEHPSAVFMPSATGTFRQPTTVRPLPTRTVRIGRGGGNDLDIDDLMVSHRHAELQALPDGTYEIVDLGSHNGTYLNGQPVTRAPVTPGDIVGIGHSVFCLVGDQLQEYVDTGEVSLDVRDLTVELDHDHKILLDQVSFPVGEKCLLAVIGPSGSGKSTLLNALTGQRPADRGTVLYDGRDLYRDYAELRRRIGLVPQDDILHAQLTVHRALGYAAELRFPQDTEKAERRARVDEVIRELGLEQRADQPIHSLSGGQRKRVSVALELLTKPSLLFLDEPTSGLDPGMDRSVMHMLRGLADDGRTVIVVTHSVLSLDVCDRLLVLAPGGTVAYYGPPDETLPFFGFVQWPEAFEAFEHDRDRDWAGEYRDSLQHEQYIEGVGTPPYLPSAAPAAAVGPPPKAQSWGAQLGTLVRRYAATLSADRTFLAIMIALPFVMGAMARALAGGKLTQETAMNALLILCVGGVLTGAANAVRELVKERAIHQRERAVGLSRSAYLMSKVVVLGTITVLQAIVLTLVALLGVDLDAPGGEGVLMPPLVELTLAVALLSFTAMMLGLLVSALVRREEVTMPLLVLLAIVQVVFCGALLKLNGVAVIQQLSWLVPSRWALGAMAGTIGLARIVPGDLTGDPLFRRSAGVWLLDMGMLVVLSLVFGYAVDRLLRRHEPLVMRK

SEQ ID NO: 8699 - protein, 136 aa, Streptomyces avermitilis
VHDEFLCHVTAYGICGGQRVGVPLGTYRAPTLALALWWMRDRASWIAERLDPHPDNPNFPPNSIAPVAETVPDVPSLLRAWCGDAIQQELVADELAAGRLVRIATSDDTTEYELLAESVDALRMQRFVPALSTPAA

SEQ ID NO: 8700 - protein, 128 aa, Streptomyces avermitilis
MSTNSNRYESAVARYFEAWNAGDQDALTKAVAAAWTEDGSYTDPLADVRGHEQITAVIAAAHEQFPGFAFRLTGTVDGHHDIARFAWELVNEADGSAPVAGSDVITLDGEDRIRSVQGFLDRVPAGAA

SEQ ID NO: 8701 - protein, 331 aa, Streptomyces avermitilis
LYTADSARYEAMPYRRTGRSGLKLPALSLGLWHNFGPDRPVETQRQILRRAFDLGITHFDLANNYGPPPGAAESALGDALRADFAPYRDELVISTKAGHLMWPGPYGEWGSRKYLLSSLDQSLTRMGLDHVDIFYSHRPDPETPLEETMGALHSAVQQGKALYAGVSNYSPEQTREAARILGELGTPLLIHQPRYSMLDRRPEEGLLDTLDELQIGSIAYSPLEQGLLTGRYLDGIPEDSRAASDSPFLSADTVTEDLVRQLRALDDIAKSRGQTLAQLALAWVLRGGRVTSALIGASSARQVEDSVAATRTLDFDAEELARIEAIIKPRP

SEQ ID NO: 8702 - protein, 292 aa, Streptomyces avermitilis
MELRHLQHFVAVAEDQHFTRAAERLMVSQSGLSASIRALERELQAPLFVRTTRSVTLTEAGRALLGEAERILAQVRAAHDAVAAVQGVLRGTLSLGTEQCIAGVHVARLLAGFRRQHPDVEIRLRQAGSGALAEEVAAGRLDLAFAVRTETDTDQLRSVPLTGEPMTVLCHPTHPLATAGAVMPEDLGGEAFVDFHPDWGPRRITDAAFAAAGVRRTVALEVNDVHSLLDLVEEGLGVAVVPRHFRHKREALTALPLKGTGETVYETVAILPPSAATSPAARALMTLLEEEF

SEQ ID NO: 8703 - protein, 171 aa, Streptomyces avermitilis
MHAKDVLTDAYSRIQEEVHAAVEGLAPDVLNARPADDANSISWLVWHLTRVQDDHLADASGLDQVWPAQGWDKRFGLDLPRRDTGYGHSPRQVAKVRVDSGELLLGYYDAVHEQSLEFIRGLTAKDLERVVDERWTPAVTLGARLVSVLADDLQHVGQAAYVRGLLQSAAS

SEQ ID NO: 8704 - protein, 354 aa, Streptomyces avermitilis
MTALDIDTIRRLPKAVLHDHLDGGLRPATLVELAQAVGHTLPTTDPQALADWYYEAANSGDLVRYIATFEHTLAVMQTREGLLRTAEEYVLDLAADGVVYGEVRYAPELMLKGGLTLSEVVETVQEGLAAGMAKAAAAGTPVRVGTLLCGMRMFDRTRETADLAVAFRDAGVVGFDIAGAEDGFPPADHLDAFEHLRRENVPFTIHAGEAHGLPSIHQALQVCGAQRIGHGVRITEDIVDGKLGRLAGWVRDRRVALEMCPTSNLQTGAATSIAEHPITALKDLGFRVTLNTDNRLVSGTTMTREMSLLVEEAGWSTDDLRTVTVNALKSAFLPFDERNALIQDVVLPGYEAAL

SEQ ID NO: 8705 - protein, 135 aa, Streptomyces avermitilis
MRRIALVTLVVDDYDEAIRFYTEALGFRLAEDESRPDGSRWVVVEPGSAAAGTGLLLARAKGDAQRGRIGDQTGGRVGFFLHTDDFARDHARMRAAGVAFLEEPRYEPYGAVAVFQDLYGNRWDLLQPAPAPTAH

SEQ ID NO: 8706 - protein, 305 aa, Streptomyces avermitilis
VILLLLIPVALPFAMPVLARRALDRLAPTAALWMLTCSAVVLAGSSLVALGAFVLTGLLEVPLFAALGELVHPLRTASNMFVVPAAAFSVGALAVCLWTLVRTVVRQSRAFRAATSAADDRHTAGDLCVIDSPQPDAYALPGRPHRIVVTTGMLRSLGPDEREALFAHERAHNAGGHHYFLVAAELAAHCHPGLRAAGDAIRLAVERVADEAARRGRRGPAADRPGDRPGRPGRAGRPQRPPLVRARGGHGSRAAAGCGPAVGAAPAPSRSAPDGRPAGRLRGPVRLCLGDGSHRLPPSGRGRAR

SEQ ID NO: 8707 - protein, 123 aa, Streptomyces avermitilis
MAEAKDERRPAGELEATVMAALWAAGVPRTPGQVQLGLGAGLARTTVTTILSRLHEKGIVGRERHGRGYAYFPVQDAPGLTARRMHTELDRDSDRHTALARFVAQLSEDDERVLRDLLESGEQ

SEQ ID NO: 8708 - protein, 283 aa, Streptomyces avermitilis
MKREDASDLAGSTAVGALVAFVLLALTVSGRAGDPLFGDADLFDWSVTHRPPVAVAVARAVTYTGTGFIPYALVVLAGLLVGRTARQRLFSVAAALLCLAAGQAVRYGVMSLIARPRPATAGWSTHASGWSFPSGHTTTSAITAGLLVLAVLARAPRGRGPLAVAIGCWGVLVGLTRVYLGVHWFSDVLGGWLFALCWLSLSAYVVTRIAPPVLHEIAASRHRPGPTTEERRHDSPTSTEDPLDPAPPPSRTGRRRGLSRRRDRAGTRDVAASSAPDRRRRPS

SEQ ID NO: 8709 - protein, 350 aa, Streptomyces avermitilis
MTPPPAPKTPSTLLRRHLGRAVGAAYLAAATAPGPGMWLRHPHRIAVVGLPDLSLNTAPFLLSLVLFTAGLQVPPRDLGRLVGRPAALLTGLALHLLAPLLIVPGVAFALRQSPDSDGGSGLVAAMILVVAMPVAAGATVWTGAGEGDQSTTVGLVLASTLASPLTVPFTVTALCPLLSADYADTLAGAARIAGSGFALTGVVLPCAAGLVARLALPRRALDALLHAAVPTAALGSLLLTYVNASGVLGPFLTRPRPVLLAAALAVAATVCGLSFALGRITARVLRLDAHAGASVTLACGMNNSSASAVLITTALPDRPQVLLPVLAYGLLQKVAAGRVVRGGHHSGRGA

SEQ ID NO: 8710 - protein, 401 aa, Streptomyces avermitilis
MTPSDEAIMCPFDFSKGLEFDPSLAELMARDSITRIRLPYGDADAWLVTGFDAVRQVTTDQRFSRAGIMGSDYPRLTPEPIVSPESINVVDPPHSSRLRRLVSQAFTKGHVERMRRRIVRLADTLLDEMAAQGPPADLAHHLSNRLPQHTICDVLGIEQDDWPRMEQYVHQLLSTGPDSRQSAATAKSELREYFGGLVEKRRSSPGNDLISALAAAKDGEDVLDDQELAVMALTLMLSGHDTATCQISNICYLLLTRPELMKHLRSRPDTLTAVLNEMLRFIPFRKGVGIPRVAVEDAEVDGVKIRAGDFVHVSYLTANRDPERYPDPDAIDPDRPSLPHMTFGWGGHRCIAVPLAMAELEVAIGRLLERFPELRLAVPPEEVRWDTETIRRFPIELPVAW

SEQ ID NO: 8711 - protein, 307 aa, Streptomyces avermitilis
VCHTPRMTSETITAEAAGTWKLGDLSVNRVGFGAMRLTGSAAFHLGTPSDRERSVTVLRRALELGVNHIDTAAFYFSSLRSANELINSALAPYPDDLVIVTKVGPYRDYTGEWGTAARPDQLRGHVEENLRQLGRDHLDVVNLRRMRQDSIAEHFGALAELREAGLIRHLGISCVEPRHLAEAQAIAPVVCVQNQYGLHSPDAGADTMLRMCGEQGIAFVPFFAIAGEGGAQGSSGSEDDEIRAVARAHEATPAQVRLAWTLQQGPHVLAIPGTGNPDHLAANVAAGAIRLTADELARLDAAYRHGG

SEQ ID NO: 8712 - protein, 464 aa, Streptomyces avermitilis
MKGIVTVMRTPRALLAATATTAALAVVVAVPTPAVSAQVPTGGAYFVQSAVTGLNAADNAGAVEQHNPKGNEDHQQWNLRTSGSAYLLESTDTAGSCLGRSGDQARTVVCTSADAAWEITPAGTDQYTLKAPGTDRHLTVGAKPSGSNYPAQLAIGSAGSLASWYLTPVTPSVNPMPSPDQRTLDQVTFLTAHNAYANGVDGGFAPPFVNLVPNQTRGINQQLTDGVRGFMMDIHQTSDGAILCHNSCTLVSKPVALWVDIQRMVDFLKQHPDQVVTVFLEDYVDPGVLRSELARVSGLSDVLYRPDRTGVRQSGWPRMADLIAANHRLLIFTDHSRSSDESAGLTRDSFGVMYQREWTVENYWSMGSGLGSSDWSCYSRWYGADTNIPLTYTESAFRPLFVMNHFRDAAIASTATTDNTKLADRAQRFCRPAARKKPNFLAVDRYDLGNPTSAVDTLNTYTYP

SEQ ID NO: 8713 - protein, 201 aa, Streptomyces avermitilis
MTTPRDLLIVAMDVGSSRYVEPGDLSLALAGAEVIDLLGAGALTLEGDRIVSNNQWTLGDRLLDEAASSLVRQPPHEPVEDWLWRRGRGLSQAYLAALETEGQVARQPGRWLPVRTGRTALVDSPARRHAADRWASGEPVLAVLAAAAGIHDLPTEDSPSIADEAVVTVLAAVNDAVMELEAVRQRRSIEEAAFDNIWRGP

SEQ ID NO: 8714 - protein, 263 aa, Streptomyces avermitilis
VTQPAIAEGLLAWNPDSGLTRGLAADTRLLAADSWLLRDGLVRGFDRHRERFRRACAECGAPPLDQLTAFWREMTAVLPRAGTWFPRVELVRGSLQLRLLLRHAPPLATEVRVWAAGQPDPRTVPRRKGPDLDALGRVRLRAGGQGAEEAVLITPSGVVLEAANSSILWWEDDTLCMPPPQLPVLAGVTVGLVQERALRTGIRLAHRERTPAELAGREVWLVNALHGIRPVVEWTGRPMNAGFAVRAPEWREWLDGILEPLPD

SEQ ID NO: 8715 - protein, 52 aa, Streptomyces avermitilis
MSQPLFAGPGSCPGPVFRQAADRHGAVFGTLDRPLGIHPGLGTDLGHTVPAG

SEQ ID NO: 8716 - protein, 508 aa, Streptomyces avermitilis
MRAPLPTLSPAEAGTSDNLAAVLAGRAERRGWTGRPAFRQGHQVWTHGEVHDLAARTATVLAEHGVRPGDRVLLALPDSLAWVTAFLATARLGAVAVPVNPELTPAEHEFMADDAEAALCVTGPGLERRFAHRRRLGADQLVALAGTASPAADAHPVGPRTPLYIQYTSGTTGRPKGVVHCHGDPGTYHELIGRRLLRITADDVTLSVSKLFFAYGFGNAFVFPLFSGSSAVLVDGRPTPAAVDGLVARHRVTLLYSVPSAYAALVADRAVGHMACFASVRAAVSAGEGMPAGLAEQVAELLGAPVLEQLGSTEAGHAFCANSFDHHHPGTVGRPVPGFEVELRDRSGRPVGAGEEGELWVRGPSLTPGYLNLPEETDRTLVGGWLATRDRARREPDGTYRHLGRTDDMETVGGSTVSPLEVEALLGTHPAVREIAVAAVTDARGAGRLRAFVVPVTPIPVGLEADLVCLARDNLAAVQVPRSVSFVPTLPRTATGKLRRHLVRQGAW

SEQ ID NO: 8717 - protein, 732 aa, Streptomyces avermitilis
VKTLLIDNYDSYTYNLFQLIAEVNGEEPVVVLNDAPPDDIPDLRDFANVVVSPGPGHPAKRRDFGIVGELLAAAPVPVLGVCLGHQGIAAGERAWVTPAPEPRHGHLSTVRHNGQDLFEGLPQQFTAVRYHSLSVREPLPLSLEPTAWAEDGVLMGLRHRSRPLWGVQFHPESVLTEFGHRMFVNFRELTASRARETRTAKARTSGTRTTEPPVRPPSPSAEGAGAAPAVLVPRPRRVAPSHRLHTRRIDVAVDAEAAFTRMYTDAPRAFWLDSSRVEEGQSRFSFFGDGTGPLAEFVRYDVESGLCEIERPGRPVRKVRASVFDYLKRQLVTRQVDATGLPFDFTGGYVGYFGYEVKADCGSVNRHRARTPDACWLFADRLIAVDHQDGATYAVCLAENTRQGAQQAADWLDAAMAQLSFVSSAKPTAPPRPTAPRLDAVEPWLVRDRTTYLADIGTCKRELKDGTSYEICLTNAARLPAPYDPYDFYRVLRRLDPAPYAAYLRFGDLDVAGSSPERFLRITRDGVAEARPVKGTAPRGERPEEDARLRDALTTDDKTRAENLVIVDLLRNDLGRVCRTGTVKVTRLMATETCATVHQLVSTVEGRLREGIGAVDCVRVCFPGGSVTGAPKLRTMEIIDSLETEARGVYSGAIGYFGCSGGADLAIASRTAVFTDGEMHLGAGGAIVLGSDPVGEYDEMLLKTAAPMRAHRDRIAGLRPAARTLPLKEAVR

SEQ ID NO: 8718 - protein, 187 aa, Streptomyces avermitilis
LNRRRPCLVSEGVTRNSVTVAGAYHVVPGRESGFHSWGWALLWASAGQSGFLGGGVLVGGGAEWHVVYRFGCGGSARDWDASVTGIQWSARADELAREAGDRIVHGSTAWFDSGTVTPAAPRPPPKWKLRFVDVSTVFPPVLLFNLAVLPCLGSLNSLIRTPSLQAFLAGPNGGLRKAENEQREVGG

SEQ ID NO: 8719 - protein, 561 aa, Streptomyces avermitilis
VTWRAFLITQRQGSAMSPDSADRATARAVWSDFCAVSPSPELRDRLRSDLQRIRETNTGLAAHIAPARTPRRPGFDDGTIIPPEEFPAGTPAARIRAAAAERAPLRGTVRVIVVLVDFPDKELTATAQHFRDLFFSENTLEHGSVRDYFKEVTHGLVSISGEVVGPVTLPHTLAWYANNNFGIGRPSGEARANIMARDAAIQADPSINYAPYDNDGNGFVDAFVLVHAGEGGEVTGEPGDLWSHKWTLPKPYPSDGAKIYGYLTIPEDAKIGVCAHELGHLLFGFPDLYDIDGTSEGVGDWCLMSGGSWGGGGDIPVHPSAWCKAQQQWVSTQRVTTDGTLALPDVKNGFEVHQLWKRGAPGREYFLLENRQQTGYDRSLPAPGLLIWHVDENQPDNSDENHYKVGLVQADGCRALEQGGNRGDEGDPYPGSTGNTAFTNGSDPSSHSYAGAETGVSITGVSAPGEVMTAHVSLAPSPTERMTTERMTAERMTAAAGTGARAETTPELAGEILEIQARLAAMEQDLASIASKVLTPLVHTGMQSDAAQMTAAHGNGRPIPQ

SEQ ID NO: 8720 - protein, 102 aa, Streptomyces avermitilis
MVQAIENLTTLRIRLISRAPHPRLAEWDQVAADILDADPVRGYADLLSHRVGGRVELAIRRDLLDGAAPGAVIRLRAKLAAGEIVAEPHPPPGEFTITPATP

SEQ ID NO: 8721 - protein, 133 aa, Streptomyces avermitilis
MAARSPASTRLQDKGGAMSLNLKNNYHQPVWAMVEWHHPNCSDGGDWMKKGWWKIGPGQTSTVFGDDVHAVNPIWYCYAHSSDGLEWRDRFQELVPTHAFEWCSNTADTSSRTILMNEFVVSRPNHVHTFLAP

SEQ ID NO: 8722 - protein, 196 aa, Streptomyces avermitilis
LDDMVVVRPRHPLPGSLHFPVRRTLMTLAVETGLWQLDRTASTVAVRHKTMWGLVTVKGAFTSISGQGEVEPDGTAHGTITLEAASLDTKNAKRDTHLRSADFFDVENHPEITFAVRTAEAGPGDTVQVAGQLTVRGISRPQSFTARVTRADSDAITLAAEFTADRDQFGMGWNQLSMMRGLTTVTATLRLTRAAA

SEQ ID NO: 8723 - protein, 166 aa, Streptomyces avermitilis
MAEPSAPADLPEHVQTPQDGLLPAELRAWMLLLAATGAIEQQLRAVVKDALGISHDEFLVLCLLADQPGSGLRMTRIAELLGRPKTRLTYQVACLQHAGLVTRQSVCGDKRGVQVTLTDKARRALSEASVPMADAVSEALARTIGPAQREAMYGLLPTDSCPPDDA

SEQ ID NO: 8724 - protein, 256 aa, Streptomyces avermitilis
VTGSEVTPSFRLAYVPGVTPAKWVRIWNERLPDIPLTLIPVPAAEASDLLRDGGADAGFVRLPTDRTDLSAIPLYAETTVVVVPKDHLVAAVDEVSAEDLADDIVLHPLDDTLDWEHLPGRPAIERPATTADAVELVAAGVGLLLVPQSLARLHHRRDLTYRTVTDAPESRVALSWREDETTDLVEDFIGIVRGRTANSSRGRSQTPPEPKASKAKRSDASGARRKPAAGKTTGKSTRSGGGGAKPGKRGKPRRRS

SEQ ID NO: 8725 - protein, 135 aa, Streptomyces avermitilis
MTSHQTTQTMKPATAAKKLGVYLEATPAEFQEGVVSRSELNALQADPPEWLQELRRNGPHPRPVVAAKLGVSIAGLARGGVTDALTTEQIDALKQDQPEWLRKERATQAEVRKESARIKEQQEQKAKDAARGDRR

SEQ ID NO: 8726 - protein, 441 aa, Streptomyces avermitilis
VNDRTPEQPADTVARLRATFRTGRTKPVEWRTDQLDRLREMLTTHGADLAAALHADLGKSSTEAYRTEIDFTVREIDHTLSHLGTWLRPESAPVPPHLGDDATAWTQYDPLGVVLVIAPWNYPAQLLLTPMIGALAAGNAVVVKPSELAPATSAVLARLLPQYLDTDAVAVVEGGIPETTALLAERFDHIFYTGNGVVGRIVMRAAAEHLTPVTLELGGKSPVFVDRDADLAVVADRLARGKFLNAGQTCVAPDYVLTDPETGRALETELARAVSSLYGPEPETSGEYGRIVNERHFDRLSGLLDSGRVVTGGGSDRTAKYIAPTVLADVDPESPVMREEIFGPILPIVTVPGLDEAIDFINDRDKPLALYVFTASGTTRQRIAAETSSGGLGYGLPLAHLTVSDLPFGGVGESGMGNYHGRYSIETFSHRKAVLEKPLSV

SEQ ID NO: 8727 - protein, 154 aa, Streptomyces avermitilis
MRMRSRMPTPPPRRPHDLMQLLTRAERLAARHLQAVLDEDGCSLDAWRVLALLSDGEGHHMTAVAEAAFLPPATLTKLTDHLVDQNLVHRRVDPLDRRRILAYLTPRGRTYWRRLDREIRARWPVLSDGDDELLRALLDRLAGTLDGAAVESGL

SEQ ID NO: 8728 - protein, 370 aa, Streptomyces avermitilis
MFRHDPPAPDWFTVDDSVLRVALVFPLQGSAGIFGPTCELCARLAAEEVNRAGGVLGKELRLLPVDGGAPPREIADRVAALVDLGVVQGVTGWHISSVRQALAPRIAHRVPYVYTALYEGGEHTAGVFLTSETPRDQLRPAMRLLARERGVRRWFVIGNDYVWPRRTARAAHSYARECGGSIGGEVYLPLGTHDFEPVLRRIERSDADAVLMLLVGSDAVRFNRAFAAAGLDGRCLRLSTLMDENMLLASGPAATADLYSTAGFFASLANQDTLDFHGRYAARYGVEAPALGSLGESCYEGVLLLAALIGRAGTLEVSAIGAAADTVSYEGPRGLLRLRGGHVRQRIYLARADGLDFDVVAELDLHSSRP

SEQ ID NO: 8729 - protein, 433 aa, Streptomyces avermitilis
LSSGPSGSSRSSGSSGSSGSRILRRRFMAGTAALAAVVALSACGAKTDAGGSSDKAAQADVSGDTVKVGLLNSLSGTMAISEVTVRDSLKLAIDEINASGGVLGKKIKPISEDGASDWPTFAEKASKLIKEDRVAATFGCWTSASRKAVKPVFEKNKSLLFYPVQYEGLEESPYIFYTGATTNQQIVPALDYLKSQGKKKIYLVGSDYVFPRTANKIIKAYAKANGMTVLGEDYAPLGSTEFSTIANKVKAAKADAVFNTLNGDSNVAFFKEYKSAGLTAKSMPVVSVSIAEEEVKSIGSQYLAGQLTAWNYYQTTPGAANTKFVKAYKAKYGQGKPTSDPMEAAYTSVYLWKAMVEKAKSFDPEKVKAASDGITFDAPEGKVTVDGASQHIRKTARIGRIGTDGLIEQVWDSGKPIKPDPFLKGYSWASGLS

SEQ ID NO: 8730 - protein, 298 aa, Streptomyces avermitilis
MTVIFGQTFTGISIGAVLLLIALGLSLTFGQMNVINMAHGEFIMAGAYTTYVLQKSISSAGLSLLVALPVAFLVSGALGALLEWLLIRRLYLRPLDTLLVTWGVSLMLQQLARDIFGAPNVQTRAPELLTGNITVIGGDDPLTFANSRLFILGLAIAAVVALSLTLRLTPLGRRIRAVVQNRDLAEVSGISTGRVDRTAFFIGSGLAGVAGVALTLVGPIGPTMGTNVIIDAFLVIVVGGIGQLKGSVIVAFVLGVLQSVLEYSTTVSVAKVLVLVAIVAFLQWRPQGLYTLRTRSLV

SEQ ID NO: 8731 - protein, 369 aa, Streptomyces avermitilis
MTGSRTSFLKGRSTRAAAGFTGAAVALFAVAPLALSDFRLGLLAKYLCTAMVAVGICLAWGRGGLLTLGQGVFFGLGGYAMAMHLKIVDAGPGTIPDFMQLYGTATELPWWWRPFANPVFALAATVLLPMAVAAVLGSFIFRRRVKGAYFAILSQALAAAFAIWLVGQQATTGGTNGLTDIQGFFGYDLDDPVNQRMVYFVIAAALLLLIALARQLIHSRYGELLVAVRDSEERVRFLGYNPANVKLVAYVVAAGMAGLAGALFVPAVGIISPALIGIVPSIELVIGAAVGGRASLAGAVLGAIAVAWAKTALSEEFPAAWTYFQGLLFIVALAFLPGGLASLVGIARRRRASRVSADTAPVLPVGEAA

SEQ ID NO: 8732 - protein, 268 aa, Streptomyces avermitilis
MSELSDRAGLPGLEIRQLRVSFDGFTAVDGVDLDVRPGDLRFLIGPNGAGKTTLVDAVTGLVKADGSVRFGGAELLGRSVHRIARSGIGRTFQTATVFEELTVLQNLDIAAGAGRSVLTMLRRRTGVPESVARALETVGLTELADSPAGTLAHGQKQWLEIGMLLVQDVRLLLLDEPVAGMSHDERQSTGELLERISEERTVVVIEHDMDFMRSFARSVSVLHAGRVLSEGTVADVQADPKVQEVYLGHAPQESTTAEPAAGVAVQEA

SEQ ID NO: 8733 - protein, 231 aa, Streptomyces avermitilis
VMLEIDDVHVGYHRSTVLHGVCVEVPKDGVAAVLGHNGAGKSTLLRAAVGLLTPARGAVRLDGEDITRRKPHERVARGMAYVPQGQQAFPHLTTAENLQLVADGRRRGKAAIAEALDLFPALRALSNRRAGLLSGGQRQQLAIARALVTEPRILLLDEPTEGIQPSVVAEIEETILALAARGGLSVLLVEQHVGFAMRAAQRYCVLEAGRVTSFGAGGQEAERSVREALSV

SEQ ID NO: 8734 - protein, 396 aa, Streptomyces avermitilis
MAVGVEEVFRAEYGRAVAVLVRFLGDIDLAEEAVQDAFTTALRTWPESGVPPSPAGWIITTARNRAIDRLRRESTREARHAEAAQLYAPGTPAEEGPVRDDRLRLIFTCCHPALATQAQVALTLRLLGGLTTAQIARAFLVPEPTMAQRLVRAKAKIRDARIPYRIPRDADLPDRVRGVLAVVYLIFNEGYGGREDLCAEALRLGRLLAELMPDEPEVIGLLALMLLIEARRPARETPEGTLILLADQERGRWERGLIAEGQALVRRCLRRDQPGPYQIQAAINAVHSDAPTAAATDWRQILALYDQLMALAPSPVVALNRAVAVAETAGPQPALDLVDALDLDGYHAFHAVRADLLRRLGRGTEAVRAYEAAIARTDNAAERGYLERRRAELTPE

SEQ ID NO: 8735 - protein, 130 aa, Streptomyces avermitilis
VKDHPVGDHRGGHIMKHYLLSVMQPAGEPPAPEVLEGIMHNLDVFHAELREAGAWVFAGGLHGPETATVLRAEEGGDVLITDGPYTESKEYLGGICLIKAPDLDAALEWGRKATLATTLPIEVRPFMGEA

SEQ ID NO: 8736 - protein, 353 aa, Streptomyces avermitilis
MTTPPDPHPLVAGARRLAAEVLAPRAEQVDQEGVPASSIEAVKRSGLLGLSAPVEYGGSAAPAAVARETAEILAGACCSTWFVQTQHHTPVMTLAKSELPVREWLLGPLARGELLSGVAYAQLRAYPRVPVRVTRERGGWRFDGTVPWYTGWGLNDVMLLAGVTDTDEALFAFTEARAQPGLRPSPPMRLAALTAARTVSLELDGLWLPEEAVALRTPYETWAAADRPKNTNAGPAVFGITASALGLLADGDPAAQESARVLRGRLDEVRRHAYALADHPVPSERIEERLVVKTRAYDLMRAATTAAVVAGGGRAMDLGSPAQRLAREGMFLLVQGQTAEVRTAHLGSLAAPY

SEQ ID NO: 8737 - protein, 65 aa, Streptomyces avermitilis
VAVACAVTSDPTAGGAVAEPVRVRRLTDHEGQKLQQIVRRGSTSSVRYRRAMMLLASAGGGTGSG

SEQ ID NO: 8738 - protein, 347 aa, Streptomyces avermitilis
MSEMQWPCTDPRPDPSADAAGRHRIAVLALPGVPPFELGIPSRVFGSVLDAGSRPLYEVTVCTADGAPVLSDAGFTVQPAAGPEALAAADTVIVPPTHAMPELGRGGPLPPEVTAAIAGIRPGTRLVSICTGSYVLAAAGLLDGRPATTHWHLAPEFRRAYPRVKVDEEVLFVDDGDVLTSAGVAAGVDLCLHMIRRDHGAAAANRAARMCVVPPWRDGGQAQYIDRPVPEPTVATTTATRAWALEHLGEPLSLNRLAEHARMSLRSFTRRFRDEVGMTPVQWLTAQRLELAKQLLETTDLSIDLVAHRCGFGSANSLRAHMRTAFGVSPASYRRTFHTDDLVEAGV

SEQ ID NO: 8739 - protein, 308 aa, Streptomyces avermitilis
MRAVVVEQWGGPEVLVEREVARPEPGLNEVLVRVHAAGVNPVDFKTRASGALIEWGEVPAVGWDVSGTVEAVGPGVGMFRPGDEVYGMPLFPRQAGAYAEYVVAPARHLAPKPANLTHVQAAALPLAALTAWQALVDTAGVRAGERVLVHAAAGGVGHLAVQIAKARGAYVIGTASAGKHDLLRQLGADEVIDYRTVRFEDAVGDVDVVLDGLGGQNAERSLTVLRPGGRLITLPGPDDVPADVPGHVRAVWMLVEPDHLGLREIAALAERGALTPVVETVVPLAEAAKAHEIGEQGRTTGKIVLSVA

SEQ ID NO: 8740 - protein, 331 aa, Streptomyces avermitilis
MRAFVVTKYKEPLQEADVPEPTVGEHDVLVRVEAAGLNPLDEKIRAGEFKQILPYKLPLILGNDVAGTVISVGTAVRGFKPGDEVYARPHQDRIGTFAERIAIAEDDLALKPASISMEEAGSLPLAALTAWQALVERGKVRPGQKVLIHAGAGGVGSIAIQLAAHLGASVATTASGSNADFVRALGADTVIDYRSQDFEQLLTGYDLVLDSLGGENLEKSLRVLKPGGKAIGIAGPPDPAFAREAGLNPLLRLAVAGMSGKIRRQAKKLGVTYEFLFMRASGDQLRQITTLIDQGVVRPVVGKVVGFDQTPQALQSLSQGGIRGKAVIGSS

SEQ ID NO: 8741 - protein, 200 aa, Streptomyces avermitilis
MSVASQSVGRRERNKQEKLDRIVAAASELFAEHGVDEVTTQQIADQADIGTGTLFLYAKTKGELLLLVQNAKYVEALEQGRADAETVPGVLDAVLAILRPIVECNRIQIDNGRTYLREMVFGDPEEPRHGAALAIVAQTEEAVAAVLRRDERVAEGDAATLAHIVSAVMFLSMAASVNIALSVEEIVQDIRRQVDVLLPR

SEQ ID NO: 8742 - protein, 84 aa, Streptomyces avermitilis
MSITGWRAREFSSLFADLGEGLDDLGVPEGQPFLISPAGVYDVALNRYFSVWLAFAVEHPGRPCPGPAHVLRLPVVRARQAGLA

SEQ ID NO: 8743 - protein, 373 aa, Streptomyces avermitilis
VAEPVRVRRLTDHEGQKLQQIVHRGSTSSVRYRRAMMLLASAGGKRVPVIAQLVQADEDTVRDVIHAFNEKGLACLDPRWAGGRPRQLKSDEEDFVVQTATTCPVKLGQPFTRWSLRKLVAYLRKVHGRVIRIGREALRCLLARRGVTFQRTKTWKESPDPERETKLDRIEHVLDRFPDRVFAFDEFGPLGIRPIGGSCWAEQTRPDRLPATYHRTHGVRYFHGCYSVGDDRLWGVNRRKKGSGNTLAALKSIRAARPDGAPIYVILDNLSAHKGADIRRWAKKHKVELCFTPTYASWANPIEAHFGPLRQFTIANSHHPNHTVQTRALHSYLRWRNANARHCDVLAAERKERARIRSEKGTRWGGRPLTTAA

SEQ ID NO: 8744 - protein, 393 aa, Streptomyces avermitilis
VSLTFHWFLPTNGDSRHVVGGGHGTPATASGRDRPPTVAYLSQIARAAEDLGFVGALTPTGAWCEDAWLTTAMVSQQTERLKFLVAFRPGFVSPTLAAQMASTFQRQTGGRLLLNVVTGGESHEQRAYGDFLDKDARYRRTGEFLQIVRELWEGKTVDLAGEHLQVEDARLARVPDPVPEVYFGGSSPVAGEVAARYVDVYLTWGEPPAQVAEKIAWVRGLAAEQGRTLRFGIRLHVITRDTSEQAWAEAHRLLDGFDPETVKSVQAGLARSESEGQQRMLALHGGGLPQALDSARAGGTPTGLEIHPNLWAGIGLVRGGAGTALVGSHEEVAERIAEYHRLGIDEFVLSGYPHLEEAYWFGEGVLPRLAAQGLWQHPFAKPAAPAAQVPFAS

SEQ ID NO: 8745 - protein, 394 aa, Streptomyces avermitilis
MPAHVIADDAEALSVAAALADEFRAGASGRDAERRLPRAELDRLSASGLLAVTVPAEHGGADVRQETLAEIFRLLASADASLAQIPQNHFVYVNVIRRQGIEEQRKFFFAEVLAGRRFGNAQSEAGTRHVQDIRTRLAPRPDGSYLLTGVKHYSTGALFADWIPVLARAENDDLHVAYVPRDADGVTVVDDWDGMGQRTTASGTVRLEAVSVPADRVLPHHLTFQGPQLHGAVAQLLHAAIDAGIAAGALAEAAEFVRTKSRPWFESGAETAAEDPLLIQRFGELAIQVRASDALLVAAARAVDAARADLTDDSAAEASLAVAAAKVHTASTAVEVAGALFEVSGTRSALNSLNLHRHWRDARTHTLHDPARWKIQHIGRHVLNGTKPPRHGLL

SEQ ID NO: 8746 - protein, 184 aa, Streptomyces avermitilis
MATVLSVSGSPSVSSRTNRLLRHLDTRLVAQGHEVIPLDVRTIPAEALLGADFRHPAIVEATELFARVDGVVIGTPVYKAAYSGVLKALLDLLPQYALTGKTVLPLATGGTTAHVLAIDYALRPVLNSMGAAHIVQGWFTLDKDITAGEDGSLTVAPAAAEALTQVVDQFSAALGRTPLLAAAG

SEQ ID NO: 8747 - protein, 373 aa, Streptomyces avermitilis
MPAEPVRFAYWVPNVSGGLVTSRIEQRTDWGYDYNRELAVLAENNGFDYALSQVRYMASYGAEFQHESTSFSLALLLATQRLKVIAAVHPGLWHPGVLAKLGATADHLSNGRFAVNVVSGWFKGEFTALGEPWLEHDERYRRSEEFIRALRQIWTEDHTELAGDFYRLRDFSLKPKPLNTPERPHPEIFQGGNSTAARAMAGRVSDWYFSNGKDFDGVVEQIADVRNSAAQAGRTAPKFGLNGFLIARDTETEARETLREIVAQADTDAVEGFGAAVKQAGQSTGDGKGMWQDSSFEDLVQYNDGFRTGLIGTPEQIAERIVAYKRLGVDLLLLGFLHYHEEVEYFGRRVLPLVRELEAQLPESEAESVPVHA

SEQ ID NO: 8748 - protein, 306 aa, Streptomyces avermitilis
MRTEQLEYIAAVTRLGSLRRAAEELHLSQPALSETVRNLERELGVDLLERKRSGARMSAEGRELLPHIINVLDAVDRLRGAAGEQHRISRMVRLGTVNAATVPLLIPVVREFRAAHPLTQVEVVGAQQSEIHRSLLEGGFDLGLVNHLDGDDVAADFETTELLRGRPVVCVRPDSPLASRTTVSVSDLLAEPLIAMRSGYVMHRFVHRLLEGHSPSFSYSTDGAEMGKLMVAEGLGATVLPDFSVIDDPLERRGAITYRPLADDSTQVLLMLQRRRAESVPQAAQGLYETFVGRAEALGGTLTGRP

SEQ ID NO: 8749 - protein, 49 aa, Streptomyces avermitilis
VRRAARDPTRRPNAMRRAAPVSLSWARGGARPLGPGRQPTRRPGTATRP

SEQ ID NO: 8750 - protein, 524 aa, Streptomyces avermitilis
MRRRAHDAARGSREHMSSDDTRPGLRCLVTGATGYIGGRLVPELLAEGHQVRCLARSPRKLRDHPWAGDVDVMRGDVTHPESVGEAMRGIDVAYYLVHALGTGSDFEETDRKSARVFGEQAKAAGVQRIVYLGGLTPAGVPEKELSPHLRSRAEVGHILLDSDVPTTVLRAAVIIGSGSASFEMLRYLTERLPVMVTPSWVRTRIQPIGVRDVLRALVGSARMPADVNRAFDLGGPEVLTYLDMMRRYAAIAGLPRRLIVPVPVLTPRLSSHWIGLVTPVPRSIARPLTESLRHEVVCHEHDIARYVPDPPGRPIGFDDSVRLALQRVRDAQVTTRWSSASVPGAPSDPLPTDPDWAGGSLYTDRRELAVDASPEALWRVVEGIGGDNGWYSFPLAWAVRGWLDRLVGGVGLRRGRRDAARLRVGDSLDFWRVEEIEPGRLLRLRAEMRLPGLAWLEMYAEPGADGGSRYRQRALFHPHGLLGHAYWWSVSPFHAVVFGGMARNIARAAAKDATDRAGAHEPAG

SEQ ID NO: 8751 - protein, 457 aa, Streptomyces avermitilis
MNVSVVLFTSDLRLHDHPPLRAALDGARQVVPLFVRDRAVDGAGFAAPNRLAFLADCLRDLDAGLRERGGRLVLRSGDVVDQVCKVAAEADADEVHLAAGVSAYAHRREQRLRSALEADGRRLHVHETVITAVAPGAVTPSSSDHFAVFTPYFRHWEREHLRDALGAPRGVRVPESVGSERLPTRTELSGLSQGLAAGGEEEGRKRLMAWLRGGITAYEDRHDDLAGDATSHLSPHLHFGTLSPVELVHRARRTGGPGAEAFVRQLAWRDFHYQVLAARPDAATADYRGRGDRWRSEAAAREEVEAWRTGRTGYPVIDAAMRQLRHEGWMHNRGRLLTASFLTKTLYVDWRVGARHFLELLVDGDVANNQLNWQWMAGTGTDTRPNRVLNPVTQAKRYDPDGAYVRRWVPELEGLRGAAVHEPWKLKGLDRAAYDYPDPIVELADGLARFRHARGRD

SEQ ID NO: 8752 - protein, 417 aa, Streptomyces avermitilis
VITMSVIRDAPDVLVIGAGLAGLACARDLSEAGHTVRVLEACDGVGGRMRSDRHDGFVIDRGFQVFNTSYPQVRRRLTLRDLRLRPFTAGVLVHTNRGALRFGDPSRSPHTFSDLLPGRLAGPRDLAALGILTARDMLAPVRSLKRGADHTTRSALAGAGFSEEFVERFFRPFLSGVFLEDRLETSSRFFHLVWRSMLRGTLCLPTEGIGAVPRALADRLPSGTVRLGTPVGTLTDDGVALTDGTVLPAHAVVVATGPGPAASLLPGLDVPAYRVVTTYYHAAARPPLGEPTLLTDAGRRFLNTCVLSEVVPGYAPKGTALVATSVLGEDAEGREPLVRDALAEAYGIDTGRWDLLTARTIPDALPVMTPPQSLSRTSRVAPGRYVCGDHRATGSVQGALASGARAAREVLHDLDGR

SEQ ID NO: 8753 - protein, 347 aa, Streptomyces avermitilis
MSESTRAEGRPGGLRPGTAAVDDTGLTTGALARRLGVSPTTLRSWDRRYGVGPQIRADGRHRRWSPQDVAMLETMCRLTSAGVPPAEAARVAKEGGGSSSPTPAQPEAAGAPAVRVRSHAGGTLPLGDVRQECRGLARAAVRLDAPAVEDQLTSSVERHGLTVAWAEVMVPTLHAVGRKWESSGDRYVEVEHLLSWHISTALRRVLAPVRPGDRDAAGPVVLACVPGEQHTLPLEALNAGLIELGLPTRMFGAAVPVEALTAAVRRLGPAAVVLWAQARSTASLPLARHVAATQWGVKGARRHPLVMLGGQGWAGRSAQGMLRPPGLREALDALAATYEGAASGPRG

SEQ ID NO: 8754 - protein, 204 aa, Streptomyces avermitilis
MTAQPTTAHARATDVPLWVPVEESLADEELARGLMNGDEACLTAAYHRWSALVHTLARRTLGDVREAEDVTQQVFLGVWRGRAAYRPERGALGGWIVGITRRKIADALAARTRRRDLVTSAGSVMLLADGAGELPEAALDRVLVRHELAKLPAPQQQVLRLAFFEDLTQTQIARRTGWPLGTVKSHARRGLRQLRRCLQQEATA

SEQ ID NO: 8755 - protein, 339 aa, Streptomyces avermitilis
VERHTSVPARRLSWLRRLPALATGTGRATGPVLPSGAPAAPHGVTDVPKARVHGSWRVRRAALRRTPVSMWRDDVSDWAAALTYYAILALLPAMLMAVSLIGLVSPRVTDDLIAHVTAWAPAESGNTLHGSLRHLAGERSAALTVAIGGGVSALWSASSYLAVFRRALHAQHGIEDTRPALRTAPRILLTAVTLLALLFVSALLLVLSGSLLEALGRRAGLGGAGAAAWTLLRWPALLALVALLVLVLFRTGPREVRELRHALPGGMLAALLWLTASAGFTAYASGLGAYSKLYGSLAGVIVFLVWLWVSNLALLAGAQFTAELTRAERAAQAPRDRGR

SEQ ID NO: 8756 - protein, 290 aa, Streptomyces avermitilis
VSRANTRRRKGETTVRIHHLNCGSMRTIDTDAGSLPAVCHCLLVETDRDGLVLVESGIGTADVARPEQNLGADFLGRAQPVLDLAETALHQVTGLGFRPEGVRHIVLSHLDLDHAGGLSDFPWAKVHLTEAEHRAAMAAPGAHPEDRVRYRPAQWAHRPHWVTYPEAQGDPWFGFDAVRPLDGLDAEILLVPLGGHTRGHSAIAVRDTGRWLLHCGDAYYFHREIDPDDPRGHPGMDILQQITEVDRPLRLGNHARLRELVRRHGDEVEVFSAHDPWELARHVPLGSARP

SEQ ID NO: 8757 - protein, 199 aa, Streptomyces avermitilis
MSPRKSVAEAAATRDRIIERAFTLASAEGLEGLTIGRLATDLGMSKAGVIGHFGTKEALQLAVLEAAVDRFRQRVPGRAVGARPGTERLSRALHEWIDYMTESEGHGGCFLTSVASEFDGRPGPVRDAVLDALSRWTAYVTGELSTAVEAGRLPPLTDVDQLAFELNGVILAADQSIQLHRDPQAPDRARRAIGRLLKR

SEQ ID NO: 8758 - protein, 146 aa, Streptomyces avermitilis
MANVSHTRGDIASHPDVPEMRERYARMLGGRDVVLVDGPVFLLGLYCAASPWILHYTTSQPALATHNLIMGIAIGLLALGFTSTPERMYGLSWAMCAIGAWMIISPWIVGTSPDTGVVLNSIIIGVLTVVLGALCAVTTTRNTPRT

SEQ ID NO: 8759 - protein, 417 aa, Streptomyces avermitilis
MADHTVAVSRTVSAWVTSGADFLGVAGPFPVDVPWWSEAEQVVGELAGLLGVPVLVLRLLTVEGGDGGRDGHVTYHVEALGSPAPGTLRQLPVDDALLHGHESLRSPWARAEGLRELIDWASGTLRDAGRPVTGPVEQRRSWNLAGLFRLPTEDGRFWLKATAHFAADEGAVIAAFARVDPGLVPTVLGSGQGRILMEHVPGEDCWGASPETVTAATERLVAAQAALASTRPAALRDWRAPALAARIDVLLDGPVAPDLTPQELSAARALADRWALLAECGLPDTAVHGDFHPGNWRSDGGSPVVVDFADAYWGNPVFDGLRVHEFLPESARPAAARAWIAAWTRHSRGSDPARALAIAEPLAHLALAVRYQEFLDGIEPSERRYHEGDPAAEVRKALRCAEAPSPYLAPAASNADR

SEQ ID NO: 8760 - protein, 489 aa, Streptomyces avermitilis
MSGSPGSPPPEGGFVRRVGLFQATTINMSQMCGIGPFVTIPLMVAAFGGPQAVIGFVAGAVLALADGLVWAELGAAMPGSGGSYVYLRQAFQYRTGRLMPFLFVWTAMLFIPLIMSTGVVGFVQYLGYLAPDMGRTTGDLVGVGIIALVVMLLWRGIENIARITAVMWTVMIASVLLVIVAAASDFSAHLAFTYPAHAFEPTSGHFWVGFAAGLTIGIYDYLGYNTTAYMGAEIKDPGRTLPRSILFSILGIMAIYLLLQIGTLGVIDWHRMTDAGDIASTSVASAVLEKTWGKGAADTVTVLILITAFASVFTGLLGGSRVPYDAARDRVFFRPYAKLHSRHRFPMLGLATMGVITAIGFLIGRHTDLATLIQLLTTVMVIVQALAQIVALTVLRKRQPTLRRPYRMWLYPLPSVIALVGWLVIYGYADKNSPGRHPIEWSLAWVALGCVAFVVWARLEKVWPFGPREIAEEYLTAAAPDADAEPAQT

SEQ ID NO: 8761 - protein, 399 aa, Streptomyces avermitilis
MRENGAMPASDAADQPEQPWSRRRLRSTNERLLLDRLRATGAASRAQLARETGLSKPTVSSALAALEEAGLVHEVGTHAPERGRTAVLYAPDPAAGHALGIDIGRSWLRVAVANLDGEVVARADVRNRARTSGALADLVVATARQVVANSGVGHDEVAHAVVGTPGVYDEQRRRVRYAMHLPGWGRAGLFDRMREELGIPLEVHNDANLAALGEYTYGVGAGSRLFTYIMIGTGLGMGVVSEGRLFTGAHGGAGEIGFLPWPGQRKPETLEDAVSGVAVVESARRFGMSGQLTAKAVFDAARQGNPAAVRAVRLEGERIAHTVAAAAAVLDPDLVVLGGGVGHSLDLLLRPVRETLRTLTPLRPKIVPSRLGEDAVLLGAVATALGTARDVVFERRSAS

SEQ ID NO: 8762 - protein, 904 aa, Streptomyces avermitilis
VFHRPASVRRFVTTAVALGLLSTLSTGARAGARTHEPPPRPTTVSSTAGSTTALTGYAIQSTAKVTDPAAAVSSPGYPASGWYPAGARSTVLAALLAGGKYADPFYSTNQQKIPKADFQVPWWYRSDFTVADTSARTYLDFSGVISAADVFVNGRQIARSADVAGAYTRHELDVTSLVREGANTVAFRIQPNNPNKNLTMGWIDWLEPPPDQNMGIVRDVLVRRGGPVALRDAHVITRLDVPSLATADLTVKARARNDSDAAITATVSGSVGATSFRRSVALAAHETKTVTFTPADTPGLHLTSPRVWWPAGMGGQPLYALDLSASVSETVSDTVHESFGIRDVKAPLNSDGARQYSVNGRRLLIKGGGWSPDEFLRWDSTYVEDRLRYALDLGLNTIRLEGHIEPDEFFDLADRYGILTLPGWECCNKWEGNVNGSGSGDEWTAADYPVAKASMAAEAARLRDHPSVVSFLIGSDFAPDAKIEKTYLDALKAADWPTPVVAAASDKSSPVSGSSGMKMTGPYDWIPPNYWYAKREGGATGFNSETSAGPDIPTLDTLRRMMTPAELDTLWKNPGAKQYHRSPSSVFGTLKIYDAALAGRYGAPTGLTDYVRKAQLAQYENVRAQFEAYGRGATDASKPATGVIYWMFNSGWTSLHWQLLDRYLDQGGAYFGAKKANEPLHVQYSYDDRSVVVVNNRPAAVSGLTARVTLFNTDGTQKYDKSATGLSVAGDGAHSTALTLPSSVSGLSTTYLARLVLTDSAGKEVSRNVYWLSTRPDTLDWAHTDWYYTPTTSYADLKGLGSMARVPVSATASTTAGTDGASTTTVTVRNTGSGRTPSLFTDVHLVDSKGKPVLPVQWSDNEVSLWPGESATLTVTYRTADLHGSAPRVRVSGWNTAEQTVPAA

SEQ ID NO: 8763 - protein, 482 aa, Streptomyces avermitilis
MLGFRRSRPRLTTALAVFGLLATGAAVQASIAAPAHAATTHRVLFDNGHAETAGNADWIVSTSQPDPLGQDSSPSSETDWTGALSSWGVALQKTGNYSLKTLPSGSSLSYGGSTTTDLSNFDTLVLPEPNTLFTTAEKTAIMTFVKNGGGLFMVSDHTGADRNNDGYDAVEVLNDLMTDNSVDSTDPFGFSIDSLSVSSDYPSAISDSSDAVLHGSFGTVTKSLIASGTTATLKPADNSSVKGLLYRTGYSGNTGAFFATSTFGSGRVAFWGDSSPIDDGTGQSGNTLYDGWNDTGATNAALALNATEWLVGASSGGDDGGGGGTCTAAQLLGNNGFESGATTWTASSDVITNSSGESARTGSYYAWLDGYGSARTDTLSQSVTIPSGCTTATLSFYLHVDTAETTTSTAYDTLKAQVLNSGGTVLSTLATYSNLNAASGYTQRSFSLASYAGQTVTVKFTGTEGSTLQTSFVLDDTALTVS

SEQ ID NO: 8764 - protein, 87 aa, Streptomyces avermitilis
MEISGIISAIVIGIVIGILGRLVVPGRQRIGILLTILVGIVAALIGSAIAGAFDVADTNGVDWIEWLIQIGLAALGVAALDRTRARR

SEQ ID NO: 8765 - protein, 328 aa, Streptomyces avermitilis
VLPFPPRAKLQVNRRGGYVLRASPHRPPPCRHGETLPLRLTPLTDPEPKPSSRRLAWLASDDDGVPVGSAFLRLFTKEGQEHLAELEGAVHPEERRQGVGGRLLDAAVAAARGEGRRSLIAQAQEGSPGDRFLAARGFRRVLALTYARLPLADAGFDRIAKIVEQPHSGYELTRWDGTVPARLAQTFADSRRAMDDMPMEDTDYGTVAWDVERVVAAAAAIAERGELLHTVAAVDSTDGSIVGFSELVVPGDGRGDAQHYGTGVLPEHRGHGLGLWMKAESIRYARERHPELAGLLTDTADSNTPMIAINDSLGYRPTHTAVEYQLEL

SEQ ID NO: 8766 - protein, 257 aa, Streptomyces avermitilis
MDHAAVLALFDRDMREGARPDGPGARIERVPGVVRQVASEHGWNGVVWSGLDEASADAAIAEQQRYFAGLGREFEWKLYGHDLPEDLGRRLRAAGFTAAPEETLMVAEVADLTLDVEPPDGVRIVPVTDRAGVDLVADVHEKAFGTDSTRMRHQLLAQVTDDPDAVVAVVALAGDEPVSAARMELVPGTRFAGLWGGGTVEGERGRGIYRALVAHRAKVAADRGYRYVQVDATSQSRPVLARLGFEPLTTTTPYVSP

SEQ ID NO: 8767 - protein, 176 aa, Streptomyces avermitilis
MVFGVATVAGIWTVGALIDAHLRRTLLCALALIGATLLALGRYADRPAVLLISVALWGAAFGGAPTLIQTALVDASGPADADVATSLQTTVYNAGIAGGSLTGGLVLDGAGAGALPWTALPLVAAALTVVALGRRRGFPALRPSDDARSSGQGPSPARGCTPRSGNSRSPRPPPVS

SEQ ID NO: 8768 - protein, 283 aa, Streptomyces avermitilis
MMTSPGPDDLVVTQASLDDWPVVVGWAADEGWNPGLSDAPSFFAQDPEGFFVGRIAGEPVSAISVVNYGADYAFLGFYLVRPDLRGRGYGLTTWKTALAHAGDRTVGLDGVPAQQDNYRQSGFELAHRTARYTGTVPAAEPASGVRPAEAADLAAVAAYDSACSPADRPRFLEHWLAGPGHRTFVRLVDGRLTGYGVVRPALDSLRVGPLFADSAEDARALFTALTADAGEIAMDIPETNTAAVALAREAGLTPSFETARMYTGPVRPFAADRVYGITSLELG

SEQ ID NO: 8769 - protein, 226 aa, Streptomyces avermitilis
MKRVTRNGLIAAAAASGALAVVMPAYADSAADGSAAGSPGLLSGNTIQLPVHVPVNVCGNTANVVGFLNPAAGNACANEGHGSPSGGAADGGAAAPGASAQGSGKDSPGVVSGNSVQLPVHLPVNVSGNTVNVVGVGNAAVGNESTNTSGGRPHHPHHPGHARPKPAAPPKAPAPARPALPNTAARPGASLARTGADETVPAVAASAALLLGGAVLYRRFRAGARR

SEQ ID NO: 8770 - protein, 545 aa, Streptomyces avermitilis
VRAYLEAFMLSTHRRCAVAGAVVAAASTAALALLGAGLPSVVPAADEPDLSRFYAQKITWAACKGDGMPKDLQCGKVTVPLDYARPDAGTLDVALARYRATGKSRGSVLLNFGGPGAAGIGALAGDGNDFMGLTNGYDVVTFDPRGVGQSSPVSCGEGSTEAFAELDASLDTGDPQAALKQLRKVADECAKHSGPVLPYIGTINASRDMDVMRAALGDKKLNYLGFSYGTRLGAVYAAQFPKKVGRMALDGVDTLTEPLAEQGLVSAEGQQTALDSFITWCVKDIACPFGQDSRSARQQVVRLVQSLDQDPVPADFGQQLSGQDLVGAIGQALYSKQMWPTLEGALANLVQNGDASGVLRLASGGMAMPDLPRTGDRPSGRPSPGPSGGLVAPADVPVDNPSAALMAITCADTPDRPTAEQVTRDMDKLRAAYEEASPVFGRYRLTEVLICYGRPKGTDFIRDEVRAVDTPKMLLVGTRGDPATPYRWTLETAKRLGDSAVVLDNKGEGHTGYGSSRCASQKIDAFLLYGSLPANGSSCGPEADR

SEQ ID NO: 8771 - protein, 531 aa, Streptomyces avermitilis
MGFTRGVRRFLLLLFVALGAAGALVLSCAVSSWWWIAAGLLLPLTALGVWDLVQTRHSLLRNYPLLGHLRFLTEPPRPEPRRYFAEGHHEGRPYGRAVRSIVHERAEGVATEEPFGTERDVYAAGYEFLMPSLRPVEPPEDPPVVRVGGPDCTQPYDMALLNVSAMSFGSLSANAILALNKGAALGGFATDTGEGGLSEYHLRGGGDLIWEIGTGYFGCRTSDGGFDEREFADKVALPEVKCVSLKLSQGAKPGTGAVLPGVKVSAEIARARAVPVGETVVSPPCHRMFSTPRELVLFLARIRELAHGKPTGVKLCVGSRRQFLAVCKAMLAEGITPDFVVVDGAEGGTGAAPPEFAGRLGTPLTEGLVTVHNALAGTGLRDRVRIGASGKVATGADIVKRLLQGADYTNAARAMMFAVGCVQARRCHTNTCPVGVTTQDPRRVRALDVADKSERVHRFQRATVRSAARIMAAMGVRDPAGLAPGMLLRRTDSTTVLSYAELYEWLPPGVLLAQPPPSWEADWTAADPDSF

SEQ ID NO: 8772 - protein, 365 aa, Streptomyces avermitilis
MEHALSPSSLAELRRPRPYPAVSVLTPTHRREPDNAQDPVRLRNMLADAKKQLEADPAITRERRTDVSAQLDLALAEVDLAHAEDGLAIFAAPGEHQVWSLARSVPERVVLSDTFLTRNLVAAQAAERPFWVLSVSADRVTLWNGGAGRVAKERTGGFPMARSLEAPNAERKERVGDLPSTFRDERTRHFLRDADIAMSAVLRAHPRPLYVTGEQAALSLLDEIGSVTKDAAHVPHGGLAHAGPDAVWAAVRPLIDAEDRKNVDTVIRDLETARGRKDFAAGVDEVWQNAGDGRIRLLAVEENYRVTVRDNGGDHLVPAASDDLDAREDIVDEIVEQCLETGAEVRFVPDGSLGEARGIAGVLRY

SEQ ID NO: 8773 - protein, 343 aa, Streptomyces avermitilis
VSQLLGVAVLGAGHMGADHIRRLDSVVSGARVAAVADPAKERAEEAVAGLDGVLVHTEVAAALDAPGVEAVLIASPGPAHEEALLAAFARGLPVLCEKPMVPDSAGALRIVEAEARLGRRLAQVGFMRRYDAEYMGLKSLLDSGRLGRPLMLHCTHRNVSSPPGFTSAMLINSSVSHEIDAARWLLGQELTAVTVLRPRPSAHAPEGLLDPQFVLFETAGGALVDVEILVNSGFGYQVRCEAVCEAGSVRIGDAHTMVVTSAGGAYQEVAQDYLVRFADAYDREVREWVDATRRGQVTGPSAWDGYAASVVAEAGVRAQDTGDRMTVELAPRPDLYGQNPISR

SEQ ID NO: 8774 - protein, 489 aa, Streptomyces avermitilis
MPSHLSADRPAAQPPPRGTVDALISQTRRLRGDVDAVRRDAPADGTDPQGRWQRALCDLAVHQLNDLDAHLAQLRDGPQPAPAAPSTAGPAERAVPTAPRSGSLLSRVGSAEWNLLTDEATWSGELYQILGRDPAAPPLTLDELPSFVHDEDRPRLTAMVTDCLIDAKPIDGEFRIVRPDGGVRTVHMMGEPVLDAHGSTASMWAVLRDVSELHRSQRTVSETHDSLQHQRHLAQTEHRLAVELQESVLPPWRASLRLPHQGPETLDLAAHYLPSSSSALIGGNWYDALELPDTQMLLSVGDLTGHGVAVTSGMAMLLGTLRGLAMAGTQPGQLMQWLNGLLDASVQPALGSAVCCRYQPETRVLTWAQAGHPAPLLFRNGTGRLLAAPDGVLLGATSGAAYGQAEETLQAGDLLLLHTDGLVPRRWADPRSSEAESGGGTAAVQRLLDLAPRFDGVRTAQHCVRTVVEEFGETEREDDACVLVARVVS

SEQ ID NO: 8775 - protein, 498 aa, Streptomyces avermitilis
VSGQPNTRLSDLFGLAGWSKGELARLVNRQAAAMGHPQLATDTSRVRRWIDTGEIPRDPVPRVLAALFTERLGRVVTIEDLGLARHGRMGRRQSDGSVEHPDGMPWAPDRTAAVLTEFTGMDLMLNRRGLVGAGVALTTGSALSSAMHDWLHTDPTLAADAPELDDPLHADPAGFDRYEAAPIGSQEIEELERSVEVFRAWDAARGGGLQRKAVVGQLNEVGGMLSYRHPDHLQRRLWGVAANLAVLAGWMSHDVGLEPTAQKYFVIAAHAAREGGDRPRAGEALSRAARQMVHLGRPGEALDLMKLAKSGSGDEVLPRTQAMLYTIEAWAQAAMGKGQAMRRTLGEAEDLFVSDRGDVPPPSWMQMFDEADLHGMQALAYRTLAEHEPGAAIMAQRHAKEALHLRESGRDRSKIFDHISLASACFIADDPEQADRYARLALTSMGSNSSQRTWDRLREMYRLTAEYSSYPKIQDLREEIKLSLPKNSSKFRGGSARA

SEQ ID NO: 8776 - protein, 380 aa, Streptomyces avermitilis
MYTASSSVSAPPRSLHPRQPGSSGPYLDPARPAAPLLGAGRSRRVPGLGTQPLSGRIDLSGPQGAQLRTAIASVHRICPEFTPVQVLRRSGRSVLLVGTTGRSTAVAKCLLDHSPIWAERIRHEIAAYRSFVRHRPPVRVPRLIAADPDNCTLVIERMPGRVAALQRHPAEAPPRADIRAALGALCRVNAWRPPAGTFDAPLNYAERISRFHELGLLTDRDMGDLQKLMHGIAHSAGRQGMGQFCHGDALLSNILLSPAGPVLVDWEHAGWYLPGYDLATLWAVLGDAPVARRQISQLAQSAGPAARDAFLVNLMLVLTREIRTYETAVQRSMHDVTPAAPGQAHPAAAPSGEEQRLLLRRLHDDCQMARRAVRAAVGTR

SEQ ID NO: 8777 - protein, 659 aa, Streptomyces avermitilis
LRGSATDPRSTVGHRRARGAAGAVASAALLLPLLGAAPSPGAAPDSSAELQRAFATASADHQVPQSVLLGVSYLQSRWDTHAGAPSVSGGYGPMHLTDARSAIAGAPHHSAGTEDARGDEARTALLPTTEVPENSQLPARLKTLPKAAELTGIPAERLRTDAAANIEGGAALLAAAQKKLGEPLSGDAADWYGAVAVFSGADDTATAAAYARDVYDVIREGARRTTDAGQSVTLAAEPGSAPDTAQLGRAGLRSVSADGTECPKSLACEWIPAPYEEFGDNDYGNHDLGDRPASQSIRYLVIHDTEGRWDGVINLVQDPTYVSWNYTLRSTDGHVAQHVKAKDVAWHAGNWYINAKSIGLEHEGFLASPDAWYTEAMYRSSARLVKYLARKYGIPLDRQHVLGHDNVPGPTTATIPGMHTDPGPYWDWRHYFRLLGRPFHATAGRGGGLVTVLPDFTANQPVYTGCVTAGLPCASHGSSEVRLYSGPDETAPLIKDIGLRPKGDDSTIDVNDVGSRVSTGQRYAVADRAGDWTAIWYLGQKAWFKNPKKQPTAVNASGLVVTPRAGLTDIPVYGRAYPEKEAYPAGVPAQSVSPLPYKLLEGQKYAIGDEVPGEYYYAVTFDTPSHKVVTGTDRYYEIQFGHRVAFVRAADVQVVSSRS

SEQ ID NO: 8778 - protein, 165 aa, Streptomyces avermitilis
MSFLRRRSATPAGPDFDVLAMDPGDWPGNLGAGLLPAPDGSCQGVFLRYDLFGGRGPAMIIGNLPEGSPARDVAESEVPFEVAQLLIALENEEEVTVVGTEDMPVMQGDNLLIVRRLKLSEGRISCVQFDRSDKVLVTIAAWDRPITDDLYALLKPLPAELFQQG

SEQ ID NO: 8779 - protein, 86 aa, Streptomyces avermitilis
VVGDRVAGPSARDASRPAVMRSRAGCPKPQGRLPEPVMPQTASHRIGGEQRAEPVRIPGVGQVPMRGEQFGDRRGSSKPGARRILL

SEQ ID NO: 8780 - protein, 80 aa, Streptomyces avermitilis
VAESTIKEHPLAGWDKPELDLSKAEWQSSSRGRGDVQIAFVEGFIAMRNSGRPESPSLIFTPAEWGAFVSGAREGEFDLT

SEQ ID NO: 8781 - protein, 388 aa, Streptomyces avermitilis
MSKEPVAVVGIGQTRHVAARRDVSIAGLVREAAQRALLDAELTWADIDAVVIGKAPDFFEGVMMPELYLADALGAVGKPMLRVHTAGSVGGSTALVATNLIAGRVHGTVLTLAYEKQSESNAMWGLSLPIPFQQPLLAGAGGFFAPHVRAYMRRSGAPDTVGSLVAYKDRRNALKNPYAHLHEHDITLEKVQASPMLWDPIRYSETCPSSDGACAMILTDRAGAARSPRPPAWLHGGAMRSEPTLFAGKDAVSPQAGKDCAADVYRQAGITDPRREIDAVEMYVPFSWYEPMWLENLGFADEGEGWKLTESGVTELDGDLPVNMSGGVLSTNPIGASGMIRFAEAALQVRGQAGEHQVEGARRVLGHAYGGGSQFFSMWLVGAEPPVL

SEQ ID NO: 8782 - protein, 349 aa, Streptomyces avermitilis
VTREIAVVAFGQTDHRRTSDELSEVEMLIPVLHDVLGQAGLKTGDIGFTCSGSTDYLAGRAFSFTMALDGVGAWPPISESHVEMDGAWALYEAWTKLLTGDADTALVYAYGKSSPGSVRDVLTRQLDPYYVAPLWPDSVALAALQAQALIDAGHADEPALAGVAARSRASAATNSHAQLSGSVPQGDYVVRPLRTGDCPPVGDGAAAVVLAAGDRARRLCARPAWIRGIDHRIEAHALGVRDLTDSPSTRLAAEKAGVFERPVDTAELYAPFTSQEVVLRRALRLDDRVTVNPSGGALAANPIMAAGLIRIGEAAARIHRGESDRALAHATSGPCLQQNLVALLEGDPR

SEQ ID NO: 8783 - protein, 306 aa, Streptomyces avermitilis
VEFPFTRSLGPVQSAFLTGLRERVLLGVKTGDGRTLVPPVEYDPVTAEEIHDLVEVAPTGTVTTWAWNHAPRRGQPLDTPFAWVLVRLDGADTALLHALDAAGPDAVHSGLRVRVRWAAQRSGAITDIACFEPYDSGDDAAAEPTGHDGRFADPVTGIVAPARLDYVYSPGRAQSAHLDALAEQRTVGERCPSCRKVYVPPRGACPTCGVATSEAVEVGPRGTVTTYCIVNIKAKNLDIEVPYVYAHIALDGADLALHGRIGGIPYDQVRMGLRVEPVWTDGGRHPDHYRPTGEPDADYETYKELL

SEQ ID NO: 8784 - protein, 258 aa, Streptomyces avermitilis
VRREGATLVLTLNRPEARNALSLPMLVGLYDGWVEADEDDAVRSVVLTGAGGAFCAGMDLKALAGQGMEGQQYRDRLQADPDLHWKAMLRHHRPRKPVIAAVEGPCVAGGTEILQGTDIRVAGESATFGLFEVRRGLFPIGGSTVRLQRQIPRTHALEMLLTGRPYPAREAAGIGLVGHVVPDGTALAAALEIAGRINACGPLAVEAVKASVYETAEMTETDGLAAELKRGWPVFDTADAKEGARAFAEKRPPVYRRT

SEQ ID NO: 8785 - protein, 584 aa, Streptomyces avermitilis
VRDQYKSFLTDSQISCPGALPSCVGLCSDDRRADGCQACPGSGGAVEYNLADLFESVVDVVPDREALVYLDHPGTGAERRLGYAELDAAANRVAHHLIDSGIRPGEHLGLHLYNGVEYLQTVLGCLKARIVPVNVNYRYVEEELVYLYRDADLVALVFDAEFTERVAAALPQTEKLRHLVRVGTPTSGAGPLPVVEFADAEAAGSPGRGFPARSADDQFIIYTGGTTGMPKGVMWRQEDLFFSGLGGGAPTGEPVKTPEELAERVAAGGEGITFFPAPPLMHGTSTLTAFIGFNFGQRVVIHRKFVPEEVLRTIEKERVTSMSLVGDAMLRPLIDALSGPMKGTDCSSMFSVSSSGAIMSETVRAQFQALVPNVMLLNNFGSSESGFNGTATPDSGPDRGFRIRVNSRTQVVDPATHEPVAVGEPGRIAQRGHVPLGYYNDPKKTAETFFRKGDERWVLLGDMATVDEAGVVTVLGRGSQCINTGGEKVYPEEVEQALKSHPDVYDVLVAGVPDTTWGSHVAAVVQLREGAGRPSLEEIQTHCRTRLAGYKIPRQLVITSTIQRSPSGKADYRWARSVAAEADR

SEQ ID NO: 8786 - protein, 257 aa, Streptomyces avermitilis
VAHLSDPHLTTGLLAVDRVAAFSRALRCVLALDPRPACVVVTGDLVDRGEAEEYEVLREVIARFPLPVHLVPGNHDDPGTLLEAFGGGPHTGGARAFPYAVEYPNATVVVLSSTVPGAPSGRLGDEQLDRLEELLSRRPEVPAFVCLHHPPVDIGIPYLDGMNLADADAFGEVIGRHPQVVRVLAGHVHRAVTGEFAGSTMVTAPSTYLQSNLNLRVGGPVGYVDEPTAFLLHHLTGTGCVTHTAQVSHAGGLIGGY

SEQ ID NO: 8787 - protein, 350 aa, Streptomyces avermitilis
MDPLSSSDPARLASEQRRLRLQVLGLNTVEAEATFDRIARLAASFTQSPLAMVNFINDERQMFRGMYVPSGSPDDKVSPESGGIAFDLSNLSREAPGDYGFCPHVVAQGSQLALDDVFDYPRFKGNPLVNDLGVRSYLGTPLRDNTGMILGTVCVADMKPRTWDRGLREGMQELTETLLSDFKLRDSLLAQQQELFAVFDGAPFPIMLTEGPDHLLRYANGKQGSAFGLVPQFSPGRHVLPGLEAIGVFGAMDDAFHTGQAATLARASIQTYDSHTLQDFNFLCTPVRTSPAAPISGVLTVAMNTTGQDFAGSEQRAFAANVQERFERLGAGGLPGGMPGQRAESAGYRG

SEQ ID NO: 8788 - protein, 668 aa, Streptomyces avermitilis
MRQGQLRHRVRTVAKDRKGLLMNRSDVDARSVAVIGMACRLPGASGTDELWALLRDGVDATSETPPERYDVDALHSVAPGPGGIASRRAGYVGQVADFDAEFFGMSANEAVELDPQQRLLLMTAWEALEDAGRRPDLLAGTRTGVFVGNARADYLELALRQGPEAATASQLNNFRSLLPARLSHFFDFRGPSIVVDTACSSSLVAVHQAVQSLRAGESPLALAAGVNITLRPDEGLVMTQADAMAADGRSKFGDAHADGHAPSDAVAVVVLKRLADALADGDRIRAVIQGSAVGNDGRTSDTVLNPSLTGQLEVLRWAYEDAGVNPADVDYVEAHGSGSPALDPLELGALGRVLGEGRPADRPLLVGSVKTNIGHAEAAGGLAGLIKTVLCLEHGQIPASLHLDTPNPQVAWDELPLVVPGKLLDLPELDRPAVAGVCGQGSSALNAHVVIRQADPAWSASAPPGRAKPYVLALSARSAAALEALARSYADHLGPDGAGTAYALRDICFSAATRRQHHEHRLAVIGSTHAEIAAALTGSPGLGGRPLSAVAERYRRGEDVDWGKVFGRSGRFVPLPHYPWQTKRYWPGEEHAQDGGDLASWVLREHARTGFDDGSTLTEIGIDSLAKLRIVVELTKRSSQDVDPEEFGRLRTVGELRRWTRSLEAAAR

SEQ ID NO: 8789 - protein, 515 aa, Streptomyces avermitilis
MSDPQNLYAWFARSAAAYGDECTALEIGDDRLSYGALRDLAERLAGRLVAAAGGTPPRRVGLLASRSVTAYAGYLAVLRAGATVVPLNPEHPSARTRDIVEAAGLELVLADAPAAGADLGVPVLVAGPEELAALAALVDEPVPELPDARTGPDDIAYIIFTSGSTGAPKGVPILHRNICAYLGQVAPRYDIEPGSRLSQSFELTFDGSVHDLFVAWAGGGTLVVPMRSQLLSPVKTINSLRLTHWFSVPSLISFASRLGTLEPGSLPTLRWSIFGGEPLTLAAAREWRAAAPDSRLEVLYGPTELTISCTAYRFPDDLADWPKTPNGTAPIGTCYPFLDLLLLDADDRPSDSGELYVRGPLRFPGYLDPANNAGRFLTSAQHPATEEPLTDRHWYRTGDRVAMRDGHLVHLGRTDHQVKIRGHRIELGEIEAMLRQQPGVRDAIVLAVPASDGEPELEAAVSGTGCVPDRLYSALGDRLPPYMLPRRIAVLDQLPLNPNGKIDRRALLAELGRSR

SEQ ID NO: 8790 - protein, 394 aa, Streptomyces avermitilis
MFDAIVVGARCAGASTAMLLARSGYRVLLLDRSAAGSDTLSTHLVHQPGVAALARWGLLENVRASGCPPLDRAVYEVADIHLEGCARGVEGQRASYAPRRHVLDAILVDAAVAAGVEFRDRCQVTGLLRDGTGRVVGVEGRHGGRSFTERARLVIGADGMRSTVARLVEAPYTVTDPRLTCAYYTYWPDVPATLELYERTGSWVAAVATNDAATLVLAYFPQVRFEEVRTDARGAYLEQIRTTAPALHERLRGKEPAERLRGTGDQQNFFRQATGPGWVLVGDSGHHKDSITARGISDAFLQVDTLVRHVDGPLGGDPVRLDAALEKFAEERDSALTPGYESTLAVARLAPHEQRLSLLRAVQTDPELTAIYFDMVAGIGSAGALYTPKLLALL

SEQ ID NO: 8791 - protein, 888 aa, Streptomyces avermitilis
VPAVCLTGLWGYTAAGLVDEQLQLHSDADRASSVARPAQDVLSRLQTERRLTAVWQASRTKTARTELDGARDETDAAVAAFRRSSSSALDTSSLQRRTRLFDEALDTLSGRREAIDGRTLSTGDTFELYTDTVSRGIGVLTAAVHSDDGRLARGGNATVSLAHITEMLSREDALISGALPSRRMTATTRAQFGQYLAIQREFRAGLDIHDLPAGAAATYTQLTDSAKWTTLGTVEKSVTTGRGTGLPGQASSWPTATEPVVGGLQSLGADSADGLSDLAADHADDLLLGMLLGTAATLAALAGGAVLALRARRSTLGRVSELQAHVEQLSGSWLPQLLARIQNGERVEPATLAPHGEQATDELERLAAAIDQLGRVAGDTAVRQSLGREGTEKVFAQLIRRTQILIHRLISLLDDLERKHEDSDLLKDIFKVDHLATRVRRHAENLVILSGSPPSRRLTAPVSITDVMRGAVAETEQYTRVKVKNLPADRRLALAGRAVADVTHLLAELIENGTSFSPPDTQVFVSATKVAKGLAVHVEDHGLGMPQDLRDHANDLLAHPPRLDMTALGEDPRLGHFVVARLAERHKIKVELRESVYGGTLVIVLLPAALLEEVASPVLDQLKSAAVAANRAVAAEASRAVAGTDDFAVVGAEGMPLVGSAIGSAGHSLDAGVTIGGVDALTHTRLPDHSGFPEYGGAGLLPAASDHPAPAPGPNASWAPPREHPAPQGHRTEPGGLGPQAGQPAHPGAHAGHHGSRAGFTEPQSGFTEPRSGPPSRHEPGAGSGGPAPAREEAPARSAARPLTTPQVLPQRTRGASLAQQLRREAEQAQGRPDGEGDKGVISPDASARAMIAIQQGLKRARMSETDEPTGADGRQQTDPRDPGAHQL

SEQ ID NO: 8792 - protein, 149 aa, Streptomyces avermitilis
VRKRYVMTEQVQSGPRLDWLLDGLVDRIPEIRCAIVLSGDGLLIGKSKNLRRDDAEHLSAVGSGMHSLARGAARHFHGGEVQQTVIQMDRAFLFVTAAGRGARLAAIASEQVDVGMMAFEMGTLVKQVGQYLSAAPRVETPSAGHIQDA

SEQ ID NO: 8793 - protein, 124 aa, Streptomyces avermitilis
MPEPRWLDDAEAGRHLRPYAITGGRTRHSQHTFTLITLVVARSAHEFDHDHLEPESVQILELCRDRAVAVAEIAAHLDLPVSVVKILCGDLLNASLVIVQAPPGQEDQPSVELIERVMDGIRQL

SEQ ID NO: 8794 - protein, 199 aa, Streptomyces avermitilis
MVSVSSEPVMPTALKILIAGGFGVGKTTMVGSVSEVPPLETEERMTAVSLGVDDLSGVEGKKSTTVAMDFGRITIAPELVLYLFGTPGQDRFWFMWDDLATGALAAIVLADTRRLDASFASIDFFEARDIPFAVGVNCFDGRRDCSAEQVRTALDLDPSTPVLLCDVRDRGSSKSVLLAVLEAARAQAAARLAPLGGGQ

SEQ ID NO: 8795 - protein, 278 aa, Streptomyces avermitilis
MPNFSAPDGTELAYHTRGEGEPLVVLPGGAMRASAYLGDLGGLGARRRLVLLDLRGTGDSAEPADPATYRCDRLVDDVEALRVHLGLERMDVLAHSAGGNLAMLYAARYPERIARLALITATPWAVGMGVRGEDRLAAARLRKGEPWFEAAFPAFEAWLAESGDWDPVFEPFFYGRWDDAARAHAAGGEEQTNDEAGDRYGSAGAYDPPATRAALAGLTAPVLVYAGELDGGPRPELARRVADVFPAAEFAVQPGGGHYPWLDDPGWFTARVEAFLAR

SEQ ID NO: 8796 - protein, 431 aa, Streptomyces avermitilis
MADARDLLDEGERLDPDGLRTLQLERLRASLRHAYAHVPFYRESFDKAGVRPDDCRTLDDLARFPFTVKADLRENYPYGMFAVPQDRIRRIHASSGTTGRPTVVGYTENDLSMWSDMVARSIRAAGGRPGDKVHVAYGYGLFTGGLGAHYGAERLGCTVIPASGGMTARQVQLIQDLKPEIIMVTPSYMLTLLDEFERQGVDPRGTSLRVGIFGAEPWTEEMRREIEERFAIDAVDIYGLSEVIGPGVAQECVETKDGLHVWEDHFFPEVVDPITGEVLPDGAEGELVFTSLTKEAMPVIRYRTRDLTRLLPGTARVFRRMEKITGRSDDMVILRGVNLFPTQIEEIVLRTPGVAPHFQLRLTREGRLDSLTVRAEARAGATPEQRDAAAGVIAAAVKDGIGVSVAVEIVEPESLERSVGKIRRIVDLRPR

SEQ ID NO: 8797 - protein, 499 aa, Streptomyces avermitilis
MTAGPSVTVDGVLRRSARRTPARRAIHYRDRSWTYAELDEAVSRAARALRETGLAPGDRVGAYGHNSDAYLIGFLACARAGLVHVPVNQNLTGDDLAYIVDQSGATLVLTDPDLAGNLADGVRTLALRDADDSLLTRLATTAQYDGAEPRGEDLAQLLYTSGTTALPKGAMMTHRALVQEYLSAIAALDLSAGDRPVHSLPLYHSAQMHVFLLPYLAVGAENVILDAPDAEQIFDLVEAGRADSLFAPPTVWIGLSNRPDFATRDLSGLRKAYYGASIMPVPVLERLKERLPELAFYNCFGQSEIGPLSMVLGPDEHKRRMDSCGRPVLFVEARVVDESGKEVADGEQGEIVYRSSQLCEGYWDKPEETAEAFRDGWFRSGDLAVRDAAGYFTVVDRVKDVINSGGVLVASRQVEDALYTHEGVAEAAVIGLPDERWIEAVTAVVVARGEVTEAELLAHAREKLAHFKAPKRVLFVDELPRNASGKILKRELRDRFAEA

SEQ ID NO: 8798 - protein, 516 aa, Streptomyces avermitilis
VSVPPNGFWSQAAADPERTVLIAPDGEEWTAGRLHASVNRLVHGLRAAGLERGDAFAVVLPNGVEFFTAYLAASQAGLYLVPVNHHLVGPEIAWIVADSGAKVLIAHERFADSARHAADEAKLPAEQRYAVGAIDGFRPYAELLDGQPGSAPADRTLGWVMNYTSGTTGRPRGIRRPLPGKLPEETYLGGFLGIFGIKPFEGNVHLVCSPLYHTAVLQFAGASLHIGHRLVLMDKWTPEEMLRLIDTHRCTHTHMVPTQFHRLLALPEEVKGRYDVSSMRHAIHGAAPCPDHVKRAMITWWGDSVEEYYAASEGGGAFATAEDWLKKPGTVGKAWPISELAIFDDEGNRLPAGELGTVYMKMSTGGFSYHKDEAKTKKNRIGDFFTVGDLGCLDEEGYLFLRDRKIDMIISGGVNIYPAEIEAALLAHPAVADAAAFGIPHDDWGEEVKAVVEPAPGHDPGPALAADILGHCEQRLAGYKRPKSVDFIETMPRDPNGKLYKRRLRDPYWEGRTRKV

SEQ ID NO: 8799 - protein, 369 aa, Streptomyces avermitilis
MQTELSKRLGVEHAIFGFTPFPAVAAAISRAGGFGVLGAVRYTAPDDLKRDLDWLEANVDGKPYGLDVVMPAKKVEGVTEADVEAMIPEGHRQYVRDTLAKYGVPELAEGEVSGWRITGWMERVARTQLDVAFDYPIKLLANALGSPPGDVVERAHGQGVLVAALAGSARHARKHAEAGIDVVVAQGYEAGGHTGDIASMVLTPEVVDAVDPLPVLAAGGIGSGRQVAAALSLGAQGVWLGSLWLTTTEAELPSPALIRKLLAAGSGDTVRSRALTGKPARQLRTEWTDAWDDPNGPGTLPMPLQGLLVAEAVSRIQKYEVEPLLGTPVGQIVGRMNSERSVQAVFDDLTRGFERAVDRVNRIAGRSQQ

SEQ ID NO: 8800 - protein, 615 aa, Streptomyces avermitilis
MTEDTADSGTGGRGPTRRHLVRRALALGGALAVAPFPAGPAKAVPPPRHPHRTLRHGSPERAGLLPDHLRGLVTDAESFLGPSPTHPWYAGAVLLAGRGDTVALHQPIGTAVRYSAYDAKTDTGVEFPAERQIPMATDTVFDLASVSKLFTSLLAVQQLERGALELEARVASYLPDFAGAGKQDVTIRQLLTHTSGFRAWLPLYKAPSRAEKLRLIWNEAPLSPPGTKYLYSDLNLISLQLVLEEITGHPLDALLRDEITAPLGLRSTRYNPPAAWKPRIAATEDARPPWSGLDRGLVWGEVHDENAFGFGGVAGHAGVFSCAWDLAVLGRTLLNGGTYGHTRILAPESVELLFTDFNTAFPGDEHGLGFELYQHWYMGAMATPRTAGHTGFTGTSLVLDPTTDSFLIVLGNSVHPVRTWRSGSAPRAAAGNHLARAVQVRPARGRTSWFSGMATAASATLTLPELDTAGTADTAETTGTADSTTADSGGRLRCALWWDTEPRSDTLFLEASADDGASWQPVPFTTACDGEEAREHPTGSVTGWSGRVWHRLHADLPRARRLTLRWRYTTDRLYVGRGAYVDAVRVESGGRVLFDEARPTDAARIEAAGWTPSEN

SEQ ID NO: 8801 - protein, 170 aa, Streptomyces avermitilis
LSIFVVPTGDVPQMAHRDGHEPSFTPWRRTGVTGLLEDDSGRVTGVRYVDEHGSPGELAADLTVACDGRDSSVRRAAGLEPSYFEVPMDVWQVRVPARDPLKEGRVSLTVRDGQFAATLDRGDYYQTSYLIKKGTDGALRPMASSGSATGSASCSAGTVRRRTPSAPGTT

SEQ ID NO: 8802 - protein, 211 aa, Streptomyces avermitilis
VAMSSRRGDRTPTFTEQARRRQIIECTIDLISTQGYPATSLSAIAEAAGLSKAAILYHFSSKDNLTKATFAYVLEQFRAFVTERVLVASDPRAAVVAYVRAMVGYQQANRRHVRVITEMLLGDGGGTRLKEPGGHDTGGRWEELAALLTTGQKAGDFREFDAQVTSLAIGGAIDGVVAHWLSHPELDLDAAADELETFTLNAIECRTPRRR

SEQ ID NO: 8803 - protein, 533 aa, Streptomyces avermitilis
VLPRTMAADEGHVPGRFDAVIVGGGHNGLVAAAYLARAGRSVLVLERLGNTGGAAVSTRPFAGVDARLSRYSYLVSLLPRKIVRDLGLDFRVRGRTVSSYTPAERHGRPTGLLVGGGERRTREAFGRLTGSAREYESWQRFYGMTGRVARQVFPTLTEPLPSRDELRRRVDDEDAWRVLFEEPIGAAIEENFTDDLVRGVVLTDALIGTFADAHDPSLRQNRCFLYHIIGGGTGAWDVPVGGMGALTDALAAAARDAGAVLATGHEAVRIETDGRSAEVTYRDADGEGTVSARHVLVNAAPQELARLTGDSPPVPAEGAQLKVNMLLKRLPALRDTAVDPREAFAGTFHIAEGYEQLAAAHAQAAAGSLPEAPPSEIYCHSLTDPTILGPDLVEQGYQTLTLFGLHTPARLFERDNEGVREELLKSTLAQLDAHLAEPLVDCLATDAEGRPCIEAKSPLDLERDLRLPGGNIFHRDLAFPYAQEGTGRWGVETAHANVLLCGAGAVRGGGVSGVPGHNAAMAALEDVGERALG

SEQ ID NO: 8804 - protein, 754 aa, Streptomyces avermitilis
MADTRLVQGRYRLLDLIGRGGMGEVWRARDESLGRQVAVKCLKPLSTHHDQSFTRVLRERFRREARVAAALQHRGVTVVHDFGESDGVLFLVMELLEGRNLSQLLEDNKHHPLPVADVVEIAEQVAAALAYTHQQGIVHRDLKPANIMRLADGTVKICDFGIARLGHDIGFTARLTGTGIAMGTPHYMSPEQISGSPVDQRSDLYSFGCVLYEIATGAPPFDLDDAWAILIGHRDTPPDPPRGHRPELPAYFEKIILDLLAKLPDERPHDARELARRIGAGRGTPAYVPTVVTSSPLPDLSAPPAPSRPERRLSREPRLPSWTRGMTTGHKATGTGLGAAPPDAGAGLTGEWVARPDTGRAPAPVRSERPTPSPELVSTLTGRHNAGLSLGRLGRWAEAGEVHRAVAAEREHALGPDHPDTLASRYEVGFTLSRTGRPADALREYAHVAQARERVLGADHPETLAARQEMAYVLGQLGQHFDAHQVYTSVLAARERTMGPDHPDTLRCRHNLAFNLSRLGRLEDSYRMAREVAAARARVLGATHPDTLVTRYEVAYALGQLGRWPEALAAYQEVAEARAQALGPDHADTLAARYEVGISLGRLGRSAEALKLYRDLVEDRTRVHGPAHPETLRARHGLGVNLGRLGRWEEALAESRDVCALRERVLGADHPDTLVSRREVAVGLGWLGRWSDALTEYRHVATAREHVLGPDHPDTLASRNDEAHCLEQLGRGQEAVELYRRVAALRQRRASGGH

SEQ ID NO: 8805 - protein, 285 aa, Streptomyces avermitilis
VEASHAGDPGLFGPSSVAWQMHGDPMMWVAGIRALYLQALHPRVVRGVLQNSDFRRDAWGRLMRTADFVGTTTYGSTEAAERAGARVRKIHSMLAAKDPGTGERYGVDEPDLLLWVHCAEIDSYLHVLRRSGVPLTDAQADRYIAEHRVTARLVGLDPGGVPGDRAGLAAYFEKVRPELTAGPEAREVDDFLQSPPIHPLLIPARALLWRRVAHLAYAALPPYAHELYGRPGPPPATVTRRLRCTGTLLRCVPARLRWQLPPKHIIRAMSRLGPGSRPAPYKLGA

SEQ ID NO: 8806 - protein, 392 aa, Streptomyces avermitilis
VHLEYTPEQQRLRTELRGYFADLVPGNAYARYTDPAAQKRFYRDTVRRLGRDGWLGVGWPKEYGGRGLTPIEQFIFFDEAAQAGVPLPLMALNTVGPTIMRFGTDEQKAYFLPKILSGEIDFAIGYSEPDAGTDLAALKTKAVRDGDEYLVNGQKIWTTNGDTADWVWLAVRTDPDAPPHKGITMLLVPTSDPGYSCTLITTLASHDTTASYYEDIRVPVSRRVGEENKGWRLITNQLNHERVTLAAHGTMAIRALRDVQRWAMETKLADGRRVVDLPWVRRDLARTHTRLDAMKLLNWQMVNAVQEGTLTPQDASAVKVYGSEARRDAYAWLMEIVAAAGALKEGSAGAVLHGELERGYRSAVIFTFGGGNNEIQREIISWIGLGMPRVRR

SEQ ID NO: 8807 - protein, 152 aa, Streptomyces avermitilis
VTSTTSRRTARAASRIPSRTTPGTPPDPFPDGASPQELFRFLEDRFTCAQACTECARACALRASFAGPDGPEGQELVRRKGIMCAEVCDATCRVLSEQARQDEETLRIQLEWCRTVCLECAHVFDDHPGAENSAKACRECAQACADFMATLV

SEQ ID NO: 8808 - protein, 133 aa, Streptomyces avermitilis
MHPFRKAVEAGDHAAIEALLAEDVVFTSPVAFKPYPGKAITAAILRGVSRVFTDFRYVREIAGAEGRDHALVFEAKVGDKTITGCDFLHFDEDGRIDDFMIMVRPLTAAVALSEAMGAQFDRIAREAAQGAGA

SEQ ID NO: 8809 - protein, 188 aa, Streptomyces avermitilis
MALRNAVLAALLEGEASGYDLAKSFDASVANFWMATPQQLYRELDRMESDGLIEARLVRQERRPNKRLFSLTAAGRAALRDFTATPSRPTAIRDELLVKVHSVDDGDTEAVRAAIAERLEWARAKLARYDRIRTRLLDGRGEEEFLADAERVGPYLTLLRGRAFERENIEWAERALRVLEQRPAHRSR

SEQ ID NO: 8810 - protein, 208 aa, Streptomyces avermitilis
VGRRITQRREELGLTREETAGRAGTDPGYLQYLEEQATALPSTNVLIRLADALETTVVALRGGDADLPPGVGRAAAHPELLELSDEECRARLSTHGVGRLAVDTPTGPVIVPLNYSVVDGVVCFRTAADSEPAASAGSRVAFEVDHIDEALSQGWSVLVRGLARLVTDPDTLRRLAELAYSGPWAGGERDTWVCVDPVGVTGRRIVVR

SEQ ID NO: 8811 - protein, 356 aa, Streptomyces avermitilis
MKALVFHGSGESVWEDVADPGIQDAGDAIVRVDTVTICGTDLHILKGDLPEVRPGTVLGHEAVGEIVETGGDVRTVRPGDRVLVSCITACGRCRFCRESAYGQCRGGGGWILGHLINGTQAEYVRVPHADLSVHPLPGAMDSKDAVLLADILPTAYEVGVLNGRVRPGDTVVVVGAGPVGLAAVATSRLYTPEKIIAVDLAPARLDAAKRLGADAVAVAGEEAEPLVADLTLGLGADVVIEAVGVPETFEMCTRMVRPGGHVANVGVHGRPAVLHLEDLWIKNVTITTGLVDTRSTPTLLRMMAAGHLPASSMVTHTFPLDAMEEAYDVFSRAADTGALKVVLGEQQHDVLMVRAA

SEQ ID NO: 8812 - protein, 793 aa, Streptomyces avermitilis
MPQVEHQNSTVLTDDELRTLDAHWRAANYLAAGQIYLLANALLTEPLSPAHIKPRLLGHWGTSPGLNLVHTHLNRVIKARDLDALCVWGPGHGGPAVLANSWLEGSYSETYPDISRDAAGMGKLFRQFSFPGGVPSHVAPETPGSIHEGGELGYSLAHAYGAAFDNPDLLVACVIGDGEAETGPLAASWHSNKFLDPVHDGAVLPILHLNGYKIANPTVLSRIPEPELDELLRGYGHEPLHVTGDDPHQVHRALAEAFDRALDRVALMQRTAREEGATERIRWPMIVLRTPKGWTGPAEVDGRPVEGTWRAHQVPLPEVRENPEHLRQLEGWLRSYRPEELFDADGRPTADVLACVPHGARRLGATPHANGGLLLRPLPIPPLDRFAVAVDKPGATLHEPTRVLGDLLEQVMKDTSARRDFRLVGPDETASNRLDAVFDASGKAWQAQTLPVDEHLDRHGRVMEILSEHTCQGWLEGYLLTGRHGLFSCYEAFVHIVDSMVNQHIKWLKTSRELAWRAPIASLNYLLTSHVWRQDHNGFSHQDPGFVDHVLNKSPEAVRVYLPPDANTLLSVADHVLRSRDYVNVVVAGKQPCFDWLSMEQARAHCARGAGIWEWAGTQNDGEPDVVLACAGDVPTQEVLAASALLRRHLPALAVRVVNVVDMTRLLPREAHPHGMSDFEYDGLFTTDKPVIFAYHGYPWLIHRLAYSRTGHGNLHVRGYKEMGTTTTPFDMVVRNDLDRYRLVMDVVDRVPGLGVRAAAVRQTMADARTRHHAWIREHGTDLPEVANWTWEA

SEQ ID NO: 8813 - protein, 267 aa, Streptomyces avermitilis
MAGKKTARVPRAAYEQELLRLQTELVKLQEWVRAEGARLVIVFEGRDAAGKGSTIKRVAEHLNPRQARIVALPKPTERERTQWYFQRYVEHLPAAGEIVLFDRSWYNRAGVEHVMGFCTKEEHQLFLRQCPIFERMLVEEGILLRKYWFSVSDAVQQERFRRRMKDPTRRWKLSPMDLESITRWEAYSRAKDEMLVHTDISEAPWFVVESDDKRRARLNMMAHLLGSVPYYEVPPPVLELPRRPPSTGYERPPRDLQTYVPDHAASL

SEQ ID NO: 8814 - protein, 290 aa, Streptomyces avermitilis
MELPLVVGVDGSESSMRAVDWAADEAALRGVPLRLVYASLWERYEGAALADGLGRPPEQVIADDIVEAAAQRAHRRHADVKISTDVLPEEPAPALLREGNEAFALVLGSRGRSGLAELLLGSVSLAVAARAYCPVIVLRGSQDNRAGAGGHRRIVLAVGEEPDDPAAVRFAVAEARARGCAVEAVRAWRRPAREALGHPLSSRRAARLHEERATEVLEAVLSGAPPDVELRRRAVEGPARKVLLDASATADLLVVGARRHPGHSGLQLGRVAHAMLHHSACPVAVVPHRG

SEQ ID NO: 8815 - protein, 117 aa, Streptomyces avermitilis
VRPRPPGTPGGFGEAVTFGRWCGAHTALALTVTEDAFAAVRSGPRRRGRLSPGHPAGARHDQVPIFDTVLGGTSALGPVAATRQELRRSSGRSRRAVPGRSVSGGRSPPSPRCPTMC

SEQ ID NO: 8816 - protein, 1050 aa, Streptomyces avermitilis
VLRPGRARGRRARPPAEWPAVTWAGGGAARVPPPVTLPRAGCGTPRAPLGMAAGRRNGSGMRALRWAGDAQRVRKLWWAAALVATGLAQVAVTVLADGKSVIERWTPALGLVVSVLGLLSTLTQSESGTGEGRGTDWLKGRADALAEVVQDMWAAEARLRRLQDPEPLPVRWSAVDAPLADHDENVRRGAEAHTALRSGQLSDARAAFLSVPSRRVVVLGQPGSGKTVLALSLTLELLAARQPGDAVPVVLPVGTWDAVREPLRVWTAARIAADFPALAAGVPGGGTLADALVAARLVLPVLDGFDELPEAQRTPAMRRLNAELDADSPLYLTSRTDAYAATVEACDVLTAAAVVELSPLRLTDAASYLTRTSRPRRMPDGRIGTAWSATLARLAAPGGPPEDALRQVLSRPLMVAMARAVHGDGGRDPGQLLDGRFRTAAQIEEHLLTAFVPAVFGDTSGSCRTTEDAQRWLGFLARHLRNRDTGQFAWWELQSAVPRIVRLLAPGALAACLSAVVAGAVMTLVAPHTMIDLWADGELYELVGNASGVVAGCVVGLAVLIDRTGRTSLRVLMAKAALAAATLGILIGVTAEPLYGASIADLGDAWLFRFLSGVLFGTAVSAVFAVAGVTACPAPLGLPWAGPTVARHVGVAALLVLSGVAILVMDPLSPAGGLWRASAAAVVACAAVVAVIRIRRRGPRGSRHRVPGREQVRRFCQGLVRGTAACLLVGLALGPAIGAVMGTVIEWRATRAGTVHTDAAALDARTGIRRATTGAWTFEAYPDGTKTARPAEPVRVVLMVNVRNPAQAWTYAPPGPGAACHAVDRRCSTALARVRFTTRDGIWHVRIAGHDARDLTLLSSLHPPAAWWFWQIGRWGLVENCVKGGIVSGLVLGLIGGCACGVYRWLDTPADLTRATSPPAGLRGDRLAVLTRGAAATVAGSAAGGLLLLTTPDRYGMHGMSLQMALVMGPLALSLSAYGRLTVARMWLGATGQLPWRLMAFLHEAHLRGVLRQSGARYEFRHLRLQECLAARAERGESEATAAGDTRWIR

SEQ ID NO: 8817 - protein, 177 aa, Streptomyces avermitilis
VARAGTQEHAGSGRSVPTSWRPVMNAPPTSSMLRALPSEHRQQLMRVALEVSFPEGTRLFEEGARADRFWVIRTGAIDLDMHVPGRKAVVIETLRHNELVGWSWLFAPHTWHLGAETTTPVRAYEFDAVAVRAMCQEDSALGLAVAHWVGEILAHRLRSTRTRLLDLHAPYGSGSRH

SEQ ID NO: 8818 - protein, 275 aa, Streptomyces avermitilis
MSNVSLPRDEGRAHVARLRTDVSHSARIWNYWLGGKDNYPVDEEVGDQILGFVPALPRSAVADRQFLARAVGFLAGEAGIRQFLDIGTGLPTVDNTHEVAQRVDPTCRIVYVDNDPIVLRHAHALLTSTPEGATDYIDADVHDPDAILERAARTLDFSRPVALTMLGVVNFIMDTDRARAIVRRLLDGVPSGSYLVISHPTTEVDGEAMTEAVRYWNSQGSAPMTLRTREELLRLFDGVDVLEPGVVSCSRWRPAPSGKDEIVDVTHFCGVAKKP

SEQ ID NO: 8819 - protein, 236 aa, Streptomyces avermitilis
MTATLITGANKGLGFETARRLIAAGHTVYIGSRDAERGRRAAERLGARAVRLDVTDDASVAAAAKTIEADGGLDVLVNNAGIQEEMGDDNVVIGAADVTVDVMRQTFETNVFGMVRVTHAFLPLLRSSAAPVVVNVSSGLASLTRATIPGDPAYTYPGLAYPASKTAVNMITVQYAKAFPNMRINAVEPGYTKTDLNGNSGVQTVEQGAEIIVRMAQVDPDGPTGGYFDADGILPW

SEQ ID NO: 8820 - protein, 367 aa, Streptomyces avermitilis
MTPRRLPAPLLDAIVVAVALLDVWVHFDSDEPGRMACAVAAAFALVLRRRLPLLTFLLTLPAVLFSDAILAALIALYTLASLTRHRVLLAACATAFTLSSMSSWPSPTFDLSETATLITLGYTGATAVAPVFLGQLVQARRDLSLRLAEISAARDHERLLTDQTVLAKERAQLAREMHDVVSHQVSLIAVRAGALQVGTQDADVKEAAATIRRLSVQTLDELRHMVSVLRASGGRPTELTPQPSLADLQRLVDNSGIEAELQADMPDGLPPTVQRAIYRTVQEALTNARKHAPGTTATVRIRQENGAVRATVTNTAPTRPALPLPSAHYGLIGLRQRAALLGGTVTSGPTADGGYELRLELPADGTS

SEQ ID NO: 8821 - protein, 226 aa, Streptomyces avermitilis
VSGACVIRVLVVDDEALIRTGFQHILDTADDIEVVAAVPGGQALQTAQEIRPDVVLLDIRMPDVDGLTLLACLRRLPHPPVVAMLTTFDMDEYVATALRSGAAGFLLKDTDPEGLPFLVRTLADGGTVLASKVTRTVVDGYLNAGPQEPAARSLAALTDRERAVLVLIAEGLSNADIGTRMHLSTGTVKDHVSAILTKLKVDGRVQAALLAERAGLLKPPRDQEGE

SEQ ID NO: 8822 - protein, 409 aa, Streptomyces avermitilis
MTHVVAEAAPAEAMSAARAGPSRTSSTGRLIGLDLARGLAVIGMYTAHLGTDPSEGGPLGWVTEVTRGRFPALFALLAGFTLIILTGRPQPRTGRAGRQAMGRVLIRSAVLIALGYALAYLDTPIDVILAAYGVIFALALPLYRLRASTLAVIAAAMTLVMPPVVYLLRAAVEGGSWADAVIANDPLARVTGSDGILELFITGEYPVLTWLPFVIAGMAVARLDLSRPGIRARIALLGGALAVLGYGGSWLALHLVPGAQATVSAATDGGSASSAWWSDAVGDPTTSTPDWMLVAAPHSQTTWSILGNTGFALVILAVCLIATDRSARLRWFATPVTAVGSVALTAYVGHIVAIKALGMDDVPTSDALAVLIGFASVAMLLALAWTRVFRRGPLEYLVHAATTPARLIN

SEQ ID NO: 8823 - protein, 217 aa, Streptomyces avermitilis
MTVRLTFMCATAGGTTRDAVFGDGLLSERGLRRARAAGATLPPYSLAIRAPSVRCAQTAYALGLPTTLEPALRDLDYGTWRGRTVGEVVADEPYGYSAWLTDPDAAPHGGESVRRLCRRIANWLSSVPPYPGRALVITEPSVVRASLVHALSAPVTAFRHFDVPPLSTVSLTLSDGHWIVRPGRVTPDRVGTSRAVPTPYDAAEGRTALLWGEATPA

SEQ ID NO: 8824 - protein, 330 aa, Streptomyces avermitilis
MKMLINVAETVVADALRGMAAAHPELTVDVEKRVIVRRDAPVAGKVGLVSGGGSGHEPLHGGFVGPGMLSAACPGEVFTSPVPDQMVRAAAAVDSGAGVLFIVKNYTGDVLNFDMAAELAEDEGVQVAKVLVNDDVAVTDSLYTAGRRGTGATLFVEKIAGAAAEEGAPLQRVEALARQVNENARSFGVALSACTTPAKGSPTFDLPDGELELGVGIHGEPGRERRAMMTSREIADFSVHAILEDLNPSNPVLVLVNGMGATPLLELYGFNAEVQRVLVERGVPVARTLVGNYVTSLDMAGASVTLCQVDEELLRLWDAPVSTPGLRWGM

SEQ ID NO: 8825 - protein, 199 aa, Streptomyces avermitilis
VLDADFFRRWMTATAASVDREAERLTALDSPIGDADHGSNLQRGFHAVAVTLEKEAPDTPGAVLVLAGRQLISTVGGASGPLYGTLLRRTGKELGDTAEVTEEQLTDALRAGVDAVMQLGGAAPGDKTMIDALVPAVDALSDSFAAGRAAAEEGAVATTPLQARKGRASYLGERSIGHQDPGATSSALLIAALEEASVE

SEQ ID NO: 8826 - protein, 138 aa, Streptomyces avermitilis
LSDTTDKLVGIVLVSHSADVATSVAELAKGLAGGGTTAPVGPAGGIPGGGLGTSAELISAAAASVDQGAGVAVLMDLGSAILTVKALLAEGDELPENTRLVDAPFVEGAVAAVVTASAGGDLAAVEAAATEAYSYRKE

SEQ ID NO: 8827 - protein, 257 aa, Streptomyces avermitilis
MSPTRGSLIVRVQSLTLVAASAALVAPTTSPPVVRTHEVARTHEAARTREAAGTREPAAAAREGTVLAADLLAKVRDCAPVSNGRYRSDDGAPADIPVCGRRDAVFWKADMDIDCDGRPGLLCNESTDPSFSDATAFQQSDGRQLNAETLPYIVVPTAGDIWDHREHGVRGGSVAAVIYQDRVQYTVVGDTGPHDIIGEASYATAQALGIRPDPRGGGTDSGVTYIVFKNSAVSPIENHVEAVAQGEALAREFLRQN

SEQ ID NO: 8828 - protein, 343 aa, Streptomyces avermitilis
MAYRYRPIPSREGGPVRRLVRRLRVPVICGSLFLTVSCGWGGQDGGRDGPLPSAPMGVTAAAGSATSVHVMWNQVSGGPKVAGYEVYRGTTKVKDVPGAEHMVDITRLKPSTTYVFTVRARDDAGNAGLPSAKVRATTPAAVAADHRAPTRPGRPSGKAVGSRAAQLNWARSTDDRGVASYDIYQGTSKIHSVGGGQTATVVTGLRPGTRYSFTVRARDAADNVSAASASVRLTTAGGADDGRGTAPTRFRAGTHRADGAYYIDLSWSPPDTDGVITEYQIHLDGRPATSLVWGGKPPRGKATYSFYLGRDAGARHRVRIRAKLPDGTWGGFSDERTVTTGGR

SEQ ID NO: 8829 - protein, 178 aa, Streptomyces avermitilis
MRTIQLFSRSGLAVAAAALPLTLASPAAAAWNSGISVSTSGSNVSVATTTCTPFNGSLGNASLLSSGQANFTQGRLAMLTGSNISQSGVWSNVSPGTYTVVVVCANGSTAGTQSIIVSGSSTPTISATASPSRGVMGGVGGSVEHYGTITFAVGAALVAVGAVATGWYLRRRTKPYRL

SEQ ID NO: 8830 - protein, 181 aa, Streptomyces avermitilis
MSLPHAILTALLEKPSSGLELTRRFDKSIGYFWSATHQQIYRELGKLEAEGYIRALPTQQPARGQKKAYEVLPAGRAELARWTAAAQEPKPLRDTLLLRLRASAVVGTEGIEDDLRRHLALHQRQLTEYEEIQDRDFGPGKDTPQDRLRHLVLRAGIDLETFWTQWLTHALAEFEELPAHE

SEQ ID NO: 8831 - protein, 671 aa, Streptomyces avermitilis
MSRYPHLLNPLDLGFTSLPNRVLMGSMHVGLEEAERGFERMAEFYAARARGGVGLIVTGGIAPNDAGRPYEGGAKLTTEAEAEQHTAITEAVHREGGKIAMQILHFGRYAYHQDLVAPSALQAPISPFPPHALTDAEIERTIDDYARTARLARQAGYDGVEIMGSEGYLINEFIATQTNRREDRWGGSYENRMRFPVEIVRRVREAVGEDFIIIYRLSMLDLVPGGSSLDEVITLAQAVEAAGATIINTGIGWHEARIPTIATSVPRGAYAWVTKKVMGAVSVPLVTTNRINTPELAEQLLAEGHADMVSMARPMLADPDFVAKAVAGRPEAINTCIGCNQACLDHTFGGKITSCLVNPRACHETELILSPTRLRKRVAVVGAGPAGLACAVSAAERGHDVTLFDAASEIGGQLNVARKVPGKQEFDETLRYFRTQLEQHGVDVRLNTRVTSEQVAAYEEVVVATGVSPRTPEIPGIDHPSVLGYLDVLRDGAPVGDRVAVLGAGGIGFDVAEYLTDSGDKASEDPATYFRSWGVDMDYRAPGGLGAPERPAPPRTVHLLQRKTSKVGAGLGKTTGWIHRTELKHRGVTMVPGVQYDRIDDAGLHITVDGHSQVLEVDTVVLCTGQDPRRDLYQELIAAGHRAHLIGGADVAAELDAKRAIKQGTELAAAL

SEQ ID NO: 8832 - protein, 272 aa, Streptomyces avermitilis
MPPLSSASSSASAVVAALRSAGCVFAEDEAELILSTARTPGEIATMVERRAAGLPLEHVLGWAGFHGLRITVDPGVFVPRRRTEFLVDLAVSLAREVSVVVDLCCGSGAVAAALAASLDGPELHAADIDPAAVRCARRNLAACGGHVHEGDLFTALPGHLRGRVDILAANVPYVPTDEVGLLPPEARDHEPLVALDGGSDGLDILRRVTAEASRWLSPGGSLLVETSERQASLAVETFTRGGLDARLAVSEELCANVVIGTRPGRASEPQGA

SEQ ID NO: 8833 - protein, 372 aa, Streptomyces avermitilis
LYKPTFRRVHMDTGLRSPALRHVLTHLVTPLLMCLGMGLAYMGAFVTPEPNHLPVAVVGAAPEAKVFAQTVKDEAGDKLDVRTVASRAEAVDLLKSRDITGAYVPSAKTPELVVATAASDMGATAVEKVFTPVAAQRDVPLKVTDVAPPAADDPTGQGLFFLLIAVSIGSYASVAALGAAGSTLPMRARALLAAGVSGVVSVIGALLAGPVFHLAHHDLLTVWGMSWLYSAGILFIGVGLHTFLKRWTTLAMMVLFVMLNFTSSGGLFRPELQNGFFGTLHAFWNGAGFVEGVRSLLYFGRDGLSGDVWRLVVWLLAGLVLTAVAGAVERVRARAAAPRRTHAKPVGVTSAEKAAGEEPADAEEELEESVGV

SEQ ID NO: 8834 - protein, 176 aa, Streptomyces avermitilis
VKTVEGPDETVVTVEEPGAHGAHGGSDAEAAVETIQREMTAFARRARASAGRMHPELSLVSYTLLGHLEESGGCRATDLATHYTLDKSTVSRQVAALERTGLIERRLDPEDHRVQVLHLTQAGRRILAQVTESRREAFHERLADWPKEDLERFAAYLLRYNAAAGEGPLKERSADG

SEQ ID NO: 8835 - protein, 301 aa, Streptomyces avermitilis
MSAQDTDGRAPEEAGRSAGDRVPQVRGRSAEGHVLDVRGQSDDRRALDVSGETAARPARDIAGPRPERHVLDNPALASLTGPHAHFAERRGRVLRYPVDVSPWLGLPDEPDADDWADLAALVGPGEEAPLAGFRGRAPDGWEVTFDIAGVQLVDNGIAAAPDAEAVRLGPEDVPEMLDLVERTRPGPFLPRTVELGTYLGIRRGGALVAMAGERLHPPGWTEISAVCTDPEFRGEGLAGRLVLAVAHGIRERGETPFLHTGAGNTNAIRLYEALGFRLRRTTRFLAARVPEHVPAGRQVGV

SEQ ID NO: 8836 - protein, 306 aa, Streptomyces avermitilis
MPKAYVFTRYGGPETEALVDLDRPSAGPGQLVVAVRAAGVNPVDWKQRTGYRRPGGPARELPAVFGNEVSGVVEETGEGVTGFAVGDEVFGNPVAGGYAQYAVLPVTTTAHKPAGLSFTDAATLPVAAATAYDGVRQLGLPSGATLLITGAGGGVGVAAVQLARAAGLRVVGVASEAKKDLVESLSAVHVPSGPELAERVRAAAPGDVDAVFDLVGGEVLEAAATLLTDRTKLITGADRETVARLGGAPVARARTAAVLDAVAALAVGGELKPYVTRTFPLELAAEALRTVEEGHARGKVVIEVAE

SEQ ID NO: 8837 - protein, 201 aa, Streptomyces avermitilis
MNVTRGFTGRPRVHHPGLPPGQYDAGDDWPVLSAEVTPDLAAADWSFRIDGLVAEPRTWSWDAAHALAPSAYEGDIHCVTSWSKFGVRFGGVSLDAFLGLVRPDATATHAVAYSHTGYTTNLPLTDLTGGRAWIAWEYDGRPLPAEHGGPARLLVPHLYFWKSAKWIAGLRILDHDEPGFWEQNGYHARGNPWEEQRYSGD

SEQ ID NO: 8838 - protein, 251 aa, Streptomyces avermitilis
VTETFVPPTRFAVPGRIAVSNRAAAVWQTATLTEIRRETPHAATFRFAVPGWQGHLPGQHLMLRLTAEDGYGAQRHYSIASPPEDAGHIELTLDHVEGGEVSGWFHTVAEPGDEVQVRGPLSGFFAWPGDRPALLIGAGSGVVPLMSMVRHHRAQGSTVPLRLLVSARSPQELIYAREYGDETTPVFTRDAAAGVPVGRMSAAHVAPLLDRAPPGGWEAYVCGSNGFAEHASRLLVEAGQPVHRIRIERFG

SEQ ID NO: 8839 - protein, 295 aa, Streptomyces avermitilis
MTSGTRTITVGIDGSRTGLDAADWAAREAERRRLPLRLLHAGAEPPVPAPVPDVDLPARTALDRAAVQLAYAHPALDIIARRTETPAVPALLAAAAEAETLVLGSRGFTGFAGFLVGSVALAVAARAARPVVLVRTGELAEDERMPADDGTPPGRAAYLPVVLGLDLDHPADRLIAYAFEAAAVRSAPLHVVHTWTTLPPTGHAPGAPLPGDAAEREEGARRTLTTTLQPWRHKFPGTDVLERVIPGHPGHHLLRASIRAGLLVIGRRTSAPGLGRAARSLIHHAGCPVAVVPHC

SEQ ID NO: 8840 - protein, 288 aa, Streptomyces avermitilis
VGMLWRRGGRTGVFPAAVGAPGVLGILRHAGSFSSRDRCAGSTGCADQSYRRTISTRPLVGAAVGRTAPGEVYLPGQVPFGPFPGRAEAARRSDMRTRMRYRYERRNPLRRRSDVVEAWTALVVAVLLFVAAPLAGAAVGWWAYDSSHSLATAQRAERRHVSATLVENAPAAVPSVQDSKEPLYQVKVRWTEPGRGARTGPAMVPAGSLRGERTDVWLDGRGRSVAPPVTDTLVWQHAVTSGVWTTGGVVGLVLLARIAERRIAERHRMAEWEEEWARTGPEWRKRTA

SEQ ID NO: 8841 - protein, 322 aa, Streptomyces avermitilis
MALFDLPLDQLRGYRSASAEPEDFDAFWAKTLQEARQYDLGPRFEPVETHLETVEVYDVTFAGFDGHPVKGWLTLPARANAPLPTVVEFIGYGGGRGLPHTHLLWASAGFAHFVMDTRGQGSAWGGGDTPDPVGSGPAFPGFMTRGVEDPESYYYRRLFTDGVRAVEAARAHPLTDSARVAAVGTSQGGGITIAVGGLVPDLAAVAPDVPFLCDFPRATTLTDRDPYREIGRYLKTNRGRTEQVQRTLSYFDGVHFAARGSAPALFSAALEDQTCPPSTVFAAFNAWAHADKAIEVYDFNDHEGGGPYQEAAQLRWLPDRLR

SEQ ID NO: 8842 - protein, 139 aa, Streptomyces avermitilis
MSMSRAATAEAARRFVAVWERAWAAHDVDAIVGLYAEDCVHRSMPFREPHRGRAALAEYIRWSFAAERTQDVRFSEPVVGDDGLAVAEFRVLAEEDGTPSTLAGCVFVRFDASGLAVETRDYWHTVTGHKEPTGSMFLR

SEQ ID NO: 8843 - protein, 388 aa, Streptomyces avermitilis
MSQQVPQVQGRCDERFTAVREAFEGNFRERGELGAAVAVTLGGETVVDLWGGWADAARTRPWERETLVNVWSTSKGPTSLCAHILADRGLLDFDAPVAAYWPEFAAAGKESVLVRHLLSHRAGLAGLREPHSVEQLYDWELTAQRLAAQEPWWEPGTRSGYHAMTFGFLVGEVVRRVSGLLPGAFLEREVTGPLAIDFTIGLPEKEADRAAELVHPRAAATSEQAAIFSQLAPVALAALLNPVVGATEGNTEQWRAAEIPAANGHGTARAVAALYGIFAGRGSWDGRPILSPEAAERVREGQGSCRDLVLGAGFESETEIGLGLWLSGSNGSYGPNPKAFGHDGFGGSCGLADPEAGVSLGYVMNRMGPHIADDPRKMALVDALYRAL

SEQ ID NO: 8844 - protein, 250 aa, Streptomyces avermitilis
LSPGGADMARSTTSDHDPLYWRIAHDLLGELRDGTIPPGERLPGERHLATHFGVSRETVRQALQMLRRDGLVATDRRGSHATLPGATAEPGADAAHMPSLTFPVGAQTTEPCRATVTWEEPPAEHALALGLAPRRPTLVHRYESVAADGSGLRTALTSFSVVAVTEVAELARYRDRADGSAAAQLWRAYDWMRKAGLTLHHRDSITQFPPSVRVTRRVHDQHHRPLEITDLVADARLDALVYEFTLPAAG

SEQ ID NO: 8845 - protein, 247 aa, Streptomyces avermitilis
MFSPHGPTLRELAVQALSSVEHGYDLLAPKFDHTPFRTPDSVLEAVEGALEPMGPFDRGLDLCCGTGAGVDVLRTVCREGVTGVDISAGMLAVGREQARAVGQPDVTWVRGDARALPFGPVFDLVVSFGAFGHFLPAELPGLFAQVHSVLRPGGRFAFPVAAPPRPASPWYWALLGFDTAMRVRNALWRPPFVMYYRAFRLGDVRRELVRAGFRVELVALPGFGQRPDGSPRCRMVVATRESGTAGA

SEQ ID NO: 8846 - protein, 529 aa, Streptomyces avermitilis
MTSFRPAPAWLADAVFYQIYPQSFADSDGDGIGDFNGIVQRLDHLVWLGVTAVWLNPCFVSPFRDAGYDVSDYLNVAPRYGSADDLAELVDEAGRRGIRVLLDLVAGHTSDEHPWFTASANDPDDHRYIWAPEGRPDGFVTSPGTRPGAYLPNFFDTQPALNFGYGRKNPAEPWRQPVDAAGPRANREALRTIMDHWLGLGLAGFRVDMAASLVKDDPGRTETARIWTELRHWLDTAHPDAVLLSEWGEPEVSVPAGFHTDFFLQFGGATDGLPLRSLWSNGDGTVNEAWDPLDCFFDASGKGSPRPFVEAWRKASDAVGATGFVSLPTANHDFSRLNCGPRTAEQLPAAFAFQLTWPTLPAIYYGDEIGMRYVGGLPDKEGSVLGPRYNRAGSRTPMQWDDGPGAGFSTAPADRLYLPLDPSPDRPTVAAQRADDGSLLHLVRRLVALRASTPALGSGGSVEVLHTGYPFVYVRGGRYLVVVNPQRNEVRCPYDATREARALEASGVRVGNGTIEAEGFSYGVFDLGR

SEQ ID NO: 8847 - protein, 443 aa, Streptomyces avermitilis
VRGVPRAGRLVRRTAPTRRRSQETSLDTSSGTQPHRMDPAGGCPHADNARLLARGAVAPVLLPGDIEGMAVLGHDALKEFLAHPEVAKNARHFTALQEGRTAPGWPLLTFATVQGMTTADGEDHRRLRSLVSKAFTARRVERLRPWIEELTSALLDGLGRAAEEGGQVADLRAHFALPLPMGVIGELLGVDAEHRDRLHHLSNQVVATDIGPEQAIAANRELVAVLSTVAAARAERPGDDLTSALIAARDEGGDRLSQQELIGTLVLMIIAGHETTLNLITNAVRALCGNRDQLELVRKGDAGWPDVVEETLRWDAPVSYFPFRYPVRDLTVDGTVIPAGTPVLAGYSAAGRDPAAHGPDADRFDVTRPARSETTRHLSLGHGAHYCLGAPLARMEATIALERLFTRFPDLELAVPEAELARHSSFVGNSVRALPVRPGVPRS

SEQ ID NO: 8848 - protein, 407 aa, Streptomyces avermitilis
LTGEAGRATVVGMVDAGIVERVRALRPLIRENALRAERERRVPDEVVEALTGTGIHRMNVPRRYGGHQTPLRTQVDAFAEIAAECASTAWMTLSQAGVSYIAALFPDEAQDEFFTGPGGPDVRIGGTLIPGATAVPYGGGYRVSGTSAFATGCHHADWHLLTTAVAAADGQLPPGPPEIRWAAVPMAELEILDDWHVTGLAGSGSNTVVARDVFVPAHRMLAVGPMLAGRFPSKANADDPFYRMPVLLLFCAWSAPVALGLARAAVAEFTERIHRRGITYTFHERQNEATVTHLQVAEAEMRVGGAELHLARLTAEIEAKARDDLPYTPLERARIRAESGYVTRICREAVDLLAAASGASSLHQEVPMQRITRDIHALCLHSFVNPTTNMEIYGRVLSGMDPGTPFL

SEQ ID NO: 8849 - protein, 379 aa, Streptomyces avermitilis
MTTTLEHPPVQQQLPAHATGVLDIAQGGQGYLRTGNCLPTPNDLQVPAALIRRHGLRKGDVVEGVRGGQRGLTEVASVNGRAPEQLRGRPHFRDLTPLHPRERIRLEHPAGGLSTRVIDLIAPVGKGQRGLIVAPPKTGKTVLLQQIAAAVAGNHPECHLMVVLLDERPEEVTDMRRSVRGEVYASTFDRAPKQHIALAELVVERAKRLVEQGQDVVILLDSLTRLCRAHNNTAAAGGRTLSGGVDAAALQGPKRFFGAARLAEEGGSLTILATALVETGSRADDFFFEELKSTGNMELRLDRAPAAKRIYPAVDITPSGTRREELLLPSAELAAVRGLRRALQTRDGQANLETLLERLRATPDNTAFLRQVQPTLPAA

SEQ ID NO: 8850 - protein, 388 aa, Streptomyces avermitilis
VSGMTIRFSSRMVGSCSALCVVGALALVPGPAVARTGVDPAAPKPTALQPPPLYRSGTQVRPRAGAPEVPNVSALSWLVADAGTGDVLASHDAHRPLPPASTLKTLFALTMLPTLPGGIRHTVAERELEGLGDGSSTVGVTEGQTYQVTDLWRGIFLHSGNDAVHVLASMNGGWDTTAHQMQAKARALGALDTHVVSPDGYDAPGQTSSAYDLAIFGRAGLNREDFARYCSTVDATFPGNGGAYEIQNTNRLLTGADGIAPYPGLIGVKNGYTSNAGNTLVAAARRGGRTLVVTVLNPQSGGGLAVYEEARSLLDWGFGAAGRVDPVGSLLSARTVAQAGPATPDAVMAQDGGGPGWPVTGAIAGAAAVGAGAVVLALRFKGGRSGRR

SEQ ID NO: 8851 - protein, 460 aa, Streptomyces avermitilis
VRLPHTDRGRLALVLPLATAVAVFTATVPLLRDWFDLRVYYGTVDAWVHHGGRIYDYRVPGTTYGFTYPPFAALGMLPMALVGLPTAVALALLLNLAATAAVLLILTGPALRRHGWFGWALAGCALALLEPVRDTVSFGQVNLLLLALVLGDAWLLSTGRGRRAGVGIGLATAVKLTPALFIGLLLLARRWRAAAVATAVAGAATALAAWAAPDASRFYWTRAVWDTARVGRLDYVSNQSLQGVLARLAAPGEPSRAVWAVAVVLVLAVWARRTHRALRAGDWRAAFALTGLAACLVSPITWVHHLVWLLPSFAVLWRRRLPRVAGTLYVVLCSSVVWLWFDDASGVDGFLGSNTYVWVTLGLLLRLPVGQRRPDRPPLKRSASTTAPAPTAAAPAIAPVTGQPGPPPSCAMTASGVAGPACATVRAESSDPTGSTRPAAPNPQSSSERASSYTAKPPPD

SEQ ID NO: 8852 - protein, 466 aa, Streptomyces avermitilis
VLAMAFPVDLRRCQALGLAGTAFLAAGGETAGALPARELIAPESGRAALGLVGVYFGVVLLIAAWALLGTVVRGPEPPTVRSLLGVLAAWAAPLLLAPPLFSRDVYSYLAQGAMVDAHIDVYAYGPARLGGPLADQVAPVWQHTPTPYGPVFLAVASALSGLTRGELPAGLLGMRLVALLGVALMAAALPRLARHSGVDPAAALWLGALHPLVLLHLVAGAHNDAVMLGLLGAGLVAARGRWHVLGVVLVTLAALVKAPAVLGLVAVVALRRHVGVARAVATTTAGALATTALATAVAGTGYGWIAALKTPVSPHNWSPTSVLGRATGALLENLGSDLAPLALPAWQAAGLVATTAAVLFIWLRLRPGPVYALGLSLAVVAVLGPAIRPWYALWGLFLIAAAAPSGSLRHRVAAAVGCVLALAVLPNGGPPDTAQVVLAVSGGVLALVVLWQAHQTARAPVPGRTA

SEQ ID NO: 8853 - protein, 313 aa, Streptomyces avermitilis
MVIMSASWSSHAFQPVLERIADEIERTPGRGRPADYIPALAACDPRRFGMAVAELDGTVYGVGDWRQPFSTQSITKVFTLALDLAREGDALWEHVGREPSGNPFNSLVQLEYESGIPRNPFINAGALVVTDRLQTQTGDAAGSLLEFLRAESGNPRLTFDQDVAASEAAHGDRNAALGHFMASYGNIDNSVPVLLDQYFRQCSIEASCADLALATGFLARHGIRADGSRLLTQSQAKQVNAVMLTCGTYDAAGDFAYRVGLPGKSGVGGGIIAVVPGRCTLCVWSPGLDERGNSVAGVAALDRFTTLTGVSVF

SEQ ID NO: 8854 - protein, 470 aa, Streptomyces avermitilis
MTAAAHRSEHDLLGDRDVPAEAYWGIHSLRAKENFPITGTPISTYPHLIDALAAVKEAAALANEELGLLEPKKAAAIVAACREIRDGKLHDQFVVDVIQGGAGTSTNMNANEVIANRALELLGHAKGEYRHLHPNEDVNLGQSTNDVYPTAVKIATVFAVRGLLKAMAVLQDAFARKAVEFRDVLKMGRTQLQDAVPMTLGQEFSAYAVMLDEDRSRLAEAVELIHEINLGATAIGTGLNAPAGYAESARRQLAALTGLPLVTAANLVEATQDCGAFVQMSGVLKRIAVKLSKSCNDLRLLSSGPRAGLNEINLPPVQAGSSIMPGKVNPVIPEVVNQVAFEVIGNDVAITMAAEAGQLQLNAFEPIILHSLSESITHLRAACLTLAERCVDGITANTEELRAAVENSIGLVTALNPHIGYTAATAIAKEALATGRGVAELVLEKGLLPADRLASLLRPEVLAGSGSPQI

SEQ ID NO: 8855 - protein, 328 aa, Streptomyces avermitilis
VIREPLHTPVAHLVREGVIEGIHYGSVVVLGADGNVDLQIGDIEAAFYPRSALKPVQAVAMLRAGLPLDGELLSLAAASHSGEERHLAGTRRILERAGLTEDDLRNVPDLPFDPVVRESWVRQGRLPSRLAQNCSGKHAAMLYTAKLNGWSLDDCLDPAHPLQQAIAEIVEDLTGQAIAKVTVDGCGAPLFSVSLHGLARAAARITTAPSGTPEARVADAMREHAEMASGTGRDVAALMRAVPGLLAKDGFEGVQVAALPDGRAVAVKIADGANRARVPVAAAALARAGVDPAALAEFAGEPLLGGGRPVGGVRPVRALDPLTRHTYS

SEQ ID NO: 8856 - protein, 486 aa, Streptomyces avermitilis
VSEQSLKGEAQGAIRTGTQPSRHVDAGDAGYAKSLKSRHVNMIAIGGAIGTGLFLGAGGRLADAGPSLFVAYAVCGIFAFLVVRALGELVLYRPSSGAFVSYAREFLGEKGAYTAGWMYFLNWATTGIADITAVAVYTHYWGMFSDIPQWVIALIALAVVLTVNLISVRMFGELEFWFAIIKVSALVVFMLIGIFLLVTQHPVDGHHPGPSLITDHGGIFPHGLLPMLLIIQGVVFAYASVELVGVAAGETENPEKIMPKAINSIMWRVGLFYVGSVVLLSMLLPWNKYTAGQSPFVTVLSNIGVPAAGGVMNLVVLTAAMSSLNSGLYSTGRILRSMAMSGSAPKFTGVMSRSQVPYGGILLTSGICILGVGLNFVVPADAFEIVLNFAAIGILATWGMIMLCHLMFWRKTRTGELSRPSYRLPGSPWTEIVTIGFLVSVLVLMYADGGAGRTTVLCLPLIAAALVAGWYGVRGRVARKASGADA

SEQ ID NO: 8857 - protein, 255 aa, Streptomyces avermitilis
VNLSDSQTGGAVPRRVSAMEAVLSHLRGAIERGDYAIGEKLPSEAELCRRLEVSRPVLREALRALQVMGLTASRTGKGTFVLAHTVEDPTFGDYVASDLLEVRRHVEIPVAGYAALRRTPENLDHLAHLLDRMERETDTTAWVAMDTLFHLTVAEAAQNPVFRRVIEEIRDALARQSAFLNELGGRREQSNREHRAIVEALIDRSEHDAVEAMSHHLDRVETTLTDIVRTPRTDTPTQIPTDSTAPSPSEGGPQA

SEQ ID NO: 8858 - protein, 277 aa, Streptomyces avermitilis
MSVINVGQAVVLGAVEGVTEFLPVSSTGHLKITEGLMGIPVDDNAVVGFSAVIQVGAIAAVLVYFFKDIVRIVSAWGRGLRNRDERHHHDYKFAWWVIYATIPIVIVGLAAKSLIEGPLASLWVVAASLIVGSGVMWAADQMGRHKRGEDDTSFKDAMLVGSSQILALLFPGFSRSGATMSTALILDLDRVAATRLSFFLGIPALTGAGLYELKDALGTGVGVAPLAVGTIVSFVVAYGSISWLLKFVAKHSFNAFVIYRIVIGVLLLGLLGTGVLS

SEQ ID NO: 8859 - protein, 124 aa, Streptomyces avermitilis
VNWLLVIAGAMVGAPLRYVTDRMVQLRHDAVFPWGTFAINVTGCLVLGLLTGAASAGVASPHLELLLGTGLCGALTTYSTFSYETLRLTETGAGFYAAANAIASVAAGLGAAFAGVWFAQALWA

SEQ ID NO: 8860 - protein, 80 aa, Streptomyces avermitilis
MTRLTGGALRVTVLIGESDTWHHKPLYTEIVHRAHAAGLAGASVFRGIEGFGGSALILDDCEVIRYAARENPGRKGEKSL

SEQ ID NO: 8861 - protein, 158 aa, Streptomyces avermitilis
MTVPHPESVGEPGIAVRAPARRRSAWHGQAPVVAVVALGGGIGGTARYAAALLWPTQSGGFPWTTFWVNVVGCAVIGVFMVVITDVWPAHRLVRPFFGTGVLGGFTTFSTYAVDIQKLVDAGHPRTALAYLAATLLAALAAVRLAATAARRVLVRRRR

SEQ ID NO: 8862 - protein, 95 aa, Streptomyces avermitilis
MLKLPISEKRLEILEWLKDPAAHFPPDRHGDLVEDGVTAAAVAVKLGVRRAVADTHLGLLAGIGLLRTKRIRRRTYYRRDEVRIAEVGRMFEKGW

SEQ ID NO: 8863 - protein, 522 aa, Streptomyces avermitilis
MFHARRALRALLIPLFAGLALTTLPATSARAAATLTNPGFESDGTGTATPAGWSTYSAAGQNAASFTESGGRSGSYRLTHWSASAYKVETYQYLSGLANGNYTLTAWVRSGGGQNSAYLALKNCGGTEQRTDLPVSAGGWIRIVTPVAVTGNQCTISVNSDANAGNWLNVDDLTFTSGTTGLGIKGSDISSLAKSEAFGGVYKTGSGTTGDALTILKSAGMNYARLKVWVNPADGYNNKTRVLAMAKRVKAQGMKLLVDFHYSDTWADPGAQSKPAAWAGHSYSQLKTDVYNHTYDVLSALKSQGTTADMVQIGNEINGGMLWSEGSTDNWPQLAGLLNSGYSATKAVSSSTVVALHLAKGGDLAGTRAWFDKAVAGGVNFDAIGLSYYGYWHGSLYDFQTTLDDAASRYGKPVFLAETAYPFRLDSDDSLTNQIDTTGELVSGYAATTAGQSAWLRDVMNIVEAVPNGRGLGVFYWEATWTAVTGNGWDPADAASGNGWENQALFGYDDKALPAMTLFSHR

SEQ ID NO: 8864 - protein, 673 aa, Streptomyces avermitilis
MPETTPKGLTRLAFGGDYNPEQWPETVWQEDVRLMREAGVTMVSVGIFSWALLEPSPGAYDFGWLDRLLDLLHENGIRADLGTPTVAPPAWFYRAHPEALPVTADGTRYEFGSRGAICHSNADYRAAAANITTRLATRYAEHPALALWHVHNEYGVPVSACYCESCAAHFRRWLTDTYGTIDALNEAWGTAFWGQRYAGFDQINPPRLTPTVGNPGQALDHKRFADATMRENFVAERDILHRLAPGIPVTTNFMTALSQCDSVDYWAWGREVDLVTNDHYLITDGRRTHVNLAMAADLTRSVASGAPWLLLEHSTSGVNWQPHNPAKAPGQMARNSLAHVARGSEGAMFFQWRQSRRGAEKFHSSMLPHGGTDTRVWREVVELGSSVDSLRSIRGTRTRADVAVLWDWQSWWAQNLQWRPSEDHDPRERADAFYEALYDRHLTVDFAHPEADLSAYPLVVVPALYLMTEAAGNNLEEYVENGGTLVVSYFSGIVDEHDAVHDGPYPGALRDVLGLTVEEFSPLLKDDRIRVTGPDGSELTGDVWSEFVVPRGAETVWTYADGLTAGHPAVTRHRFGEGSAWYVSTRLTAQGLDALLGRAADDARIAPRADLPRDVEVVCRTGESGTFLFAVNHTALDTKVPLDAHGTELLTGERAAGQVSVPAGAVRVVRLDG

SEQ ID NO: 8865 - protein, 439 aa, Streptomyces avermitilis
MPNTKHCRLVATALAVALGATTLAACGSSDDDSDARSGPASLTYWTWTPGMDKVVDLWNKGPGKKQQITVTVKKQASGDTLVTKILTAHKAKKAPDLVQAEYQALPTLVSNDALADISKNAGDAKGKFAEGVWQQTTLGSDAVYAIPQDIGPMMFYYREDLFKKYGLTVPTTWEQFAKTARALKHKAPDKDLTTFSSNDSGLFAGLAQQAGAKWWTTSGQKWKVGINDAASQKVADFWGGLVKEGAIDNQPMYTPAWNKALNTGKQIAWVSAVWAPGTLTSGAPDTKGKWKMAPLPQWGDSDSVTGSWGGSSTAVTTDSKHQAAAAKFATWLNTDPKALTALAKESGIYPAATTAQTSDAFQEPPAFFSNQPDFYPQAAKIAKTTAPSAWGPNVNVAYTTFKDAFAAAAKNKSDFGAALAKMQDDTVADLKKQGFEVSE

SEQ ID NO: 8866 - protein, 307 aa, Streptomyces avermitilis
VTSARRTSYGVKGAPYAFLLPAATLFALFFALPIGYAVWLSLHKVRVFGLGLGAGARKEVWAGLENYTDALTDSALLHGALRVVGYGAIVVPVMLGLALVFALMLDTDRVRLAPFTRLAIFLPYAIPGVVAALLWGFLYLPDVSPFYYVLNGLGLPQPDLLDGGPLYLALSNIAVWGGTGFNMIVIYTSLQAIPVEVYEAAKLDGATPLQIALKIKIPMVAPSLVLTFFFSIIATLQVFSEPTTLKPLTNSVSTTWSPLMKVYQDAFGKGDIYAAAAEAAIIAVVTLVLSFGFLRAANSGNKQEEAR

SEQ ID NO: 8867 - protein, 301 aa, Streptomyces avermitilis
MSSLALRKSAPAAGTTPGTAQGPPLRRRIALVPTLTLLLGALYCLLPVAWVVIAATKSGRELFSTFTFLPGTGFTQNLKDLNAYRDGLYWTWMGNSALYAGLGALLSTAVSALSGYALAVYRFRGRETVFNVLMAGVLMPPVILAIPQYLLLAKADLTDSYASVLLPLILSPYGVYLARIYASAAVPGDVVEAGRMDGASEWRIFIRIALPMMVPGLVTVFLFQFVAVWNNFLLPYIMLSDDEKFPITLGLFTLLEQGANTPALYTLVITGATLAVLPLIALFLVIQRFWSLDLLSGAVKS

SEQ ID NO: 8868 - protein, 343 aa, Streptomyces avermitilis
MTMHATGGRRRPPTIHDVAREAGVSRGTVSRVLNGGHYVSPAAQEAVNAAIRRTGYVVNRHARSLITGRSDSIGFLLTEPQERFFEDPNFNVLLRGCTQALASHDIPLLLMLAGTKDERRRITRYITAGHVDGVLLVSSHSGDPVAEELREAGVPLVACGKPIGLGSKVSYVAADDRDGARDMVRHLLSLGRRRVGVVTGPLDTPGGVERLAGYREVLAEAGLEYDERLVVPGDYSRASGAAGAERLLERAPEIDAVFVASDLMAQGVLTVLRQAGRRVPEDVAVGGFDDSPAATASTPSLTTIRQPWDRISNEMVRVLLAQIGGEDPAAVILPTELVRREST

SEQ ID NO: 8869 - protein, 118 aa, Streptomyces avermitilis
MTAGLKTIIYPVKDLARAKALFGALLGVEPYADEPYYVGFKDAGQDVGLDPNGHAKGMTGPVPYWHVTDIRSRLSALLNAGAEPLQDVQDVGGGRLIAFVKDADGNLIGLIQEPAAHQ

SEQ ID NO: 8870 - protein, 129 aa, Streptomyces avermitilis
MAAKTTGARLEEQWRDILSVHARTMCEIDRALHPYGLGASDFEVLDILATESAEAGDQCRVQNIAGRVHLSQSALSRLIGRLAKDGLVERSVCEEDRRGVWVALTRKGRDLHAEALPLQRAALARVLNA

SEQ ID NO: 8871 - protein, 342 aa, Streptomyces avermitilis
VEPGVITAVLDRAAGAHGLRYAPDPASAALSTIGGNIATNAGGLRCAKYGVTRDSVLGLEAVLADGTVVGTGRRTVKGVTGYDLTALLTGSEGTLAVITSATVRLRPVPVATATLAAFFDSFEAAAEASYAIGRAGIEPALAELVDGPVLHAIDPALRERGAALLLVQCDGAGAAAEAEVVARVLAPSATAVETTTDPVEAESLLAARRLALPALERLGRPLIEDIAVPRSRLAEAVREIRAISARHDVPVFTIAHAADGNLHPIIVVDRSLPGLPDAAWEAAGEIFALALRLGGTLTGEHGVGVLKRQWVADELGPAAHALQRRIKRAFDPRGVLNPGKCL

SEQ ID NO: 8872 - protein, 139 aa, Streptomyces avermitilis
MDTPSNDRPTPETAAAAQEALTALSVHTMDTEALDTLADSEVLVPVPDDAAEPDASDPSIVALPVLEESGGEQTVPVFTSEPAMAELLPFVSRYRVVPLGALASQWPSAGLSLAIDAGSPHGLTLDSDGVRTLLARPSA

SEQ ID NO: 8873 - protein, 397 aa, Streptomyces avermitilis
MGDMDARRVSVDRLVGRSSGQGLVAIPLALIVVITVVDIHSPSTIHLGPLLVIAPALTASIAGPRLTALVGVVAVAAQVFIAVFHGGLATANHIAQIIALSVLSALVVFVCHVRERRDRELSRARSVAETAQLALLRPPPRRIGPLRVAWLYMTAEDETQIGGDLFAVARAAHPSTRVIIGDVRGKGLASIGEASVVLGSFREGAHRYATLPELTAALEVSVCRDLEDVADTRHDPGEHFTTALVLDIPDDDSQAEMIDCGHPPPLLLHDHQVTVLYPRRPVPPLGMCELPAASHRTDPFAFEPDDILLLYTDGVIEARSPTGAFYPLAERVASFPTSSPDTLLRHIHDDLLHHIGGQPADDAALLIIERTASHLHRPHLPARTLDGRRRIHHGGSS

SEQ ID NO: 8874 - protein, 165 aa, Streptomyces avermitilis
MQGNQTSVMTAVHGRLPGSRAGASPRRAEGRHRRSGRRGGRWHRRLLAYRDVELVQCPAPDGRGEDCLLLVHIRKVVGRVTYQACDECAEGVITDVVLDGPFRDSGLGTRALLHLRSRHPGVTWRTTLDHRLTRGLLRRMRIPRTVVDGSCSHVRAAVVAQAAGG

SEQ ID NO: 8875 - protein, 332 aa, Streptomyces avermitilis
MWDTLAQWARYRSSGAASIRRRVSIPAMTDALLSGPLVDDAWLAAHLDDPRLVVLDATALLPSPRHDGDHRSGSGHAQWAERHIPGSRHADLTGDLSDHEAPYHFAVPSPRALADALQRLGVRDGSEVVAYDSGGGIWAARLWWMLRSISVPAAVLDGGWAVWEEGGHPVAHGDETGAVRVSRPLTPVPRPDVWTGIDEVAAISRGERPGTLVCALPPGGFDGSAATRYSRRGHIPGSLSLPGRGLLDATGRLLPRSELARRTGAVLQDAESPVVLYCGGGISAAGTALALTLLGREDISLYDGSLEEWSGDLSRPIRLGHQLGDQRLGDQR

SEQ ID NO: 8876 - protein, 311 aa, Streptomyces avermitilis
MSHVRVMLDYFHPWPNSAGLYVARERGWYREAGLDVELAVQDPGRGDTLEYLARGEVDLGLFPPNRLLARRAAHAQPLLAVAAVNHRALEAVQTARSTGITRPRDLAGRRLAYNPTPRGRAMVRHLVATDGGDPDAVITVDSGYRELTVDDIAAGEADATFGNYWSWDALRGDLPEEHRLTWPVDEIGAPRYHSYLLGTSEAFADTEPGLIRAFLSATARGYAAAAAEQDRAQALLERVIPYFSRPLIARSLALVAPTWTGADARWGVIDETRMGPYADWLARHGAIAHARDWASSYTNELLETTAPAVST

SEQ ID NO: 8877 - protein, 345 aa, Streptomyces avermitilis
MRPRTTALLALATAAALTATGCAAQDSTSAATKNGTTQVTLALDWTPNTNHTGIYVAQQKGWFKDAGIDLRIVPYGSTAPETLVANHKADFGISYQEGVTTARSAGQDITSVYAVTQKTNVTVSVRADRDDIKSPKDLDGKTYAGFGAPYEKALLQKVIQEDGGKGDFKQVTLNTSAYAALYAGKADFAMPMPTWEGLEAKLTGKPLKDFQLADHGFPAIYSTLVASSGQYLKQNPEVAKKFLAVVDKGYEYAAGHPGRAADLLIAANKSTLTNTELVKKSETLLAKEYYRAADGTIGTQTAERWQDFADFEFRAGLLTDKNGKKLTKAPDASTYFTDAYLPDTK

SEQ ID NO: 8878 - protein, 257 aa, Streptomyces avermitilis
VRAVLRAVWPPLLVLVVLVTGWQWYVSAAGVDPTVLPGPGRVLSEGWSNRTDLWDQTLPTLQETLLGFALSFAAAWLVAVVLDFSAVARRGLYPLLVASQTIPIVAVAPLLIIWFGFGLLPKMLVVTLTTFFPLAANLAAGFAATDRDAMRLLRSLGTGRLRAFRLVRVPSALPHFFTGLRVSITYAVVGAVFAEYAGAEKGLGIYMQAQKSAFRTDLVFAAVTVTALLSIALFGATCLLQRLVLPWERALVKEGTS

SEQ ID NO: 8879 - protein, 275 aa, Streptomyces avermitilis
VGAGAGEGGHVMSLEVRGAGKAFGTLEVLRELELSVRPGEFAAVIGPSGSGKSTLFNLISGLDTPTSGEILVDGAPASVASGKVAYMPQKDLLFPWRTVLDNTALGLEAQGVRKKEARRRAGELFEAFGLDGFQSSYPFQLSGGMRQRAALLRTVVLERPVLLLDEPFGALDSLTRTEMQLWLADMWQRYRWTVVLVTHDIREAVLLADTVHVLSPRPATVVERVEVPRSGPRGLDALAEPEFAATERRVLDALRGPTAVTAAVTTAMTTAVSAT

SEQ ID NO: 8880 - protein, 374 aa, Streptomyces avermitilis
VSSHLAHGMGTEPVEPDWPPLTEAEVADVVGPSRVVWRSPRPLSAAAVVERGGRRLFVKRHHLSVRTPEGLAEEHAFLRHLRERGAPVVEVLDVATRQEWVYEVHSAGLGTDLYRDDLSWSPFRSSTHARAAGAALARLHLAADGFEAPRRIPQPLVASFTIFAADDPGTALERYVAERPALAGALADHPWRADTRRVLLPLFERLAPHLPLLEPLWTHNDWHASNLLWDASGEVSTVLDFGMSDRTTAVHDLATAIERNAVQWLQPGFPVREQDVDALLDGYQSVRPLTVSESAALPELLPLVHAEFALSEMGYFHGITGSAENTRLAYAYLVDHAEWFTGDAGSHLVDRVRHRAAAAPKPPPAGRPLSDASS

SEQ ID NO: 8881 - protein, 489 aa, Streptomyces avermitilis
MLPGEGHAARRVLMVCMAAGVTTLLDQSVLNIAVPALRQSLEAGSTDVQWIVAGYSLTFGLMLVPGGSLGDVHGRKGLFLVGLSVFVLFGVIAATGVRPEMVIAARLMQGAGAGLVNSQVIGTLQDVFTGQDRARALGLYAVTGGLAAALGPALGGTLVAAFGPELGWRLCLLLSTPCGVITLWLAALWLPRARRPDGRSRLDWWGLLWVGALTLTLMLPFISTPSSGGEAALWAGAAVVLTACFVLGQRLRVRAGRAPLVHPSLARSLPYTLGTAVAMASFGSSLAATLVLTMFLQSGLGLSAPAAALVTLPAALAMGGASAVAWRTVRRLGPHTVTLGLALGILALLAAAAGAVIASRTALPWVLAAVQLCSGAASGLTVSPNQAQVLQHAPAEAAGVAGGILQMAQRIAAAVALSAVSGSYLRGVAGAAGAPRAAFAHAMLICAALLALAVALSLLRSHRTGPRRPPTLLAPGHPQATPAPVHEEP

SEQ ID NO: 8882 - protein, 401 aa, Streptomyces avermitilis
MQAHRDEFIAKLVATTEAEISQLEHDEPLRGLLEASITENIVTSLHVVINRIDPGTVDAPASAVSYARRLAQRDVPLSALLRAYRLGHAQSLDLVLGEAVRLNLPDIAGTLITLVSLSSAYVDRVCDQIARVYEEERERWVGTRGVLRRHWVTQLLDNPRVDQRQAEAALGYRLSGSHLGVEGWLDGTAATTDPTAVFDRLASLLHTVLRAHGRPLLIHTDEAGVRIWLAVRPDCPVDADTVAAELADAALPVRVALGSVRPGLDGFRRSTRAAARAKALALSAGPTAPRAVAFARVAPVALLVDEPRELADFVSDTLGDLAVDDPRNEVLRETLRVFLATNRSYAATADHLTVHRNTVHYRVQRAVDHYRLDLDANAFDLHFALNVCRWHGGKVLRPKGK

SEQ ID NO: 8883 - protein, 471 aa, Streptomyces avermitilis
MSDAIVVGAGPNGLAAAVALARRGLKVTVLEAADEIGGGTRTSELTVPGLLHDHCSAVHPLGVGSPFLRTLGLERYGVTWAWPDVDLAHPLDGGRAGVLVRSMERTVRGLGPDGPAWERLFAPLAEDFDALTEDLLRPVPHLPAHPVELARFGLRALQPATTVARRWRGAEARALFAGAAAHLMHPLTGPTSSAVGLMLVGAAHRFGWPVARGGSRTITDALAALLAQLGGTIETGVRVDSLDQLAAARIVMLDTAPGAAARICGDRLPGRVRSAYEGWRHGPAAFKVDLAVQDGIPWTHEACRRAGTVHLGGTLEEVVRTEAQTAGGRMPERPFVLVGQQYLADPSRSRGDVHPIWAYAHVPHGYPGDATEAVLRQIERFAPGFRDRIVGIAARSTAELARSNTNFVGGDIVGGANTARQVALRPRVALDPYSTGIPGVYLCSAATPPGAGVHGMCGANAARSALRYLDR

SEQ ID NO: 8884 - protein, 580 aa, Streptomyces avermitilis
MGFLAPNMADVDIRQWRTRPYQQRIRPLAEHWAGHGFGTPGIVHLLYLVKITAYALGGIAVVSLTPGVGGIAHFGSWWAEPLVYQKLVVWTLLYEVLGLGCGSGPLSSHFLPPVGAFLHWLRPGTVRLPPWPDRIPFTSGTRRTAADVTLYAAVLGAAGWLLCAPGGPGAAGVAAPWRVAVLAAALALLGLRDKTVFLAARAEHYGLTLLVFLFPAADMTAALKLIMLALWWGAATSKLNRHFPFVVAVMISNSPLRPAWLKRRLYRHYPDDLRPSGLAAAAAHGGTVIEYVVPLVLVLSHGGTVTTVALAVMVVFHLHIMSTFPMGVPLEWNVFFIYSALVLFGHDAAVGAFALHSPALAAVLVLSLVMVPVLGHVRPDLVSFLPSMRYYAGNWATGLWCFRKGTEHRLNEHIVKASGLPVDQLTRLYGADTAELVLHQGLAWRAMHSHGRALVGLLPRAVDDVESYDVREGEMVAGAVLGWNFGDGHLHNEQLVAAVQQRCGFAPGELRVVLLESQPTHRSRQHYRIVDAASGLIEEGYVNVRDMVVRQPWLDDDTPAIPVEPIEAPRPVTEAAAAHE

SEQ ID NO: 8885 - protein, 485 aa, Streptomyces avermitilis
MHSAELPDLRARQDADGACIADDAADLDNAAFARRVRRAASALRARGVGRGDVVALLLPNTADFVVALFAAWRLGAAVTPVNPALTESEVRYQLGDAGAAVAVTAGPSPLAGALPVAELSTGPEDTTAPETDAGALALLIYTSGSTGRPKGVMLDHANLAAMAEMMTGTARLTETDHSLLILPLFHVNGIVVGVLSPLLAGGRVTVAGRFRAETFFDLVATVRPTCFSAVPAIYSMLAELPDHVRPDTSSVRFAACGAAPMPAALIERFERRYDIPVLEGYGLSEGTCASTTNPLYGRRKPGTVGLPLPGQQVAVMDPQGRIAPAGATGEVVVRGPNVMRGYLGRPEETARTVIDGWLHTGDVGRFDEDGYLVLVDRIKDLIIRGGENIYPKEIETVLGDHPEVLEAAVVGAAEPRLGEVPVAFVALRPGASATTADLLDHCRARLAEFKVPTGITLVGRLPRNPVGKTDKPALRSGTTALTTAG

SEQ ID NO: 8886 - protein, 403 aa, Streptomyces avermitilis
MTALLPEKTSVDERLAADFYDIESLLPPHERELLTHARAFMRTEVKPLVNEYWAKGEFPRELIGKFRDLGLAGVPYEGYGDPLPAGSNLLVGMLSMEYTRTDASSATFFGVHSGLAMYSIYRGGDQEQRDRWLPSMAALDTIGAFAMTEPLGGSDVAGGMRTTARRDGENWVLNGAKRWIGNATFADLVVVWARDEADGKVKGFVVEKGTPGFSPVKIENKIAFRIVENAEITLTDVKVPEANRLQRIDSFRDVAEILRATRSGVAWQALGVMLGAYELALGYAKERKQFGRPIARFQMVQDLLVKSLGNITACWGMLVQLARLQDAGVFRDEHSSLAKAFVTSRMREVVAWCREIFGGNGIVLDYDIARFFADAEAIYSFEGTREMNTLIVGKAVTGESAFV

SEQ ID NO: 8887 - protein, 318 aa, Streptomyces avermitilis
MTKPFTAAAVVGAGTIGLSWAALFAGHGIRVRITDPRPDLAEAVAEALDQAAGQLAAQGLDVHGLAERVLIADDLADAVRDADVVQENGPENAAFKRELFTDLVGTAPAHALLLSSSSAIPATAFTDTIEDAGRILIGHPFNPPHLVPLVEVVPGERTSEESVARAVEFYRFVGRVPVVERKEIPGFVGNRLQNALSREAIYLVEQGVVSPAELDTVMVNSLGLRWATVGPFLGAHLGGGPGGYRHMAEHIGVSMQKMWDSLGRPEQSPEHVERLVEAVENAYGSRSYADLSQERDARQIAVLSARDSATHLEKETRS

SEQ ID NO: 8888 - protein, 251 aa, Streptomyces avermitilis
MNQQDVPRHFATPLANPAYPPVVPRFTNREYLNIVYRTDHEALRAVVPEPLEIDEPLVRFEVMRMGDVSGYGPYTESGQAIPVTYQGERGEYLHAMYLDNLPAITSGREASAYPKTAGSPGLYAEHGALVGVLDVGTLRVATATMGYKHYELSVEEAVAQVGVPTYMLKLVPGFDGAPQVAQLVRNEITDITVKGAWTGPARLQLFQHVLAPLADLPVREVISASHILTDLTLAPVKPVHDYLAHPAYPTR

SEQ ID NO: 8889 - protein, 256 aa, Streptomyces avermitilis
MHSTTEVRTETIGSSLLITIDRPKARNAVNAAVATQLAFAIDQLEADPALRAAVLTGAQGTFSAGMDLKAALAGESPEIPGRGFGGLTRARTTKPLIAAVEGWAMGGGFELALGCDLIVAADDARFGLPEVGRGLIAAGGGVIRLPKRIPYHLAMELLLTGEPVSGERAGQLGIANRVVAAGETVATALHLAERIAQNAPLALAAVKNLVRAADGAPEEEAFAVQGRLMATLAASADVREGMTAFTERRSPVWQGR

SEQ ID NO: 8890 - protein, 389 aa, Streptomyces avermitilis
MMDSTTAGDTGPLNGVRVIDLSTVVMGPYAAQILGDLGADVIKIESPSDTVRVGPYRTTPGMTPLNLNVNRNKRSVSLNLKDDADRARALELIDSADVLVTNMRPGALARLGLAHADVAARNPGLVYAHAQGFRSDSDRAGNAAYDETVQAASGLVDVANRALGTPAYLPTIIGDKVCALTIVYTVLAALVHRGPTGAGQYIEIPMTDTLIAFNLVEHLAGHVFEPPEGPTGFPLSMKRGHRAVPTRDGLACVIPYNPQNFRDFFLAADRADLAADPRVNGEAVADDDVDALMELVGECSPSMTTEEWARVCAKHSIPMAPVLELERAAEDPYVRGGRLLDVVDHPSEGAIRTVGIPVRFSATPGSVRRLAPLPGQHTEEVFGELATGR

SEQ ID NO: 8891 - protein, 303 aa, Streptomyces avermitilis
VDMLHLRYFVAVAEELNFSQAARKLHMAASPLSQRIKDLERELGYELFERTTHRVDLTPAGSALLPMARDILERVNAIPWRLSEAVRPRLDRLFIGMPAGVHPLLRERVRLLEDACREVCELKRWPGTSADLADAVHDGRLAMALVRLPVSDPALEIIEVMRERLGAAVPADRFAGRASVTLDELADLSYVATPNDATPAYFEEIDAHLNSVGVKKRIRINMADYSGSSELISSGMAFSMTMLSPESPMHLYRLDNVVVLPVEDFQPALVTGLLFRRDRADDGGDLSDVAARARQIFHEVISV

SEQ ID NO: 8892 - protein, 467 aa, Streptomyces avermitilis
LLLPPPCTPARLPELPMQTSSCAPARRPSTGAARSRTALGLVVALLAACFVAMTPSPAWAADLLLSQGRPATASSTESSAFPAAAAVDGDPGTRWSSAFADPQWLQVDLGSVQQITRVGLRWEAAYATAYQLQTSTNASSWTTIYSTTTAAGGTQSLPVTGSGRYVRILATARATQYGHSLWEFEVYGPGGTPPQDDFWGSTSDIPPANNAVQVKILNRTNGKYPDSQVYWSFNGQVHSIAEQPYLDMPANSAGRMYFHLGTPDSPYYDFIEFTVGNNVFNGNTTRVDAFGLKLAVRLHTKDNYDVEVGENRQTFAEDRAATFQRFTDAVPAEFKVLTRTQGPYRIIAPGSDPSFRAGGANANYFTSYAQSVGVNAATSDIFGCAASLAGHPDVCAALNRHVATLPASQQADPAQYYKAAPANYYAKFWHDNAINRLAYGFPYDDVASQSSFISHSNPQWLLVAVGW

SEQ ID NO: 8893 - protein, 463 aa, Streptomyces avermitilis
MVNHATGAPALARSLTLRAVTLFGLAYMTPLIVLGTFGVVAADTGGAVPTAYLLALVAMLFTAHSYGKMAAAYPVAGSAYTYVRKAIDGRLGFLVGWVTLLDYFFLPMVIWLIGGAYLQAQFPAVPSWIWIIGFIAVTTVLNIRGIKTAERVNDLLMVFQVLVIGIFVVLSLRHVLHIGGAGALASGAPFANGATTAAGISAGAAIAAYSFLGFDAVTTLTEETVDPKRTMPRAILLTALIGGGIFVLVAYTTQLAHPGSSFDDPSSAAFEIAKSIGGDLFSSVFLAGLVVAQFASGIAAQASTSRLLYAMGRDGALPRKVFARLHERYRTPALNIVLTGAVGLIALRLDVATSTSFINFGAFVAFTFVNVSVLAMYIRRRRAGDTLNPLSYVVAPAIGAVVDLYLLYNLDGRALTLGLIWLGLGVVYLAYLTRMFRVPPPEMSFTPADSDEAQVAGALQNTK

SEQ ID NO: 8894 - protein, 289 aa, Streptomyces avermitilis
MSRPLPLALAQLPPRPAHAPLSGFAAEAESILARFPHTRMAVFPELHLCGVDALGAEAHEQLREIAEPLDGPRVKELAELAGDLGVWLLPGSVCERGPAGELFNTALAFSPQGRLAAWYRKVFPWRPSEPYDPGDRFVVFDVPEAGRIGFAICYDAWFPEVARHLAWRGAEVIVNPVMTTTSDRAQEVVLARANAIVNQVHVVSVNTAGPLGSGHSLVVDPEGRIRAEAPGDGTAILTDVIDLDDVTRVRTHGTAGVNRMWDQFTDTDAPIELPLYGGRIDPRTWRPGA

SEQ ID NO: 8895 - protein, 256 aa, Streptomyces avermitilis
MPGSDNVPTTGLTALELSGVRRLSALEAVRARIALAVDLGLLSPGERLPGTAQIARALDVSEITARRALVSLCGDGVLERRRGRNGGTLVAAHPTPGTVLTTETYRTATDAVHRLIDHRLALECGIAHLASVRASGEDLSELQEIVEEMDRAPSWAEFHGCDERFHLRLAEATGVPSITGPYGAVLRELYRYYLPYPVDALRASNREHRDLLDALRRQDTAAASEAARHHVETLRHTMFVGLLSASADTGTVAPGS

SEQ ID NO: 8896 - protein, 340 aa, Streptomyces avermitilis
MSTYRAAQVAAASGPFEIVQREVPRPGPGHVRIAVDACGICHSDSVFVDALLPGVRFPLVPGHEIAGHIDELGEGTDISWQVGDRVAVGWFGGSCGHCPPCRQGDFVVCQNLKVPGWAYDGGYAEAVIAPADALARIPDALAATDAAPLGCAGVTTYNGLRRSSARPGDLVAVLGIGGLGHLGVKYAAAMGFETVAIARGSDKADFAKQLGAHHYIDSTADTTVADALQSLGGAKAVLATAANSDAITATVDGLAPRGELVAIGVDAEPLGISPNQLLMGGKIIRGHPSGTAQDVQDTMAFSALHGIRPMTETVPLDQADEAYRKMMSGAARFRMVLTTG

SEQ ID NO: 8897 - protein, 233 aa, Streptomyces avermitilis
MHLGVIGATGTIGSRVVTEALARGHHVTAFTRDSTQIDEDRGNVVWKSLDVLDAASVAAGISGLDVLISGFQPGNAAKDIADTVARSIADPTVYATAARSLLKALESHPRTRLIVIGGAGSLEIEPGVVRADSDELLHSSLDALGLPRQYAAAVRGHRDALNVLRTSNRLWTYFSPAEDIAPGERTGRFRTGGDQPVLDAEGRSRISVEDAAVALVDEAELPRFVQRRFTIGY

SEQ ID NO: 8898 - protein, 250 aa, Streptomyces avermitilis
MYGTHHRDAVESATVGKTNGRRERLRAETTAEIKRVALELMATGGPDAITLRAIAREMGMTANAIYGYFATRDDLVTTLINDVYTSLVDTVDTAWETAPAQDPAARIQAWACAFRGWALAGPEGFRLIYGDPVPGYRPPAGGAAPDAAHRVCKGITALAAAAWPHAEHRYADSDFSWSDFDTGLLDKVRPAFPELPPAAVALALRIWSHLHGLISLEIYGHLQTQTLNPDKLFREELAQLIRSLSMTPQG

SEQ ID NO: 8899 - protein, 85 aa, Streptomyces avermitilis
VLAPQACPAPGHASPRGSCRPRGPGTLAAMTSTANSGSSVSMTTPHFLPTISLPAISSPAPTPWLAAAHCFPLTQFRITTFSSLP

SEQ ID NO: 8900 - protein, 341 aa, Streptomyces avermitilis
MSGWTLFELSPGGTADPDTGVAAVSRIPGHMEVWWVGPNGSVEGAYWYDGHPWARYQIAPNGSAGGASRITAVSRIPGHMEIWWVGPNGSVEGAYWYDGHPWARYQIAPNGSARRHGITAVSRIPGHMELWWIGPNASVEGAYWYEGSSWARYQIAPNDSAALNGGITAASRIQGSMELWWVGPNESVEGAYWYDGHPWARYQIAPAGSASAVGGITAVSRIPGHMEVWWVSRNESVEGAYWYEGSQWARYQIAPNGSGYRGSDLTVVSRVPGHMELWWTGTDNSVQGAYWYDGHPWARYQLAPAGASSGDGIASVSRIPGSMEVWWLTGRQSIEDGYWYE

SEQ ID NO: 8901 - protein, 160 aa, Streptomyces avermitilis
VKMSGGVEWALHCCVVLTSVEEPVPATRLAELHDVSASYLAKQLQALSRAGLVRSVQGKAGGYVLTREPASITVLDVVEAVDGPDQAFTCTEIRQRGPLATPAESCAVPCAIARAMTGADAAWRAALRAVSIADLVQNVRSDSGPGAMAGISAWLSAPDA

SEQ ID NO: 8902 - protein, 242 aa, Streptomyces avermitilis
MKFAVIGGTGLIGSQVVKNLNAAGHEAVPHSQSTGIDVISGQGLDQAVAGADVIVNLTNSPTFDEASPAFFQTSMDNLLAAGRKAGVRHFVILSIVGVDQVPELDYYRAKALQEKILAAGPIPYSIVRATQFMEFIDAVLSWTADGDTVRLPATPIQPIAAKDVADAVAEVAAGAPLGGIRNVAGPEIFSLDELGRITLSHKSDGRTVVTDPTAGMFGAVKGDVLTDKDAHLAPTHYADWLS

SEQ ID NO: 8903 - protein, 360 aa, Streptomyces avermitilis
VTSSPTRTPTSPPPTTPTGSPEPLAPSPARGPHELVLPATEPAAGSGMRPMEWNSANRFTSVGNKGRDAAQRQEKRMSSRRPPRRDPRSHAHGPARRWWRRHWKAGTAVLSALFVATASPLIYDAIKSGTSAIVEGDRPPFAWTTQVDSPEDAGCKSYVFDSDAKMSAPSPNEDWQVWATRQGGTAANLTTIRLTLQGRSASSVVLHGLRVDVESKSRPKGSVYDLGLSCGGLTSRNFDINLDDPEVAPASRAGDDGTPAARFPYRISSTEPEVFLVHARTENCDCRFHLNLDWTSGDRKGTLRIGDGKNAFRVIGTQRLRWFELDMDKQQWVKQPVVDTVPGAELGRLVKRSDVRREAA

SEQ ID NO: 8904 - protein, 180 aa, Streptomyces avermitilis
VVDPAPEHPYPDGHRPDEAPAPHALLEPVLGLLGSWYGRGEGGYPTLTGDFGYAQELTFSHDGRPFLRYEARAWLLDADDAPLRPSARECGWWRLQPDGRVEALITQPTGIAEIMVGRATGNTIDLSTHEVALAPTAKKVNATRRRYTLTDDDTLTFHHDLEAVGQPMQHHLSARLRRRG

SEQ ID NO: 8905 - protein, 950 aa, Streptomyces avermitilis
VGQSRADSKRPTGLSRARRSGISGAAALIGVAALVVSAVPADAKAGGPVPPPSPGELIPGQKTATPALVEGLREQAPAARNAAGAARAYLAAKQDRYRIADPGRDLEPLGTVTADGQETVRLRQRYHGIPVLGGQYVVRMEKQDGGRVVTGTSGKYFTGLRTGTTAEVDDALAVERAVDAVLARLGAEKFTAYGEDDEGKKDATPLTGTSHGLVVLPTGTGVLARHVTVRGADPARGEPVLREVYVDAQAGYPVLQYSGIRTFDAPGTTAEGSAASHPAQEPTEPAPGETGSGVKLDGKPVELQVTHDDTRAAYVLRDHSRIHNDTADVLATWDARGKWASDVVGNWPADLQEFASPTPAFGAEATEAGAVDAHWAAGQVYDYYKNKHGRDSLDGRGMSINSLVGTTDYGQPYVNAFWDGQKMVYGNGDAEYRPLAAGLDVVGHEMTHGVVDHSADLVYAGQSGAMNEAIADYFGNAIETDVHGIAMADPDSGLLGEALCRTRTPRECAVRDLNDGRTTAKSFLGVGFGTDNGGVHLNSTIFSGALWDIREDVGPTLADKIVYKALTEYLTPLDGFTQGRDAVIAAARALGTGGKDLTAVQRAFNAHGIVPNWELALGVDSDLLIERVNTYDSQLGAGGDWWTAATSNEEGSEAYSVWAGRTDGTGQLKLMSPNDGRYHVNPATDGKTVVWQAHGTSGVDILARPLAGGPVKTLWHGRSVGGALDVDGDVVAFAYNNHGGRAGVAYLSLKDPANVVTIGGGTYHRATFPSLSHGKVVYQDRQRVSAVYETTTRVVDVATGEDKVIQRAAPGASLGPTAVTGDHVYWLLDEIDQNGTTALRRAGLDGSGITDLSPETGPESLNVFDLTASEGAVTVDARTPDPAFRNESLAKLWQFSAEGKGDGVRKSRVSCNRGEQLSAAAASGTQVVWLDATTGISNVVTRTRPSGTCG

SEQ ID NO: 8906 - protein, 267 aa, Streptomyces avermitilis
MTVKGGTAVARREQTDGATLQGKVAIVTGGAGGLGRATALALGKAGARVVVADLDPQGGKEVADLVGGHFRACDVSDLDANRALVDFAQEQYGGVDIAFLNAGVTTGCGVGEDFDLARYRRAMGANLDGVVFGTHAVLPALRARGGGSIVATASLAGLAAVPLDPLYAANKHAVVGLARSLGQALAPENVRFNAVCPGYAESRIIDDLRDMLAEQGLPVIPAQAVADTVLRIVTGDGTGECWFVQADREPEPFRFRNVPGPGKPAGT

SEQ ID NO: 8907 - protein, 318 aa, Streptomyces avermitilis
VKPDDWEHCSGPVEEPGPGRFAGRTRVISLDPAMRGWLDDRPSYLPPVGIGEVMRAGSVIEVTASNHPDFQPGDHVVGTFGVQEHVVSDGKGAMKIDTSLAPPSTYLGALGMPGMTAYFGLLEVGALKDGETVVVSGAAGAVGSMVGQIAKAKGCRVVGIAGGPEKCALLTDELGFDAAIDYRTEDVRKALRGHAPDGIDVYFDNVGGDILDAALTRLAMHARVVVCGAISQYNNATPVKGPSNYLSLLVRRARMEGLVVFDYAKRYPQATQEISGWIGAGHIKVKEHVVRGTVDDFPETLQMLFRSENVGKLVLELA

SEQ ID NO: 8908 - protein, 179 aa, Streptomyces avermitilis
MTHADDNRYPPAAPPGWPQPRTAPHENAPRHEPYGYDAPRHDSYGYDTPRRDSYGYDASPYDPYGQAPRHRPSTHEPHRHHADLAALRSAYRVLRRVSTLTALGSFVVYVVLSCYAPDLMGSKIAGELSLGMALGVLQLIVTFAAVLWYGRSAQRSVDPLARVVRERAVRPGRDAEVAR

SEQ ID NO: 8909 - protein, 538 aa, Streptomyces avermitilis
MNDFSSGTQATVLILFTALVTLTLLMCVMAGPDRDDLTNFYTGYLSLTPLKNGLAIAGDYISAATVLSTTGIIALAGYDGDVLAVSTAMSLVLLMFLLAEPLRNAGRFTMGDVLARNMPGRAVRIASCVVTLAATLPFLVVQLSGAGSLLTFILGIPHLSGARTVCIVLVGSLMIIYAAIGGMRGTALIQMIKIVLLLGTSVALAALVLNRFDWNPGDLLRAAQRGSGAGPAFLQQGLQLGTSAGSRLDFVSLQITVVLGVACLPHITMRLFSARDVPAVRRSMSWAVGTVTTFCLLVIVMGTGAAALVGSRYITAADPHGRTSVLMLSQVLGGDADSAGATILYAAMAGTVFITLLSSVAGMTLAAASSLAHDLFAHAARRGQAAPRTEMTVAAWTSVAVGTVAITLSTLVQHWDVGVLTTLAICIGASAVAPALTYSLFWRGFTRTGLLGSLYGGAACALVLMVFSQAVSGTPSAVFPKADFALFPMQSTGLVSIPFGYLAGWLGSRLDRRRRAAESRENQRLYEESEARLLAAAE

SEQ ID NO: 8910 - protein, 359 aa, Streptomyces avermitilis
LAGYVTNLSLQPVRLPIQAVTVLERRVVVVVYAGALALDITGPIEVFDTANRLLPPAGAPYRIDLVSPDAPLVRTSSGVRVEASPLDAGQGPIDTLLVPGGWSLDNALRDRALVSWIGRAAARSHRVASVCGGSFLLAEAGLLDGRRATTHWAYSEAMACRYPDVTVDAEPIFVWDGPFVTSAGVSTGIDMALALVEADHGAALALETARFLVLFLKRHGGQSQFSAILDAQLADHPPIRTAQEWILDNLHNPLPVAEIARRANMSLRNFARVFRREVGTTPGQYVERTRIARARELLETTDLTIGQIAGRCGFAAPETFFRSFGRTLGLTPKEYRHRFQVISPSGLIDRHHETDRSPA

SEQ ID NO: 8911 - protein, 598 aa, Streptomyces avermitilis
MTTPTSDIRSGIPSDLPEAGTVRLVDHLAGELARAGVTHMFGVGGANIEDLYDAVHRGRAVHGVVAKHEFSAVTMADGYARTTGRLGVVAATSGGGAMNLVPGLAEAYASRVPVLALVGQPPTGQEGHGAFQDSSGRAGSFDAREVFTPVSRFCARVENADSLTELLPRAMAAAQAHPRGPAVLLLPKDVQQARIQVPGRGATPTPGMPEPEPTAEAAWLDSAVLTAVSDTLRGAGRVLVIAGEDVAAADARAELAELAGRLGAWVAVTPDAKDVFDNRDPRFAGVAGVMGHANVEECLRRADVCLLAGTRLPLLARGGLDRALAATEVVCLGPEPPFVAGTALGGNLRDALRAVTGRLPPRPRACPEHAGPLPTPTPSPVSQARGRPIPYAQAVAAVEAALPQDAHVFVDAGNAGASAVHLLPAPRHGRFVVAVGMGGMGYTFGAGIGAALATGRRTYVLAGDGSFFMHGMEVHTAVEYAAPVTFVVFNNNAHAMCAVREEFLQGGVRSDDLFARTDLAAGVAAAFPSLEVTGADDAAQLRQALLRSNAGGGPAFVALDCDPGEIPPFLPFQSFTEATENATENKESPVERGIVHVG

SEQ ID NO: 8912 - protein, 217 aa, Streptomyces avermitilis
LNEESSTLADIPGLMRIENPGKEELTAHCMELTHAVYPHHQVYGQYCTIHAYVDCPPERAYDYLRQGHHLEEWTCSLRDFAPAGPPGLWVGHDRLEDDTRIYCEVVANPEAMTVDYHCSWDQGEKLWMIYLMRVVPARLVLDKPGSVITWTNCRHPYYDDNPHPGAAPRPDRPWVGDYWDLFYAGHTVEMNNLKAILEHRHRNGLPVNVAPPTAVAR

SEQ ID NO: 8913 - protein, 339 aa, Streptomyces avermitilis
VTTVSLTDVASYLPGEPVPAEFYTDYPGAEDKLRNHPMFKVPPSRHHVAADESNADMVERAVQPLIERHGRDEIRGVDVLLVHSQLPDLPFVGAGTEVARRLGLNPEWLVDVANAGCASFVYMLKLARQILTTTDAKTALICNAQSAAGQCFTQSEVRRLAQAAIPGDGCGVGYVTTSADTPVLDVETRHIGEYAGDMTVAVDDGRKYWEPGESQLRIGFTDASVAKVLARGNRLVPEVVTDLCRRLGVATADIDVLITNQPNRTFLRNWREALQLPPERHLNTFDQYGNLFGAAIPITLDRAIRSRQVEDGDLVVLGGFAHAGDFAGATAVRWHGGRG

SEQ ID NO: 8914 - protein, 364 aa, Streptomyces avermitilis
MDVPVLHRLALNESPYPPLPSVRKAMRRAVAQAHRYPQFYPDDLTELIAAWCRVTPDRVVVGSGSVGVALQLLQAVVEHGDTMAYAWRTFDAYPLLAAMVGAHPVPVPLSPDGQQDLGALLAALDHRTRVVVLCNPHNPTGSLVTADDLSAFLRQVPPRVTVLLDEAYVEFARGPGLPDTPALLGAHPNLLVLRTFSKAYGLVALRVGYGLGAPDLVARIRRQQLPFGINAVATAAVRASLRADGELRLRVDTVVAERERLRHELVDLGWRVRPGHANSAWLDAPDPIDEGAAALTAAGVQARHYPGEGLRLTVGSRKANDAVLAALAGVGRHTASGRRASSAAPDGTVAAHRRPPVSGQRPDG

SEQ ID NO: 8915 - protein, 265 aa, Streptomyces avermitilis
MKISDHPDHGSGFAPVDHRTAVAAETARFVAVVKDADLATAVPGCPGWTLADLVKHTGSVQRWFSVLLRARIQEPPQKREVDLRFPDEEGGYADWLAESATVAAEAFAATDPNLPMWAWGVDQHARFWARRMLFETLLHRADAELALGLRPTIDRPLAVDGIDEFLVNLPFAAFFAPKVANLRGPDRTIRFRATDGDDDWLVRLRPDGFGLDTTHPTEDTAAATVRGTATDLLLLAYGRLPYDAEALAHEGDEGLLAHWFANSAF

SEQ ID NO: 8916 - protein, 57 aa, Streptomyces avermitilis
VRGGGIGAVSEPSSPLVLVQPVPELPFGGVGVRAGDPADTSLDMASHSHTILSRPLG

SEQ ID NO: 8917 - protein, 502 aa, Streptomyces avermitilis
VSHAQHAVPRRHSGDTVVVLALGLAAMVVSMMQTLVVPVLGIIQSDLEVTTANVSWVTTATLLSAAVFTPLLGRFGDQHGKKPTLVGVLLVMIAGSVLAATTTSLTWLIVGRVMQGAATAIFPLALSVLREEIKPEKLHGAMALVSGTLAFGSGLALVGAGLLTQGSDPDYHRVFWLAVALAVMALAGVLFAVPASRTKTGGRTDWLGAFTLAMLLVLLLLPISQGHEWGWTSGRTLGAFVGAIVMAVVWVITESRVKEPMVDMRMFAHRPVLFTNLAGLLLGFAMFTQFIGVSYLVQMPEDVAGYGFGASVLAASVVYLLPTTLVSLVGAQFGGVLVRRLGARVTLAAGACFGVLGFTWLSAAHDATASVIGAGMVIGLAISFGYASMPALIVASVPAHQTGIANGINSISRSVGSAVASAVITSLLASKTIPLPDGMPALPQESQFTLSFTIAGAAFVLVVAVALVGLKAAHAPRTPVLRKVTQSGTPQSAEVEADAELV

SEQ ID NO: 8918 - protein, 145 aa, Streptomyces avermitilis
MTGTPRIDTAQLMELLSVSLAAYYGDFTVAAASESLTASQGKTLNVLRRGPASMSVLATTLTCDASNMTGIVDRLEKRGLVRREPSPSDRRVKNVILTAEGERVIDVIRGKMHATLAGLNRLSAQERDTLYALLERAFTAQLAAA

SEQ ID NO: 8919 - protein, 260 aa, Streptomyces avermitilis
MAGLDLTGRTAVVTGASRGIGLAIAQAIAAAGGNVVLTSRSQEAADAAAARVGGTAVGVGAHAVDEEAARRCVDLTLERFGSLDILVNNAGTNPAFGPVIDQDHGRFAKTFDVNLWAPVLWTGLATRAWMGEHGGAIVNTASVGGMAFEANIGLYNASKAALIHLTKQLALELSPKVRVNAVAPGVVRTKLAESLWKEHEQAVSAATALGRIGEPADIASAVAFLVSDAASWITGETMVIDGGQLLGDALPFREGAGIGL

SEQ ID NO: 8920 - protein, 421 aa, Streptomyces avermitilis
MSLFEMSDRAKKYQAELLEFMDSHVYPAEAVYHEQMSASGDPHFHPPVIEELKAEARGRGLWNLFHPHPEWGPGLTNLEYAPLAEIMGRSHIASEACNCNAPDTGNMEVLTLFGSDEHKEKYLKPLLDGTMASAFAMTEPRVASSDATNIELRMERDGDEYVLNGRKWFASNALHRNCKVLIVMGKTDPTADPHRQQSMMVVPIDAPGVTVMRGLLVFGYQDREGHAEIDFTDVRVPAKDVLKGEGEGFAISQARLGPGRIHHCMRAIGAAERALELMCRRAQSRVTFGSPVAERSNIQDWIAEARIDIEMIRLLTFKAAYLMDTVGNKGARTEIAAIKVAAPNIALKIIDRAIQVHGAAGVSEDFPLAMMYAQLRTLRLADGPDEVHKRAIARHELGRYRDAAGAAGGTVTPGGHKAVVS

SEQ ID NO: 8921 - protein, 242 aa, Streptomyces avermitilis
MTMTSDSSRVSRMDTTGPEEIDGEKVPPVAPLSHLREPPTTKRGARTRAALVKAARKVFERDGYLDTRLTDITKEAQCAAGSFYTYFTNKEEVLAAVLLEAQEDMMHPGMSRVQGSDDPYAVLEASNRAYLEAYKRNAKLMALLEQVAQVEPEFRTFRSRRADAFIRRNARGIADLQARGVADRGVDPLMASRALSGMVSVMAYNAFVLGERHEEDAPVDFEELVSTVTRLWANALRFPGHG

SEQ ID NO: 8922 - protein, 215 aa, Streptomyces avermitilis
VNTVSNVAEKTRTAVLVDFGGVITSSVLRAFTDFGASLGGDPRLPLDLLGRDQPSRTLLADHECGRIDAEAFERGFAERLRVHGADVPAEGLTARMQAGMSIDQDMLALLGGLRAAGHPVALVSNSFGTGTYDGVDLAAVADVVVISAEVGIRKPSRRIYAIACERLGIDPEEAVMIDDLRQNLDGAARIGIGGVLHTSAADTRRQLAERFGITA

SEQ ID NO: 8923 - protein, 399 aa, Streptomyces avermitilis
MREAVIVSTARTPIGKAYRGAFNDTQAQELAAHALSHAVRRAGLEGGEVEDVIFGCAVQQGSSGGNVARQAALRAGLPDTVSGMTVDRQCSSGLMAIATAAKQIVTDGMQVAVGGGVESISLVQNDRMNTHRMADPWLVEHKPSIYMPMLQTAEIVAERYGVSRERQDEFALVSQQRTAAAQEAGRFDREIVALGSVKKVLDKQTGEVRDEEVTLTRDEGNRASTTLEGLAGLAPVLPDGQVSAHSSVTAGNSSQLSDGASASVLMESKEAERRGLEPLGVYRGMTVAGCGPDEMGIGPVFAIPKLLKQHDLTMDDIGLWELNEAFASQALYCRDELHIDPERFNVDGGAISVGHPYGMTGARLVGHALIEGKRRGVRYVVVSMCVGGGMGAAGLFEVV

SEQ ID NO: 8924 - protein, 370 aa, Streptomyces avermitilis
MNPVRYEDYRPTERPSYQEEMEAVVAQVARRTRASVERETVGRAVRTAHGKTYGLLKATVTIGDNPGVYGQGIFARPTAYDAVVRYSNGLGHFRPDHQLGAACGMGIKLFGVDGPSLLDDERDSGTFDLNLINNDVFFANTAYDYMVIEELFAELPEALVDPARRKTWMAEFLTRRQTLTDPGSWLWDELLAMLSFTSVPRRNLLSYSYNSMGAFRYGDHIAKIRTVPTAASLASLTHQIVDVRADNEAFRRTLVAEAAERDHSFELQVQLNTDLARMPVDNTSVRWPEDLSPWGTVARVDIPRQDIGGNDNLAAADATSITPWRSRQEHRPIGEIQRVRQEVYRRSSIERHRINGQERREPAGSAELLG

SEQ ID NO: 8925 - protein, 456 aa, Streptomyces avermitilis
MTEVVADVATALAAALPGRVVTDRDAMEAYRRDQCLLAPAGRPAAVVRARSTDDVITTLRTAGDHHAPVVTRGAGTGLAGAANAIDGCVVLSLAAMDRILALDVPGRTATVEPGVLTGDLDARARQHGLWYPPDPGSKAISTIGGNLATNAGGMCCAKYGVTADHVASLTAVLADGRVIRTGPPTRKNVAGLDLTRLLVGSEGTLAVIVDATVRLRPFPVATATVVATFPTPRQAVDTVLRIAAVADPAVVELMDRTCMGAVNRLTRMGLDESAGALLLVQCDGPSAGQEAATCARLAEAGGATEALHTADPAEGEMFMQARRMVYPALERLGTTLLDDVGVAVQDLPRLLAAIERTAAEHDVLVGTFGHAADGNLHPTVVYDAADRDAADRAGAAFDDIVAAALALGGTITGEHGVGSLKTRYLDAQLGPTELELMTGIKAVFDPADLLNPGRAY

SEQ ID NO: 8926 - protein, 236 aa, Streptomyces avermitilis
VRGMTISPVSRVPLSLDVAQRLRAAILDGTFPADTELPTETELAQSFGVGRSTVREALRVLQAHGLISGADTVSTARPRVTHERTAGAAGLALSTALQVGAIPLADLVALRTLLEAEAIRQTTAVPDAARSCLVTMAAAVENADIQTFHAADVDFHGQLAYAGGNQALGFVIGVLRDCIAGYLLDALAAVADRGTVLARLLAEHQAIVDALDAGETDRAAELVVAHVRGFYEPQTP

SEQ ID NO: 8927 - protein, 235 aa, Streptomyces avermitilis
LSVCQTRSYRGSRCASGHKATTSKTRKSGVAMTEKLELDPARTAIVLIEYQNEFTSDGGVLHGAVADVMQHTGMLANTVAVVDAARQAGVPIMHAPITFAEGYGELTRHPYGILKGVVDGKAFVKGTWGAAIVDELAPVNGDIVIEGKRGLDTFASTNLDFILRSKGVDTIVLGGFLTNCCVESTMRTGYERGFRVITLTDCVAATSQEEHNNAISYDFPMFSVPMTSADVIAAL

SEQ ID NO: 8928 - protein, 425 aa, Streptomyces avermitilis
VDRPPADPHGPSPLCTSLTERDMPSDRIRELIGRGAAVAARAPEEWLREIEDATLSAEYLQALADDPDLTAQIRRTSRANVLHWATWNVRSPGAPVPANVGPEALATARELVRRGLNDSALQSYRSGQNAAWLRWMSIAFELTSDPAELRELLDVSTRSISAFVDATIAAVSAQIQAERDELTRGTNAERREAVTLLLNGAPIHPDRASARLGYRVEQTHTAAIVWSDAAESDLGDLERAADALAKAAGVSRFLSVTAGAAMLWVWLPSAALPATNRLERHLDSHPTARAALGSTGHGVEGFRRSHLDAMTTQRMMARLHTVRSVARFETVEIVALVTREPQQADQFVRRTLGGLATGAPELREAVAAYIHEECNATRAAARLFTHRNTLLRRLERAQRLLPHPLAGNTVRIAVALDVLHWRGDG

SEQ ID NO: 8929 - protein, 509 aa, Streptomyces avermitilis
MSVSEAPTATEHIDVLIVGAGISGIGAAHYLQSEHPQRGYAILETRGALGGTWDLFRYPGIRSDSDLHTFGYAFKPWEEEAIARGDKILAYLHEAAAEDGIDKKVRFHHTVRGAAWSSTEARWTVQVERTDTGERLSLSCKWLFCAGGYYRYDQGYTPHFEGIERFEGLIVHPQHWPEDLDYRGKRVVVIGSGATAVTLVPAMAGTAAHVTMLQRTPTYILPVPATDKIAQLLRKVLGRRRGYAWTRRKNIAQQAAIWRFCQRFPRSARRLIRWVNTRRLPKGYPVEEHFDPPYDPWDQRMCVVPDGDLFEALSNSSASIVTDRIDTFTERGISLSSGRRLEADIIVTATGLNVQALGGIQLTVDGTKVHLPDKVAFKGMMLSGVPNFSFSVGYTNSSWTLKVGLLCEHFCRLLDYMDAHGHTICCPELSDPDMPTRPLLDFEAGYIKRGIDHLPRQGTEEPWLMSMNYQADVKLLREDSVEDENLCFSSPTATPRPARGLQATAHLEP

SEQ ID NO: 8930 - protein, 853 aa, Streptomyces avermitilis
MASAWSPTRRGSRERPTRVRVTTVAGRVRRTGVDDIGIRYEVVSGVEKRMTVLSESGDDPFALHHAASVVLDDRGTVVGWSRRAQELLGYPESAVIGRPAFDVLIDPGSLPAAKDAAATCRRDGGWFGVLAVRHSSGRLVEMGFRARALLRGDHVREWFLVGAPAAEVLEWQRDRAVLDGLFRRCPIGLVVHSPELTILRVNRAIERFTGIPAASFRGMPTGALLVAEDARTSVDRVRQVVETGRSQVSTEQYARLERDPARVRAASVSAFRLEDPAGRVLGVAETVEDVTERHRARLRLALLNQAGARIGSTLDVRETARELADVMVPHLADHVSVDLSPPVMRGEEPAQAPTGPVARVAVRGVVARQPDLEYPEGEPVQFAPGTPQAGCLADGRPVLEPVLSPDWFLAEPRQGEHAPDLSAHSLIVVPLAARGLVLGVMSLWRSRHPEPFEPDDLTLAQELASRAAVSIDNARRFTQQQQTASTLQRTLLPRTVPHQPAVEVAPRYLPASTASGPGGDWFDVIPLSGARVALVVGDVVGHGLHAAATMGRLRTAVHTLATLDLEPDEVLSRLDDLVNLLAAEQETAGEGPAGEQIVGATCLYAVYDPVSRQCSAARAGHPLPVVTTPDGQAGLLDLPPGPPLGLGGLPFEAREIELAEGSLLTLYTNGLIGERHIDVDTGLQRLRTALTHPADPLEKTCQAVVDSLVPAQPADDIALLIARTRVLPPENVASWQLPLEPTAAAQARALATAQLSQWGLEHLAFTTELIASELVTNAYRYAGGPVTLRLIRERCLVCEVADASHTSPHLRRARTTDEGGRGLFLVAQMTERWGTRYSREGKTVWTEQPLLGL

SEQ ID NO: 8931 - protein, 596 aa, Streptomyces avermitilis
VLMPRQQPGSSLRAARELYLEVTKDPSARPLVVASWHRSMEYQVKSGSLEAPYLDNPNLDSPLARAALPIQDRLHEQLADDPVSTMITDRNGVVLSRKVSHEGLTTNLNRVHLAPGHVFAERYVGTNGIGTALASGRPVMIAGMEHYVEALRDFHCAAVPILHPTRRTLLGAFNLTTIRQGSGGMLMAFARSVAAQIEAEIAAITSRRERALFQDYMEACSSTRPGPVLALNRDVVMMNEPLSAAVTGPDHYALLDHAREIADHPRLEGTRSIALPSGRVAELRVSRCRREDSDAGAVFRVRLIGRLQPTSAGSASPARSSLGLVGSSPHWLRAVADSEAAFVAGTWLHLLGEAGVGKRTLVAALHRAHGAGRRLEMTQAPPSDSPAVTERWLHDIGELLVVPSTVLVLSDVHLLGDQLRQRLADLLVRLDGSASGQLVMICQPSMVGADDHLDQLCGASVEVPPLRHRYGDIEHLARLFLRKYRPSGENTFSPDALALLQRCPWPENVRQLETVIRGLARRPSGRMIHVEDLPPECRVSSHKVLTTIEALERDAILRGLLDRNSNVQRTAQDLGISRATMYRKMRRYGIVPSSLT

SEQ ID NO: 8932 - protein, 341 aa, Streptomyces avermitilis
MKAVQVIEYDEPPALVDVPDPQITGPLDVIVKIGGAGVCRTDLHILEGQWKDKSGVALPYTIGHENAGWVAEVGQAVTHVKVGDPVILHPLVTCGLCRACRAGDDVHCMNSAFPGIDTAGGYAEYLKTNARSIVPLAPSLEPASVAALADAGLTAYHAVAKAARVLRPGDKAVVIGAGGLGHIGIQVLRALSPVEMIVIDRSPEALALAKELGADHTLVADGSEAERVRDLTAGHGAEAVLDFVGEGGAVETGVACLRRNGNYHVIGYGGRLNVPTIDVISTEINFIGNLVGSYNDLSELMVLAAQGKVTLHTQRYPLASFRQALDDLDTGAVRGRAILIP

SEQ ID NO: 8933 - protein, 533 aa, Streptomyces avermitilis
MRTRPYKRFAAVAAVAALTATACTAPDQAQEGPKDKAPLFKLGSQISYEKYGKDYPDTKVEDVPGPCSYEAISRKDYSGQTLKIISHAVPVIGEPTQLHAKQFEEITGAKVEVVNVPFGELHQKILTPLQAGQPAYDVMFYPSLWIGDLAPYLAPVPKKYLNTPGMKDVTGTYMDVATWNRKVVQYPMDGDRHYLKVRTDVLNDPKQQAAYKAATGKELRVPKTWDEYQDVAKFFSGKDFDGDGKRNYGSAEVTKRDDLTFSAFISRAAPYVKNPDVKGGVFFDLETMKPLINTPGFVRALDDMVKAKSTWAPGGANFGLGDEIFSFGGGQTLMSYSWDDAFIQAQQPDSRIRNKVQAAPLPGSSEVYNRTTKSWDTKANQAPYFTWGWTSAVAKASRHQQMAFDYLCFFSNEANTALDLTIGRFGVNPYRYSHFDPSFWERLGWDPKVAKSYVKTLSGMEESRNRVFDLRVPGVNQYMSALANGVAAALAGQDSPQDALDGVAGEWSKITGQIGKDKVQSAYRNVVALEDNS

SEQ ID NO: 8934 - protein, 312 aa, Streptomyces avermitilis
VAGPDRPATRGRPPPSARRTMDGLRRHKSMFLLPGLLTLFLIIIFPLLFTIRVSFSGWNVSNPQMDFIGGANYTAMLHDSRFWASITRLILLAGGTVLIQYVIGFGMALLVWREARGRRFWRVLFLVPMMTTPVVMAAIWQTIFHESLGPANDLLGMLGLTNIPWLTESGPALVALMTVEVWQWTPFMFLLLLAGLLSLPKEPFMAAAIDGAGTWRTFWKVTFPLMAPVSVAAIVIRLIEASKLSDSVYVLTSGGPGSSTETPGYYLYIQGLRDQQTGYGGAMSLTYLVLMIVTLTVVAALLTRAFKLKGDS

SEQ ID NO: 8935 - protein, 281 aa, Streptomyces avermitilis
MRSRLYPVFKYTVIALWACFVAGPFLWAMTTSFKNANAVQGGPTYIPWVQYKPTLTGWHNIFGGAGGIDVVQPFVNSAVITIAASAISLALGSLAAYALSRYRFKLGFIKNSDIVFFFVSQRIMPPVVLVIPFFYLLQWGGLLDSIPGLVIVTVALLLPIAVWVMVDFFNGIPREIDEMAMLDGCPPFQTFVRAILPNSLPGLTVAAMFCAVFGWNDFFFAFRLTFTEVQTLPQAVVALNSSIPPWWTLSAAALFGVAPLILLALWVERLLSKGNLSGAVR

SEQ ID NO: 8936 - protein, 362 aa, Streptomyces avermitilis
MNLHATDLCLTVDGVDHLKNVTATFRPGRLHTVIGRTMAGKTTLLRALAGLQKVDSGSLTRAGADFLKTPVWRRDTAMVYQQFINYPHLNVFDNVAFPLKRAGLSRDVIRRRARQSLASVGLADFEKRKPSQLSGGQQQRVAMARALARDTGILLLDEPLANLDYKLREQLRDEFKALFSDQGDTIVIYTTTEPAEAMMLGDVVLVMHEGRILQTGTPQEVFERPATTTVASIINDPPMNIFAGRIEGGQVTVAGFQATHISAHLADLPDGTYQFGLRATDVGLASSGVEGEVTFVEISGSETFVHVVVGETPFVVQIEGIHDVALGDLVRLRLRPDRLFAFDEQGTLVRTPSYDLASVEGR

SEQ ID NO: 8937 - protein, 359 aa, Streptomyces avermitilis
MAQLDIVDVGHAYAPGAEEEQWALKPLRLTFESGKTYALVGPSGCGKTTLLNILSGLVRPSRGQVLFDGVDVTALPTKARNIAQVFQFPVIYKSMTVYENLAFPLECRRWDKARIDAKVRQVAEALDLHDRLRQPARGLTADDKQLISLGRGLVRDDVAAVLMDEPLTVIDPQLKHSLRRKIREITEQFRPTVIYVTHDQYEAMSFAQEVLVMKDGRAVQQGTPEQLFEAPSSTYVGYFIGSPAMNFLTVDRNERPFALGGRTLSVAWDIPQGTTDVQVGVRPEHVKVVTDPGPNTFPGRLRSVSDHGAQRVLEVEVAGQLVRAKTPREEGVPLGEAVLVHLPRAKVLPYADGQLVLRS

SEQ ID NO: 8938 - protein, 794 aa, Streptomyces avermitilis
VPTRWGVTHLTRMQWGEGCHCATGGHMSEISTAIDALLQARLRQLPEVERESARWHTLGERLAELADALADLRAHTTMDAELVAALTLPQLTETQLSVAQAADSFRVIASRFTRATVNIGVSGAARMGKSTLLQSISGLDDNQIPTGHGIPVTAVRSRIFHSPAVRRAELEMHSPESFLATVISPLHAALDLSPVPRTVAEFGRWVYPEVLPDTRDRVLLTRLRELQSALTSYEPLLTGGVRTVPLEEVRPFVAYPTHEEITKAGERVGRAYAAVREARIECAFPHEHVARIGIVDLPGLGEVVADADRRHVAGLRNEVDAVLVVKRSSDTSSYFDETDTAGLGLLEEVRGFVRSTGEFTYLVHNADPDKPHLAENLRGDLLRNVNGGEPDRFFTVFETDVRDPERVGREVLGPLLKRMAEGLPVMDAEVLAGIRTQASSVRDRVRLQLTDLRLALDQVAQRAGVPEEVNDAKAAQLRSAVARRLRGLVAELAAEAHGSMVGPGFGEALEKAYEGVLEWIQDGFGKGTDAWREEALTCMITEGHSAAFAGPEFSRVRVEISRRFAALDDFFTARLNAAWNRTAAMLAAECGALFQRNDSRQADSVSSSDDATATPSAHPGRDVLAELAELFARSSQPCPGLASAVDSLLDVRLEYRTLLYPRVRPELAPLNLQVTHPNTGEQMQQVAVPLTAEGAEHLHELFNSLAEQAAFRIKQSLSQEAAVPAAVIHALVEQFEDTLIRSGTSVMEFRRFVRSYRNDLWPAEFKGIDEANSRFARVLRVVQDISDVLDEEQP

SEQ ID NO: 8939 - protein, 381 aa, Streptomyces avermitilis
VTDEHSVFEYKIGLLAPSRVGKSTLIAGLLTEGQQQLAQDSSVHLLTADRPTKNRLAATYNLVSGALKARMFEPGLVPSTSDPSWFRLLLEARGQDLQIRFDILDYPGAWLEGAGEGTEDEQKWNECEAFLADSSVLILPIDSVLLMDSGDDHAHLLASHLSVFQINQAVLRWAKNRRELSGEPAMIVFCPVKCETYLSDSGSLQDHAGTLRGKVVDQFSDVLKTVRDAAPHAAVRYLPIDTFGCVELVSARWIHAQGSPGGEMLVPKYRVRPPGQIVRKGLDDLLTLLCRQLVDTARAQSERTTAAKQTAALNSRNHAELREGFFRDLWLNFNGERNRRRHTAATDERLFAMSQRTTQSLFDVLTALAGRESGPRLHHLS

SEQ ID NO: 8940 - protein, 300 aa, Streptomyces avermitilis
VHVYLRTRGVPRKLDYGFLGAAPGSRWWDTYSELTATERPCLLAVTSKGRWRVLISGVPSTRTDSVGTLVYYTLVLDGSPSPAGTVGPRQDRPTVLALASRWLDDIARHPEGRGVLSELLDGLCSSAEVDRLLAARHSELTTERAELTARLATALASLSPAPSLNPAPSVPSAQDSGAPSPVLLTERWIAGRTAPGADAAFLARLSSLLSGEDGQAHLLNLVSSAEDITTLPQKPGLLAVLIEGGMVGDPAMPAEALPKLPSEVVASAPKARWRAAMVPTVLTALILLLVALVLVAGNWT

SEQ ID NO: 8941 - protein, 135 aa, Streptomyces avermitilis
VQVSVELRAPRRRLTFFSAATYQKEWLEPDSLLAFRCEFVADEARTGHPVRALLLARLAVGRARVFNYETARYEFGRVEDLDFAVSLDGETVYEAYGARPMEEDRGLTFKDETGYWTTIRPITSALKQAVRDENP

SEQ ID NO: 8942 - protein, 149 aa, Streptomyces avermitilis
VTACQPAEQGSSSRAARAEPVKSFNRALASSTCAACLSLHVSVPAPRRLSACQEKRSDKAMPRAVVRASADSTTAVDPSTATVDAARRAALTRFSAALMRSIASSRCTGPAPLSAVQAPRKPSSAATASVISALYAAWRTSRRHRWCSK

SEQ ID NO: 8943 - protein, 328 aa, Streptomyces avermitilis
VKARPLGRTSVRVSTLGFGAAPLGNLYGPIDDCQAQATLKAAWDVGVRYYDTAPHYGLGLSERRLGDALAHRPRSEFTISTKVGRLLEPHPAPTGSDLTAGGFAVPDTLVRRPDYSRDGVLRSLEGSLNRLRLDHVDIVYVHDPDDHLDAALDHALPALTALRDQGVIGAVGVGMNAVAPLLRVVAEAEADAVMVAGRWTLLDRTARPLLDACAERGVAVVAAAPFNSGLLSRPHPANDATFDYGPASESALRRARLLAGVSGRHGTALPHAALRFPLRDPSVACVVAGFRTSEEVVSAARWATTDLTGEAWLDLDTAATWAAEIPPS

SEQ ID NO: 8944 - protein, 277 aa, Streptomyces avermitilis
VRIDAHHHLWDLSVRDQPWTSDVPALRRTFTAAELRPALERNAIDATVVVQTIAVPQETPELLALTCTDPQVRAVVGWTDLTEPGIADRLAELREQPGGSALVGIRHGIQDETDPQWPARPEVRRGITSVAAAGLVYDLLVRPDQLPSAVRAVRELPDVRFVLDHAGNPVVSPDGLVSWTALLTDLAECPNVTVKLSGLVTRTGGDPAAALRPYADVLFETMGPDRLMYGSDWPVCLLAAEYDEVVAVAESLTEELSADEREAVFGTTAARWYGIPS

SEQ ID NO: 8945 - protein, 258 aa, Streptomyces avermitilis
LGDSTQAPGKADDATSRPYRPGYELVAEQLLDYIAQENLRPGDRLPTEQGLAQILGASRNVTREAVKVLAAIGRLNVRRGAGIFVAASVGGLLDDELSHFRPTSMEDVRMLLDYRKVIESETARRAASLATPIEVRAIRESAESSLAAATMNDVDTFAKADAAFHDAVGAASHNVFLRSSVAGVRRLASQSDVLLFHGDVPGSLEVAAGQHVAIAEAVAAGAADLAERLMVEHIGTTQSQFEKKIRDRLFSPDADTAP

SEQ ID NO: 8946 - protein, 1129 aa, Streptomyces avermitilis
MCRSTAVEPPIALGVPVDDRDSQVSPPSGDWIRVSHPSARRRVFAPLRRSFTAAFSVAAVAALLTAVPAQAAPPPPDIDVYVSPAGRDVGSGSAAHPFRTLEHARDHVRDVRRNAKGDIHVRLMSGTYRLSRTFALTARDSGRDGHKIVYEAAPGAHPVISGGERITGWVPAGGAGRVYKAKVGDIDTRQLYVDGELETRARSAKNPSGFSKTSTGYTFTDTGLNAYKRPSDLEVVSSWGWKLMRCPAQSIADNKMTMQQPCWHNAHLQRGQEIQNPTWLENARELLDTPGEWYLDKGEGEIYYMPKAGQDLSTATVTVPRVQDLVDLDGTRTDPVSNVSFRGVTFSYSTWLAPSSFEGLIEGQAGFRMVGHDPDFDATRLKWQKTPGAVNVSYGHGIGFEGNTFTHLGAVGLNLNTGTQGSDITGNVFRQIAATGIQIGGVAVIDAHPDDSRDITKDTRVDNNVVTKVADQYNGSIGILAGYTDHTVITHNKVYDLPYTGISVGWGWGLTDKGGNSNYSPGNLGVPIWDTPTTSRDTEVTDNEIYDIMKSQADGGAVYTLSTDPGGVVSGNYIHGIPSPAYGAIYHDEGSRYWTNTGNALCDVAYQWLFLNHGMDIDATGNFTTQPAYSAQANSTGSTISGNTTVGSCGQLPASVVNNAGLQPSYRHLDPGPDVADHQAPSRPGTPSAVTDFPTVADLTWAASTDDTSVTGYSVHQDGKLISATGKTSVRLPGLTAGKTYAFQITARDAAGNESGPGPTLHVTMPSGTDLALKKSLTASSYSENNTPEKAVDGDLSTRWAQGLGLPDPSWIQVDLGAPYDVNGAITTFEKASGYKYRIEVSPDEVHWKTLADHTAANTTAATDYAHTDDPVTGRFVRLTVTGSSWNGGSIYDFQVYGTPRTVTDHTAPTAPGQPTVKPLLPGLVDVSWSAATDDTGVTSYVVYRDGKRIGVTDATTLRVSGLTADTEYSFTVVARDKALNASDPGKAAVVTTPADHDLALDKQVTASSSYSKDYAPEKAVDGDLSTRWAQGAGLPDPSWIRVDLGKDTGVSSVVTTFEKAGGYKYRLEYSTDGTTWSIFEDHTSDATSSSAVHSFADKPVTARYLRLTVTDSSGNGGSAYGLQAYGGF

SEQ ID NO: 8947 - protein, 365 aa, Streptomyces avermitilis
MKITHVEVHRIDVPAASPPFRWRDGLSGSAPVGDGAVLHIGTDEGAEGVSVFARPGAYSTLRDLVDRVFRAELVGADPFQREWLWHRVWELDRIHELPLPTLGLIDIALWDLAGRYHGEPVWRLLGGFREAIPAYASTSTFSSVAEFLDVADQCLALGYRGIKLHAWGDARRDAELCLALRDHVGPDVPLMYDGSAGFDLPDAIRLGRALSEADYLWYEEPIREFSISAYQRLAEAVDVPLLVAETSDGAHMNAADFIRAGAATFGVRAGTTLRGGITGAMRTAHLADAFRLRAEVHGSDIPNHHLCMAISNTTYYESLVTSVNVVRERHVDDQGLVHAPAGPGIALPLDFGYGNELLPFVEQPR

SEQ ID NO: 8948 - protein, 461 aa, Streptomyces avermitilis
MESSRSPRTGRRHSLLRTAAVTLSLATTAALAGCASADTTTRSSSGQSAFKPAAQKEGSRITVWADSTRLPSVQAYQKSHPDVKMKIVTYDGGADGSTYLQSKVQLFDRTGSGWPDVVFGTPTDVTWASEATKPDARPFAAPLDEKLVPQSTLDEFAKGSLTPCEFDGHTYCMRNDIAQVLLWYNKSLMDKWGYKVPTTWEDYEALGKKVAKDHPGYLVGSVGDTNSHESYFWSGQCPAFSLVKPDTLRTDLRDPKCTRMAKLLDDLIGAKAIATQGFFSQGFAENSGGKVLMAYGPSWYGQYLFKAGFKTPAKQIAAAPPLAWKGESTTATGNVGGGVWMVSSHSANLKASTDLVTWLTTSDENQAGAPTYPAYTQAAKAWLANPANRNYFANDVSEPFEQAANEVWTGWSNTRFSDSTAWSSVVLPALTSGKSLTETLPAWQREIAGEAKSQGYKVVDQ

SEQ ID NO: 8949 - protein, 310 aa, Streptomyces avermitilis
VTLLETEPVAVSPVRRGTTPRRTGRGRAGYFFVAGYALLLLAFGVFPTGYAFYLALTNDRGQFTGLNQFVKVVQDYRFAPAFTHMLIYLVMWLVTLVVLVVLTAVVLRSRVRPGTSALFRFLYYIPGALAGVASVLVWLFMLDPDVSPVSWLLTAMGLKTFAAVLAPGNLPLILMLIAFWTGAGGWMVVMYGALNNIPDDVLEAARMDGAGPWRTAWHIQIPMIRQWIVYMTIMAFATGTQLFVEPQLLQTASLGRVSPTWSPNQLAYVYAFQQGDFNGAAAISVVLLAVGLLAAGLLVARSNLFKLDEK

SEQ ID NO: 8950 - protein, 304 aa, Streptomyces avermitilis
MTQTAVFLTAVRRRIRPSRTLPFLVVGLLLALLLLFFVLPVIWLLLTPSKTAGEVVRDNPLSFGSFHQIGTAWRHLFAFQDGAMTRWLRNSAVYSGGSLILTLAVSVPAGYALALTNFRGRKTLLVITLVTMIMPQATLVLPIFLELNRFHLIGTIWSVILPFSFYPFGVYLVYIYFGSSLPRDLLSAARIDGCTEWQLFSRIALPLAKPVVGLVAFFSFVGNWNNFFLPYLVLPNSEQFPVQVGLNQLLTSTPSFNPVAGAGLNVTIPELALAILIAILPVLVLFVFSQRTLVSGMLAGASKE

SEQ ID NO: 8951 - protein, 564 aa, Streptomyces avermitilis
VYRLDPRYAPAPQAVLHTGWQAVASQLPDGPVVVAIDGPPSVDWSLLGDRLENELTGRGTPVTLLDIRSHYARPAHVRSRTEHPADADDPYFRRLADNPLDDLFEILPVSAPPTEGLLLVYGPGAALVEHDLLWYADVPKRYAEAAVGAGEPGVNLGLPGEKPDFRRLFYIDWPMLDQHRDALAHRLDAWLDMQSPDHPAWIDGAGLRATYAALARKPVRTRPYFNSTPWGGHWAQRELGFNPNCRNTALGYELIAPEAGILIGTGPEDQAEVPFQLLCVLEPLSVLGAEGHAQFGTSFPIRFDYLDTVGGGSLSVHCHPKESYMRERFGWAYTQHETYYLTLGSTDTKVFLGLREDADVDVFRKEVERAVTDGVPMDPEDHVLAFPAEQGRLFMIPAGTPHASGAGNLVLEISATPYLYSLRFYDWLRPGADGNPRPLPYEHGFANLETGRRGTAVARDLVQEPRTLREGTGWREEVIGALAEMFYEVRRFVLDAGAEATDDTQGRFHILNVVEGEGVTVHTAAGDRHELAYAETLTVPAAVGRYTLRATGVGPVRVVKALVR

SEQ ID NO: 8952 - protein, 322 aa, Streptomyces avermitilis
LIPVLEIGGTHVTAALVDLRDGRVTNRTREPLDADGDADDILGTVRHCADGLSVPPGARWGVAVPGPFDYARGIALFKGVGKFDALYGMDVRAAFLEGLRQRPADVVFLNDAHAFLTGEWSAGTVRGHHRAVGITLGTGVGSAFLADGRICANGPGVPPEGRMDLTEIDDRPLEDTVSRRAILARYGDPAADVHDIAGRARAGEARARRVLDDVFTGLGVVLGPRLVDFGATALVVGGSIARSWDLVAPALSAGLVTGGWTPNSPHADADSLPPGAPECPVGDAPPGPGGTSAAGAQRTRTMKPAGPAGNAALVGAARAAGA

SEQ ID NO: 8953 - protein, 317 aa, Streptomyces avermitilis
LPPSAFGGYMPANSARTVHLLVALALLAGAAVAGCGGEKEDGSRGAEVGDGNSASPQVKVRAGQVADAWDGSKAAEIWHKGYYPMGEVVQLPGTGLHNDADKRAYKTGNFLLRGGLPASFHKDGQVRWGSGGSLTLPLMGAQKAYMALDRDSSDGPHLVATGAKLGEMTLTTSRGPATVPAWLFTLEGYDTPLKRVAVSPSKLPEPPIKPAKGMSTNVLAPLGGLVQVAGDGRSVTVVATHGSCDDGPAVDVLETGGSVVLSASVVGAKDGACTSELGGEKVTVKLGRPVGNRILLDASTGRPVPYSKWPETSPSWS

SEQ ID NO: 8954 - protein, 76 aa, Streptomyces avermitilis
MRPRTGATLYKVIETSLCDMYGDSGGAMFTGAIALGITSGGNYVDEPCGDTDAQPDRVTDYQPVQGVLNTHNLAVY

SEQ ID NO: 8955 - protein, 174 aa, Streptomyces avermitilis
VTAGAMALSGAFGSGPDSGPRGPVEAEALSAFPLENTTDWVSYGDHVAVIHVDNEKISPVPDKAKEHGEGHVDRTGRVVIDKVLYNRSGSPELPSSFTTQLAGLWWEDGVGTREFNFRGTSRLESGHSYIAVLVWDEDVQGFEAAALGGVLPFDKGTVGLGEIDGKTRQSLPPD

SEQ ID NO: 8956 - protein, 246 aa, Streptomyces avermitilis
LEDLRRSGWSSAPCVPLAWGGSTVTSDHDLLWRRCAHLGRVLLPVVDEEAWRQARLLVHQEAWRQARRHEHLEAWGINIVEGERLIELFAALAAHAVTVDISASAAEIDVLPPSVVADAATGKRDLELLAGLPDTFADGRDELAVKVFRLYTYRGGQYSRRLFQLSTELRRALIVLRGTRNARILAFAGSASLLDTPAPVEHQRPHAAHHLRTAPVLIRRGVKSGQDYGTCPRATTRKASLRRRCL

SEQ ID NO: 8957 - protein, 477 aa, Streptomyces avermitilis
VSGHVPVPTEHPEVVHMASAATAPPPPASLKRIVAASLIGTTIEWYDFFLYGSAAALVFNKLFFPGSDPLVGTLLSFLTYAVGFAARPLGALVFGHYGDRLGRKKLLVLSLLLMGGATFAIGLLPTHSTVGSAAPVLLTTLRLVQGFALGGEWGGAVLLVSEHGDARRRGFWASWPQTGAPAGQLLATGVLSLLTAVLSDAAFVSWGWRIPFLLSGVLVIVGLWIRLSVDESPVFQQALARAEARSAAPDAVAEKLPLVSVLRHHWRDVLVAMGARMAENISYYVITAFILVYATTSAGVSRQTALNAVLIASAVHFAVIPAWGALSDRIGRRPVYLLGAAGVGLWMFPFFSLIDTGGFGNMILAVTVGLVLHGAMYAPQAAFFSEMFATRMRYSGASIGAQFASVAAGAPAPLIATALLSDYGNSTPISLYVIAAVVLTLIAVGAAKETRSRDLAAVDPVTDAEPAAARAADAPAV

SEQ ID NO: 8958 - protein, 645 aa, Streptomyces avermitilis
MSRDHVQSPQRSGEAAATGPKAPFLELLARGASADAYEQPVLLARAEGLSPERVAALERTKRLALRVRSEMEGRRRREAELSALFETAHDLAGLRDLDAVLQAIVQRARSLLGTDVAYLTLHDEAEGDTYMRVTEGSVAARFQQLRLGMGEGLGGLVAQTARPYVTPDYFNDERFQHTRVIDGGVRDEGLVAILGVPLMIGPQVIGVLFAADRRARVFEREQIALLGSFAALAAAAIDTANLLTETRSALDRLARANEIIRDRSGVIERASDVHDRLAELVLRGGGVHDVAAAVSQVLDGTVEFAEAVVTPAVALEASRAEGHAVRHGDDWIAAVAAGGELLGALVLRGHPGLDPVDQRTLERAAMVTSLLLLARRSASEAEQRVRGELLDDLLDARDRDPRLLRERAWRLHADLDATHVVLAARLDGAAADADQEASARRRLWSAASHLAATRHGLAAARDGGTVLLLPLDPGDTATTLARRTAGQLGTAVHEPVTVGASAPVESLADHPDVVGAAYAEGQRCLDALRLLGRAGEGAAAEDFGFLGLLLAGDRDISGFVGRTIGPVVAYDERRGTDLLHTLDAYFACGMSPARTKDELHVHVNTVAQRLERVGRLLGDDWQSPARALEIQLALRLHRLSSPARP

SEQ ID NO: 8959 - protein, 266 aa, Streptomyces avermitilis
MNAPLVLPGPHATSLDLGGRTALVTGAAGGIGRACALRLAAAGAKVRAVDRDPEGLDTLAEAARGLAGTVEPQVLDLTDLDAAELSAAGTDVLVNNAGLQLVRPIEEFPPEAFHTVLTVMLEAPFRLIRGALPHMYGQGWGRIVNVSSVHGLRASAFKSAYVAAKHGLEGLSKTAALEGAPHGVTSNCVNPAYVRTPLVEKQLVDQAAAHGIPEERVLSEVLLRDSAVKRLIEPAEVAEAVAYLCSPQASFITGTSLALDGGWTAH

SEQ ID NO: 8960 - protein, 157 aa, Streptomyces avermitilis
MATPDFIRTIRASAGHQLLWLPGVTAIVLDDDGRVLLGRRSDTRTWSVIGGIPDPGEQPAACAVREVYEETAVRCVVERVVLVQALEPVTYDNGDTCQYMDITFRCRAVGGEARVNDDESLEVGWFPLDALPELNEFGLLRIKQALSDGPTWFDPMT

SEQ ID NO: 8961 - protein, 539 aa, Streptomyces avermitilis
VTVTATSVDEPEQLEPQAAPASRGARRVRRLVPAAAATLSGVLLYVSFPPRTLWWLALPAFAVLGWALRDRTWKAGLGLGYLFGLGFLLPLLVWTGVEVGPGPWLALAVVEAVFVALVGAGIAMVSRLPAWPLWAAALWIAGEAARARAPFGGFPWGKIAFGQADGVFLPLAAAGGTPVLGFAVVLCGFGLYEIVRQVVDGRRTGVVRRGAAAVALLSVAVPVVGALAARSLVSDKAEDGTATVAVIQGNVPRSGLEFNAQRRAVLDHHARETERLAAKIKAGKVAQPDFVLWPENSSDIDPFTNPDARAVIDSAAKAVGVPISVGGVVERDGKLYNEQILWDPAKGALDTYDKRQVQPFGEYLPLRSLLGAINKNWTSMVRQDFSRGTEPGVFTMAGTKVGLATCYEAAFDWAVRDNITHGAQIISVPSNNATFDRSEMTYQQLAMSRVRAVEHSRTVTVPVTSGVSAVIMPDGKITQKTGMFVADSLVQKVPLRSSQTPATRLGILPEMVLVLVAAGGLGWSVAAVVRGRRNDALQG

SEQ ID NO: 8962 - protein, 377 aa, Streptomyces avermitilis
VPRASDVRPDAAGPAGARHRSGGGWVGSTGTEAAAGTTAADDRRNVSDATGIAVLAACATWSLVTAAARGGRPEGVLLAVLAVSAGYASGRICGALLPVATPCAGALAGLGLVLAAPHGTAGLQGSSPLGPAGATAALLTLCAGAACCAAWAARPSASRLALRLLAAAITVTAAALGSLTGFAACAGVLLCSSAADRMRRRGPGLACLALGTALVSATAWAIAENVLPAGLTTALEGQLTERRILLWRDALRLARQDPVLGAGPGRFGELSPTAAQSLLPDGKPHSAPLQQAAEQGLLGVALLAAVFCWVLYALWRSPRATPIALTAGASLTALAAIATVGDALSFTTVTAGAGLLAGIATARPLLSGEAEGERGAD

SEQ ID NO: 8963 - protein, 181 aa, Streptomyces avermitilis
MRDHPHDEDVPLTEVWTGRATNRAQWLLALGGAAFLALGVELAVDSAWTSGIAPLVMAVVGCIAAGLLVIFGTLAFVHVAVKVDQDCLEVRCGHIGLPRRRIPLAQVAGAEFVARVTPCQWGGWGYRWRPEKGTAVVVRRGEGVVLRLWDGHTFTITVDNAEAAVRIIRDRLHSTIPGAAH

SEQ ID NO: 8964 - protein, 261 aa, Streptomyces avermitilis
VKIALLDSGIGLLAAAAAVRRLRPDADLVLSSDPASVPWGPRTPQDVTERSLAVAEAAAAHRPDALIAACNTMSVHALPALRARFEPGLPVIGTVPAIKPAAASGGPVAIWATPATTGSPYQRGLIREFADGVAVTEVPCPGLADAVEHANEAAIDAAIAAAAERTPDDVRVVVLGCTHYELVAERIRAAVQKPGLPPLVLHGSAGAVAAQALRRIGELPAPEAPMGASLTVLLGGREETLPAPALAYEEGQLLQTLSTAR

SEQ ID NO: 8965 - protein, 391 aa, Streptomyces avermitilis
VSAVVWIAAGSLTAWLWLLLGQGFFWRTDVRLPPRVEPADWPSVGVVVPARDEAGVLPDSLPSLLAQDYPGRAEIFLVDDDSSDGTGALALELAERHGGLPLTVDSPGAPPPGWTGKLWAVRHGIGLARARDPEFLLLTDADIAHAPDSLRELVAAARTGGFDLVSQMARLRVESVWERLVVPAFVYFFAQLYPFRRIGTKGARTAAAAGGCVLLRTDAAERARIPDAIRHAVIDDVALARVVKGDGGHIWLGLAERVDSVRPYPRLHDLWRMVSRSAYAQLRHSPLLLVGTVLGLVLVYLVPPGALFVGLAAGSAPTMAAGGIAWLVMTGTYLPMLRYYRQPLWLAPLLPVTAFLYLLMTVDSAVQHYRGRGAAWKGRTYARPGTAFEER

SEQ ID NO: 8966 - protein, 441 aa, Streptomyces avermitilis
VMGADMTMPKGSNIPVPTTALRVEVGRRSGPGGPDVDASALLLVSGKVRSDGDFVFYNQPAHSSGAVRHEGTREAGGQVTDTLFVDLARVEPAIERVVLAASADGGTFGQVPGLYIRVVDARQGSEVARFDPTATVETAFVLGEFYRRQGAWKFRAVGQGYGSGLEGLAKDFGITVDEPQHLLPTPRHTRVGRPAEAQSPQAAAPPPAGPPVPLPPPPMTVPPAASPTPVRLSKVTLTKEAPSVSLTKQGGTSGALRVNLNWQMRKQFSGWGGKRGRAVATHADLDLDLCALYELSDGRKGVVQALGNAFGSLYRPPYIHLDGDDRSGAVASGENLTVNLDHKQSFRRILVFVTIYEGARSFADLHATVTLQPQNGAAVDFSLDECTVPSTVCALALITNTGADLLVQREARYLIPERGVSPQRTIDHAYGWGMNWTPGRK

SEQ ID NO: 8967 - protein, 146 aa, Streptomyces avermitilis
MTSPRSTYGGGYYSASPFPDTPIYDSLVAERGTPQIAPIRVPSAYDASNNLPALPSALPALPAGPSQQVPAYGYPQAQQPAPLQQAPTAYIPQQAAAPRGYPGAQPQQPRPMAAGTGYEAMRPAAPRPAPAPYQDPYNNGQQYRGY

SEQ ID NO: 8968 - protein, 274 aa, Streptomyces avermitilis
MGNAELHSIHIHPVKAFRGQSPREAVVEPWGLAGDRRWVLVDDGGKVVTQRQEPRLALATAELLPGGGVRLSAPGHEPVSVPVPEPAVTTTLDIFGDKVEAVVADDTAHAWCSTYLGADVRLVHMDDPATRRPVDPDYARPGETVSFADGYPLLVTTLASLDSLNDLIAQGDHPDEGPLPMNRFRPNVVVAGTAAWAEDDWSRIAIGEVTFRVTKMCGRCVVTTTDQSTAGRGKEPLRTLGRHRRFGKDLAFGQNLVPESPGTVRVGDRVRILE

SEQ ID NO: 8969 - protein, 201 aa, Streptomyces avermitilis
MRAIGGLWRWRHNPLRRTTDLIEAWVTLTALLLILVAVPVIGAVVGAVAQDALQQSVRDQHRARHETVATVVKKLNRGPLDPDPETSSARDAHSRVLAAWTGPDGSAHHGAVLADLKTPHRGDHFTLWTDQQGRMVGRPLDTATATTHAMLAGFGAAAMSAGLVEGGRRLIVWRMVRRRYARWDQAWDRAGPDWGRTGAGS

SEQ ID NO: 8970 - protein, 812 aa, Streptomyces avermitilis
MAQGTVQVTHTGTSRWRRRTGEYASLAAALEAAGDGDVLTVAPGTYRENLVVQRAVTLRGPEGSPGSVRIAPVDGVPLTVRASAVVQDLHVEGQDAAAPAVLVEEGTPELMDVRIVTRSAVGIEVRGGARPTVRRCTVDNPAGIGIAVLDGGGGVFEECEIVAAGQSGVAVRGGGHPRLERCRVHHASGAGLSVTGENSALEAVGCEIYEIKGSGVQATGRATAHLTDCDVHRTTADGVTLDTDAVLTLADCRIHDVPENAVDLRSRSVLTLTRTTVRQFGRNGLSVWDPGTRVDANQCEIFDSTGDYPAVWISDGATAVLEACRVHDVPDALFVLDRGSRADVVDSDLSQVRNTAVSVSDGATAQLDDCRIRDAATGAWFRDHGSGGTLSGCTVDGTQTGVIVTKGADPTIERCTVTSPAEAGFYVSAGGRGSFHNCRVTDSGGYGFHVIDGCRATLKKCRTERCARGGYEFADGGPGAPGGGGAIVEDCTSDESAGLRPPAQATAVETTSQSPGLLGAIPGQRITEHEPHIAAAPEPEQPSRTSKAVLGELDTLVGLESVKREVRALTDMIEVGRRRQQAGLKAASARRHLVFTGSPGTGKTTVARLYGEILASLGVLEKGHLVEVSRVDLVGEHIGSTAIRTQEAFDKARGGVLFIDEAYALSPEDSGRDFGREAIDTLVKLMEDHRDAVVVIVAGYTAEMERFLTVNPGVASRFSRTITFSDYGPEELLRIVEQQAEEHEYRLTPGAGEALLKYFTAIPKGPAFGNGRTARQTFEAMVERHAGRVAQLDEPSTDDLTLLYPEDLPELP

SEQ ID NO: 8971 - protein, 777 aa, Streptomyces avermitilis
MLNDPRTVRITGDGTAAVYRRADDADAERRPGDHRGTPVPEAYVWCNLTSGNGARALWLLLLPFMVINLAHWMRPATRGRKRTVRLYGLLVRLIGLTLTVLLVAAACEVALDLAAWQCAGTHACAEKHSWLGFLSPVASGGWWSQPGRRLALAALAPAALTGLLWYLSHRTWSAYESQQPISRRAEPEEETHRTALGRPGFWYGRRLVARLRAAHTAAGFLTVAAAVGASAVRHDSRAGGPAALQWLAGLLAATLVGGAVVVVWVVCRRGRTENRLDRELDGTLVRRLPRGALALLALTMLYAGWSRPGWHSTGRLPGDMTFGGIALTQGLVVIALGVVARVLYRTLPQAVGSAPAGGTPTEARTAMRGLAGPAVAMLACALGSVMSGGISQRVADWLDGSGGVMTGPPVLLTWQASAIPPLLIVLLVLFAWLARRTWLLRRAEMDAVERDHHGEPQDTTRTRRIASTRAMAALTDRAPLVVGITSTVTLLLGAAALVGAAATGDVPGRAARGTYSFVQGSADTAQGLGSWLISFGFILFVTWGRRAYKDPAARRTIGILWDVGTFWPRAAHPFAPPCYAERAVPDLTWRMATWTRATGGRLVLSGHSQGSVLAAAAAWQLKPSERRRVGLLTYGSPLERLYGRWFPAHFGPAALSALHREVDCWRNLYRLTDPIGGPVRLPGDCGPQVDRAPLRDPLAYGRTEEHPLPAPILGHGGYQADPAFAEERERLLARLRPDVPGPRARGAAGDQGVGGDQDVGGDQGGAGDQGSSGRSSG

SEQ ID NO: 8972 - protein, 276 aa, Streptomyces avermitilis
VSENQNLLAEQRRALILDEVRRRGGVRVNELTRKLGVSDMTVRRDLDALARQGVLEKVHGGAVPVVEASTHEPGFEAKSGLELTAKEDIARAAAELVAPGTAIALSGGTTTYALAHQLVDVPDLTVVTNSVRVADVFHAAQRTSGQRQGAATVVLTGGVRTPSDSLVGPVADQAIVALHFDVLFLGVHGISVEAGLSTPNLAEAETNRRLVQSARRVVVVADHTKWGTVGLSSFASLDQVDTLVTDAGLPAGARAEVSEHLRRLVVAGEPGDGTDI

SEQ ID NO: 8973 - protein, 159 aa, Streptomyces avermitilis
MARRLRPVGLDFTQIAPVCLVFAREVAAPPKTVFRALAEDVGGWSEWFGAVTSARPVEDGAGREVRLKGGTRFRETVVVAKPAEVYAYRVDETNAPGMSALLEEWRLTPAGTGTRVQWTFAADGPAVFRFVVNLGRAGLGRAFRDAVTSLDRRLAATRA

SEQ ID NO: 8974 - protein, 374 aa, Streptomyces avermitilis
VSTPRTTHPGETLDVDHSDADYRSWLKEAVRKVQADANRSADTHLLRFPLPEEWGIDLYLKDESTHPTGSLKHRLARSLFLYGLCNGWIRPGRPVIEASSGSTAVSEAYFAKLIGVPFIAVMPRTTSAEKCRLIEFHGAQCHFVDDSRKMYEESAALAAETGGHYMDQFTYAERATDWRGNNNIAESIFRQLELERFPEPTWIVATAGTGGTSATLARYVHYMQHDTRICVADPENSCFFEGWTTGDPDVTCDCGSRIEGIGRPRMEPSFVPGAIDRMMKVPDAASVAAVRALEQAMGRKAGGSTGTGLWSALKIVAEMVAEGRRGSVVTLLCDPGDRYLDKYYSDAWLAEQGLDIAPYTAAIDSLLATGVWRD

SEQ ID NO: 8975 - protein, 107 aa, Streptomyces avermitilis
MAEPEFTATGVRIGKRLRSLTRAGQVRISGGRLELLTSYGSEIDSAPVQAVRASKPWFAPEDRALADVNGTRYSLTLGEHDPAPGKPGPPSARRFIEAVRKASGRRS

SEQ ID NO: 8976 - protein, 171 aa, Streptomyces avermitilis
VISKPSRHCTVELQALPSRIGQVRRIVSAQLRYWHLDPLIDQAALGVTELLSNVHRHAQPDKTCIVEMELLLDRLTVSVHDHDPRLPVVRDAEPSATSGRGLAMVAAVSESWGVRPEGESGKVVWFTLPAPSATALPTRPPRDIGRPVPVLRRAVDGRRSEHAPARSAVAG

SEQ ID NO: 8977 - protein, 103 aa, Streptomyces avermitilis
MQTLANWDGGPGPWIPFFPLIWAAVVIGVVTVLRRTVRRGRGGPWGGGAWGAMGDGRPTGDSPIAVLGRRFASGEIDEDEYWRRLSVLDEQFGRLGKGGAASV

SEQ ID NO: 8978 - protein, 191 aa, Streptomyces avermitilis
MYSHGMSTQERLIESTRELLWERGYVGTSPKAILERAGAGQGSMYHHFKGKPDLALTAIRRTAEELRAAAEGALSGPGTPYERIEAYLRRERDALRGCPIGRLTMDPDVVASEELRAPVDETIDWLREQLAGIVEEGKEQGQFAQSLDAEEIAATILATVQGGYVLARAAGSPAAFDTGVRGLLSLLRPPP

SEQ ID NO: 8979 - protein, 194 aa, Streptomyces avermitilis
VHAMQYELTLPADYDMDIIRSRVSRLGHALDHWDGLGFKAYLMRERGVDGSPVNQYAPFYLWNTVEGMNSFLWGGAFQGIVDDFGRPPVQQWTGLSYEEGGAAGSPARVAVRHRRRVPEGARLTGLMQDAVREAQQLAALDGVVGAAAAVDPRRWELVHFSLWEHDAPKAAGEVFQVLHLSAPGRASLPRGRQW

SEQ ID NO: 8980 - protein, 303 aa, Streptomyces avermitilis
VVSTVRTVLGDVLPEHLGVCDAHDHLFFGSPQLPGQELRDASAARAELAAFREQGGGSVVQWTPYGLGRRAADLPLLSRDTGVHVVAATGLHQAVHYDAGTLAELRGRLADTFVAELTTGIGPSGVRAGLIKVAGGFHALDAHARWTMTAAAEAHHATGAPIAVHLELGTGALDVLDLLCGESGVPPHRVILGHLNRSPDFTVHRQAAEAGAFLAFDGPSRANHATDWRMPDALRALAEAGFGHRLLLGGDTTTAAARSVNGGPGLPYLLRRLRPRLEQALGKDLVGRIFTENPGRAFGVEWR

SEQ ID NO: 8981 - protein, 414 aa, Streptomyces avermitilis
MNGKAGPRVAGEGNTRTRLDRGRGALGPALELVHTGRAPTRAVLTAELGVTRATAGAVAAELEALGLIRVDAHPGAAAGSQGRPSHRLEVAENGPVALAAQVHADGFRAALVGLGGRIVATAPGCETVDADPAKVLGSVVEAGAELLEETGRRCVGAGLAVPSAVAEPEGLALNPLHLAWPAGAPVRQIFAERVRAAGITGPAFAANDVNLAALAEHRHGAGRGSRDLLCVATGHRGVGGALVLDGRLHTGSSGLALEVGHLTVNPEGGRPCHCGSRGCLDVEADPLAFLTAAGRDPGPEVSLLQQANDLIRTQYADPYVRTATQALIDRLGLGLAGLVNILNPDRIILGGLHRTLLDADPDRLRAVVADRSLWGQSGGVPILPCTLDHNSLVGAAELAWQPVLDDPLAALAGT

SEQ ID NO: 8982 - protein, 222 aa, Streptomyces avermitilis
MDAELFPRSRAQVAPDAVHVPDWADAGRQRRFLAACRDWARPPAGLRTVHTPGGGTMTSRQVCLGWHWYPYGYARTVVDGDGAPVKPLPDWLAELGRDAVSDALGPQAVPPVPYDIALINFYGADARMGMHRDSDEKSGAPVVSLSVGDTCVFRFGNARTRTRPYTDVELRSGDLFVFGGASRLAYHGVPRVYADTAPPELGLVGRLNITLRVSGFQDPSGE

SEQ ID NO: 8983 - protein, 380 aa, Streptomyces avermitilis
MNDPMTTPWGAYALARFPEDPRDRLRAWDASDAYLLRHLAASGTPLSGSVVVLGDRWGALTTALAAHRPTQITDSFLAREATRENLGRAGVDPSSVRLLTTRDTPPERIDVLLVRVPKSLALLEDQLHRLAPGVHEGTVVVGAGMVKEIHTSTLKLFERILGPTRTSLAEQKARLIFCTPDPGLVRDPNPWPYRYRLPDGVGPLSGRPVTNHAGVFCADRLDIGTRFFLRHLPRVSGAERVVDLGCGNGVVGTAVALTEPEAEVLFVDESYQAVASARETFRANADGTAEFLVGDGLSGVPAASVDVVLNNPPFHSHQATTDATAWRMFTGAKRALRPGGELWVIGNRHLGYHLKLRRLFGNSELVASDAKFVVLRAVKK

SEQ ID NO: 8984 - protein, 301 aa, Streptomyces avermitilis
VPLAATGDLIAGATADHTAVAAFNIITLEHVEAVIAGAESVGAPVVLQISENAVKFRYGRLLPLARAAAAAAERASVAVALHLDHVQSDDLLRQAPGAGFGSVMYDAARLPYAENLAATRAAADWAHARGLWIEAELGQVGGKNGEPPLDAHAAGARTDPAEARAFVADSGVDALAVAIGSSHAMTSRTAALDHGLLRRLAAQLDVPLVLHGSSGLPDDELAAAVTGGIAKVNIGTALNLAMTRAIREFLAAHPDAVDSRKYLSVGREAMAAAAAELIAVLRAAGGPQHRTTGSGSGTPTS

SEQ ID NO: 8985 - protein, 316 aa, Streptomyces avermitilis
LCSKGRYILHESASLGRGYGMSHVENELNSQPACWTRAATEAAEYAGALPATGERVAVVGCGTSFFMAQAVAALREQAGQGETDAFAASEFPPGRAYDRVVALTRSGTTTEVLALLAELRGRTRTTAVTADPRTPVMESADEVVVLDYADERSVVQTRFATTALTLLRAHLGLHTDAVVADARTALDTPLPEGLVECTQFTFLGRGWTVGLANEAGLKMREAALAWTEAYPAMEYRHGPISITTRGTATWMLGEAPEGLAEQVRETGGLWVAGGLDPLAELVRAQRLAVAVAAARGLDPDRPRHLTRSVILAPAAR

SEQ ID NO: 8986 - protein, 259 aa, Streptomyces avermitilis
MSRDARWKTLLELLVERGRLDVEEAAAQLEVSAATIRRDFDQLAEQQMLVRTRGGAVVHGVSYELPLRYKTARHASEKQRIAKAVAELIAPGEAVGLTGGTTTTEVARALAVRGDLASGSPALTVVTNALNIANELAVRPQFKIVVTGGVARPQSYELVGPLADGVLGQITLDVAVLGVVAFDAAHGAAAHDEAEAAINRLLCERAERVVVAADSSKLGRRAFARICATEAVDTLVTDAPVSEDTVRRFAEAGVEVVAV

SEQ ID NO: 8987 - protein, 289 aa, Streptomyces avermitilis
MTTGHFTSVEDVSARLAETGYLASPAVATTVFLADRLGKPLLVEGPAGVGKTELAKAVAEVAGASLIRLQCYEGVDESRALYEWNHAKQLLRISAGRDETWDEARTDIFGEEFLLPRPLLTAIRGDEPKVLLIDETDKADVEVEGLLLEVLSDFQVTVPELGTITATRRPFVVLTSNASRELSEALRRRCLFLHIGFPDEELECRIVRLKVPGLDAALAESVVRVVGALREMDLRKVPSVAETIDWARTLLALGADTLDETVVRDSLGVLLKHQEDILKASAKLDLDAV

SEQ ID NO: 8988 - protein, 457 aa, Streptomyces avermitilis
VKAPAASGVPERLTALVQALRSHGIRIGTGETVDAARALEALGLADREYLREGLASALLHGTGQRAVFDPVFDLYFPRGVGVPEPGSGPAPDRDELRDRIAAALAAGDEALLGQLAAEAVNGFGGYGSSPGSDGWSSYQTLDRLRPQTLLARVRASVLAQATDSGFADRLLDDEIRRRIEEFRRQVRTEARRRVAERRGADEIARRGVAPTADRVDFLFAGRAQLAELRRTVQPLARKLATRLAARRRRASRGTIDLRRTLRGSLSTGGVPMRPVLRRRRPVRPELVLLCDVSGSVAGFSDFTMLLVQALHDQFSKVRVFAFVNRIDEVTGLVVRGAADPEGLGARIMAQAALTGWHDSSDYGVSLGEFAERYADAVGPRASVFVLGDARTNRSDPNLPALRRVAERARRVYWLNPEPHTQWGTGDSAALAYAEVVEMHECRNARQLGELVARLLPV

SEQ ID NO: 8989 - protein, 680 aa, Streptomyces avermitilis
MRRSARTAPAALTPLADHVDPAWLPSEAFRALGSRRTVVCGTGALVDTVHGEVAWACGAFGGSVVRAEEPADDRPCDLLLHLGERLDAPEPLGDEGFTLVRRRGRTTVTAAGQRGLLYGLFHVVRLGEAAFGASRAREAHRPALASRMLDHWDNVAVHPVMGQVERGYAGGSLFWRDGRARGDLERVRTYGRLLAACGINAVAVNNVNVHATEAHLLTDRIGEVAEIAGALRPYGIRTQLSVTFAAPLVLGGLATADPLDEAVRAWWAEATGRVYAAIPDFGGYVVKADSEGQPGPFAYGRSHADGANLLADALAPYGGTVHWRAFVYDHRQDWRDRSTDRARAAYDHFVPLDGRFRDNAVLQVKHGPMDFQVREPVSPVIGAMPRTRLAVEVQATQEYTGQQRHVCALAPMWSQVLRWRPEGATGTSVGELARGGLVAVSNAGDDPYWTGHPLAQANLYTVGRLGWQPDADPFGLLDEWIDLTFTPARTEAPERLVAGLRAVLYRSWRTYEKYTAPLGVGFMVQPGHHYGPSVDGYEYSPWGTYHFADRDGVGVDRTRATGTGYAGQYAKPWAEVYESPDTCPDELLLFFHHVPYGHVLHSGRTVIQHIYDTHFEGVAEVEEARQVWASLVDLVEPARHTRVAERYEEQLRGAREWRDHINSYFFRKSGVPDAHGRRIH

SEQ ID NO: 8990 - protein, 678 aa, Streptomyces avermitilis
MTAPGIGKIPYGGDYNPEQWPEAVRDDDHRLFTQARIDTLTVGVFAWSLTQPAEDAYDFGVLDGILERAAAEGRRVCLATGTAALPPWLARAHPDVNRTDFEGRRHRYGQRHNFCPSSPAYKSAATALAGRVAERYAGHPALLAWHIGNEYGGACYCDLCAEAFRRWLREHHGGLDALNDAWYTAYWSHRYTDWDQIEPPSALTEHWRGPDHTAFQGITLDYLRFTTDALLGCFLAEKEAIREHSPETPVTTNFMGMYRPLDYHRWAPHLDFASWDNYPPLDAPPTWPALAHDLMRGLKDGAPFWLMEQAPSTTACRDVNPLRRPGELRLASWQAVAHGADAVLYFQLRASRGACEKYFGAVIGHAGRDDTRVFREVSHLGREFELLGDTPLGARTPARTALLFDWDSWWALEISDGPSRLVRYQDQVHAYYRAAREAGADIDVVPVTAGLRAYDVVLAPALHMVKGDLAGRLEAVAARGGTVLTTFLSGRVDTHDRAFLADVPGPLAPLMGIRVDEWDARPADTAHPVTLGDDKDVVHTDARLVFEIVLPRGAEPVGTYQADFYAGTPAVTRHRFGERGGEGWYVATALAQPGVDWVVRRVLARHDLIGPYADHPAVETATRVAPDGTRLLFLLNHAPEPARLTAHATATDLLTGKRSERSEPLTLDPLGVAVLRLR

SEQ ID NO: 8991 - protein, 253 aa, Streptomyces avermitilis
VVGRAAPAGLPGGAAMSVVDEGRAGETRSPRTRSFGDGPLSRAAALVHTLLTVEVMLLTAASPGLGALLVLGPDPSGLPLAAACLLPLGPALAAAVYALHHRGRDLTDLHPARDYWRGWRLNARPALKIWTPLLAWLTVIAFCLTHFAVGGLPGWWAALLAVIGLGCLLWGAHALVLTSLFTFRTADTCRLAAYFLLRHVRATLGAASLIVLTTGLTLLATEALPALLAPLLLLSLLHACRPVITETEEDFTA

SEQ ID NO: 8992 - protein, 507 aa, Streptomyces avermitilis
VISVPAEATGRLSDAWRACVGTGRIELALRRDYQDSLALLQREIGFRYIRGHGLLSDGMGVYRPYAYEGARRVHHSFTYVDQVVDAYLGLHVRPFLELGFMPTELASGDQTVFWWRGNVTPPRSYDEWARLVRATLTHLVDRYGIEEVRTWPIEVWNEPNLTDFWQGADEAEYHRLYEVTARTVKDVDASLQVGGPAISPGADEWLLRFAEFAERREVPVDFVSRHAYTSGPARPVPFGAYQTLAPARRLLDQFARPREQLKGTRYTELPVHITEFNSSYRPDNPIHDTAFHAAYLAPVLAAGGDHADSFSYWTFSDMFEESGVPTALFHGGFGLLTHRQVKKPTYHLYAFMARMGEELLERGDDHLVTRHPDGRVTVLAWAPVDETGRTPGPDRHTLRLSVPVGRRPRGAAFVRRSTVDEEHGNAWTAWRHMGGPRSPRPHQIDLLHEAAEPARSHLRLPVEDFRADLGLTLARHEVTLVELSPVEDETPPWWDERRLLGSPVEPR

SEQ ID NO: 8993 - protein, 549 aa, Streptomyces avermitilis
VKNTGQLSRRGLLAVAGFAGLAALTGCGSGDGEADTKDLSKKRAGAMKNYGAGDQFKATKALTFTILHNDMPTYPMKRDWLFWKEVTERTGVTLKPTSVPASDYDKKRSLLIGAGDAPLLIPKTYPGQETAFVSSGAILPVSEYVRLMPNFRAKVEKWGLEGDLDSIRQADGNYYVLPGLHEKVKSGYSLSFRTDVLKKHGLDLPTTWDQVYDVLKALKAAYPDVYPFSDRWGQPTPGGALLNYLGPAFGTKAGWSYANTAWDTKARKYVFTGATDEYRQMLEYLRKLVAEKLMDPESFTQSDDDAVRKLLSGKSFVISANPQELVQNYRYNLGKQVKGATIEMIPVPIGPTGEVIVGSRLENGLMVAGRAAEGDSFVAMMQFVDWLWYSDGGQEFAKYGVEGVTYTSSGAGRYKVADGISYMGSDPSAPKDLQKDYGFTNGEFAYGGSWALVSSSFSPDEKAFQDAMAGRKLLPVDPAHPLKADEQEQATLWDTPLKDHVTQNTLKFALGKRPMSEWDAYLAELKAKNMQRYIDLHNTAYERFKKEHG

SEQ ID NO: 8994 - protein, 308 aa, Streptomyces avermitilis
VVTLSDGRPRRPARPRLSAGRPSRGHRVFQAVNGLILTGVVAVTLYPFVNIVARSFSAEDRIRAGQVNLLPEGFNLTTYKIVLKDGMFWRNYGNTVLYTVVATAIAMVLTTCYAYVLAKPHLKGRGALVGVAVFTMFFSGGLIPNYVLITGLGMKNTLWAMVIPNAISVFNLLVMKAFFESLPTELEEAAQIDGLSTYGILLRIVLPLSKAVIATMVLFYSVSFWNSWFGAFLYLDRAEEMPVTVYLRNLIAGATGGENAGADLEQLTQVAANIQSVTIVLTALPILLVYPFVQRYFVSGVTLGAVKG

SEQ ID NO: 8995 - protein, 332 aa, Streptomyces avermitilis
MTSPTAVDPTPGARNPSPSEHTAPRPRRRPAPRRTWRQALRRDWQLYSLVVLPLLFLLVFRYLPMIGNAIAFRRFEPGGSMLGERWVGLRYVRMFLTDPTFWQVFTNTMWLGALTLVFCFPVPIVLALLLNEVRTRALKRFVQSVSYLPHFLSIVIVAGVTMQMLATDGPVNHALKAFGQAPVRFLQEPDWFRAVYVGSEIWQTAGWGTILYLAALTTIDEDLYEAARIDGAGRWKQIWHVALPGIRPTMITLLILNIGTFMAVGFEKVLLLYNPLTYPTADVISTYLYRTGVESNSFSYAAAIGLFEAVIGLVLIFSANQLSRRTVGTSLW

SEQ ID NO: 8996 - protein, 333 aa, Streptomyces avermitilis
LRGAVPAFDLPPAELENHRPAPHEPADFDAFWQATLKESGQAEPVLSVRPFDSGLRLVETWDVTFRGFAGDPVRAWYTRPAEAPRPLPAVVEYAGYGRGRGLPHERLTWAAAGYAHLLMDNRGQGDQYGCGGDTPDPHATAPSGPGPAVRGLLDPRDYHYRRLITDAVRAVAALRALPGVDGSRVAAVGNSQGGGLALAVAGLVPDLAAVLVSAPFLCGIRRALELTDAAPYGEITAYLAVHRGAEAAAYRTLSYVEGVSFARRATAPAHFGIGLRDTVCPPSGAYAAYNRYAELTGHDPLKEIHPYPFNQHEGGDAVHVRRQLTWLDGILGG

SEQ ID NO: 8997 - protein, 407 aa, Streptomyces avermitilis
VVRGRPSESRRSIALVHWAFPPTVGGVESHLADYAGRLTRRGYQVTLLTGEARPQPVDRVEILTHPLLRLAEYHHAALGENSRTGRWLTPVEQRRAAELHEWLARVVDARDIRIVHGHNLHHFSPVPALALNRLREQSGTTLLHTYHSVWPEDPWTAQFCRSWDGHYVVSDYLAFACRTHLGIRARRTYLGIATDRFRSLPPPRSDGPHTVLLPARLIPNKGAELAVRMLDTLRRTGLSVRLVLTSPQEVVDWHEEQQGFLDRLNRLIDGLGLRPHVDLVPTPKELMPRLYARAHVVVYPSDYPEPLGLAPLEAMSAGRPVVVTATGGLPEAVLHDRTGYVVTPGDLEQLSDRVRRLLLDPALSKRLGREGRRHVERQFNLDTYVDKMCANYSALLDERVEGLPRIG

SEQ ID NO: 8998 - protein, 733 aa, Streptomyces avermitilis
VIDSASPEVGLQPFLHTRVICLAAPSFALSATDGQLRGTGVDGFYDQDRRLLHTLRVLVNGQEPEPVDHGQQGPREAVFRAMCRQPGDPTSAPWLLVTRERAVRRPGSGESGDVIRLHNVNSQEARFTLSVVAATDLADVATVKAGAPVDDVGCEQVEGVARGVRWLCPRDKSRVLLRAEALTTSADGRTAPAGGLPKPELLLDREHPGRAEFRWQLCLQPDEEWSVRLLLQGKTTTVAGHPVPPRLGVPWQTPEVTGHERMAALLKRGLADLEALRLAERSSAAGEREDQFVAAGCPWFLGLFGRDSIWAARMMLPLGTDLARGTLWTLARRQGERHDSFTEEAPGRILHELRPAETRHGDGMVLPARYYGSVDATPLFVVLLHEAWKWGLPEKELKLLLPHARAAMKWVEGAMGGDHLIRYGKGRANGLLHQGWKDSPDAVRDAEGRHIEPPIALCEVQGYAYQAAMAYSDILTALGDGGGEAERWQERACRLRAAFHRSFWITEPKGRRYPAIAVDAEGHPVSGLTSNMGHLLNSGILLDDEERRQVAEALVSEELRTPWGIRTRSARLPGFNPFSYHGGSVWAHDSAIAVHGLATAGFAAEAAALIDGMLDAAAHFDHQLPELYAAYPSPRFGRPAPFPPSCRPQAWAAASATLLCSAMLGLEADVPRRRLTVRPIAPSLMGLNSPYSVRGLRLGADTVDVRVDTHGGTEVLGIDGKHWHIAAPAPCTT

SEQ ID NO: 8999 - protein, 1011 aa, Streptomyces avermitilis
LLLSSGDGVGRGDPMRRSNRVRRRLDQVLVFTGAAVAAGAGTGVKFVDGGVQALLICLLAGGTGIGAYAANSLRARAGGPPPHVLISHPDGDEPWALWLAWRLRRIGYLTSTRSWAATERTVPPPPEVAPDHELIILSRALDDAGPATEETRPSRTRGRTVLALATTHRDPALTRWAGYEVLSLAGRTAAEAAATVDARLHHAGAGPRPDYTAPHVAGEAEPRYPGEGALVTNLQPRGVSHFTARRTELALLREVLGRVNVSGDGRICAIHGLSGIGKTRLALEYARRYEDLFDVIWMVEASHPPTARASLIALARALQERRERQPGAVAAQEERDPEQTLRRLLLNELPRTKSLLIYDGAEDDSAIRELLPDARNGGQVLITSVSPAWQRIAPHRIALEEFSAEEAVAFLRDASGVDDVTGLGRIVERLGRLPLPLEHAAAYLRQSPDIDSYLRALELPSSLTPPARADVSPSGAEAWILSFNQVEAKDEVAGLLLRLCAFLAPQGIPSYFFDNAADRTDLLPAALCESVTEPARYLRITGTAKSYSLLTGEGQLVMHTRVQAVIREAMTAHERSVHAADAARLVNGWFPEDPDRVRTWPQCVELLPHARVVLGHCRDHSVVDENTATLLQSVGEYFRAQGDHNEAERLLMEALHQRERLRDRSHPLVADTLFCISRLKVLRAELPEARDFAERALDIRTRLLGEGDLRTLDSRLQLGEVLRELGDFAAASAVVEQTIRRLRRRGDADPVKVAESLRDLGVVRWRQGRLPESIGHHREALQLLEQTPGGGERARRDDTASVHEALGLALLDSRDLEAAEHHLRTALAVLKDAKYAEGHPLVLSSSVHLGETLRQRAMRYRGRGDQRAGARERSSPGDLEAARLLGEAKRTFDRVLSAPHMNGDHPDRACALVRYAHLLLDQGNSEAAMTEVTNAHRIYTDKYGSRHPYVAEACYRRALIHKKRGQLQKALEDLETGREIYLGVHPADHPLLRQLDDELQDVSAAATGDHP

SEQ ID NO: 9000 - protein, 399 aa, Streptomyces avermitilis
VPQINKTCSPSVVPNTDLTRLRVALTVFFALDGFVFAGWVVRIPAIKEQTGASASTLGLALLGVSAGAVITMMLTGRLCRRFGSHPVTVVCGVLLSVSVALPPLTHSVPALGAVLLVFGAAYGGINVAFNSAAVDLVTALHRPVMPSFHAAFSLGGMVGAGLGGLVAAHLSPTHHLLALTMVGLLVTAVAGRTLLRHEPPVPPDRPRQEEHARRPLDGRTRGLVLVFGLIALCTAFGEGAMADWGALHLEQDLDAHPGVAAAGYSCFALAMTAGRLSGTALLERLGRTRTVVVGGTTAAAGMLLGALAPSVWAALLGFAVTGLGLANLFPVAVERAGALAGPSGVAIASTLGYGGMLLGPPAIGFMADWYSLPAALTSVAALAAVAAAIGFVTRRTTAD

SEQ ID NO: 9001 - protein, 493 aa, Streptomyces avermitilis
MTSPLTTSVSGGRWTPRLWGTLLVLCAAMFLDALDVSMVGVALPSIGSELDLSTSTLQWIVSGYILGYGGLLLLGGRTADLLGRRQVFLVALGVFALASLLGGLVDSGPLLIASRFIKGLSAAFTAPAGLSIITTTFAEGPLRNRALSIYTTCAATGFSMGLVLSGLLTEASWRLTMLLPAPIAVIALLAGLKLLPRSEREKDHNGYDIPGAILGTASMLLLVFTVVEAPEAGWASARTLLSFLAVAALLTVFVRVERRSPGPLIRLGVLRSGSQIRAQLGAMAFFGSYVGFQFLVTLYMQSLLGWSALHTALAFLPAGALVALSSTKVGAVVDRFGTPRLIAAGFALMVVGYALFLRISLDPSYAAVILPTMLLIGAACALVFPSLNIQATNGVDDHEQGMVSGLLNTSVQVGGAIFLAVVTAVVTANAPEGSSPQAVLDSYRPGLIVVTGIALAGLLITLTGLRTRRTQASVVVAESPQKAPEAERVAVHD

SEQ ID NO: 9002 - protein, 171 aa, Streptomyces avermitilis
VVSGEVIGKTVHAHALNANAFNSDATNSIFCYRASMAAKKAEQVLVDQWRGILAVHARTLCELDRELHPHGLGASDFEVLDVLAEGAAPDGGSGYRVQEIADRVHLSQSALSRLIGRLEKDGLVTRGMCPEDRRGVQVCLTPKGRALRDEVLPVQRAVLTRMLAGDAAECG

SEQ ID NO: 9003 - protein, 221 aa, Streptomyces avermitilis
VIRVLLADDQSLVRAGFKALLDAQPDIDVAGEAADGEEALRKVRELRPDVVLMDIRMPFLDGLAATRRITDDADLGHVKVVMLTTFELDEYVFEAIRSGASGFLVKDTEPDELLRAVRAVVQGDALLSPGVTRRLISEFAARSKAPAAADSLAGLTEREREVMALVGFGLSNDEIGRRLVVSPLTAKTHVSRTMVKLGARDRAQLVVLAYESGLVRPGWLG

SEQ ID NO: 9004 - protein, 445 aa, Streptomyces avermitilis
MEEQRANAQGWRHGPPWWRRWVDDRRQGRGRGPRLPWRSTALLTVLVLVGSDFAAHVQEGGRAPLDPFARALLLLGSALLLWRHRHPVPVVFGTAAAAMLYLGAGYAYGPVFLIVAVGCYSAVVAGHRRAAWTAVGMLWAGHVVVSHWLYRWLPPSGDAPAPWGQEIVIVTWVVAIMAVSELARLRREQWARERAERAQAARRRADEERLRIARELHDVLAHSISVINVQAGVGLALLDSDPEQARTALTIIKAAGKEALGEVRHVLDTLRTPDEAPRAPAPGLDRLSELVEQAASAGLTVEIEGEVPKLAPGTDLAAFRIVQEALTNVVRHSGSRHARVLIDDGRGDTGGDLPGDARAGTRVDPHASTQGGTQGVLRLRIDDDGPAAGVDAGGSGNGLAGMRERAAALGGTIEAGPRADGGFRVLAVLPFRAPPEETLQIKEDR

SEQ ID NO: 9005 - protein, 216 aa, Streptomyces avermitilis
MAGVKESPRERYRAQVRSEIKERAWEQIATAGASGLSLNAIAKQLGMSGPALYRYFAGRDELITELIRDAYRSLADAFRAAAESGADLVGLAHAMRDWALGDPQRYFLVYGTPVPGYHAPEDVTAIASEIMSTLLDACAAAPGAAPHGDAFDEHLADHRPWAADHPAPPAVLHTALAFWTRLHGVLSLELAGHFTGMGFDPAALFAAEIDDLSATR

SEQ ID NO: 9006 - protein, 347 aa, Streptomyces avermitilis
MEGVIASRELLEVVLPGTVEPEGLQLRYRALPAPEAGQILIAMEATGVSFAEQQMRRGRYYDQPPFPFVPGYDLVGTVRAAGSGVTPGLVGKRVAALTKVGGWASHVVIDAADAVEVPAGVGAAEAETLVVNGITAWQMLHRKARVRAGQTVLVHGANGGVGTVLVQLARAAGVKVIGTASARHHDALRELGVTPVDYRTEDVPGRVRELAPNGVDAVFDHVGGRSVIDSWRLLAPGGTLVSYGSAATRDDTGSKQWPVLKILGRVWLWNTLPNGRRAYFFNVWAGRALSKNRFRARLRADLTEVFAALQRDEVTARIAARLPLARVAEAMRLAESGTVAGKVVLIP

SEQ ID NO: 9007 - protein, 244 aa, Streptomyces avermitilis
MSTARGARARARTEVTAAIKDEARRQLAAEGAARLSLRAVARELGMVSSALYRYFPSRDDLLTALIIDAYDSLGETAEAAHAKGSDAANHAQRWVAVCEAVRGWALAHPHEYALIYGSPVPGYVAPDTTVPAASRVGLVLMGIVRDAHQGPGVVGSRLPAELEPEARRMAADLAPDLPPATVVALVAAWAKLFGLVGFELFGQFHRLVEDREPFFRHAAAQLAHDVGLVFTGPTPPRGGSKQGP

SEQ ID NO: 9008 - protein, 183 aa, Streptomyces avermitilis
VPITESTALALERRSHAHSSQARAPLSKASGVSMSSSPYYLQGSRFTIRMNGVIGWLARRGFSLKGTAELSVRGRKSGQQQRIPVNPHPYEGAEYLVSARGHSQWVRNMRVAGGGELRVGRTVRAFTAVELPDEEKLPVLRAYLEKWGWEVNQYFKGVTAKSTDEELIAAAPDHPVFRITVKP

SEQ ID NO: 9009 - protein, 401 aa, Streptomyces avermitilis
VSSENSSTDDAQQVWDVVVVGAGPAGASAAYAAAVAGRSVLLLEKAELPRYKTCGGGIIGPSRDALPPGFELPFQDRVHAVTFSNNGRFTRTRRSKQMLFGLINRPEFDQQLVEHAQKAGAELRTGVTVSRVEQHGSAVPDRRTVAVVLQGGDSLLARAVVGADGSASRIGAHVGVKLDQVDLGLEVEIPVPETVAEDWQGRVLIDWGPMPGSYGWVFPKGDTLTVGVISARGEGAATKRYLEDFIARLGLAGFEPSISSGHLTRCRADDSPLSRGRVLVCGDAAGLLEPWTREGISFALRSGRLAGEWAVRIAEAHDAVDTRRQALNYAFAIKAGLGVEMSVGKRMLTAFERRPGMFHAALTGFRPAWKAFAQITRGATSLGELVRSHPMAGRVLTSLDR

SEQ ID NO: 9010 - protein, 451 aa, Streptomyces avermitilis
MSSNPVAETVASLMPRAKAELTELVAFKSVADFDQFPKSQSEGAAKWVAEALRDEGFQDVALLDTPDGTQSVYGFLPGPAGAKTVLLYAHYDVQPPLDETAWVSPPFELTERDGRWYGRGSADCKGGVVMHLLALRALKANGGVPVNVKVIAEGSEEQGTGGLERYAEQHPELLTADAIVIGDAGNFRVGQPTVTSTLRGMTLVRVKVDTLAGNLHSGQFGGAAPDALGALIRVLDSLRAEDGSTTVDGLTGDARWEGLRYEEEQFRKDAKVLDGVELIGSGAVADRIWARPAVTVLGIDCPPVVGATPSVQAGARALVSLRVPPGVDAAEAAKLLQAHLEAHTPWGARVSTEQIGQGQAFRADTTSPAYAAMAEAMSVAYPGQEMQYAGQGGSIPLCNTLASLYPQAEILLIGLSEPEAQIHAVNESVSPEELERLSVAEALFLRNYAAV

SEQ ID NO: 9011 - protein, 249 aa, Streptomyces avermitilis
MALYVRLMQVIEVLSGRTALHLLRFAVGQAYLWCDGDESTLIDAGAVGSAASIVQALTGIGRRPEDVRRIVLTHFHEDHAGGAGEFAALSGARVSAHRLDAPVVRGELPGPPPVFEDWERPIHAGVSKLLPERSPDQVRPEAVAELSDGDVLDFGGGARVVHAPGHTAGSVAFHLPEHGVLFTGDAVAASPVDGRVMLGVFNVDRAQAVDSFRRLASLDADIACFGHGGPVVGAAAGALRASARTYDEV

SEQ ID NO: 9012 - protein, 346 aa, Streptomyces avermitilis
VIVWINGAFGAGKTTTARELIELIPNSALFDPEVIGGALTHLLPPKRLAEVGDFQDLPIWRRLVVDTAAAMLADLGGVLVVPMTLLRQEYRDEIFGGLASRRIPVRHVLLAPAETILRERIAEREIPADLADGEMRVRQWSYDHIEPYRAALAAWLTADAHPVDTSALTPYETALRIAEAVRTGDAPACDIVQTPEPTAETLAAGVLLFDEQDRVLLVDPTYKAGWEFPGGVVEPGEAPARAGMREVAEETGIRLDEVPRLLVVDWEAPVPPGYGGLRFLFDGGLLDSHEAGRLVLPGPELRDWRFVTEEEAAGLLPPVRYERLRWALRARERGAALYLEAGIPLG

SEQ ID NO: 9013 - protein, 64 aa, Streptomyces avermitilis
MKKRSMLAIASLAAGFVVAAVTPSHAVDGDVIGDLNVNDTISTVDHTINSDSLAVDDNALGRKG

SEQ ID NO: 9014 - protein, 682 aa, Streptomyces avermitilis
MRHPYARTTRTTRTTRTTRRRVVGALTAGLLCTAGLAAPALAAPAAGPVSPRPADSLALTPPMGFNNWNSTGCRPEFNEDMVKGTADIFVEKGLKDAGYQYVNLDDCWALPARDSNGKLVPDPARFPGGIKAVADYVHSKGLKLGIYTSAGTKTCNEAGFPGALGHEYSDAQQFADWGVDYLKYDNCNNQGVDAKLRYTTMRDALKATGRPIVYSLCEWGENKPWEWASDVGQLWRTTGDISDSWGSMLSILKQNLPLAPYAGPGHWNDPDMLEVGNSGMTDTEYRTHFSMWSIMAAPLLIGSDLRKASAATFDILDNKEVIAVDQDPLGKQGTVLSSEGGRWAVTKEMKDGSRAVALFNETDSAQRITTTAQAVGLPKAHAYTLRDLWQHRSYNTAGTISATVPAHGTVLVRVSADAAWAKNPPAVELGVDGSPLLEAGRTVALTSALTDLGRTPAKRVSVTLSGPRGWRVRATSPTTAGTVPTGRSLRTKWKVTAPDGTAAGSYDLTLKATYRSPTGVRAETLVPLAASVVPAPPSGVSYLGDLPWMSTTNGWGPVERNTSNGESAAGDGRPITVDGVVHAKGIGVHAESTIAYYTGRSCETVTADVGVDDEQDTNGSVTFEIWADGTRVASTGVLTTAMPARPLSADVTGAQVVRLVVTDGGNGITSDHADWADAKLSC

SEQ ID NO: 9015 - protein, 319 aa, Streptomyces avermitilis
MHTDLVAALDIGGTKIAGALVDGHGRILLRAQRATPAQEDGDTVMGAVEDVIGELTGSSLWGGATAVGIGSAGPVDASAGTVSPVNVPGWRDYPLVERVRKATAGLPVELIGDGVAITAAEHWQGAARGHDNALCMVVSTGVGGGLVLGGQLHSGPTGNAGHIGHISVDLDGDLCPCGSRGCVERIASGPNIARRALEGGWQPGPDGDTSAAAVAAAARAGDPVAVASFERAAQALAAGIAATATLVEVDIAVIGGGVGKAGDVLFTPLRAALRDYATLSFVQRLTVTPAQMGTDAGLVGAAAAALSRKPSATAVGVSG

SEQ ID NO: 9016 - protein, 345 aa, Streptomyces avermitilis
VAETARRAENRYGNRPTMKDVAARAGVGLKTVSRVVNGEPGVTPDTERRVQEAIDALGFRRNDSARVLRKGSTASIGLVLEDLADPFYGPLSRAVEEVARAHGALLINGSSAEDPDREQELALALCARRVDGLVVIPAGDDHRYLEPEIKAGVATVFVDRPAGRIDADAVLSDSFGGARAGVAHLIGHGHRRIGFIGDMPRIHTAVERLRGYRAAMEDAGIPVEDSWMSLGVTDPERVRRAAEKMLSGPSPVTAVFAGNNRVTVTVVRVLAEHGRRIALVGFDDFELADLLQPGVTVVAQDAAALGRTAAERLFRQLDGSLVTPERIELPTRLITRGSGELPPAD

SEQ ID NO: 9017 - protein, 439 aa, Streptomyces avermitilis
MGGCGMGQGQQEKVATSLAGAVSEGISATLAPVDAELERRYPGDPGTRQPVHTVYVPGDVFAADTIRSWGDRALAALDEHAPDAASFATALGLAEELAAPVYDRVRAKLEREPIEDLRVDFEDGYGPRPDAEEDEAAARAARLIAEAYRNGTAAPYMGIRMKCMEAPVRDRGIRTLDVFLTGLMEAGGLPDGLVLTLPKVTYAEQVTAMVRLLEAFEKARGLEPGRLGFEIQIETSQSILATDGTATVARMIQAAEGRATGLHYGTFDYSACLGVSAAYQASDHPAADHAKAIMQVAAAGTGVRVCDGSTNVLPVGPTEQVHDAWRLHYGLTRRALARAYYQGWDMHPGHIPTRYAAVFAFYREGFEQAAARLSRYADRAGGDVMDEPATAKALSGYLLRGLDCGALDVAEVAEATGLTRTDLEGFAGPRRGDLTASAK

SEQ ID NO: 9018 - protein, 303 aa, Streptomyces avermitilis
VTEGGRVSNTSRVTRRTGLRTAAAVAAALPLLSASPASASRNRGRRLDVMTFNLRFASASEPHSWAVRRPVMRELLRRERPHVIGTQEGLYQQVRDIEADLGPHYDWIGTGRAGGSRDEFMAVFYDTRRLAPLEYDHFWLSDTPDVIGSNTWGGGSIRMVTRVRFRDLADGDRPFHFLNTHLDNASQYARARAAALIADRIAGLDRSQPLVVTGDFNAAAHKNAVYETMLGAGLVDTWDTAAERGKLYGTFHGYKPLVPDGDRIDWILASPGVAAHCASINAFSSNGQFPSDHLPVQASLRLA

SEQ ID NO: 9019 - protein, 320 aa, Streptomyces avermitilis
MAEVLVYVDHVDGAVRKPTLELLTLARRIGEPVALALGSGAENTAAALAEHGAGKVLTHDAAEYADYLVVPKVDALQAAYEAVSPAAVLIPSSAEGKEIAARLAVRIGSGIITDAVDLEAGDEGPVATQSAFAASFTTKSRVSKGTPVITVKPNSAPVEAAPAAGAVEALSVSFSDKATGTKVTGRTPRESTGRPELTEAAIVVSGGRGVNGAENFAIIEALADSLGAAVGASRAAVDAGWYPHSNQVGQTGKAVSPQLYIASGISGAIQHRAGMQTSKTIVAINKDAEAPIFDLVDYGVVGDLFDVVPQLTDEVKTRKG

SEQ ID NO: 9020 - protein, 264 aa, Streptomyces avermitilis
VSLRIVVTVKYVPDATGDRHFAEDLTVDRDDVDGLLSELDEYAVEQALQIADDADDADDAEITVLTVGPEDAKDALRKALSMGADKAIHVEDDDLHGTDVIGTSLVLAKAIEKAGYDLVISGMASTDGTAGVVPALLAERLGVPQVTLLSEVSVEDGVVKGRRDGDSASEQLEASLPAVVSVTDQSGEARYPSFKGIMAAKKKPVESWDLSDLDLEAEEVGLEGAWTKVDSATERPARTAGTIVKDEGEGGKQLAEFLAGQKFI

SEQ ID NO: 9021 - protein, 168 aa, Streptomyces avermitilis
MTATPDLGTQLASPDLLRSVFRRHAAGVAVITARGDGGPVGFTATSLTSVSAEPPLVSFGIGVGASSWPAISETAHVGVHILGEHQQELAGVFAKSGADRFGASTGWREGPEGVPVLDDVLAWLVCRVVARVPAGDHRIVLAEVVLGDPTGAGRPLLYHQGRFSGLRD

SEQ ID NO: 9022 - protein, 137 aa, Streptomyces avermitilis
MTGLVVCVVVLVVASAYGVLHRRRSGRVRVRGRDGGKHLGAAELGEGLGERATLVQFSSAFCAPCRATRRVLTEVAGLVPGVTHVEIDAEDRLELVRELDIIKTPTVLVLDAEGRIVRRATGQPRKADVIAALGEAV

SEQ ID NO: 9023 - protein, 138 aa, Streptomyces avermitilis
MDIDVRGPRFGAAVTTVVLAVVLITGSAWLLAWQTLAFALGAAGGAGRSPYGWLFRKVVRPRLGPPTEFEAPDPPRFAQTVGLGFAAVGLVGYTVGPPWLGLAATGCALAAAFLNAAFGYCLGCELYLLVRRVTVRAE

SEQ ID NO: 9024 - protein, 242 aa, Streptomyces avermitilis
MAELVYRPVVGLAQTLFKAWDLKIDCKGSENIPRSGGAVLVSNHISYLDFIFDGLAALPQKRLVRFMAKESVFRHKISGPLMRGMKHIPVDRKQGETAYQHALDSLRSGEIVGVFPEATISQSFTLKSFKSGAARMAQEAGVPLIPMALWGTQRLWTKGHPKNFKRSHTPITIRVGEPVEAPTDQYAGAITRRLRERVQELLEAAQRAYPVRPKGPDDTWWMPAHLGGTAPTPEEVKAAEAR

SEQ ID NO: 9025 - protein, 230 aa, Streptomyces avermitilis
MTLTLTVSDEVRALAPGFTHVAVEAHGLLNGPSNEGTAALLEDAARRLAVRLDGRAPHEDPHMAAWREVYTAFGSKPSRTRNSAEALAKRALADAGLPRINMLVDLYNAVSVAHLIPVGGEDLDRVQGGMRLVRATGDEEFVTVAAGEEAVEHPDAGEVVWCDDAGVTCRRWNWRQGPRTRLTEESASAVFLLESLAPMPVAHLEAAAAELAELLEKFSPGARITVRAPV

SEQ ID NO: 9026 - protein, 199 aa, Streptomyces avermitilis
VVAFLCSAGMELTQETPDLSAYLAAGEVIDHHHPRVRETAARLAEQAVDSYAYARSAYEFVRDAIPHSADSGDLRVTWRASDVLAEGTGICHAKAHALAALLRAEDIPTALCYQKLDLVHGLVAVRFDGAWHRQDPRGNKPGVDARFSLDGERLAFTPDPESNELDYPVLYAEPHPAVLGALQAAHDRPHLWKTLPTAL

SEQ ID NO: 9027 - protein, 356 aa, Streptomyces avermitilis
VNPPKTDARRHHDPEVRGFASDNYAGAHPEVLAALALANGGHQIAYGEDEYTDNLQRIVRSHFGAGAEAFPVFNGTGANVVALQAVTDRWGAVICAESAHINVDEGGAPERMGGLKLLTVPTPDGKLTPELIDRQAYGWDDEHRAMPQVVSIAQNTELGTVYTPDEIRAICDHAHGHGMKVHLDGARIANAAASLNVPMRTFTNAVGVDILSLGGTKNGALFGEAVVVINQDAVSHMKHLRKLSMQLASKMRFVSVQLEALLAKDLWLRNARHANEMAQRLAEGVRAVHGVEILYPVQANAVFARLPHDVSERLQKHYRFYFWNEAAGDVRWMCAFDTTEDDVDGFVAALKEEMAR

SEQ ID NO: 9028 - protein, 248 aa, Streptomyces avermitilis
MRNGALSGAVIAVAGAGGPAGRATLVRLADAGATVVGSDNDPERLAEAVDAARYGHGGATVVGDTVDLFDLESTRDWATRIEKDFGRVDGLVHLVGGWRGSETFTKTILDDWDFLELLLIRTVQHTSLAFHEALQRSDRGRYLLISASSASRPTAGNAAYASAKAAAEAWTLALADYFRKAGGESGPTSAAAVLVVKALVHDAMRAERPNAKFAGFTDVKELAEAIAGVWEQSAAEVNGNRLWLTEKP

SEQ ID NO: 9029 - protein, 465 aa, Streptomyces avermitilis
MTEILVQERSEEQVPPQVRVVEHPAWPVLKDAVEQIRPWQSKDGSIDFEAEGAPDASDAELAVRRAIDAVEELSPLLPHDAAYHAALVKDLRRWSDDGFKVPDFLDSLLAFQPAGHRRDGLQHLVVFPMYTQNGNPDRNFEAVVLRMVWPDWLAELEATRYDNPLFCGITFEDFTAGYDTNSAVLFPETIAVREAPERFSWGGIFCDREAARFRAVTDAAVDTLGLELPADIAAMVHDQQRCEQAFVLWDMVHDRTHSHGDLPFDPFMIKQRQPFWMYGLEELRCDLTAFKEAVKLEADGFPQGRDVQYAVLFDRMFRFPVTGERVRNYDGLGGQLLFAYLHKHDVVRWTDNKLHIDWQRAPQVTNELCAEIEDLYRAGIDRPKLVHWFKAYELVSTYLAPHPGSRWAKGPDALDLTQPPRKLVDDVLPDEFPLSMFYEALAKKLKNVIASTKGITATSAERAAA

SEQ ID NO: 9030 - protein, 163 aa, Streptomyces avermitilis
MGPRPTAARAVQPVRVTPGWARHAEVDRGRGHAPGMKLTNGHMACAPGMFGSSGGDFMPPADAVKEHSPDLGGSVADGRGPPAPSRRVGDLAYAAKLRVTGVPVTCSRYPAMLHGFLGLAEPLAEPLAEPVADARDAQRSIAEVVASTVSGRKKSGEGGGEAG

SEQ ID NO: 9031 - protein, 227 aa, Streptomyces avermitilis
LNFLTIGHRGVMGTEPENTLRSFVAAQRAGLDLIELDLHLSKDGALVVMHDAEVDRTTDGTGPIAEKTLAELRTLDAGRGERVPVFEEVLDAVSAPLQAEIKDVAAARALAEVMNRRDLVARVEVLSFHDAAIAEISRLVPGVRTALVASRYGTDVVDRATAVGATTLVLNIRRLTLEIVEHARKADLRIIGWVVNTQDHLRLVRALQLDGATTDYPEIKRTGRFTA

SEQ ID NO: 9032 - protein, 179 aa, Streptomyces avermitilis
MDTAATGLTFRDATDADVDALVALIESAYRGDASRAGWTTEADILEGQRTDPEGVRAVIKSSDSRLLTVERAGAVVACCQLEHRGDHAYFGMFAVSPALQGGGLGKVIIGEAERAAREAWGVAAMHMTVISVRDDLIAWYERRGYRRTGETTPFPYGDERFGVPQRDDLEFELLVKPLA

SEQ ID NO: 9033 - protein, 130 aa, Streptomyces avermitilis
MVHVLSSRTLLRPTDPERSRAFYGEKLGLAVYREFGTGPERGTVYFLGGGFLEVAGRSDSPPSPALKLWLQVPDAGTVHEELKNAGVEIVRPPVREPWGLIEMWIADPDGTEIVLVEIPADHPLRYRPGI

SEQ ID NO: 9034 - protein, 254 aa, Streptomyces avermitilis
MKLDRPVTGGPCWTELGTSDLEAAKRFYTDLFGWRLETDPRQEAGGYTVAHLGDAAVAAISPRYEESQPVAWNVSFSVADADAAVATVRDAGGTVVLGPMDVFDVGRFAVASDPGGAAFQLWQPRAFPGAGLFNAPGSLGWVELLTRAAEQATAFYTTVFGWSVNASEHYTQWGVGGADFGGMVTMDEQFPPQVPSHWLPYFAVEDVDATAHDATEAGGSVLMEPTSVPDGPRIAVLRDAQGAAFGIHVGGEEG

SEQ ID NO: 9035 - protein, 172 aa, Streptomyces avermitilis
MCAMTHGLVLSPGSGRRMGTSGMTLKVGADVSARWSVFEADVEPGFDVGAHLHDEAEELFYILDGELDLLAFEPRIRASGDWRAWESGTGHKVVRGGPGSMMYVPSGCPHAFANPGSVPARMLFLAAPAGHELYIREIADILDAPGPPDQRAIAEARTRHGIHQLTPMKPGG

SEQ ID NO: 9036 - protein, 198 aa, Streptomyces avermitilis
MTAADGRTDTGGGTAGGRPHTGSGADGGGAAAHDTVAAVVRQWRAVRPDIDTGPMEIIGRINRCAALLQQAEDAPLRRVGLTRPEFDVLGTLRRTGHELTPGEIARETFSSGAAVTKRLKQLTERGLVERRGDARDRRVAHVRLTDAGRELVDGILPEQLSYESAVLSGLDGEGQGELAGLLGELLVQLEGRLGVPRG

SEQ ID NO: 9037 - protein, 553 aa, Streptomyces avermitilis
MSSATPTTSRVRPLPLVGVLRLGRPSDIWFKPALSVVAAVTPPNLTLLALGRLDLAMYTMAGSLCALYAHNRPYAARARALAWVVLGMIGGLAVALIAASLTTSAVVLVTVGALLAAAQKAVCDATRIGPPGHVVLTFISSASLFAPGTLGQVPGHLALAVAAGAWAWIVGMAPGLVRPHGPERRATAHALNAAAAYAETRGTGDGHARARAGAAAAVHAAWQSLLSTGARTAPRRALERLVVRAEVALAVPADAEAGQLRAWARELRGKGPIPIPRVPRAGDGTTDELLGVEAELDSPARPLLSRLGPLAPIALRTALGCALAGYVALALGVGRPYWALVTAASLYQANVTLTWSRGIQRVVGNLVGVLAFAAIAPLAHLGPAALVLSCLALNFGAEALIGRNYWLGSVCVTPMALLITEFAHLQEPGELMTDRVVDTLVGALVGFVAAVAVTNRRAGDRIELALDALESAREHAAKTVTAEHPEPGALESARRELAAAVVDLRATTDAAAGEWWQRALPEERVVLAEQAGHRTLAATVRRQGLHTTEGAPA

SEQ ID NO: 9038 - protein, 182 aa, Streptomyces avermitilis
VHGSASPGWLLVALCAATGTYCLLRMRSGVEEQRRAAGGEALMGFGMAAMAVPAAVAAPPRWAWLAYAVVFGAAGVRALWGAQTGAHHLHHLVGAFAMAYMAGVMAASPAHHEHGAASGLPPVTGVLLLYFAGYVLWSGVRLIPVASVAGGGRSVGWGDRPELARACRLSMGIAMVAMLLTL

SEQ ID NO: 9039 - protein, 311 aa, Streptomyces avermitilis
MMVPAALLLLGALTAVVAPRLLALADWPDREPVVALWVWQCVVAAVLVCCALSMTLSAAAAWVAVRGHVFAGAPHPVVEAYALSTGGSWASTTAVMLAGGGVWSAAMLVREIARARARRRQRRAELLVRAPLLPGEEPGADRLVVLEGERPDAWWLPGAAPQLVITTAALRRLKGRQLDAVLAHEQGHAQARHDWLLHCSGALAGGFPQVPVFAAFRDEMHRLVELAADDVASRRFGRLTIALALVELNEDRGVFGPCPTPQAHVPQRVHRLLTPPDRLTAARRLQLTAAAALVPVIPVLVAFVPGLRALG

SEQ ID NO: 9040 - protein, 227 aa, Streptomyces avermitilis
MHSPPVGSPPRPPRPRAAARAVVVLAAASALVVLLVALPWQPLIALDGDISRATHRWAVDEPGVTHAFRILTDWVWDPLTMRLACAAAVVWLVWRHSAWRLALWVAAACALGTLLQQVLKAAVDRARPVWPDPVDSAHYTAFPSGHAMTATVVCGLLLWLLRLYGAGRALWRTGVALAAVSVVGVGLTRVWLGVHWPSDVLGGWLLGALVVAGAMASYGRWHGSGPA

SEQ ID NO: 9041 - protein, 232 aa, Streptomyces avermitilis
MAIKGVLFDFSGTLFRIESTESWLRAALTAAEVPLPEPELIRTAEELESVGALPGGALPSQPLPARLAELWEVRDRSAAQHRAAYTGIARQVPLPDPRLHDALYDRHMAPAAWSPYPDAAEVLGALRERGVAVGVVSNIGWDLRPVFRAHGLAPHVGAYVLSYKHGIQKPDTRLFALACEALGVAPQDTLMVGDDRRADGGAAALGCGVHFVDHLPAPERPDGLRPVLELVG

SEQ ID NO: 9042 - protein, 239 aa, Streptomyces avermitilis
MSPRSASVNEELRRRSRERLLQAAVELVSERGYEATTLGDIADRAGSARGLVSYYFPGKRQLVQSAVHRLMHRTLQEALDREPRTEDGRERMARAIDAILGLARDQPVLMRQHMAGILQAEGFMQCPEQRRLAELLRETVARRGSPDAATDYPMLRALLMGAVYAALVPGAPMPLPVLRAELFKRYGLDWETGAPPAPEGADGTCGTDLSRFFATESRAGEDEGRPKPPDSVPGTRQSK

SEQ ID NO: 9043 - protein, 500 aa, Streptomyces avermitilis
VTLLNEPRRRRRSTGVAAAAAGLLAALLTAGPAAATPDPGDGAVTQKEVSRSAQAQVRAAMSDGEIPGQDEVVHSDNIEHVANIPKEAFTGFNSDLAFQGKYAFAGNYDGFRIFDISNPRAPRTVAQVLCPGSQNDISVSGDLLFLSTDSSRSDSSCNSTTQPATEKSSWEGMKVFDISDKANPKYVAAVETACGSHTHALVPERRNVYVYVSSYSPNAAFPDCQPPHDGISVIKVPRKAPEKAAVVSFPVLFPGEGQDGGGNPGSPTNPGVAKTTGCHDITVLPSKDLAAGACMGDGILFSIKDPEHPKVLDQVEDNVNFAFWHSATFNQKANKVVFTDELGGGGAATCNATVGPNRGADGIYDIVGKGEKRKLVFKSYYKIPRHQADTENCVAHNGSLIPVKGKDLMVQAWYQGGVSVWDFTDSAHPEEIAYFERGPLSTGTLSVGGSWSAYYYNGYIYSNDIAKGFDVLKITDRRTDPAKRVRLRELNVQTQPDYFD

SEQ ID NO: 9044 - protein, 239 aa, Streptomyces avermitilis
MRRSTGGNVLVTNVPDPSRALNSRVRQMTWATVSLAVVALALSGCDSGSDSPTDVKSGAASGPSVIVPGKPGDANETLSAEDAAKRRTDDDSPNTADFSYARMMIEHHTQALEMTELAPKRAESGKVKRLAERIAAAQGPEIASMEAWLKSHGGERKSTSHAHDTMPGMASAAQLKTLRAAKGRAFDELFLTLMITHHDGAITMATEVKSQGNNIQIEEMADDVIAQQTSELGRMRDLP

SEQ ID NO: 9045 - protein, 154 aa, Streptomyces avermitilis
VSVRRAWEVREHEVTTSWFDVCLAFADGARVDVLAVLAEGGVFVEDVRAQPPLSLDDLTALADWIEGPLFEACGGEPGPSGEPEEASSRHARPAWPRGIEGRRLVAEEYLAAQGEGIDPVLAVMCATGHSRRRALRLIAGARDAGFLTPRHVRR

SEQ ID NO: 9046 - protein, 448 aa, Streptomyces avermitilis
VLHVAVVGSGPSGVYTAQGLVQQDSGVRVDVLDRLPCPYGLVRYGVAPDHEKIKSLQNNLRTVLEHERVRFLGGVRIGPDGVPATRLRELYHAVVYCVGAATDRHLGIPGEELPGSWSATEFVSWYSAHPDSVADGFVRGARSAVVIGVGNVAVDVTRILARGPSELSPTDMPQAALTALAASRVTDIHMVGRRGPSQARFTTKELRELGALPDTDVVVDQRELALDPAYADPSGLPAAQRRNVEVLRAWAEAPPKGAPRRIRPRFFLRPVELLDGGGHVGAVRFERTAPDGRGGVAGTGQYEDIEAQLVLRSVGYRGVPLEGLPFDAEQGTVPHLAGRVLRDGAVSPGEYVAGWIKRGPTGVIGTNRPCAKETVTSLLADAPVLVRREVPDDPMAVLRAEGLRPVEWAGWQAIERAEAELGASLGRNVVKLPDWAALRAAAAGTAAH

SEQ ID NO: 9047 - protein, 451 aa, Streptomyces avermitilis
MATTASVHPVDEVPPIRQLAAFGLQHVLAMYAGAVAVPLIVGSAMKLSAADLAYLITADLLVCGIATLIQCVGFWRFGVRLPIMQGCTFAAVSPMVLIGTTGGGLPAIYGSVIVAGLAIALLAPVFGKLLRFFPPLVTGTVILIIGVSLLPVAGNWAAGGQGAKGFGEPKNLALAGFVLLVVLGVQRFAPAFLSRIAVLIGIVVGLAVAVPFGFTDFGGVGDADWLGISTPFHFGTPTFHASAIASMLVVALVTMTETTGDLIAVGEMTDRGVEPRMLADGLRADGLSTVLGGVFNTFPYTAYAQNVGLVGMTRVRSRWVVAAAGGMLVLLGLLPKLGAVVAAIPAPVLGGAGLVMFGTVAASGLKTLARVDFKDNDNLTVVAVSVAVGMLPVGVPTIYAQFPDWFQTVMNSGISAGCLTAIVLNLLFNHLPGKAGSPAKAAEPDEASGTA

SEQ ID NO: 9048 - protein, 119 aa, Streptomyces avermitilis
VTTAAPTARSRALAHPAREEIRLEAVLHALSDPMRLQIVRELAADGDELSCSHFDLPVTKSTTTHHFRVLRESGVIRQIYRGTAKMSGLRKDDLDALFPGLLDSVLTACAHQADRLGGA

SEQ ID NO: 9049 - protein, 359 aa, Streptomyces avermitilis
VSALFEPYSLRDLTIPNRVWMAPMCQYSAAPQGPAAGAPHDWHFAHYAARATGGTGLIVVEATAVSPEGRISPYDLGIWNDTQVEAFRRITRFLAAQGTVPAIQLAHGGRKASTDRPWKGGAPLAADEHGWQPLGPSPVAFDERHPVPTELSVAEIRQIVGQFADAARRALAAGFEIAEIHGAHGYLINEFLSPHSNRRTDEYGGSYENRVRFALEVVDAVREVWPAGKPLFFRVSATDWLDEGGWTADDTVRFAAELQAHGVDLLDVSTGGNASGVRIPTGPGYQVPFAARVKAGTSLPVAAVGLITDAEQAEKILANGEADAILLGRELLRNPSFARLAARELGGDVHVPAQYHRSV

SEQ ID NO: 9050 - protein, 303 aa, Streptomyces avermitilis
LSSEIDVLVLGGAGVDTIVQVPELPLPYADSYMVPAIETRAGQTGDFVAVGVHALGLRTHHIDMIGDDREGDLVRALHRDRGIGLTEVPLSAGTKRAVNLVGPDGRRLSLYDDSRAPDEERLPPPTVAALAAASRHAHVAITHPCADALPTLRETGVSISTDLHNWDGVQAYHEAFAHEADIVFLSTTALANPEKTMRQIAERGRAREVVATAGAEGAYLLADGEVTHIPTVTPPAPVVDSNGAGDAFASGYLFGRLAGEPPRRCALYGSIAGAYACTVPATRADAIGREQLLATAAELTNRP

SEQ ID NO: 9051 - protein, 209 aa, Streptomyces avermitilis
MSAFRGPQAWRSRWRRKPLARWRRNPLWRWRRNQLRRRSDVLEAWVLFSAWTVTVLCGVLTGLAAAHSVEQGLARERAEWRPVRALVAEDAPESSAAASSGADRVWAKVRWTTANGSTHSGQARVAAGSATGTPVTVWTDRDGLLVTKPVPPSEAQVRGVTVGLLVGVSAAAGPFVGGRLVRGRLERRRMERWDEDWARFGPMWGRKTG

SEQ ID NO: 9052 - protein, 380 aa, Streptomyces avermitilis
VVGCRLARIWNNVVAEVAAMAEVLLTVGTRKGLFVGRRRGGAWEFDESPYFNAQAVYSVAIDTRDKAPRLLVGGDSAHWGPSVFHSDDLGRTWTEPPQPAVKFPKDTGASLERVWQLHPAAAEPDVVYAGTEPAALYRSEDRGESFRLVRPLWEHPTRDRWVPGGGGEGLHTVITDKRDPSAVTVAVSTAGVFRTHDGGASWAPSNSGVSAVFLPDPNPEFGQCVHKIAQDAATPDRLYLQNHWGVYRSDDAGGHWTDIGEGLPSTFGFAAAAHPHRGDTAYVFPINADADRVPADRRCRVFRTADAGESWEPLTAGLPDEDHYGTVLRDALCTDDADPAGVYFGNRNGEVYASADDGDSWRQLASHLPDVLCVRAAVVG

SEQ ID NO: 9053 - protein, 587 aa, Streptomyces avermitilis
MHPCSPRLVGVPAPDRFGVLMGTQWNAVDGRIRTTARGHAVLNSPRLNRGTAFTRQERQELGLVGLVPPQVLTQDQQAARAYTQFRSQPNDLAKNVYLTALRDRNEVLFHRLLGDHLAEMLPIVYTPTVGTAIERYSYEYRRPRGVYLSVDAPEDIERTLRASGLGADDVDLIVATDGEAILGIGDWGVGGIDIAVGKLAVYTAAAGVDPARTLAVMLDVGTNRQELLDDPLYLGNRHPRVDRESYDAFIDAYVTAATELFPDALLHWEDFGPANARRILDRYREKVRTFNDDIQGTGAVNLAAVLSGVRAGGVPLRDHRVVLFGAGTAGIGIADQLRDALIADGLTPQEATDRIWAVDRHGLLAEDQQGLHDFQLRYVRRGAEIAGWRRDDALGGVPLAEVVDRVRPSVLIGASGQGGAFTEDIVRAMAAHTDRPIILPMSNPTRLAEAVPADLLTWTDGQALIATGSPFDPVEVDGVTHHIGQANNALVFPGLGLGAVVARAERITDGMLVASARAVAEQTDATAPGVPVLPLIDRLRDTSAAVAVAVARAAVEDGVARETVDDAVEERVRAAMWQPEYPPIEAV

SEQ ID NO: 9054 - protein, 361 aa, Streptomyces avermitilis
MDPAMSFAEIFTVVVPVFLVIAVGYGTGRRALFDAGGAQALRELTMQLALPAALLLSIWQTPRRVLVEQLPLVGLLAFGLLGVYAVLLGVLRLAGRRPLRRAALFALACVQPQYAFMGTSILGGLFGTAQAAVPIAVAGILVNVVLDPVVLILLGMPEHPASRTAATAAAATSAVRRPALVTVGGGAPGESVEAAAPVAAGDASPEHRPSVLRTVGHALREPFCWGPVLGLILSVGGVGVPKVAGTSLTLLAGAASAAALLYVGVSVSRIGRPKLTPAVWAIALTSVVVLPLLVYGAGLAMASAADAAQAALIVAFPVSPVPLMFAARHGSKADVRTIGSAVVLSLLLSFVTLPLLIELIG

SEQ ID NO: 9055 - protein, 585 aa, Streptomyces avermitilis
MTPTADTRPERPPRTSRMRWPRSAAGCTPVRLPLAAAARGAVALALPLLVGLRTGWVVPSVIAAIGALWGVSQDGSDPYRVRVRRLGWTGLSSALGLLAGELALRSGEPAAVAGCLVAAALVAGTVGLRGRIASVSGMHLLLGVTIGSGIPVPGPWWQPPLALLAGVALVLALSAAPWLWRRHHVERAAVLAVYRSAGEALAAAGTPRAEEARRRMTLALNHAHEVMAAHLAPRARQRQQSEVRELIRAFHCAVRLGEAVTAVVWEARPLPPAVTGVPQQLSERLLPGRGSAPAAADTAAEQAVPAVDAGSPGRRALAELCATVDGAPDPADLTLDLPARSWPGRAARLRYATLLAGCVLTAHLLAEALHGARGYWLPMTVAFVYKPDFGPVFTRALHRCAGTVVGVAAIGAVSLAATGTYTVIGVVAVFGALMAVGVRHHYALATLGLTAVVFVLVDLLGDHRALYGTRILDTVLASALVLVAHFAVWPDSAANRAEAQTEAAVAAARRYREVAPEAGLVQRQSLRRAAYHQLAEARRAVAHARGEPARPGRPLPDWEDTITTAERLCDRVTAQAVAGAAGPAR

SEQ ID NO: 9056 - protein, 312 aa, Streptomyces avermitilis
MRRKNARMDLQVLRSFQAVAEGTTVTDAAADARITQPALSRALNRLEDEVGAELFQRVGRVLRLTPAGRVFKEYVDAVLDSYDRGRRAVAEIVDPDAGAVSLAFLHTLGTWLVPRLVTDFRQAFPQARFELHQDGEIGLTRHLLDATADLIITSSEPAHPLITWRRLLVEPLRLAVPARHRLARRRRARLAEVAEEPFILLKPGYGLRGISETLCLEAGFTPLVGFEGEEVETLRGLVAAGLGVSLIPSSPDSTTPPDSPIRYLEITDVHGARDIGIAWLSSRALPPITRRFLDHALKSAAAPAASQATSRA

SEQ ID NO: 9057 - protein, 99 aa, Streptomyces avermitilis
MIIFGTRGYLYQLAMLTLVCGRCGNPSAHTLRKRVTKFTLFFVPLFPFSTKYTTQCTFCGAEQKVTKEQAERLQAQGAHGHGGQTYGQQSQQPQQPYQS

SEQ ID NO: 9058 - protein, 237 aa, Streptomyces avermitilis
MSSQGQKVAVITGASQGIGAALVDAYRKLGYAVVATSRTIAPVNDAGVLTVQGDIAYPATAERVISTGVERFGRIDTLVNNAGVFVAKPFTDYTQDDYATVTGVNLAGFFRITQLALEHMLSQGGGHIVNVTTSLVDNADSNVPSVLASLTKGGLQSATKSLAIEYATRGIRSNAVSPGVIKTPMHSEETHEALAALHPVGRMGEQSDIVDAVIFLENAPFVTGEILHVDGGQSAGH

SEQ ID NO: 9059 - protein, 326 aa, Streptomyces avermitilis
MSDKIALSTWPTPLEPMPRLAAALGLGENDLWIKRDDLIGLGGGGNKVRKLEWTVGAALAAGADTLVTTGAAQSNHARLTAAAGARLGLDVVLVFPGTPDSATHGSGNLVLDSLFGARVHWAGDGGPSTMGDVADEVCRQLRRDGARPHLIPFGGSSPLGARGYVEGGEELRSQLPDVDHVVVALGSGGTMAGLVGALGEQRVLGVHCGAVAEPAATVADLAGPLTRRSITPESLRLRTDQVGAGYGVLHEPVLEAMRTAAGTEGIVLDPVYSGRAMAGLIAAVRDGDIRPAQRTVFLHTGGLPGLFGHTETVQRSVSTLRSYEVE

SEQ ID NO: 9060 - protein, 202 aa, Streptomyces avermitilis
VTSFARVRITCQDGDVNLDHVFVCGNPALDFAATLRARRSLRFEMFASPDRLDAWYRESGVVDAVSPSQEADVEQAVAVREAIYELVTARRLGEAYADEALSVVNGAARKPPATPQLTAAGRRTDATPEEALSTVARHAVEVLSGPDVPLLKECGNPECTRVYIDRSRGMRRQWCGMESCGNKLKAAAYRARKKEAQAPASR

SEQ ID NO: 9061 - protein, 178 aa, Streptomyces avermitilis
VVSVTGYLITNRERNKSPLPPQAEWAWWYQYYFSTERGLLGLQANAHDLARLIWKFNSPTWDFDDATFDRTAAAFDNPDYVSIVIHNYRWRLGLAEGDPRYDRLENRLAAGPVIGVPTVTLDGERDPFTPAGDGSSYRDKFSGPYAHRTLKNIGHNVPQEAPEAFAEAVVEADGLGHR

SEQ ID NO: 9062 - protein, 147 aa, Streptomyces avermitilis
VDMKLEIAVVPVADVDRAKDFYQALGWRLDADVADGEDFRVVQFTPPGSPCSIIFGTGVTSAAPGSTQGLHLIVSDIEAAHAELTDRGVKVSEVFHDASGVFHRAGNEGRVPGPDPERRSYASYLSFSDPDGNGWLLQEITERFPGR

SEQ ID NO: 9063 - protein, 206 aa, Streptomyces avermitilis
MGRTSDAREKILTAAQSLIELRGYSALGTAEICKVAGVPKGSFYYFFESKEALALAVLDEHWATQRREWTRILSGEAEPLQRLRQLFEETEAGQRAGQQSCGTVSGCMFGNLTLEMSNQTEAIRERLQQIFDAQVDMVEEVIIGARERGEVAVSDTREGARSVVAQLEGQVLFAKLYNDTGRLKPLWTNCLAILGARMPEEVSAAN

SEQ ID NO: 9064 - protein, 217 aa, Streptomyces avermitilis
METRQHATGRGPAGTRQPVTVRLFGGPTALIETGGLRLLTDPAFDAPGPATGGTRALAKSRHPAGAAEGIGTPHAVLLSHDRSVDIDNLGFAGRHLLPTVVSGVPARAGRHTQRRNIMREFLVEITTTIPEGTEPAEVDRRRAAEAVRAEELAATGNLFRLWRPVGELRSIGVWRAADEDELHEKVLGTLPLRSWMTLTVTPLESHPNDPGRADATA

SEQ ID NO: 9065 - protein, 304 aa, Streptomyces avermitilis
VELRQLRYFLAVAEELNFGRAAERLLIAGPSLSQQIKTLERDLGVRLFDRDRRSVSLTPAGTALLPYTRSLLERADDLQRRARRLGGSEPVRLGYVNWLPADLTARASAVAQLHIDAWVAPSHAQAARVADGSLDLAVCWVRNEDLERHGLRARLIGADRLYAVTTGSDPSGVGAQDTVVLLDDDTTSWSSWNVYAEQLAHDTGARTVRISDGGVTGPAFFDHVRRGRRPVVNSPKGQTTPLPPDLVQRPVIAPKIYWTWSLVWRSSEVRAAVLAVVDTLTDGVGDLGIHAPDAWLPDGDPYKR

SEQ ID NO: 9066 - protein, 225 aa, Streptomyces avermitilis
VAPRPLHELVEAGWAKALDPVAGRIAAMGDFLRAEVAAGRTYLPAGANVLRAFQQPFDDVRVLIVGQDPYPTPGMAIGLSFAVSPEVRSLPGSLENIFRELHTDLGLPRPSNGDLTPWTEQGVLLLNRALTTAPRKPAAHRGKGWEEVTEQAIRALVARGTPLVSVLWGRDARNLRPLLGDLPAIESAHPSPMSADRGFFGSRPFSRANELLVRQGAQPVDWRLP

SEQ ID NO: 9067 - protein, 352 aa, Streptomyces avermitilis
VTPTGAAPGGRDGTPDGPGPRADPTAAAGRSDVVLAVDSGGSGLRAVLAARGGGGAALSAPLVSKEPVRTGPRGIDAGQLLEHLLPMARQLLADAEAGGPCAVAIGAAGFATLGDGLRAELPSALARELGVPRVALAADAVTAYTGALGVRPGAVVAAGTGLIAVGTDLRSWRRADGWGHLLGDCGSGAWIGRAGLEAALRAHDGRPGGSPRLLARAEERFGPVASLPGKLYPRTDRPAVLASFAPEVAACAPGDPVSAGVLRTAARHMAESAAAVCPASGHPQVALTGGLFKMGAPLLVPLGEELAVQLPHARRVTAEGDPLHGAVRIALDLAAGSLTLPCDEHMLYVVTE

SEQ ID NO: 9068 - protein, 307 aa, Streptomyces avermitilis
MSSPTGPASGLPVRMPRPRQPGRHRRPEPLAAPEGAPALVLAVPGTPSAATRSLAEEVVSIARSELPGLDARIGYLDGDTSEFPTLQSVLVRTFEERTARFEQARAAGMDVKEPDGPVAVVVPLLAGPDSALLRQVRQAVMDSRIAADLTDVLGPHPLLAEALHVRLSEAGLARADRARLFTVATAADGIILASVGGDEAVQAAGITGMLLAARLAVPVMAAALDEEGSIAATAEQLRSSGSQQLALAPYLIGPEIDAGLLDAAAQEAGCSAAEALGPYPAIGKLVLAKYTTALGIAPQQPQGAPVR

SEQ ID NO: 9069 - protein, 346 aa, Streptomyces avermitilis
VTDGGRRRRRAFIGSFTAAGGLGVLTAAVDEDTGALTVLGGADGVPDPSYLALSPDGGMLYAVSETADGAVAAYRVEDDKPELTAPPVPVGGSGPTHLSVHAGHVLIANYGSGSVTAVPLRADGTPADEGATVLQHAGAGPDPKRQQSPHAHQVLPDPSGRWIVSVDLGTDSVRVCILHGGALAVHREIALRPGSGPRHLAFHPDGDRAYVLNELTPMVTVCRWDPADGALKPVAETPVLPGAPEGDAYPSGIVVSPDGRFVWTATRGKDVISVLAVEKDGLRLVTTVPCGGAWPRALTLAGRFLYVANERSGNVTWFAVDPTTGLPRRGGSIEAPAASCVVFDRV

SEQ ID NO: 9070 - protein, 605 aa, Streptomyces avermitilis
MRNFPRRHGDGSTGSAGNTAGTGSTGSRPQWPEEPGGWLDRARAHRDGADTDPPASHEPATGGAGRGLRTAEPPDTGQGLRTATGQGPRMADPSGVGRGRGVWTADGSGTGSITGLQGRLLADAPPESAASRPGGDARDRHGAPSRARGWSTETWCAPHGRKDTAGESEHRPPGPTLPGARGWGAARTRGDRPDGHPDHPTGSPTTDGPARPARPDRREEGDGHDGHEGQDGHDGHDLLCAATAFLTLHHTEERLGDPARRIAAAHAEIAETGTYRHTTEELVFGARVAWRNANRCIGRLYWHSLCVRDRRDVRDAKDVAEASADHLREATRDGRIRALITVFAPDAPGRPGPRIWNEQLIRYAGYARPGGAVTGDPRNAGLTALARRLGWPGGPGSPFDVLPLIVQSAGDRPRWFTLPEDAVLEVALTHPEYPWWRSLGLRWHAVPALAGMCLESGGICYPAAPFNGWYMGTEIGARNLADADRYDLLPHLADRLGLDTRSDRSLWKDRALVELNRSVLHSFDRAGVTVTDHHTESLRFLTHLDREERKGRRVGADWSWIVPPISGSATPVFHRTYETVERHPAYVHHPEALARARGEIDEILV

SEQ ID NO: 9071 - protein, 74 aa, Streptomyces avermitilis
MSGPLPVIVSPPSPTGGRRVRVDGEILGLAYNLGDVAEFLRRAGMDMEPVQVAVSPLIDWRGVGPEYWGPETRA

SEQ ID NO: 9072 - protein, 116 aa, Streptomyces avermitilis
LTSEAYERPAAQEPYEQELSKARLEDENLQLKQAVLSHATIDQAIGVVVVLGGLAPGRSWDVLREVSQRTNIKLRHVAELIIDWAQTGDLPRDIREELESGLRQAKCRVDGGDGPL

SEQ ID NO: 9073 - protein, 158 aa, Streptomyces avermitilis
MAVDELDTRILRLLLEQPRTSVREYARILGVARGTLQARLDRLERDGVITGTGPALSPAALGHPVLAFVHIEVTQGHLDDVGDALAAVPEIVEAFSITGGGDLLTRVVARDNGHLEDVIQSLISMPGVVRTRTEVALRERVPHRLLPLVESIGRTAAK

SEQ ID NO: 9074 - protein, 231 aa, Streptomyces avermitilis
MSTLGTTSVVFDLDGTLVDSEPNYYEAGRHLLAEQGVTDFTWADHEQYVGISTQESLELWKERYGVEAPLDDLLADMNRRYLALARASTPVYPEMRKFVELLAGEGVPMAVASGSSPEAIEAILTGTGLASWLTTVVSADEVARGKPAPDVFLEAARRLGVSPADCVVLEDAAPGAAAAHAARMRCIAIPYVAAQADDPAFATAGLLVRGGQTEFTARAAYEWLARSTPSS

SEQ ID NO: 9075 - protein, 386 aa, Streptomyces avermitilis
VLDIAEELNRWVGEGRGFAVATVVAVGGSAPRPPGAALAVDSDGTVIGSVSGGCVEAAVYDSCVQALQDGTTVLERFGYSDDDAFAVGLTCGGVIEVLVTPVGVDAPGRTVFAAALSAAARGEAAAVVRVSRGPAELLGRALLVHPDGSYEGGLDGHPRLDRTAVAEARAMLDTGRTGTVEVSESGARCPGGLTLFVESSVPPPRMIVFGAVDFAAALVRTGKFLGYHVTVCDARPVFATRVRFPEADDLVVDWPHRYLRDTPTDERTVLCVLTHDAKFDVPLLVEALRLPVAFVGAMGSRRTHEDRDRRLREAGLTPRELSRLRSPIGLDLGARTPEETALSIAAEIVAARRGGTGVPLTGSPTPIHHDLSDAPGPVTAGTRAVG

SEQ ID NO: 9076 - protein, 495 aa, Streptomyces avermitilis
VWVAGELAQLFSLDPASVRVRSEHVGGGFGSKGVRPHQVAAVMAATVLHRPVRVVLTRRQMFSLVGYRSPTAQRIRLGADPDGRLRAFDHQAQSLTSTVHEFVESSAVLGRVLYDADAHRTTHRLVRLDVPTPTWMRAPGEAPGSFALESALDELAEKCGLDPIALRARNEPGAGPVSGLPFSSRNVLACFEEGARRFGWADRDPRPGVRREGRWLLGTGTAAATYPSGVGPSTAAVTAEADGTFTVRINAADIGTGARTALTLIAAEALAAEPGRVRVHIGDSDLGPAMFAGGSMGTRSWAWAVTAAAGELRERLALGGGIPPEGITARSDTTEAVGGLAKKERHSFGAQFAEVAVDTTTGEVRVRRMLGIFAAGRIVNPLTARSQFLGGMVWGLSMALHEEAVRDHSSGGLVGADFAGYHFAANADVPLLEADWVEDPDPDDPVGIKGIGEIGVVGGAAAIANAVWHATGVRHRQLPIRPDRVLLAAEGSRSA

SEQ ID NO: 9077 - protein, 719 aa, Streptomyces avermitilis
MTTTTQGAARATGAVGTAHTRVEGRDKVTGAARYAGEIPYDELAHGWLVLSTVARGRVRTVESDPVLAMPGVLAVLHHANAPRVTTDYIGIVGRPDPALGIFQDDRVPYVGWPVALVVAETSEQAREAAEALVVRYDEEPHDVEFFAGHPGLYTPQDSPLVQAEAVKGDVEAELAASDVVVDAEYATPGGVPLPAGAARGDGPLGQRPARRRRLQPEHRVGGRRAGPAVLPRPGLGAGAVGARGRRLRVQGGAPAPGGRRHGRNGSAPPRQSRTDPSADVLAGRLPQPHGAADQARCRPRRAAAGLRPPGAEPHVDRARVRRVERRPRPCAVRRRRAPHHSSPRTARRADPDLDACAGRGAGLVRAGVGARRTRGEVRPGPDRPARAQRTRGGPCVRAAVQQPQCARLLRGGRPQVRLGGPRSASRRAPRGALAARDRYGGRHVPLGGRPVHGGGDRGGGRHLHRADQRGGHRDRSTDRADPDRRGGAGRRAGTRPRAHRGQRPRSGDVRRRLDGHPLLGLGGDGRGGRAAGAAGPGRRHSAGGDHRTVGHHRGRRRPREEGTALLRSAVRRGRGRHHHRRGTRTADARHLRRGPDRQPAHRAQPVPRRHGLGSVHGAARGGRQGPFLGRPRRRRLRGLPLRRERRRPSARGGLGGGPRPGRPGRDQGHRRDRRGRWRGGDRQRGLARDRRTPPAAPDQARPCPAGGGGIQECLTSPRS

SEQ ID NO: 9078 - protein, 330 aa, Streptomyces avermitilis
MREFDYQRAFDVPGAVALLGADPDARFLGGGTNLVDLMKSGVERPGRLVDVRELPLDLVEPTPEGGLRIGATVTNSDLAVHPDVRRRYPALAQAVLAGASGQLRNMATVGGNLLQRTRCGYFTDLAQPCNKRLPGSGCPAVEGEHHNHAILGASAHCVATHPSDMAVALAAFDAVVSYETADGEGELALADFYLPVGDTPHRETALPPGALITGVTLPPSPVAAVSRYRKVRERASYAFAIGSLAAALDVQDGVVREVRLAFGAVASRPWRARTAERALTGRPASAEAFAAAADAELGAAEVLPHNGYKVPLLRNLVVAVLTELTEEAAR

SEQ ID NO: 9079 - protein, 190 aa, Streptomyces avermitilis
MAPSTSSAITLNINGEKHTLPVDHRTTLLDALRERLDLTGTKKGCDQGQCGACTVLLDGRRAVSCLQLAVAAEGRVITTIEGVADGEQLHPVQQAFLDLDGYQCGYCTPGQICSAIAVIEEHAAGWPSAVTADVRPEAGAPPLTADEIRERMSGNLCRCGAYVSIVQAVARAAEAHAADAQAAEVKGAAA

SEQ ID NO: 9080 - protein, 198 aa, Streptomyces avermitilis
MPEGGRVQQKKEAPLRSDAQRNRERILEVALAELTCSADAPLSAIAKKAGVGQGTFYRNFPNREALVLEIYRYEMQQVADTAAQLLRTRAPDEALREWMDRLAQFAMAKAGMAEAIRKATSAPGSPAKPGHEPVTAAAALLLDANESAGTIRPGVTPDDFILAIAGLWQIDPHGDWQPRAARLLDLVMDGLRTGARGR

SEQ ID NO: 9081 - protein, 296 aa, Streptomyces avermitilis
MTDTLTVSVLGTGIMGAAMARNLARAGHTVRAWNRTRAKAEPLAADGAHIADTPAEAVEGADVVLTMLHDGDAVLGVMRQAAPALRPGTAWIQSTTAGLDALTGLADFAREHRLAFFDAPVLGTRQPAEAGQLVVLAAGPTESRETVTPVFDAVGSRTLWTGEDGAAGSATRLKLVANSWVIAATNATGEVLALAKALGVDPQNFFDAIAGGPLDMGYLHAKADLVLNNGLTPASFAVSTAEKDARLIVQAGQEHGVRLDGAEASAERLHRAAAQGHADEDMAAVYYASFDETRTP

SEQ ID NO: 9082 - protein, 566 aa, Streptomyces avermitilis
LLTISRRVFYVRKRKISTERGREWERSMKHRAMKRRTVVMGVGAAAGVVAAGGFALSAQASGTSGSKSSDSSDALVFDKDAFTVLTTTITTDGGDKEVKYHFYKAITYVAKPVDEKYQSLNVSVPVEIDGTAVDATNAPILFANSVGGYMPSSVADATGVGGAAMTGMPGGGASASPSASASAGTGAGEVQSGGNGQVNAGGEMVNNGKLALAAGYVVVEPGARGRTLTDSSGTYYGTAPAAIVDLKAAVRYVRFNKGRIPGNTARIVSSGTSAGGALSALLGASGDSPLYDSYLKDLGAAEASDAIFASGDWCPITDLEHADMAYEWNWGANKLSTGTLVDQSVSKELSTAFADYQASLRLRAKGFGALTARNLDDYLLRTYLQPSATTYLKGLSETERSTYLAANTFITWDGTVATFTWADFLTHVGARKKDTPAFDAFDLSAGENNEFGTGTTQARHFTLYSLRHEKGGSARLDSDLPTKLDLMNPMYHLVKEQNPHRSKHWWIRVGTKDSDTSLSVVGNLAASLEQLGDDVDTLYYWDQGHGANTDAADFITWIAKVTGYKK

SEQ ID NO: 9083 - protein, 431 aa, Streptomyces avermitilis
VVQAAVGGGAPVMATRIEQVGQALPERRPELDAIRMLVVFGLIFFHSALVFATDDDYYVKNSETTQVIMILAGFAVVWAMPVLFLISGLGSWYSLRRRGAAGFVKERLLRLGVPLVFATLVLNPLPQWLRLRSADPGYDESYLAFLPHFYDVHVELAEFPFLLQGEHFETGHLWFVVLLLAFSLMLAFLFRVLAADRLRPVTDRLAQATFRVRGAILLPALPLALLCAFAGLEEDYAGWHRWAYLVFFAAGCALAADDRVRTAMRRAAVPAGRLGGVLFALSGPGFAVADEPFTEMTALGMATRAFFGAAGWCLVVAILGHLDRRRAARAVGRTPDPLSSGRHRVYAYLGAAVLPVYVLHQPVVVAVAYFVVGWNAPIPVEYAVIVIISLAVTLSVYELLVRRTRVTRFLLGMRVNTPDRPPRPGTSPRSR

SEQ ID NO: 9084 - protein, 199 aa, Streptomyces avermitilis
VGVPAVAGCMPVRLGRLSPSGGRYMGKVLGDVGGSEGASGHGQPATWVGGGLKLGLGVLLALFGVRLWHRRPRDVSQARLPKWMAAIDSFTPVKIFGLALLLSAANIKNATFTIAASASISSSGIPLGQQIGALAVFVVIASLGILAPLAVFLIAGERARNTLDGWKNWAAQHNIPVMAVLCFVIGLKLLGDGIAILTG

SEQ ID NO: 9085 - protein, 184 aa, Streptomyces avermitilis
VAEETAAPKADAAAPRSFTLSDTTAGPVGTRGTRVFIDKQSPKAYHALVETSEAVRAVAADAGLDRVLVELINLRVSQINGCAYCLSLHTKAALRVGETTQRLGVLAAWRDTELFTSRERAALALAEVTTDPADATAQEHAYDAARQVLTDDEISAVIWVAVTINAFNRVSIMSKHPVRGIPHQ

SEQ ID NO: 9086 - protein, 156 aa, Streptomyces avermitilis
MRISVSSDMDEPVARSLLAELRGRGHEVVAHGALRPGDDTRWAACSAAAAREVATGTSDQAVVCCWTGTGASIAANKVPGVRAALCTDAYTADGARRWNDANVLALSLRLTSQPLLREILDAWFAAEAGEDADDRENVAHVGRLDADRTGGAADRG

SEQ ID NO: 9087 - protein, 266 aa, Streptomyces avermitilis
MPQLAVDGAGMTYDDEGPHDGDGGVPLVFIHGWTADRHRWDHQMAHFADKRRVVRLDLRGHGESGGSARTIDELAGDVIALLDHLEIDRFIPVGHSMGGMIAQTLALAHPERIERLVLVNSISRMTYSRGRGLLMAASTLVPFKLFVAANIQRAFAPGHPREEVREYIRASSATPRDVVMTYYAAMRSFDVLDRVGEIRMPTLLVHGYYDIQLPVSQMLRMAKDYPDAVVRIVDAGHELPVEKPAELTSALDRFVTGQVGGVQLVG

SEQ ID NO: 9088 - protein, 378 aa, Streptomyces avermitilis
MIFRTTDSTTRPALRRVRTTTTLRPLHHRLDPARVEEIPFRAGDGVRLGLTRVDSGEPDRPAVLLLHGHTASADMFLLPETRNLVDALLDDGYEPWLLDWRGSCRLPYNETGQKYTYDDVALYDIPAAVSHIRGRIGDRPLFVVAHCIGSLTLSLSMTAGLVPGLAGVVSQGVFLTPKLAGRTSLRMSVAGELLKTRIDHIPVDFRKVGLWSKYTPLFALASRKASCPDPTCQILHNSAWGTGASLFVHEHLSEATHDRLAELLGPAPLWILPHLRRIELARSVVRWHDTDHRYRELPQNALDAAGRIDTPVLLIAGSENGLWLDSQKLCHDVLARRQPYLDVSYTEIPGYGHLDTFLGRGAALDVFGHILDFLGERR

SEQ ID NO: 9089 - protein, 842 aa, Streptomyces avermitilis
MREVNEGASAYPGQRATGESIERGGGGLSVSDLLAKVMTAAAPQPTGSGTESGPGAGPTAGPSLDVDGLAVAVAATAGRYLPGGHLSPDSDFFDAGGTSVHAVELVAELERELGMEIALDDVFADARPRTLARRWLSAGGAPAAHSATPATPEPTAAGVAATGVTAIGATAAGAAVAGATAAGVAATPGLLPLSAAGTRPAPAPSGLPVPSPRTPPAVAATPPPGSGDAPYSTARREDLDQILADLALADRLPWTGAPEPLPPRRILLTGATGFLGSHMLLDLLRHSDAHVYCLVRAADEEAATARLGQALKGYELPWSSEVRRRVTVLPGDIRHPRLGLSDDLWNTLAHELDSVVGVAAAVDFLRGYPSLRQSNVLGALTLAELAATGRPKPLHHISSIAVFNEVGITAMGEDDPLARVDRLVAGYDQTKWTAEVALRRARDHGLLVTAMRPGGIGGHTRTGAYNPQDLSSGLISAFGRFRTVPAFRYLNAAPVDWVSRVAVGVICEPDAWGYDYNLTGVPNTLDDVVQDMALGGMHVRVQDWDEWRTDALARLEADPVPELAFLTRVLRSPTALKLCEATLKGPAAHDDRTAALVEALGLGPAARYDAQAQLRTFERLARDGLARLPHKDDQPYLWFSERTEGGVGPVGAPADTPCSMALTLSIASMYQLVKERRVDVSGELVCAAVHPEPLTVERGDVWIRPEEGIPEQHGMRHQLLRYRLELRDTDGGHWWLEGHKYARARRDVWRQTRALTVEIGRAGEPARLTGEVVVPADSYVRDQIDGIKVDPRLTSQEKRAAKLTWLAWFGLEVGRGLLGPFARVAADLLDLRRNPTLTERNR

SEQ ID NO: 9090 - protein, 4809 aa, Streptomyces avermitilis
VRAWLSAAVADAAGLQAPVIDLDRPIAEFGLSSRQLVTLAAELSQRIDRPLNPSLVFDHPTIAGIAEAVFDESPVGATAADPAPADAPPARADDDIAIVSMACRFPGGADDPEALWRLLTAGEDAISEVPAGRWDTQGLYDPDPEATGKAYTLRGGFLSDIDRFDASFFGISPREAAAMDPQQRLLLGTAWETIERAGIVPETLNGSSTGVYIGLYDSGYQASASLGRLDGHVGTGSASSVASGRISYTLGLQGPAVTVDTACSSSLVALHLAARALADGECDLALTGGATLLVTPRGHVEFSRLRGLSPSGRCSPFSTEADGVVWAEGCGLVLLKRLADARRDGDRVLAVVKGSAINQDGRSQGLSAPSGPAQERVLRAALDAAGLRPDDLDYVEAHGTGTPLGDPIEGRALTAVFGPGRPADRPLGVGSLKSNLGHTQAAAGIGGVIKTVLALGHQLLPASLHAETPTEHIDWAGGGLRVHSTAAGWPRDVDRVRRAGVSAFGISGTNAHVVLEEAPHDLTRPTGEPQSPEQPTAEETAPHLPAPHLPAPHLTGKTLFPLSARTLPALRGQAGRLLEALSADPQTPLPEAAATLAHHRTHFEHRAVVQAGDRDELLTALRGLAEGQPDTDRVAGPQQALPPGKLAFVFPGQGAQWTGMARDLLDRSPVFADELDRCDAALRPFTTWSVAAVLRGDAGAPSPDRVDVVQPVLFAVMMSLAAVWRARGVRPDAVIGHSQGEVAAACVAGALSLNDAAAVVALRSQALTELSGTGAMAVVALPHTEVEAHLAGLDGRVSVAAVNSGRSTVIAGDVEPLEALLADLDRQQVFVRRLDVDYASHSAQVEQVRAAVLDELDGITTCPTSVAWYSTVLGEPVTEELEADYWYTNLREPVRFAPTVERMAADGYRYFVELSPHPSLLTALRTVVEDADAAEAAEDTAPDLVAVGSLRRDEDGPACLDRAAAELHVHGRRIDWRRLVADAPRADLPTYAWDPQRHWIEPEAAAGAPGLFDRAAHPLLGIQLQSADETRWTFRNEWSPATADWLPDHAVFGRTVVSGTTLMELCRAALAVARPDAPGDVTDLFLLTPLTLPGSGTVEVSVEVVTAGPVPEITVHSRPRGQEGTGWTLHATASAAEAAPVTQGPLPVWPEAAGTAWSPKTYERLARLGLGYGPAFQGVRAAVTTGDGELLARLSLPTVARDVADPYPLHPAVLDAALHVAAVFDAGDASDGRVLLPVAVGRCVLPHGGATELTARVRRSGGSGTDLTLDVTLWDADGIPAGRLEGVRLRAANPADLGTGSENGRHLYEVAWTAVPEEPAGAPGTEWTVLGDPSDPEAAAALRGLAAAGITVGETGADVRVRFWPRPASDVEPAAAAQELAATALAELQALLALPEDEAPTRTVWVTHGAVAAGEGDTVPGLAQSVLWGLARSARTEHPGLGLTLLDLDGSDPGGALPVAVAYAGEPELALRAGTLLVPRLVRARAAQALPIPADDHYELAGLPADVTLRAVAPRALAPGQVRIQVHAARVHPSGDDAPDAVSAGVLTEVGADVEGLALGLRVVAVADTAPGSAAVADARLVVALPDGLPFTTAVTLPGEHADAVAPGRAELGAALREAVASVAAGHTRPTRPRAWPVTAAREAIRRGGPVVLDLVGRPTLAPTDGTVLITGGLGAVGRHIARLLAEHGVPRLLLTSRQGADDPRAAEVRAELAALGAEVEVAACDVADAAALADVLGRIGDELPLRGVVHCAGVLADGVVAELTPERLTRVLRPKVDGAAHLHRLTADVPLDLFLLVSSAAGVLGTAGQSNYAAANVFLDQLAHHRRALGLPGVSVSFGAWAGEGLAAEHADLERMARLGHRALTPDQGRELVELSLRRGAPHLVAWSLDLPRLRETTAAGDDTAAALWRSLLPAPRTGQDGADGLADRLARLPEAERAERVLALVREEASRALGLRSAQSVRPDQPLRELGMDSVTAVELRNRIGTRIGAKLPATLLFDHPTPSRLAEYLLTTALATAGRPARRTAPGAQPARTATPASDEPVAVVSMACRLPGGVSDPEGLWHLVAQGRDAVGPFPAGRWDVESLYDPDPEALGKSYAREGGFLDGIESFDAGFFGITPKEAAAMDPQQRLLLEMAWEALERAGTVPAELAGSTTGVYVGMFGSDYLAGSRLDQLDGYVGTGSALSVASGRLSYALGLHGPALTVDTACSSSLVATHLAAQALRSGECDLALAGGVTLMVTPGTFVEFSRLRGLSPTGRCRSFSDDADGAVWAEGAGMLVLKRLSDARRDGDQVLAVLRGTAVNQDGRSQGLSAPNGPAQEQVIRRALELSALGAADIDYVEAHGTGTTLGDPIEANALSEVFGDSRPENRPLYLGSLKSNIGHAQAASGVLGLIKVVQSLRHGTLPRTLHAGTPSQHVDWDGSGLHLLQEAVDWPSSGERVRRAGVSAFGISGTNAHVIVEEAPPPAATEPNAEPMPGKRLFALSGRSEAGVRGQAARLAQYLTEDVALPDVAHTLARHRSHFERRTAIVAADRDELRAALDALATGRTPLVPPREEQTGKVAFVFAGHGGQWPGMGVELMAGSDAFREELARIDEAVRRHVGWSVLNVLRAPEEIAPLDRTEFLQPVLFAVNAALAAAWRALGITPDAVIGHSLGEIAAAYSAGALTLDAAVTVVTRRAQAVVPLAGKGGMLSVELPRAQVEELLAPYAGRLFVAAVNSAHATAVSGDAEALAEVLHRLEERKIPARRLSTPFASHTPLMDPLREELLDRFADVRGARTPTPLYSTVLAEPVPGDRLDAAYWYANLREPVRFADTVRRMLDDGYRYFVELSPHPSLGPSIEAVAAEAGIDAVGVGSLRRQQDGRDILLRRLGELYAAGHTPDWPVLFPTGRRVDLPTYAFARERHWLAPAPASPAGGGGPLLGTHVEASDEPDRHLFQSDLDLRDSRFAYLTDHRVTGDVWLPGAAFLDMALEAASALQDGGEVRLADVRFLRPLRLDEGRPVRLQLVLRPAEDGVRDFTIASAVTGERRTRWERHVSGRVTVTAGEPMADARLAVLREQCTEQVDLPGVYARLAALGIDYGPAFRGLEEGRRTHSAALGRLAAHPAAGHLLHPAVLDAAFHTAALPGDAPEGRAFVPAGFGRLRFTGLRTTPVWVTCELRSMAGDTATLDLRLWDENEQLVLEAEEFELAALSPLDGALFETRWQPRPPAQEPPATGSWLILADETGVAVELAERLGSSVPHVIVRRGEAFGVEGPGRYVLDPADPQQLAHLLDEAFADGLPERVVQLSALDAPAIGEARTAEQAARLCCLSTLHLVRTLADRPEGRAPRLFVVVRGSQAVGDSTQVTHPQQALAWGFGLAVAQEYPELATTLIDLPSTDGVDALWEQLRHADDERLVALRDTGRLVPRLARTRPDDGGHGELTPDGVYLITGGLGGLGRVVAERLVRRGARRLALLSRGRPGADAAGWIKGLEERGVTVHLARADVADRAGLTAALAALRRDAGPVAGVVHAAGVLDDATVANLTDERVLRVLAPKVLGTTLLTELIPEAGNLVLFASAAGLLGSAGQSPYSAANAFLDAWAHHLSRTDRRALSLDWGAWAGVGMVAESGTRADETSRSGLVAFSPDEGGELFERVLATSRRQLAPIALDWEMLALDADAARTRPLLGDLVTVPTGGADSDDLVKKVFAATTDHDRAVRLEAYVRARVGEVCGGAVDVSGTTVLKELGLDSLMLVRLRNAFARELGVELPAAAMFSASDIRGLVRALVAALPERDTVTPEQPADVTSEVLEVPETELRPATRDVVRLLRSAQPGMPGAAHAVGLAVRLTTPTTRETLTGILTRLVARHAALRTAIVPGAEGGRQLRVDREPANPVLRWTDVAADVELDAGDRLRELLESPFDLTTAALWRFELLDGGARGQILVFGAHHAVSDLQSLLLVAGEIDAELSGTSLGDTVTNRDIDLLIQAQRTEGTVPTGDGPGAAAAVEWREAFHGSGRLDLTLTRERPAARSYRAGSVTVAIPDGLMERVSAAASGLAVTPAAFCLGTLTVLLAHRRERERFVLAVPVDTRIHADAYDAVGFFGVPVPFPAEAGAGEPVEQVLRRTDGRLEKVLAKGAMFSDVLPTLAKQGLYRPNAPLVEVYFNYVRSSAGRLTNLEVLPAGTGWSDLDLMITMTPDAGRIRLDHNLDILDAAATTDLGEEFLRLLARAVEDPTAPVRTTAASEAPAATEVLVASEVPPAAEALAVSEAPAATEVPPATEVPPAGEPAVVPPRPLAVAATFALGNLPLMCELACNEGAGARDGGVTVAEAPYHHVLASLRDPSGVFADPATAVGVVLLRAADLERFGPVDDALLAELRTEYPAALRALSERTRKPLIVGFPPSARADDRLERWDSEVAAELAGLPGIAVLGPDDWTRHHAVGERFDERTEKLAHLPFTPDFQAAVALRLADVVRAVRRPAPKVIAVDGDETLWGGVAGEIGPEAVDLTGPRALLARRLLQWRAAGALLALVSNNDEDTVRAVLDRPDSLLKAEHFSVLSAAWGPKSGRLAEAARTLNLGTDSFLFLDDNPVEIAGVRSALPEVLSVTCPPTAELDEFLGRLWPLVPAAATAEDGLRARFYEQERERDAVREHAGFEEFLAQLELEVDIRALSAADVQRAEQLVRRTNQFTLRARSADGGDLTRWRECGEVWTAAARDRFGDYGQIGLLAVRPGEGQLDVLAWMMSCRALGRGVEERLLRWLADRAEELGCAKVRLTAERTPRNVPARRLVAALGGGDQDDAYLETVVTPDQLRAFRSWQQQ

SEQ ID NO: 9091 - protein, 574 aa, Streptomyces avermitilis
MARSLVDLLTKHASHQPDRTAYRYLVTGDRDGEIQDISYGRLAERSRAVASWLQERGLAGSRAMLLYPPGLEFICGYLGCLSAGVVAVPGVPPQGRSQNHRALTRMKRLIADADAKVILGGREVIAALGTMAEHLPELAEITCVATEDIPDAAAGSWREPDLTADSVAFLQYTSGSTSAPRGVMVTHGNLLDNERVITERMGHTPDTIAEYDHELFVSWLPVYHDMGLIGPVLNTVYLGATATLFSPLHFLQQPQRWLTALSHYRPHTSGGPNFAYELCLKQATPDLLDGLDLSRWKVAFNGAEPVRAATLRRFTETFGTAGFRREALYPCYGLAEATLMVTGGSVAAPPTLIEAPETGPHAGAADAAAVGSGRPGPGVTLVIADPERQQELPDGEVGEIWVLGASVAKGYWRNTLATRESFRATLKNREGRFLRTGDLGFLRDGELFVTGRLKDLIVIDGRNHYPQDLELSAEMSHPALRPGCTATFSVDGGVEGEQPVIVAEAAPEAADEFEKITDRIRSAIGEAHGLSVRDVVLVHPGTIPKTSSGKIQRRASRTAYLDGTLSVVGAAATR

SEQ ID NO: 9092 - protein, 226 aa, Streptomyces avermitilis
VINSGNGTDYESMRFDRRGQAEAFDAIGDRYDEAFPHKEGQVSVGEWLIGSLPPRSRVLDLGCGTGMPTARQLTDAGFDVVGVDLSGGMVELARAYVPGATFHQLDVADLRPGGSRDLGRFDAVAAFFSLLMLPRPEIPLALLTVRHLLVPGGLFALAMVEADVDDFSIPFVGHTIRVSGYLREDLHTVIETAGFEIVKEFSYTYAPSVADVPPEEQVFLCCRRRG

SEQ ID NO: 9093 - protein, 660 aa, Streptomyces avermitilis
VTEHHTPHEGPAQASRQSGGPLSGAGPVAPVTPMGPRVTRTPQPPPAHGRHDGGRPGQPGKGPVTPSRADTGRHAPEGDAPEAEYAEGAVPDSTGPQTDRLRYLDVATRQIARGMDLDETLRELHRAAVPAFADVIFIHLHDPLPVGDEKSAAPVALQLHSIDRTPEPAHTGWSRMPAPTSLPLPSDVAERVHLTATGRLATLLLAGRPAFGDAPGIAPAVAELLGPVASVPGALPPGRRLVIAPLHGRHHVMGTVVLLRRPDRPAFTGDDLLVASQLATHTALGVQKAVMYGHEASVADTLQHTMLPSSLPEPTGVRLASRYLPASKTAQVGGDWYDAIPLPGSRVALIVGDVMGHSMTSAAIMGQLRTSVQTLAGLDLPPDEVLHHLDEQAQRLGSDHIATCLYAIYDPISHRLLMASAGHPPAVLLHPDGRGEVLRIPPGAPIGVGGVAFESVEMPAPTGATLLLYTDGLVESRETDVGTGVEALRARLQATADGRAAPSLERLCDQVLGTLGPGTRDDDIALLAARFEGFPPDSVGYWFLAPHPLTARQARRLTRRTLRRWGLESLLDSTELMVSEVVTNAVRFASRPIALRLLRTDVLRCEVTDDSPQVPRMRHAEPGDEGGRGLFLVNQLARRWGATRLSTGKVVWFEQLIPKK

SEQ ID NO: 9094 - protein, 470 aa, Streptomyces avermitilis
VPSPHAWPDCFTTCPVGQWYGRPASRRVTGMEDTTGHPRNAQGHRAWWVAAVAGLAIVVAGAFSTMPGILQGPLHREFHWSRGSIGLAASVNMVLYGVTAPFAAALMDRFGIRRVVVAALSAVAGGALLTTVMNASWQFTLFWGFLVGLGTGSLAMTFGATVTNRWFVQRRGLVTGMLSSGSVLGQLVFLPALSWTIDHYDWRPALITLALVALATAPLVRLTLRDHPADLGQRPYGSDAFVPKPPPVTGAARRTVTVLRDSARTRPFWLLAALFAICGASTNGIMWTHFAPAAHDHGMPVTTASTLLAVIGVFNVAGTIGSGWLTDRVDARRLLAVFFTLRGVLLVTLPLLMAATVNPPMMVFVVVFGLLDLATVPPVIALCRQFHGADSAIVFGWTNAAHQVGAALAALLGGVARDAFGSYDFVWVLLGAACAAAALLALVIQRPSAPRSTELRDTPVPSTADCATGR

SEQ ID NO: 9095 - protein, 319 aa, Streptomyces avermitilis
VRPGLLPMELGIVHRLFGTARGADGRRLYAVVTCAPVPGEITTDTDFTINVPCGPEALEGADTVIVPAAVEDYTPQKRGQLAAPVRAALARIPDGARLASICTGSFVLAAAGLLAGRRATTHWKSCEELRTLYPEIDVDPDVLYTDDRGVLTSAGVAAGIDLCLHMIRSDHGAEVANTVARDTVVPPHREGGQAQYIEQPIREPADASTAAARTYALRHLEQPLVLEDLAREASMSVRTLSRKFRQETGMTPIQWLAHQRLQHARRLLEQTDEPVDRVAARAGFGTGTAMRQRFRETLGVSPRAYRHTFRGTARRHAPG

SEQ ID NO: 9096 - protein, 140 aa, Streptomyces avermitilis
MSDAFTTRVLNVASGSQETVVDLTHDCEAFLRDTAAGRDGLLNVFVPHATAGVAIIETGAGSDDDLLAALHTLLPADDRWQHRHGSPGHGRDHVLPAVVAPHATLPVIDGRLQLGTWQSVCLVDTNQDNPNRQVRLSFLG

SEQ ID NO: 9097 - protein, 268 aa, Streptomyces avermitilis
VPALEPIVPASTRRTRVPRWLRRTSGPVLLLLLWQLLSSTGVLTSDVLASPGRIAQVARDLVVDGSLPNAMGVSLQRVAVGLLFGAAIGTGLALVSGLFRAGEDLVDASVQMLRTVPFVGLIPLFIIWFGIGEAPKIAIITLGVSFPLYLNVYAGIRGVDSQLIEAGESLGLSRWGLVRHVVLPGALPGAMTGLRYSLGIAWLALVFAEQINADAGIGFLMVQARDFLRTDVIVVCLIVYAFLGLLADFVVRSLERLLLQWRPTFTGR

SEQ ID NO: 9098 - protein, 260 aa, Streptomyces avermitilis
MATDVHRPLSTQKAATAAAQASTAAASAVRVDGLTRSFDGRAVIDNLELDVRPGEFVALLGRSGCGKSTLLRILAGLDRDIEGTVLVPRRKAVAFQAPRLMPWKKVWRNVLLGLPGKPERAVAEQALTEVGLAHRSHAWPKTLSGGEAQRASLARALVREPDLLLLDEPFGALDALTRIKAQRLVGELWQRRGCAVLLVTHDVEEAVLLADRVLVMDDGVIAYETEVELDRPRDITDPRFAELRAELLERLGVDTAAEAA

SEQ ID NO: 9099 - protein, 342 aa, Streptomyces avermitilis
MRRRLAPALLLPFPLLLAACGGNSAAGTSTGGRTDGKGSLTLNVGDQKGGSEAVLRAAGELKNLNYKIKWSTFTSGPPLLEAINAKAVDIGGVGNTPPVFAAGAGSKISVVAAWHGTSKGEAVLVPKNSSLRKPEELKGKSVAVAQGSSAHYQLVASLEKAGLKLSDVKVKYLQPADALAAFTSGKVDAWAVWDPYTSQVLQAKQGRALVDGDGVVNGLSFQVAAPSALADKKKSAAVKDYLERLRRAQDWVYEHPAAWAKVWAKDTGLPYEVALASVKRTNASRVPVAVDKPLIASEQQIADTFTGLKLIPKKVDFADFVDTRFNGGLPASTSTPRVYKDS

SEQ ID NO: 9100 - protein, 384 aa, Streptomyces avermitilis
MTVHLHWFLPTGGDGRTLVDRHAYASNSADLARPVKGVRPPDIEYLAQIAKAAEQLGFEAVLTPTGTWCEDAWLTTVALAQHTERLKFLVAFRPGVISPTLAAQMAATYQRITRGRLLLNVVTGGDSTEQRRFGDHLDHDRRYARTDEFLSVVRGVWSGRPYDFDGAHYQVEGGLTAVPPDPLPEIFFGGSSAAAGPVAARHADVYLTWGEPPEQVKEKIDRIRSLAEREGRTVRFGIRLHTISRDASAEAWSTAHRLLDDLDADTIAAAQTALGRSESVGQQRMLALHGGSRDRLEISPNLWAGVGLVRGGAGTALVGSHAEVADRIEEYHALGIEHFVLSGYPHLEEAYWFGEGVIPDLAARGLLPPVTAGGGSPLLVAGGR

SEQ ID NO: 9101 - protein, 362 aa, Streptomyces avermitilis
VNNIGVPAREVDVVVTGAGQAGLSSAFHLRRTGFEPERDFVVLDHAPRPGGAWQFRWPSLTYRKVHGMHALPGMELTDADPSRPSSEVIAEYFDTYERTFDLRVRRPVDVTAVREGEGGRLLVQTSDGTWATRALINATGTWDRPFWPRYPGQESFRGRQLHTAQYPGPEEFAGQRVVVVGGGASGTQHLMEIAPYAASTTWVTRRPPVFREGPFSEDVGRAAVAMVEERVRRGLPPRSVVSVTGLPLNDAVRRAIADGVLDRLPVFDRITPDGVEWDDGRRVAADVILWATGFRAAIDHLAPLRLRAPGGGIRVEGTRVVADPRIHLVGYGPSASTIGANRAGRAAVRDIRRLLAGEPLTV

SEQ ID NO: 9102 - protein, 281 aa, Streptomyces avermitilis
MQMNTPPRSTIRLTRRGRGALIATGAVVAATAVAVPLLILKSDGPTRPTSLVIPEGWRSGQIYEAVDKALELPAGTTRKSLAKANLKLPGDAEGNPEGYLFPATYPLEKATPESLLRAMVDTANKKFRGSPITAGAQRNAMTMYQAVTIASIAQSEAATKADMGKVTRVVFNRLERGMPLQMDSTINYAMNRSTLNTTVADTKLDSPYNSYQRMGLPPTPIANPGEDAMRAAVNPTPGDWLYFVTVKPGDTRFTSSYEEHQKNVAEFNRNRRSPSPSPSHR

SEQ ID NO: 9103 - protein, 599 aa, Streptomyces avermitilis
MHPDRPTWTPSPAATEQPRQVRRILKLFRPYRGRLAIVGLLVGAASLVSVATPFLLREILDVAIPQGRTGLLSLLALGMIVSSVVTSIFGVLQTLISTTVGQRVMHDLRTAVYGRLQRMSLAFFTRTRTGEVQSRIANDIGGMQATVTSTATSLVSNLTSVVATIVAMAALDWRLTAVSLLLLPLFVWISRRVGNERKKIATQRQKQMATMAATVTESLSVSGILLGRTMGRADSLTQSFADESESLVDLEVKSNMAGRWRMAVISIVMAAMPAVIYWTAGIALQLGGPSVSIGTLVAFVSLQQGLFRPTVSLLSTGVQIQTSLALFQRIFEYLDLPIDITEPDQPVHLDQVKGEIRFEGVEFHYDDKSGPILQGIDIRVPAGGSLAVVGPTGSGKSTLSHLVPRLYDVTGGRVTLDGVDVRDLDFDTLARAVGVVSQETYLFHASVAENLRFAKPDATDEELYAAARAAQIHDHIASLSDGYDTVVGERGHRFSGGEKQRLAIARTILRDPPVLILDEATSALDTRTERAVQEAIDALSANRTTLTIAHRLSTIRGADQIVVLDAGRAVERGTHEELLERDGRYAALVRRDAQLEPTR

SEQ ID NO: 9104 - protein, 151 aa, Streptomyces avermitilis
MTTPDPDGLLAEQLLRLTRRVHRIQKRHLEQRGLGITPAQSRLLRTLAHYSSPPRMADLAQRLEVVPRAVTTLVDGLEASGKVRRVPDPTNRRVIRIEVTDEGRKALHELRGARRSAAEEILAPLTDDQREVLGGLLDTLVDGAPEGERHC

SEQ ID NO: 9105 - protein, 85 aa, Streptomyces avermitilis
MIYTDVTHAYPSTNLLGNCVAVFAVSRWEGALDTARAKKVLDGEIAFVPDDDDHAPRTDAETPEAEAAKPTVPARSVKEPAPEVG

SEQ ID NO: 9106 - protein, 541 aa, Streptomyces avermitilis
MSMLVGVILVASTLLGASPAPAAGKHTAEATPSAEPAPPAEFGTDWHDPLTAAPPIGKPATRSCQVTVAEAQFRDFTPYRGTYAPPRGCGDRWSRVVLRLDGKVRGRQFDRLGYLHIGGVEILRTSTPEPSPDGIEWSVEKDVTRYSDTFRQSRDVEMLIGNVVDDTYTGVIDVRATLTFYAADRTNGPAATPDRVLTLADGTTLTTPRNSERIVAEVYATGSGGGCEEFWYLTVPDSAPYSCKADKGPYREVQIKVDGQLAGIAAPFPTVWTGGWSNPFLWYVIPGPRAFDVKPIEYDLTPFAGLLNDGRPHRVDVSVVGVPEGQAGWSAPVNVLVWQDTKSTRVTGALTAHKAADLANSTTYTPGSEHRLDTEGGHRLTVAGYVNTSHGRVTTTVSRTLATTSAHRWTDGENMDGLQAVWNDDESVTADGRGPDRTTRIRRTYTMDGTTTLGPDDRLRSALTLGDRATAVESRGGRRTAWSRLDDTYTGDATYTANVPRDQRHAVATTSERYRLSGSAGCYDRNLVTVQGVLTRDRSDC

SEQ ID NO: 9107 - protein, 274 aa, Streptomyces avermitilis
MAGKQGAVRNRPERGATMVRMRIGGASGAVRAGVVAATCGVLLMSLTACGGSDGSNAAKGGGGSGGKAGSGSGQSKAPTVDLLRIPDVGDRLQNKIPANSRQVVAVYGEGKDSADSTIVLYTKNGSTWDQTRSWEGHNGKKGWTTDHHEGDKRSPVGVFTLSDAGGVLADPGAELPYTQSASFQAPHYWSRSHWHDFDYVIAIDYNRVKGTAPNDPTRPEGQSKGGSIWLHMDHAGGTSACVSLSKSGMEYLLRTLDPNQHPVVVMGDKADLKA

SEQ ID NO: 9108 - protein, 620 aa, Streptomyces avermitilis
MQIQDLPYPDPGVPDARSGPRFLWWLFRNQLGGQLTSLAWGLLHFLAVSGLPFCVGLAVQAVVDRSGTRLALTGGLIVLCGAGLALGESMLHRAAVTNWITAAARVQQLLARRTAQLGSALTRRVAAGEIVAVSTGDVEKIGWFVEGVSRFTAAAVTVVVVCVGLVVYQPALGVVVAVGVPVLALAVLPLLPRATRRADVQREKAGRATELASDTVAGLRVLRGIGGEELFLDRYRRASQEVRRAAVRSARMWSLISAIQVLLPGLLMIAVIWRGVHLAVDGRITVGELVTVYSAVMLLTYPLRHFEEIAMAYSFSRPSARRAARVLSLERATDTAGSREADVPDGDLYDPATGLLAPAERLTAVVCGDPDAAGVLAERLGGHPSEEGTSVLLGGVPLDELPLDSARTAVLVQDKDPVLLSGSLRELLDVPASGEVSAAEALAAAQCGDVLEALAQGSLEAEDPMDARITERGRSLSGGQRQRLALARSLITDPEVLVLDEPTSAVDSHTEARIADGIRGLRTGRTTVVFTSSPLLLDRADRVVLVHEGEVVAVGAHRELVHSEPRYRAVVTREVDAEAARSGVLTDDRAAVGGVLAGEEAAMGGVLHEIDELEEIEETA

SEQ ID NO: 9109 - protein, 593 aa, Streptomyces avermitilis
MIGVAPPAYDPAAPTTANTLPVGAPATVRAYVAELFRRHRRAFLILIAVNTVAVVASMAGPYLLGAVVERVSDHTRELHLERTAALFVLALVVQAVFVREVRLRGAMLGERMLADLREDFLVRSVGLPPGVLERAGTGDLLSRITTDIDRLANAMREAVPQLTIGVVWVALLLGGLAVTAPPLAPAVLLAVPLLVIGCRWYFKRAPSAYRSEAAGYAAVAAVLAETVDAGRTVEAHRLGGRRIDLSDRRVKEWTAWERYTLWLRTVLFPVVNLTHVTVLCSVLMIGGVFVLQGWIDVGQLTTGALIAQMLVDPIGMILRWYDELQVAQVSLARLVGVRDVEPVAGDESLAPDGRDVHADRVHFGYRAGVDVLRKVSLEVAPGTRLALVGPSGAGKSTLGRLLAGIYAPRDGRITLGGAELSRMPAERVRSHVALVNQEHHVFVGSLRDNLLLARTGAGDAELWAALGAVDADGWAQALDDGLDTEVGSGGLALTPAQAQQIALARLVLADPHTLVLDEATSLLDPRAARHLERSLARVLDGRTVVAIAHRLHTAHDADVIAVVENGQISELGSHDQLVAADGAYAALWRSWHG

SEQ ID NO: 9110 - protein, 156 aa, Streptomyces avermitilis
VDSAEGWGDDVYQPDGSEIQEDSGLLDTEDTLVSDGVSDPLDRGWSSPDRPWAVERSDVTAAERRHGETLDQRLAEELPDIAEPDGDGIGDCPDGDGEPLDNEVGAARSGRLVAPDEGAHEDEENGLIATDVGIDGAAASAEEAAMHIVDEDALSG

SEQ ID NO: 9111 - protein, 91 aa, Streptomyces avermitilis
MQQDKQPDYHPVVFRDRAAGYAFLTRSTATSDKTIEWDDGETYPVVDVEISSESHPFYTGKARTVDSEGRIAQFERRYGSTGPGSDGGGAA

SEQ ID NO: 9112 - protein, 886 aa, Streptomyces avermitilis
MALSRPILLLPLPSCPCALTLCRRHSVAFAIFVRASDSPLGCDDRQDGGVTLIDQLPQTADPDALYEAFESWAGERGLTLYPHQEEALIEVVSGANVIVSTPTGSGKSMIAAGAHFAALARDEVTFYTAPIKALVSEKFFELCKLFGTENVGMLTGDASVNADAPVICCTAEVLASIALRDGRQADVGQVVMDEFHFYAEADRGWAWQIPILELPQAQFILMSATHGDVSMFEKDLTRRTGRPTAVVRSATRPVPLSYEYVVTPLTETITELLATKQAPVYIVHFTQAQAVERAQALMSINMCTREEKDKIAELIGNFRFTTKFGRNLSRYVRHGIGVHHAGMLPKYRRLVEKLAQAGLLKVICGTDTLGVGVNVPIRTVLFTALTKYDGTRVRTLRAREFHQIAGRAGRAGFDTAGFVVAQAPEHVVENEKALAKAGDDPKKRRKVVRKKAPEGFVGWTENTFEKLISSDPEPLTSRFRVTHTMLLAVIARPGNAFDAMRHLLEDNHEPRKQQLRHIRRAIAIYRSLLDGGIVEKLDEPDASGRIVRLTVDLQQDFALNQPLSTFALAAFELLDPESPSYALDMVSVVESTLDDPRQILAAQQNKARGEAVAAMKADGVEYEERMERLQDVSYPKPLEELLFHAYDTYRKSHPWVGDHPLSPKSVIRDMYERAMSFTEFVSFYELARTEGIVLRYLASAFKALDHTVPDDLKSEDLEDLIAWLGEMVRQVDSSLLDEWEQLANPEEMTAEEAQEKADQVKPVTANARAFRVLVRNAMFRRVELAALDHVEELGEMDSDSGWDADAWGEAMDKYWDEYEELGTGPDARGPRLLMIEEEPQNGLWRVRQTFADPNGDHDWGISAEVDLAASDAEGRAVVKVTAVGQL

SEQ ID NO: 9113 - protein, 264 aa, Streptomyces avermitilis
MMGPAHSLSGAAAWLGVGAAAAAAGHTMPWPVLLVGALICAGAALAPDLDHKAATISRAFGPISRTLCEIVDKLSYAVYKGTRKQGDPRRSGGHRTLTHTWLWAVLIGAGASVLAITGGRWAVLALLFVHMVLAIEGLLWRAARGSSSDVLVWLLAATSAWILAGVLDKPGNGSDWLFTAPGQEYLWLGLPIVLGALVHDIGDALTVSGCPILWPIPVGRKRWYPVGPPKAMRFRAGSWVELKVLMPVFMLLGGVGCAAALNFI

SEQ ID NO: 9114 - protein, 288 aa, Streptomyces avermitilis
MTNPAERLVDLLDLEQIEVNIFRGRSPQESLQRVFGGQVAGQALVAAGRTTEGDRPVHSLHAYFLRPGIPGVPIVYQVERVRDGRSFTTRRVTAVQQGRTIFNLTASFHKSEEGSFEHQLPPAREVPEPESLPTVTQEIQEYLGALPETLERMARRQPFDIRYVDRLRWTAEEVKDAEPRSAVWMRAVGPLGDDPLVHTCALTYASDMTLLDAVRIPVEPLWGPRGFDMASLDHAMWFHRPFRADEWFLYDQESPIAVGGRGLARGRIYDLEGRLLVSVVQEGLFRPL

SEQ ID NO: 9115 - protein, 336 aa, Streptomyces avermitilis
MSGDTITQSTTSQTATSQTMPSQTATSQAVPSQTAPSRTIRSKTAMSTPVALTRAARELGLRRGEFELAVQLGYVRTVPDDKGGGPRVARAEIDRVRDEDGFPEALRERVTVLGTRDGAALMGVTPARFTRFARLGLVVPVKFYLNRYRAVVWLYLAEELRQFAAGKENTRLLSGRTPEGLRDQLDAGLDLRPRNWRGRHLGFQLRQTEDPWEKAAVVASLLDPAQVAEIVQDPYERALLNRLRPARSAHDTHDSPAAVLTARIMTADAPDEIGWLRADLSQSLAEAREHRPAPRPSQGVPDERPPETTTAVDLAGASEEAQRSGGLFGWLRRRNP

SEQ ID NO: 9116 - protein, 138 aa, Streptomyces avermitilis
MAQNTGLGWLLDDLTERVEHVRHALVLSNDGLVTGASTGLRREDAEHLAAISSGLHSLAKGSGRHFGAGRVRQTMIEFDDAVLFVTAAGEGSCLSVLSAAEADIGQVAYEMTLLVNRVGEHLGVDARQPEKKTPTVDL

SEQ ID NO: 9117 - protein, 145 aa, Streptomyces avermitilis
MGGMAQKMTEEEWRAFVSHGTRTGKLSTVRADGRPHVAPIWFLLDGDDLVFNTARDSVKGRNLARDGRAALCVDEDRPPFAFVVFQGQAELSEDLDEVRLWATRLGARYMGEERAEEFGSRNGVPGELLVRLRIDKVLAYSAVAD

SEQ ID NO: 9118 - protein, 201 aa, Streptomyces avermitilis
MVSENSDATNVETTALALKILVAGGFGVGKTTMVGAVSEIRPLRTEELLSEAGQSVDDTDGVDQKVTTTVAMDFGRITIRSGLSLYLFGTPGQDRFWFLWDELSQGALGAVVLADTRRLEDCFPAVDYFEHRHIPFVVAVNCFAGARTYGAHDVSRALDLDQGTPVVLCDARDRDSGKEVLIRLVEYAGRMHTARLLDSVG

SEQ ID NO: 9119 - protein, 137 aa, Streptomyces avermitilis
MTEDRPGSALQAGSQWYDNEAGPLVRPYAMTGGRTKPGPTGVRFDLIALVTLDTAAPRVDDDTSLGPEHRALIDLCRVETQSVAELAAGADLPVGVVRVLLGDLLELGCVTVSRPVPPAQLPDERILREVIAGLRAL

SEQ ID NO: 9120 - protein, 145 aa, Streptomyces avermitilis
MIQDPGMKADQRPGELDWLLDDLVLRVAEVRHAVVLSNDGLAVGASADLRREDAEHLAAVASGFHSLAKGTGRHFGAGGVRQTMVEMDDGFLFVAAAGDGSCLALLTAVTADIGLVAYEMARLVKRVGEHLYTPARIAARPPTAG

SEQ ID NO: 9121 - protein, 850 aa, Streptomyces avermitilis
MRTSRRTPSAGAEPPSRPPVRGRRAHAGQPADEDTGTDETVTAASADSPVGAGRWGVRPRTVRAKIVCLLMVPVVSLLALWAYATVSTAQDVARLRQVQQVDTTVRAPVAAAVAALQAERAAAVRHVIDPSAEPDSGFRTLAARTDRAVDKLRLGGHHTVADGADLPAQVPGRLETFVSGAEQLRSLRGAVLERRARWDETFGQYTRTIAAAFGVGGALTGIQDADLGSDARVLLEFSRAGEALAQEDAVLSSARLAGTLDGERLRLFTGAVDTRRTLTDSAVADLSERERAAWQGVATGRAYADVRTAEDKVLANRPGARRIAAAPQATWDPAHARVQEGMRTIEADAGRGVADRADPLTRGLLTPAGAAVLFGLAAVAASLVISVRIGRGLVIELISLRNSALEIARRKLPQAMRKLRAGEEIDVRAEAPPGPPAEDETGQVAEALSTVHRAALRAAVERAELASGISGVFVNLARRSQILVHRQLSLLDSMERRSEDPNELSDLFRLDHLTTRMRRHAESLIILSGAAPGRAWRMPVSLTNVVRAAVSEVEDYARVEVRQLPEASVVGAAVADLTHLMAEIVENAAQFSPPHTRVRVTGEPVGNGYAVEVEDRGLGMGKETLAEANRRIEQSEALDLFDSDRLGLFVVSRLAARHGIKVHLRTSPYGGTTAVVLLPTALLHSGTAERVPRAADTGRDAEPAYARVAAASHQSVQQAVGRPALVPPVHAAVEAAPDTTPENPPPGVATLRLHRPPDAEGPEAGEQDDPEGSDDLPRRVRQASLAPQLRRQRPEEPAPHTHGVRDDEERTPELVRDRMAAYRDGWARGGGRSPGRAAGPAGDSSEGDPA

SEQ ID NO: 9122 - protein, 243 aa, Streptomyces avermitilis
VLSYVMACIGAALGLRCTVRALGATGRSRRNWLITAASAIGTGIWTMHFVAMLGFSVSGTEIRYNVPLTILSLLVAMVVVGTGVFAVGYGRDRARALFLGGLTTGLGVASMHYLGMAALRLHGVVHYDPVLVGLSVLIAVVAATAALWAALNIQSPIAVAVASLVMGVAVSSMHYTGMIAVRVRVSPAGEVLPGATAMQFIFPLAVGLGSYLFLTSAFVALSPTAGEREASASAQQPVESVAR

SEQ ID NO: 9123 - protein, 202 aa, Streptomyces avermitilis
MRCMSDDHTHVQEFFEARAADWDSRFPDDGPAHAAAVAELGLREGDRVLDAGCGTGRALPSLRAAVGSSGVVVGVDLTPAMLAAAARAGRGRDGHLLLADVTRLPLGTESLDAVFAAGLIAHLPEPAENLRELARVVRAGGTLALFHPIGRAALAARQGRQITPDDLRAEANLGPLLAGSGWRMTSYVDEDARFLALAVRVK

SEQ ID NO: 9124 - protein, 252 aa, Streptomyces avermitilis
MKQAEFDGRGSMIRWTETPGFEPARVYVHGLGSASTVYHAHIAARPEMAGRRTLFVDLPGHGISDRPADYGYTLEDHADALSAALDEAGVSGAEIVAHSMGGAVAIVLAHRRPGLVSRLVLSEANLDPYPPVKAGSSGIASYEEADYVDNGGHARVLDKIGPTWAATMRLADPRALHRTAVNLARGTTPTMRRLLEGMTADRVYLQGELSGEVEGRRDLEAAGVRVVTVPGAGHNVMFDNPDAFAAEVVGVP

SEQ ID NO: 9125 - protein, 180 aa, Streptomyces avermitilis
MRSMLELAILGFLYDAPLHGYELRKRITALTGHVRPIAESTLYPAIKRLETAGLLKRATEPGSVAAPRHVLTLTEDGRRELRRRLAEPVQRDITDENRWFTVLAFLRHLADPTAQAAVLRRRLAFLEEPASFFYEGDRPLRAEELDDPFRRGILTIARATSRAELDWLRTTIGSLDGSGG

SEQ ID NO: 9126 - protein, 301 aa, Streptomyces avermitilis
VKRFERLEQIRRMDPEKDALKIYRLTAAYEFPWDFTRALELALYRTYAVPSIGRLLAETAELTDRTQKRYDDTALLLDAVVEHGFDGAEGRSAIRRINQMHRSYDISNDDMRYVLSTFVVMPRRWVDAYAWRRLSRHEVVATTVYYRTLGRHMGIKDIPGTYEEFEDCLDTYEEAHFAWDADARRVADATLGLMTSWYPGPLAPLLRTSTFALLDEPLLRAFRYEPPGAATRALVRRAVRARGRMVRLLPPRRAPHFARRNWEVKGYPNGYRVGELGTTPVPGVRGCPVRHSGTSATAPVE

SEQ ID NO: 9127 - protein, 113 aa, Streptomyces avermitilis
MGEGRRQSHRGKAAQMFGRLRTSFSRFRNSMRVEAAPRGGKQNHNLFEAAAAYVAACAEDDQERMDEAATWVSPEALSFGVSELACRAVIALARERDESSRTVARTLLGLPMA

SEQ ID NO: 9128 - protein, 293 aa, Streptomyces avermitilis
MAGTDEETVAAQDDALYVLTAVLLTPAKFPSVLGDDYPEACAALGLAPLADGYGLVLGQDGDGARWTVVIDDVSLVAVAIASWDCGMEYDLSPEEHTVVAALPGWPLAVAVAAPGVPAPHDPSPEVTDLEPLRPPDCETWGSAQRRLGADEIALQWATWRGQIGDDYFTNRNGEASAEEPVKADDGDGNNENDAGDDNVDSRNTPRRGIRRVLAEARSYVDTPPPLGRVRSSFAPGDARTLRADGPGWSIVARTDDIAFVLLDEEPGEVLPVGRGPELPGLLEALDKMAVRPA

SEQ ID NO: 9129 - protein, 78 aa, Streptomyces avermitilis
MHPFSGQRAAVAAKEATYMSKNAKIATGGVVVGLILWIWLPWWAALLIILGVPAAAYLALDPAQRRRLRRVTRKELGR

SEQ ID NO: 9130 - protein, 353 aa, Streptomyces avermitilis
MPHIAAVATEPPPGTLSGQHAGSEFAPLLRTVKGQGLLERRHGWYAREIALNALALASVVTGVLLMGTSWWVLLLAPVLAVLSTRTAFIGHDAGHSQITGDKSVSRLIGLIHGNLLLGMSYAWWNDKHNRHHANPNHIDKDPDVAADVLVFTSEQARERVGFRRWLTRNQAWLFFPLTLLEGIALKVSGFQDLRRQPPRERTVEALLLVSHVIGYACLLLVSMSPGKALAFAAVHQALFGLHLGLSFAPNHKGMEMPDPDATRLGHLRRQVLTSRNVRGGPLTDWFLGGLNYQIEHHLFPSMPRPHLRLAQPLVRAHCRETGISYVEAGLVDSYRQALRHMREVGEPLRSQYP

SEQ ID NO: 9131 - protein, 979 aa, Streptomyces avermitilis
MPAATPAEITEVARCCAVFMPAEPARTGRVAFWRPDGDAPPAVAGGSVEELTVVLPGDEGVERVAVPAVLLSVRAALPVLTRARAAAHTHRATAFWGTAGVLALQLVARGLLLPGLTAGDHDAWRAGPLRAEDLDRIRDLAAAMPPEAHAVPWADTEPLRLPGPEPLLRAFLDAVADTLPRSPAAPLAAGGPAFAAREPQQVPEQRAWAADVAAGHDAGVRISLRVEVPGLASIAPGEAGSAASRAEASARPQERSSPGPEETASTGSAAVHPALRAVLQVHSVSDPALVADASAVWAGARAFGPRARMDVLLALHRAARAWAPLAPLLSAAVPDTVDLADDEAAELLGEGSRMLAAAGVDVHWPKELARPLTARAVIGPPDGGQGKDRAASDVPSFLSADALLAFSWWFALGDQQLTRAELDTLAEANRPLVRLRDQWVLVDPREVRRARAQQDRKVTPIDALSAVLTGSTEVDGRRVDVRATGWLAALRERLAAPEGQAPVAQPAALAATLRDYQLRGLGWLARMTSLGLGGCLADDMGLGKTITLIALHLHRQSDDSAAGPTLVVCPTSLMGNWQREIERFAPGTPVRRFHGSARSLDGVADGGFVLTTYGTMRLDAERLAEARWGMVVADEAQHVKNPYSATARALRTIGAHARVALTGTPVENNLSELWAILDWTTPGLLGTLGSFRTRYAQAVEGGRDPAAAERLARLLGPFLLRRRKSDPGIAPELPPKTETDRTVSLTKEQAGLYEAVVRETLAEISGADSMARRGLIVKLLTGLKQICNHPAQFLKEERPNIAGRSGKLELLDELLDTILSEGAGVLVFTQYVRMARLLERHLAARGVPSQFLHGGTPVHEREAMVHRFQEGEVPVFLLSLKAAGTGLNLTRAEHVVHYDRWWNPAVEAQATDRAYRIGQTRPVQVHRLIAEGTIEDRIADMLLRKRELADAVLGSGESALTELTDAQLADLVELRGGAR

SEQ ID NO: 9132 - protein, 425 aa, Streptomyces avermitilis
MKDRDEERTFAPLPPAHGRGFARTWWGQAWLRALEDAALDSEQVRTGRRLARAGAVGAVSVRPGGVTAVVQDHDHTAHRADVLLQELSEEQWDRFLDMTVERAGHIAALLDREMPPHLVEDAAAAGVELLPGLGDLEATCDCDAWDHCGHTAALCYQMARLLDQDPFVLLLIRGRGESELLHALQARSAVSPQEPSAPDRPLEGVDAAETYATGFLLPPLPGPPELPAEPGLPPSLDTEVPPAPGVDPDALGFLAARAAHEAHRLLAEALRTGHEQHVAEEELTPAEDAVRLAAGAPGTTVAARLADGTGRDGEGLAAAVRAWHCGGVAALAVLEDDWTAEPEALSRARAALESSWDEDERPRLRASGNRWSVVGGRAQVRLGAEGRWWPYRKERGRWLPAGPAAQDPATALALALAATDGEERG

SEQ ID NO: 9133 - protein, 427 aa, Streptomyces avermitilis
VTVTIAPSEAAVPPAEETSADEEFWVEPPASGDVAPSGDAAPSSEVASSGDAAASGDAAPMEGSASMEDSASTESSASKEGSAATENSAPVLDVPEPVARDAREFGVYARTGGWAFALKVARSVRPGGQSAEETPKVSAKEFAALAGCSAERVMRYYKAWDKAADDGIVPHFEVLVPGADIELPDADVWLSYYTSRSSAASERGTAIAAAAQAEGIRPTKALEVAENPTALRAAILADPSTAQAARAALLDRLKEDPALQTELARDIARTDELKKAVATETRAADRIGYVRQIVENGQVKTPAGQTIDAPAELRAEAERHLSLIDELDDDEEAGQWATDAYDTVKDLVAQTVAADPELRLQERRTKFYSSLQRATRVFEELTFDDVDDLDTIYEDDMLQRLEELQQAITMCITTLRKAAPAAESAEA

SEQ ID NO: 9134 - protein, 535 aa, Streptomyces avermitilis
MTAALTAAKQGLSCVVVEKAATFGGSAARSGAGIWIPNNPVILAAGVPDTPAKAAAYLAAVVGPDVSADRQRAFLGHGPAMISFVMANSPLRFRWMEGYSDYYPELSGGLPNGRSIEPDQLDGNILGAELAHLNPSYMAVPAGMVVFSADYKWLTLSAVSAKGLAVAAECLARGTKAALLGQKPLTMGQSLAAGLRAGLLAAQVPVWLNTPLTDLYRENGTVTGAVVAKGGSAGLVRARHGVVVGSGGFEHNAAMRDQYQRQPIGTAWTVGAKENTGDGIRAGERAGAALDLMDDAWWGPTIPLPDQPYFCLAERTLPGGLLVNAAGARFVNEAAPYSDVVHTMYERNPTAPDIPAWLIVDQNYRNRYLFKDVAPTLAFPGSWYDSGAAHKAWTLDALAGRIGMPAAALRATVNRFNSLALSGDDTDFQRGDSTYDHYYTDPAIVPNSCLAPLWLAPYYAFKIVPGDLGTKGGLRTDARARVLRADGSVIPGLYAAGNASAAVMGHSYAGAGSTIGPAMTFGYIAALDIAAAAGS

SEQ ID NO: 9135 - protein, 164 aa, Streptomyces avermitilis
LSPCGRLSVAPGTISGMGVRYDYFAAADDAGALARLHGDLGAVDDEFGLTGLKGADPDLILGPVEAGLTGRSVAEVEDDPRFTRLISDPQAEDRCLVTLTGTLRDALAGARPERLGQTAMTVVSGPEDSAGWDADLLADFLQRLAELSRHARVTHQQLYCLISL

SEQ ID NO: 9136 - protein, 322 aa, Streptomyces avermitilis
MQFVKLGSTGLDVSRICVGCMSFGLPDRGPHEWTLDEEASRPLIRQALEAGINFFDTANVYSDGTSEEIVGRALADFARREEIVLATKVNGSMHEGPNGHGLSRKAIMTEIDNSLRRLGTDYVDLYQIHRWDPTTPVEETMEALHDVVKAGKARYVGASSMYAWQFSKAQYTARLNGWTRFVSMQNHYNLLYREEEREMLPLCEDQGVGVLPWSPLARGRLTRDRDVTTARSRTDEFGKTLYRQGDDEIVDAVARIAADRGVPRARVALAWLLHQRAVTAPIVGATKPAHLDDAVAALDLELSEKEIEQLEQPYVPRAISGH

SEQ ID NO: 9137 - protein, 284 aa, Streptomyces avermitilis
MAHGISLHIGLNGVDRTKYGGWDGKLIACENDARDMEQLAKEAGIKERTTLLTPEATVDNITAELRKAAKVLTAGDLLLFSYSGHGGQVPDLNGPEDESDRLDETMCFFDREYIDDELYKEFEGFAEGVRILCFLDCCHSGSGIRVREILSPEAMEEQFQTTDPNQVETTARIMPLDMQAEMYDRNKEFFDDIQRKLNAKDNRDLGATALLISACQDNQLAADGLRNGLFTATVLQVWNGGKFTGGYKAFHREILKQMPAIQSPNLFITGRANNRFITERPFTL

SEQ ID NO: 9138 - protein, 188 aa, Streptomyces avermitilis
VSRRGRRARDNCGMNGTSEVHADGGRDRDAEGRARNARPRDGLGRPLPYGVDGVARQPEGVVRSPMDTVTEAQALLDAGKPFHAHEVFEDAWKSGPEEESGLWRGLAQLAVGLTHAARGNTTGGARLLRRGAGAVEEWASRAGRDRPYGMDLTDVVAWARDLAADVERDEEAIDAGASAPRLRGSTPR

SEQ ID NO: 9139 - protein, 256 aa, Streptomyces avermitilis
VRKILVIGIGAGDPDQLTLQAVKALRSTDVFFILDKGEVKSDLVQLRRDMLDAHIQEGTYRLVEARDPERDRAAGGAAYSPAVGDWRSARAEIYERLITDELGEDECGAFLVWGDPALYDSTLGILEEILERGAVAFSYDVVPGISSVSALVAKHRTGLNRVARPVQITTGRRLAEGFPEDVDDVVVMLDAHQTFRRYADQDIDIYWGAYIGTPDEILASGPIAEAAPRIELLRAEARERKGWIMDTYLLRRHPRD

SEQ ID NO: 9140 - protein, 248 aa, Streptomyces avermitilis
MSLHVLVLGGTTEARELAASLAPRPGVRVTTSLAGRVSRPGTVEGDVRIGGFGGAQGLAAWLGEHRVDAVVDATHPFAAGITANAARAAAATGVPAVVLRRPGWRPGPGDRWHAVASLPAAADLLPELGRRVFLTTGRLGLAAFAHQAELHFVVRSVESPEPPMPPDTEVVLARGPFTVADELGLLREHRVDVLVTKDSGGAATAAKLTAARELGLPVVVVRRPPLPEGVTAVPDVAGALARLGLSLP

SEQ ID NO: 9141 - protein, 257 aa, Streptomyces avermitilis
MNTMTLWHITPWEFAALAAAALLVGFSKTAVSGANTVSLAIFAAVLPARASTGVLLPILIVGDVLAVLTYRRHAHWPTLWRLFPAVAAGVVFGTLFLVWADDGIVRTSIGAILLLMAAVTVWRRRTADRTGEPEAVATRTGRIKARSYGVLGGFTTMVANAGGPVMSLYLLSAGFRKLGFLGTSAFFFLIVNVSKVPFSVGLGLIDGHSLLLDAALAVFVVPGALIGKWAVNRINQRLFEQLVIAATVVGGAQLLLR

SEQ ID NO: 9142 - protein, 503 aa, Streptomyces avermitilis
MAATLSLAAILAENARRRPEKTALVEGELRLTFAEVWQRARAQAGALVGLGVRPGDRVALMAPNTADFPHAYYAIAAAGGVVVPVHLLLSASEVEHVLKDSGATLLLCHPAQAETGTAAAQAVGVQVITLGAEFEKLARIAEPLPSYVTRAADDPAVVFYTSGTTGVPKGAVLSHFNLVMNATVNAFDANDIRPDDVALGALPLFHAFGQTVSMNSTWRAGATLVLLPRFDAARAIELMVKEGVNTFHGVPTMFVALAGAAAAMDALPELRVCVSGGASLPLAVLERFEEAFGAKIYEGYGLSETSPTATVNQPVFGTRAGTIGHPLWGVDVEIARAEVEGRVELLPPGELGEVVVRGHNVFSGYLGRPEATAETLVDGWLRTGDLGTKDDEGFLRIVDRKKDVIIRGGYNVYPREVEEVLLRHPGVAQAAVIGLPDELHGEEVCAVVVRATGAVPEAAEITEWSKEHLGRHKYPRRVEFTDALPLGPSMKILKRELRVRYAQ

SEQ ID NO: 9143 - protein, 395 aa, Streptomyces avermitilis
VRPVHFAAARRTPIGKLRGALSVVRPDDLAATVIRGLIADLPGLDPARIDDVYWGAANQAGEDNRNVARMAALLAGLPESVPGATVNRLCASGLEAVTTAARTIAAGEADIVLAGGSESMSRAPFVLPRPDEALPHRIETVDTRLGWRLVNPAMKELHGLLSMGETAEEVAERYAVPRERQDEFALRSHRRAADARKNGYFDDELLPVTRPDGVVVADDECVREDTSYEKLSRLKPVFRQGGTVTAGNASPMNDGAAGLLLVSEEALNELGLESLGQYVAGASAGVHPDVMGIGPVPATEKALARVGWTIGDIEEAEFNEAFAAQALACVDRLGIDPELVNPTGGAIALGHPLGCSGARILTTLLHRMRRTGAARGLATMCVGVGQGSAILVERH

SEQ ID NO: 9144 - protein, 160 aa, Streptomyces avermitilis
MPVVKSTLPEPARQVVGEALQQTLVDLLGLSLIGKQAHWNIVGPRFRSIHLQLDEVVSTARTYADTVAERAAALGVSPDGRPETVAASFGLQGPKDGWLRDTEVVRLLVEALEATVGGLRERIAVTEKADPVTQDLLIGLTAELEKQYWMFQAEDWPRDN

SEQ ID NO: 9145 - protein, 215 aa, Streptomyces avermitilis
MQQDRRIIGELIAAHGTTYADEAGIRLKDAPQPLYRLLVMACLLSARIRSSVALAATRALYDAGLRDPRRMAEADWQERVDALGRGGYRRYDERTATQLGEGAELLIERWGGDLRRMRDEADGKVPELRRLLREIPGMGPAGADIFLREVQHVWPGVAPHLDNKALSGAERLGLPKDPRKLMERAGDTEPAVLAAALVRVALDKKSAREVLARVG

SEQ ID NO: 9146 - protein, 412 aa, Streptomyces avermitilis
VSDGSRRPGSGSGRGRGRGGRRMRYIVLGSRPAHGVGAVARARTAEKATRRAGDRDGVTVNHGLRVAAAYAWRLLVVGVAVYVGFMTLGRLQLVAVALFLALVVTAVLRPPAGLLARRLPRAAAVAVSVVGSLVVALGLLALVGGLVAGEWDQLGREFGGGLGRIERWLEGPPFHVDPAVMSDLQGKVSSFVSEHRSQLISSALSGAGRVVEVLTAAVLALFCSIFFLHSGDNYWHWFLARLPEGAREPWGRAGRAAWRTFAGYTRGIIIVAASNAVLVGIALFALQVPLALPLTLLEFFAAFIPLVGSPIALAVATVVALASRGPVVAIAVLALIVVVGQIEGHLLHPLVMSWAVRLHPVVVALSVIAGSILAGVIGAVVAVPMVSVAWSVLSVLRPPHEPGAGHPGRSPG

SEQ ID NO: 9147 - protein, 178 aa, Streptomyces avermitilis
VCRMSTPSPPSLPAASASPEVTGIERALTRITYLSTRARQHERLMALAGVPLDRAAVALLRQISDTEPLRPGELAHRLGVEASHVTRQVQQLEKSGYVTRVPDPDDRRAQRIQLTSTGREAVDRIREAGARGMQMALAEWSPEELRQLATLFHRMVDDFLSYAVDDAEQEPAATAHSA

SEQ ID NO: 9148 - protein, 405 aa, Streptomyces avermitilis
VKRILVVGASAAGLTAAETLRREGYDGTITLVGDECHAPYDRPPLSKQLLAAEWEPERLALRTPGDLEALDLDLRLGVAATGLDVTDRTVRLADGSSVPYDGLIVATGVRPRRLPGEGAHVLRTVDDALALRDRLGPGTRLVVVGAGFLGAEAAAVARRLGADVTLLEPAPVPLAHAVGAEVGEVLSRAHLEHGVELRTGVTVTEVTDEGVRLADGEVVEADEILVAIGCLPNTEWLKGSGLTLGDGLVCDAYGEAARSVYGAGDVARWHNPLFGVSMRIEHRTNAAEHGMAAARNLLRPEARRPFAPVPYFWSDQYDMKIQAYGYFRAHDETVVVEGDLAERRFVAAYRTGDRLTGALAAGLPPRAIRRWRQAIAAGATWREAVRDNISPATAPWGSVLPEKIT

SEQ ID NO: 9149 - protein, 65 aa, Streptomyces avermitilis
MRVELDEPKCVASGQCVVAAPEVFDQRDDDGVAILLDEEPAAGLHDGVREAAAVCPAAAIRLVER

SEQ ID NO: 9150 - protein, 413 aa, Streptomyces avermitilis
MADALAGRAPDATPPVAAYPMPRAVSCPLAPPPALQPLRDEQPITKVRIWNGSTPWLITRHADQRALLTDPRVSNDDRDPGFPYVNAHRAEIAHATPRLITNTDAPEHTRLRRTVNAPFLIKRIEAMRPAVQRIVDGLIDDMLDGPNPADLLTALALPVPSLVIAQLLGVPYADHEFFQRNSNLVLDNSVPAEEARAASGALAAYLDTLLAEKTAAPDADVLSEMGGRIKAGEMTHREAVHMGVAMLIAGHETTATMISLGTLALLEHPEQLAVLRDAEDPKVIAAAVEELLRYLTIVHSGIRRVAKEDIEIGDRVIGAGDGLLFDLHAANWDSEAFPEADRLDLSRPARHHQAFGYGPHQCLGQSLARLELQVVYGTLYRRFPTLRLAAPIDRLAFHHTGTTYGVRCLPVTW

SEQ ID NO: 9151 - protein, 234 aa, Streptomyces avermitilis
MYGRASERPLLARGDGRHVLIVVDDPEIAELLSTTMELAGFRISVADTAGEAVARLVKRRFDLVVLDADLSDMTELAQEPRLAVVERPRVLLLAEYDSLDRLLPELGPGETDYVTKPLRIAEVLARAQVLLHGRRRVRREGTLGYGDLVLDDSTCQAWRGQRALDLTPAEYRLLRHLLVNANKVLSKERIGRFVRGEFRGGNAIEQLVSRVRRKVDRDGPPLIHTRRGFGYWLG

SEQ ID NO: 9152 - protein, 256 aa, Streptomyces avermitilis
VPDFSSRAGVAFVAGGTGGIGAAIVRTLARRGSDVVFTYRSQQAAADGLAGEAEAYGRRVVAVRLDLGDEAATARAVSGAAGTPGGLHTLVYAAGPHVPMVHLSRVSPSQYHAQLAADAGAFFNLVHPALPPLRESRGSIVAVTTVATRRFPVRDGLSSGTKGAVEAVARALAAEEGRYGVRVNCVAPGMLTDGMAARLIESGELDEAALEITRGNIPLRRFGDATDIAEAVAFLASDRAGYITGQSLGVDGGYSV

SEQ ID NO: 9153 - protein, 442 aa, Streptomyces avermitilis
MSSSHLSARGSRLAALVVGLCWLVVLFDGLDMFVYGAVLPHMLEEHALGLEPSQAGDLGSYATFGMLIGALSAGTVTDWVGRKKVILSCTAVFSLASALCAVAPSIGVFGLGRFIAGLGLGGLLPTTITMVAEYAPRGRGALIVGMLMTAHQAGGILSGFVGLWTGGAGGWRVAYWICVVPLFIGVPLVAKFLPESMSFLLARGRTEEARELARRYDVDMPAPEAERPAAGERWSALAALFRGNLWRTTLLFWLASFCGLLLVYGVSNWLPTMMRGAGYELGSSLSFVIVINLGGIVGMLVAGRFSDRYGAPLVATIWFAATAVGVYLLGIHMPLALTYVVVFLTGLFLFSAQAMIYAAVAGRSGADNRATAVGWVSGIGRFGAVFGPWLGGQLVASKAEGWGFTAFAVAAVLATVFVSLTGLRSPRRTQGSTAPQRLSTTG

SEQ ID NO: 9154 - protein, 316 aa, Streptomyces avermitilis
MTPPLGDIAHLGHVELLTPDLDRSVRFFTDILGLTVNGTSGDSVYLRTWDDYEHHSLILTAHGKPGMRRTALRASSEEALQRRVKDLENTGRGGRWVEDEPGIGPLYVSSDPDGHELALYWESEWYEAPPELKPGLKNQPQAKPGQGVGVRRLDHVNFLASDVAANAAFTREVLGARATEQIVLDSGKVAAQWLTFTNKSYDVVYTSDWTGSSGRLHHVAFATDNRDDILRAADLCLDNDVFIETGPHKHAIQQTFFLYVYEPGGNRIELCNPLTRLVLAPDWPLITWTEAERAKGQAWGLKTIESFHTHGTPPVD

SEQ ID NO: 9155 - protein, 357 aa, Streptomyces avermitilis
MLMRGGTSKGAYFLAEDLPADAGARDDLLLRVMGSPDPRQIDGLGGAHPLTSKVAVVSVSADPEADVGYLFLQVGVDTAQVTDRQNCGNLLAGVGPFAVERGLVAPGDAETSVRIRMLNTGDLAVATFPTPGGRVDYTGSAEISGVPGTAAPVVIEFPPGGSPLLPTGLARDVVAGTPVTCVDNGMPTVLIAASSLNVKGYEDPKDLEEDVALADRLRAIRLEAGRLMGLGDVDGTTVPKLSLLAPPLHGGAIMTRTFIPVRCHTSIGVLGAASVAAGLRVEGGVGQDLARLPAHGDRLRIEHPTGFLDLETSIEHGAAGAVPVARRTAVVRTARKIFDGTVFPRSAATAPTPARHS

SEQ ID NO: 9156 - protein, 236 aa, Streptomyces avermitilis
MSGVIVTNPPKADAKDVESLSGYGVATVHEALGRSGLLGPDLRPIQQGVRICGSAVTVLSWPGDNLMIHAAVEQCGEGDLLVVTTTSPSTDGMFGELFATALQRRGVRGLVTNAGVRDTEELREMGFPVWARAVSSQGTVKATGGSVNVPVAIGGQTVRPGDVILADDDGVMCVPRERSARAVEASAARTAKEEASRAAFAKGELGLDRYGLRDTLARLGVEYRTYEEYAREEAGS

SEQ ID NO: 9157 - protein, 249 aa, Streptomyces avermitilis
MTHGNAPATPRSTLVITAHAGDFVWRAGGAIALAASRGEKVTIACLTFGERGESAKAWREGKSLEEIKGIRREEAEKAAATLGAEVVFFDAGDYPLLATPELTDRLVAVHRQAQPDVVLTHPLDDPYNGDHPAAARMALDARVLAQAIGYPAPGEIIGAPPVFFFEPHQPEMCGFKPEVLLDITEVWETKRKAMECLAAQQHLWDYYTDLGKRRGVQLKRNAGPNLGLPHATYAEAYMRPYPQVTGELA

SEQ ID NO: 9158 - protein, 216 aa, Streptomyces avermitilis
MPKEARPSTGEQAKQHALTQLRQAILHGEMAPAQRLVENELAEQFGVTRASIRAALIDLAAEGLVERIRNRGSRVRVVTVEEAVAITECRMVLEGLCAAKAAVAASDEQLTELADLGAAMTKAVADGEPVTYSELNHELHDRIREFSGQQTAVELLERLNAQLVRHRFQLALRPGRPQHSLNEHLSMIEAIRDRDPQAAEVAVRAHLTSVIEALRD

SEQ ID NO: 9159 - protein, 498 aa, Streptomyces avermitilis
MAGTSDPTAGAGSPGGKPSEPGWVPDSKFRKDMGPWANFALGFTYLSPVVSTYTLFGTALAAGGPPMIWAFLLAGAGQFLVALVFGEVVAQYPIAGGVYPWARRLWGPRWAWMTGWVYMWALLVTITSVAYGAGPYIAILLGFAPTVHTTVGCTVVLIVVAALINYAGTRALSWAAVIGFTGELVGALVVGIYLLVTHREHGIGVIFDSFGAEGDGSYLPAFLGAAIIGFYQYYGFEACGDTAEEVEHPGRVIPRAMRRTIYVGGAAATFTCLTLLLSVTDYRAVISGKDTDPVVRVLYDAMGEVGARLVMGVVLISFLSCTVSLQAAAGRLIYSYARDRMIFGHKLLERFSPARAVPTYALLVAAVVPALIAFGSLVSENALTKIVSFAILGIYASFQMVVLAALRARLKGWEPAGEFTLGRFGLVVNAAALAYGIFAIINICWPRNPEQPWFDNYVVLLCGGVVLITGLLYMVTTRHHGRGEAPSGDAIPCDGTSV

SEQ ID NO: 9160 - protein, 514 aa, Streptomyces avermitilis
VTDEPEYDYVIVGGGTAGCVLAARLTEDPDCRVCVIEGGPSDVGDERILRLRNWINLLGSEFDYGYTTVEQPRGNSHILHSRARVLGGCSSHNTVISFLPLPEDLDDWVDRGCTGWGPDVLLPYRHRLQNRIVPVADKDRNPIARDFVTAAASALGVPVIEDFNARPFAEGAGFFSLAYEPESNRRSSASVAYLHPVLDRPNLTLRLETWAYGLLPDGDGRLTRVQVRQSDGTTATVRAARDMLLCAGAIDTPRLLLLSGVGPAQQLRDLGIEVRADVPGVGENLLDHPESVIVWETHGPLPPNSAMDSDAGLFLRRAPRGPRPDLMFHFYQVPFTVNTERLGHPAIEHGVCMTPNVPRARSVGRMWLADADPTRQPCLDFRYFTDPEGYDEKTIVDGLGIAREVAAAAPLRDWLKREVAPGPDIRTDAELSAYGRKAAHTVYHPAGTCRMGADDDPLAVLDPQLRVRGVSGVRVVDASLFPTMPTINPMLTVLLAAERAVDLIKGTRQPGEAR

SEQ ID NO: 9161 - protein, 488 aa, Streptomyces avermitilis
MPDLFIDGEWVRGATGTTREVVNPFDATVVRSVDEGDATDVDRAVTAARRAFHAADWAAAPTQRRADVLFRVAEYLLRDIEEIARDETLNTGKTLAEARIDVKDVSNAFRYFAEMAGKDAGRVVDAGPDVLSRVVHEPVGVCALIAPWNYPLLQASWKVAPALAAGNTFVLKPSEITPLTTIAMMRLIEEAGAPPGVANLVLGAGATVGSAMTVHPEVDLVSFTGGLGTGRRIMESAAREVKNIALELGGKNPNVVFDDADFEAAVDHTLDASFLHSGQVCSAGSRLLVQDSWHDRFVRELADRASRIRLGNGLDPHTESGPLSSAEHRAKVEKYIDLGRSEGARLVTGGRRPDDPDLAHGFFLLPTIFDDCDRSMRIVQEEVFGPVVTVETFRTEDEAVELANDTRYGLAAGVWTGEASRAQRVAARLRHGTVWINDFHPYLPQAEWGGYGQSGVGRELGPTGLREYQEIKHIYQNLSPGPSGWFKG

SEQ ID NO: 9162 - protein, 236 aa, Streptomyces avermitilis
MTITTERGSQQYAYTDLPRLMGLMTGDEKHGPAATSTLDALWVLYDRVLRVAPERVDEPGRDRFLLSKGHGPMAYYAVLAAKGFLPVDWLPDFGSYDSPLGHHPDRVLVPGAEIGSGSLGHGLPIAVGTALGLRAQGLGEPRVWVLTGDAELDEGSNHEAIAYAGAAGLERLHTIVIDNSSATHALTGGIAARFEAAGWATTTVDGHDHEALHAAFTAPHEGRPLAVVARVRPKDA

SEQ ID NO: 9163 - protein, 303 aa, Streptomyces avermitilis
MDTMRDRFAPVVSRLLDEDPRVVVVLAEIGKDGFTEARRRHPDRVINVGIREQLLVGAGAGLALTGLRPVLHTFASFLVERPFEQVKLDLGHQDVGAVLVSAAASFDWPAGGYTHMSPGDVALLDTLDGWTMHVPGHPDEAETLLRHAVAAGDDKVYVRLSVQSNARRRAVDGERFLTVREGRAGVVVAVGPLLDPVLEATEGLDVTVLYATTVRPFDAVALRRATETAGTDVVLVEPYLAGTSTAAANDALHDVPHRVLGLGVGRPELRRYGSVDEHMAAHGLDAGSLRQRIAEFAGAPARA

SEQ ID NO: 9164 - protein, 162 aa, Streptomyces avermitilis
VCRRPCRGRRHGTAPLSAVGCRCRLWAVRSRRALSVALVTVRLMLDAEDVRRIALSLPDTTEKVAWNMPTFRVAGKMFATVPEDETSIAVRCPKEERDELALAEPRKFWIADHEAGFAWVRVRLVALEDEAELRDILADSWRQAAPPRLIDAHPELGLPAAD

SEQ ID NO: 9165 - protein, 301 aa, Streptomyces avermitilis
MIEARRLHILRAVADHRTVTAAAAALYLTPSAVSQQLTALEQETGHRLVERSARGVRLTPAGEILLGHTHAVLAQLERAEAELAAYSAGSAGTVTLASFATGIGLVVAPALARLATTAPGIRIRVQDAEGDASLPMVLDRQVDVAVAVEYRGAPDADDPRLTHIPLYAEPFDAVVPVTHRLADTAEVPLAELAKDPWIGPYPGNPCHDVVVLACENAGFQPRLEHSSDDFRAVVALASADAGVALVPRSALRGMELTGVVVRPVDGVAPTRRVFAAVRRGAENHPLIRPVLDALAEAATVD

SEQ ID NO: 9166 - protein, 398 aa, Streptomyces avermitilis
MMFDSVRDDLRTTLDEIRTAGLHKPERVIGTPQSATVSVTAGGRPGEVLNFCANNYLGLADHPEVIAAAHEALDRWGYGMASVRFICGTQEVHKELERRLSAFLGQEDTILYSSCFDANGGVFETLLGAEDAVISDALNHASIIDGIRLSKARRFRYANRDMADLERQLKEASGARRRLIVTDGVFSMDGYVAPLREICDLADRYDAMVMVDDSHAVGFVGPGGRGTPELHGVMDRVDIITGTLGKALGGASGGYVAARAEIVALLRQRSRPYLFSNTLAPVIAAASLKVLDLLESADDLRVRLAENTALFRSRMTEEGFDILPGDHAIAPVMIGDAAVAGRLAELLLERGVYVIGFSYPVVPQGQARIRVQLSAAHSTDDVNRAVDAFVSARAELEA

SEQ ID NO: 9167 - protein, 342 aa, Streptomyces avermitilis
LKALVKEKAEPGLWLMDVPEPEIGPGDVLIKVLRTGICGTDLHIRSWDGWAQQAVRTPLVLGHEFVGEVVETGRDVVDIKAGDRVSGEGHLVCGKCRNCQAGRRHLCRATVGLGVGRDGAFAEYVALPAANVWVHRVPVDLDVAAIFDPFGNAVHTALSFPLVGEDVLITGAGPIGLMAAAVARHAGARNVMITDVSEERLELARKIGVSLALNVADTTIADGQRALGLREGFDIGLEMSGRPEAMRDMIANMTHGGRIAMLGLPSQEFPVDWARIVTSMITIKGIYGREMFETWYAMSVLLEGGLDLAPVITGRYGYRDYEAAFADAASGRGGKVILDWTL

SEQ ID NO: 9168 - protein, 193 aa, Streptomyces avermitilis
MSYDPPRPIGRLLLTPEDKDAPERVRRLRRLGLGERPEPVFDAFADRLAEVAAVPYAMVNFIDENRQFFAGLHAPDGTGSGGRPAADGAEPPDVRRYMARDYGFCPHVVVRRKALVLEDVCDYPRFAGNPVVDEIGIRSYLGAPLIDRTGIALGTICVVDIEPRPWGRAGLETIKALAAELVEQIGRRESGGI

SEQ ID NO: 9169 - protein, 182 aa, Streptomyces avermitilis
VAGGFGVGKTTFVGAVSEIAPLSTEELLTTVGAATDNLDGIENKVETTVAMDFGRITLDPEHVLYLFGTPGQQRFWFMWDELSEGALGAVILADTRRLEDCFAAVDFFEQRGLAFIVAINDFDGGYRYDPAEVRAAIDLDPHIPVVRCDARISSSGVQTLLTLVRHLLAHAPATAPSHGAHT

SEQ ID NO: 9170 - protein, 106 aa, Streptomyces avermitilis
VRPYTVSNGRTRPTTALDLLSQVMATGVTPLGYLGPEHTQALELCRAPVSVAEVAAHLKLPAAVTKVLLSDLVDCGALTTKPPEFYHNPTDRSLLEAVLDGLRRQL

SEQ ID NO: 9171 - protein, 144 aa, Streptomyces avermitilis
MASDAPTGHVSDLDWLMSGLVQRVPHTTSAVLLSCDGLVKSVHGLDPDSADHMAALASGLYSLGRSAGIRFGDGGDVRQVVVELDSTLLFVSTAGSGTCLAVLAGREADAAVLGYEMAMLVKSVRPYLMTAPRQAAAQPPAMRP

SEQ ID NO: 9172 - protein, 517 aa, Streptomyces avermitilis
MSHLRAPAARADRREGGRHGRPVARTVPSLPETHIRPQLLRLAVLPPIAVALSGCAAVLFTVRSTGARPDLTLWAVLAGAFGVALAGIVIAAVAADRAARSVRDRLGALRADGARGEAELRALVETLRRGEAPPVRAPRAAPAADADEFELVAAELARAHDGAVTAVVQAAQLSSQAGSEQKVEVFVNLARRLQSLVHREISILDELENEIEDPDLLKGLFHVDHLATRIRRHAENLAVLGGAVSRRQWSKPVSMTEVLRSAIAEVEQYSRVKLVPPIDGTLRGHAVADVIHLLAELVENATVFSAPHTQVLLRVNLVTSGLAVEVEDRGLGMPLSEQNKMNTLLTDPDQVNVASLLQDGRIGLFVVSQLARRHGIHVRLQSNIYGGVQAVLVVPQELLGAVPGGPGEAPRTLPQGMNGGAAAQAVTGGGQQTQSRTPQAPGTLQTPQNPPPGPGAHRAPTPRRPPAVAPPGRRPVHRTRPRPDGGVPTRHRTRRGAAAVGDGPVGAGRGPRAVQGP

SEQ ID NO: 9173 - protein, 406 aa, Streptomyces avermitilis
VTGFRLPSSGLRAVRPAAFGADPSGERLERIRRSPNFVDGSFVNPEGTRTRPAGGSTLELAKVFLRKEERTRRSPAGTVPVHPTTFADLARPPASGLRLTWMGHSSVLAEIDGHRVLFDPVWGERCSPFDFVGPKRLHPVPLPLAALGPVDVVVISHDHYDHLDLPTIKALAGTDTVFAVPLGVGAHLEHWGVSPDRLRELDWNESTKVGGISLTATPARHFCGRGLRNVQHTLWASWAVAGDTHRIYHSGDTGYFGGFKDIGAEHGPFDATMIQIGAFSEFWPDIHMTPEEGMRAHLDLQGGRPGGVMLPIHWATFNLAPHPWVEPGEGTITAARAAGARIALPRPGEPFEPTAETVPSEPWWRGVAVTPQGGWPAVGPIPGDTPRDIPEGAVEGTGEPETVAAG

SEQ ID NO: 9174 - protein, 260 aa, Streptomyces avermitilis
MWSRSGLPLWSAPLTAPGRACHSAMSRHTARRSGLDVTSATPRPSYQRGHPLRSAPDDVLEVAPVARVSLTPRRTFFFRIVEWYSKRTYGKVLDPGKALAHHPRVLWADLRFEQSVAKWNRLDPDLKALAEMTAAATIGCAWCMDFGYWVSRERGMAREKLLDVPSWRDSAAYTPLERDVMEYAEAMTLTPPAVEDDLAARLVDRLGEPAFVELTAMVAVENLRSRINSALGLTSQGFKDSCDVPSAEERTASPRAVRQD

SEQ ID NO: 9175 - protein, 392 aa, Streptomyces avermitilis
MTAPLMTLAWTDHVTGRQGYLVVDRLVRGVSSGGLRMRPGCTLDEVAGLARGMTMKEALHYNPEGRYIPLGGAKGGIDCDPRSPEAYGLLVRYLRAMRPYIESCWTTGEDLGLTQDLVDRAAAEAGLVSSIQAVYPLLDDEATARKRLADAFAVEVDGIGLDELVGGCGVAESLLAALDRAAVPYAGTRVAVQGLGTMGGATARFLARAGLTIVAVADVKGTIANPEGLDVEALLAARDAYGTVDRSALRPGDRELPGEAWLSVEAEVLVPAAVSYVVDTTNQRRIGARWIVEAANMPVLPEAEALLTERGITVLPDVVVNSGTNAWWWWTLFGDIDADADEAFARTRRSMRALTDLMLARAEADGTTPRAAAHAIVADRLPVIAERFGWYR

SEQ ID NO: 9176 - protein, 206 aa, Streptomyces avermitilis
VARVRLSVAERREELLRAAIEQIEARGVAAVRIADVAAALGVSNALVLYHFSTKEKLVAEAFAHAAEDDLAHLRKLLGRRTSALRRLRTAVRWYAPTGQAKGWRLWIEGWAVALREPALREVTQDLDRQWKAAITEVIAEGVAGGEFRCPDPTGAALRLTALLDGLAVQMTAYSGAVSRARTQEWVDDALARELGLERAALTAATR

SEQ ID NO: 9177 - protein, 261 aa, Streptomyces avermitilis
VIGSYVAVGDSFTEGVGDPGPDGAFVGWADRFAVLLADRRPEGEFNYTNLAVRGKLLDQIVEDQLQRAKELAPDMVSFCAGGNDIIRPGTDPDEVAERFERAVADLTAAVGTVLVTTGFDTRTMPVLKHLRGKIATYNGHVRAIADRYGCPVLDLWSLKTIQDRRAWDNDRLHLSPEGHTRVALRAGQVLGLDIPADPDQPWPPLPPRGTFEVRRDDIHWAREYLVPWIGRRLRGESSGDHVAAKGSLSPDDIKMRIAAAV

SEQ ID NO: 9178 - protein, 239 aa, Streptomyces avermitilis
MTTTRRAFGALATGAALAALAPATAASASPHHRGGRLIAHDDFRHGLGRWATELQDGGTVTAARGVLEIDVPSGATVWFRKRLEGPYVIEYTATPVDAGGANDRVSDLNNFWNAVDVRSPDDLFATPRGGALAEYDHLKTYYVGYGANANTTTRLRRYVGEAGVRPLLYDYTQPLLTANEPNRVRIVSDGSTVQWWNNGRPVFDHSDPEPYTSGHFAFRTTWSHFRITGFRVWRLYNHA

SEQ ID NO: 9179 - protein, 301 aa, Streptomyces avermitilis
MPAKGKHRRPRSPRFTRSIAVAGTGGAALALPLMGATGAHAATPTAAVSGKVSAAPVAAKQGAAEKSGTKTYAVRAGDSLSKIADEQSVTGGWKKLYSDNRSAIGGDPTLIHPGLKLTIGAKSASSAATQSSTATKPATGVKSATAKTPASKTTTATRAADTTTGAGYTLPVDGATIGTAYKTAGSMWSSGYHTGVDFVVPTGTTIKAVAAGTVVSAGWGGAYGNEVVVRHADGQYSQYAHMSQLSVSTGQSVAEGRQLGLSGATGNVTGPHLHFEIRTTPSYGSDVDPVAYLRAHGVVVG

SEQ ID NO: 9180 - protein, 700 aa, Streptomyces avermitilis
LSTSVDICGGLMVEIAEDRRTWLLSGPTSSYAVHLTEGHELLHLHWGPRIALADAEALAALPAPGGSSFESPLDGREEYPVEGGPRFVRPALSVRTDERRGTEWRFEAYETEGDELRLRFGDSGLAVTLHYRMRDDVVERWVTLANDGPALELLRADSATWTLPERDGWRLSQLHGRWAAESRLVRSDLTYGEKIIGSRRGHTGHQHLPWVALDCEATEESGEVYGCALGWSGSWRISVAQLSDARVQITGGAGYDDSGLLRLGPGESFTTPVFAGLWSDGGFGGASRAWHAYQRAYVIPDADQDRPVLFNSWEATTFDISEEQQGALARRAAAMGVELFVVDDGWFGARTGDRAGLGDWTPNPDRFPAGLKPLADYVHALGMQFGIWVEPEMVNPDSELYRAHPDWVQFQPGRTRTEFRNQLVLNLAREDVQQCLWEQLDGLLSSAPVDYVKWDFNRCFTDAGWPGEAYPQRLWVDHVRALYRLLDRLRAAHPGVAFESCSGGGGRIDLGIMARTDQVWTSDNTDPLDRLAIQHGFSQIHPARVMAAWVTDSPNTQLNGRVSTLRLRFVSAMAGVLGVGGDLAEWSERELVEARDWVSLYKEIRPVVQRGDLYRLRPPTGGLSAVQYVHGDEAVVLAWLQAQHYGEPVAPLRLRGLDPAATYECRETGEVHRGAVLLHHGLRTGLHGDLDATVVRLRRI

SEQ ID NO: 9181 - protein, 265 aa, Streptomyces avermitilis
VTQQVPSTEPELAGVRNFRDVGGLPTVDGRRVRHGLLYRSGHLAHATDEDAAFLASLDLHTIFDFRNAADIGLEGPDVELPGVRNLNFPLTDPAHGAEFWTMVRDGDLDQLRGLLADGKAANRMITSYRTIIKERTAEHGRVLRELAEESVPALMHCAAGKDRAGLSIAVALLAVGVERDAIVADYLESNAPHRRYKVRRSSSAAQAYSPEVMELLSPLFEARAEYLAAAFETIEETWGDTDTYLERGLKITPELRERLRERLLD

SEQ ID NO: 9182 - protein, 64 aa, Streptomyces avermitilis
VPRPGDGTPDDGRHTMTEQPESSQNRRSMEEKFPRALWVRLIIYIAVGHLFAGFIYLLFELGAK

SEQ ID NO: 9183 - protein, 208 aa, Streptomyces avermitilis
MSSSESGPVEDLPAVAPQLRALRRRASLTLEVAARAAGLSPAHLSRLETGQRQPSLPMLLALARIYGTTVSELLGETVGDRDAVVRAADMEPAGAGGWTYWQAGAGGRAMQALRVHVPYGTQGDVVRVHPGEEWLYVLKGRLRLRLGDTTHLLGPGDSAHFDSLTPHRLAAADHDGAELLFLHTLLQSPAATLCLGPATGHPTMGDTP

SEQ ID NO: 9184 - protein, 476 aa, Streptomyces avermitilis
MTIPSGKAPSEGAPSGNREFDLGALLAERGAERYELHAKYLNHQLPRMLHTIGFDKVYERAEGAHFWDADGKDYLDMLAGFGVMGLGRHHPVVRKALHDVLDASLADLTRFDCQPLPGLLAEKLLTHSPHLDRVFFGNSGTEAVETALKFARYATGKPRILYCSHAFHGLTTGSLSVNGEDGFRDGFAPLLPDTAVPLGDLDALARELKKGDVAALIVEPIQGKGVHEAPPGHLRAAQDLLQRHKALLIADEVQTGLGRTGDFYAYQHEEGVEPDLVCVAKALSGGYVPVGATLGKEWIFKKVYSSMDRVLVHSASFGSNAQAMAAGLAVLSVMENEQIVANARATGEQLKSRLAALVDTYELLSDVRGRGLMIGIEFGRPTSLKLRSRWTVLQAARKGLFAQMVVVPLLQRHRILTQVSGDHLEVIKLIPPLIIDERDVDRFVAAFTAVMDDAHSGGGLLWDFGKTLVKQAVAQR

SEQ ID NO: 9185 - protein, 632 aa, Streptomyces avermitilis
VTMLENIRGPRDLKALSEAELGELAEEIREFLVHAVARTGGHLGPNLGVVELSVALHRAFESPVDRILWDTGHQSYVHKLLTGRQDFSKLRSKGGLSGYPSREESEHDVIENSHASTVLGWADGLAKARQVQGEKGHVVAVIGDGALTGGMAWEALNNIAAAKDRPLIIVVNDNERSYSPTIGGLANHLATLRTTDSYEKVLAWGKDVLLRTPVVGNTLYESLHGAKKGFKDAFAPQGMFEDLGLKYVGPIDGHDMKAMESAFRRAKRFHGPVLIHCLTEKGRGYEPALAHDEDRFHTVGVMDPLTCEPLAPSNGPSWTSVFGDEIVRIGEEREDVVAITAAMLHPVGLNKFAEKFPGRVWDVGIAEQHAAVSAAGLATGGLHPVVAVYATFLNRAFDQLLMDVALHRCGVTFVLDRAGVTGVDGASHNGMWDMSILQVVPGLRIAAPRDADQLRAQLREAVAVDDAPTLLRFPKESVGPAIPAVDHVGGMDVLHRFPESPQVLLVAVGVMAPVCLQAAELLEARGIGCTVVDPRWVKPVDPSLPGLAAEHRLVAVVEDNSRAAGVGAAVALALSDAEVDVPVRRFGIPEQFLAHAKRAEVLADIGLTPVEIAGRISAGLATKEELSKEKQE

SEQ ID NO: 9186 - protein, 385 aa, Streptomyces avermitilis
MTAISLGVPEVPVRPIAERRVSRQIQVGPLAVGGTAPVSVQSMTTTRTSDIGATLQQIAELTASGCQIVRVACPTQDDADALAVIARKSQIPVVADIHFQPKYVFAAIEAGCAAVRVNPGNIKQFDDKVKEIARAAKEHGTPIRIGVNAGSLDRRLLEKYGKATPEALVESALWEASLFEEHDFRDIKISVKHNDPVVMVNAYRQLAAQCDYPLHLGVTEAGPAFQGTIKSAVAFGALLSEGIGDTIRVSLSAPPVEEIKVGIQILESLGLRQRRLEIVSCPSCGRAQVDVYKLAEEVTAGLEGMEVPLRVAVMGCVVNGPGEAREADLGVASGNGKGQIFVKGEVIKTVPESKIVETLIEEAMKIAEQMEQNGVASGEPAVTVS

SEQ ID NO: 9187 - protein, 340 aa, Streptomyces avermitilis
MAMPLRQTIKVATYLAEQKLRKREKFPLIVELEPLFACNLKCEGCGKIQHPAGVLKQRMPVAQAVGAVLESGAPMVSIAGGEPLMHPQIDEIVRQLVARKKYVFLCTNAMLLRKKMVDFTPSPYFAFAVHIDGLRERHDESVAKEGVFDEAVEAIKEAKRRGFRVTTNSTFFNTDTPQTIIEVLNFLNDDLEVDEMMISPAYAYEKAPDQEHFLGVEQTRELFRKAFAGGNRRRWRLNHSPLFLDFLEGKVDFPCTAWAIPNYSLFGWQKPCYLMSDGYVTTYRELIEDTDWDAYGRGKDPRCANCMAHCGYEPTAVLATMGSLKESLRAARETVSGNRG

SEQ ID NO: 9188 - protein, 214 aa, Streptomyces avermitilis
LMSTKPDPAPLLIACALGIERLALRSGDRGGADGPVTVLRTGMGPKAAERAVTRVLADPALREAAVVATGFCAGLAPGMHPGDLVVAEETRDPRGVTPCVGTEVLVKELVRAVPGRTVHTGPLIGSDHVVRGHERSDLLLTGAIAADMESASTLHGAVCTGTRPVAAVRVVVDAPEHELVRIGTVRGGISAFRVLRAVLPAFFEWHRSLLLPRR

SEQ ID NO: 9189 - protein, 666 aa, Streptomyces avermitilis
MTATTDGSTGALPPRAASASEPHDTIPQAAGSVGIQDAAARATQRATDFLLSRQDAEGWWKGDLETNVTMDAEDLLLRQFLGIQDEKTTRAAGLFIRGEQRADGTWATFYGGPGDLSATIEAYVALRLAGDGPDEPHMAKASAWIRERGGIASARVFTRIWLALFGWWKWDDLPELPPELIYFPKWMPLNIYDFGCWARQTIVPLTVVSAKRPVRPAPFPLDELHADANDPNPAKPLAPMVSWDGLFQRLDVALHTYRKVAPRRLRKAAMNTAARWIIERQENDGCWGGIQPPAVYSVIALYLLGYDLEHPVMREGLASLDRFAVWRDDGARMIEACQSPVWDTCLATIALADAGVPADHPQLVRAADWMLGEEIVRPGDWAVKRPQLPPGGWAFEFHNDNYPDIDDTAEVVLALRRVKHHDPERLDNAIRRGVRWNLGMQSKDGGWGAFDVDNTSPFPNRLPFCDFGEVIDPPSADVTAHVVEMLAFEGLSHDPRTRRGIQWLLSAQEANGSWFGRWGVNYVYGTGSVVPALVAAGLPASHPAIRRAVTWLETVQNDDGGWGEDLRSYPEAAEWSGKGASTASQTGWALLALLAAGERESKAVERGIEWLAQTQRPDGSWDEPYFTGTGFPWDFSINYHLYRQVFPLTALGRYVNGEPLVEVKGG

SEQ ID NO: 9190 - protein, 376 aa, Streptomyces avermitilis
VTPDLHGTGPRTPRTATRGETVPTVPPAEKAADAVDVTALLERGRTLSTPVLRAAVDRLAPPMDTVAAYHFGWIDAAGNPADGDGGKAVRPALAVLSAQAAGAAPEVGVPGAVAVELVHNFSLLHDDLMDGDEQRRHRDTVWKVHGPAQAILVGDALFALANEILLELGTVEAGRATRRLTTASRALIDGQAQDISYEHRERVTVEECLEMEGNKTGALLACACSIGAVLGGADDRTADTLEKYGYHLGLAFQAVDDLLGIWGDPESTGKQTWSDLRQRKKSLPVVAALAAGGPASRRLGELLAEDAKSSDFENFSEEEFAARAALIEEAGGREWTAQEARRQHTIAIEALDTIEMPQQVRAQLVALADFVVVRKR

SEQ ID NO: 9191 - protein, 475 aa, Streptomyces avermitilis
MSDATRLEGPDAEASGRPERAAVVVGGGLAGITAALALADAGVRVTLLEGRPRLGGLAFSFQRGALTVDNGQHVYLRCCTAYRWFLDRIDAASLAPLQDRLDVPVLDAGGKPGRRLGRIGRTALPVPLHLAKSLATYPHLSLAERARVGRAALALKGLDLADPALDTQNFGSWLAAHGQSARAVEALWDLVGVATLNAVAGDSSLGLAAMVFKTGLLSDPGAADIGWARVPLGELHDRLARKALDSVGVRTEVRTRVTSISLNGNGRWSVQVPGETLHADAVVLAVPQREAHELLPEGALDAPERLLEIGTAPILNVHVVYDRKVLSRPFFAALGSPVQWVFDRTEASGLPEGQYLALSQSAAQDEIDEPVSVLRERYLPELERLLPATRGAQVKDFFVTRERTATFAPTPGVGRLRPGARTKAPGLCLAGAWTATGWPATMESAVRSGVSAAGAALNALGRPRDHLLELFEEAA

SEQ ID NO: 9192 - protein, 316 aa, Streptomyces avermitilis
VIRTVESEQHVSAPVLAAYSYCETVTGQQARNFAYGIRLLPTPKRRAMSAVYAFSRRVDDIGDGALAPDVKAARLEDTRALLSRVRDGRVDEDDTDPVAVALAHAAEQFPIPLGGLDELIDGVLMDVRGETYETWDDLKVYCRCVAGAIGRVSLGVFGTEPGARGAERASEYADTLGLALQLTNILRDVREDAEGGRTYLPADDLAKFGCSAGFDRPIPPEGSDFAGLVHFEVRRARALFAEGYRLLPMLDRRSGACVAAMAGIYRRLLDRIEREPEAVLRGRVSLPGREKAYVAVRGLSGLDARHVSRRTVRRRV

SEQ ID NO: 9193 - protein, 300 aa, Streptomyces avermitilis
VTEAGTARAADPERDTLDKAADENFPVAPFFLPRAWRTDLMAVYGFARLVDDIGDGDLAPGGADARLLGVSPREAEDRLALLDAFEADLHRVFDSTPRHPLLRRLQPTVRRTGLSPEPFLGLIAANRQDQLVTRYETYDDLVAYCELSANPVGHLVLGVTGTSTPERVRRSDAICTALQIVEHLQDVSEDLGRDRVYLPAEDMKRFHVQEADLATATAGASVRALVAYETERALNLLNEGTPLVGSVHGRLRLLLAGFVAGGRAAIRAIAAAEYDVLPGPPKPGKLQLLREVGVTLRGEG

SEQ ID NO: 9194 - protein, 259 aa, Streptomyces avermitilis
VAEQRNDSHIPTVIADELHIVYRVNGAKTGKGSATAALSRIVKRGEERGVRKVHAVKGVSFTAYRGEAIGLIGSNGSGKSTLLRAIAGLLPAEKGKVYTDGQPSLLGVNAALMNDLTGERNVILGGLAMGMSREQIRERYQEIVDFSGINEKGDFITLPMRTYSSGMAARLRFSIAAAKDHDVLMIDEALATGDRKFQKRSEARIRELRKEAGTVFLVSHNNKSIRDTCDRVLWLERGELRMDGPTEEVLKEYEKFTGK

SEQ ID NO: 9195 - protein, 309 aa, Streptomyces avermitilis
VSETTHDGGVAVSARPSPDEGLSGAELAAKYGLAVSGARPGLVEYVRQLLGRRHFILAFSQAKLTAQYSQAKLGQLWQVATPLLNAAVYYLIFGLILHASKGMPSDVYIPFLVTGVFVFTFTQSSVMAGVRAISGNLGLVRALHFPRAALPISFSLQQLQQLLFSMIVLFLVAIGFGSYPSLSWVLIVPVLALQFLFNTGLALIMARMGAKTPDLAQLMPFVMRTWMYASGVMFSIPVMLADKPAWVADVLQWNPAAIYMDLMRFALIDGYGSENLPPHVWAVAAGWAVLVALGGFVYFWKAEERYGRG

SEQ ID NO: 9196 - protein, 294 aa, Streptomyces avermitilis
VSTATKVGAVIITMGNRPDELRALLDSVAKQDGDRVEVVVVGNGSPVPDVPAGVRTVELPENLGIPGGRNVGIEAFGPGGTDVDILLFLDDDGLLAHHDTAELCRQAFTADPELGIISFRIADPDTGETQRRHVPRLRASDPMRSSRVTTFLGGANAVRTKVLAEVGGLPDEFFYAHEETDLAWRALDAGWMIDYRSDMVLYHPTTAPSRHAVYHRMVARNRVWLARRNLPAPLVPVYLGVWLLLTLARRPSGPALKAWFGGFKEGWTSPCGPRRPMKWRTVWRLTRLGRPPVI

SEQ ID NO: 9197 - protein, 227 aa, Streptomyces avermitilis
MRELSLRIDRHLVNTRITPNQLTYVMTVAGVLAAPALLVPGITGAVLGVVMVQLYLLLDCVDGEVARWKQQFSLGGVYLDRVGAYLCDAAVLVGFGLRAADLWGSGRIDWLWAFLGTLAALGAILIKAETDLVGVARHQGGLPPVKEAASEPRSSGMALARKAAAALKFHRLVLGVEASLLILVLAILDSIRGDLYFSRLGVAVLAGIALLQTLLHLVSILASSRLK

SEQ ID NO: 9198 - protein, 353 aa, Streptomyces avermitilis
VPVLTRLIPSPVVVDIRPGALDDLASVLADQRISHSGKLAVAISGGSGAKLRERLAPALPGATWYEVGGGTLDDAIKLADDMKSGHYDAVVGLGGGKIIDCAKFAAARIGLPLVAVATNLSHDGLCSPVATLDNDAGRGSYGVPNPIAVVIDLDVIREAPVRFVRSGIGDALSNISAVRDWELAHREKGEQIDGLAAAMARQAGEAVLRHPGGVGDDSFLQVLAEGLVLTGISMSVAGDSRPASGACHEINHAFDLLFPKRAASHGEQCGMGAAFAMHLRGAHEESGYMAEVLHRHGLPVLPDEIGFTVDEFVQVVEFAPQTRPGRYTILEHLDLNTEQIRDAYADYAKAIGS

SEQ ID NO: 9199 - protein, 250 aa, Streptomyces avermitilis
MIGLVLAAGAGRRLRPYTDTLPKALVPVGPEGNEDSLTVLDLTLGNFAEIGLTEVAVIVGYRKEAVYERREALEAKYGLKITLIDNDKAEEWNNAYSLWCGRDAIKHSVILANGDTVHPVSVEKTLLAARGDGKKIILALDTVKSLADEEMKVVVGPEGGMTKITKLMDPAEATGEYIGVTLIEGEAADELADALKTVFETDPQQFYEHGYQELVNRGFRIDVAPIGDVKWVEIDNHEDLAKGREIACQY

SEQ ID NO: 9200 - protein, 573 aa, Streptomyces avermitilis
VRVASDAGDAETLLAAVPANQRVAIVDARFVGHLHALRLGLTDPRFEAAALAGAVSAQPGARQALTRALARESSAATGGATVVMDNLAERITAALDADGVQVHRPDLGTLVAAVPADPQARNEVRQAVTAVDDEAVRLRTAVKSRDGFFTTHFISPYSRYLARWCARRGLTPNQVTTASLLTALVAAGCAATGTRAGFVAAGLLLLFSFVLDCADGQLARYSLQYSTLGAWLDATFDRAKEYAYYAGLALGAARGGDDVWALALGAMVLQSCRHIVDFSFNEANHDATANTSPTAALSDKLDSVGWTVWLRRMIVLPIGERWAMIAVLTALTTPRITFYALLIGCAFAATYTTAGRVLRSLTRKARRTDRAAQALADLTDSGPLAEFLTRFARRLRLRGPACVALVTGALVVLAAALAPYGSWWPVLAAVTYVLLSPVALLKPLKGALDWLVPPFYRAAEYGTVLVLAAKADVNGALPAAFGLVAAVAYHHYDTVYRIRGNAGAPPHWLVRAIGGHEGRTLLVTVLAALLVPTDFKVALTALAVAVALVVLVESIRFWVSSQAPAVHDEGEPA

SEQ ID NO: 9201 - protein, 326 aa, Streptomyces avermitilis
MTWLITGGAGYIGAHVAWAMTEAGERVLVLDDLSAGVPDRLPTSIPLVQGSSLDGALLKRVFAEHSVTGVVHLAARKQVGESVAQPTRYYQENVGGLTTLLDAVAGAGIQRFLFSSSAAVYGNPDVDLITEDTPCAPVNPYGETKLAGEWLVRAAGRAHGISTVCLRYFNVAGAASPELADTGVFNVVPMVFDRLTRGEAPRIFGDDYPTSDGTCVRDYIHVADLADAHLAAARRLTAGATGDLTVNIGRGEGVSVRELITLIGEVSGDTTPALVEPRRPGDAPRAVASAALAAEELGWHARRGVREMVESAWRGWRHHHPEAARG

SEQ ID NO: 9202 - protein, 197 aa, Streptomyces avermitilis
MPITPATSTHSSSNGTAEAILLELVDENGTTIGTAEKLAAHQPPGQLHRAFSVFLFDEQGRLLLQQRALGKYHSPGVWSNTCCGHPYPGEAPFAAAARRTHEELGVSPSLLAEAGTVRYNHPDPDSGLVEQEFNHLFVGLVQSPLRPDAEEIGDTAFVTAAELAERHAKDPFSSWFMTVLDAARPAVRELTGPSAGW

SEQ ID NO: 9203 - protein, 191 aa, Streptomyces avermitilis
MDQRITNTRRVVTIEREGGDRTMDDQGRGTGPRPEGGADMPDDGRPPAPLPYEGVWRYTAPAVDASVPQARHAVRDLLARQGVPVSRDLAQGLLLIVSELVTNAVRHAALLSPMLAVEVAVGADWLRISVEDNHPYRPTALEADHGQTGGRGLLLVREITREAGGVCDVEHTASGGKVIWAAVPLKPVGMF

SEQ ID NO: 9204 - protein, 249 aa, Streptomyces avermitilis
MEPQLLHSVADGVATVVIHHPAKRNAMTAGMWRALPSLLDELASDTAVNALVLTGQGDTFCAGADISTLLDSPDEAQALAARAEESLAAFPKPTLAAVRGYCVGGGSQLAAACDLRFAEAGSLFGVTPAKLGIVYPASATRRLVSLVGPATAKYLLFSGELIDAERALRTGFVDEVLPEGQLDKRVAEFTRVLTARSQLTQAAAKEFANGRADRDTYWAQQARGSGDTAEGVAAFLEHRRPRFTWTTSG

SEQ ID NO: 9205 - protein, 211 aa, Streptomyces avermitilis
MQIAIVLYDRFTALDAVGPYEILGRLPGAETVFVAERTGPVRADTGALALTADKSLAEVPSPDLVVVPGGPGQTAQMENGVLLDWLRAADASSTWTTSVCTGSLLLAAAGLLKGRRATSHWLALDLLDRFGAAPTGERVVFDGKYVTAAGVSSGIDMGLALLGRIAGDEHAQAVQLLTEYDPQPPYDAGSPQKAPAHLVEEFRTSSRFILT

SEQ ID NO: 9206 - protein, 334 aa, Streptomyces avermitilis
VGYSSLRPSGGPPRIEGMRTVVVVLFDDVQSLDVTGPLEVFAGAEAHSGGTYRIRTASLDGAPVRTSSGLALVPDHSLTEAPAAHTLLVPGGNGTRRPDPRLVDWLRAHGPRAERLVSVCTGAVLLAEAGLLDGRRATTHWAYCDQLARDHPAVEVDADPIYVRDGHIATSAGVTAGIDLALALVEEDLGRDVALLVARHLVVFLRRPGNQAQFSAQLAAQTAQRAPLREVQQWITEHPGDDLTVESLAARARLSPRHFARAFQAETGTTPGRYVDGVRLEHARRLLEDTADGVEEISRACGYGTPEAMRRAFVRALGTAPAEYRRRFHTTVTR

SEQ ID NO: 9207 - protein, 255 aa, Streptomyces avermitilis
MAAVGVGDVQAAYFAARAAAMGPVGAGVVTATFHNFRHELVAAHVPGVWGTASPEVVLAARARAVDATLRRLLGAELLAAEEVAEAAELALRATEACSRNARPLYAAHADLPVPDAPHLALWHAATLLREHRGDGHLTVLLGAELDPVEALVSHTATGKGMAPKWALATRGWSQEHWEAAVLRLRERGLLDAEGELTEAGTALRKEIEAQTDRIDRAPYEHLGAAGVARLTELAAGLLSRAMAAGAFPTGMIGKS

SEQ ID NO: 9208 - protein, 810 aa, Streptomyces avermitilis
VTTPLVGSIEGRIAEELGVRERQVKAAVDLLDGGSTVPFIARYRKEATEMLDDAQLRTLEERLRYLRELEERRTAILESVREQGKLTAEVEAQIRGAETKARLEDIYLPFKPKRRTKAQIAREAGLEPLAEGLLGDPSVDPAAAAAAFVDADKGVADPQAALDGARSILTERFSEDADLIGELRERMWVRGRLAAKVRDGKEETGAKFADYFDFAEPFTELPSHRILAMLRGEKEDVLDLVLEPEEPSEQPGPSSYEGIVAHRFGIADRGRPGDKWLGDTVRWAWRTRILVHLGIDLRLRLRTAAEDEAVNVFAANLRDLLLAAPAGTRATLGLDPGFRTGVKVAVVDATGKVVATDVIHPHVPANKWDEALAKLARLAKEHAVELIAIGNGTASRETDKLAGELITRHPELQLTKVMVSEAGASVYSASAFASQELPGMDVSLRGAVSIARRLQDPLAELVKIDPKSIGVGQYQHDLSEVKLSRSLDAVVEDCVNGVGVDVNTASAPLLARVSGISSGLAENIVAHRDANGPFTSRTKLKGVARLGPKAYEQCAGFLRIRGGDDPLDASSVHPEAYPVVRRMVKSAGSEVASLIGNSGVLRSLRPDDFVDETFGLPTVSDILRELEKPGRDPRPAFKTATFKEGVEKISDLASGMVLEGVVTNVAAFGAFVDIGVHQDGLVHVSAMSKTFVKDPRDVVKPGDIVKVKVLDIDIPRKRISLTLRLDDEAAASEGRQDQQGQGGGGRQQRGAGRPPQQRQQQQRQQQPQRQGRAGGGGGGGGSRQAPPPANSAMADALRRAGLVDPKRGKG

SEQ ID NO: 9209 - protein, 546 aa, Streptomyces avermitilis
MTATLVAKNLAAGHGDRSLFSGLDLVVAPGEVIGLVGANGAGKSTLLRLLAGLLPPEEGELRLSPPTATVGHLPQEPERRPGETVREFLARRTGVAEAQRVMDEATQGLVDGAPGADDAYAVSLERWLDLGGADLDERAEEVADSLGLTVGLDQPMTSLSGGQAARAGLASLLLSRYDVFLLDEPTNDLDLDGLERLERFVGGLRAGTVVVSHDREFLTRTVTKVLELDLAQQQITLYGGGYEAYLEERETARRHAREDYDEYADKRAALEGRAQMQRSWMDKGVKNARRKAGNDNDKIGRKFRSEASEKQASKARQTQRMIERLDTVEEPRKEWELRMEIAAAPRSGAVVATLRDAEVRRGDFTFGPATLQIDWADRVAVTGANGAGKSTLLGALLGRIPLDAGHATLGSSVVVGEVDQARKLFHGSEALLDAFCAAVPDTEPAEVRTLLAKFGLKSHHVLRPAASLSPGERTRSALALLQGRGVNLLVLDEPTNHLDLPAIEQLETALDSYEGTLLLVTHDRRMLDAVRTTRQLEVADGKVTER

SEQ ID NO: 9210 - protein, 339 aa, Streptomyces avermitilis
MSAEYATFGLAPAMRAGGVLTNGDYQVHRDFVDFIVDGRPLLFQLSDLDAVSPLASDVPPAIFTAQVRGLLLEAEAPPADGRYVIYGCPECENIECGAVTAVIEKDGEDFVWRDFAWQTDERADLELNGYHGIGPFRFHGTEYRDALSSLLDGGSGPRRRVLLIGARVAVLAKLAAALRTIGIGADITHDATAVPADELREYGAVAFGRAVGEKERAAVRQSFARAGVEVAYIDGLAPIIPLLVAQTEHALDRSPEERRRLTRLVAADGEAGIEVTSTCRVRLTAYRLDRLYRTHVHEVFDDVLEAGRHRIPLDPKATKGESFVVARTSGSVLVAAMER

SEQ ID NO: 9211 - protein, 317 aa, Streptomyces avermitilis
VETGRSGEVIVVGGGVIGLTTAIVLAESGRRVRVWTREPVERTTSAVAGALWWPYRIEPAASARAWALTSFDVYEELATRPGRTGVRMVEGVQGGATLEETEAWALGRALGLRAATAEECPGGGLWARLPLIDMPAHLRWLRERFTAAGGTVETRTVTDLAEAKAPVVVNCTGLGARDLVPDTSVRPVRGQLVVVENPGIRTWLVSTGADGEMAYFFPQPGRLLLGGTAVEDEWSLVPDPAVAEAIVRRCAAWRPEIAGARVLEHRTGLRPARGTVRLEREPLSDGRVLVHNYGHGGAGVTVAWGCAQEAAGLAASW

SEQ ID NO: 9212 - protein, 431 aa, Streptomyces avermitilis
VTTRRMSAVALAAAALAAPLLTAPAHAAEPPPRTGFEQTDGARWTTQPEEQDFLTALDRTSERVSLARIGTTEQGRPLDLVRVGGGHRARATVLLVCSQHGDEPSGREACLTTVRDLAYAKDAHTRRFLKQTTLLVVPTANPDGRAADTRGNSDGVDINRDHLELRTAEARAVAAVLRDRRPDVIYDLHEYGATPPYYDKDLFDLWPRNLNTDPTVHDEAQTLSQAYVRPAAQRAGYTTGTYGIWTDPVTGDPVKQTAGDGQERILRNMSGVKHAAGLLIESRVDPLTDAEQTDGSLNKRRRVQSQLAALGGLFGFTGERGARVAAATDAARLAGYRDRGPVYVGGADNDPAEPAEVIQNPPCGYRLTAEQYTAVKDRLALHGVRVRHEGADGADGTVLVPLRQSLRALVPLLLDERAPYHLTAGEAAADC

SEQ ID NO: 9213 - protein, 676 aa, Streptomyces avermitilis
VIPPHRCLTDPLLQGSWPGYLPPMPKRARRMRLTTWRSPVTAVIAALLAAFLTPAAAHGAPRESAPVYSYENAIRESVWVDTRLDGDGDGKTDRVAVDVVRPRELARQGRKIPVIMDASPYYSCCGRGNESQKKTYDANGDVVRMPLFYDNYFVPRGYAFVGVDLAGTNRSDGCVDVGGRSDIQSAKAVIDWLNGRAHGYTSRTGTARAKATWTNGRTGMIGKSWDGTVANGVAATGVKGLKTIVPISAISSWYDYYFAKGAPLYDSGPDWLSDYVDSPDARTKCAAVQRKLVDEAPRTGDWTSLWTERDYVKDASKVRASVFLVHGMQDLNVRAKNFGQWWSALAKNGVERKIWLSQTGHVDPFDFRRTAWVDTLHRWFDHELLGYDNGVDREPTADIERHPDQWVTSTLWPPRGTDAVTLRPGTGTQAGVGTLGLRTGSGTETFTDDPRLSETDWAAHIDESTASKAGFVTAPLAGDVRLSGSSKVTVTATPTTSTAHLSAVLVDLGPDTIRDYADGGEGITTLTDRTCWGASTAGDSACFKNTRATTAAVDYTVLSRGWADLGNHASARKGVPLTPGKAYTITLDLAATDHVVPKGHRLALIVAGTDKDLIDPPSSTPTLTLDLARTSARVPLVGGAAAFTRATAQSGTAADATVLDGVREPHTAHRVPGGGL

SEQ ID NO: 9214 - protein, 497 aa, Streptomyces avermitilis
VHRRLIAPGALAASLLLAIPASAASYSPGAPGIGDPYYPAYGNGGYDVSHYDLRLKYQPRTDELEGTATLLATTKQDLSRFDLDFLLDVSEVRVNGAKASFTTSGQHELEITPATPLPKGTPVTVVVRYSGVPSTKSAYGFSTWHRTPDGAVAADEPEAAWWWYPSNDHPSDKATYDVSVAVPDGTQAISNGLLQSTSSKLGWTRYNWRSTKPQATYLTTLAVGRFDITTGKTSDGIPVINAYSKDLGDNDGAARASVERTGELVDWLSGYFGPYPFNSVGGYVPNTTTGYALETQTRVYYSPKQFANGSNTSVVVHELAHQWYGDDVSLAGWKDIWINEGFARYAQWLWSEHEGEGTTQELADYVYASHPADDAFWTVKPGDPGPDDQFDTAVYDRGALAVQALRNEIGDDAFFAVLKGWPKDHAYGNAAVGDFQKYAEKVSGKSLAALFDTWLFQPSKPAASAAKGASLASRTAAATVQPRSWKKIAATNSAHQG

SEQ ID NO: 9215 - protein, 159 aa, Streptomyces avermitilis
MSEIRYVRGDATVPSGEGVKMIAHVCNDIGGWGSGFVLAVSHRWPEPEKAYRAWYRDRAANDFGLGAAQFVQVERSLWVANMIGQRGIRTSDNEVPVRYEAIDAALGLLADRAVALDASVHLPRIGCGLAGGTWSRVEPLITERLVRRGIPVTVYDHGD

SEQ ID NO: 9216 - protein, 487 aa, Streptomyces avermitilis
VSKDAVDTARVASRTDVTQSPADAGDAGYSKDLKARHVNMIAIGGAIGTGLFLGAGGRLHNAGPALAIAYLVCGVFAFFVVRALGELVLYRPSSGSFVSYAREFLGEKGAYVAGWMYFLNWSTTGIADITAIALYTHYWSLFTDIPQWVLALIALAVVLAVNLISVKIFGEMEFWFAIIKVATLVGFMLIGIFLLATHHEVGGHTPGLSAVTDHGGIFPHGMMPVVLVMQGVIFAYAALELVGVAAGETAEPEKVVPRAVNSIMWRVGLFYVGSVVLLALLLPGSVYSADQSPFVTVLSKIGIPAAGDVMNLVVLTAAMSSLNSGLYSTGRILRSMAMAGSAPKFTARMNRSQVPYGGILLTCAVCVLGVGLNYLMPTQAFEIVLNVASLGIISTWVIIMICHLVFVRRARAGLVTRPSFRLFGSPVTEIVTIAFLLAVLGLMWNDPEVGRKTLLLIPLVAVLLVGGWFAVRRRVSQAEDRELAQLK

SEQ ID NO: 9217 - protein, 231 aa, Streptomyces avermitilis
MTTDTGEPTLTVDELAARAGVTVRTVRFYSSKGLLPPPSIGPRRVGHYSQEHLARLALIEELQHQGMTLAAIERHLQQLPPDLSAHDLALHRAVVASWAPDAVETVTRAELERRAGRPLGEADLERLAAMSVLARTEDAFRVDPGLLPLGVQLLDVPVAHEAILAARTALIEHSRAAAHELSRLFRDAVAERDSQAVKSLSAHMQPLVVQALLTTFQRSLREELREWLAES

SEQ ID NO: 9218 - protein, 213 aa, Streptomyces avermitilis
METRTALVTGAAQGLGQEFAVALAGRGFRVAGLDLVPQPETAKRVLDYVELTADVSDEEQVREALDEVIDRFGTLHVLVNNAGAGPESDFEDTTPEEWRRAMRVNLEAPFLVTRAVLPYLKAAGWGRIVNIASAAVFAAPPTRVAHVTSKAGLIGLTRSLASALGPYGITVNAIAPSAVRTADLVSTLLYVVDEGSGLLTGQTLTVAGGSTCW

SEQ ID NO: 9219 - protein, 735 aa, Streptomyces avermitilis
MSTEPTTIRWEQDETGIVTLVLDDPNQSANTMNQAFRASIAAIADRAEAEKDSIRGIIYTSAKKTFFAGGDLKDMMKAGPSDAQRAFETGTAIKNSLRRIETLGKPVVAAINGAALGGGYEIALASHHRIALDAPGSKIGLPEVTLGLLPAGGGVTRTVRLMGIADALLKVLLQGTQYAPARALENGLVHEVAATHEEMLAGARAFIDANPESQQPWDKPGYRIPGGTPANPKFAANLPAFPANLKKQLNGAPYPAPRNILAAAVEGSQVDFETALVIEARYFTELVTGQTAKNMIQAFFFDLQAVNSGANRPQGVAPRQVRKVAVLGAGMMGAGIAYSCARAGIEVVLKDVSAEAAAKGRGYSEKLCAKAVSRGRTTQEKADALLARITPTADPADLAGCDAVIEAVFEDTALKHKVFEEIEHIVEPDALLCSNTSTLPITALAEGVERQADFIGLHFFSPVDKMPLVEIIKGERTGDEALARAFDLVRQINKTPIVVNDSRGFFTSRVIGHFINEGVAMVGEGIEPASIEQAAAQAGYPAKVLSLMDELTLTLPRKIRAESKRAVEEAGGTWVTHPAEAVIDRMVDEFGRTGRGGGAGFYDYVDGKRAKLWPGLREHFTKPGHEIPFEDMQERMLFAEALDTVRLLEEGVLTSVADANIGSIFGIGFPGWTGGVLQYINGYAGGPGAGAGAGAGLPGFVARARELAERYGERFTPPALLVEKAEKGEHFSDAK

SEQ ID NO: 9220 - protein, 404 aa, Streptomyces avermitilis
VSTEAYVYDAIRTPRGRGKASGALHGTKPIDLVVGLIHEIRDRFPGLDPAAIDDIVLGVVGPVGDQGSDIARIAAIAAGLPDTVAGVQENRFCASGLEAVNLAAVKVRSGWEDLVLAGGVESMSRVPMASDGGAWFADPMTNMATNFVPQGIGADLIATIEGFTRRDVDEYAALSQERAAAAWKDGRFEKSVVPVKDRSGLVVLDHDEHLRPGTTADSLAKLKPSFADIGDLGGFDAVALQKYHWVEQIDHVHHAGNSSGIVDGASLVAIGSKEVGERYGLRPRARIVSAAVSGSEPTIMLTGPAPATRKALAKAGLSIDDIDLVEINEAFAAVVLRFARDMGLSLDKVNVNGGAIALGHPLGATGAMILGTLVDELERQDKRYGLATLCVGGGMGIATIVERV

SEQ ID NO: 9221 - protein, 397 aa, Streptomyces avermitilis
MSHQWCHSAGGLMAVARTPGHGPLAGVRVVELAGIGPGPFAAMLLADLGADVVRVDRPGGAGLAIAPEYDVTNRNKRSVIVDLKAEHGPAGVLDLAERADILIEGYRPGVAERLGVGPEACHARNPKLVYGRMTGWGQEGPLAQRAGHDIAYIALTGTLGMIGNPDEPPAIPANLVGDYAGGSLYLVVGVLAALHHARATGTGQVVDAAIVDGAAHLAAMIHGMLAAGGWQDQRGANLLDGGCPFYGTYETADGQYMAVGALEQQFYAEFVELLGIGDEAPSRKDVSRWSELRETVAARFKTRTRDEWTAVFEGSDACVAPVLSLREAPAHPHLAARGTFTDHGGITQPAPAPRFSATRTAVRSGPAQPGAHVEDVAREWGVPRLLEGLRPGPGEGA

SEQ ID NO: 9222 - protein, 391 aa, Streptomyces avermitilis
MSRLKTDRAYDIVLFGATGFVGTLTAEYLAAHAPEGLRWAIAGRSARRLEQVRERLGGASEIGILQADVADPGSLRDIARNARVVATTVGPYLNYGEELVAACADAGTDYADLTGEPEFVDLTYVRHDARARETGARLVHACGFDSIPHDLGAYFTVRQLPEGVPLTVDGYVRSQAMFSGGTFASALNQFARGPQMLAAARDRRRHEPRVVGRRVQAPLGAPRFAKEVGAWALPLPTIDSQIVQRSARVLERYGPDFRYRHYAAVEQLPFAAGGVAAVSALFAAAQLPPARRWLSGRLKPGDGPSAEKRAKSWFSVRFVGEGGGQRVYTEVAGGDPGYDETAKMLAESALSLALDDLPHTSGQVTTAVAMGDALIDRLRAAGITFRVAAKR

SEQ ID NO: 9223 - protein, 229 aa, Streptomyces avermitilis
MTTVRIPAGWPATEEEARAVQDELRGRVILDEPGPPPGTGRVTGVDVAYDDERDVVVAAAVVLDAATLDVVAEATAVGEVSFPYVPGLLAFREIPTVLAALDALPCPPGLIVCDGYGVAHPRRFGLASHLGVLTGLPTIGVAKNPFTFSYEDPGAPRGSAAPLLAGADEVGRALRTQSGVKPVFVSVGHRVDLDHACAHTLALTPKYRIPETTRRADSLCRRALKEATA

SEQ ID NO: 9224 - protein, 108 aa, Streptomyces avermitilis
MPRGSSPKRERQYEHIKQSAQDRGESQGRAEEIAARTVNKERARSGESKTASKTSTNDMSSGKRGGQRSHTGSAGPTYDQLYEEAKRRNIHGRSDMNKSQLKQALGNK

SEQ ID NO: 9225 - protein, 350 aa, Streptomyces avermitilis
VAALAAALTTPAGAAPAGAAPLSAAGRQTPHWQLKDSGTDVRFRGLSAVSRHAAWVAGSKGTVLRTTDGGAHWRNVSPPGAADLEFRDIEAFDARRAVVLAIGEGEASRVLRTDDGGATWTESFRNTDAKAFYDCLAFFDRRHGLAMSDPVDGAFRILSTSDGGRSWKVLPGAGMPAAQDGEAGFAAGGQCLVTSGPRDAWLATGGGAHARVLHSADRGLTWTAADTPIPAGDPARGVFALAFRDRTHGIAVGGDYRADQASPRAAAVSGDAGRTWTTAAQPPPAYRSGVTWLPHTGSAALAVGPTGTDLTTDGGRTWKTLDTGSYDTVDCTPDRGCWASGEKGRVARLE

SEQ ID NO: 9226 - protein, 138 aa, Streptomyces avermitilis
LSTVIEQPVEARLVAAAPRMPSIPATLHYDRSDPFAIRMTFPAPATLEGVEVCWTFARELLASGMEEPVGHGDVRVRPYGYDRTVLEFHAPEGTAVVHVRSGEIRRFLERTTELVPVGLEHLQIDLDHDLAELMRDAC

SEQ ID NO: 9227 - protein, 251 aa, Streptomyces avermitilis
VYTLGAGMRAVNAINVGPAQYRGGTVPDGSLSLPARLYLLSWDTTKLKVSGETHLHHLVRAGALTELAQRGLLTDVDGIATPADPDGRTGDPVLDGLMELVEESRPRKWKAWVTLRARVTLDAVRAQLAADGYLRAEKRRVFGLFPSVEYELARVPAVQALRAEARQVLEGPLPVAAVPDRDAALVALAAAAELRTLVPSKDRKRYKDRVEELTERGGAAAPALRKVIQEVRTAMIVAITAASTSGAATSS

SEQ ID NO: 9228 - protein, 539 aa, Streptomyces avermitilis
MTASITCTSLSFAWPDGTVVFDDLQATFGPGRTGLVGVNGSGKSTLLKLIAGQLSPADGTVRVAGEAGYLPQNVALDTALRVDEALGIAATRAALHAIEAGDVAEEHFTAVGDDWDVEERAIATLGELGLGHIELDRTIGEVSGGESVLLRLAALLLRRPDVLLLDEPTNNLDLYARRRLYAAVEAWSGVMVVVSHDRELLELVDQIADLRSGEVTWFGGNFSAYEEALATEQEAAERMVRVAESDLKKQKRELIDAQVKLARRKRYGQKMYEQKREPKIVMGARKRAAQESAGKHRILHEERLTEARERLDEAAEAVRDDDEIRVDLPYTAVPPGRSVLTLQDLELTYGARVDGGLELRGPERIALIGRNGAGKTTLLRTIAGELQAVSGEARAHVPLRFLPQRLDVLEDELTVAENVARFAPDATNNRVRARLARFLFRGARADQRAATLSGGERFRATLAALMLAEPAPQLLLLDEPTNNLDMASVRQLTTALESYEGALIVASHDVPFLESIGITRWLLLEGKLKDTTPEEVGMG

SEQ ID NO: 9229 - protein, 258 aa, Streptomyces avermitilis
VPSKKALIRRPSPRLAEGLVTHIERAQVDVGLAVEQWEAYAEALRTHGWETVEVDPADDCPDSVFVEDAVVMYRNVALITRPGADSRRGETAGVEEAVARLGCSVNWIWEPGTLDGGDVLKIGDTIYVGRGGRTNAAGVQQLRAVFEPLGAQVVAVPVSKVLHLKSSVTALPDGTVIGHIPLVDRPALFTRFLSVPEESGSHVVLLGGSKLLMADSAPKTADLLADLGHEPVLVNISEYEKLEGCVTCLSVRLRELYA

SEQ ID NO: 9230 - protein, 324 aa, Streptomyces avermitilis
VTITSPHLGSTSDWTDARLLYALEEVVENELNRHLKVAKDWMPHDYVPWSDARNFPGLFEDGEAWDKEQSKVTEIGRIALVVNLLTEDNLPSYHHEIASLFGRDGAWGTWVHRWTAEEGRHGIVMRDYLLASRAVDPDKLEAFRMSHMSEGFESDNRHSMLHSVAYVAFQELATRVSHRNTGHQSGDPVCDRMLARIATDENLHMVFYRNLLKAAFELAPDLTMQAVRDVVVNFRMPGHGIPGFERAAAQMAIGEVYNMRIHHDDVLQPVLRHLKVLEIDGLSPEGLHAQEELGLFMGGLDTEARKFDEKLAARKARMAARAGA

SEQ ID NO: 9231 - protein, 256 aa, Streptomyces avermitilis
MRELALHVRVMSPPRPVLEARGAYERGIAVVAASVARGTQWIAERIADAEPFVRGHALRVADSLQVPDTVYESALGDACEAVCRDLLRGIVVGRRTALADRLADGLRRDWGDAEAARLLPGCAPETVARLLPGLFHAVTGWKTLANRHPRTVLDAAEQALATLPEALRAPWWSRYAPAVAATVTAEPLRARALLERLGPETMPPRLRKHLGDFAVAAPGRLLRLLLTPAWHAVRRHRGLGPGVLRTLARKQLTAYE

SEQ ID NO: 9232 - protein, 81 aa, Streptomyces avermitilis
MHTETITSPDIAWQEEALCAQTGADFFFPEPGSSVREAKRICGLCEIRSACLEYALTNDERFGVWGGLSEKERLSLRRDPR

SEQ ID NO: 9233 - protein, 263 aa, Streptomyces avermitilis
MLTTRYVTGAPNWLDVGTPDIDGATSFYGGLFGWQFQSAGPDAGGYGFFQLSGKTAAGGMQTTPEQGPPSWTVYFQSPDAEATAKAAEQAGGHVFLPPMDVMGQGHMAILADQAGVPFGVWQPGRNKGLDVAGAPGSLCWIELYTPDIARAAAFYDKVFGWETSAVPFPGGTYTCINPAGTEPEAMFGGAVPLQDDPTEAESGAYWLPYFEVEDTDATVAEAQELGGKVRMPATDLEGVGRLAKLADPYGARFAVIKSTPPQG

SEQ ID NO: 9234 - protein, 348 aa, Streptomyces avermitilis
VTETASRPTLEAVAARAGVSRATVSRVVNGGDGVREPLVARVRRAVEELGYVPNQAARSLVTKRHDAVAVVIAEPETRVFADPFFALQLRGISKELTAHDCQLVLLLTEGRDDHARVGRYLAGGHVDGALVFSLHLDDPLPGLIRGAGVPTVFGGRPGWGDGTRDAAPAVYVDCDNRGGARAAVRHLVGLGRTRVAHLTGPLDQTSAVDRLDGFRDVMVDADPRLVVQGDFTPAGGERAMRELLERCPDVDAVFAANDLSASGALRVLREQGRRVPEDVALIGFDDMLPVAEQTDPPLTTVRQDIEEMGRLMARLLLSGLDRRGEAAGPAGTPAGVVLPTTLVRRASA

SEQ ID NO: 9235 - protein, 338 aa, Streptomyces avermitilis
MGDAVELEAAGRTVRLSSPDKIFFPERGFTKLDVAQYYLAVGDGILRALRNRPTTLERYPDGMSGESFFQKRAPKNMPDWIPTAHITFPSGRSADEMCPTEVAAVVWAAQFGTLTFHPWPVRRDDVDHPDELRLDLDPQPGTDYADAVRAAHELRAVLHEYGDLRGWPKTSGGRGLHVFVPIERRWTFTQVRRAAIAAGRELERRMPDQVTTAWWKEERGEKIFVDYNQTARDRTIASAYSVRPRPHAPVSAPLRWDEVGDARPRDFDIATMPRRYAELGDVHADMDDHAFSLEALLELADRDEHDHGLGDLPYPPEYPKMPGEPKRVQPSRAKHGDG

SEQ ID NO: 9236 - protein, 356 aa, Streptomyces avermitilis
MDLPVMPPVKPMLAKSVAKIPPDMQYEAKWDGFRAIVFRDGTEVELGSRTGKPLTRYFPELVEALRDRLPERCVIDGEIVIARDGRLDFDALTERIHPAESRVRMLAEKTPASFVAFDLLALADDSLLDTPLTERRALLESALSGVTAPVHVAPATTDREVAEQWFEQYEGAGLDGVIAKPLTLRYRQDERAMFKVKHERTADVVVAGYRLHKSGPVVGSLLLGLYDDRGALQHVGVSAAFPMKRRAELVEELEPLRMEDAAGHPWAAWSNEAAHETARLPGAPSRWSGKKDLSWVPLRPERVAEVAYDHMENGARFRHTARFRRWRPDRTPESCTYAQLEEPVSYDLTEILGSRG

SEQ ID NO: 9237 - protein, 325 aa, Streptomyces avermitilis
MARMRRGVMTAALLAATVTGSLVTGCTTHGRAVDDGRNRQQGHPESQVSGSPSATAGPVLAVKIDNAGAARPQTGLDTADVVYAEQVEGGLSRLMAVFATNLPKTVGPVRSARESDLELLGQFHDPTLAFSGAQHKLLPLIDKAPLRAVSPEQDSNAYFRGGDKAAPHNLFLRPKRLLNSAPGADALTTGFHFGAAPPGGTPEKARTVRFPAARFTFTWSEQRQRWLVSMDGTQAVTTDGATVAPATVVVQHVKVRQSRFHDFLGSNTPYTETVGTGKAEVLRDGRVFDVDWQRKSATDGTEFTTADGSPMNFAKGQVWVVFAKA

SEQ ID NO: 9238 - protein, 155 aa, Streptomyces avermitilis
MAAVDLSTHPGHLARRLQQAHYLLWNTMVSEEITSPQFAVLNALVAEPGLDQRTVGERVGLDRSTIAEVISRLSRRGLLDKVRDAHDGRRFLLRLTEEGTRTHRKLTVRTARMNQVFLAPLSAEEQSQFFDLIQRVSDAAEGLRNPAEPLTASKT

SEQ ID NO: 9239 - protein, 260 aa, Streptomyces avermitilis
MDKVVATALEAVADVPDGATLAVGGFGLSGVPNVLIQALYERGVAGLGVVSNNCGAMESGLAVLLAAGRIARVTGSYIGANKEFARQYLAGELEVEMIPQGTLAERLRAGGAGIPAFYTPAGVGTQVADGGLPWRYDGSGGVALASPPKEVREFDGTEYVLEHGIRTDFALVRAAKGDRHGNLVFNKSARNFNPLAAMAGRVTIAEVEELVEPGGLDPDAVHVPGIFVQRVIALSPEQTNAKMIEKRTVSASAATGTVSG

SEQ ID NO: 9240 - protein, 215 aa, Streptomyces avermitilis
MAWTREEMAARAARELADGQYVNLGIGLPTLIPNHLPAGVEVILESENGILGTGPYPAEEQVDPDLINAGKETVTVLPGASFFDSALSFGMIRGGHIDVAVLGAMQVSAGGDLANWAIPGKMITGIGGAMDLVHGARTVIVVMTHTAKDGQAKILEECALPLTGRACVNRIITDLGVLDVTADGLLLVETAPGVTAAEIVDKTAAKVRVPEEIRS

SEQ ID NO: 9241 - protein, 138 aa, Streptomyces avermitilis
VKDVYVVDAVRTPIGRYNGSLASVRPDDLAAHAVRELLTRTPGLDPSRIEDVYFGNANGAGEENRNVGRMAALLAGLPASVPGVTVNRLCASGLEAVIQAARAIALTVAHQLARKGSGVGVATLCIGVGQGLALVLER

SEQ ID NO: 9242 - protein, 256 aa, Streptomyces avermitilis
MALTQSHIDIEVDDLQNAYDKAVAEGGPVRHHPPRDYAPYRSSVLRHPKQPLVAVHGGDPETVELAGPVFGVTDITEIDNDLTRQHRGEPIGERMTVSGRLLDRDGRPVRGQLVEVWQANAAGRYAHLREQHPAPLDPNFTGVGRTLTDDQGRYTFTTIKPGPYPWGNHTNAWRPAHIHFSVFGTAFTQRLVTQMYFPSDPLFAYDPILRSVTDAAARNRLIATYQHDLSAPGFSLGYAWDIVLDGPSATWIEEGR

SEQ ID NO: 9243 - protein, 206 aa, Streptomyces avermitilis
MGHRPRRSLRHLDRGRPLSMTERLLPTPSHTIGPFYGHALPFPGGPDVAPQGHPDTITLHGYVFDGAGAPIPDALLDFWQAAPDGSLTGAPGSMRRDPSTGGFLGRNGTDFTGFGRVATDADGHYALHTLPPGNAGLPYISVCVFARGLVHHLFTRAYLADGADPLLDSLPAERRATLIAAEGANRTYRFDIRLQGEGETVFLEFQ

SEQ ID NO: 9244 - protein, 445 aa, Streptomyces avermitilis
VTEPVDSVDSDAGLLAPGWTGSPASAATGNGAFLQALLDAEAALTRAQAGLGLAPAEAASAVSVAADAVGFDVRSIALRARAGGNPVIPMVADLTAAVGAEHGPYVHRGATSQDIMDTAMMLVARAALDLILADLERTARALGRLAAAHRDTVMPGRTLTQHAVPTTFGLKAAGWRSLVLDARDRLTTVRLPAQLGGAAGTLAAFNAFGTEDTQALVTAYARELGLAEPALPWHTLRTPIADLAGALAFTAGALGKPAADVLTLARTEIAEVTEGAGGGSSAMPHKANPVAATLIAASARRAPGLAATLYASMAAEDERPAGAWHAEWEPLRELLRLVGGAAGHAAELAEGLWVNADTMREHLGLTQGLIVSERLAAELAPVLGRARAKELVTRAAKLAVAENRPLVDVLGEEQELTDLDLADLTDPTRYTGSAGALTDRALERR

SEQ ID NO: 9245 - protein, 379 aa, Streptomyces avermitilis
LTTKPNGRLSHHHAEGPVTAPPLLLGPSLGTSYALWDKVAPELSVTHRVIRWDLPGHGGSPAGLIGPGATVADLAELVLALAGSLGIDRFAYAGVSLGGAVGLHLAAHHPERVSSLAVLCSSAHFNGAQPWRERAELVRREGVAPVAATADSRWFTPGFTVPELVQDHRDADPDAYAACCDALAAFDLRDRLSSITAPTLLVAGRQDPATPPAHLREIADAVPGASLTEIAGASHLAPAERPEAVLAALRGHFDGYASRGMEVRRQVLGDEHVDRAQARQTPFTARFQDFISRYAWGEIWTDSTLTRRERSMITLTALVAHGHYDELALHVRAARRNGLTPEEIGAVLLQTAVYCGVPAANSAFAVAQRVLAEEDDTAG

SEQ ID NO: 9246 - protein, 895 aa, Streptomyces avermitilis
MTEVRPGAVASASLWERDAEIAALVEAVDALRADSPSSGSGSLLVFSGEAGIGKTALLGETRRIAESRGCTVWSARGGETVTSVPFNVVRQLLQPALVALMPDEAREYLGDWYDIAGPALGITEPGDRQADPQGVCDGLVAAVRRLARREWPLVLLIDDAHWADQETLHWLAAFAERLHDLSVLVVVARRPGEATEESTRHLDVIAAAAGPVATLSALTPEATAGLTRATVGVHADAPFCREVWAVTGGNPYETVELLAKVQDSELEPSESSAAELRALNRSARGRGLVARLEGLGIDATRFAWAAAILGTGISLDLAAQLAGMQREEALHCADLLGAARILTEPAPVNGRQPDGDLEFVHPLIASAVYNSIPDALRTAMHGVAAQVVTDSGLGAAAASRHLLEVHPDDDAELVDQMREAAREHLAVGAPDAARRCLERALLEPPLSDVHARVLYELGCATLLTSPATTIDYLQAALAMPGLDGDVRVDAVFRLSQALLHNNQVEEAVRTVDAEAARLEPGPARMRLQAVHYMWECVHAGEDISPTSVRALAELAKKCTGKDNSERALLILRGFDAMTRGENAEEVAELCDRALVNGRLAPGLGWTDTEWGIELLMMLASAYAYADRLDRAEALYNEALRAYEGAGWSGGHLALAHSYVGLGHRRRGRLTEAEKYLRESLRIAERVGRGLPLYWSATCGLVDTLLARGHVEEAAEIAERYGFGPPYPTTIVLPDTRSVRGRLLLALGRTEEGVNELEAAEKAATARGHHNTVLAPWALDLARALAVDDPRRAAELAATARRQAERFGTDTAIGEALRCAAALETGQRAASLYKQAVTYLEASPCSYEHAAARVEYGIATRSATELTRGLTLARSCGADGLVAQAQEALDNGPGLR

SEQ ID NO: 9247 - protein, 450 aa, Streptomyces avermitilis
LKLTFHHHRGPGGTGMSIPVQDSDRRAARPEQSRRALLAGSVGNLIEWYEFGVYGYFATIVAARFFTPEGGGEVEGLVKAYASFALAFFFRPVGAALFGRLGDRIGRRPVLILVIALMTAATTLIGALPTYATAGALAPWLLTFLRVVQGLSAGGEFGGAVSVMTEFAPPGRRGLYGSWQSFTVALGLLCGAGVAALLAVFLSEAQLSSWGWRLPFLLTLPLGLGALWLRLRLDETPAFASGRAHPNAYDRPPARRLAGAIALGASRVMGWAAAGYTFLVVLPSYLQSTLHATFQQALVATVLANLGFAATIVPAGLLSDRIGRRPVMLTGAALVTVLALPLLNLLQNTGTSNAAKGVAVCAAGAVVGLMAGPGPAMLSEMFPTRVRCTGLGLAYALSNAVFSGCAGLIITETIERTGNVDIPAYYAAATCAVSALALATVRTNQKSQGS

SEQ ID NO: 9248 - protein, 384 aa, Streptomyces avermitilis
VRVIGLMSGTSYDAIDAAAADLGLAGDRLVLKPLGLMSEAYDSGLREELAAALPPAATSLAGVCRLDTRIGQAFAAAAVRADRELCGGRAELVASHGQTVYHWAEAGRVYGTLQLGQPAWIAEATGLPVVADFRPRDIAAGGQGAPLVSLVDLLWLRGRAGTSVALNLGGIANLTAPDGTAFDTGPACALIDAAAHGLSGGRLDHDVDGALAARGTVHEPMLRRLLAEPYYALPAPKTTGKELFHLGYLRDALAGFGTLTAEDVIATLTRLTALTVADAVRAVRATEVVASGGGTRNPVLMEMLARELGAVALRTSDELGLPSAAKEAYAFAVLGFLTVHGLAGTDPVSTGARHPSVLGSVTPGRDGLRLPPRADWSPVRLVLE

SEQ ID NO: 9249 - protein, 330 aa, Streptomyces avermitilis
MTQVTPPGWYPDPGQTSDGPALERWWDGKAWTDQTRPVGSAAAWGPPAHPPTVGAYPDGPPAPARRGLRTGIAVAAAIAVLAGIGGGVYALTKDDGGSGNASNSQGPGGPGGQNGQGGTGGGEGGSGGPGGLPGDSGGSDGQSPAPDQSEPPKVKGGGAVSDAINGISLPVPDDWYGQALTAGAQVSSNDSYKCPGDTSKKCTTGGAYSAPAVALGTDGSTPEEVAKADIAANAKESYGGTTYGKITSHEELASKAVTVAGQKGYLVRWKAVTSKGADGYVESLVFPSPANAKQLVVVRFGIDVGKKESVIDEITKGIKVSSGGGSGQNV

SEQ ID NO: 9250 - protein, 204 aa, Streptomyces avermitilis
MTSQAADGPETVVASRRSKITPEREQEFFDAVLEQIRECGYDALTMEGVAASTRCSKSTLYRQWKTKPQFVAAALRANRQVRFSGIDTGSLAGDLREAARAAGTWSGRDTQLLQALGHAVMQDEELQQALRDALVEPEIEALQEMIRRGVERGEIAADHPALEYIPAQLLGVLRVRPVLEGQYADEEYLARFVEAAVLPALGLT

SEQ ID NO: 9251 - protein, 336 aa, Streptomyces avermitilis
MDSLTEPDPEGAAAVQRPPLVRELLLVAGLFVVYKVGRQLANGHTGEAFHNAQRVWDGERALRLPDEGAVQSALLHGDALVHVANTYYAVVHFPATAAFLVWLYLRRPGHYLWARRVLAVLTAAALVLHLTFPLAPPRLLAAAGLVDTAQVYGPSVYGGNPETDSMANQFAAMPSLHFGWALMVAIGLIAATRSRWRPLWLLHPLLTLMVIVGTANHYWLDAGVAAALLGIALAVIHAPVRTAAAADRTPAPADIAVPATGLTAPAGDAAPPLAGLAGHVVPAPVGAAPSTGGSGLVGARRAEAERVGASPAEANPAKASRAGAERVGTERVGAGR

SEQ ID NO: 9252 - protein, 314 aa, Streptomyces avermitilis
VNATLVAIVLSLFSAVAYAAAAVAQERLAARNTDTGALRLLGDTAWWWSVALNASAALLHVAALKYGPLTLVQPLGALTLVAAVPLGARVAGRRVSAVEWRGTALTLIGLAALLVTASGPAPDDVLTVPEALAVAGATAVLIGGLSRPGARPGLRHATASGFASGVASALTQTVTVAATDRSDSLLSAQVIVVTLLVAAFAAGGLLLSQTAYQGGLGAPLAVVTLANPVAASVIGLSLLGERLEGGPTGVLLAFVGAAIAAWGVVTLSRSAPAPAPVADDDHPVAAVLALEPGSAAYEPSLLPQQPNPGHLTAH

SEQ ID NO: 9253 - protein, 285 aa, Streptomyces avermitilis
VTTHSNTPAGWYPDPHGAPQTLRYWDGAQWTDHTNADQQAQGAPQVPQQAQQPQQAYAQQAAPAPDRRVQRQVQQEAGVAAGAVGGGTLFTEPVLVVNQKAKLIEVTNEYKVMDQNGNQLGSVTEVGQNAFKKVLRFVSSVDQFMTHKLEIRDAYGQPQLLLTRPAKIFKSRVIVSRPDGSPVGEIVQQNMIGKINFAMNVDGQQVGAIKAENWRAWNFAIVDHAGNEVARITKTWEGLAKTMFTTADNYVLQIHFQLPEPLLSLVVATALTVDTALKQDSRGLG

SEQ ID NO: 9254 - protein, 683 aa, Streptomyces avermitilis
MPEVNRRRFLQLAGGTAAFTALSNSIERAAALPAHHSSGTIEDVEHIVVLMQENRSFDHYFGSLRGVRGFGDPRPAAQANGKPVWNQSDGAKDVLPFHPDADDLGLQFIQDLPHGWSDGHSAFNQGKYDKWVPAKSATTMAYLTRDDIPFHYALADSFTICDAYHCSFIGSTDPNRYYLWTGYTGNDGKGGGPVLGNEEAGYSWTTYPERLEAAGVSWKIYQDVGDGLDANGSWGWIPDAYRGNYGDNSLLYFDQYRNAKPGDPLYDKARTGTDARKGEGFFDQLTADVKGGKLPEISWIVAPEAFTEHPNWPANYGAWYVAQVLDALTSDPKVWAKTALFVTYDENDGFFDHLVPPFPPQSAAQGKSTVDVGPDLFKGDASHAAGPYGLGQRVPMLVVSPWSKGGYVCSETLDHTSVIRFMERRFGVHEPNISPWRRAVCGDLTSAFDFSRKDTKPVALPATDGYRPPDHDRHPDYVPTPPAHPALPRQERGSRPARPLRYAPLVDGSADAAAGKFTLTFASGARAGAAFLVTSGNRTDGPWTYTTEAGKTVSDTWNSAYSNGSYDLTVHGPNGFLRVFKGPGGAAGPEVTARHVGSDVRLVFTNKGPGTVRLELTDGYGGKPRSFKVRPGATVKHTVDLRAARRWYDLTVVSDADAGFLRRFAGHVENGLPGVSDPAIVTD

SEQ ID NO: 9255 - protein, 227 aa, Streptomyces avermitilis
VDLTPTLPRGGTADRGPLTPHRPSTTPFCDRSPRARVALESLSSADITDGLTEFELDAAMTYLDDDTLRHVRRFPLYEERYVLLTPVDGPLAAQPTARWAQAAALPLCLLGPRMRNRRIIDECFAADGATATPAIESDSVAGLYAQLPGGRWSSVISHAWLHMFGVPEGMGVVPLEGPARGPRVGLVVARSEPRSALAEALLTVAREADVRDALDSLLHTYLGGGHG

SEQ ID NO: 9256 - protein, 160 aa, Streptomyces avermitilis
VSQSLAAAGTAAGAMAELALTGDLARPARLTVSDLLAWPRHRVRVSFECATSGVQHHAFEGPLLHDVLSDAGPVFDAARRKDRLRFLIAVTGADGHHALLSWAEIDPDFGRAPVLLAVSIDGTPLDRAGPQLVLPQDRCGARHISGIDAIRVDGGYTPWT

SEQ ID NO: 9257 - protein, 128 aa, Streptomyces avermitilis
MHTYRIGDAAALLGVSADTVRRLVDGGRLTAERDATGRRIIPGPVLAAYARQLHRTERENAGSSARNRLSGIVTDVTLGDVSAQVEIQAGPFRVVSLVSRESAEELKLEPGVPAVAVIKSTNVVVERP

SEQ ID NO: 9258 - protein, 274 aa, Streptomyces avermitilis
MTRSARRTHRTLKVAGAGAAALLALSACSSSDDSSTKADSSASASSSAKLSGTVTVFAAASLKESFTTLGKEFEKEHPGTKVTFSFGGSDSLAASITGGAPADVFASASPKTMAIVTDAGDASGTPATFVRNQLEIATLPGNPDKVSSLEDLTKSGLKVVLCDKEVPCGAAAQKALDAGKLKLTPVSYEQDVKSALTKVELKEADAAVVYKTDVKAAGDKVEGVEFPESANAVNDYPIVRLKDTKNAEAAKAFIALVRSAEGQKVLTEAGFLKP

SEQ ID NO: 9259 - protein, 289 aa, Streptomyces avermitilis
VTSPHDTSDAVADTLTGGPRRGPGHVRTGFGRGVPLPLLVPALVGLAFLVLPLIALLVRTPWHSLPGQLTSPEVWQALKLSLVCATAATAVSLVIGVPLAWLLARVEFPGRGLVRALVTLPLVLPPVVGGVALLMALGRNGVVGKWLDSWFGITLPFTTTGVVIAEAFVAMPFLVISVEGTLRAADPRYEEAATTLGASRFTAFRRVTLPLIAPGIAAGAVLAWARALGEFGATITFAGNFPGRTQTMPLAVYLALQSDPEAAIALSLVLLVVSVAVLAGLRDRWMTAS

SEQ ID NO: 9260 - protein, 364 aa, Streptomyces avermitilis
MTDTEKSAHEVMGVPGPAAAGLDARLIVDRGTFRLDVALTAAPGDVVALLGPNGAGKTTALRALAGLVPLTGGHLRLDGAPLERTPPESRPVGVVFQDYLLFPHLTALDNVAFGPRCHGATKAAARARAAEWLERMGLTAHAGAKPRRLSGGQAQRVALARALATSPRLLLLDEPLAALDARTRLEVRTQLRRHLAEFEAVAVLVTHDPLDAMVLADRLVVVEDGRVVQEGTPADIARHPRTDYIAHLVGLNLYPGRAEGHAVRVDGGPVITTTEDLTGPVFVAFPPSAVTLHRDRPTGSSARNLWQCEVAGLETHGDQIRADLTGELPLAADLTTVAAAELDLHPGATVWASVKAAQTHAYSA

SEQ ID NO: 9261 - protein, 300 aa, Streptomyces avermitilis
VAGRALAVPCADLDTLPMTSAESDGPGRVDRLLRYPVKSMLGEELPAVEVTERGLAHDRRVALIDRDTGKVASAKHPRLWSRLLTVTAQADNSAVRMTTSDGKELWSTDPGVDEALSEIVGRPVFLTDAPPHEAALDRADPEDVLRDHTRPPVSARTGRIGGGSPEGTFFDFAPVHVMTTSTLARIAALAPNGSAQAERYRPNIVLRTPLTRGFTENDWIDRTLHLGTGLVLRVIARTPRCAIPTLAHGTVPADTAALRVLAEHNRVTPTESMGPQPCAGVYAQVLRPGRIRLGDPVHWA

SEQ ID NO: 9262 - protein, 724 aa, Streptomyces avermitilis
MHSNSLRYVRRMSAIGAAVALAAGLLVALAPAAHAAAGADLPFTSVEAESATTTGTKIGPDHTQGTIASEASGRQAVRLGAGQRVEFTVPRAANAVNVSYNVPDGQSGALNVYVNGTKLAKTLAVTSKYSYVDTSWIAGAKTHHFFDNARLLLGQNVQPGDKIAVEAVSTQVTVDVADFEQVAAAATKPAGAVSVTDKGADPSGQGDSTQAFRNAIAAAQGGVVWIPPGDYRLTSSLNGVQNVTLQGAGSWHSVVHTSRFIDQSSSSGGVHLKDFAVIGEVTERVDSNPDNFVNGSLGPGSSVSGMWLQHLKVGLWLTGNNDNLVVENNRILDTTADGLNLNGNARGVRVRNNFLRNNGDDALAMWSLYSPDTNSSFESNTISQPNLANGIAIYGGTDLAVKNNLISDTNALGSGIAISNQKFLDPFSPLAGTITVSGNTLVRAGAMNPNWQHPMGALRVDSYDSAIEANVSITGTTITDSPYSAFEFVSGGGHGYATKNVTVDGATVRNTGTVVVQAESQGAAKFSNVQATGVGAAGIYNCPYPAGSGTFTLTDGGGNAGWSSTWGDCSAWPQPGQGNPDPDPTRNLAKGRPATATGSQDVYTPGKAVDGDASTYWESTNNAFPQAWTVDLGSSQAVRRLVLKLPPATAWQARTQTLSVQGSTDGSAYSTVVASQGYRFDPATGNTATVTLPSGTNLRYLKLNVTANTGWPAAQFSEVEAYLS

SEQ ID NO: 9263 - protein, 533 aa, Streptomyces avermitilis
VGQPTPARIQKDWWRTAVIYQVYVRSFADGDGDGTGDLAGVRARLPYLAGLGVDAIWFNPWYLSPMKDGGYDVADYRAVDPAFGTLAEAEKLIAEARELGIRTLVDIVPNHVSDQHPWFRAALAAGPGSPERALFHFRGGRGAHGELPPNDWPSQFAGSTEPVWTQLPDGDWYLHLFTPEQPDLNWAHPAVRQEHEDVLRFWFERGVAGVRIDSAALLAKDPDLPDLVEGRAPHPFVDRDELHDIYRSWRAIADEYGAVFVGEVWLPDTERFARYLRPDELHTAFNFSFLSCPWDARRLRTAIDETLAEHAPVGAPATWVLCNHDVTRTVTRYGRTDTGFDFAAKAFGTPTDLALGTRRARAAALLSLALPGSVYLYQGEELGLPEAEIPRESIQDPMHFRSHGVDPGRDGCRVPLPWVADAPHAGFGGEPWLPQPARWSAYAADLQAEDPGSMLSLYREALRLRPAYADGPLTWLPAPDGVLAFARTEGLMCVVNLADTPAGLPAHSRLLLSSGPLDDQGRLPQDTAAWLRI

SEQ ID NO: 9264 - protein, 291 aa, Streptomyces avermitilis
MSTRTLVSPLTLSRPRGKAAYWTVFTGVVLLFALAFLFPVYWMVTGAMKSPDEAARTPPSLVPQKWHLSGYTDAWDLMQLPAHLWNTVVQATGAWLLQLVFCTAAAYALSRLKPVFGKLVLGGILATLMVPAQALVVPKYLTVADLPLIHTSLLNDPLGIWLPAVANAFNLYLLKRFFDQIPRDVLEAAEIDGAGRLRTLWSIVLPMSRPVLGVVSIFALVAVWQDFLWPLMVFSDTDKQPISVALVQLSQNIQLTVLIAAMVIASIPMVAMFLVFQRHIIAGISAGSTKG

SEQ ID NO: 9265 - protein, 318 aa, Streptomyces avermitilis
MTKTAARRPVEAIAVRPVPAPPPGGGLGRRRLADQAHAYAFLLGGLLCFALFSWYPAIRAVVIAFQKYTPGSPPEWVGTANFTRVLHDPEFTAAWRNTLTFTLLALLIGFAVPFVMALVLNELRHAKAFFRVVVYLPVMIPPVVSALLWKWFYDPGAGLANEALRFLHLPTSNWSNGADTALVSLVIVATWANMGGTVLIYLAALQGIPGELYEAAELDGANILQRIRHVTIPQTRFIVLMLMLLQIIATMQVFTEPFVITGGGPENATVTVLYLIYKYAFLYNDFGGACALSVMLLVLLGAFSAVYLRLTRSAEEDS

SEQ ID NO: 9266 - protein, 446 aa, Streptomyces avermitilis
MRSSGFRRACVALVACSFVLTACGSSGDAADGKTRITVNCMPPKSAKVDRKFFEDDIAAFEKKNPDIDVVAHDAFPCQDPKTFDAKLAGGQMEDVFYTYFTDATHVVDVNQAADITSYVKDLKSYDTVQQQLRDIYTVDGKVYGVPRTGYSMGLIYNRGLFEKAGLDPDKPPATWDEVRAAAKRIAALGGGTVGYADYSAQNQGGWHFTAELYSQGGDVVSADGKKATVDTPEGKAVLQNLHDMRWTDNSMGSKQLLVINDVQQLMGSGKLGMYLSAPDNIPILVKEKGGTYTDLALAPMPGGKGTLIGGDGYMFNKKATPAQIKAGLKWLDFMFLTPGKGFLGDYARAKKNDAPVGLPEPRLFSGAADARDQQVKKANANVPVENYQSFLDGNQSLRMKIEPPQAQQIYSVLDSAVSAVLTKKDADIDKLLKDASGKIDSILARG

SEQ ID NO: 9267 - protein, 330 aa, Streptomyces avermitilis
MTRRLAEVAKKVGVSEATVSRVLNDKPGVSPATRQAVLSALDVLGYERPTQLRGERARLVGLVLPELQNPIFPAFAEVIGGALAQLGLTPVLCTQTKGGVSEADYVNLLLQQQVSGVVFAGGLYAQADAPHDHYRRLADRNIPVVLVNAAIEHLGFPAVSCDDAVAVEQAWRHLASLGHERIGLVLGPGDHMPSARKLAAARALGDLPDEYVARAMFSIEGGHAAASRLIDRGVTGFICASDPLALGAVRAARRKGLDVPSQISVVGYDDSALMNCTEPPLTTVRQPIESMGRAVVELLNARIGGSSVPDEELLFEPELVVRGSTAQAPR

SEQ ID NO: 9268 - protein, 242 aa, Streptomyces avermitilis
MSGDPAPVPGDPAPRRKTAMAAQHSPALPTLGGRKPSYRERVADALRAALIAGELRAGEVYSAPGLAARFGVSATPVREAMLDLAKEGLVDTVPNKGFRVTAVSEKQLDEYTHIRSLIEIPTTAGLALTADPAELEALRPVAREIVAAATAGDLIAYVEADLRFHLGLLALAGNDHLVDVVRDLRRRSRLYGLTALARAGRLRASAEEHLELLDALLARDTEAAREVTTRHLGHVRGLWVAP

SEQ ID NO: 9269 - protein, 333 aa, Streptomyces avermitilis
MRSKLVLHAVDSHTEGMPTRVITGGIGTIPGATMNERRLYFREHRDDIRQLLMNEPRGHSAMSGAVLQPPARPDCDVGVVYIEVSGYLPMCGHGTIGVATVLVETGMVEVVEPVTTIRLDTPAGLVVAEVAVEDGAARAVTLKNVPSFCVGLDRKATLADGRTVTYDLAYGGNFYAILPLGEFGLPFDRSRKDDILKAGLSLMDAVNADGGPVHPEDPSIRGCHHVHLVAPGSDARHSRHAMAIHPGWFDRSPCGTGTSARMAQLHARGELPLGTEFVNESLIGTRFTGRLLGTTEVAGIPAVLPSFTGRAWVTGTAQYLLDPEDPFPAGFVL

SEQ ID NO: 9270 - protein, 296 aa, Streptomyces avermitilis
MTVHRPWRGVLVATALPLTADLAVDHDKFAEHCAWLVEQGCDGVVPNGSLGEYQVLTPEERARVVETAVSAVGGARVMPGVAAYGSAEARRWAEQARDAGCRAVMLLPPNAYRADERSVRAHYAEVAKAGVPVVAYNNPIDTKVDLVPELLAALHGEGYIHAVKEFSGDVRRAYRLAELAPELDLLIGADDVLLELAVAGAKGWVAGYPNALPAASVELYHAAVDGDLATATQLYRQLHPLLRWDSRVEFVQAIKMSMDVVGRYGGPVRPPRVPLLPEQETAVRAATEKAVAAGLA

SEQ ID NO: 9271 - protein, 499 aa, Streptomyces avermitilis
MRAEPARAESARAELAVIGAGPAGLAAALAAGARGVRVTLIDSAAQAGGQFYRRPDPALEARRPQVLHHRWRTWERLRDGLAAQVGTGGVKHLTEHQVWLVERQSTGFTVHALRAESPVVVHADAVLLATGGYEKVLPFPGWTLPGVLTAGGAQAMLKGGLAVAGGTAVVAGTGPLLLPVATGLAAAGVEVAALVEAADPKTLVRHARALAVKLPEGARYAARLLRHRVEFLGRHTVVEAHGGERLAAVTVAALDAGGRVRTGTERRILCDTLAVGHGMLPHTDLAETLGCRVDGLNVSVDEEQRTSVPGVWAAGETTGIGGAALSLAEGHIAGRSIAARLAGREPDPRAWAAAAKSRTRLRQFAAVLDTVYAPPAHWSDRVTDDTVVCRCEEVTGGAIREAVEELGAGDLRTVKLLTRAGMGWCQGRMCGPAVAGLAGCQLAPSSGPFARPVPLGVLARAADGHRSEAPTADHGDEAPADGRRAEAPADDHLTQRGPS

SEQ ID NO: 9272 - protein, 99 aa, Streptomyces avermitilis
VNPLRLVHARPGAAFAVTFDGREIEALPGQTVAAALWSAGVTAWRTTRGGGRPRGVFCGIGVCFDCLLSVNGAPNQRACLVRVRPGDVIRTQEGTGHEG

SEQ ID NO: 9273 - protein, 415 aa, Streptomyces avermitilis
VTSPLTCDVVVVGAGMVGAACAYYAARAGLDVTLVDRGPVAGGTTGAGEGNLLVSDKEPGPELELALLSGRLWAELVERRPGFGHAVEYEAKGGLVVAETPEALTALTDLAARQSAAGVEVSPAAADQLRELEPHLAPGLAGAVRYPQDAQVMPALAAAHLVRASGARPATGASVTAVLRTPDGSVRGVRTDRGDIHAPAVVNAAGTWGGEVARLAGVRLPVLPRRGFVLVTEPLPRMIWHKVYAADYVADVASDSAALATSPVVEGTAAGPVLIGASRERVGFDRTFSLPVVRELAAGATRLFPFLVGVHAVRAYVGFRPYLPDHLPAIGPDARVPGLFHACGHEGAGIGLATGTGYLIAQVLAGRDPDLDLTPFRPERFSGHFPDRSQDGLPGALPDRPAHRGADRREDQETP

SEQ ID NO: 9274 - protein, 285 aa, Streptomyces avermitilis
VRSAASDQPVRSPAVQLSRSARIALRVAAGCGFAAIYVPLALVLVNSFNSDRSASWPPSGLTLHWWSVAWGSEGARAALWVSVKAGLGATAIALLLGTLIAFAVARHRFFGRDAISFVVVLPIALPGIVTGIALNSAFSTVLEPLGVGLGMFTVVVGHATFCIVVVFNNVVARLRRTSGSYEEAAMDLGANTFRAFADVTFPLVRSALLAGGLLAFALSFDEIVVTTFTAGPGIETLPIWIFNNMTRPQQAPVVNVVAAVLVLLSVLPIYVAQRLSADTATESRI

SEQ ID NO: 9275 - protein, 297 aa, Streptomyces avermitilis
VKTTTARAAGRTPVRRLAGTLHRRPRLRLSLLLTAPLLWLAVLYLGSLSVLFISAFWTTNSFTSEVVKVWSTDNFHTLFTTPVFRQVILRSVGVALAVTVLCAVIAFPVAFYTARLAKPKWRPLLVVAILTPLWASYLVKVYAWRLILSQDGLADWMLKPFGLSGPGFGLPATVITLTYLWLPYMILPIHTALEQLPANLLDASADLGARAGRTFRSVVLPMVLPSVAAGSVFTFSLSLGDYITVQIVGGKTQLIGNLVYSNIELNLPMAAALGTVPVVVIVVYLLAMRRTGALSSL

SEQ ID NO: 9276 - protein, 414 aa, Streptomyces avermitilis
VLTPPLSPPSRMENVVRLTRTLQATAAVAVLLAATACGSSDSGGSSSSTGLNPPDLKAQSKLGKTEGQVNLVAWAGYVEDGSNDPKTDWVSDFEKQSGCQVNSKVAASSDEMVKLMKTGQYDAVSASGDASLRLIASGDAAPVNTDLVPNYQDVFSGLKKQAWNSVDGTPYGIPHGRGANLLMYNTQKVKPAPTSWSAVFDDASRYKGHVTAYDSPIYIADAALYLKATKPELKIKDPYALDQKQFDAAVALLKKQNANVGEYWGDYLKEISAFKSGDSVVGTTWQVIANLAADEGAKVKAVVPKEGSTGWSDTWMVSAKAKHPNCAYKWLDWIISPKVNAQVAEYFGEAPANAKACDETSDKNFCDTFHATEESYWKDTAFWNTPIEQCLDGRTDVKCVPYAKWVQAWTEIKG

SEQ ID NO: 9277 - protein, 345 aa, Streptomyces avermitilis
MEARAIRLQGLRKVFGDTAAVTGVDLEIADGEFFSMLGPSGSGKTTVLRMIAGFESPTAGRIELAGQEVTGLAPFERDVHTVFQDYALFPHMTVEQNVAYGLKVRKVPRVERLARARKALADVRLEAFGTRRPSQLSGGQRQRVALARALVGRPRVLLLDEPLGALDLKLREQMQVELKAIQREVGITFVFVTHDQEEALTMSDRIAVFNRGRIEQVGTPAEIYERPSTPFVASFVGTSNLLSGESAQRIVGAPGTYSIRPEKIRVLGESAHAGDPQYSTATGTVVEVVYLGDVTRFLVDLDAGGRLTALQQNLETSSADVAAYRGTRVTLQWHRGHTFRVPEAG

SEQ ID NO: 9278 - protein, 251 aa, Streptomyces avermitilis
VVAVKQPVNRNAGGARSAVFTPVDSRARVETVVRRLGDAIELGLLADGEQLPGESELAGQLGVSTVTLREALMALRQQGLVTTRRGRGGGSFVSLPAIPGEERLRVRLAGWSTEELRDLGDHWAAVSGAAARLAAQRTEPDDLQQLRRTLEEFDQAEDAAARSRVYGRFHVELAAAAQSARLTREQVALQTEVGALLCLVLGDDAYRQEVAGRHRAVISAVQDGADDTARALAERCVQDSTARLITLRLAL

SEQ ID NO: 9279 - protein, 265 aa, Streptomyces avermitilis
MSRSPGPAGAAATLDVSPQARVAAQARVAAQVRSALEAVFEAVEETRADTAALLAQVAGLGRRPATVDLAGLRPGLHLRLARQELVSGVGFVAAPGLLGDVPTWLEWWQTGADGALRPLLLDLDPRQSAYSDYTHWDWFALPRDTGRRAVAGPYVDYLCSEEYSLTLSAPVQVEGRFAGVAAADVYLRHFETAVMPLLQRLPGPAHLVNARGRVAASADPAHLAGSLTKGPDFAAVLTQARPEHFDGLHLMPCDGVPLVLVMAER

SEQ ID NO: 9280 - protein, 222 aa, Streptomyces avermitilis
MAYQAGGQRPAPRPVPASVEAQAYLQDYAALLESVSFPSVVFDHRWDVVLSNAAFETLFGGVGPHPTAMPGDNFLRFVLFHPDAATILGEHESSWCLPMLAHFAAAVERHGQDRGLLSIRRDIAQDPIMEAAYRHGLPHWIRAVGANAVEHDGAVRPLLHPDPRWGTDCRVVGETPRTLQDMGYTRMTLVLREARRPADGPRRPRRAGRTSNHLSVVPSPER

SEQ ID NO: 9281 - protein, 218 aa, Streptomyces avermitilis
VTDGLEVPDATATVLLPAVVARVAALADRLGVAHAEVFDVGRLSVASGVPEPVVKALLSGRPAGEPDLQARFLQRLDLLRRTRLKPNRRRYTQQEIADGAGMSRQQAGALINGDRRPTMEHCDAIQRFFRVHAGFLTAEDPEALAGTLQRSEQELLQQLADRERAAAMAVDDPLERLLQDHGVRGIAWRAAQLPTDQHRDKVAEWLDMLLESVKRPES

SEQ ID NO: 9282 - protein, 176 aa, Streptomyces avermitilis
MRRLCGELVAELSLPAPAEPADLYAALCDGMSRRRGRPVQYRTAAFPPGTASGLWLDMADQDLVVIEERTAPDHQLVILGHELWHMKAGHCSHHVEGAAVAARLLSDTADLQATVLKVAARTRFELSDEKEAESFGLLLASKCRRWLAGSSLRGPVRRDDVAGRIEASLGYRGPQG

SEQ ID NO: 9283 - protein, 401 aa, Streptomyces avermitilis
MDGSSYYIPAAAMGVALAAKAPALIRGWRDPLLRSVGVLLALAGLVFLFAAPPTIAEVNALTGIPNISAPLVYCVLSAFSASCLVLIINWRGGPPEVTRRLSRRWIAGYSVVSVALVVLFLLGEAPQERLRDLDTYYANTPFIREMIVLYLAALTVAGVAMNVMCWRWAIQVRGWLRAGLLVIAFGFMFNIPYAAAKFTAVVAQWNGGNLDYLSTDVAPVLASAGAQISAVGFCLPLACQRIGDNWITWSTYRRLGPLWRELKPVSTFADRAVRISWWSSADLQVTQRESDIHDGMLGLYPYFDSEVRCLAYDAAVAAGSEPAQAQAEADAAMVTAAVRARSADPEGRVISSAEATAPFSSLDGPRDLVRMSNALRQSPVVAAARRQASTRSESDFHERTR

SEQ ID NO: 9284 - protein, 486 aa, Streptomyces avermitilis
MSEPASVPRGAAPGSRGTASPRAVVIGAGLAGMLAAAALHRHAEVTVVDRDVLPAEPAPRKGLPQARHAHLLWSGGARAMEDLLPGVTAAWLAAGARRIPLPTGLVSLSAQGWLRRWPEMEFMISCTRDLLDSVIREQVAKKEGVTLLAGTELLGLEGGALRVTGVRVRTPEGEERVLEADLVVDASGRGSRSVAWLDALGVPQAPMDEVDSGLAYASRIFRAPAGTEDFPVVNVQPDPAQPVPAQSATIVPVEGGRWLVTLSGTHGGQPTASAEEFEAFARGVRDPVVGELIAHAEPLTNVVLTRSTINRRRFFEKVKDWPEGFVAIGDAVATYNPVYGHGMSVAAQGAVALREHVAEHGLAAPGLARRAQRAVALPVKIAWELATGTDIRYPEAIGKQPGGTQKLLGRYVERLMRTATGRPLVAQAFLGVITLSRPLSTLVKPEVLFAVLRGPRRSPLAGPPLTPEERKAVLTAKEPSGTQAAG

SEQ ID NO: 9285 - protein, 347 aa, Streptomyces avermitilis
MVDVPPPRPRRALRLRPVGDGELRLHHRVVHGYRRAYRMAGEGPVLVLIHGIGDSSATWAELIPDLARTHTVIAPDLLGHGASDKPRADYSVAAYANGVRDLLASLDIESATLVGHSLGGGVAMQFAYQFPERTERLILVSAGGVGREVNPVLRAVSLPGAHLMLSTLRLPGMRFQVGMFARLMRLLDTDLGQDAPELLTLVDALPDVTSRSAFIRTLRAVVDWRGQAVTMLDRCYLTEGMPTLLLWGDRDSVVPVRHAYGAHEAMPGSRLEIFEGAGHFPFHTDPARFLALVEEFTGTTRPAHWSREHWRELLRAGRPGSAAGRPDTVRNRAVERDLRQASERSAT

SEQ ID NO: 9286 - protein, 100 aa, Streptomyces avermitilis
VPPVCPGAHAVHVPHDEADQGESRPMPTAVLTDRERAAVQAYLRLLQTVRATFDGPPDGRRPPAVPTAALAEAEQALSAAGLAGNEEEFFHLLRSWCPEG

SEQ ID NO: 9287 - protein, 229 aa, Streptomyces avermitilis
VIEELLPAAVVAVEAHGDEAAVDGALYPEEQAVIARAVEKRRREFTAVRVCARRAMEKLGVPPQPVLPGERGAPRWPAGLVGSMTHCEGYCAAVLVRAGELASLGIDAEPHDRLPEGVLSSVALPTEERRLYDLGRSRPDVHWDRLLFSAKESVYKAWFPLTGKWLDFLEADIEIFTEPAAQGKALSGGFRAELLVPGPLVNGRRLDAFDGRWTVRRGLVATAVTVPHH

SEQ ID NO: 9288 - protein, 290 aa, Streptomyces avermitilis
MKGASVESTAGRGQLLAISDLHIGYAENRALVEKMRPESDDDWLLVAGDVAETVADIRWALETLAGRFRKVIWAPGNHELWTHPKDTVTLRGLARYEHLVDLCRELGVTTPEDPYPVWEGPGGPVAVAPLFLLYDYSFLPAGCDTKEQGLEYAHGTGVVCTDEFMLHPDPYPTRDAWCRARIAETERRLAQLPPELSTVLVNHYPLDRHPTEVLHYPEFAMWCGTRLTADWHRRFRAEVMVYGHLHIPRTTHHEGVRFEEVSVGYPREWRRRQTPPGTLRRILPMEVEAR

SEQ ID NO: 9289 - protein, 381 aa, Streptomyces avermitilis
MGSRVRVWLNRTYAENVFFMDQLRRNPHDRAVEIHATHADADSPVLAAADTSAMEPEGLSPAGYVEYALDQCARRGIDVFVPRLHQDAVVAHRADFAAAGTALLAPPAEAVAVFQDKATAYEAVQAIGIPVPPWRRVRTEDELLSAVEELEAGGYKACFKPAAGAGGVGFRIITRTPFSLAHLNGFPGPYVQLDLVIQAVRDADEPVDWLVMPHLGQPEVSVDCLTGPDNRIRMAVGRTKNGRRRGFTLHEQWIDPATRLAEGFGLHYLSNIQFRMFGDKPVLMDVNTRPAGGLHQLSLCGLNAPWAAVQLALGEDPGEVAPPFLGTDYTVVSGPRPLRAVSLPQQRTEEPETVLPAVPAPAAKPVSAPPAEAGAPATAPA

SEQ ID NO: 9290 - protein, 561 aa, Streptomyces avermitilis
VRITMFRRSRRSLLALLGSAALALAGAVALPGTAQAANILSNPGFESGSLSPWSCTGNLGSVVSSPVHGGSKSLAGAVSSSDTAQCSQTVPVQPNTTYSLSGWVRGSYVYLGVDGGASTWTTSTSAYSRLSVSFTTGASQTSAKIYVHGWYAQGTYYADDISLDGPGGGGSDTQAPTAPGSLRSTGKTSSSATLAWNASTDNVGVTTYDVYSGSNQVLSVSGTTATVSGLSPSTAYTFTVKARDAAGNTSAASNSVSVTTDAGSGGGTGFKQAAPYLYLGWGDPPSATSVMSSTGIKWYTMAFMLDSGGCNPAWDGSRPLTGGNDQSVINSVRSAGGDVVPSFGGWSGSKLGANCSSASALAGALQKVIDAYGLKAIDMDIENTDEFENATVQDRILTALKTVKANNPGLRTIVTFGTTTTGPTYWGNRLIEQAQALNAGIDVFTIMPFDFGGGSDMYGNTVNATDGLKAKLKSTFGWDDATAYSHIGISGMNGLSDQQENTSPATWTQIRDWANSHHIARLAFWSVNRDRPCPGGGVVSNCSGISQNTWQFTSITAGFTG

SEQ ID NO: 9291 - protein, 416 aa, Streptomyces avermitilis
VSMQPWFTDAKLGIFVHWGVYAVDGVQESWSFYDDIVPHDQYMSQFDRFTAARYDPRDWAALFARAGARYAVLTSRHHDGVALWDTAHGNLNVGRDLISGYADALRERGLKVGLYYSHSDWNHPDYASTRKPGRPPELADNRYSEVAAEYEDLAAWERFIAYRDGQIRELTSRYKPDLMWFDGEWDRSEEQWRIPELAALIRSEVPDVVFNARMLSEGDYATPEQGAPVVPPQGPWELCLTINDSWGFQHHDHNHKSVTQLIRYFTETIGGGGNLLLDVGPKEDGTIPAEQVERLEGLGDWIAKHAEAVYGTVRGLPAGHHYGPSTLSADRRTLYLTLFDAPRAEIGVRGMAGTVRRVTVLGSGTELAHRVIGGLHEAPGVLWIEPPAAADLDPHATVLAVELDGELELYRGPGRF

SEQ ID NO: 9292 - protein, 1022 aa, Streptomyces avermitilis
MHDERRRIEERVERIHNQRIKPAVYAAAVPFAVEAWQAPGEPVPFEEAAAASYAPFAMDTPWGPPWGTTWFRMRGRVPAEWAGRRVEAVIDLGFTGDWPGNQAEALVHRTDGTPLKAVNPLNQYVPIGNPATGGEEIDYLVEAASNPDILAGDFARPTPLGDVLTAGDKPLYTFRRADLAILDEEVWHLDLDVQVLRELMLELGEHDPRRHEIMHTLDRALDALDLDDISGSATAVREVLAPALARPAHASAHTLSGVGHAHIDSAWLWPIRETKRKTSRTFSNVTSLADEYDDFIFACSQAQQYEWVRDNYPHVWARIQESVKKGQWAPVGGMWVEADGNLPGGEALARQLIHGKRFFIEHFGVETKGVWLPDSFGYNASYPQLAKLAGNEWFLTQKLSWNQTNKLPHHTFWWEGIDGTRIFTHFPPIDTYNARFSGEEMSRTVRNYADKGRGTRSLAPFGWGDGGGGPTREIMERARRLADLEGSPKVVVEHPDAFFKAAREEYPDAPVWVGELYLELHRATYTSQARTKQGNRRSEHKLREAELWATTAALHAPGYAYPYEKLDRLWKTVLLHQFHDILPGSSIAWVHREAEAEYARVATELEELTAEAVAALGGGGPRVFNTSPRDRAEVVRTSTGAPAYVEVPAGGSAPLDGAAPPRPVTVTGRVLDNGLVRVEVAEDGTLASVRDLTADREVLADQGNLLRLHTDLPNYWDAWDIDKHYKNRYTDLLDADSVTVVEQDPLIGAIRVERSFGKGSKITQTITVRAGSRRIDVETEIDWHEAEKILKAAFPVDLRAPHSSAEIQFGHVQRPTHTNTSWEAARFEVYGHRWVHIGEPGYGVAVINDSTYGHDVSRTVREDGGTTTTVRLSLVRAPRVPDPEADQGRHRFTYALLPGASIEDAVAEGYALNLPLRVADAQGAPEPVVSVDGAGLTVEAVKLADDASGDVVVRLYESGGGRSRGTLRTGFPLAGVHVTDLLERPLAEGAGDAVVDGDGAVAVELRPFQVLTLRLKRAATAQ

SEQ ID NO: 9293 - protein, 445 aa, Streptomyces avermitilis
VKLTILGGGGFRVPLVYGALLGDRAEGRVTRVVLHDLDAGRLTAVARVLAEQAAGDPDAPEVSFTTDLDEALRGADFVFSAIRVGGLEGRADDERVALAEGVLGQETVGAGGIAYGLRTVPVAVDIARRVARLAPDAWVINFTNPAGLVTEAMSRHLGDRVIGICDSPVGLGRRIARVLGADPREAFIDYVGLNHLGWVRGLRVAGRDELPRLLADPGLLGSFEEGKLFGPDWLRSLGAIPNEYLHYYYFNREAVRAYSEAEKTRGAFLRDQQARFYEEMKRADSSALSAWDRTRAEREATYMAENRDAAGAGERDADDLSGGYEKVALALMRAIARDERTTLILNVRNRGALTVLDAEAVIEVPCLVDANGAHPVAVDPLPGHATGLVCAVKAVEREVLSAAESGSRATAVKAFALHPLVDSVNVARRLVDGYTSVHPGLTYLK

SEQ ID NO: 9294 - protein, 261 aa, Streptomyces avermitilis
MTSTVHRVLAERRHQLILRALRSGGPAAVTDLSEQLGVSPATVRRDLLRLEEEGLLTRVHGGAVVEEGDQPFAEVAEMRVAEKDAIAVHAAAMVADGQSVLLDIGTTAYRLARQLHGRRLTVITSNLVVYEELADDEGIELVLLGGMVRREYRSLVGFLTEDNLRQLHADWLFLGTSGVRPGGQVMDTTVVEVPVKRAMIRAGERVVLLADSAKFPGTGMARVCGPEDLDAVVTDGPVDAATRSSLEEAGVEVIVAGKVQA

SEQ ID NO: 9295 - protein, 345 aa, Streptomyces avermitilis
VGDERPDVLLTGLLFYDLVLTGLGKPPTPGEEIWTEGMGVSPGGIANLAVAASRFGLRTSLATVFGDDHYGAYCRGVLAGQEGIDLSLSRTADGWHTPVTVSLAYGHDRALVTHGQDPPYSQDALMGDPPEARTALVHIEAEPHAWLAKAAANGTRIYADVGWDPTQQWSRDLLDQLSLCHAFLPNEAEAMAYTRTDSAMAALGTLTDLVPVAVVTRGGDGAVAVDQTTGEYAEVPALDIDVLDPTGAGDVFGASFVAASLGGWPLAERLRFAVLAAGLSVQRHGGALAAPGWYGVHRWWHSLEDPGLRRAYGFLADRIPADPGPPVRHAPVTPPDATRRPSTSR

SEQ ID NO: 9296 - protein, 431 aa, Streptomyces avermitilis
VGAVRLSRRGLLRAGLAGTAATALGGLATGCAVPTGSTGRNMVLWYWSGGLSPKVVQDAKARYDSAVNLQAIQIGGYYRSKLMTTMTGRAHIPDIVGLKGEDMASYLPNSDQFVDLRALGADRLKDRYLPWKWDEGIAEDGSMVGFPIDCGPVAHYYQPAVFEKAGLPYEPADVSKELDTWEKFLAAGERLKKRVPGAFILTDALSIYGMSVNQTTKRFVDRDRHFIGDQEHVRTAWDRAVEATRRGLVSKIINGTPDNISATERGLLPSQLNASWAAGDIKLNTPKTKGKWRVASCPGGPSNIGGSFLAITKACREPEKAFEMITWMLDAGNQAQGFVDSVLFPSTPASYGMKKLREPDAFFGGQITMDVFGPAAEKIPVAFNSPYDIALKTPIDDELRNFSVLGKDPEKAWKDAMSKCRRIADHLGVSY

SEQ ID NO: 9297 - protein, 320 aa, Streptomyces avermitilis
MATAPVVETSPAVVSATPTARSGKGVLSHWRLYAAISPFYLLFLAFGLIPVGFSLYLSFHRWDGLGSMEFAGLSQYRYLLSDSQFWTSIGNTIVIWALATIPMILLAMVTAVLLNSAVRFKNVYRFAFFLPNVTSIVAVAIIFGSVFSTNFGLMNAVLQAVGLDQVAWLNTPWGIKVAIATLMTWQWTGYNAIIFLAGLQTIPGELYEAARMDGAGPLQTFFRITLPLLRPVLLFVLVISTVTGLQSFSEPQVLLQTTDNNSSFAGGPGHAGQTMVLYFFQQTFDNNDFGYGAAVAWGIFLVVVLFSIINWRLVQRRGEE

SEQ ID NO: 9298 - protein, 278 aa, Streptomyces avermitilis
MASIKGSRQRGIALHLVLVIGLLLSVFPFYWAVIMSTHSSTEIFSYPPKLLPGSHFLENVRHLFDNVDFFGSMANSLLVAGSVTVLVLFLDSLAAFVFAKFHFPGRRVLFALMMAIFMVPAQLQAIPQFVIMAKLGWIGSMTALVVPAAANAFGIFWMRQYMQSAIHDELLDASKLDGAGFLRQYWHVALPVVRPGLAFLGIFTFMGQWNDYAWPLIALTNPDNVTLQVALSQLNGVHGTTDYGMVMTGALLALVPLLIVFAIGARQIIADLGKGAIR

SEQ ID NO: 9299 - protein, 974 aa, Streptomyces avermitilis
MSRDPLIALRPWESPEVTSWGRLPMNAVDRRTGALPLDGEWRFQLLPTPGSPVTEAWSSQHVPGAWTVQGTDDLPQYTNVTMPWGEFPPASPAANPTGVYEREVDVPAEWAGRRVVLRVGAAESVLLVHVNGRPTGISKDSHLAAEFDLSDVVRPGERATVRLTVVKWSDASHLEDQDHWWHGGITRSVLLYATDPLHLADVTVRARPDGGLRVDCRVRHAMGRLPGGWYVTGELAGHLLAQDAEFDRLNAQDERVSDFLGEARLTALVREVRPWTAETPELYELTVRLHRADGSVADTAHPRVGFRQVEIRGRDLLVNGERVYIRGVNRHDFHPLTGRTVSYDDMRADLVTLKRFGFNAIRTAHYPNDPALLDLADELGFYVVDEADIESHDHAHEIADDPRYTAAFVDRVSRMVLRDKNHPSVIVWSLGNESDYGANHDAAAGWVRRHDPTRPLQYEGAAKLGWADPTVASDIACPMYAPVEDCVAHALSGEQTKPLIQCEYSHAMGNSNGTLADHWAAIESTPGLQGGFIWEFWDHGILQRVNDGRPAGRAGAGLYDNGVAAQGHRWAYGGDFGETVHDGAFIADGVVFPDRTPKPVMYEHREIAAPVRLAYDGGDLRISNHQHFRGLEWLAASWELSLAEGGTLTAPAGLPDVRAGESAVVPMPFALPEDGGEAWLTLRVTTADDEAWAPRGTEVCVPRVRLRAAAPVASAPLTTGAPVQVDEDGLLVHPLLTAAPVLSLWRAPTDNDEIGGMAARWRAWGLDALERKVVDVRRAAGSVTVVAEYGTMAGAVRHEQVFTRVEGGVRVEETAELPAGLDDVARVGSVFETVAGLDVLEWYGQGPWESYPDRSGGAPVGHHSRPVDELFTPYLRPQESGGRHGVRRFTLSAPDATGFAVELDEPRQVNVTRYRAADLAAATHHDELVPRPGCVVHLDVAHRGLGTASCGPDTSPGHLVPTGTHRWSWTLRVL

SEQ ID NO: 9300 - protein, 562 aa, Streptomyces avermitilis
MTEQQLPAWADPSVSPAALDPQGMSRRGLLRRAGLFGAAFAVGSLATPAAASSGRYGGNDPRLAYLVGDHHIHSVYSHDAKYTFSQLARAGDRYGLDWMVFNEHSNFGHADYGAKLEHQEILKARAENPRQLIFQGLEWYIPAAEHATVFAAPGPHEVDLLTRFELAYDGKLLGYTDGATSNPNTARNEAHAIKAIQWLAEQRRTGYVDDVLVLANHPMRLGIDSPHEMRGWRDAAPEIMIGMEGAPGAQGGGIPGWVGSGQQRGEYVNKPSANSWPGYPEDAYVLYGGFDWTTATVGGLWDAMLAEGKLFTITTNSDVHRVVFDTWKNGDWAPGRNFDNTGHLPDPVNTDSQQPGGDFWPGQFSRTHVGVTRYGYRAVMAGLRAGRVWLDHGHLLDGLDVRLKRDCDHGPGVTMGGRLRVRKGEKLTLSVTVTTASRPNPHGILPELAHVDVVRGAVRGPAADRDDWRAPDTRVVHTRDVSGRKGTYTLRIPLVAGDESFYVRLRGSDGNRNGTGYLGASVDPHGPIPHVPGNGDPWVDTWFYANPVFVDVVGGRQENRPA

SEQ ID NO: 9301 - protein, 921 aa, Streptomyces avermitilis
VIPARTRHTVAIVGAGAAGTLTAIQLCETATRRRTPLDLVLVDPAPEAGRGTAYATSDPRHRLNVPAGGMSCYPDDPGHFTRWLCRHGEPTVTGADFATRYRFGAYLADTLGQAIVRAQGVVGVRRLRVRAESCTDAPDGRVELHLADGGRVTADSAVLATGPAGSPGDWAPPALRASARFVAAPWAPGALDGPRADGADVLLVGTGLTAVDLALTLDRPGRTVHAVSRSGLLPQPHALTPAGTMPAPEDLGSSLAELRRAVYRHISRAVRTHGDWRPALDSLRPHTARLWRSLTPDERAQFLKEEGARWNTHRHRMAPATAESLTRRRTARRLRVYAGRIVGVGVGVGEGAGVVGAGDEGAAARSGPGGVPAHFRPGGILTVSLSGGRRIRAGWVVDCTGPGPRLDDPLWRSLFGSGAAVPGPLGMGVATGDGRLLDARGRAERPLFTLGAPRRGELWETTAIPEIRVQAAALAQELLAPLTRPARAARRPRRRPVDAHGLALSTHAEAAAAYRTGLDRVLKVRAAAEDAFGRAVTLDPGFALGHAALALVGHECGAEVDVPRALADAQRSARERADERERSFVDVVTRRIHGDDGDGALLRHLEAYPADALALATAVPTIAFSGINDLDDAYALRLVERTSPVYDGHWFPTSLLAFLRQEEGRYGEAGELAHRALAAEPAAGHAVHALAHVHYESGAHATGRDWLDGWISGQGRGAVHRAHFSWHVALHELALDDTAAVRKRWFAQLAPGRVTGVRALVDSGSLLWRARLSGSWRGRIPAADVLGTVAQEVVERPATAFTALHAAVALAAAGDLAALRRLRDHAAGADEVQREIIVPLCESFAALVEERFHDAARGLDALLPGLRKVGGSAAQREVVEETLLYALVAGGRCDAARRLLDARLDRQHAPRDRRMLAGLPV

SEQ ID NO: 9302 - protein, 423 aa, Streptomyces avermitilis
VGVPHISNGSGRQSWSRRGALAALAAALPATVLTGCGGFADASEDTKSTGGGTAGNTAGTADAKTTEAKAPTLTVTPADGTKKADFSSPVEVTVTHGTLASVKVSGNDGATLAGRYNDARTKWTSTGNPYSGTTYTVTAKAKGADAETVTFSTKSPGETFVGYFTPEANSTSGVGMPVSVNFTHAVADRAAVEKAITVTAEPAVEVVGHWFSDTRLDFRPETYWAAGTRITLGLRLKDVEGADGVYGTQSKDVTFHIGREQISTVDLATRTMTVRRDGSTYATYPVTGGDADHTTWSGIMVISERFTETRMESSTVGLGDEYDIKDVPHAQRLTTSGTFIHGNYWAGSSVFGHTNASHGCIGLQDTKGANDSSVAGYAFYKSSMLGDVVVVKNSGEDTVDPSNGLNGWNLSWDQWRAGSALSR

SEQ ID NO: 9303 - protein, 466 aa, Streptomyces avermitilis
MSETSGISARRRSLRRALVAVLGTLSLAAAAATAATLPANASAPTPPAGWTQVFLDDFNGAAGSGVSTANWQYDTGTSYPGGAANWGTGEVETMTSSSNNVSLDGNGNLRITPLRDSAGNWTSGRIETNRTDFQPPAGGTLRVESRIQLPNVTGAAAKGYWPAFWMLGAPYRGNYQNWPSVGELDIMENVQGLNTDWATVHCGTNPGGPCNETSGIGGNTPCAGTTCQASFHTYAMEWDRSTSTEEIRFYLDGVNFHTVKASQVDATTWANATGHGFFVILNVAMGGGFPAAFGGGPDSGTDPGHPMVVDYVQVLQSSGGSGTTPPPSGSRDAYSAIQAESYDSQSGTSTETTTDTGGGQNIGSLGNGDWALYKGVDFGSTAAKQFYARVASGAAAGVSGLVEVRLDSRTGSPVGSFSVAGTGGWQSWRTVPANISSVTGTHDVYLTFTSGQSADFVNVNWFDFGH

SEQ ID NO: 9304 - protein, 298 aa, Streptomyces avermitilis
MADRTTRAAHEGDGIRTFPFPVDLSVFGVGMQVGPMGADRIWHADAPLDRVHRIDFHVVMVFHDGPVRHMIDFAEYEASAGDVLWIRPGQVHRFSRTDEYRGTVLTMQPGFLPRATVEATGLYRYDLPPLLHPDPDRLAALEHSLAQLEREYVDTTTLPLSLHTSVLRHTLTAFLFRLAHLAVSSAQAGREQTDTTFTRFRDAVEKGFATNHSVSAYADTLGYSRRTLVRAVRAATGQTPKGFIDKRVTLEAKRLLAHTDLPIGRVGAAVGFPDSANFSKFFHQHTDTTPAAFRAELR

SEQ ID NO: 9305 - protein, 693 aa, Streptomyces avermitilis
LKMSTHTHDSFEWTDLDRRAVDTARLLAADAVQKVGNGHPGTAMSLAPAAYTIFQKVMRHDPADPEWTGRDRFVLSPGHTSLTLYTQLFLAGYELELDDLKAFRTHGSKTPGHPEYGHTAGVETTTGPLGQGAANAVGMAMAARYERGLFDPHAPEGESPFDHTIWAIVSDGDLEEGISAEASSLAGHQKLGNLVFLYDDNHISIEGDTATAFSEDVPKRYEAYGWHVQRIEPSADGDIDVHALHAALKAAQAETERPSFIAMRTIIAWPAPNAQNTEASHGSALGAEEIAATKRVLGSDPEQTFEVADEVLAHARRALDRGAEEHAAWDKRIAEWRTAQPERAKLFDRIVAGQLPEGWEQSLPVFEAGTSVATRAASGKVLQALGAVIPELWGGSADLAGSNNTTIDKTSSFLPKGNPLPEADPYGRTVHFGIREHSMAAEMNGIALHGNTRIYGGTFLVFSDYMRNAVRLSALMQLPVTYVWTHDSIGLGEDGPTHQPVEHLASLRAIPGLNIVRPADANETAIAWREILERHATHPAPHGLALTRQGVPTYEANEDAAKGGYVLQEASTGTPDVVLIATGSEVQLAVAARERLEAEGVGTRVVSMPSVEWFEEQSPEYRASVLPPSVKARVAVEAGIGLTWHRYVGDAGRIVSLEHFGASADAETLFAEFGFTAENVAAAARESITAARG

SEQ ID NO: 9306 - protein, 378 aa, Streptomyces avermitilis
MITVSNTVENLERLSDEGVSIWLDDLSRKRITSGNLAELIAHKHVVGVTTNPSIFQAAIGSGEGYEEQLADLAVRGVTVDEAVRMMTTADVRAAADILRPVYDATGGRDGRVSIEVDPRLAHDTEATIAEAKQLAWLVDRPNVMIKIPATKAGLPAITEVIGLGISVNVTLIFSLERYREVMDAYLAGLERAQAAGIDLAGIHSVASFFVSRVDSEIDKRLAKAGTDDAQALKGKAALANARLAYEAYEEVFAGERWTALAPAGAHKQRPLWASTGVKDPAYKDTLYVDELVAPGTVNTMPEGTLNATADHGDIHGDTVTGGYAQARADLAAVERLGISYDEVVKQLEDEAVAKFEVAWGDLLEAVATSLRGKGADGE

SEQ ID NO: 9307 - protein, 548 aa, Streptomyces avermitilis
MSKTPSTGTPGTEKPVTGTPATETPVTEAPVTEAPVTEASAVDWANPLRDPRDRRLPRIAGPSGLVIFGVTGDLSRKKLMPAIYDLANRGLLPPGFSLLGFARRDWEDQDFAQVVHDSVREHARTEFREEVWQQLAEGMRFIPGDFDDDMAFKQLRASVDELDASRGTSGNYAFYLSVPPKFFPKVVQQLKKHGLADAPEGSWRRAVIEKPFGHDLASARELNAIVHEVFDPDQVFRIDHYLGKETVQNILALRFANQMYEPVWNRSYVDHVQITMAEDIGIGGRAGYYDGIGSARDVIQNHLLQLMALTAMEEPAAFDAESLLAEKLKVLKSVKLPGNLGEHTVRGQYTASWQGGERVRGYLQEDGIDPRSTTDTYAAVKLEVDNRRWAGVPFYLRTGKRLGRRVTEIAVVFQRAPHSPFDSTATEELGANAIVVRVQPDEGMTVRFGSKVPGTSMEIRDVSMDFAYGESFTESSPEAYERLILDVLLGDANLFPRHQEVEESWKILDPIEGYWDTHGKPAQYPSGSWGPEEADEMLARDGRSWRRP

SEQ ID NO: 9308 - protein, 311 aa, Streptomyces avermitilis
MKIDLTDTTASKINKALVQGRHAIGTPAVGMVLTMVIVTDEENAYDALKAAEEASREHPSRTLVVIKRVARTPRDRTQSRLDAEVRVGSDAGTGETVILRTYGEVSDHADSVVLPLLLPDAPVVVWWPVDAPDIPSKDPLGALAQRRITDMYAVEAPLAALEARVSSYAPGDTDLAWTRLTPWRSMLAAALDQARTPVISAAVESEAENPSAELLARWLGARLHVPVERVVTAGPVVTAVRLGTEKGEILIDRPEGPLATLSLPGQPARTLALKVRSTSELIAEELRRLDADEMYAIALRGEAAEENTSHV

SEQ ID NO: 9309 - protein, 549 aa, Streptomyces avermitilis
MSDSPRLTRRPEWTELEDHRAGPLLHPALRELFAADPERAERYVVRAGDLRLDYSKHLITDETLALLQELATATDVFGLRDAMFRGEKINVTENRAVLHTALRAPRDAVIEVDGENVVPAVHAVLDRMADFADRVRSGEWTGHTGSRIRTVVNIGIGGSDLGPAMAYEALRAFTDRSLTVRFVSNVDGADLHEAVRDLDPAETLFVIASKTFTTIETITNATSARSWLLAGLDGDEKAVAKHFVALSTNAGKVSDFGIDTANMFEFWDWVGGRYSFDSAIGLSLMIAIGPERFRELLDGFRIVDEHFRTAPAEANAPLLLGLLGVWYGSFFGAQSHAVLPYSHYLSKFTAYLQQLDMESNGKSVDRDGHPVEWQTGPVVWGTPGTNGQHAYYQLLHQGTKVIPADLIGFINPVDGLSDELAAQHDLLMANLFAQGQALAFGKTGDEVRAEGVPEEQVPHRTFRGNHPTTTILAAELTPSVLGQLIALYEHKVFVQGAIWNIDSFDQWGVELGKVLAKRVEPALTEGADVPGLDPSTAALVAAYRTHRKK

SEQ ID NO: 9310 - protein, 292 aa, Streptomyces avermitilis
MQLGLIGLGKMGGNMRERIRRAGHTVVGYDRNPEVSDVSSLTELVSALEGPRVVWVMVPAGAPTQSVVDELGDLLSPGDTVVDGGNSRWTDDEKHAEELAAKGIGFVDAGVSGGVWGLQNGYALMVGGDAEHIARVQPIFDALKPEGDFGFVHAGKVGAGHFSKMVHNGIEYAMMQAYAEGWELLEKVDSVTDVRAVFRSWQEGTVIRSWLLDLAVNALDEDEHLEKLRGYAEDSGEGRWTVEAAIHNAVPLPAITASLFARFASRQDDSPQMKMVAALRNQFGGHAVESAE

SEQ ID NO: 9311 - protein, 203 aa, Streptomyces avermitilis
MGDLILVRHGETEWSLSGRHTSRTDLPLTHHGEEQAKSLAPFFAGRSFARVLTSPLDRAVRTAELAGLTGAVTDPDLHEWDYGGYEGITTVEIHRTRPDWDLWTDGVPSASDGSRGESPQEVGERADRVLSRVDAALRGDGEDVVLVAHAHFLRVVTARRLGLPPEQGRLFRLATGTVSRLSTEHGRPVIATWNESGTSHGHH

SEQ ID NO: 9312 - protein, 151 aa, Streptomyces avermitilis
MALWDRIKESASTMQTQLEAKKNDLKSGAFRDASMAMCALVAAADGSVDPSERQRVAQLIATNEVLQNFDADDLRRRFDANLDKLTADFAFGKVSVLQEIAKAKKKPAEARAVIQIGIVIGGADGDFDKTEQAVVREACFALDLPPHEFDL

SEQ ID NO: 9313 - protein, 964 aa, Streptomyces avermitilis
MTETGRHEQQYERYEGGSPEAERQVFERLAREIMEVQVKNQRAQGGGISRTFHAKAPLAVENARLRFHDDLPEALRVGFAQPGADYPATVRLSNASGVQQGDGSPDLRGAAVRVRVSEDESHDLLATSHPVSHARDAREFVAFAKAMAGARSPLQKAFGLFVKLPLAVGLGTANRMRRNVQAAARHTVDSLASETYWSRGAILWGEAGPVRYLLRPAPGSPPPLPCDPNDPDFLHRELAQRLARTDIAFDLCVQRFVDERRTPVEDASVEWQEAIAPAQPIARLTIPGQDLDDAKARTVARRIEDLAFNPWHTTDDFRPLGNINRARKAAYGASSAHRLGLRFSTAEPWQNRLLTPPAGAAFGLLNRVLPWHRLPLRLSLLNLVFLRKALRRFNLIDTEPREAPPKAQPVPEPIPERLRTERSYDGSYDDLSEPGMGAVGAAFGRNVTPDYRPDLFDTPNPVTVSRRLLYRESFQPATSLNILAAAWIQFQVHDWVNHRRHRPGGRTVEVPLPPGSGDWHNTPGGPPENVMRFAENEGLELPGDRPPILFGNVASHWWDGSEVYGEDEQTARFLREPDGGARLRLEDGHLPGGTNGIPLTGFSESWWMGLSAMHTLFAREHNAVCDALRAEYPSMSEERIYRTARLVVSALIAKIHTVEWTPAILATEAIDIGLHTNWQGPPRNWLNKLGLWLFEAHSLTGIPGTRPDHHGVPYSLTEDFVTVYRMHPLIPDDYELREHHFGQRLETVGFLDIQGGAAEAKIRKTGLANTLYSFGIAHPGAITLHNFPRSLQQFERDGEIIDLSVVDLVRTRRRGVPRYNDFRAGLHKKRIRSFEELTRNAETLARLKEVYRSVDEVDTMVGLLAENPPAGFGFSDTAFRIFILMATRRLQSDRFLTVDYRPEVYTPLGIDWVEKGGMNSVILRHCPELASLMPRRASAFAPWRTVQPAANGGPPDNGGPGDNG

SEQ ID NO: 9314 - protein, 485 aa, Streptomyces avermitilis
MEINDLTPAERRVWEAFPRGASVDFRTPDADTEAAEWGPERTVRASVLRALLLTAPQEEGETAALKVAGARITGVLSLMYATIGHVVRLSHCRFEEAPKLHGAQLRQLNLRQSVLPGLASGNVRIDGILRLTDCRVHGPVRLDGAQISRALFLDGARLSAQDDAQPVLQLNQAAIGDDLWAPKLRVRGEVRMNGIHVAGSVNLEDADLSAHAGTALSAETLSVGTDVRARCLRADGRLELRGARIPGRLDLLHARLSNPGGTALRASSCAIRELWLRDGDRIEGVLNLRRAQIDLLTLAPEMLPDEVFLSGLTYTMLTPNEPAERRLPMLDRDGGGYLPSGYEQLSAAYRRIGDDNAARLVQLAKQRRHRATLAWYARIWGHVQDATVGYGFRPLRAAGWLLSLLAVGSIAYGVHPPHPLKASEAPPFNAVFYTLDLLLPVIDFGQERAFSPTDWYQGLSYVLIITGWILATTIVTGVTRTVSRQ

SEQ ID NO: 9315 - protein, 601 aa, Streptomyces avermitilis
VRTSIATVSLSGSLTEKLTAAARAGFDGVEIFENDLLASPLSPEEIRARCADLGLSIDLYQPMRDIEAVPADEFSRNLRRARHKFELMRRLGADTVLVCSSVSPLAEDDDALAARQLRRLAELAADFGIRVAYEALAWGRHVRTYDHAWRIVEAAGHPALGTCLDSFHILARGSDPKGIEDIPGEKIFFLQLADAPQMAMDVLQWSRHYRCFPGQGGFDIAGFLGHVMRAGYRGPLSLEVFNDVFRQAEAGPTAVDAQRSLLALQEATGLATPPAPVVPTGIAFAELVTPDVEPVSALLSALGFGRTARHRSKPVDLWQQGAARVLVNTGPAARRAGTSLAAVGLESPDPAAAARRAEALLAPVLPRRRALEDAPLEAVAAPDGTELFFCAARPELPDWRGDFADLEVDADAPGRAPAHGVTRVDHLALTQPWHQFDEAALFHRSVLGLNAQDSVDVADPYGLHRSRAVTNADGSVRIALSVGPAPTDDGARAQHIAFATEDVVATARRFRAAGGRLLRIPANYYDDLAARYEFADGELETYRELGILYDRDAGGAFRHCYTETVGRVFFELVQRDAGHRGYGAQNAPVRLAAQHAGRPVR

SEQ ID NO: 9316 - protein, 291 aa, Streptomyces avermitilis
VTQDSYLVGLIGSGIGPSLSPALHEREAGRQGLRYHYRLIDIDRLGVGPEAVGGLVRAARDLGFDGLNITHPCKQLVISHLDTLAPQAEALGAVNTVVFEDGRAVGHNTDVTGFAASFARGLPDARLERVVQLGAGGAGAAVAHALLTLGAGHVTVVDALPERAAALAVALNRHFGDGRAAAASPDTLPKLLTDADGIVHATPTGMAAHPGIPLPAELLHPGLWVAEVVYRPLETELLRTARALGCATLDGGGMAVFQAVDAFRLFTGREPDSMRMLADIAELAGTAAVRH

SEQ ID NO: 9317 - protein, 221 aa, Streptomyces avermitilis
MTSVDEPAPPNGRIRDAARTRAEILDVATQEFARAGYDGARVDEIAARTRTTKRMIYYYFGGKEQLFTAVLERAYSVIRQAEQELDVEHLDPVAAIRKLAEVTFDHHEAHPDFIRLVSIENIHGAEHIAASEELGRIGSPALDVTGRILEAGRSSGLFTADVDAVDLHALISSFCFFRVSNRHTFGALFGRDLVAPGRREHYRTMLGDLVIAYLTADRSAD

SEQ ID NO: 9318 - protein, 450 aa, Streptomyces avermitilis
VSVPAAPHDAPPGQPRKAALAAWIGSALEYYDFFIYGSAAALIFPKVFFDESDPADATLLSLATFGVAYAARPVGALFLGHFGDHLGRKKIMVFTLILMGLSTFLIGCLPTRAQVGGLAPVLLVLCRVLQGVSAAGEQASANSMTLEHAPPHRRGYFTSFTLNGTQAGQLLATLVFLPVAALPEDQLLSWGWRVPFWLSVAVAVAGYVIRRTLQETPAFAQQAAADGVAKLPLAVLLREHWADVLRVVAAALIASVSTIFTVWALAYATSDSVGLSRSSMLWVGALANLVALGAIPLWAVLSDRVGRRPVFLIGAVGSAVLMFLYLWAISTGSYPLVLLLGVLTFGVVYSAANGIWPSFYGEMFSTRVRLSGMAIGTQIGFAVAGFAVTFAAQIAGPDGDDWSSVALFASALCIPPIVAALTARETHKVPTELLGERPAQGAANRETVTA

SEQ ID NO: 9319 - protein, 145 aa, Streptomyces avermitilis
MTQDATQDALLKLLSDHLAGVLVTLKRDGRPQLSNVAHAYYPDERTLRVSVTDDRAKTRNLRRDPRASYHVTGPDRRAYTVVEGVAELSPVARDPHDETVEELIRLYRDVLGEHPDWDDFRAAMVRDRRLVLRLRVERAYGIPRG

SEQ ID NO: 9320 - protein, 194 aa, Streptomyces avermitilis
VSMSDEGTGLRARLIEAGVDLVAKEGANALSLREIARRAGVSHGAPRRYFPTHLALLSAIARRGFAELAERATAAVGDGGASPRAQLASLGRVYLDFALDNRGMYELMFRHDLLESNRLGLRDTSLPLFGVLVDLVARARPGADARAVAGSLWANLHGIAQLWGWGSLQLATGAVDFAPLLGTALDAHLGPEDQ

SEQ ID NO: 9321 - protein, 457 aa, Streptomyces avermitilis
VSAHRGLTLTSSVVGAVIVALDGTVLTVAQPTLGRDLHASVAEVQWTSTGYLIAVASLLVFAGRVGDRYGHQRVFAVGMLGFGAASAGIGMAAGIGWVIGLRVVQGVFGALLQPATLGMLRAAYPPDRLGMPIALRTSAIGVAAAAGPLVGGALVTPFGWRSVFFVNVVPALAMGGLALAVRGPERTPPSGRRLDLPGACLLAVALACLVHTLVGIPDGGWTTVSTLGLIAAAVAGTVFVHHERRTPSPLLPPDVLGSAAVGAALGILVAASASMLGTLFVSSYFLQDVLGLTPLETALRALPGPVMMVLAAPASAVLMRRYGPRRTTACAMTLLALGVLVLSRLGEGSGALSIGTGFLLLGAGFGTVMVAATAVVVRQVAAGAAGVAGGLQQTAMNVGPTLGVAAATTLMTYTRVGLAPTLTVLAALAAAGALPALALPGRSGSRSGAPEESLTAS

SEQ ID NO: 9322 - protein, 408 aa, Streptomyces avermitilis
MGHLRQEAEPGEVGLDPKALARLDQHFAHEVDDGRLPGFLVSVSRHGRVAHLTTYGHRDRAAELPVETDTLWRMYSMTKPVTSVAALILMEEGRFGLDTPVAEFLPSFAEPRVYVDGAGPDIRTRPAGQPILIRHLLTHTAGLTFGFYHCHPVDARYREAGIESSVPPGADLAEACEVYAGLPLQFEPGTRWNYSVATNVLGRLIEVVSGRPLDDFFADRVLTPLGMTDAGFCVTPEQASRLAELYGETEDGGIAPVPGLPLHGRPRFLSGSGGLVATAYDYHRFMEFLRRRGELDGVRLLAPRTVAMMTANQLPGGADRRAFGTTVHQEPGSAGLGFGLGVSVVVDPGVTRSPSALGSYGWNGVATTTFWVDPHNDMTVQFLTQVRPTGSHRVYPELKRLIHESLAG

SEQ ID NO: 9323 - protein, 141 aa, Streptomyces avermitilis
MATATEKNAALLRTAYQRLQSGDLDACVELLTENFIANVPGTPDPLHGREIWRLGAQAMLEGFPDLQVDVEDMFSVHDKVAVRVHFRGTHQGTFQGVAATHRPVGFRSIELYRIEGDRIAEEWVAPDLMSLMQQISPPSGP

SEQ ID NO: 9324 - protein, 283 aa, Streptomyces avermitilis
MSGTGEVRGMRAARIAAGAVIPGELALAVCLAAGVRPPVWATAAAEAVALAVLMLEAWVLRSLYASRRAQGLEPPAALRAAVRAVVPARVRRLLVHELRAAASLGRWAARRKHGVRPGDHVAGYTGPQTAMMYGLIFVSVIETVALAVLIPWPVVHRVLLVLDVYGVLMMLGLHAACVTRPHVARPDGSLRIRYGALFDLAVPADAVASVRVDRCYPQGRLVTLSEKGVLDLIVAGQTTVTLELTRPLVFTRPLGGRGEARTIRFHADDPRALVGALRRPALT

SEQ ID NO: 9325 - protein, 244 aa, Streptomyces avermitilis
MRIGEIAALVGVTTRAIRHYHHVGLLPEPERRPNGYRAYSVRDAVLLARVRRLTELGLSLDEVRDVLADDAGRDLADVLEELDADLARQEAEIGERRRRLAVLLAAEPRDTEPLSPALAALLAKTPHPASPAAAKDREHLTLLDAAGSGGQELYAALGPLAADPALLALYERLDALAEAPTDDPRIPALAAELVAAVPDEVFAAISAEGQVVAGFQEALLAEYAPAQAEVVRRVMEAFMRRSRG

SEQ ID NO: 9326 - protein, 384 aa, Streptomyces avermitilis
MSDPVPASGTVHWIGAGLSTGSGLAAVCVAADRVRLWHRTEERAAQALDHLGLAGRAEPRAYTLPALAAELAPGDVVVSMLPAPEHAPLLALCVQGRAHFACSSYVSDAVLDQVPAAAAAGVVVLTEAGLDPGIDHLFAHSLIARAQEAIGSETAAEVSLTSYCGGVPAVPNDFKYRFSWAPAGVLNALRSPARYLDHGAETTTDRPWEATRPHVVDGETFEVYPNRDSVPFIGQYGLPAAWKPQTFVRGTLRLDGWLRAWGAVFEELKAGDDERIAALAAELATTYPTTEEDRDRVVLAVSLEVRSGTGATWSGRYLLDLEGTPEESAMARCVSRTLGLGVRHVLDGDLPAGLNRAAETAQRSEEWLGELRREGIDFALRTDG

SEQ ID NO: 9327 - protein, 369 aa, Streptomyces avermitilis
MTQLHLWLRHESRTTERRTPVVPSDARRLVESGVRLTVEDSPQRIFPTEAYEAVGCEIAEAGSWVSAPPDAVIVGLKELPDEPAELVHRHVFFGHAYKRQPGAEALLRRFAAGGGALFDLEYLVDDDGRRLAAFGYWAGYLGAALAVLHHRGGLGTPLRPTSKEELEAELRSSEGELTALVIGALGRSGRGARVALGEAGVEPTCWDLAETRDLDRPVLLEHELLVNTVLTTRPIPPFLTDKDLDEPGRRLRTLADVTVDVGSPLNVLPVYDTTTDWAHPVRRLREAPPLDLIAIDNLPSLLPREASTDFSAALLPSLLDFGTAESRGRSGGPGVRSGGPWGRCLDRFHEACRELGIELGTDDTEVRDV

SEQ ID NO: 9328 - protein, 381 aa, Streptomyces avermitilis
MNTHADVVVIGGGVMGTSIAYHLARAGVRDVVLVERDELASGSTSRAAGGVRAQFSDELNIRLGARSLEAFGRFGEEPGQDIGLHRVGYLFLLSTPEEVAAFETGVRLQNSLGVPSRMLEPAEARRLSPLITTDGLLAAAFSPDDGHCTPESVVHGYAAAARRHGAKVLRHCEVTGIETRGDDITAVLTRRGRIGTGTVICAAGAWSKAVGAMVGVDLPVRPLRRQIAVTEPVTGLPPGLPMTIDFTSSLYFHTEGPGLLVGMSDPDETTGFSTETHDRWIPRLCEAMERRAPPLLDLRRTGGWAGLYEITPDHNALIGEAGSCSRFLYATGFSGHGFLQGPAVGEVIRDLYLDRVPFVDISPLSVERFAADAPRPEVNRV

SEQ ID NO: 9329 - protein, 326 aa, Streptomyces avermitilis
MTDDDVLYLSSRRVTELLDTDAAIASQRAAFTALGDGTAELPGKIMYPSRFDDSVVFAYVSRLSADTGTVAKFGSVNPGNPAAGLASVHAVINALDPVTGRLVAVMDGTAVTTLRTAAASAVAFDALATADASELGLLGSGTQALAHARAVARVRDLRSVRVWSPNPGRREQAAQRLAAELGVAAKGVDTAEEAVAQVPMVAACTLSRTPVVRGEWLAPGCTVVSVGSFEPTRSEVDAEVLRRAAAVVVDDPGTAADHAGPVVDALRERRLAPDDLIPLGAVVTGRHTARTSPGDIVFYNSVGLGIQDAAAAWAVIAAARGPREHP

SEQ ID NO: 9330 - protein, 230 aa, Streptomyces avermitilis
MTENFGVLGGTAHLSGVERVVNAPLPTVYGDFHAVGYLDHDRGEEQVALVYGEIGDIGGLGGVRGAGEEGVLTRLHSECLTGDAFGSRHCECGPQLTTALREIVAAGRGILVYLRGHEGRGIGLLAKLRAMKLQAEGLDTVEANLALGLPVDARDYGVAAKILHDLGVRSVRLLSNNPRKLESLLQHGINVVEQVPLLIPPCEENITYLRTKRERLDHILPHLDAVARSS

SEQ ID NO: 9331 - protein, 266 aa, Streptomyces avermitilis
MSSSGSQSTVSGLLPQDTTEDVRERGSGAVRQVAVLPVGSFEQHGAFLPLATDTLVACAIAREVAAAYPVHLLPPVTISCSHEHAAWPGTVSISSVTLHAVVRDIADSLRRSGVETLVLVNAHGGNYVLGNVVQESAGSGTRMALFPAPEDWDAARERAGVQTSLLSDMHAGEIETSILLHTHPELVRPGYETTDFLVDDRRHLLTLGMSAYTESGVIGRPSLASAEKGKQLLAGLVDSFEPYFSLVTSESATVTPGTAAADRHRS

SEQ ID NO: 9332 - protein, 499 aa, Streptomyces avermitilis
MTAPADAGPLMTDAAQLTTVRPPEPARPKDGATSVTVSPVASPRTSRATRLRARFASRAVRKHFGTVAGTVILGVLLWRLGTGVFLDGLRRIDAPTLLIGLGIGLLTTVFSAWRWCLVARGLGIRLPLGPAVADYYRALFLNAALPGGVVGDVHRAVRHGQSTGDLGRGVRAVIFERTAGQIALVAIGVPVLLTQPSPVLAQSRHLAELLGLAALGSLAIVAAIRMGRAPRPSRRGRALRAALTEARSALLDRRNWPGVLLSSCVVLAGHLAMFLVAARVAGSAASVARLLPIALLALIAMGLPLNIGGWGPREGVTAWAFGAAGLGASTGLTVAVVYGVLSFVASLPGICVLVVRWYAALKHRRHESPATAERPDEAVDVADEAVDAAHAEGETAAPTGRPRHLVPDAGSTPERTPHALRAPAPHASYPRSPPSRPEVLLTRRHERCRSAAAVPGVTVADSEVTKEKYGSKESTSPASSCFPFSAEASEGRPMTPDSV

SEQ ID NO: 9333 - protein, 318 aa, Streptomyces avermitilis
MSMSTTPTGSPGSTATGAADTDPASGPAPLPAIPAPAGADPEVPRYAPQWLQLREPADAAARAHDLLDPLRIRLANRPGRPRDLVVHDLGCGTGSMGRWLAPRLDGAQHWVLHDRDPYLLHFATVGAPRAAADGSRVTVTTQRGDIGRLTPDALAGASLVTASALLDVLTPDEIDTLAEACVGAGCPALLTLSVVGRVELTPADPMDAEIGEAFNTHQRRGDLLGPDAINAACEAFGRLGATVRVNPSAWRLGAQESELAAEWLRGWVGAAVEQRPELAERADTYLQRRLAACAAGELRVVVHHMDLLALPRPAGGAS

SEQ ID NO: 9334 - protein, 380 aa, Streptomyces avermitilis
VPVQHAALKNAEIIPMSLRTAHFVMPGGVDDPAMPSGGNAYDRRICLDLPGFGWQVHKHLVDGSWPRPGADARAELARTLRELPDGTVVLLDGLVACPVPEIVVPEAERLRLAVLVHLPLGDETGLDPAVAAELDRLERTTLRAVSAVVATSDWAVRRLVSHHGLAPDRVHAAAPGADIAPLASGTDGVSRLLCVAAVTLRKGQHRLIEALATVTDLPWTCSFVGGLGQDPEYVARLRALIDQHGLGDRLHLAGPQAGAELDASYAAADLMVLASYAETYGMAVTEALARGIPVLATDVGGVPEAVGRAPDGGVPGILVPPEDPAALAAELRGWFGEADVRRRLKAAARGRRAALDGWATTARSLAGVLSRLPDTSRRAA

SEQ ID NO: 9335 - protein, 132 aa, Streptomyces avermitilis
LFSITVRDHIMIAHSFRGEVFGPAQRLHGATFLVDATFRRAELDDDNIVVDIGLATQELGGVVSELNYRNLDNEPDFAHTNTSTEFLAKVIADRLAERVHKGALGEGARGLAGISVTLHESHIAWASYERAL

SEQ ID NO: 9336 - protein, 326 aa, Streptomyces avermitilis
MELTGRAFWLRSPGHGELRDVELHKPADGEVLVRALYSGVSRGTETLVFRGGVPESQQAAMRAPFQEGDFPAPVKYGYLSVGTVEYGPRELVGRTVFCLYPHQSRYVVPASAVTVIPDAVPAARAVLAGTVETAVNALWDAAPLVGDRIAVVGGGMVGCSVAALLARFPGVRVQLVDADPARADIARALGVGFALPEDALGECDLVVHASATEAGLTRSLELLAPEGTVLEMSWYGDRRVSLPLGEAFHSRRLVVRSSQVGTVSPSGRPGRTYADRLALALELLAEPAFDALVTGECAFEELPDVLPRLASGELAGLCHRVLYDAG

SEQ ID NO: 9337 - protein, 240 aa, Streptomyces avermitilis
VALNHTYDARLLQQETTVGAGVQILLLALLGSAIGMGPAGWLTGLAFALATWAVLTRAVLRSRLRSFGLANRVTLGRATLVGGVTALVADSFESSPPITLFVGLTAVALILDGVDGKVARHTGTSSALGARFDMEVDAFLILVLSVYVSMSLGPWVLLIGAMRYVFVAAARAMPWLNGELPPSTARKTVAALQGVVLLVAGAGILPQAVTLGAVALALGSLVWSFGRDIGWLWRTNARTA

SEQ ID NO: 9338 - protein, 696 aa, Streptomyces avermitilis
VRTDSHRHPNSPLTAVRNLGILAHVDAGKTTVTERILYLTGATHKRGEVHDGTTVTDFDPQERDRGITIFAAAVSCDWDGHRINLIDTPGHVDFSDEVERSLRVLDGAIAVFDAVAGVEPQSESVWRQADRHGVPRIAFVNKLDRAGADLDTAVESIRQRLHPAPLVVQLPIGTQDGFRGVVDLVRMRSLLWADGRDTVEEGPVPDALRDEADRRRRQLEEAVAELHPVALEEFCAQATVSAQTLTRALRDLTRTGDGVVVLCGSAYRNRGIEPLLAAAVAYLPSPLDVPAVRGTEDGAVRERAADPAAPFAALVFKVTATATGRLTYLRVYSGTIGKGETVLDTGARRSERIGRILRVQADRHTELDRAVAGDIVAVVGPKTARAGSTLCAPAAPLVLEPPTVADPVVSVAVEARSSTDTDRLASALARLAEEDPSLVVRTDPETGQTVLSGMGELHLEVAVEKIRRDRGTAVNVGRPRVAYRETVARGVSGLVYRHVKQDGGAGQFAHVVLDVEPLESAADGGHGGFEFRSAVVGGRVPQEYVRAVAAGCRDALAEGPLGGHPVTGLRVVLTDGATHPKDSSEMAFRTAGRFALREALRASAMLLLEPVAEVTVTAPDDAVGAVLGDLAARRGRVSDSTTRAGASVITATVPLAELFGYATRLRGRTRGRGTFTTRPAGYAPALSTASRRTPVR

SEQ ID NO: 9339 - protein, 629 aa, Streptomyces avermitilis
MPSRTPRTLLTALATVASVALLSTGPALAAPVPQATATAAAAWDADRAAAAYAANPAAVTASGSENGGTAPGLAFDGNASTRWSSNFADDAWIRLDLGTTLRIDRVVLDWETAYGKRYVLEVSKNGTDWAPFYTETAGTGGSVTAHTYPQEVTGRYVRMRGVERATPYGYSLYSFKVYGGEPAPASTTRTNLALNHPAYSNFYQHAGNSPAFVTDGGWPANFKDDASRWSSDWNADRWVSVDLGATSRIDTVDLYWEAAYAVDYQIQVSDDNRTWRTVHQPTAAEIAARRADVKSPGDATGRHDTVTLSQPATGRYVRMLGKERRSFYNPAPATAQFGYSLYEFQVWGTGGSASAAYPALPGEQSGTYQTAFFDDFTTAALDRSKWRVVRTGTEMGSVNGESQAYVDSTDNVRTENGNLVLRAKYCKGCTRAGGGTYDFTSGRVDTNTRFDFTYGRVSARMKLPVGDGFWPAFWLLGSNVDDPSVSWPASGETDIMENIGYSDWTSSALHGPGYSADGNIGARQTYPGGGTADHWHTYAVEWTPTTMRFTVDDRLVQETTRNKLESTRGQWVYDHNQYVILNLALGGAYPAGWNQVTSPYWGLPQTSVDKVAAGGVQAEVDWVRVEQKK

SEQ ID NO: 9340 - protein, 452 aa, Streptomyces avermitilis
VTIDLAALPHDFLWGTATAAYQIEGAVAEDGRSPSIWDTFSHTPGKIDNNDHGDVACDHYHRWREDIGLMKQLGTNAYRLSVAWPRVIPGGDGPVNAKGLAFYDELVDGLLEAGITPSVTLYHWDLPQVLQDRGGWPERATAEHFAAYAAVVAERLGDRVTHWATLNEPLCSAWIGHLEGKMAPGLTDLTAAIRASYHLLLGHGLAAQAIRAAAPAAEVGIVNNLSTIHAASDRPEDVAAARRMDGHVNRWWLDPVHGRGFPADMREVYGVELPEQPGDLATIAAPLDWLGLNYYFPATVADDPTGPAPRVRSVRRLGVPRTGMDWEIDATGIETLLLRLTHEYGPRKLYVTENGSAFPDVVRPDGTVDDPERQDYLVRHLAACASAARKGAPLAGYFAWSLLDNFEWAYGYDKRFGLVHVDYRTQVRTIKGTGHRYADIVRTHRGRARRAA

SEQ ID NO: 9341 - protein, 290 aa, Streptomyces avermitilis
MSSTSSTARSPMAPPRSFLWSRRIFLTLLTGFVLLPVYVMVSSSLKPLADVSGKFRWLPSSLTIRPYIDIWSTVPLARYFVNSLIVAGAATVCSVVIAVFAAYAVSRYDFRGKRVFTVTVLSTQMFPGILFLLPLFLIYVNIGNSTGIALFGSRGGLILTYLTFSLPFSIWMLIGYFDSVPRDLDEAALVDGCGPLGALLRVVVPAAIPGIVAVAVYAFMTAWGEVLFASVMTNDTTRTLAVGLQGYSTLNNVYWNQIMAASLVVSVPVVAGFLLLQRYLVAGLTAGAVK

SEQ ID NO: 9342 - protein, 332 aa, Streptomyces avermitilis
MTTTTASAESGERTVRKNSPGAARGPRRTGRIKRIGLPYLLLLPALLLELLVHLVPMVIGIVMSFKELTQFYIRDWGTAPWSGLDNYQVSVDFDAPVGEALLHSFLVTIAFTLLSVGLCWLIGTAAAIYMQDTFRGRGLLRALFLVPYALPVYAAVITWVFMFQHDNGLVNHVLHDQLHLTDKPSFWLIGDNSFVALLTVSVWKGWPFAFLIVMAGLQNIPGELYEAAALDGAGLWQQIRRITLPSLRPVNQVLVLVLFLWTFNDFNTPYVLFGRTAPEAADLISVHIYQASFVTWNFGTGSAMSVLLLLFLLVVTGVYLLLTSRGRKTADV

SEQ ID NO: 9343 - protein, 438 aa, Streptomyces avermitilis
MRSIRAAAVGAVTMSLALAASACGGGSSTGGGSNDSPKTLTYWASNQGASIAVDKKVLQPELDKFEEQTGIKVKLEVVPWSDLLNRILTATTSGQGPDVLNIGNTWSASLQATGALLPWDAKNFDKIGGKDRFVDSALGSTGAQGKDPAAVPLYSMAYALYYNKKLFADAGIAKPPATWDELIADGKKLSKGGTWGLGAEGSNPSENIHHTFVFAKQHGADFFTADGKPDFTSDGAVTAVKQYVDLMAKDKIIAPGNAEYAQNQSVSDFAKGKNAMLLWQSASSNLKSQGMSDDAYGIAPMPVQSGTPGSGTNVNSMVAGINMAVFKNTHNLDGATKFVKFMTGDAEQKILNTAYSTIPPVKTAQADAAFNTPANAVLKDTLAKSAVALPQVADESQFETAIGTAVKELFADAAAGRAVTTASVKAKLEKAQQQMPKK

SEQ ID NO: 9344 - protein, 432 aa, Streptomyces avermitilis
VAARNGRTVHDLRRENRTAVLQRLYFDGPMSRHSLAPATGLSSGSISNVVAELLADGLVEEAGSVGSDGGRPRTLLRVVPGSGHMIGVDVGETRVRVELFDLSLAELARTERPLAHKGRQAYDVGVIVGHIRDGVAEVLAAAGITAGELLGVGIGVPGIVERSGEGGAVVHGQTIGWDAVPLEHMLRLSGQLPEHVPYFIDNGAKTLGQAEMWFGAGRGAHNAVVVLFGSGVGACVVTDEVEHGRAVEWGHLTVRVQGRRCRCGALGCLEAYAGAEALLARWQEAGGQPPYDTDEETALTAMLAAAYPEDGRAPDPVAAAVLAETAEYLGAGLSDLINLFQPERILVGGWAGLQLGSRFLESVRTHALAYALRYPAGRVGIELGRLGPDAVTVGAAILPLADFFAHGGRRAPAPDAPVPSPAWRTSLDGRLA

SEQ ID NO: 9345 - protein, 599 aa, Streptomyces avermitilis
MSPAPTGSSAERPSIARRTVLGAAAAAASAPALLGLSTPASAAPSSAAPRALPGGGDLGPNVIVFDPSTSGIQAKLDEVFRQQESAQFGTGRYALLFKPGTYNGLNAQLGFYTSIAGLGLSPDDTTINGDVTVDAGWFNGNATQNFWRSAENLALVPVNGTNRWAVAQAAPFRRMHVRGGLNLSPNGYGWASGGYIADSRIDGQVGPYSQQQWYTRDSAIGSWLNGVWNMVFSGVEGAPAQSFPNPVYTTLNTTPVSREKPFLYLSGSEYRVFLPEKRTNARGVTWGNGTPRGTSLPLSQFYVAKPGVSAATLNQALTQGLHLLLTPGIYHVDQPIQVNRAGTVVLGLGYATLIPDNGVTALKVADVDGVRLAGFLIDAGPVNSATLLEVGPRGASTDHSANPTTVQDVFVRIGGAGAGKATTSMVINSRHTIVDHTWIWRADHGTGVGWDTNRADYGIVVNGDDVLATGLFVEHFNKYDVQWYGQRGRTIFFQNEKAYDAPNQAAIQNGSVKGYAAYKVGDAVTTHEGWGLGSYCYYNVNPSIVQHHGFSAPNTPGVKFHDLLVVSLGGQGQYERVINETGAPTSGTSTIPSTVVSYP

SEQ ID NO: 9346 - protein, 381 aa, Streptomyces avermitilis
MRRVIGRAVVTAVAVALTAFLPSTAQAAVSVPPAAARDATCGVLAPGASATAQAAVDAACAQIGVWYSWGGGHGATPGATYGYYDGVDPDSLHDGERKGFDCSGLVRYAYYRATGKDLLNGTSNDQFHSSQASARFSAGQGTGPLLPGDLMFWGSGHIHHVAMYLGGGQMVEAYESGTHIRVAPARTGGDYAGAIRINPSGTVPPPPANGGTTFETWGTSVRTHSTPSVSASVVDTFAGPTQVSVQCQQHAETVTAEGYTNDIWSRLADGSWLTNVYIKGPAELPGVPDCGGSTTPPPTSGSKAFQTWGTGVRTHSEPHVNAGVVDYFAQPTTVNVVCQAHAQEVTADGYTNDAWSKLTDGSWLTNIYIKGPAWLPGVPTC

SEQ ID NO: 9347 - protein, 213 aa, Streptomyces avermitilis
METSDVTCAAVPYQGDRMSPREFDASFTEAMPRLRRRLLAMTGNAHDADDLLQETYLRLSRRARAQTLARQQHPYAYTCAVAFNLLRDSWVHPSRRERTTDRLPEAGWDGGLGSYEASATALALLRVLSPKEAAAVILIDLEGLSHDTAGERLGAHRGTVQRNRMRALAKMRAALGACGTEGDDAVSREEPPVPRPLQGRGRGTGMDHPNSRK

SEQ ID NO: 9348 - protein, 228 aa, Streptomyces avermitilis
VTEIIPLSDARVAGVAEDECGEPLVDLREVAELRLDARQADHDGSYAHLRAGALRRLLQAQRLLPTGVRFLVLEGYRPPQLQRRYFEEYAATMRAAHPDEAPDRIRELTSAYISPPEVAPHVSGGAVDLTLCGADGTELPLGTEVNATPEESEGACRTAAPNISVEARANRAVMDRALTAVGFVNYPTEWWHWSYGDRYWALLRRAPAARYGPTAPPGLRAGGSTPTA

SEQ ID NO: 9349 - protein, 345 aa, Streptomyces avermitilis
VVHCADQGMARAARDLAGALIASSAVLYNQFDAWSRSHAAALEAVRRGGDTEGEAWLLTGLGQLRYEQDKFEESYAYFADALRLFDERGDVPRGAALSLAGMGSARREQARFAEALQLLSSALERYEQTDDVGARARVLYGIGYVHREQGRGAQAWEALSGALGLYRTASDRHGEALTLRSLALCRRADGAWADAERLLHEALRIFVGLQDTFGVMYTEQSLAKVELRRGHLEKARERLGRCLEVARERQDRFGEALVLRTLGEWCLAAGETERAREPLERALAAWEALDLPLWGARTAWDLAEVSASRATNRRRGQPARRRWRPSARWTAGRRGSARTKACRTR

SEQ ID NO: 9350 - protein, 752 aa, Streptomyces avermitilis
MFEVRLLGPVEVWQGNRRAPLGGARPLAVLAALTVHLGEVLSTERLVDFVWDEQVPATATALVATHVSAVRRALARVSEAPVIRTRPPGYVADFSPSQVDARRFEELLALGRSSAARDRPGEAADILSDALSLWRGQEALEGLGQSFARIEAARLAELRLVAQEESFGLRLALGREDETIAPLLAHVAAHPLRERPRGQLMTALFRTGRISDALRTYQEGREVLRRELGIDAGPELRALHQAVLTNDSERLGTGTGTGTGLGTGVRTGLGTGVGAGRKAKAVAAGPAATSSAPPRIPYAQDSTHRIAAPTRFGPEPTGRPAPAPSHLPPDVADFVGRTEQIAWATSLLHGVNNTTRTAPPIGVISGRSGMGKTALAVHVGHRTAELFPDGRLFVDLRASDTAPLQPADALARLLRAMGIDPETSPNGIDDLTGLYRTHVAHRRILLILDNAAGETHLRPLLPPGPGSAVLVTSRRRLVALEGAAHLDLTVPDEPEALQLLKRVAGEERTRSEPDQVAEIVTLCGRLPLAVRIAGARLAARPHWAPGRLAGRLRDERRRLNELRAGDLELRTSLELGYADLDPQERRALRRLALMELPDFAAWIAAPLLDIGTEEAEEAVERLVDCHFIDVLGVDGTGRNRYRIHDLAREHARERCLSEESAEERAAAVPRRCCGWWPAGWGWPRERRPGGPGERPGTFPSRGPYDCSTRRRKRDCWTGPRPGSPPSRPVCWRPWSTAPTKGWPVRPGISPVR

SEQ ID NO: 9351 - protein, 341 aa, Streptomyces avermitilis
MKRTDARHGRAASPAAARDTAAPRRRSRPGRSGVSVLAAMCAVASLALTGCTRDTDRPHPTSPVAKAERTRQSPELTYAEDLRISDAEQHLVKQCMARHGYRFWEERTLTLEESRPVGYVQDDVRWARTHGYGSRIMAKEDRARLRNPNLAYRASLPTARQSTYDTALDGGRTATLLKIEAPGGGTITKRSGGCTGEAEKKLYGDPKTWFRADSTVSNLRPLYVGKLLRDQEFSGAVRDWSRCMRRAGHPYRDPNEARQAMREHGTRQTRAAEARTFAAETRTATADAGCARAASLKSIGKEREAHYVGELSAEYGDALDTYRRLKRAALAHAEQIVPARA

SEQ ID NO: 9352 - protein, 153 aa, Streptomyces avermitilis
MRKLSIALATLGLAALGLAVPATAHASAGCDAKWPGRDGNVRAWKDADCQGELLGVTPGSDPNWGDGAGPFQGSDVNVASSVMNSGYVGGKDVVAFYYLTNYNDTSYGCLKPGELYVDNLGRNHFTNGANMNDNIMSHTWVAASACAPGSFIG

SEQ ID NO: 9353 - protein, 731 aa, Streptomyces avermitilis
LRPDGLPHMDMPPPARVTRALGEHLVSMLLLKLSAQDLLALNSRRRMVPHLAARWKHFRGSDASLSERSAWAESLVDLAKDLVAANRGNVEMIVECAATVDESDRPGAPRLIDVVLIGHHPYTRGLSVQLVELKRWSMVTRVEAATAELVHVPGMGEKKHPAVQLREYFDAFTGARGPLSGLDFECGGFAYLHNATDASVKPLMDLDAPTGAYARMYTNDGRGRLMSDLRKHFAEDGGASAAETLLRSMQLRNTPLLDAMIRSRGEDTVFTLRGRQQEVADQILGTTSLVLGDPNQPALMPDERRVVFLVTGGAGTGKSAIGLQVKAELEANGRTVKYASGSRAFNGAIQEHVGYGDREFRESFTYFSSFVTPPEPPLDVLLCDEAHRLRDRSTSRFWRPEQQGTKPQVDELLEASRLTVFFLDESQSVRPNEVGNVELIENAAKRHDAELVRYRLREQFRCGGSDAYIRWVRAVLGVTDDVAEQWTPDGLMHIEVADSPEELEQVIRSEALAGASARMVAGYCWPWTKPLGKEKRLEADVRIGDWHRPWNADSESFCENGAPPSKIWSVHQDGLEQIGCVYTAQGLEWDWCGVIMGDDMVRRDGKWVFRRGKERKDLEAGVKRVAVPGSFDPKVRASSVDDGGFARLVRHAYHVLMTRASRATVLYSTDEETRVYLKDLVGNVQIHGLRPTWENLPPEARVPHLPRPRRGGRNRSRNRRDKGQPGQKTLF

SEQ ID NO: 9354 - protein, 627 aa, Streptomyces avermitilis
LLFRASAATVAVMALDGSLFLHLTEQFVRMHGYRPGPSEVRSWERSIPALTAALNEASLGDVEVMIEYALPLNSKRADAVLAGLHPATGEPAYVVVELKQWSQAAPDEDDPVLCHVDAYAHPVLNPIEQVRRYCEYLVNFNGAVAEHPQRVSGVAYMHNATEFGASGLREIELDDQGQLFTAERRGEFLDHLRSKLSDKHPGARAADELLAGKTVPSKQLMSVAAQEVQDREQFILLDEQQVAYRTVLNAVRKAKQSDRKEVLIVTGGPGTGKSVIALSLLGELYRQGVPALHATGSQSFTKTMRKVAGARKREVQDLFKYFNSFMTTEKNTLDVLICDEAHRIRETSANRYTPAAHRSGRPQIEELIDVARVPVFLLDEHQVVRPGEMGTVAEIKAAAAKKGFECHVVPLESQFRCGGSDAYLRWVVRLLGLEPGGPVAWDPDDRMQLLVAESPEEMESFLQNRRGQGYGARMSAGYCWTWSKEPKPGDPLPADVVIGDWARPWNLRGERAISGAPPSALWATDPAGFGQVGCVYTAQGFEYDWSGVIIGPDLIWRGDTWVTDRTASKDPVFKKSTLDSDVDRLIRNTYKVLLTRGMVGTVVYSTDPETRAKLRELVGVQREVVAV

SEQ ID NO: 9355 - protein, 513 aa, Streptomyces avermitilis
MAPTLTLKSGTSWSDAWRRCLAVAPEAFRDDRVLNLWGAAWQTDGRALPATSPVDGSPIAGPPRLDGDIAGQAVRASLDQHRAWRHVPLDERRARVAATLDALTEHRELLALLLVWEIGKPWRLAQADVDRAIDGVRWYVDGIEPMVADRAPLDGPVSNIASWNYPMSVLVHAMLVQALAGNAVIAKTPTDGGVACLTLAGALAAREGIPVTLVSGSGGELSEALVRAPEIGCVSFVGGRDTGAAVATDVADLGKRHILEQEGLNTWGVWNYTDWDALTAVIPKLFDYGKQRCTAYPRFVVQRTLFDEFLAAYLPAVRTLRVGHPLAVERREDPYPELDFGPVINAAKAKELNDQVTEAIDRGAVPLHRARLTDARFLPGQDTSAYVQPVTLLNPPPSSPLHHAEPFGPVDTIVLVDTEAELLAAMNASNGALVATLSTDDRATYDRLSPQIRAFKVGHGKPRSRGDRDELFGGFGASWRGAFVGGELLVRAVTQGPAGERLPGNFPEYHLMP

SEQ ID NO: 9356 - protein, 299 aa, Streptomyces avermitilis
MAIYLTKESKVLVQGMTGGEGMKHTRRMLAAGTDVVGGVNPRKAGRAVDFDERTVPVFGSVREGREATGADVTVVFVPPAFAKAAVVEAADAGIALTVVITEGIPVHDAVAFHAYAAAKGTRIIGPNCPGLISPGQSNAGIIPADITKPGRIGLVSKSGTLTYQLMYELRDIGFSTCVGIGGDPVVGTSHIDCLAAFEADPDTELIVLIGEIGGDAEERAAAYVRDHVTKPVVGYIAGFTAPEGRTMGHAGAIVSGSSGTARAKKEALEGAGVQVGGTPTATARLVLARLEAERDVTHS

SEQ ID NO: 9357 - protein, 376 aa, Streptomyces avermitilis
MDLYEHQARELFADHGILVPRAEVTDSSQEARVIARRLGGRVVVKAQVKTGGRGKAGGVKLAADPAAAELTARQILGMDIKGHTVGKVMLAEPVDIEAEFYVSYVLDRAAGRFLAIASAEGGMEIEEVAATRPEAVARVPVDPAEGVTSAKAAEIAEAAGLPPATVDVLVRLWEVLLREDAVLVEVNPLVRTAQGQILALDGKVTLDDNARFRQTRWGAEAAEHGDQLEAAAAAKGLNYVKLDGEVGIIGNGAGLVMSTLDVVAGCGARPANFLDIGGGASAQIMADGLSVILSDPAVKSVFVNVFGGITACDAVADGIVQALDTVRLTKPLVVRLDGNNAARGRAILDGRRHPLVQQVTTMDGAARRAAQLADAG

SEQ ID NO: 9358 - protein, 564 aa, Streptomyces avermitilis
MPDGSSDNNSDLISGGHLVAKALKAEGVEVIYTLCGGHIIDIYDGCVDEGIKVVDVRHEQVAAHAADGYARITGKPGCAVVTAGPGTTDAVTGVANAFRAESPMLLIGGQGAHTQHKMGSLQDLPHVDMMTPITKFAATVPDTARAADMVSMAFRECYHGAPGPSFLEIPRDVLDARVPVSKARIPAAGQYRASTRSAGDPEAVEQLADLLVHAEKPAILLGSQVWTTRGTEAAVDLVRTLNIPAYMNGAGRGTLPPGDPHHYQLSRRYAFSNADVIVVVGTPFDFRMGYGKRLSPDATVVQIDLDYRTVGKNRDIDLGIVGDAGLILKSVTEAASGRLNGGASKRKEWLDELRAAEQTALDKRLPSLRSDASPIHPYRLVSEINDFLTEDSVYIGDGGDIVTFSGQVVQPKSPGHWMDPGPLGTLGVGIPFVLAAKQARPDKEVVALFGDGAFSLTGWDFETLVRYDLPFVGIVGNNSSMNQIRYGQAQKYGLARERVGNTLGDVHYDKFAQMLGGYGEEVRDPADIGPALRRARESGKPSLINVWVDPDAYAPGTMNQTMYK

SEQ ID NO: 9359 - protein, 409 aa, Streptomyces avermitilis
MTKALEGIRVLDMTHVQSGPSATQLLAWLGADVVKLEAPTGDITRGQLRDLPDVDSLYFTMLNCNKRSITLNTKTERGKEILTELIRRSDVMVENFGPGAVDRMGFTWDRIRDINPRIVYASIKGFGDGPYTDFKAYEVVAQAMGGSMSTTGFEDGPPLATGAQIGDSGTGIHAVAGILAALYQRENTGRGQRVNVAMQHAVLNLCRVKLRDQQRLAHGPLAEYPNDDFGDEVPRSGNASGGGQPGWAVKCAPGGPNDYVYVIVQPVGWKPLSELIGRPELADDPEWATPEARLPQLTKMFQLIEEWSATLPKWEVLEKLNAHNIPCGPILSTKEIVEDASLVANEMVVTVPHPERGEFVTVGSPLKLSDSPVDVTSSPLLGEHNAEVYVGELGLGDEELRLLKSNGVI

SEQ ID NO: 9360 - protein, 715 aa, Streptomyces avermitilis
VMAEDRALRVRTLLDTVRAEGRTALTAPEGKVIADAYGIAVPGEELATDVDEAVAYAARFGGPVVMKIVSPDILHKTDAGGVIVGVEGAADVRAAFCRIVENARAYNERARIEGVQVQELLPRGQEVIVGAVTDPTFGKVVAFGLGGVLVEVFKDVTFRLAPVDADEALSMLDSIRSTEILRGVRGAAAVDRWAIAEQIRRVSRLVTDFPEIAEVDLNPVVATPEGAVAADIRVILAESQPKPRRTYTREEILTSMRRLMQPSSVAVIGASNEHGKIGNSVMRNLIDGGFSGEIHPVNPKADDIVGRKAYKSVTDIPGEVDVALFAIPATFVAAALEEVGRKGIPNAVLIPSGFAETGEHELQDEVVAIAERHGVRLLGPNIYGYYSTWHDLCATFCTPYDVKGGVALTSQSGGIGMAILGFARTTKTGVSAIVGLGNKSDLDEDDLLTWFGEDPHTECIAMHLEDLKDGRAFVAAARATVPRKPVVVLKAGRTAAGAKAAGSHTGALAGDDAVYDDILKQAGVIRAPGLNDMLEYARALPVLPTPQGDNVVIITGAGGSGVLLSDAVTDNGLSLMEIPPDLDASFRTFIPPFGAAGNPVDITGGEPPSTYEATIRLGLEDPRVHALVLGYWHTIVTPPMVFAELTARVVAEFRERGIEKPVVASLAGDVEVEEACQYLYERGVVAYPYTTEKPVAVLGAKYRWARAAGLLGGGS

SEQ ID NO: 9361 - protein, 493 aa, Streptomyces avermitilis
VRVGRPGTRAHTKGIGQGALARTFDARGNRDMTTTDLSTSVPYREVTDRNGRVYRIGETDTDLMGRPRTWMVILPWVGMMGISSAEYAFTSAEDTLHEAHLWSSGHIFWLMGVWVFFQAAVAFPAGQLRESGRLPARTAMMIGALGTLLGYLALAFAPNVVVAYVGFGMCSGIGAGLVYATCINMVGKWYPERKGGKTGFVNGGFAYGSVPFVFIFTSVLDLSNYKVVLSCVGVGLCLVVASAGWFFKDPPKSWWPPHVDPLTVTDDPRIRRALAKNPPAVKQYTPKEAARTPVLWMMWFCLLCTAGINIFGIAFQVPFGKDMGFAGGIVATAMSLKAIVNGTGRGVIGWISDRYGRRNTLVVVCLVLGSAQFGVLVSGQMGSMPFFLFCSMVSGFGGGAIFPLFAAMTADYFGENNNASNYGMVYSSKLISGLVGSGLGAVVVGAWDYDGAFVLAGSVGLASAVLALFLRAPGRPRAQHILPNPQPLGEEMA

SEQ ID NO: 9362 - protein, 468 aa, Streptomyces avermitilis
MTADPIAARSASADPGAPNRSYREVTDSRGRVYRVGETDRDILGHSRKFMVYLPWAAMMAISVFEYAYGSAEDTLSHAHGWTQSNTFWILSVWVFFQAGIAFPAGWLREKGVLTACTAMHLGAGMCLVGFLALSHLSNVLLAILGFGVVGGIGSGLVYATCINMVGKWFPERRGARTGFVNGGFAYGSLPFIFIFNYAFDTANYHRVLDLIGCYVMIVVLSSAFFFKDPPKNWWPADIDPLTCSGNGKSAASLAKNPPAVKQYTPKEAIRTGVLPLMWITLVMTAGVSIFGISFQVDFAKEVGFGPLVAASSMGIMAVINGIGRAVVGWLSDILGRKLTLVFVIVVLGLAQFGVIWAGDVKSEWLFLFFAFLSGFGGGAFYPMFAALTPDYFGENYNATNYGLVYSGKLISGLFGGGLGSMVVAAWGYNGAYALAGAISMVAAAIALLLKQPGRNTDRSLTPEPQPAG

SEQ ID NO: 9363 - protein, 334 aa, Streptomyces avermitilis
MPRDFTLFTGQWADLPLEEVCRLARDFGYDGLELACWGDHFEVDRALADPTYLESRHALLDKYGLTCWAISNHLVGQAVCDALIDERHRAILPARIWGDGAAEGVRQRAAAEIKDTARAAAAFGVDTVIGFTGSAIWHLVAMFPPVPESMIDRGYEDFAERWNPILDVFDAEGVRFAHEVHPGEIAYDYWTTQRALAAVDHRPAFGLNFDPSHFVWQDLDPVGFLYDFRDRVYHVDCKEARKRLDGRNGRLGSHLPWGDPRRGWDFVSAGHGDVPWEDVFRMLGSIDYRGPVSVEWEDAGMDRLQGAPEALTRLKAYDFEPPSASFDAAFGGND

SEQ ID NO: 9364 - protein, 402 aa, Streptomyces avermitilis
MGQPHPRDEADAGKPPLGIGMVGYAFMGAAHSQGWRTVGRVFDLPSRPVLAAVCGRDGQAVRAMAERHGWAAAETDWRALIARDDVDVVDICTPGDSHAEIAVAALAAGKHVLCEKPLANTVEEAEAMAAAGEQAYRQGRLTMVGFNYRRLPATSLARRMVREGRLGTLRHVRVTYLQDWLVDPEFPLTWRLRREVAGSGALGDLGAHIVDLAQYLAGEPLAGVSALTETFVRERPLPGGTTGGLAAVSAGGLGTVTVDDAALFTARFASGALATFEASRFATGRKNSLRIELNGERGSLAFDLERLNELAYHDHTEPLAHAGFRRILVTEPDHPYLEAWWPPGHGLGYEHTFVHQARDLVHAIAANHRPEPSFADGLQVQRVLAAVEESAAKNSVYTPVVV

SEQ ID NO: 9365 - protein, 349 aa, Streptomyces avermitilis
MPEPTPVTSRRGLLFGTAAVSAGALLVGCTSNDTTSEKPAANDRSAADDKPGKHVTIGFAGPQADHGWLNAINDNAKSRAKKYGDVTLEITEGSNDTAAQIGQIETLINKKVDVLVVLPADGKALTQVGLKAMRAGIPVVNLDRIFNSPQAYRCWIGGDNYGMGLSAGRYIGEKLKDKPNARVVELAGLDNLELTKQRTQGFDAALKNYPNIRKVARQAAEFTVESGQSKMAQLLQAQSRFDALWNHDDDQGVGALRAIKQAGRDDFLMVGGAGALSAFQAIKADDGVLKATVLYPPTMAASAIDLARALGQGKGVGGLAEFEIPASLTLYSAVVDKDNVGQYMSTGFR

SEQ ID NO: 9366 - protein, 339 aa, Streptomyces avermitilis
MTQPVSPPRGGTGQASPVSELPAWRSLAARADVRTLSLLGVLAALVVIGGITKPDEFLDTRNLQLVLTQASVIGVVTVGMTFVITSGGIDLSVGAIVALASVWATTVATQEYGFAGILFTAMIVGVGCGLVNGLLIAYGGLVPFIATLAMLASARGLALQITDGRTQIVTVDTVLKLGERDSYLLGIPPLVLVFAVVTVIGWLILNRTTFGRRTVAVGGNAEAARLAGIDVRRQRLYLYLLSGLCCGIAAFLLIILSGSGQNTNGNLYELDAIAAAIIGGTLLSGGRGTITGSVLGVLIFTTITDIFALNNLQSDVQQIAKGAIIVAAVLVQRRTASTT

SEQ ID NO: 9367 - protein, 512 aa, Streptomyces avermitilis
MAPEPPLLTMSGITKSFPGVRALDGVDLDVQAGEVHCLLGQNGAGKSTLIKVLAGAHQPDDGRLCWRGAPVTLRSPIAAMRLGIATIYQELDLVEGLSVAENVHLGHEPTTAGFVVRGKAARASTAALLKRLGHPEIAPSRLVGDLSAAQQQIVSMARALSHDVRLIVMDEPSAALDPDEVDNLFRIVGDLTADGVAVVHISHRLEEIRRIGDRVTVLKDGRAVAGGLPAKSTPTREIVALMTGRDVEYVFPDRPPAPAPATSDPLLKVQGLAREGEFEPLDLELRPGEIVGLAGLVGSGRSEILETVYGARKPSAGQVTVAGRALRPGSVRAAVRAGLGLAPEERKTQALLLLESVTRNVSLSSMSRFAHGGWIDRGAERDAARAATRELSLRPDRPSAPARTLSGGNQQKAVLARWLLRGCRVLLLDEPTRGVDVGARAELYAVIRRLADEGLAVLLVSSEVPEVLGLADRVLVLREGRVVHRAPARELDEHRVLDLVMEGSPVEGTPAS

SEQ ID NO: 9368 - protein, 396 aa, Streptomyces avermitilis
VRRMTARPANAHQARLLRLLRDDGPNSRAQLGDRIDLSRSKLAVEVDRLLETGLVVADGLAASRGGRRSHNIRLAPALRFLGVDIGATSVDVAVTNAELEVLGHINQPMDVREGPVAVFEQVLAMAAKLRASGLAEGFDGAGVGVPGPVRFPEGIPVAPPIMPGWDGFPVREALSQDLGCPVMVDNDVNLMAMGEQHAGVARSVGDFLCVKIGTGIGCGIVVGGEVHRGVTGSAGDIGHIQAVPDGRPCACGNRGCLEAHFSGAALARDATEAAQQGLSEELATRLAAAGTLTAVDVAAAAAAGDATALDLIREGGNRTGQVIAGLVSFFNPGLVVIGGGVTGLGHTLLAAIRTQVYRQSLPLATGNLPIVLGELGPTAGVIGAARLISDHLFSPA

SEQ ID NO: 9369 - protein, 224 aa, Streptomyces avermitilis
MLSAGLPQGTVPKLERPGPLRDRVYEALLELITTRALQPGQHLVESELAGHLGVSRQPVREALQRLNTEGWVDLRPAQGAFVHEPTEDEADQLLTVRTLLEAEAARLAAANAGTAGITALEELCAQGERAVADDDVDGAVAMNARFHTKVMELAGNAVLAELAAQVDRRVRWYYTPVARQRGRQSWIEHRDLIDAISARDERRATEVMRAHTEHTRKTYHEREK

SEQ ID NO: 9370 - protein, 315 aa, Streptomyces avermitilis
MNGSRIAAVGHYQPAKVLTNEDLASLVDTSDEWIRSRVGIRTRHFAGPDEPVDELAGHAAAKALASAGLAPADIDLVLVATSTAEDRSPNMAARVAARLGIPSPAAMDINVVCAGFTHALATADHAVRAGAATRALVIGADKMSAVTDWSDRTTCVLVGDGAGAAVVDACPEGAEPGIGPVLWGSVPEMGHAVRIEGTPPRFAQEGQSVYRWATTQLPAIARRACERAGLTPADLAGVVLHQANLRIIEPLAAKIGAVNAVVARDVVESGNTSAASIPLAFSKLVERGEISTGDPVLLFGFGGNLSYAGQVIRCP

SEQ ID NO: 9371 - protein, 443 aa, Streptomyces avermitilis
MSPPVAPAGWSRWLVPPAALSVHLSIGQAYAWSVFKPPLESALGLSGTQSALPFQLGIVMLGLSAAFGGTLVERNGPRWAMTVALVCFSSGFLISALGAATEQYWLIVLGYGFVGGIGLGIGYISPVSTLIKWFPDRPGMATGIAIMGFGGGALIASPWSTQMLESFGTDSSGIAQAFLVHGLVYAVFMSLGVLLVRVPRTERPVEGAPSAFQGPQVSARDAVRTPQFWCLWVVLCMNVTAGIGILEKAAPMITDFFADTSTPVSVSAAAGFVALLSAANMAGRIGWSSTSDLIGRKNIYRVYLGVGALMYALIAWFGDSSKPLFIVCALVILSFYGGGFATIPAYLKDLFGTYQVGAIHGRLLTAWSTAGVLGPLIVNWIADHQKEAGEHGSSLYGLSFLIMIGLLVIGFVANELVRPVHARHHIPAPREAADVQRQQPESA

SEQ ID NO: 9372 - protein, 323 aa, Streptomyces avermitilis
VKVAVLGAGAIGAYVGASLQRAGADVHLIARGPHLAAMRRHGVRVLSPRGDFTARAHATDDPAEIGPVDFVFLGLKANSYAACGPLIEPLLSDTTAVVAAQNGIPWWYFHRHGGPYDGHRVESVDPDGAVSAVLAPERAVGCVVYAATELEGPGVVRHLEGTRFSVGEPDRSVSVRCGAFSEALRAGGLKCPVEPDLRNDIWLKLLGNISFNPISALARATMRQMCLHGGTRRVIEIMMTETLTVAEALGCEVGVSIERRLAGAERVGDHRTSTLQDLERGKPLELDVLLGAVVELAEITGVEVPTLRTVHALSDLLAARTAA

SEQ ID NO: 9373 - protein, 641 aa, Streptomyces avermitilis
MTKRDRTPKTYTRLTHPLVRDSRDEPLRRATWEEALDRAARGLDAARGAFGMFSCARATNEMNYVAQKFARVVMGTNNVDSCNRTCHAPSVAGLSAAFGSGGGTSSYEETEHTDLIVMWGSNARFAHPIFFQHVLKGIRNGARMYAVDPRRTSTAEWAESWLGLNVGTDIPMAHAIGREIIHAGLANETFVERATSGFEEYRALVEPWTLSLAEKVTGVPARAIRELAHAYARAERAQLCWTLGITEHHNGTDNVRALINLSLLTGHVGRYGSGLQPLRGQNNVQGGGDMGAIPNRLPGFQDILDPDARLKFESAWDTVIQPHYGLNLTEMFEAMEEGTLRAVYCIGENPAQSEADSERAVRRMRALDFLVVQDIFLTRTAELADVVLPATAGWAETDGTTTNSERRVQRVRRAVTPPGEAREDIDILCALAARLGHDWKYADAEAVWNELRSVSPDHYGMTYERLAEHQGIQWPCPAPDRLEPPYLHGRLWSSDPAGRGRLAPFGIVQHDPPVDLTDEEYPIRLTTGRRLDSYNTGVQSGGFASPLRRGEFVELCPEDAERYGVVVGEQVQVASRRGAVVAPVWIDPALRPGLAFMTMHFPDEVDTNRLTIEANCPIAGTAEFKASAIRIEKLPVTAVRS

SEQ ID NO: 9374 - protein, 607 aa, Streptomyces avermitilis
MDLHFGDSKPSDEERAAVDALLGPPESSWEGADRSDADLRWARGGRAARDRRDLLLPGLHAVNDRIGWISEGALDYLCRRLTVPPAEAYGVATFYSMFAVKPRPATVLHVCTDLACASAGAAELCAGVEARLGPGSGVGVERGPCLGLCERAPAALAVRAGDPVRTAVSAPATVEAAVLAASAPDSAPEEPSAALAVPQAGQDGLVLLRRVGVVDPASLDDYRAHGGYAALRRAFELGPAEVIREVTDAGLVGRGGAAFPTGRKWQATASRPDRPHHLVCNADESEPGTFKDRVIMEGDPYALVESMTIAAYAVGAHQGYLYLRGEYPRALERMSHAIEQARARGLLGDDVLGQGYAFDIEIRRGAGAYICGEETALFNSIEGYRGEPRSKPPFPVEKGLFGRPTAENNVETLVNVLPVLTMGAQAYAAIGTAKSTGPKLFCVSGSVDRPGVYELPFGATLGELLELAGVRERLRAVLLGGAAGGFVRPDERDIPLTFEGTRQAGTTLGSGVVMAFDDTVPLPRLLLRIAEFFRDESCGQCVPCRVGTVRQEEALHRIVARTGAAAADDIALLREVGRAMRDASICGLGQSAWNAVESAIDRLGAYE

SEQ ID NO: 9375 - protein, 286 aa, Streptomyces avermitilis
MTAIPLGVPRRLVEFTVDGQEARVPEGSTILDACRAAGKDVPTLCQGDTLTPKNACRVCVVEVEGARTLVPACSRGAEPGMEVRTDTERARHSRRLVLELLASSVDLSTTPKAAGWIKEYEAKPDRFGPDAARLNEEPKVDNDLYVRDYDKCILCYKCVDACGDQWQNTFAISVVGRGFDARIAVEHDAPLTDSACVYCGNCVEVCPTGALSFKSEFDMRAAGTWDESAQTETTTVCAYCGVGCNLTLHVQDNEIVKVTSPHDNPVTHGNLCIKGRFGYQHVQNRD

SEQ ID NO: 9376 - protein, 282 aa, Streptomyces avermitilis
MGRVTERRKVIRIRDGAVSTRPDTLVAEEPLEIRLNGKPLAITMRTPGDDFALAAGFLVSEGVLGEADELQNIVYCAGATVDGSNTYNVVDVRTAPGVVLPDITLERNVYTTSSCGLCGKASLDAVRTTARWTIDDTPPVRLEPELLASLPDRLRAAQRVFDRTGGLHAAALFTEEGELVDIREDVGRHNAVDKLVGRALQSGSLPLSRTVLLVSGRASFELAQKAVMAGIPVLAAVSAPSSLAVDLAAESGLTLVGFLRGASMNVYAGEHRIALRAAAAQG

SEQ ID NO: 9377 - protein, 185 aa, Streptomyces avermitilis
MTAPVPAAEPRLALDPARTALVLVDLMDRIVGLPVEPRKGVEVLSVAEGLAAGFRSAGALVVLIRVERPGLAEQPPGSGLVAGLAADGDLEIVKRTIGGFQGTALDEQLRERGISTLVFGGIATNLGVESTARAAGDLGYDLVFVEDAMAALTAAEHDASVRLDFPRLGTVVTAAEVHFASGEVR

SEQ ID NO: 9378 - protein, 144 aa, Streptomyces avermitilis
MSAPLPAIRTLPSWLLGRAAARGRGLVAEALAAEGMKMWHHVVLSAVADLGPVAQAELGRSIQLDPKDLVGVLNDLQSAGLIVREPDPKDRRKNAVSLTGEGTRLLKRCEKAARAANDALLAPLEAAERDQFMSLLIRISGTDG

SEQ ID NO: 9379 - protein, 238 aa, Streptomyces avermitilis
VSPVSRRATASPVSASDTVTPTTPSCTKPWATPVPESASPVDAVALVRSGLVALGALEAARPRPGESALVTAAAGGVGQLAVQLARLRGASRVVGAVSAPGKAAFVRGLGADDVITYDADAWGEPVDYVLDAVGGELLTPAIAALAPGGRLVAYSSGGGTVQAYDLLVSAKSVIGFQMARIARGEPQLYERWRRELWRLFTDGALRPAVHGEFDLADAAKAHEVIESRSNLGKVVLRT

SEQ ID NO: 9380 - protein, 126 aa, Streptomyces avermitilis
VYSASRAHPHPRGLVTPGEFHRATSARPVVRVGGSYLDAGTTLLGSLVACAGVLGAAVVAYLGKRGENALNGFSSLTDKLQSERDRLERQVAERDSRIVELSTLHAADQSEIARLRLDVHRLGGAP

SEQ ID NO: 9381 - protein, 625 aa, Streptomyces avermitilis
MPSTLRARIASTLTAVLTTAALLALPSPAGAEQATDTGEFEQQVLFKASQDPGYACFRIPAVVKTTDGTLLAFAEGRVLNCGDAADIDIVLKRSTDGGRTWGPLQVVNEGGGDTHGNPAPVVDRETGRIVLAETYNTGRTDSAGCTVPCDRTPHLQYSDDDGLTWSRPRDLSDEILPPEWNSWYATGPVHGIQLTRGRHAGRLVLGVNTETWDGSRVSANHAALITSDDGGDHWRIGATDSWPIAADGTFRQKPSEMTLAERTDGSVLVSGREQDGTDLGHRTQAVSRDGGSSFTAPFRDLPDLYTPQVQGSSLRLGDRLLLACPGDPDRRRTMTIRSSYDGGRTWDSVDRGTVVTTDWSGYSDLVRVGRDTVGLMYEGGAVDARDEIRFARFTEDWLKPRRGPDPTTPDLAPHAKGAAVLGGAEQTEGVFGGALDFDGADDAVRLPYRAELPLGTKDFTASLWFRYTAATGEQPLLWMGGIGTSQPQVWLRGEPASNRVQGLITVRDGASAPQSAFVRTTGAYNDGQWHHLALRRGGGALTLFLDGTPISTADVPGSVSRNSPFGVHIGQRMDSRAYFTGSIDEVRVYGRALSDAEITGLRTDNEASARDTVLRLPMDRVSGSH

SEQ ID NO: 9382 - protein, 410 aa, Streptomyces avermitilis
VPDDARARRRTGTGLGVLLALVCTAVLLTALPDHHRESGGCAARTVESWRPDTELTGEFARYGDDATRADDWTGGDGTHSVRLPDGRVLWLFSDTYLGQVHGPPNPVGESYAWRDTSAPLVRNSAVVMTGAGRLSATLPAPLFPDPAAGQWRWPVAARVEPRSPGSSEQVVRVLLWTRTTGAYPWIYGVPTATEVATLSLPDLRVEGITQVLDQRQVPDPAHRVLFGTTAVTGDGDWTYVFGGDDGQAASRPASKAYVARVPRGRLAEPGAWEYWDGSAWRAHARPAAMLGDGRGTGVGSAFTVVRDGPTYVLFTMAAGTRGLTTVTSYWACSPAGPWHGPARGFSPPLPQGQVAAYNPQAHPVLGGDGRLVLSYDVNWLDTTGASAQANLSRNVSLYRPRFVSLRLTPG

SEQ ID NO: 9383 - protein, 346 aa, Streptomyces avermitilis
VKRLRWPSWIPVDPYILLLLGTVGLAALLPARGTAADVASGASTAAIAFLFFLYGARLSTREALEGLKHWRLHVTVLACTFVVFPLLGLAARGLVPALLTQPLYTGLLFLTLVPSTIQSSIAFTSIARGNVPAAICAGSFSSLAGIVVTPLLAAALLGNSGGGFSADSLVRIVLQLLVPFLAGQVLRRWIGGFVLRHKKVLGLVDRGSILLVVYTAFSEGMVQGIWHQVSAVRLAGLLVVEAVLLAVMLALTWYGGKALGFGREDRIAIQFAGSKKSLASGLPMASVLFGAHASLAVLPLMLFHQMQLMVCAVIAKRRARDPERSAVTPESAAGTRTAVGTGTRSG

SEQ ID NO: 9384 - protein, 289 aa, Streptomyces avermitilis
MYDPSQLRTFLAVAQTLSFTQAARRLGLRQSTVSQHVRRLEDTAGRQLFSRDTHSVELTEDGEAMLGFARRILEVHEQATAFFTGTRLRGRLRFGASEDFVLTRLPEILEGFRYDHPEVDLELTVELSGTLHEQLAAGKLDLVLAKRRPQDPRGELVRHDRLVWIGAERLRLDPDRPVPLIVYPPPGITRALALEALEKQGRSWRVVCTSGSLNGLIAAARAGLGVMAHSRGLVPPGLVRVPERAGLPELGEVDFVLVHGRRRGPTQGAAEALAAAILAGGDRLHRGRT

SEQ ID NO: 9385 - protein, 325 aa, Streptomyces avermitilis
LERESDAFDALDLQLLAALELAGRAPFSRIAAVLGVSDQTVARRYRGLTAEAGLRVVAVRDAERLGQDQWMLRLRCTPDSSGAIAEALAKRPDTGWIGLASGGTEVACMSRPRSRGDQDDLLLGKLPRTPSIVEIRAQQLLHRFYGGPTGWIGKFSALTDDQIAALRPEVPAASGPARIAPEDEPLVAALERDGRATYPELQRATGRSESAVKRSLAALLASGAVYIDIEYHSEILGYSLAALLWITTSPGALHSVGEALATHDEIAYASATAGPSNIVATAVVRDTGALYAYLSGRLGHLEGVQHVETTPFMRRVKQLTYRMPG

SEQ ID NO: 9386 - protein, 494 aa, Streptomyces avermitilis
MRTWGPLTAVCLGTFMLLLDVTIAVVALPDMARALHASLSDLQWVMDGYALALAALLLGLGAAADVLGRRRVHVAGVVLFAVASLLCGLASGPGMLVAARGVQGIGAAAMFATTLPLLGSVYQGRRRSAALGVWGAVSGAAAAVGPVLGGLLTDGPGWRWIFFVNLPVSVVAVWLTLRVVPESRGPRGRRIDWAGTVAFAGFAGALTYGAVRAGSEGWAEAGTLVSFAAAAGALGCFVLIERRTADPLLDLSLFRKPAFLGVMVGALAFNAAAFGVMPYLSIWLQTLLGMSPVRGGLVFLWLSAASFVVAAVGGRLLHGVPSRLTIGGGLLLIGSGLFCQAVLDAGATATALIPGLILVGVGTGLVAPGIAGAALAAVPLERAGMAGGAVNTFRQLGYALGIAVFGTVLTSRMQNALPRDAAHTLAGGGAGALRGTLSEHALRAAFASGLDAASVAAGVTATAAGALVLVLVRTPRPAPDAAGAPAQEVAAHRG

SEQ ID NO: 9387 - protein, 608 aa, Streptomyces avermitilis
LREFTNPPLASAPPVGGLADVVFDHALEDPLHVALGRKDEQGTWRDVTAAEFRDEVLALAKGLLAQGIRFGDRVAIMCRTRYEWTLFDFALWTIGAQVVPVYPTSSAEQVFWMLHDAQVSAAMVEHEDHAMTIATVIDRLPQLHRLWQLDVGAVQELYESGAHLEDEVVHRHRRAVTPESVATIIYTSGTTGRPKGCVISHANFMFEADTVIERWEPVFHSKRGDEAATLLFLPLAHVFGRMVQIAAVRGRVKFGHQPQLNAAALLPDLAAFKPTFFLAVPYIFEKVFNAARRKAEREGRSGAFEKAVEAAVKYADAVEAKAWGIGPGPSAALRMQHQVFDKLVYAKIRAAMGGRVRHAMSGGSAMDRRLGLFFAGAGVYIYEGYGLTESTAAATANPPERTRFGTVGQAIPGTTVHIADDGEIWLNGGNVFQGYLNDPKATDATLHDGWLATGDLGSLDEDGYLTITGRKKEILVTSGGKSVSPGVLEERVRDHPLVAQCIVVGNDRPYIAALVTLDSEAVEHWLQMHDKPQLTPAELVRDAELETEVRRAVVAANTLVSQAESIRTFRILAHQFTEEHGLLTPSLKLKRKAIENAYATEVEALYRA

SEQ ID NO: 9388 - protein, 278 aa, Streptomyces avermitilis
VSTKVPPITLNNGVEMPQLGFGVWQVPDDEAERAVATALEAGYRSIDTAAIYGNEEGTGKAIATAGIPRADLFVTTKLWNSDQGYDSTLRAFDVSLEKLGLDYIDLYLIHWPLPTRGQFVETYKAFEKIYADGRAKAIGVSNFLPEHLRTLIDATSVIPAVNQIELHPHLQQHAAREFHAEHGIATEAWSPLGSGKGLLEVPAIVAIARKHERTPAQVVLRWHIQLGNIVIPKSVTPSRIKENIEVFDFSLDDEDIAAISALNEDRRLGPDPATFDMG

SEQ ID NO: 9389 - protein, 233 aa, Streptomyces avermitilis
VRTRTLTLAAAAGAALLATAALPATASPSGTKAPASAQEGSVSAASLLAKVTSCSQISNGKYKTDDETSATIPVCGKNGAVFWKADMDIDCDGQVTGKCNGTTDPWFQDDTAFHQSDGKPLRADSLPYVVVPSSSSIWNYASAGIKGGGVVAVIYNNKVEYAVVGDTGPTKIIGEASYATAQALGIDPDPETGGTDSGVTYILFKNSQVSPIESHSAAVSLGDSLAKQFLQNN

SEQ ID NO: 9390 - protein, 233 aa, Streptomyces avermitilis
MTDSPVALITGGGSGIGAAVARRLLDAGHRVTVTGRGEERLRGFAEELGRPEGLLTVAGNAAEYEHVQAAVEATLKEFGRLDTVVANAGFATHDTVAEGDPAGWSEMVLTNVLGPALLIRASVDALKETRGRIVLVGSVAGHVNTPGNIYGATKWAVTGLAENTRRQVTEFGVGVTLISPGRVETPFWDSYGSLPPGQLLTADQLAESIVWAIGQPSGVDVNTVVVRPIGQPV

SEQ ID NO: 9391 - protein, 292 aa, Streptomyces avermitilis
MAHHHDHPQHDHTEIDFAEWLPLLEQEAELFTPLYARAAAWLRERQPEPELIVDAGSGPGVISCLLADTFPRARVVAVDGAEPLLERARARADRLGVADRFTTVQAELADGLGNVEYPADLLWASRSLHHVGDQRAALSGFARGLAPGGMLALLEGGLPARFLPRDIGIGRPALQSRLDAVQEEWFTEMRAALPGAVTETEDWPALLTAVGLRHIATRTFLLDLPAPVSEEARAFVVTSLTHRRDKLADGLDADDLATLDRLLDPGDKASLHHRPDVFLLTAHTVYVAVKAG

SEQ ID NO: 9392 - protein, 569 aa, Streptomyces avermitilis
MSRTRTAILAALALVAGASGTAVAAVAPEPGIAAVPCTVDYKVQNQWDTGFTTAVTVTNNGAAKSSWAVKWSYAGNQKVTSGWNARISQSGTAVTAANESYNGALASGGSVSFGFNASYSGTNALPTAFTLDGVTCNVDDGGGGGGGTDPDPSGKVDNPYAGAKVYVNPEWSAKAAAETGGSRISSQPTGVWLDRIAAINGVNGGMGLRAHLDAALAQKGSGEEVVQLVVYDLPGRDCAALASNGELGPTEIDKYKTQFIDPIAAILADSKYAGLRIVTTIEIDSLPNLVTNTGSRATATPACDTMLANGNYVKGVGYALNKLGAIPNVYNYLDAGHHGWIGWDDNFAPSATLFKQAATSEGATVDDVHGFITNTANYSALKENNFTINDSVNGTSVRQSKWVDWNRYVDELSFAQAFRTQLVSVGFNSGIGMLIDTSRNGWGGTARPTGPGATTSVDTYVNGGRYDRRIHVGNWCNQSGAGLGERPQAAPATGIDAYVWMKPPGESDGSSSAIANDEGKGFDRMCDPTYTGNARNGNSMSGALPNAPLSGHWFSAQFQELMKNAYPAL

SEQ ID NO: 9393 - protein, 492 aa, Streptomyces avermitilis
MRHPPRSALLLVAGAVALIGSAVVPVVTASGATTPACTVEYAVTSQWDAGFQGGVKITNNMAALSSWRLTFDFAGGQKVTQGWNAKWSQSGTTVTAANESYNGSLGSGASVSAGFLASWSGSNAVPTSFKLNGTTCNVEAEPSPSPSPSDPPATGAAPKLHVSGNKLVDADGKTRRLLGVNRSGGEFMCVQGYGIFDGPVDDAAVKAIADWKANTVRIPLNEECWLGLSNIKPEYGGANYIAAVKDLVARVEAHGMTPVVELHWTYGQYTGNSAGCSDVHATCQKPMPDAQYTPSFWASVASTFKDDAAVAFDLFNEPYPDRATSTTTQAWQCWRDGGTCPGITYEVAGMQDLVDAVRGTGAKNLILAGGLAYSNDLSQWLTYKPTDATGNLVAAYHVYNFNTCASETCWNSTLAPVAAQVPLVAGEIGENTCSHSFIDTVMKWFDDRGLSYLGWTWNTWDCSSGPSLISNYDGTPTSFGIGLRDHLRALNG

SEQ ID NO: 9394 - protein, 973 aa, Streptomyces avermitilis
MASRRRRRTVRRLWTAVVAALALPVTTLATGISAPSAQAAALQCSVDYKTNDWGSGFTTDVTVTNRGTDPINGWTLTYAYTGNQTLTGGWSGTWSQSGKSITVKNASYNGTIAAGAAVNTGAQFSYSGTNTSPTGFAVNGTTCAGAHQPPVTVLTSPTAGAVYTQGDAVPLVATAAAADNATISKIEFYDDTTLLGTDTSSPYTLSAAGLSVGGHSLIAKAYDSLGASAESTPVGITVASGPAVVASPTQLGVQQGKSGTFAVKLSTQPSANVTVGVTRTDGNTGLSVTGGSSLTFTPANWNTAQTVTITADASGTGSATFTALATGHTKATVTVTELAGSKAYDARFLDLYGKITNPANGYFSPEGIPYHSVETLIVEAPDQGHETTSEAYSYLLWLQAMYGKVTGDWSKFNGAWDLMEKYMIPTHADQPTNSFYNASKPATYAPELDTPGEYPAKLEPGVPAGSDPIASELKSAYGTDDVYGMHWLQDVDNVYGYGNEPGKCEAGPTATGPSYINTFQRGAQESVWETVPQPTCDAFKYGGTNGYLDLFTGDSSYAKQWKYTDAPDADARAVQAAYWADVWAKAQGKGGDVSGTVGKAAKMGDYLRYAMYDKYFKKIGNCVGPSTCAAGTGKDASHYLMSWYYAWGGATDTSAGWAWRIGSSHTHGGYQNPLAAYALSSYADLKPKSATGQADWAKSLDRQLEFYRWLQSSEGAIAGGATNSWAGRYATPPTGTPTFYGMYYDQQPVYHDPPSNQWFGFQAWSMERVAEYYQQTGNANAKAVLDKWVGWALSKTTINPDGTYRIPSTLQWSGSPDTWNASSPGANTGLHVTVADYTDDVGVAAAYAKTLTYYAARSGSTAAKTTAKALLDGMWNNYQDSLGVAVPETRTDYNRFDDSVYVPSGWTGKMPNGDAVNSSSTFTSLRSFYKNDPAWSKIESYLAGGAAPTFTYHRFWAQADIALAMGSYAELLE

SEQ ID NO: 9395 - protein, 882 aa, Streptomyces avermitilis
VRRTRIFTAVLALAAGLPAGTPPALAASAPTATIAADTYSWKNARVDGGGFVPGIVFNRSEKNLAYARTDIGGAYRWAESSKTWTPLLDSVGWSDWGHTGVVSLASDSVDPNKVYAAVGTYTNSWDPGNGAVLRSGDRGASWQKTDLPFKLGGNMPGRGMGERLAVDPNRNSVLYLGAPSGKGLWRSTDSGASWSQVTDFPNVGTYVQDATDTSGYASDNQGIVWVTFDESTGSPGSSTRTVYVGVADKDNSVYRSTDAGATWSRLAGQPTGHLAHKGVLDAANGCLYLAYSDKGGPYDGGKGQLWRYTTKTGTWTNISPVAEADTYYGFSGLTVDRQHPGTVMATAYSSWWPDTQLFRSTDSGGTWTKAWDYTSYPSRSNRFTMDVSSSPWLTWGANPAPPEQTPKLGWMTESLEIDPFDSARMMYGTGATVYGTDNLTNWDSGSQFTIKPMARGLEETAVNDLASPPSGGAQLFSALGDIGGFRHTDLTTVPSLMYTSPNFTTSTSLDYAETDPGTVVRVGNLDSGPHVAFSTDNGANWFAGADPSGVSGGGTVAAASDGSRFVWSPAGTGVQYTTGFGTSWSASAGLPAGAIVESDRVDPKTFYGFKSGRFYVSSDGGATFTASAATGLPSGDSVRFKALPGTKGDIWLAGGASDGAYGLWHSTDGGAAFTKLATVDQADTIGFGKAATGASYQTLYTSAKIGGVRGIFRSTDKGASWTRVNDDAHQWGWTGAAITGDPRVYGRVYVSTNGRGIVYGDTAGSSDGGGTEPAPTGACTVTYRITNQWSGGFQADVQLANTGSTAWDGWSLGWSFGDGQEVTQLWNASYAQAGSGVTAANLAWNGRVAAGSSVSFGFTGSWSGSNGRPTAFKLGGQNCTVA

SEQ ID NO: 9396 - protein, 624 aa, Streptomyces avermitilis
VQHPHSHRNRRRQILTMTAAAVLTAAGLTTLATGPAQAATARQVEALDRGVVSVHTDSGNLVSWRWLGTDQNDVSFNVYRAGALVNATPITGSTNYFHSGAPAQADYTVRAIVGGVEQADSVHAVQFRTGYKDVPLTPPAGGTTPDGVAYTYEANDASVGDLDGDGQLDFVLKWQPTNAKDNSQSGYTGNTVVDGIKLDGTRLWRVDLGRNIRSGAHYTQFQVYDYDGDGKAEVAMKTGDGTTDGRGTVIGSSSADYRNASGYVLSGPEYLTMFNGRTGAAMGTVDYVPARGTVSSWGDSYGNRVDRFLAGTAYLDGSRPSLIMARGYYTRTVLAAWDWRGGAFTRRWTFDTTSSTNSGKGYDGQGNHQLSVADVDADGKDEIVYGSMAVDDNGSGLWTTKNGHGDALHVGDLDPSRAGLEEFKVDEDSSKPSSWMADAGTGAILWSTAANGDNGRGVSGDVWAGSAGAESWSSRADGVRSPQGAVVASRKPGSINFLSWWDGDTVRELLDDTHIDKYGTASDTRLLTGSGVHSDNSTKATPSLSGDLLGDWREEVVWPTTDNTALRIYSTPYETSTKITTLLHDTQYRTALAWQNTAYNQPPHPSFFLGNDMATAPRPTVYTP

SEQ ID NO: 9397 - protein, 101 aa, Streptomyces avermitilis
MPVEPLSQKEIEDRLAELPGWSLDGDRISRSYRLGSHFAAAAMVVHIAQVQEELDHHSDLTLSYHTVSLTVNTHSVGGAVTELDFALARRVEDLAPGHGAS

SEQ ID NO: 9398 - protein, 355 aa, Streptomyces avermitilis
MYDRWNLSWQATAGYRARVRGCLLGGAIGDALGNPVEFASLDRIRAEYGPRGITGLVPDGDGVVGRITDDTQMTLFTVEGLQRAHHRERHKGIGGAAPRLVRQAYGRWLDTQTRPGPGADVDGGLAARPWLYARRAPGNACLSGLTQDHVPDPMLPLGPPGAVNPQSKGCGAVMRSAPFGLGRAPVDFAFGLAARCAQTTHGHPTGYYSAGALAAIVTHLVEGESLEGSVLRALRLLAVHPGHDETTAALHRALDLAAEGDPTPEKVETLGAGWIAEEALAIAVYCALATTDVTRALLLSVNHSGDSDSTGAICGNLLGALYGDHGLPHEWLERVEGRAEIAALADDFAAECVRR

SEQ ID NO: 9399 - protein, 285 aa, Streptomyces avermitilis
MTIVASGAVAPPPGPTEKGTGPTDRGVGPLLRGWRERRRVSQLELALRAGSSARHISFVETGRSRPSEEMVLRLAEHLEIPVRERNALLLAAGYAPHYPETPLDDPAMDALRQGVRRLLEGYEPYPALVVDATYDVLAANRGIAMLLEGVPESLLTPPLNAMRLTLHPEGLAPRIRNLGEWRGHLLAQMERQIALHRSAPLRTLYEEVAAYPVPDPVPDAADEPAEPAPHFALPLRIEHDGRVLSFVSSISTFNTPMDVTVAELAIETFLPADPATVKYLQSLQP

SEQ ID NO: 9400 - protein, 287 aa, Streptomyces avermitilis
VSERRAAPTVGQVVLGRRLQELREAAGLRREEAARVLRVAPATVRRMETAEVALKIPYLQVLLATYGVPDAEVAAYVSLAEEANRPGWWQRYHDVLPDWFSMHVSLEGAASIIRSYEPHFVPGLLQTEDYARAVLEAGTVGQTRPEDIERHVSLRMARQKLLTRERPPHLWVLMEETVLRRPVSIRGQVMRDQIDRLLEAAESDDITLQVLEYAAGPHPGTFTSFVLFRFAEPELPDMVYSEYLSGALYLDSRAEVSLHLEVLDHMAARAASGRRTRQILREYRERF

SEQ ID NO: 9401 - protein, 141 aa, Streptomyces avermitilis
VATTRSAHTVWEGNLLEGNGVVTFDSSGIGQQPVSWPSRAEQANGKTSPEELIAAAHSSCFSMALSHGLAGAGTPPTKLVTSADVTFQPGEGITGIHLTVEGTVPGLDNDAFVAAAEDAKKNCPVSQALTGTTITLSAKLA

SEQ ID NO: 9402 - protein, 230 aa, Streptomyces avermitilis
VRDIIRTRMFRTLTSAQATALFGAVIVLAFAVAILGIFATLAESKGIQQFVVLVGMLLLFLLAVVVIAARVATGPRARRPAAGASRAERSLTTVRRHVGLGEPDQAERALEASHVDQESEEFWYWKARIALARSNIEVASGYVDEALRLEARNPHSLALKIALLVLGRDPDRRDRAVRLSEESTGLGPELDAWLRRMRAEGMFDGGVHTRTELESRCPLPARTTESAHAE

SEQ ID NO: 9403 - protein, 462 aa, Streptomyces avermitilis
VSHGLAAVPGEFKANEATTHFVEIALKAGRARPEDAPATEPLPVNFVFVVDTSGSMTGTKLDTVKSALQTIYRELRPADCLGIITFDHNVRTVLPAVAKQDLPPERFAEVVSALTTQGGTDIDLGVQYGIDEISRHSVSGRTVNCLYLFSDGDPTSGERDWIKVRANVAAKLRGDLTLSCFGFGSDARMPELAALAGLAGGHSTFVTRPEQVGADLLGDLSRRDHLAAIDIQLRLDIDPEVEIRHLYGHDLVTDPRARAAVLREAGQAAERALQDYGTKALPDIITEDKGIRIFAPDLAFEETYWVVLEIRVPAGRELSGLGTATVQYVDTVARAGRRHELDLCEALTLPEETVTVHAVGLWTSEVTFYALDDLYDRDREAAKNRLTHHLKNLEAAHSHLPAKEFRDDQVTLRKLITLTGALGAVVSFSDVSHGAGAGPGFAPAVRVMNDFGRVRSGFWPHY

SEQ ID NO: 9404 - protein, 106 aa, Streptomyces avermitilis
VTSSAPRWAVPATTWTFFCDAAPHDAGYLPVTVIAGRLRVHGRGGTVLQPGIDLLHRADDLPPGAPVPVITDGWCDVLRVRREHAYLIPQGARLPFTARGPVFRVR

SEQ ID NO: 9405 - protein, 709 aa, Streptomyces avermitilis
VWAGTRGGCGVGGGRWRSVLSGVWRSIAVWAVSTVTMLVLAGLLPDFQLQSDNGDSATRIAITAAAGAGVFGLLSSLFWPLLVRLLLLVPALVIGLLVFFLNGSLLLIALRINPSGRGEAAPETAVVVAAVMSAVASATGGALAVRDDDAYRRRLYRLADRRRRRGEGQAGPSTPGTVFLQLDGVGHDVLAEATAKGLMPTVAAWLGLPTAGTRGGRGPTHVLTPWRTDWSSQTGASQLGILHGSNHDIPAFRWYEKETHEVMVCNRPSSAAELQRRAVERTGDGGLLTVDGASRGNLFSGGADQLALVLSIAARRGRKNRSRAGYFAYFCDPANAVRTAMSLVAEVGREMGQSTLARVRKQRPRVKRGGLYPFIRAFATVVERDVVVAAVIGDMLAGRNAVYADLVGYDEVAHHSGPRSRDAAKVLERLDRSLALIAKVAEHAPRPYRVVVLSDHGQSPGETFQTRYGLSLGNLVRAGCGLPVPRRARRTHSGAEARAAVRAALRRPVEEGGEEHRPSHRRSEPVVLASGNLGLVSFPDVPHRMSKEEIDRRHPALLSTLANHPGIGFVLVRSDEHGGLVLGAHGAEIPVDALDDEHPGPLADFGPGAADAVRRTHSFPHTADIMVNSWYDPVEGEVLAFEEQIGSHGGLGGAQGRPFLLSPVAFSAPVDDGTELVGAEHLHRVFRRWLRECDGPQVPLATRADERAA

SEQ ID NO: 9406 - protein, 141 aa, Streptomyces avermitilis
VRGAFGPSATVRVTAIASLTPLEELDADPFLVDSRSQYAMCARWAAERGYVVTRELLVRGLRPDHCALWADVEAGLVDLFVAPSHRVLERALASVDEFAAECARRGVRVETVGRAEPSYDAKMKARIHRRLSMPTAGYDGR

SEQ ID NO: 9407 - protein, 255 aa, Streptomyces avermitilis
VEITWWGHATCTVEDSGTRVLTDPLFARRLAHLRRRRGAPPPPEAAVADVALVSHLHADHLHVPSLARLAPGTRLLLPRGAVRQVPGLRRLGHLRLTEVAPGDRTQVGDLVVRTVPARHDGRRLPVGPHRSPALGFVIEGAARTYFAGDTGLFEEMAEEVGPVDVALLPVGGWGPYLGEGHLDAGRAAQALARLTPRSAVPVHYGTYWPIGMDAVRPHEFHTPGAEFVRLAAERAPAVAVHLLAHGESVRPEVAR

SEQ ID NO: 9408 - protein, 207 aa, Streptomyces avermitilis
VIFLAAVNSTVSPASTQQAIGYPTLFLLVLIGALVPVVPTGALVSSAAVVAFHQSAPFALLFVFAVAALAAFLGDIALYWLGRRGMRSKNGSRWLRAIRDRAPEDRLAQAQEKLRDHDIAVLTLSRLVPAGRLPVMLACLMADMPLRRFARGNGPACLAWAVTYQLIGILGGSLFEEPWEGVVAAVALTLTISVAPSVWRRLRRDAA

SEQ ID NO: 9409 - protein, 389 aa, Streptomyces avermitilis
MTQQTQQTEQTEQTKQTKQTKQSGFTTSTVSPTDQDADEPTSTTTTTTTFTSPSPSPPTPAGPLAPPNAPPEPRPLGERRRWQRSFADRLTAPLPGLKALARFAREGAIRPGPEGLADIPKLPFEPAPLPRVDARMVAVSWAGHASWVVRIGGLTVLTDPVWSRRILGTPARITPVGVAWSALPRIDAVVISHNHYDHLDAPTLRRLPRDTPVFVPAGLARWFRRRRFTQVTELDWWEAAELGGVRLDFVPSHHWSKRSLTDTCRTLWGGWVLTAPDGQRVYFAGDTGYGHWFAQIGRRYPGIDLALLPIGAYDPRWWLSDVHCDPEEAVQAAVDLGAHRMAPMHWATFVLSAEPVLEPLTRVRAAWEKAGLAREDLWDLPVGASRVLE

SEQ ID NO: 9410 - protein, 441 aa, Streptomyces avermitilis
MGNGRTRLRGGTHAADGSGRTRPRPLRPAAARPGTARTAGTRGRPRRRRGPPRRRTRRRRPRPPRRGLRLLRAARSVRGPRPRRRRTGRPGPAPRTDRGARWRCARAPALRRLVGTPKGPGPPGKGPVFPCWRTPRGKLGGPSRDSGPPLLEEPVAGFRARRPGESRGVLRFRRRVGRTNPNRQPSHPPEVLHETIEAAAGEGLHLVSDETWRDTVHRPHDTVLFSPAEMLPDGVTVLTDLAGPFLPAGWPAAVARFPDTADGAGLRARVLDVLTALGARIARPVAAAAAYALDEPADVTERLTAAVRLHARVATAAHRAVVTAGALARPPQAGRHLYVDLGPLRSALSAHGVGDAQELEDFLTARLGLPAPGGQRFGDDLAALRVRLSTGPLLGTTAEERTRCLDSPAPLELPHVQRALILLGSVFDDLRDDAQRWEPPR

SEQ ID NO: 9411 - protein, 356 aa, Streptomyces avermitilis
MRRCARVLSATALAGAALGVAAPAASADPATEVRPRSVAPGGAVTLSVSCDATGAERSDAIEAGPQSSEETEAQLRLGGNDDAGAAADGETARMPSDGDFDGGATGAAGPPAQWEVDGQCPVTTGGQESQWTALPSDTRDGEARNGAADPSGAADVPGAADAPDAADAPDAVNRPDEVNPPSAVAPPDTLDAPAAVDPPGAVVPPDTVDPGAVNRPDAADAPDAVNRPDEVNPPSAVVPPGVVVPPDTLDAPAAVDPPGTLAPPGTASRPGTVEPPDAVNRPDAVDPPDTPNGPDAVNPSGAADAPPGVQRGAQAGEGGAFTGSIPALVTGSVLVAVAIGAACYRVLRRKGTSSRI

SEQ ID NO: 9412 - protein, 264 aa, Streptomyces avermitilis
MRTQASAKRHSHDDAPDTAEAFRKLATLPPGQQRDTLREEIVEAWLPMAERLAGRFRNRGENYEDLRQVASLGLVKAVDRYDPELGNAFESYAVPTITGEIKRHFRDHMWTLHVPRRVQDLRNRVRFASQDLSQTISGRRPTVAEIAEHANMSEEDVRAGLEALESFTALSLDAELPGSEDGYSLSDALGSADPALDIVVDREAVKPRLQALPERERDILYMRFFGDMTQSRIAEQLGISQMHVSRIISRCCDRLREQVMRDAA

SEQ ID NO: 9413 - protein, 136 aa, Streptomyces avermitilis
MQRGSDRLSVHRDDEMKHELQGLLRSGHPTRAEEWNDPEPTADDDPQIAGGPVTPGGATGSLAAVRYELGRHLGRTSFPAGPADLIGALRRSHAPDALVEPLERLPHKARYTNAHELAEAVVRTADGAGPQDEEQG

SEQ ID NO: 9414 - protein, 148 aa, Streptomyces avermitilis
MADFVREVMTPGVVAVRPDASLVEAAQLMRAQDVGDVLVTLDQQLVGVLTDRDIALRAVADGVDPRTVSAQGVCTTNPVVIGPDEPVSAAVALMREHTVRRLPVVEDGHPVGMVSLGDLAVAQDPESVLADISRAEPDSWPGAAPAAR

SEQ ID NO: 9415 - protein, 181 aa, Streptomyces avermitilis
MRIAFLTAPEGVEQIELTDPWQAAVDAGHQPVLVSTEPGQVQAFNHLDKADTFPVEEVAGEVPADSFGALVLPGGVANPDALRMDERAVAFVRAFFDQGRPVAAICHAPWTLIEAGVVPGRVLTSWPSLRTDIRNAGGTWVDEQVQICDQGPNTLITSRKPDDLKAFREAFLTEFDKAAAA

SEQ ID NO: 9416 - protein, 105 aa, Streptomyces avermitilis
MVPPGCPRVVGPERVPGPHQGHDDRGTIMNGVDPGRLTDQQLMKELEAIHRTRHDTLLHGSNDALRVHNVRMAQLEGEYLRRHPRRPVAPGRTREGARERGCAQA

SEQ ID NO: 9417 - protein, 539 aa, Streptomyces avermitilis
MGHLEAAHLEYYLPDGRVLLGDVSFRVGEGAVVALVGPNGAGKTTLLRLISGELKPHGGGVTVGGGLGVMRQFVGSVRDETTVRELLVSVASPRIQEAARAVDTAEHAMMTVDDEAAQLRYAQALSDWAEVRGYEAETLWDMCTMAALGVPYEKAQWRQVRTLSGGEQKRLVLEALLRGTDEVLLLDEPDNYLDVPGKRWLEERLKETRKTVLFVSHDRELLARAAEKIVSVEPSPTGADAWVHGGGFATYHEARRERFARFEELRRRWDEKHAQLKKLVLNLRQAASISHELASRYQAAQTRLRKFEEAGPPPEPPREQDITMRLKGGRTGVRAVTCKGLELTGLMKPFDLEVFYGERVAVLGSNGSGKSHFLRLLAGDDVTHTGEWKLGARVVPGHFAQTHAHPELEGRTLLDILWGEHSQDRGAAMSRLRRYELTAQAEQRFERLSGGQQARFQILLLELEGVTALLLDEPTDNLDLESAEALQEGLEAFDGTVLSVTHDRWFARSFDRYLVFGSDGRVRETAEPVWDERRVERAR

SEQ ID NO: 9418 - protein, 497 aa, Streptomyces avermitilis
MTPDVDLTVRPPRPRVLRDRLLAADYRLFEKVAARHWPGGDRLLPRLSRTANHGVLWFAAATALAATGSPRARRAAARGLASLTLASATINTLGKRSVRRPRPVLDPVPHVRRLKRQPITTSFPSGHSASAAAFATGVALESRGLGAALAPLAAAVALSRVYTGVHFPSDVLAGAALGVGAAFAVRGLVPTRDRLPPPGRPRVDAPALPDGAGLVVVADQGAAAPDRVRALGDALPRAETVQCEPDEVRAELEKAAARAQVLGVCGDDGTVNAAAEVALRHGLPLAVLPGGSPDHLAHDLGIEGVRDLTRALRQGDAVRVDVGRFTSGDIERCFLGSVGLGVHPELVRERERWAEWLGAWPADVIAALRVLRADHHPLQVGLGGAPRPLWLLFAGNGTHHRTGLAPGRRHELADGLLDVRVVHGGRRPAARLLAAALAGPLTRSPAHAAVRVRELRLTGVAPGTLLAHDGEVTEVQGDVTLRKLPEALTVYRPFPRT

SEQ ID NO: 9419 - protein, 273 aa, Streptomyces avermitilis
MSKSQETAVYTHGHHESVLRSHTWRTAANSAAYLLDSLKPHMKILDIGCGPGTITADLAALVPDGRVTGVDHAPDILEQARATAAGRGLRNVEFAVADVHALEYPDDTFCVVHAHQVLQHVGDPVQALREMRRVTRPGGFIAVRDADYAAMTWYPESPGMTDWLDLYRRVARANGGEPDAGRRLRAWALRAGLTDITATSSTWTFATAEERDWWSGLWADRTLASAYAARATEGGHATTRQLRAVSQAWREWGRQEDGWFSVLHGEILCRKIV

SEQ ID NO: 9420 - protein, 94 aa, Streptomyces avermitilis
VSTSSSGRNRLDLEPDTVERDLVKLVLTVVELLRQLMERQAVRRFDTGELTEDQEERIGLTLMLLDDRMKELCERYGVRPEDLNLDLGPLGSLL

SEQ ID NO: 9421 - protein, 64 aa, Streptomyces avermitilis
VTVVERREIALVDLLDRLLAGGVVITGDLTLRIADVDLVRIDLNALISSVNAQVPSPWPDQEEQ

SEQ ID NO: 9422 - protein, 255 aa, Streptomyces avermitilis
MTGLRYVYAVCRPFGTPLQAELTGVAGAPPKQLSHHGLVAVVSEVPAEDFAEEPLRAHLEDLEWLTATARAHQSVIDALTVVTTPLPLRLGTVFQDDSSVRVMMEAREEAFRRTLDRLDGRVEWGVKVYAETEQTEPERSPGKAASGRDYLRQRRQRNRSHEEMWENSERFAGRLHHTLAEYAEDSRLHAPQNPALSRASGRNVLNAAYLVPRSDSEEFVEKVDRTKDELSGVRVELTGPWAAYSFSGIDGEADA

SEQ ID NO: 9423 - protein, 108 aa, Streptomyces avermitilis
MTTPSRLPDPYGSGGGANLADILERVLDKGVVIAGDIRINLLDIELITIKLRLIVASVDKAKEMGIDWWEDDPALSSRARHNELARENAELRAHVAELEGARPQEEAS

SEQ ID NO: 9424 - protein, 378 aa, Streptomyces avermitilis
MSDTLGSVTGRAKDQAKGGVKENPITGVVQSEAADRLKAEVQEYLGAQAQRLLVGFGRKLGETTGKLNDIAEGNSPGFAKLALDGGRKLAEGKGPLRSALELGAGRAKDSVVGALKNLTGGKGRRKGGAGKKPTVIIEFIDVGVPLRTAYDQWTQYQDFSTFAKGVKSANRADDTTSDWQLKVFWSNRSWKAHTTEQVADERISWTSEGAKGTTKGVVTFHSLADNLTRVLLVIEYYPKGLFEKTGNIWRAQGRRARLDLKNFARFITLKGEAEDGWRGEIRDGEVVRSHEDAVAEEEAEESGPEGESEEPEEAYEDQEDGEADGEEGEPYEEQAEYADEDEAPEGEYADEDEVPEDEAPEEEYEYEEEEAPVGGGRR

SEQ ID NO: 9425 - protein, 228 aa, Streptomyces avermitilis
MNRIGLGLAIGAGYVLGRTKKMKLAFAVGTMVAGKRLNLTPRALADLVSQQLLNNPQFKEIGDELRQDLRGVGKAASGALLERQIEGLADRLHGRTAQVRDQLAGVAPDVPGLDDDEEEDERDEEDARDERGEADEPEERDREPDGEEDRPRRAAPAKKTAAKKGPAKKAPAKKAPATKTAAGTAGAKKAAKKAPAKRTAAAKRTAAAKSSARRVTRTRTRERGGDDE

SEQ ID NO: 9426 - protein, 87 aa, Streptomyces avermitilis
MGLITEVLLLPFAPARGSIWVLGQVLAEAERQYYDPATIRAELARLEQQLEAGEIDETEFDRREDELLDRLETSSRSGAGTGNGTTG

SEQ ID NO: 9427 - protein, 255 aa, Streptomyces avermitilis
VSTYVYGIAASSHPSLPDGMGGVGEPPMPVRIIKEGELAAIVSDAPEGLRPKRRDLLAHQNVLNEAGGGGTVLPMRFGSVGADDAAVAGVLAERADHYKERLTALAGRVEYNVKASHDEEAVLHRVMSENTEIRALAEANRQSGGGSYDHRLQLGEMVAAAVQRREAEDAVDVRHTLEPAADAVSVGPESTGWLANVSFLVARDAADTFVAAVEQLRKGHPHLDVRLNGPLPPYSFVEPDPSESVDSFTGAERVE

SEQ ID NO: 9428 - protein, 141 aa, Streptomyces avermitilis
MTVVPAQQTGGGGGSSGLYDVLELVLDRGLVIDAFVRVSLVGIEILKIDVRVVVASVDTYLRFAEACNRLDLESGPHKSPGLPDLVGDITESGARGKSKGALSGAAETISDAFKQSREEGQSESRPRARKSTASRRKEEQE

SEQ ID NO: 9429 - protein, 115 aa, Streptomyces avermitilis
MSNTSNTSKSQDSQNTQDAPRNERGGTAEKRPGTMEVLRKAGAQFAELTGLEAESVSSFERSEDGWQLQVEVLELARVPDTMSLLASYEVKLDPYGELTGYRRVRRYERGRADAR

SEQ ID NO: 9430 - protein, 616 aa, Streptomyces avermitilis
MNTRQLTELGQQLRVDSVRAADAASSGHPTSSMSAADLMAVLLAHHLRYDFDRPAHPGNDRFILSKGHASPLLYAAYKAAGAIDDAELLTFRELGSRLEGHPTPRRLPWVETATGSLGQGLPVGVGIALSGKRLERTGYRVWVLCGDSELAEGSVWEAAEHAGYEHLDNLTAIVDVNRLGQRGPTRHGHDLDAYARRFQAFGWHTIEIDGHDVDAVDRAYGEAESTSGQPTVILARTLKGKGVAAVEDREGLHGKPLPDAEEAIAELGGVRELRIEVQDPPAARVLHAVAAPGQVELPRYDKGDEVATRDAYGQALTALGGAREDVVAIDGEVGDSTRSEYFAKEYPDRYFECYIAEQQMVAAAVGLAARGWVPYAATFAAFLTRAHDFVRMASISGAGINLVGSHAGVSIGQDGPSQMGLEDLAMFRSVYDSTVLYPCDANQTAKLVAAMAGLDGVRYLRTSRGASPVLYGPDEEFPVGGSKVLRSSGEDRLTLVAAGVTVHEALAAADSLAEAGIRARVIDLYSVKPVDRDTLRQAAEDTGCLLTVEDHREEGGIGDAVLDAFLDGRPVPRLVRLAVRTMPGSASPAEQLHAAGIDAESIATAARLLVEQAVVR

SEQ ID NO: 9431 - protein, 453 aa, Streptomyces avermitilis
VSRPRILIVGAGFAGYQTARTLSRLTRHKADITLLNPTDYFLYLPLLPQVAAGILEPRRVTVSLAGTLPHVRLVLGEAQTDGIDLDARTVRYTGPEGDVGTLTYDRLVLAAGSVNKLLPIPGVAEHAHGFRGLPEALYLRDHVTRQVELAAAAADSETCASRCTFVVVGAGYTGTEVAVQGQLLTDALVRNRPLREGRRPRWLLLDVAPRVLPGLDERLSRTADRVLRKRGVEVRMGTSVKEATSDGVLLSDGEFVDTRTLVWCVGVRPDPLAESLGLPMESGRLLVEPTLQVPGHPEVFACGDAAAVPDLENPGQYTPMTAQHAWRQGKTAGHNVAASFGIGTRRPYRHRDLGFVVDLGGVQAAANPLGIPLSGPLAGAVTRGYHLAAMPGNRVRVAADWLLEAVLPRQAVQLGLVRSWSVPLDTASPELARMPGAPERLATTDTPTTEGPS

SEQ ID NO: 9432 - protein, 203 aa, Streptomyces avermitilis
MFRRLRVRRFAVRTASRAELRERRPGYPGRMKPLDHLEHLDKSLVDELAQVARETIRDELREQSRKQRRTATLYAASGAAALYAGAALAVALGLALSLGLPGWAAALITAAVLGVVAQLLRAAARPSPSRPTTRYDLEPAGDHGRVVGGTPPAGPPGGLGMPYPPVPPVAPGAPMPGTAEPGAPRQDDMDPEAPHHRGRRAGS

SEQ ID NO: 9433 - protein, 117 aa, Streptomyces avermitilis
MEILGATLRICVDDLEASVPFYERLAGGSALRFERGGVQVAAVGCFLLMSGPEAELDVLRKVAATIAVKDVDEAHRVLGDSGAHILAGPVATPVGRNLIAMHPDGSVYEYVDRRAAD

SEQ ID NO: 9434 - protein, 298 aa, Streptomyces avermitilis
MRSIVVLDAPSNLGLRPPAPGTVPGCYKLAGALREQRIVQRLGALEGGVVVPPRYDRGEWQEGDGVFNAAALASYTRKLADRIEHHVRAGDLPVVLGGDCSIQLGASLALRRIGRYGLAAVDASADFRHPGNSDRVGAAGGEELALATGRGQEDLTDIEGLRPYLRDEDVRLFGIRDDDPERTELGALKIATVTVGDLRAWGADALARATVEAFEIPQLQGFWVHLDADVLDPSVMPAVDSPDPDGLLPDEVVALLRPLLRSPHCAGLNVTIYDPDLDPDGTAGALLADIVVSAFDAS

SEQ ID NO: 9435 - protein, 180 aa, Streptomyces avermitilis
VSENSRYLAEGPRVGLRPFTYDDEAEFLARVRESKDLHRPWLFPPDSPDAYHAYAGRLIEDPTKAGFLVCEKDGGGIAGFININNIVAGSFLNGTLGYGVFAHAAGRGLMGEGLALVVAHAFTTLGLHRLEINAQPGNAASIALARRCGFRLEGFSPDFLYIDGAWRDHERWAITATGPR

SEQ ID NO: 9436 - protein, 310 aa, Streptomyces avermitilis
VMSTTPLNRPARLAPGARVAVIAPSGPVPEERIQAGLDILRGWDLDPVPTPHVLDRHPRFDYLAGTDADRAADLQSAWCAPDVDAVLCARGGYGVQRMVDLLDWDAMRAAGPKVFVGFSDITALHEAFATRAGLVTLHGPAAAGADFIKNARAQEHLRATLFEPESVRTIASGGPALVPGRARGVTLGGCLSLLATDLGTPHARAGARDGLLMLEDVGEAAYRIDRSLTQLLRAGWFDGVAGIALGSWERCGPYEKLRAVFADRLGGLGVPVVEEFGFGHCEGALTIPFGVRAELDADAGTLTLDEPALR

SEQ ID NO: 9437 - protein, 666 aa, Streptomyces avermitilis
MQTLAYGSWPSPIAAGLAAAHDGQPEFVGFVGDEAWWTEPRPTEGGRRTLVRRRADGVEESVLSAPWNVRSRVIEYGGRPWAGAARPEGPLVVFVDFADQRLYAHEPDTPGARPRPLTPVSPVGGGLRWVDPRLRVERGEVWCVLEEFTGDGPTDVRRVVAAVPLDGSAAEDRGAVRELTDGRHRFVTGPRLSPDGRRAAWLAWDHPRMPWDGTELIVAEVAGDGTLREAHTVAGGPDESIAQVDWAHDGSLLYASDRTGWWNLYRDDEPVCPREEEFGGPLWKIGQRWFAPLESGLIAVVHGRGATALGILDPETGEVVDAAGPWTEFAATLAVHGTRVVGIGASPRSAYEVVELDTLPQALGSDRAGATPVARARVIGAAHDDPVDPACYPEPQIRTFTGPVGREIHAHIYPPHNPGCVAPGDELPPYVIWAHGGPTSRAPLVLDLEIAYFTSRGIGVAEVNYGGSTGHGREYRNRLREQWGVVDVEDCAAVALGLAEEGTADRARLAIRGGSAGGWTTAASLASTEVYGCGTILYPILDLAGWGSGETHDFESQYLESLVGPLAQVPGRYAERSPAEHADRITAPFLLLQGLDDVICPPAQCERFLARMRGRGVPHAYLAFEGEGHGFRRADTTVRVLESELSLYAQVFGLNPPGVPTLELTT

SEQ ID NO: 9438 - protein, 440 aa, Streptomyces avermitilis
MAEAPALEEVVRFTSDLIRIDTTNRGGGDCRERPAAEYVAQKLAEAGLEPTLLERTEGRTNVVARIEGTDPLADALLVHGHLDVVPAQAADWSVHPFSGEIRDGVVWGRGAVDMKNMDAMILAVVRDWAREGVRPRRDLVIAFTADEEASAVDGSGFLADRHPGLFEGCTEGISESGAFTFHDGAGRQLYPIAAGERGTGWLKLTAHGRAGHGSKVNRSNAVTRLAAAVARIGAHAWPLRLTPTVRAALTELAAVYGIDADLDDLDDMDDMDGLLKKLGPAAALVEPTVRGSANPTMLSAGYKINVIPGEAVGYVDGRYLPGGEDEFRTTLDRLTGPDVEWEFEHREVALQAPVDSVTYARMRAAVEEFAPEGHVVPYCMSGGTDAKQFSRLGITGYGFAPLKLPEGFDYQALFHGVDERVPVEALHFGVRVLDRFLRTA

SEQ ID NO: 9439 - protein, 277 aa, Streptomyces avermitilis
MKILISADMEGATGVTWPADVLPGTPQWERCRSMFTSDVNAAVLGFFDGGADDVLINEAHWSMRNLLLERLDERAEMLTGRHKSLSMVEGVQHGDVDGIAFIGYHAGAGMEGVLAHTYLANSITGVWVNDERASEGLLNSHVVAEYGVPVVLVTGDDVACEDALGYAPEALKVAVKDHVSRYAAVCRTPSRTAADIRAAAKEAASLAVPHEPVVGGPFTVALEFDAEHLAMAATVVPGVGRIGERKVSYTSGTMYEGIRTFKAVTTIVSAAVEEQYG

SEQ ID NO: 9440 - protein, 241 aa, Streptomyces avermitilis
MSVTSRYREAWEGFWREAPEGQGAVFWDAEPILTAGVHLALFEPRLTAPGLPLVDLGCGNGTQTRFLADRFPHVVGADLSAAALDHARRADPAGQATYRLLDAAEKTEAETLHAELGDANIYMRGVLHQCEPDDRQPLVDGIATLLGDRGRLFLVELAEAAGVVLKGLARSPQGPPPKLAPVFRHGIAPGEVADAAVPAYLDAAGLTVLASGELPLVTTEYRPDGTRIELPSRWLLAGRGA

SEQ ID NO: 9441 - protein, 820 aa, Streptomyces avermitilis
MERGTEWGAPSGHGAGHGAVERATAAGRIPLAVVVVDRAGLVSHWSRGARRLFGTSREDAVGRPAVDLLPVSGALPDDEIAPYGAYAAYEGLGPDLESSLGGWLSYPAAGRARLRVPERDRIDVLWWAYPLVGPGPERLLVLAADADALRPDARGAEGVAVERIAPGFALHTDFPGAEELARELPEILPSMSVGESARIVSQVLELGYPVLEFSQNDRVPVTPDWGVPRRAERKARRERAARAVASGESVPQDVQDEGEDLEYVAVRERLEFLNEVSGRIGTSLDLAQTIIEVSKAVVPRFTDVAGTYLREQVVAGEGFPDGVPDTTTMWHRVAVEHTDEPGRWDDVVPVGEAMPFPAHTPFFQCMTSGQPVLVPRISEQMGHAIAAQFEKRDIRPLINNRSMLVVPLKARNVVLGFMILLRHPERVEFNDMDRVTGAELAARAGLVLDNARMYTYQESVAETLQDSMLPHIAPRMAGCDIATRYLPGTLLGRVGGDWFDSVKLPGSRTALVVGDVMGHGLNSAAMMGQLRTAVQTMAALDLPPAQLLRNLDDLAQRLGDTYLATCLYAVYDPITSELEIANAGHIPPVLVRAEDGRSELLDLPTGAPIGVGGVPFESVRVPVAPGDRLVMCTDGLVEVRGEDIGVGLATLCESAAHPAASMDDACDTIIRALNVRGGRKDDVALLMARLGGIAPEDVALWRFALDPVEVGRARAAVREQLHEWGLNSLADNAELMVGELVTNAVRHARSRRVELRLVRGETLLCEVDDEDHTLPSLRGAGPADEFGRGLRVVSTLAREWGASRTSAGKTVWFELTLPRR

SEQ ID NO: 9442 - protein, 792 aa, Streptomyces avermitilis
VGGTTLVKDEPAAEPSDTPAPPAPGPAQLGPRRVRLVFCALMLAMLLAALEQMIVATALPKIVGELHGLDRMSWAITAYLLTATVALPVYGKCGDLFGRKGVFQFAIVVFVVGSVLAGRARTMDQLIAFRAIQGLGAGGLMIGVQAIIADIVPPRERGRFMGLIGAAFGLASVAGPLLGGYFTDHLSWRWCFYINAPFGLVTLAVVTVALKLPKPLTKARLDVLGALLLAVASTCAVLLTSWGGTEYAWDSRIILGLGAGACVAAVLFLVVEHFAPEPLIPLRLFRDSVFNVTGLVGLVIGVALFGAASYLPTFLQMVDGASATESGLLMLPMMAGIVGASIIAGQLISHTGRYRMWPILGSVLAAVGMWLLSRLEADTPRLQYSIWMAVLGAGIGMVMPVLVLAVQNSVRPADLGTATSANNYFRQIGGSVGAAVFGTLFAHRLADALEERLPTRAGARLPDPESLTPQLVHALPPDLRDGYVAAYADAMPRIFLFLVPVLVLGLLIAFFLKEKPLVSHNAPAEPVSLAQVPQARSPYAAGVPVCGTVQHPDGTVVPRAALTLIDVAGQQIGRGASGEDGRYALSTPGSGSYVLIAAAGGHQPQAVSVTVGERPVELDVVLGGAGRLAGSVLTADGTPVREAIVTLTNVHGEVVSTTRSGREGGYVITELVAGEYTLAASAPAFRPAALPVTVQAARETRQDVELAGGAVLRGTVRAGGGRPVEDARVTLLDAAGNVVDTLTTGGDGTFRFVDLSSGEYTVIAAGYPPVATVLQVAGGGRTERDLQLGHED

SEQ ID NO: 9443 - protein, 147 aa, Streptomyces avermitilis
MAQVEATTERIIAADAEKVFDALADYSDARAKVLPEHFSEYEVREGGDGEGTLVHWKLQATSKRVRDCLLEVTEPTDGELVEKDRNSSMVTTWRVTPAGEGKSRVVVTSVWNGAGGIGGFFERTFAPKGLARIYDAELANLAAAMEK

SEQ ID NO: 9444 - protein, 346 aa, Streptomyces avermitilis
MRWENLTAGPAGDPARDAALFGADAVTTRTFDTPEFRGITFHEIRARSIVNRVPGASRMPFEWTVNPYRGCTHACVYCFARKTHSYLDLDTGLGFDSQIVVKINAPDLLRRQLASRRWHGEHVAMGTNVDCYQRAEGRYQLMPGIIAALRDHANPFSILTKGTLILRDLDLLEQAAEVTDVGISVSVGFTDHELWRTVEPGTPAPERRLDVVRTLSEHGIGCGVLMAPVIPFLSDQPAQLRATVRAIAAAGATSVTPLVLHLRPGAREWFMAWLEHHHPYLVRRYERLYAEGAYAPKWYQRRITRQVHELAQEYGIGPTRAGMPRRIPEPEPETPPTPEPTQLTLL

SEQ ID NO: 9445 - protein, 525 aa, Streptomyces avermitilis
LRKRAAVLCGAAVMVAGMLTTAPADASAPRTARTASAAKLTWKKCGTADFPKLQCTSLKVPLDHAHPGGRKITLALSRVPHTAKTYQGPLLVNPGGPGGSGLALAGFVASSLPKAVAAQYDVIGFDPRGVGSSKPALDCKPGHFKPVRPDSVPSTPALEKANVSRATSFAKACGTKYASLLPYLDTISAARDLDSIRQSLDAKKINYLGYSYGTYLGAVYAKLYPDRVRRLVLDSIVDPTGVWYDDNIAQDYAFNDRHLAFLAWVAKHNKTYKLGTDPAKVGAKWYAMRAALAKKPAQKKVGASELEDTFIPGGYYNGYWPHLAEAFAAYVNDKNSDPLVKAYANFGAVDAAGDNGYSVYTSVQCRDVSWPRDWNQWRKDNWAVYEKAPFMAWNNAWYNAPCAFWPTSSARPVDLSNNALPPALLFQATNDAATPYEGGVTVHHLLRGSSLVVEQGGGNHGITLSGNACLDKHLATYLTNGKVPHGGGDIDAVCKKVPDPAPSSTKALPSAARGSALHGLLGFRG

SEQ ID NO: 9446 - protein, 211 aa, Streptomyces avermitilis
VTGVLVREMTLDDCHHVSTIRIRGWQTAYAGLIPQSYLDALDLDADAERRRTHLVKGDGTMVNLVAERAGEVVGWACHGPYRDGEVRTRDAELYAIYVRPDEVGKGVGQALLRESTRRCASAGHRHMFLWVLKENAPARRFYERSGFAPDGAEEPFEVHGVTVPEVRYVRALGAPHRGGRGPATPEAPAAPAAASVRPPPPVRAPDARGRP

SEQ ID NO: 9447 - protein, 202 aa, Streptomyces avermitilis
LPRLGLMDEELRSLTERRLRNEAGASVAYERLLATGDVEELAAALTEPGQPLWARELVAFRLGVAGDRRAFEALVLLLNHRDPQRCASAAYALARLDDPRTARAAAALATNELRVAYALHPVRLLVELRAPEAVPALITTLRRRLRPHDPYRRVALACVEGLGALGDVRAREVLTDALAHPALAQAAAGALKRLPGPRAPRE

SEQ ID NO: 9448 - protein, 601 aa, Streptomyces avermitilis
MATPPFDPSLSPLKTVAVIGLGTMGTGIAEVLARAGREVVGIDISEAAAGHAVTALEASTARAVQRERLTEQERGDILARFRTFTDLQAAADADLVIEVTPESYEIKQQVLRALDGIVRADTILATGTNALSVTRLAADSAHPERVLGLHFFNPAPAMKLVEVVSSVLTAPTAVAAVTNLALDLGKEPVAVGDRPGFVADGLLFGYLNQAAAMYEAKYASREDIDAAMKLGCGLPMGPLALLDLIGVDTARTVLEAMYAESRDRLHAPAPILKQLSEAGLTGRKSGRGFYSYDEPGSATVVRDALTPLSGGPGEQGRTVRSVGVAGSGTMASGIAEVFAKAGYEVVLAARSEEKAQTAKARIGKSLSRSVDKGRLTAEAAAETLDRITPAGSYDAFADVDLALEAVAEDLEIKQQLFATFDKVCKPGAILATTTSSLPVVACARATSRPQDVIGMHFFNPAPAMKLVEVVRTVLTGDDVHATVREVCAKIRKHPVDCGDRAGFIVNALLFPYLNNAIKMVQEHYATLDDIDAAMKLGGGYPMGPFELLDVVGLDVSLAIEKVLHREFRDPGLAPAPLLEHLVAAGCLGRKTGRGFREYAKR

SEQ ID NO: 9449 - protein, 271 aa, Streptomyces avermitilis
MSQPARSSRTAATPDAPESAAGSRAAAQRLKMRRELAAAAMELFATKGYEATTVDEIAAAAGVARRTFFRHFRSKEEAIFPDHDDTLVRAEAVLNAAPAHEHPLDTVCRGIKEVMKMYAARPEISVSRYKLTREVPTLREAEIASVARYERLFTRYLLGHFDEHAHDDDANDDPLLAEVAASAVVTAHNHVLRRWLRAGGQGDVEAQLDHAFAIVRKTFGTGIGAGRETAPPRSAPASSFTDGDVLVTVARVDAPLDQVMRTIEQALKERS

SEQ ID NO: 9450 - protein, 445 aa, Streptomyces avermitilis
VKEILDAIQSQTATSADFAALPLPDSYRAITVHKDETEMFAGLSTRDKDPRKSIHLDDVPVPELGPGEALVAVMASSVNYNSVWTSIFEPVSTFNFLERYGRLSDLSKRHDLPYHIIGSDLAGVVLRTGPGVNSWKPGDEVVAHCLSVELESSDGHNDTMLDPEQRIWGFETNFGGLAEIALVKSNQLMPKPDHLSWEEAAAPGLVNSTAYRQLVSRNGAGMKQGDNVLIWGASGGLGSYATQFALAGGANPICVVSSEQKADICRSMGAEAIIDRNAEGYKFWKDETTQDPKEWKRFGKRIREFTGGEDIDIVFEHPGRETFGASVYVTRKGGTITTCASTSGYMHEYDNRYLWMSLKRIIGSHFANYREAWEANRLVAKGKIHPTLSKVYSLEDTGQAAYDVHRNLHQGKVGVLALAPREGLGVRDEEKRAQHIDAINRFRNI

SEQ ID NO: 9451 - protein, 682 aa, Streptomyces avermitilis
MTERQTSDGRREKDRPWLMRTYAGHSTAEASNELYRRNLAKGQTGLSVAFDLPTQTGYDPDHILARGEVGRVGVPVSHLGDMRRLFQDIPLEQMNTSMTINATAMWLLALYQVVAEEQGADITKLQGTTQNDIVKEYLSRGTHVFPPGPSLRLTTDMICYTVNHIPKWNPINICSYHLQEAGATPVQEISYAMSTAIAVLDAVFASGQIPEDRKGDVVARISFFVNAGVRFVEEMCKMRAFGRIWDEITRKRYGIEDPKQRRFRYGVQVNSLGLTEAQPENNIQRIVLEMLAVTLSKDARARAVQLPAWNEALGLPRPWDQQWSLRMQQVLAYESDLLEYADIFEGSHVIEAKVQELVEESLAEIDRIQEMGGAMAAVESGYLKSQLVASHAERRARIESGREKIVGVNIFESTEPNPLTADLDAAIQTVDPAVEARVIAALGTWRDTRYQPPFNHPRPCKALEKLKEAAKGTGNLMEATLECARAGATTGEWAGALREVFGEFRAPTGVSSAPVAVTAEAGTALALVRQKVELTAKDMGVGKLRFLVGKPGLDGHSNGAEQIAVRARDAGFEVVYQGIRLTPEQIVDAALAEDVHGVGLSILSGSHAQLVPDVLDRLREAGATDIPVIAGGIIPNADAEQLRAAGVAAVFTPKDFDITGIIGRIVDEIRKANKLDPLEVPA

SEQ ID NO: 9452 - protein, 321 aa, Streptomyces avermitilis
MTTPVNRLRPRRSCLAVPGSNPRFLEKAQGLPADQVFLDLEDACAPLAKPEARHTIVKFLNEGDWTGKTRVVRVNDWTTQWTYRDVVTVVEGAGQNLDCIMLPKVQDAQQVVALDLLLTQIEKTMGFEVGKIGIEAQIENAQGLNNVNEIAQASPRVETIIFGPADFMASINMKSLVVGEQPPGYPADAYHYILMKILMAARANNLQAIDGPYLQIRNIDGYRAVAQRAAALGFDGKWVLHPGQVEASNEIFSPSQEDYDHAELILDAYDFYTSEAGGKKGSAMLGDEMIDEASRKMALVISGKGRAAGMQRTSKFEAPEA

SEQ ID NO: 9453 - protein, 175 aa, Streptomyces avermitilis
MQFGRTYEEFEVGAVYKHWPGKTVTEYDDHLFCLLTMNHHPLHMDTNYAEKTTDFGKNVVVGNYIYSLLLGMSVPDVSGKAIANLEVESLKHVAPTFHGDTIYGETTVLDKTPSRSKSDRGIVYVETKGYKQDGTLVCVFRRKVMVPTETYIKERGGEQPGRPELTAPAEKKTEK

SEQ ID NO: 9454 - protein, 401 aa, Streptomyces avermitilis
MARLAQTAGLTDIQQEILSTVRDFVDKEIIPVATELEHRDEYPQQIVDGLKELGLFGLMIPEEYGGLGESLLTYALCVEEIARGWMSVSGIINTHFIVAYMLKQHGTQEQKDHFLPRMALGEVRGAFSMSEPALGSDVSAISSKAVKDGDEYVLNGQKMWLTNGGSSNLVAVLVRSDEGHPEGTAPHKSMTTFLVEKEPGFGEVRPGLTIPGKIDKMGYKGVDTTELIMDGLRVPANRVLGGTTGRGFYQMMDGVEVGRVNVAARGCGVAQRAFELGVSYAQQRHTFGKPIAQHQAIQFKLAEMATKVEAAHAMMVNAARKKDSGERNDLEAGMAKYLASEYCKEVVEDAFRIHGGYGFSKEYEIERLYREAPMLLIGEGTAEIQKMIIGRRLLEEYRLQG

SEQ ID NO: 9455 - protein, 215 aa, Streptomyces avermitilis
MPHSQTSAPRGRVRLARGASPWLLPTVATAALSLVRARRSGAAKAVAVPATALAAGMLWFFRDPEREITQGRVISPADGVVQSIMPWKDGRTRVAIFMSPLNVHVNRAPLSGTVTSVEHIPGGFVPAFNKESENNERVVWHFDTELGDIEMIQIAGAVARRIVPYVPQGTKVEQGDRIGLIRFGSRVDIYLPEGVDVDVEVGQKTVAGVTRIDRD

SEQ ID NO: 9456 - protein, 260 aa, Streptomyces avermitilis
MPLSLRLSIADTLTLGNATCGFMAVYFTTTGILIPHLTGSQESGMARHSAATAVILMLCAAVFDLFDGLVARKLRSSPMGAELDNLSDLISFGLAPAYFVLVYGMVADDAHQRVAAVGAIVVLLAVVLRLARFSCVTVKDGTFQGMPSPFGALTVVSIVLLELPFVATLMAIIGTAWLMVSRVEYPKPRGRLAVAMLSWIVLSMGLLAAWAFDAPSGQLLLQTGCALQLVMGAVIPLFATARRVNNFRDNRREARAAQLP

SEQ ID NO: 9457 - protein, 383 aa, Streptomyces avermitilis
VADAGVNGTRRVLIAADKFKGSLTAVQVAERVTAGLRRVAPAVEVEALPVADGGDGTVDAAVAAGFERRAVRVAGPLGEEVTAAFALRGGTAVVEMAEASGLQRLPKGVFAPLTASTYGSGELLRAALDAGARTIVFGVGGSATTDGGAGMLAALGARFVDAEGEPVAPGGGGLSELALADLSGLDPRLAEIELVLASDVDNPLTGPKGAPAVYGPQKGAAPDDVATLDAALAHFAAVLEKAIGPKAAEYAAAPGAGAAGGIGYGALVLGAGFRPGIEVMLDVLGFAPALDRATLVITGEGSLDEQTLHGKAPAGVAAAARAAGKEVVAVCGRLALPPQELGRAGIRRAYPLTESEPDIAKCIEDAGPILERVAENIARDFLV

SEQ ID NO: 9458 - protein, 377 aa, Streptomyces avermitilis
MTPVGTEPDLADRVLGGWLGRIAGNMLGKPVEQGDHWTRERIDRYLRQAGALPLTDYLPEPVGPGAGDEFALRPEWRQCVRGRIHGSCRDDDVDYAILGLHLLETHGFGFSTEQVGDLWLLRLPYLQTFTAERAAYRNLAGGIRPPLTATYENPYQEWIGALIRADIYGWTCPGAPWRAASLARRDAVLSHTGNGVYGAMWAAALISAAFTAPGVRDALDTALTVIPASSRLARIVRRVASLHETRLSWEDTLSTVAEETAGLGWIHTVPNAAVLTAGLLYGDGDFTRTITLTVRGGLDTDSNGATAGSVAGVLSGAAAIPPQWKDPLEDTVRSAVFGFDGVRISELAARTLALAETEPETGAGPETGAAGTGLDTP

SEQ ID NO: 9459 - protein, 164 aa, Streptomyces avermitilis
VTTPQDFATYIAGLPRVLAGAAVLFRDATGRVLLVEPSYREGWALPGGTIESDDGETPRQGARRETAEEIGLDVEPGRLLAVDWVPGTARPPLVAYLYDGGVLGEEDLKAIRLQEEELLSWRLVPREELPEYLSGALGRRVLAGLDAVAEGAGTAELENGHRVG

SEQ ID NO: 9460 - protein, 146 aa, Streptomyces avermitilis
MTTTGMQQRHGTGSGSGGAWVSGWTAFAGAMMILGGTMAVFEGISAIVHDDVFIVTNSYSYNFNLTGWGWIHLILGILVFFAGIAVFRGELWARITGIVLAGLSMIANFIWLPHSPFWAIVLIVVDAFVIWALCVGTDRDAARTTA

SEQ ID NO: 9461 - protein, 344 aa, Streptomyces avermitilis
VAANAWMNTPRGFTLDASGNPVNVDVRRAVFTPMLGPEYWHFVVGVILTAGYVVAGVYAVGLLWGRRDRYHRLGFTVPFSVAAILTPVQFILGDSIARSVFHKQPVKFAATEIVWKTGTHMPEYMFGRLRSDGSISGGIKIPQLDSILAGFSVNTKVTGLSSVPASDRPTATQATIAHWAFDIMVTIGSLLVLLALWYGWCWLRHRGLPRSPWFFRCAAVAGAACLLTVECGWITTEVGRQPWIVYQNMRVSEAVTDTRASSLWAMLGIVVVVYVLVLGAFLAVLLKMSSRWRLADEDALAGAAAEDLEDDTPYGPRPLSTTGSGHRGGNNDGGSGRDTDRGGE

SEQ ID NO: 9462 - protein, 349 aa, Streptomyces avermitilis
MIEDVVAWVLLAVVAAYACAGGADYGAGFWDLVAGGPERGKRPRWLIDHAMEPVWETNNVWLIFILVIMWTGFPVLFQTVFTAMWLPLALAAVGLVLRGAGFALRKPTRRLARRRIVGAVFALSSLLTPFFLGAAVGGLATGRVAPGTKASADAWANGTSVIAGLLTIAATAFLGAVFLTADARRFDAADLVGYFRLRAWCSLGVIAVLAVVGLAVTHDDARYVHDGLTGGIGLALVLVAVVSALATAGLLYRTATGWARITAVGSVALVVVAWGLAQRPYLIPTSLTVSEAAGASTTLRWLMLVTVIAVVLVGPPLVLLYRLDTRGALQPLTDADLRRTASGRDPENP

SEQ ID NO: 9463 - protein, 188 aa, Streptomyces avermitilis
VTGAGAGAGIQAAEESPIVLVVGVTGSGKTTVGKAVAEQLGLEFVEGDDFHPAANIAKMTAGHALDDADREPWLRALADRIRHSAAAGEGLVVACSALKRAYRDKLRAAAGPGLWCLYLALDRDTARDRVSRRTGHFMPAQLVDSQFETLEPLEPDEPGMTMDATAALATILTRVRAAVPRSGRGTAP

SEQ ID NO: 9464 - protein, 151 aa, Streptomyces avermitilis
VSDESVEMGPIDYLVVEFPGNRMTGEGFPLLVDLVDRGIIRILDLMFVGKEKDGSVVGLEIADLTGDGALDLAVFEGASSGLLGQDDIEEAGAALEPGNSAGILVYENLWAAPFATALRRGGAQLVASGRIPVPAILAALDATDADQPPTM

SEQ ID NO: 9465 - protein, 455 aa, Streptomyces avermitilis
MTSSAPPPDPDQHSADPSGDQRLSARERSELDKLRHRVSALEGAGPSGAGPSGAGRHHWLRSTGSVLLILLASLLSLLAVVAVWANSIVRDTDRYVATVGPLAGNPDVQKAITNRVTSAVLAQIDVEALVKELEQAAAQQGAPPKAAQLLGDLSGPITSGLKSLVSSTVQRVVSSSAFDTLWVDANRSVHSALDKALTGHDGGAVSLKNDQVAIDVGPIVAKVKDQLVSAGFKPAARIPAVHTDFVVFASKDIGEIKTYLRVLEIIGNWLPVIAVLIGAVGVYLAVNRRRALIGIASGVFAAMLLLGVALTVARAIYLDHLPSGTSDAAAGAVYDALVKFLRASVRAVGALALLTAVGAFLSGPSRAAVLTRTGCRRSIGALRDVAVSAGLPLGAVGRFVHRYKRWIGGVILVVAAVVLFTWSYPTTAVVVWTVVIVLVAFAIREFLDAPPTEPA

SEQ ID NO: 9466 - protein, 318 aa, Streptomyces avermitilis
MIHVRAVCPPDLTERTMALLSAEPCVLNLVLQTGGVRNPDGDAIECDVLTGAANEVLRGLRALGLEHDGSIVLDPVDMVFSERAARTGAERLGARLRAPVWEQVEARIRAEGRYPPSFYLFLVIAGIIGAVGIITNSQILIVAAMVVGPEYGAITSIALGIDHHSRPRIQRGLVALLVGFLLAVAATFLFALVVRGSGLQPTAFELGIRPVSNLIDTPNFFSAVVAVLAGIVGIVSLAEARTSALLGVFISVTTIPAGADIGVSCAFASWDEARGSLFQLLLNIVVLIVVGTGTLKCQRAIWRRVSERRHEGAVRRAP

SEQ ID NO: 9467 - protein, 310 aa, Streptomyces avermitilis
MRTPDELSEAGFRSLYRHLRDTAPGGGTRRGALDTISAEQVLAAVREVRSGRTVSLAAPVNTHAAPDDADPAEHRLTAPADGEPDPTGVQFARDRIAMNIHGDVNSHIDALCHVIYDGTLHGGIPAADALSPDGASALSIALARDGIVGRGVLLDIPQLHGVPWLEPGSQVTAEDLAAAEAGQGVRVGRGDILLVRVGHRRRRAELGAWDVADARAGLHPAAMEFLAEREVAVLGSDGNNDAAPSAAQGVAFPVHVLAIHAMGLHLLDYLRFEDLVPLCARDGRWSFLCVIAPLRLPAATGSPVNPLAIL

SEQ ID NO: 9468 - protein, 545 aa, Streptomyces avermitilis
MSPSPGRTDDVPRTVAGMTDARHYDVIIIGTGAGGGTLAHRLAPTGKRILLLERGDYLPRERDNWESTAVFVKGKYRAPEFWYDKHGNQFPPEVNYYVGGNTKFYGAALFRLRPEDFGELRHHDGISPAWPLSYEELEPYYTQAEHLYLVHGRHGEDPTEGPTSAQYAYPPVQHEPRIQQLSHDLEKQGLHPFHLPIGVNLTQDDRGRATHASACIRCDRVDGFPCLVGAKSDAQVICVDPALEHANVEMLTHADVRRLDTDATGRSVTSVVATVGDGAASTVEFSADIVVVACGAVNSAVLLLRSADDRHPQGLANSSGVVGRHYMRHNNLALMAVSKEPNDTKFQKTLALHDWYLGSDDWDYPLGGIQMLGKSDAEQIHGEAPRWAGAVAPDMPFEVLAHHAVDFWLCGEDLPLAENRVTLDGDGGIHLALDEKNNIAGLKRLRHKLQGMLSHLGMHEHHLLSHSIYLHKGMPIGATAHQAGTVRFGRDPADSALDVNCKAHDLDNLYVVDTSFFPSIGAVNPSLTAIANALRVGDHLAERLR

SEQ ID NO: 9469 - protein, 472 aa, Streptomyces avermitilis
VTAGHPADHETRHRTPRERAALGKAARSSVPRSSHAEFAPPQKRPDPVDVVDAQSATRVPELVPIRYGRMTESPFRFFRGAAAIMAGDLAGTPRSGFRTQLCGDAHLLNFRLLASPERRMMFDINDFDETLPGPWEWDVKRLTTSLVIAGRANGFSAKERAGIVRSTVRSYREWMRRFAGWGNLTVWYAQFDEEWVRAHFIDEASAGIRDSWSQAVAKARTRDSLHAFGQLTHIVDGKVRIAADPPLITPLQDLLPDVERGALEKEIRRLIERYGRTLQSDRRILLEQYRVADLARKVVGVGSVGTRCWIVLLLGRDDKDPLLLQAKEADESVLAPFAGASGYRTQGERVVSGQRLMQATSDIFLGWERVDGIDGRRRDFYVRQLRDWKGIAEPEVMVPAGMRAFGELCGATLARAHARSGDRIAIAAYLGGGDVFDRALVTFAERYADQNEKDHQALVDAVRTGRVAAEAA

SEQ ID NO: 9470 - protein, 605 aa, Streptomyces avermitilis
MERYPPIADHGLVGDLQTAALVSSQGVIDWFAAPRFDSPSIFASLLDHDGGGHFLLAPEHPEGTWRQLYYPDTGVVVTRFMSPDGVGEIIDYMPVLPGPTASDRHSLVRIVRSVRGTVRFRLVCRPRFDYARATHELDLTPDTATFRAPGTTAFLQSTIPLERDEQDVRGAITLNGGESAAAVFTVCAPGGEAPPPPTTERITEELWENIAFWHGWVRTSRYHGRWTDMVHRSAITLKLLTYAPTGAPVAAATMGLPEQVGGERNWDYRYTWVRDGSLSVRALLDLGFVEEAARFTRWLGDRLSAREGPDDEPLQIMYRVDGDPHLTEEILEHFEGYRGSYPVRAGNAASDQLQLDIYGEALYALAEGREIGEQTGYHGWKALAGTLDWLVDSWDRPDEGIWETRGGRQDFTYSRVMCWAAFDRGLRLAATFRRPADTVRWTQARDAILEQVMERGWNDKEQALVQHYGGDVLDASLLLAPRVGFIAPRSPGWLNTLDAMDRVLVSDSLVYRYDPQASPDGLRGSEGTFSLCTFLYVDALARAGRLPQARYTFEKMQTYANHVGLFAEEIGPSGEQLGNFPQAFTHLSLIMAATTLDEALDGPHH

SEQ ID NO: 9471 - protein, 160 aa, Streptomyces avermitilis
VKQHMLVDSPYGPLTLVAADGVLCGLYMVAQRHRPSEETFGARDDTPFGETVDQLTAYFAGELTEFDLPLRLDGTPFQRTVWEQLRRIPYGETRSYGELAGALGNPKASRAVGLANGKNPLGIIVPCHRVVGADGSLTGYGGGLERKRRLLDFERGAALF

SEQ ID NO: 9472 - protein, 488 aa, Streptomyces avermitilis
MHIDSERCVRAVRSKDARFDGWFFTAVLTTRIYCRPSCPVVPPKPANMTFYPSAAACQQAGFRACKRCRPDTSPGSPEWNQRADLVARAMRLIGDGVVDREGVPGLATRLGYSTRQIERQLLAELGAGPLALARAQRAQTARLLIETTSLPMAEIAFAAGFSSIRTFNDTVREVFALSPSELRGRLPKKTVVSPGALTLRLPFRAPLNPDNLFGHLAATAVPGVEEWRDGAYRRTLRLPYGHGIVALTPAADHIGCRLSLSDLRDLPVAISRCRRMLDLDADPVAIDDQLRADPLLAPLVDKAPGRRVPRTVDEAEFAVRAVLGQQVSTAAARTHAARLVTAHGEAVTDPEGGLTHLFPAPEALAAVAPESLAMPRTRRTTFTTLVRQLAEGGLHLGVESDWEETRARLLSLPGFGPWTADVIAMRALGDPDAFLPTDLGIRRAAEELGLPSTPAALTARAAAWRPWRAYAVQYLWATDSHPINFLPV

SEQ ID NO: 9473 - protein, 509 aa, Streptomyces avermitilis
MTLQARTQTSYWLETAPPGAPAPVPAGDTTVDVAVVGAGIAGLSAAWELTRRGRSVAVLEAGRIAAGVTGHTTAKLTALHTLVYDRLRRTRGTDAARLYARSQTDAIRRAAEIVDELGIDCEWEEAAAYTYVRDGARADEVRAEAAAAREAGLPAEYVTETELPFPVAGAVRVTGQAQFHPRKYLLALADEIRRRGGLMHERTRVVDLTEGEPCVLTTENGARITADAVVVATHYPVFDRALLFTRLSPRRELVVAAPIAEERAPRGMYITPEENTRSMRTAPYGEGKRLLIVTGEHFTPGAGDDVEERFERLAEWAARHFGDLTFTHRWATQDNDSTDSVPLVGPLHPGSRHTYVATGFGGWGLSGGIMAGGLLGELITGGTAPWRDLYDPGRVASVVREGTEFLKHQAQVAGHFVGDRLPPLSGPSVTGIAPGDGAVVHAGGERCAVYRDDDGQVHAVSARCTHLGCLVAFNRAERAWECPCHGSRFAPDGQILQGPAVRPLEQRDI

SEQ ID NO: 9474 - protein, 472 aa, Streptomyces avermitilis
VPSMLDVVVVGAGPNGLTAAVELARRGFSVAVFEARDTVGGGARTQELTLPGFRHDPCSAAHPLGINSPAFRAMPLERYGLQWLHAERPMAHPFTDGTAAVLSRSVAETAASFGPRDAGTYRRLVEPFLSRWDTLAQDFMSLPLTALPRDPVTLARFGLVGLPPSTWLTRRFRDERAKALFAGLVAHVIAPLDGIATGAVGLVFALAAHARGWPVARGGSQSISDALTAYLKDLGGTVHTDYEVKRLDDLPPARAYVFDTSPTALARIAGFGRYYEGYRYGASVFKIDYALDGPVPWTAKEARTAGTVQIGASSAEIGTALRAASREGRAPDPPFLITVQPSVVDPSRAPDGKQVFWAYGHVPNGWTGDLTDAMERQLERFAPGFRDRVLARATAGPPELAAHNANYVGGDIACGAASGLQLLLRPRLSLFPYSTPHPAVFICSSATPPGPGVHGMSGHNAAKAVWRRLRSS

SEQ ID NO: 9475 - protein, 281 aa, Streptomyces avermitilis
MIGDTETIEEFLAHRTSDVEEAVRQAAATEIMPRFRQLAAHEIDQKSGPHDLVTDADRKAEAYLTEVLAKLLPGSVVVGEEAVHANPVTYEAIQGEAPVWIVDPVDGTRQFVHGDPGFCTLVALAQGGVVHASWTYAPALDQLATAIRGRGAHLDGEPLRSGAPDPGRDLEVATSHPDYTTEEQKRALLALRTEGVLPRPCGSAGLEYLAVARGELDATAFSWEAAWDHAAGLLLVEEAGGAHLTRAGEPFRITGGNALPFTAARDEATARRVVGLLSAGG

SEQ ID NO: 9476 - protein, 645 aa, Streptomyces avermitilis
LDLSRVTRTPQIPPRADPERRPIWPMSGNSEVRGRMFTTRPTLQGTFGMVSSTHWLASQSAMAVLEEGGNAYDAAVAAGFVLHVVEPHLNGPGGEVPIILAPAGGEVRVLCGQGVAPAGATIEHYKGLGLDLVPGTGPLAAAVPGAFDAWMLLLRDYGTKSLADVLKYAIGYAQDGHAPVERVGETVETVRELFETEWVSSAEVYLPGGKAPRPGELFRNPALAATWKRLIAEVSGTGDRVAQIERAREVWRGGFIAEALVRQSGRPTLDTSGERHTGTLTAADLASWAATYEAPATYDWQGWTLCKAGPWSQGPVLLQQLALLPPELPRYGSADYVHLLIEGCKLAMADREAWYGDAAEVPLAELLSDAYNAERRVLVGHKASYELRPGSPGGRTPRMSGHARVVAADEPEPAFGPPGAGEPTVAKSPLSPVPGEPDIAADGGTRGDTCHLDVVDRWGNMIAATPSGGWLQSNPVVPELGFPLGTRLQMAWLDEGLPNSLTPGRRPRTTLTPSLALRDQVPVLAFGTPGGDQQDQWQTHFFLAVVLRSGVRGGLDLQGAIDAPNWHNDSFPGSFYPRGTRPGSVTVESRTDPGVVEELRRRGHDVLVGEAWSEGRLCAVARDPETGVLSAAANPRGMQGYAVGR

SEQ ID NO: 9477 - protein, 287 aa, Streptomyces avermitilis
MDYCSSCRRHLNGALVCPGCGAYAPDIAPATVDGGVVPSWAGTATTGTTVSESVPWEYPASDTWHDGRLRDEAAVEAGLEEAPETDPYGDLEGTMPAPAPQGRAARRRQLARWKKNQRRAVVATAVALVGGGLTVAAMDRHSADRAQASTAPEVATMGTADEQVAEQPHPSSTQPGTRLSSHTPPAQSPTTDLPRRRSAAAPPRVTPPSAQPFAAASPPPTARAAAPQPRTASPSTVGTVPDGTGTAAKETSASAGADDTAPGAPQASPAPTTTSPSQICLLLVCLG

SEQ ID NO: 9478 - protein, 143 aa, Streptomyces avermitilis
VSSMDAVWVRGVNGIQLHHVTDLQDAGRFLGNAAMALRAAHVRTGADRYSSIATELKSLVQRVRELEDEARSSMHDLHSTDPERFARCRDGHEPWPGEIPAGFIPRHTCKDECLYHDRDVLDAITQCTCGRPPCRACEIGGKL

SEQ ID NO: 9479 - protein, 387 aa, Streptomyces avermitilis
MAKILAVLYPDPVGGYPPDYARDEIPAITGYPGGQTTPTPQTIDFTPGQLLGSVSGELGLRRFLEDRGDTYVVTSDKEAPDSTLDRELPDADVVISQPFWPAYLTAERIASAPRLKLAITAGIGSDHVDLPSAIAHGMTVAEVTFSNSISVSEHAVMQILTLVHNYMPAHDWVTAKKGWNIADSVSRAYDLEGMDVGVLGSGRIGQAVLRRLAPFDVRLHYSDVHRLPKEVEEELELTWHPDARSLASSVDVLSIHTPLHPQTQNLFDDDLIGAMKRGSYIVNTARALIVDRDAVVRALNSGQLAGYAGDVWYPQPPPPDHPWRTMPYEAMTPHVSGSTLSAQARYAAGTREILECWFDGRPIRPEYLIVDGGGLAGTGARSYTVTG

SEQ ID NO: 9480 - protein, 204 aa, Streptomyces avermitilis
MRADESGPERESREPTHIPGAEPELGGEPTPRGEPGPGFEPGPGGEPAPSRAPFRSRLRKGVLAAVALGGVLGGSARYALGLTFPTPRGTFPVTTFAVNVSGAFLLALLLVYVLEIWPPTRYVRPFAAVGFLGSFTTFSTWMVDTDRLLGHGHYAVAAFNVFGSLFAGLAATGLGLAIGRMALARRVRLAARHGRARRYGWWVR

SEQ ID NO: 9481 - protein, 212 aa, Streptomyces avermitilis
VGNVGLLFVGAVLFMNGLLLLGKVDAKAAAVFNLFIGALQVLTPTYLIFTANGDPMKILAASGIYLFGFTYLYVGIGLLTGLDSTGVGYYSLFVAVAALGYSFVNFRLFKDYPFGVIWLYWAYLWFLFFLLLGLKKDDLKIYTGWVTAIEGWVTGAIPAGLLLSGYWKHPTETAIALAVFGVVVFVGLWPRTHRTPRPTSAAPRTGGVGAPT

SEQ ID NO: 9482 - protein, 416 aa, Streptomyces avermitilis
MPEILFSVDHSKSMRDQAVPGHNRWHPDVPTVAMVKPGAEFRMECRDWTDCQVGNNDTANDVRDIDLTIPHMLSGPIGVEGAEPGDLLVVDILDLGPVPQQTGDAAGQGWGYTGIFAKANGGGFLTDYFPDAYKAVWDFHGQQAVSRHLPGIRFTGITHPGLFGTAPSAEMLARWNTREQALIDTDPNRVPPLAVPPDATNALAGTATGDLARRIGEEGARTVPARENGGNHDIKNFTRGSRVFYPVHVQDAKLSGGDLHFSQGDGEITFCGAIEMGGFIDFHVDLIKGGMETYGISTNPVFIPGNVEPRYTEFLTFIGISVDHDTDTNYYLDATLAYRRACLNAVEYFKKFGYSGEQAYLLLGSSPIEGRISGIVDIPNACCSLYVPTAMFDFDVRPTAAGPMKADRGQCALATA

SEQ ID NO: 9483 - protein, 298 aa, Streptomyces avermitilis
MFVTNARSPRLPGAASPARRSPRTGGISPFTAETRISRATTNATTKPGAPVAGPNWCCSPASRAWWRRGASGVTPCAETACHHRRVIAIRPKPARCAALACLLALAASGCGLSAELDRERNPERRPTPSPTRAAPSPTRAAPPPASATPGPSPVVPVQQERGCPPSGLRFDSGPVDAAMGLRAMTLTLTNCGKRSYEVNGYPSVRVLDERGTPLTGVRTVEGTDKVFMAPQDPGPEPLTLAPGETARAGLYWRMGAEDGTYLRVAPKTGRDAMNVRPQEPLDIGPENTLGTTAWAPAS

SEQ ID NO: 9484 - protein, 222 aa, Streptomyces avermitilis
VSSLPLPLALTARLLPVAVLASAGWALTSGPFAPAPTAQHKPTQKTQTQSPTAPSTTAATKTYASAPAPCGAVPEKTVTSLVPGTKTAGKEIASTDKSVRRTCSWNALKGYDYRWLDVSYEISDTDKAAQKTFEQRTTEKSGGGAVPGLGDEGYSVVNLTTEDKQQTREGVVMARVSNALVTVTYNGSDFETQKAPGTDEINKGAIKAAKAAVAALEDGQKA

SEQ ID NO: 9485 - protein, 513 aa, Streptomyces avermitilis
LIGLPMTETVPPDSPPTAQVTLPDGRVEIAPDAPAPSGPYANEDLLPVPVEKRTWTTYNFSALWVGMAHNTASWTLASGLIAVGMDWKQAVLTIALANLIVLVPMLLTGHAGPKYGIPFPVFARASFGIRGANLPAVVRALVACGWFGIQTWIGGEAIYFLAGKLFGDSWANASKVGGYAWTMWLSFAIFWVLQVAIIYRGMETIRRFENWAAPFVLVGAGVMLWWMSSKAGGFGPLLDQPSKLGWGPDFWKLFAPSLMGMIGFWSTLSLNIPDFTRYGRSQKAQTWGQALGLPTTMTLFAFLSVMVTSGSQVVYGEAVWDPVQLAAKTDNVFGIIFALVTVLVATLSVNIAANLVSPAFDFSNIAPRKISFRTGALATCVLGVLIFPWKLYSDPQGYIFTWLGLVGGLLGTVAGILIADYWILRRGSLDLADLYRAGGRYWYDGGWNWRAVVAFVVGGVLAVGGADFHPLIDGRPIPALQSLADYGWAVGLGTSTVLYVVLMALRGRDKAAV

SEQ ID NO: 9486 - protein, 341 aa, Streptomyces avermitilis
MDFGLVLQTDPPASRVISLMKRAERNGFRYGWTFDSAVLWQEPFVIYSQILANTQKLTVGPMVTNPGTRTWEVTASTFATLNDMFGNRTVCGIGRGDSAMRVAGRKPNTLARISGAMKVIRALGRGDEADLGGTVVKFPWVKPGAELPVWMAAYGPKALKMTGEEADGFILQLADLYLTEYMVKAVKDAAVAAGRDPSEVRICVAAPAYVTADDSPEALAHAREQCRWFGGMVGNHVADLVSKYGEHSAAVPDELTDYIKAREGYDYSHHGRTDNPDTAFVPDEIVDRFCLIGTVEQHIEKLNALRELGVDQFAVYDMHDAQEAVIDAYGTKIIPAVNGPQ

SEQ ID NO: 9487 - protein, 466 aa, Streptomyces avermitilis
MSRTVIRGGLVVTASDEIHADVLIEDGRIVALAASGTPAAEAWTAERTIDATGKYVIPGGVDAHTHMELPFGGTFASDSFETGTRAAAWGGTTTIVDFAVQSVGHSLREGLDAWNAKADGKCAIDYAFHMIVSDVNNETLKEMDLLVEEGVTSFKQFMAYPGVFYSDDGQILRAMQRSAENGGLIMMHAENGIAIDVLVEQALARGETDPRYHGEVRKALLEAEATHRAIKLAQVAGAPLYVVHVSAQEAVAELARARDEGLNVFGETCPQYLFLSTDNLAEPDFEGAKYVCSTPLRPKQHQAALWRGLRTNDLQVVSTDHCPFCFVGQKELGRGDFSKIPNGLPGVENRMDLLHQAVVDGHISRRRWIEIACATPARMFGLYPKKGTIAPGADADVVIYDPHAEQIISAETHHMNVDYSAYEGRRVTGRVETVLSRGEPVITEREFTGRAGHGVYTPRSTCQYLN

SEQ ID NO: 9488 - protein, 280 aa, Streptomyces avermitilis
MSRVIRAAVFQTAWTGDKESMIQVHEQAVRDAAAQGAQVLCFQELFYGPYFCQVQDKAFYEYAEQIPHGPIVKRFQALARELGIVLVLPMYEEEQPGVLYNTAAVIDADGSYLGKYRKTHIPQVEGFWEKFYFRPGNSGWPVFDTAVGRIGVYICYDRHFPEGWRALGLAGAEIVFNPSATSRGLSGYLWQLEQPAAAVANEYFVGAINRVGVEELGDNDFYGTSYFVDPEAQFVGEVASDKETELVVRDLDLAKLREVRDRWQFYRDRAPGAYGPLTAP

SEQ ID NO: 9489 - protein, 519 aa, Streptomyces avermitilis
MTTALEPALSVRQVLTLDRVLAGEPEVVAGAGHLDRPVRWVHVAEAADVGVMLTGGEMVLTTGVLLAGDPEAQAEYIRSLHRAEAAAVVLGLGRAFPAPPDVMRRAAERCGLPMVVLHRPFPFAELTEEVQSRLVRQKFAAVSLSEAVRTALTGLITAGAPLQRMLDEIAGHAACPVVVTNLAHRVLATAGERSAVDDVLRDWERIARQAGGSEGAGWVRAELGGRGERWGRIVLCGYRGDAATGRLLADRAAEALVLHRMLGGSAHTWEEQSAQGLLTDLVSGVVPARQLLPRARAAGLPVNRRTFVPLVVRDGEPPVLDRVLRMLGLPGLVAELADGATAVLLSLARDQDAEALSAHFATRLRTESGASGTVVAAADPRTAWDDVPAGLREAQHVADAVAENSAVLDLPAVVRLRDVHLRGLIRLLRDDPYVQSFAERELNGLLCGRDAESDLLPVLRTYLATGRNKSRTAQLHHVSRPALYRRLEAIQARLGVDLDDFEQAASVHIALLAHDAQQG

SEQ ID NO: 9490 - protein, 426 aa, Streptomyces avermitilis
VSDLYGRHRSVLPDWLALYYADPIEITHGEGRHVWDAAGNRYLDFFGGILTTMTAHALPEITKAVSEQAGRIVHSSTLYLNRPMVELAERIAQLSGIPDARVFFTTSGTEANDTALLLATTYRQSNQILAMRNSYHGRSFSAVGITGNKGWSPTSLSPLQTLYVHGGVRTRGPYAELGDADFIAACVEDLKDLLGHIRPPAALIAEPVQGVGGFTAPPDGLYAAFREVLQEQGILWIADEVQTGWGRTGEHFWGWQAHGQSGPPDILTFAKGIGNGMSIGGVVARADIMNCLDANSISTFGGTQITMAAGLANLIYLLEHDLQGNARRVGGLLIERLRAIGAQLPVVREVRGRGLMIGIELVKPGTDEANPQAASAVLEAAREAGLLLGKGGAHNTSALRIAPPLSLTVAEAEEGAAILDRALRSV

SEQ ID NO: 9491 - protein, 280 aa, Streptomyces avermitilis
MAHVVRAALVQATWTGDTESMIAKHVEHAREAARQGAKVIGFQEVFNAPYFCQVQEPEHYRWAEPVPDGPTVVRMQELARETGMVIVVPVFEVEQSGFYFNTAAVIDADGTYLGKYRKHHIPQVKGFWEKYYFKPGNMGWPVFDTAVGKVGVYICYDRHFPEGWRQLGLNGAQLVYNPSATSRGLSAYLWQLEQPAAAVANEYFIAAINRVGQEEYGDNDFYGTSYFVDPRGQFVGEVASDKSEELVVRDLDFDVIDEVRQQWAFYRDRRPDAYEGLVRP

SEQ ID NO: 9492 - protein, 559 aa, Streptomyces avermitilis
LVFSTGSEYSSLAGVVAMAVEQLPRQVGEFARYLNGLLARLDQDGGWCGVFWQRDPDGMRACLDGWEVPPWDVVEALLQDLAAEYGPGAVAEEAERARSLHAASLAAYDARPGGRDALGDRLDVMLREQRYAAERQAELGRLLPSAGSHEEADSVRLDLAWARDDHDRATARCAELRRRMEDLDRRALRAHGQGTQHFPPSGSGTGGVFRAQEAGQREPDGTGDSRPRRLRPQQQGYGPTGHADLSGRTDLTGPTGPTGSTGPTDSTDSTGFDGLTGPADPADPVSPTGPTDPTDPPHTTDNPPPVTSAAPATMPKQRGKRRPRGSARFAGMIDAQETPPAATLPAAPAPAPAPNTGRTPRGARFAGAAGQAPAAKPRREPLDDEARRDTIETVRTLTRLRGEGRSGEAHALLVEAAYWPAARFPLLAAELHRVGLGADWATLLWEAASLPADRLVAAADALVAAGRTVDGQQMLRQGVVRPAPEIGEALLGLTGDGRHREARALLDAYVRIRTPEEAARSVEADPHTLVPLLLEAARGVSEECHWDLVHALRVAGFTT

SEQ ID NO: 9493 - protein, 85 aa, Streptomyces avermitilis
VVMVRTPLTPEEHERGERLGQLLREARGSRTMADVAASAGLSAETLRKIETGRAPTPAFFTVAALARALGLSMDDIAGRCVLIGV

SEQ ID NO: 9494 - protein, 261 aa, Streptomyces avermitilis
MVELKTDTSIDAMHEAGQVVGRALTAVREAADVGVSLLELDEVARGVLREAGASSPFLGYRPSFAPTPFPAVICASVNEAIVHGIPDGYRLRDGDLVSVDFGAELGGWVGDSAISFIVGTPRAADVRLVETAERALAAGIAAAVVGNRIGDIAHAIGSVCRAAGYGIPDGFGGHGVGRRMHEDPPVPNEGRPGRGLPLRHGMVLAIEPMLIGGGTDGFHAAADGWTLRTDDGSRAAHAEHTVAITDAGPRILTARTKTHAA

SEQ ID NO: 9495 - protein, 599 aa, Streptomyces avermitilis
MRRPVARNLAVLAVSAAVVSVGAAAPPTAVTSVRKVPVAVGYGGAVSSVDADASAAGIEVLKKGGNAVDAAVATAAALGVTEPYSSGIGGGGYFVYYDAKSRTVRTIDGRETAPLSADSHLFEENGKALAFADAVTSGLSVGTPGSPATWQTALDKWGSKRLGTVLKPAERIARDGFTVDSTFRTQTASNEARFRYFPDTAKLFLPNGELPVVGSTFKNPDLARTYAELGTKGVDAVYRGDLGEDIVATVNKPPVEPSSGWNARPGRLSAKDLEAYRAKLQAPTKTSYRGLDVYSMAPSSSGGTTVGEALNILEKTDLSKADEVQYLHHYIEASRIAFADRGRWVGDPAFEDVPTKELLSQKYADSRACLISDDAVLTSPLAPGDPRSPAKACATGGTAAPTTYEGENTTHLTVADKWGNVVAYTLTIEQTGGSGITVPGRGFILNNELTDFSFTPANPAVHDPNLPGPGKRPRSSISPTIVLDRHDKPVVALGSPGGATIITTVLQTLTGFLDRGLPLVDAIAAPRASQRNAAQTELEPGLYDSTLRGKLEAIGHSFKLNPEIGAATGVQRLSNGKWLAAAEKVRRGGGSAMVVRPAS

SEQ ID NO: 9496 - protein, 251 aa, Streptomyces avermitilis
MNDDVRNIVLGVVAAGISAALGWIARTYLWKRKLRRKQAFFGLPDNSESLLVVNREAGGPELTVMRHDVFALLELSALIKDCGAHAQVVAHDAAQQGFGERTEFCVGGPSSNRRMAAHLHSLLPGIQVNTDPEPGPDRGAFQIGTERYRLESGKGEYVLLARLTADLGHGTRPVFLFCGQRAITNQAATRYLARNHERLARKYGGNSFVLLLKVVNSQAYGPDVVELVADVTRAAQTPAPVVAPRNSHRAS

SEQ ID NO: 9497 - protein, 522 aa, Streptomyces avermitilis
VGHARKTLRTTAVSAVSATLIAGTALGLAPTAQAASGGVSFVDIAGDGGTVLKANVVTPAGADGSRTYPLIVLPTSWGLPQAEYLAQAHKLADSGYVVVSYNVRGFWQSGGYIEVAGPPDVADASKVIDWALAHTPADARKVGMAGMSYGAGISLLAASHDKRIKAVAALSGWADLTDSIYSGRTQHVQAAALLDGAGTLTGRPSPELQQVFKDFFASDLSTEPDLLAWGKKRSPETYIDQMNKNGAAVFMANGWGDTIFSPNQLAKYYEELTGPKRLEFRPGDHATAEIAGLFGVPNDVWTDTERWFDHYLKGEDNGIDGEQPVQLKPRSTGDYEGYPDWKSVGATTKKIALTGTTTIHTNVDSGANGGLIFLSSILDQLAQLPPMASIPLLPRYWAAVWQSEKYTSGQHVRGTVKLHTTVTGTKESGTLVAYLYDVGPLGVGKLVSNAPYTFHGQTPGQPFGVDLELSSTAYDVPAGHRLALVVDTVDSLYIEHNPSGAQLTFSSPEHDTSYVSVPLREQ

SEQ ID NO: 9498 - protein, 296 aa, Streptomyces avermitilis
MTTKTLEATALYDIPGPRTRQRHRLYGVLSTVVLLALVGWIVYLLFDTGQFTYTKWMPFEYKGIQELLLRGLGNTLKAFGIAAVLSLALGGLLATGRLSDHAPVRWVATLVVEFFRAMPVLVMIFFIFVALKVQPLPALVAGLTLYNGSVLAEVFRSGVESVERGQREAAFALGMRKTQVMAHVLVPQAVRAMLPAIISQLVVALKDTSLGYLITYEEFLHAGKLIASNLDYDLPFIPVVMVISPIYIGMCMLLSWFAQWVSRREQRSPKTEAVEVAAAEPGTLLPRGGPPTAPRP

SEQ ID NO: 9499 - protein, 214 aa, Streptomyces avermitilis
VNVLTDNFSTFAKGFLGTVELTVYASALALVLGFLMASFRVAPVASLRAFGTAWVTVLRNTPLTLLFFAVLLGLPRFGLVLPFEVFAVLALGCYTSAFICEALRSGINTVPRGQGEAARSLGMTFEQTLSVVVLPQAFRSVISPVGSTLIALAKNSAIAGAFSVNELLGTYKTLSELGYNIVWTFVWIAVGYLIITLTISAIFNFLERRWGVAR

SEQ ID NO: 9500 - protein, 305 aa, Streptomyces avermitilis
MIRSTRVCLALALVLITALLATACGKEGSPPTKGPATDKLPDYQVAQGFQLNDSPTWKRAKKRGYLTVGVKEDQPYLGERDPASGAFSGFDIEIAKMMSASLGFDPGTIRFKTIASANRETALQNGQIDYYVGTYTINDKRKKLVGFAGPYYLAGQSLLVRKDEQGINGPQDLAGKRVCSAAGSTPYQRIQQDYPKVKLVAYDTYSVCVDNLLTYQVDAVTTDDAILIGYAAKVPEELKVVGKPFSEEPYGIGVPRNDNALRFALDDALEAREKDGDWKKAYEATLGLSGVPAPTPPAIDRYPAS

SEQ ID NO: 9501 - protein, 253 aa, Streptomyces avermitilis
VSRAGCMAVDPLIELHDVNKYFGELHVLQDINLTVGKGEVVVVIGPSGSGKSTLCRTVNRLETIESGTIRLDGQPVPDEGKALAKLRAEVGMVFQSFNLFAHKTVLQNVSLAQVKVRGRKKDEADRHSRELLDRVGLADQALKYPAQLSGGQQQRVAIARALAMNPKALLFDEPTSALDPEMINEVLEVMQQLARDGMTMVVVTHEMGFARSAANRVVFMADGRIIEDRTPEEFFTNPRTERAKDFLSKILKH

SEQ ID NO: 9502 - protein, 146 aa, Streptomyces avermitilis
MNIPFLGNWRKKHGAAFGVAVFTDGDSDREGVAELLSECELLRSQAEQAGVELDDSATSLEALDQLLPRWRDDEEILPWLGNDAGLYLGTVIVRTVAGADWEIWTSGRPTVRLAGGREVDVVSAGHEWATTGAPELSQVYAEVAEP

SEQ ID NO: 9503 - protein, 587 aa, Streptomyces avermitilis
VRRRLWGAAALLGLFAGVAPVAAAEAVAAPHGAGPVPLERLFDNTAVSDDQRPGAADFDGSGSSLSAQDLTAAGWTPGRTLTVQGARLTWPRRAAGEPDNVRADAQSVRLRGRGDALAFLAAGTAGSDVSGTGTVRYANGTRSSYRLTASDWRTGPLATKAVALPHINTPAGQLAEKARLYVVTVPLAHGREVASVTLPRGGDLHVFALSIRPSTRGWTGSWAASTSGYTAVGPWTDRTLRLVVHTSAGGPRVRIRLDNTFAAAPVRIGSATVAVQEAGARPVAAPVPLSFRGAAGAEIPAGAQEVSDPVGFQVPADAQLLVSFHLPGTVTAAPVHRLAVQRSYVSEPGDHAGDGTPDAYTSAITSWPLLTGVDVGGGPGSVVMLGDSITDGEKSTQDANHRWPNVLATRVLNQHVVPHYGVLNQGISANRVVTDRYPGDGISTDTGGVSALHRLDRDVLAQTSARTAVVFQGVNDVRWGASADQVIAGLRELADRAHGRGLRVLAATIAPCEGESLCTPAADTRRTAVNTWIRASESFDGVLDFDAVVRDPGHPARLLPAYDSGDHLHPNDAGLAALAESVDLTLL

SEQ ID NO: 9504 - protein, 262 aa, Streptomyces avermitilis
MRIATWNVNSITARLPRLLAWLESSGTDVLCIQETKTTAEQFPADALRELGYESAVHATGRWNGVAVISRVGLEDVVRGLPGDPGFDGVQEPRALSATCGPVRVWSVYVPNGREVEHPHYAYKLQWFEALKAAVAGDAAGSRPFAVMGDFNVAPTDDDVYDVAAFEGLTHVTPAERAALATLREAGLSDVVPRPLKYEHPYTYWDYRQLCFPKNRGMRIDLVYGNEPFAKAVKDAYVDREERKGKGASDHAPVVVDLDVQDA

SEQ ID NO: 9505 - protein, 211 aa, Streptomyces avermitilis
MKLTKKSHACIRLEKDGRTLVIDPGTFSEEDAAVGADAILVTHEHLDHFNEDRLRAGLESNPAAGIWTLKSVAEKLSAAFPGRVHTVGHGDTFTAAGFDVQVHGELHAVIHPDIPRITNVGYLIDDGRVFHPGDALTVPDHPVETLMLPVMAPWSKIAEVIDYVREVKPQRAYDIHDALLTDLARPIYDHQIGALGGSEHLRLTPGASAEV

SEQ ID NO: 9506 - protein, 431 aa, Streptomyces avermitilis
VSETPMNTLQYRFDGPEDAPVLILGPSLGTTWHMWDRQVPELMKQWRVFRFDLPGHGGAPAHPAGSVTDLAARLLATLDALGVHRFGYAGCALSGAVGAELALRHPERLASLALIAASPRFGTADEFRQRGVIVRTNGLDPIARTSPERWFTGGFAAAQPAITEWAVQMVRTTDPGCYIASCEALAAFDVRAELSRIGVPTLVLVGSDDQVTGPAEARTLVAGIPDARLAVVPGASHLVPVEQPAAVTDLLVRHFSTAWQPAFESTTGQTAIPAAPVKPVLAAPAPVAPVAEIAPAAMQPEPAGRPDRYETGLKVRREVLGDAHVDRALASADAFSGDFQEFITRYAWGEIWDRPGLDRRARSCVTLTALVAGGHLDELAFHTRAALRNGLTPVEIKEVLLQAAVYCGVPAANSAFKVAQQVIREETTPQE

SEQ ID NO: 9507 - protein, 190 aa, Streptomyces avermitilis
VGQGGVAVLVRTCAQFTDARGREEVGEESVVQATRITLGLPVHRIGQLSEEIRNVDARLTRLVERRAPQLLDVVGIGPDTAVALLITVGDNPERLDSEASFAALCGVSPVERSSGRRQFRRLNRGGDRQANAALHRIVFTRLRVDPRAQDHYERRIEEGRTRREIVRCLKRYAAREVFHLVKQLRPAPRS

SEQ ID NO: 9508 - protein, 253 aa, Streptomyces avermitilis
VDLSNRTVLIVGGTSGIGRELARRFAAAGSTVAVGGRSPEALSELAGEGFGTISIDVTDSASVASARDAVLARYPELDTVVTMPGIMLLEDLRDPAHFEAAATTIDTNLVGTIRVIDAFTPHLVRRGAGTFITVTSGIAFLPFPPMPTYAASKAAVHAYSEALRAQLDGTGVSVVELVPPAVATAGQEKVNPHALPLDDFATEVVQLLSEDPTPREILVKAALMHRWAERDGTYDDLVAQRSQALAMLPSREG

SEQ ID NO: 9509 - protein, 290 aa, Streptomyces avermitilis
MKDEESGNRLGSYLRARRELVSPARAGLPPGGNRRVPGLRREEVALLAGISPDYYLRLERGRDKNPSPQVLESLARVLRLDDIERTYLLGLTAARPRAPRRKRPEHVPARVHQLLAHLRIPAFVEGRAFDVLASNPMAVALSPRLRPGQNRLRSLFLDPEEQAFHQDWAKAAASFIAGLRTTIGDDTDNPRFVELVGELALSSQRFRTLWARHDVRNLDGGTTTVHHPVVGELRLHRDKLPIDDVILVVYYPDKASDGDEKLQLLAALSQTEPTDTAHSRQADAPRPKTP

SEQ ID NO: 9510 - protein, 80 aa, Streptomyces avermitilis
MEDQIGALGLVLNALFNTRYLEAAVTQPREDGFEARDEDVARLSSFVRHHINMLGRYSFQLPDLPGGLRPLRAPDATDDQ

SEQ ID NO: 9511 - protein, 273 aa, Streptomyces avermitilis
MDWTLGEEFATPEGVVRWGTLGRGDPIVLVHGTPYSSFLWRDIAPALARTRKVFFFDHLGFGQSDRREGQDLSLAAHARNFARLLDHWELSDPSVVAHDIGGAVALRTLLLEKRSYQDLTLFDAVSGGEWERGLFQLFLEHEEVFQKLPGYAHEALVASHLRHATHVGFRPGVLDAFLAPWRGDSGQAAFYRQYSQIRQADTVAYEHLLGGMSLPVRLVWGREDRILPPRYAEWLHERVPHAELHWIEGAGHLLQEDAPGRLLACLTAGFPSA

SEQ ID NO: 9512 - protein, 255 aa, Streptomyces avermitilis
MIEILNSARLERARDTGALVGNILHTLKQRSAVGTNLLDIDQWAKEMITEAGAQSCYVDYAPSFGRGPFGHYICTAVNDGVLHGRPHNYTLADGDLLTLDLAVARGGVAADAAISFLVGKARPAESVAMIEATERALAAGIAAAKPGARIGDLSHAIGTVLSKAGYPINTEFGGHGIGSTMHQDPHVANTGRPGRGYKLRPGLLLALEPWVMADTATLVTDADGWTLRSATGCRTAHSEHTIAITDSGAEILTRP

SEQ ID NO: 9513 - protein, 101 aa, Streptomyces avermitilis
MVRLPLTPAEVERGQRLGALLRRARGCRSMLDVALASHISPETLRKIESGRVATPAFPTIAAIADTLGLSLDAVWAEISQAERTVEDQSVLPVTRHPSLVS

SEQ ID NO: 9514 - protein, 100 aa, Streptomyces avermitilis
VVAVCGRARVGGADLQPHRDAEVENGGVAACRECVGYRVSHAFPMCGHAARVRALAPFGQEATEPTGGQVGVAAEVRWAVLGLVDEVISVRAGVPAQRGQ

SEQ ID NO: 9515 - protein, 790 aa, Streptomyces avermitilis
MTDMTGTQGMDDGAERSPWQRAADGADPRRSADGADVTGPHDPAGEVDVSGSQRPADVARRALRAARGRDARGADAADADADADARAHADAPRADAQADADADADAQAEADPVRDAGPTTSDETSGRRSRPGDVAREALRRATARGSAAGSGEGAPPAPDSPAEPSRPAEHSESGESSEGEELAEGWSGLPAAKEDAQAGRPGDIARQALRAARDDAKQGQREARARGVGAARRSAGASRTDSRERQGTPGEGDERRNRARELREFLAGAFVLPADDPTDLPADALPTDAAPRDETRDAASTHASTSSSTHAEDEVWSGRSTPTADRRADGRETEPRPPVSPSRPLTGSAPSEDTPHQPSAPRVPRSMAAPGRDGELRRTFAALPARTGDGVGVDRFAETWWGDAWVSALEEGALDAARLARGRVYAGQGHVDAITVTPGLVLAYVHGSRPRPYRVQVRLRTLSDDDWDRFLDAAAERPGHIAALLDKEMPHSLADCGIPLLPEPRDLDPQCSCPDSGHPCKHAAALCYQTARLLDEDPFVLLLLRGRGEREVLDALSRRNAARAARAAQEQEPAPLPGVRARDTLARRSLPPLPAPLPAPPHPEQPPVYPAAPGGPDPFALDQLATDAAARAHALLTAGRDPVAELTLWQDAVRLAAARPGSGLTAATRALYASLATAAGRTTGDLARAVAAWRQGGLEGLAVLEEPWDPPAGRFDRARPLLLAADLPAFRPWRNRLTHPKGHAQLRLGHDGLWYAYESEPDHDDWWPRGTPDLDPVGALTGLGAPDEA

SEQ ID NO: 9516 - protein, 962 aa, Streptomyces avermitilis
VTGRMGDGVVPGGAARAAGAVAVRPGVVVDASVPVRLAAVFLPAPLPRQGRVAFWDPAGGPLPPLPGTPLSDEELTVVRPHGAGVRRGTVPAVSLPLDAALPLLARSRRDPAAHPATACWGAAALHALRLVARGRLLPGLTADGLDAWRAGPLDPEDIAHLRAVAAALPYEGHAVPLPGPGPLRLPEPEALMRSFLDAVADTLPRTPAAAYTSGKPFAAREPQRLPGAHDWAAEVAAGMDAGVRVSLRLDLSAYQLFDDGEGARRAGAAVVQVHSLADPTLVVDAAALWAGEADATFGPRARVDAALAVRRAARVWPPLDRLAEQDVPDVLALSEQELSELLGVAATRLGAAGVAVHWPRDLAHDLTAAAVVRPAPGSATDGTGFFESEELLQFRWQLALGGDPLTEAEMDTLAEAHRPVVRLRDQWVLVDPALVRKARKRELGLLDPVDALSAALTGSTEVDGETVEAVPAGALAVLRDRLTAGVRPAEPPEGLQARLRDYQLRGLAWLDLMTSLGLGGCLADDMGLGKTVTVIALHLRRARSEPTLVVCPASLLGNWQREIIRFAPGVPVRRYHGPDRSLEDLDGGFVLTTYGTMRSAAPRFAEQKWGMVVADEAQHVKNPYSATAKALRTIPTPARVALTGTPVENNLSELWALLDWTTPGLLGPLKSFRARHARAVENGEDEEAVERLARLVRPFLLRRKKSDPGIVPELPPKTETDHPVPLTREQASLYEAVVRESMLAIETAEGIGRRGLVLKLLTSLKQICDHPALYLKEDAGGTAGLAARSGKLALLDELLDTLLSEDGSALVFTQYVGMARLITAHLASRAVPVELLHGGTPVPERERMVDRFQSGTTPVLVLSLKAAGTGLNLTRAGHVVHFDRWWNPAVEEQATDRAYRIGQTQPVQVHRLITEGTVEDRIAEMLEAKRALADAILGSGESSLTELTDRDLSDLVSLRRPT

SEQ ID NO: 9517 - protein, 194 aa, Streptomyces avermitilis
VTAASVPRQSSSPDEPSRTPEDPRHRIRRRALTLLIIVLLIGVPAGYLVISANQSRDSGKDKEEKYSATGLTAGWPSRVQRRLYQVPIPGWSSDVAYYETNNWKTSRLYAQFRTSNEALDTFLDNIGTNTGELKQDKIAISARDQRIVGWEFTGPGPWYGLVHHQKDPAPTQDIVVNRSDPQHPMVYVVSRAVP

SEQ ID NO: 9518 - protein, 381 aa, Streptomyces avermitilis
MSTYRDFTHRGSARATVLRTVGTRERRSHLTAPRVPTVGIDIGGTKVMAGVVDADGNILEKLRTETPDKSKSPKVVEDTIVELVLDLSDRHDVHAVGIGAAGWVDADRNRVLFAPHLSWRNEPLRDRLAGRLAVPVLVDNDANSAAWAEWRFGAGRGEDHLVMITLGTGIGGAILEDGQVKRGKFGVAGEFGHMQVVPGGHRCPCGNRGCWEQYSSGNALVREARELAAADSPVAYGIIEHVKGNISEISGPMITELAREGDAMCIELLQDIGQWLGVGIANLAAALDPSCFVIGGGVSAADDLLIGPARDAFRRHLTGRGYRPEARIARAQLGPEAGMVGAADLARLVARRFRRANRRRVERYERYERYVESRRTTKESP

SEQ ID NO: 9519 - protein, 280 aa, Streptomyces avermitilis
VTGTVERTALVELADVSKHYGNIRALEDVSLEVHAGEISCVLGDNGAGKSTLIKIIAGLHRHDGGTLRIEGEDTHLSSPREALDRGIATVYQDLAVVPLMPVWRNFFLGSEPRKGVGPFKRLDVDFMRRTTHAELLRMGIDLRDVDQPIGTLSGGERQCVAIARAVYFGAKVLVLDEPTAALGVKQSGVVLKYVAAARDAGLGVVLITHNPHHAYLVGDRFVLLKRGAMFGSHTREEITLDELTRQMAGGSELDDLRHELERAPAPTHLGGHPRDAAPGD

SEQ ID NO: 9520 - protein, 343 aa, Streptomyces avermitilis
MTATTADERLLRTSPLRKLLGRPELGSVVGAVAVFVFFAIVADSFLRAASLSTVLYASSTIGIMAVPVALLMIGGEFDLSAGVLVTSSALVSSMFSYQMTANVWVGVGVSLLVTLAIGAFNGVMLTRTNLPSFIITLGTFLMLTGMNLGFTKLISGTVSTKSISDMEGFSSAHDLFASTFTIGGVDFKVTILWWFGLVAVASWILLRTRVGNWIFAVGGNKDAARAVGVPVNKTKIGLYMGVALGAWISGQHLLFSFDVVQSGEGVGNELIYIIAAVIGGCLITGGYGSAVGSAVGAFIFGMTSKGIVFAEWNPDWFKFFLGAMLLLATLLNAWVRKRAEATK

SEQ ID NO: 9521 - protein, 334 aa, Streptomyces avermitilis
VARTRTWAIIALAGALSVSLAGCSSTGGKRAEDARKAASAQGKAAVNTPRWTFAMITHSGDGDTFWDIVQSGAEQAAVKDNINFLYSHNAEAQQQAQLVDAAVDKKVDGIIVTLAKPAAMKAAVARAEKAGIPVVTVNSGSEESKAFGALTHIGQDETVAGEAVGEELNKRGRKKALCILHEQGNVGHEQRCAGVKKTFKGTVQNLYVQGTSMPDVQSSIGAKLQADSSIDSLVTLGAPYADTAVKARNDAGSKAEIDTFDLNAKVAAELKDGTLGFAVDQQPYLQGYEAVDLLWLYKYNSDVLGGGKPVLTGPQIITKDQAAKLEQYTKRGTR

SEQ ID NO: 9522 - protein, 249 aa, Streptomyces avermitilis
VDPTVSLQLSVDRSSPVPLYFQLSQQLEAAIEHGTLTPGSLLGNEIELAARLGLSRPTVRQAIQSLVDKGLLVRRRGVGTQVVHSQVKRPLELSSLYDDLEAAGQRPATQVLLNTLVPASAEVAAALGVAEGSDVHQVERLRLAHGEPMAYLCNYLPTGLLGLDSEQLEATGLYRLMRAAGITLHSARQSVGARAATAVEGERLGEPEGAPLLTMQRTTFDDTGRAVEFGTHTYRASRYSFEFQLLVRP

SEQ ID NO: 9523 - protein, 336 aa, Streptomyces avermitilis
MRIGLIGAGRIGTFHATTLSRHRDVGSLIITDVAPARAHELADRLGETAAPGVDEIFTWGVDAVIITAATAAHAELIGRAARSGLPVFCEKPIAVDLPGTLSALSEVDAAGTILQMGFQRRFDVGYTNAREAVRSGRLGRLHTVRAMTADQSPPPPDYLPLSGGIYRDCLVHDFDIVRWVTGREIVEVYATGADAGPAMFREAQDVDTAAVVLTLDDGTLATATATRINGAGYDVRMELAGELDTVAVGLDDRTPIASTEPAGPPPADKPWTGFLERFGPAYEAELAAFVEVVRGERANPCDGREALQALRVAEACELSRHERRPVQLGEIAGGRD

SEQ ID NO: 9524 - protein, 141 aa, Streptomyces avermitilis
MNAPATLDLSSAQQALDSQPFSRLLGTRITAFGDGAATLEVGIREELHQQNGFLHGGVLSYAADNAITFAGGAALGPAVLTGGFSIQYVRPALGHTLVARAEVVHAGRRQAVVRCDLLTVTEDGTEALCAVAQGTVLTAGA

SEQ ID NO: 9525 - protein, 393 aa, Streptomyces avermitilis
MGNVIDLGEYGARFTEDPYPVYAELRERGPVHWVRTPPPEAFEGWLVVGHEEARAALADPRLSKDGTKKGLTSLDVELMGPYLLVVDPPEHTRLRSLVARAFTMRRVEALRPRIQEITDGLLDEMLPRGRADLVDSFAYPLPITVICELLGVPDIDRVTFRALSNEIVAPTGGDAELAAYERLAAYLDELIDDKRSTAPADDLLGDLIRTRAEDDDRLSGEELRAMAFILLVAGHETTVNLITNGVHTLLTHPDQLAALRADMTLLDGAVEEVLRFEGPVETATYRYAAESMEIGGTAIAEGDPVMIGLDAAGRDPARHPDPHVFDIHRAPQGHLAFGHGIHYCLGAPLARLEARVALRSLLERCPDLALDGPPGARPPGMLIRGVRRLPVRW

SEQ ID NO: 9526 - protein, 223 aa, Streptomyces avermitilis
MTAIRLLLVDDDPLVRAGLSLMMGGAADIEIVGEAADGSEVEQLVDRTRPDVVLMDIRMPTLDGLAATELLRGRADAPQVVVLTTFHADEQVLRALRAGAAGFVLKDTPPAQLLDAVRRVAGGDPVLSPAVTRQLMLHAAGGSPDTRRATARDRIAALNDREREVAVAVGRGGSNAAIAAELYMSVATVKTHVSRILAKLDLNNRVQIALLTYDAGLLEADGH

SEQ ID NO: 9527 - protein, 342 aa, Streptomyces avermitilis
VRYRLLGRTGLRVSELFLGAMTFGEQGGVGAPRPECARILDAYAEAGGNVIDTAINYRGGESETIVGELLKGQRDRFVLSTKYTISRDGADPNAAGNHRKNLTLSLETSLRRLGTDYIDVYWVHIWDRNTPIEETVRALDDAVRSGKVLYVGISDVPAWVVSRANTLAEWRGWTPFSALQVPYSLLNRDIERELLPMAEAFGMSVAAWSPLQNGILSGKYTRPGGLEPGTAARLPAEAIGDRERAEAEAVQSAADELGVSCAQVAIAWTMAHSPAVHPILGARRVEQLVENLGAAELTLPTEVLAALESATDFRAGFPADFIDDTSAWVYGTAGHRVVGRAG

SEQ ID NO: 9528 - protein, 479 aa, Streptomyces avermitilis
VDDFGRRSRRRGGAGGRPCVNLSTVSSDKPAPSPGASTYRAVFERMVPARSGPRPPGLPEPAVPLSYGLPRQRWFLPSAVIAALDAGGAERGRHPRRTVRDWIVDLGCVLLAVVIGIAAAEAVTREHDIPHGLAVADQWLGASACAAVWLRRRRPLGLAVAMMPVGLISNTAGGAGLIALFTLAVHLPFRYVAWVGGIQLALLPGVYWLRPDPDLPYVAAVAVAGLLTVTVVGWGMFVRSKRQLVLSLRDRARRAETEAELRAEQAQRLAREAIAREMHDVLAHRLTLLSVHAGALEFRPDAPREEIARAAGVIRESAHEALQDLREIIGVLRAGDADDAGRPQPTLAALDGLVAESREAGMKIVLDHRVTAPAAVPASIGRTAYRIVQEGLTNARKHAPGAEVTVTVAGAPGDGLTVSVRNPAPPGDVPHVPGSGQGLIGLMERATLAGGRLDHGAEGDGGFGLRAWLPWPGPGPDPR

SEQ ID NO: 9529 - protein, 131 aa, Streptomyces avermitilis
MRFPPRITRISAAAALLSALLVGGTVSATTADATAASVGSICYSDLPSQAYDTLDLIESNGPFPYSQDGAVFQNREGVLPTQSSGYYHEYTVKTPGSSTRGARRIVTGKQTQEDYYTSDHYVTFDLIDFDC

SEQ ID NO: 9530 - protein, 301 aa, Streptomyces avermitilis
MSSIAVPGALAPRRAWLTDLPVLLVAVVWGASYLAAKDITTARTVIAVLVLRFGVVLPVLVIAGRRSLRALSAAQWRGAALLGLILSGIFLLETYGVVHTSATNAGLIISLTMIFTPLAEAAVTRARPPRAFLAAAGVSVLGVVLLTQGGGFTRPSLGDLLMLLAALARTVHVLAMSRVKSVQGADALPLTTVQLGAAVAVFAVLSTGTDATVWGTAAGFGAREWGGLLFLAAFCTLFAFCVQMWAVRRTSPSRVSLLLGTEPLWAAAAGITLGGERLGALGLMGGVLVLAGTAWGRRAAG

SEQ ID NO: 9531 - protein, 202 aa, Streptomyces avermitilis
MGKLTLTAFVTLDGVHQAPGGPEEDRSDGFEQGGWSVPYGDEDFGRFVTDAFARVDAFLLGRRTYEIFAGYWPKVTDPADPIAAKLNSLPKYVASSSLTDPAWSGTTVIRGDLAKEVAALKERTARELQVHGSGALARSLLALDLIDTVHLLTFPVVLGAGRRLFAEGAVPTAFRHVFGSTTGAGVAIHTYERAGRPTYGSY

SEQ ID NO: 9532 - protein, 335 aa, Streptomyces avermitilis
MIVSVVSMPEGVVARTGLTQAREHLASSRFVIVDVDQEEEPPLDDEPLSRRLGLDDAAWKWLGRPDEHVRVEYHAGTAAGVVPVVCGNQVIHIHVLAGDRHFITIHQGPVELIDTFIGQLPQDRPPDAVTTLFLFLQGVLETYRRAITQAHLEVEDLEEAMFEQRQPEQVRRLAQLRQRAAHLHRAFLPYAAVAQEILVRRRMADHDLSAERQAMNRLHEHTVQLVLVEIEALRDAARRAASSYASLIADQQNVVINRLTIVSMIFLPLSFLTGFFGMNFAFLTNRLTSEDSFLEFGVGLQVGAVIVALYYVLYRTHWRQLRDSRARDAAGDDQP

SEQ ID NO: 9533 - protein, 376 aa, Streptomyces avermitilis
VTAQHPSPSARFTGDANPYGGGDPYADYRTADFPFTQYANLADRQLGAGVIAANDEFFAQRENLLVAGRAEFDPEHFGHKGKIMDGWETRRRRGASAAHPWPTAEDHDWALVRLGAPGVVRGVVVDTAHFRGNYPQAVSVEGASVPGSPSPEELLAGDVKWMTLVPRTAVGGHAANGFEVSVEQRFTHLRVNQHPDGGIARLRVYGEAVPDPVWLAALGTFDVVALENGGRVEDASNLFYSPATNTIQPGRSRQMDDGWETRRRRDHGNDWIRYQLVARSEIRAIEIDTAYLKGNSAGWAAVSVKDGESGEWTEILPRTRLQPDTNHRFTLAAPVAGTHARVDIFPDGGISRLRLFGSLTEEGAARLTARYQELGG

SEQ ID NO: 9534 - protein, 445 aa, Streptomyces avermitilis
VSDVELVLRSTRVITPEGTRPAAVAVAAGKITAVLPHDAEVPAGARLEDLGDDVLLPGLVDTHVHVNDPGRTHWEGFWTATRAAAAGGITTLVDMPLNSLPPTTTVGNLRTKRDVAADKAHIDVGFWGGALPDNVKDLRPLHDAGVFGFKAFLSPSGVDEFPELDQERLARSMAEIAGFGGLLIVHAEDPHHLAAAPQRGGPRYTDFLASRPRDAEDTAIANLLAQAKRLNARVHVLHLSSSDALPLIAGAKAEGVRVTVETCPHYLTLTAEEVPDGASEFKCCPPIREAANQDLLWQALADGTIDCVVTDHSPSTADLKTDDFATAWGGISGLQLSLPAIWTEARRRGHSLEDVVRWMSARTARLVGLAQKGAIEAGRDADFAVLAPDETFTVDPAALQHRNRVTAYAGKTLSGVVKSTWLRGERIMADGEFTEPKGRLLSREP

SEQ ID NO: 9535 - protein, 267 aa, Streptomyces avermitilis
VPTSSASTTDSAKSPAPSGGVQSLERAFDLLERMADAGGEVGLSELSASSGLPLPTIHRLMRTLVACGYVRQQPNRRYALGPRLIRLGESASRLLGTWARPYLARLVEETGETANMALLDGDEIVYVAQVPSKHSMRMFTEVGRRVLPHSTGVGKALLANTPANEVRALLARTGMPAATEKTITTPDGFLAALEEVRRLGYAIDDNEQEIGVRCLAVSVPDSPTAAAISISGPAGRVTEEATEKIVPVLQQVAAELSEALATSGPTA

SEQ ID NO: 9536 - protein, 164 aa, Streptomyces avermitilis
VRSNPRGPGDVHGLNFGPRSGAHHTGWRLLTRFPGAHRRRGELSDVRRTFAQRRARGRAVLRSLGQRPVTGSDEDPRVAGLRTAVSRLRRELAAHPVEFPDRGIAEDELAALAAMAVGGVPEIPRLRRSLLLIAGAIGSVSALARGLADVRGAVELFGEPPRRG

SEQ ID NO: 9537 - protein, 199 aa, Streptomyces avermitilis
MTENEDLVAGLLLAAGGGRRLGGRPKALLEHRGRPLVEHVAGVLRAAGSTRVYVVLGAQAAAVRERAVLPGCILVDNPDWELGMGTSLRAGLEAMHGTGVRAALVSLVDQPGIGPAAVARVRAAYTSPSTLASAAYDGVRGHPVLFGAAHWAAVAASATGDRGARAYLKAHESAITLVECGDVAEAYDIDTVADLVHLE

SEQ ID NO: 9538 - protein, 541 aa, Streptomyces avermitilis
MSAPAPSPLALVDAEPLPRQEEVLTDAALAFVAELHRLFTPRRDELLARRAQRRAEIARTSTLDFLPETAAVRADESWKVAPAPAALNDRRVEITGPTDRKMTINALNSGARVWLADFEDASAPTWENVVVGQLNLTDAYTRNIDFTDPKSGKSYALKANEELATVVMRPRGWHLNERHLVDSQGRPVPGALVDFGLYFFHNARRLLDLGKGPYFYLPKTESHLEARLWNDVFVFAQDYVGIPQGTVRATVLIETITAAYEMEEILYELRDHASGLNAGRWDYLFSIVKNFRDGGAKFVLPDRNAVTMTAPFMRAYTELLVRTCHKRGAHAIGGMAAFIPSRRDEEVNKVAFEKVKADKDREAGDGFDGSWVAHPDLVPIAMASFDAVLGDKPNQKDRLREDVSVAPGDLIAIDSLEAKPTYNGLVNAVQVGIRYIEAWLRGLGAVAIFNLMEDAATAEISRSQIWQWINAGVEFENGEKATPELARKVAAEELANLRAELGEEAFAAGNWQQAHDLLLKVALDEDYADFLTLPAYEQLAG

SEQ ID NO: 9539 - protein, 99 aa, Streptomyces avermitilis
LVGAPRMTTPHTHRVQIEYCTQCRWLPRAAWLAQELLTTFETELTELALKPGTGGVFVVRVDDEVVWDRREQGFPEPTAVKRLVRDRVAPEKSLGHSER

SEQ ID NO: 9540 - protein, 304 aa, Streptomyces avermitilis
VLREVTAVRYVTPLRAGGSVPGVVEADDLGTYVVKFTASAQGRKALVAEVIVGELARRLGLRFPELVLVHFDPTVAEHEPHQEVQDLLHASAGVNLGMDYLPGAEDFTPEIAKTFDVDPLEAGKVIWLDALTVNVDRTVHSSNLMIWPTFGIAPPRLWLIDHGAALVFHHRWDASSPEKAYDFRSHALGGYAPDTRAADAELAPRVTEELLREVLAEVPDAWLADEPGFDTPDDVRAAYVGYLAARVRASGTWLPTDFPTREQLTAEDAHRAAKTRAGRPNWLKRVPDLHGKPAAEQDWSVHLG

SEQ ID NO: 9541 - protein, 505 aa, Streptomyces avermitilis
MERMDRVDPMIPMSPGDDVGPAADAYADAPLLNCLLREMGEPAGDQGVYRLRSGGRLLRVRGDRRPRDPEVYAGGAWHRLTHAELVKLVAEELRRGTGLSNSELPGEMVDSRDAVAALLGARARATPPDDPYLRSEQSLITGHPHHPAPKARGGGPVTGWLPYAPEAYARFPLVLLGVRADTVVEEGDTTALDALAEAPPGYRLLPAHPWQLDLVGARPEIRDAFADGRLVRLGRTGCAVWPTAAVRTLYAPEADLFLKFSLDVRITNDVRRLWRHDLLKLRRTDEAAANAFAAARGPAAWLSDRGYRTAGFAFEELAVLVRDGLAPHLLPGTTPLLAAALVEGFDGNPLDRLDDPRAWWAAYLRQVVPPVLDAFARHGVVLEAHLQNTLVAVDADGMPVQALFRDAEGVKLLPDVSRAAGWERLVYCLVVNHLAELAALLAERRPGTDPWPAVRRELARHDLPEVGELLASPTLPGKTNLLLRWTGADGADARYLPLPNPLARA

SEQ ID NO: 9542 - protein, 502 aa, Streptomyces avermitilis
VHRPATAESELAAELDAVRPGLSAPYAAALPGARAAVLTRLWRALAHEPLPWIAHREPEPGGLTLRLADGRRLHGPPSDPYATAPYVTGVRLDETSYAHPARLVSALGVPHGPALAAELDHSVASLALSRAGQPRVDPKSPTTSWEWEQRVVDGHPFHPNCRSRPGFSAAEQLAYGPEHRPVVRLGLVAVEECLVRGEWPKWLRDGERVLIPVHPWQTAHVLDAPVEDGPAAHPLMSLRTLALRDGGPDVKTALSARLTSSVRDISVYSIETSATVSEFAEAFAARTDGLLHITRTLGAATAGRPELAAVVRESPDTYADAEAAERVVPVASLTGTGLPGSPAWLAEFTRLTLTVGLRLLDLGVALEAHGQNLLVVLSATGAPLRLVYRDLADIRVSPARLARHGVPLPDLGGRLVTDDETTLRRKLFGSLVAGALAATAGSGPALREALAAAARDLPRTPDLTALLEEPLPAKALTLMRLSPDRPGDSWAQLPNPLVTRAF

SEQ ID NO: 9543 - protein, 420 aa, Streptomyces avermitilis
MITRQRLAVGLCALLAALTAGFAFPAGAVADETTADAPKVDLVLDVSGSMRARDIDGGSRMAAAKQAFNEVLDATPEEVRLGIRTLGANYPGDDRKTGCKDTAQLYPVSTLDRTEAKTAVATLSPTGWTPIGPALLKAADDLDGGTGSHRIVLITDGEDTCAPLDPCEVAREIAAKGVGLTIDTLGLVPNSKLSKQLSCIAEATGGTYTSVEHKEDLTDKVNQLVDRAADKVVTPVAVDGAADCAKAPTLKSGLFTDRAEFAQHRWYRVDVKPGQELRASVSLSADRQVNPDYGVLLRAVTVHNREIVRGEAAGTGRTDVVSTGLRYPKAESDDEDATAETVCLQVSHSFSPAAGVKTTPGLPLELTVDVVDGPDQAGDVASFGLGRGWWLLGALVLTGFLAGLLWGWLSRWRFAVWRTN

SEQ ID NO: 9544 - protein, 281 aa, Streptomyces avermitilis
MRISRVLKSGVRNSGVLVAAGLLLGAAVAPAVADSSPSASPSGDSAAPTSAGTSFRTATEIAQGQRATAGGSAGDYLYWSFPADTGLRPTVKATVKFPQSAERGASQTWQLDVYDGLRRRQACQYGAQTRTAAQDATSVDLSCTLRTVRAWSEPWADDPLPGTYYVRLTLVDVATGDLGLPVSAEVQVDSKDIGGSAAVDGSLSQPLVPGIATASDTSDEGSDSAKASLFSLEPDDGWASGWWTDRWVWTAIGGILAALAGIGGYALTKGSGRPRQVPPGA

SEQ ID NO: 9545 - protein, 218 aa, Streptomyces avermitilis
MSRLRRMPPRRSYDQYCSAARALDAVGDRWTLLIVRELLGGPRRYTDLHADLPGVSTDVLASRLKDMERDGLTTRRRLPPPGAVYVYELTGRGRELLPVLQALGSWGAPALAERRATDAVRAHWFALPLLRSLEGDGLAVGLLEIRLEEGRFHLHLGAAEGPAYGEGPAPEEPDARLVIDADTCMALSRETLTLHQAVREGRAEITGESALAKLLRGD

SEQ ID NO: 9546 - protein, 402 aa, Streptomyces avermitilis
MEFRQSSKLSEVCYEIRGPVIEHANALEEAGHSVLRLNTGNPALFGFEAPEEILQDMIRMLPRAHGYTDSRGVLSARRAVAQRYQDRGLEVDVDDVFLGNGVSELVSMAVQALIEDGDEVLIPAPDFPLWTAVTTLAGGKAVHYLCDEQADWYPDLADMAAKITDRTRAVVIINPNNPTGAVYPKEIVEGILDLARRHGLMVFADEIYDQILYDDAVHHSAAALAPDLVVLTFCGLSKTYRVAGFRSGWLVVTGPKQHARSYLEGLTMLASMRLCANAPAQYAIQAALGGRQSIQELTAPGGRLYEQRDRAWQKLNEIPGVSCVKPKGALYAFPRIDPTVHKIHDDEKFVLDLLLREKIQVVQGTGFNWPRPDHFRILTLPHADDLDAAISRIGRFLSGYRQ

SEQ ID NO: 9547 - protein, 199 aa, Streptomyces avermitilis
MGDLLLVRHGETEWSVSGRHTGSTDIPLTENGREQARRLAPLIASHHVGAAFVSPMRRARETARLAGLDGARVDADLSEWDYGGYEGVTTVEIHRTRPDWFLFTDGVEPGPPEHPGESPEEVGARAERMLAKVDAALADTEGSVVVVSHGHFLRVLAARRLGLPASGGALFQLATGTVSRLSTEHRRHVVASWNVRPSS

SEQ ID NO: 9548 - protein, 208 aa, Streptomyces avermitilis
VRGSACSPTCQPAFSSVAAQARNASGSGSCTATASGWGVARTRYPPPSVPAGRCPAASSASAAACTRCARSHPHGRSTAPSGLVIRRNSRSPCQALCTSRRREGPASPSSPPIRAANTPDPASAGAGVSTTGSGASRMRCPAGVRKWSCGGRGCRKASPRFTRAASWASVPFSRPVTGSAASMTRRCAAVGGRVTAALLPSSSRRAAC

SEQ ID NO: 9549 - protein, 140 aa, Streptomyces avermitilis
VAEPFSVAVTVRGYETDVQGHLNQSVYLQYAEHARWSLLHAAGISQTELTGKGVGPVTLETTIRYKRELRAGDEVEVTCGFVWGEGKSFRVEQTIRKTDGTVSAELTAVGGLLDLKERRLVADPREYFRALAADPGLFDL

SEQ ID NO: 9550 - protein, 133 aa, Streptomyces avermitilis
MSQGNTAVTAQVVNAHACPVREVLDRVAGKWSVQIIVAAAHGPIRFTELERSIEGISRRMLTLTLRNLERDGLVTRTVHSTVPPKVEYELTPVAGELHATLLSLTDWAERHRVTVAQSRAAYDARHRPELLDG

SEQ ID NO: 9551 - protein, 486 aa, Streptomyces avermitilis
MSFLIESRTRQRQRTPSRWASLVVLCAGTLMTVLDGNVVTVAMPAIQGDLGFSGPGLAWVVNAYLIPFGGLLLLVGRLGDLVGGKRMFTAGLAVFTVASVLCGVATSQATLVAARALQGIGGAMTSAVVLGMLVALFPEPREQARAIAVFSAVGAAGGALGTFLGGALTQALNWHWIFLINLPIGVLAWLAALRFLAPERGAGLGRGADYPGAALVTGALMLTVYAIVGAGDRGLAGTLVLAAVSLALFSAFTVRQARAPRPLLRLRLFRSRVLTGANAVQVLMIGGMFGFQYIGALYLQRVLGYGELLTGTAFLPAPIAIGVLMLGLSARTIARFGPYRVLLSGLVLISAGMALLSRAPVDGTYLADVLPPLLLLAAGFAAAMPAVTGLAMSGARAEDAGLASGLFNTTQVVGGSLGLAVLTTLAASRTDHLRHGGADLVAATASGYRLAFMVATGIAVAALVLAAGVLRTERATSGQPPANTPR

SEQ ID NO: 9552 - protein, 728 aa, Streptomyces avermitilis
MPLARRVLLTALAAGSAGAAVACDPASADGAPAAGSAATAARRLLPRHWRQLTFRTAGGRDTFQVSGRTGRVTVTGGTPATQLTGLNWYLRNIADADINWAGRQLRLPRALPGLAGTVTRRANVPHRFALNDTNDGYTGPYHDWTYWERELDVLALHGYNEVLVQTGADALHHRVFQEFGYTDEELRKWIPGPAHQPWWLLQNLSAFPDPVSQQLLDARAALGRRIANRLRELGMTPVFPGYFGTVPPGFADRNAGAHTVPQGTWMGFARPDWLDPRTEHFTRVAAAFYRIQDEMFGGASTRYKMDLLHEGGSPGDVPVGDAAKGVERALRAAHPGAVWVILGWQHNPPRAIVDAVDKDRMLVVDGLCDRFPKVTDREADWHGTPYAFGSIWNFGGHTTLGANTPDWASLYERWRTRPGSTLRGVALLPEAADNNPAAFALFSELAWREGDLDLRAWFARWARSRYGGRDPHAEAAWDILRRTAYGTTRADSWSEGADGLFGARPSLAATKAASWSPKRLRYRPEEFEPALGELLKVRPGLRGSSAYRRDLLDVARQALSNRSRVLLPQIRTAYEAKDTARFDRLTGVWLALMDLLEALLATDSRHLLGRWVADARAWGASAAERDRLAYDALSLLTVWGTRAGADAGLRDYANREWAGLVGGLYRLRWSTYFAELRSASREGRTPKKTDWFALEDRWTRNPGGLATRPTGDTYQAAVRVHERLTAER

SEQ ID NO: 9553 - protein, 271 aa, Streptomyces avermitilis
VHSPHIRTSRRTLLALIGASLVAGPLVANQSATAAPVGLDDPAKKEIAMKLVSSAENSSLDWKAQYKYIEDIGDGRGYTAGIIGFCSGTGDMLDLVELYTQRKPGNVLATYLPALRNVNGGDSHQGLDPGFPGDWRRAAQDSAFQQAQNDERDRVYFDPAVRQGKADGIGVLGQFTYYDAIVMHGDGGDSTSFSSIRGRALAKAEPPAQGGNEVTYLNAFLDARVWAMRQEEAHSDTSRVDTAQRVFLTKGNLNLDPPLDWKVYGDSYHIG

SEQ ID NO: 9554 - protein, 486 aa, Streptomyces avermitilis
VAAQPSPSTDAVPTDQPRHPVDEKLPLLKMTTSGLQHVAAMYAGVVAPPLIVGAAAGLSGTELTFLTGACLFTAGLATFLQTLGFWKIGARLPFVNGVTFAGVAPMTAIVASTKDRSDALPIIFGAVIVAGALGFVAAPFFSKAVRFFPPVVTGTVITLIGVSLLPVAFGWAQGPDPTADSYGSTTYLGLAAATLVIVLLLRRFTHGFVKQIAVLLGLVIGTLLAIPLGVTDFGPVAGADLIGFPTPFHFGAPRFQLAAILSLSVVMVVSMTESTADMLALGEIVGRPADERTIAAGLRADTLGSALSPLFNGFMCSAFAQNIGLVAMTRIRSRYVVATGGGFLVLMGLCPVAASLIAVVPRPVLGGAGVVLFGSVAASGIQTLVRAGLEKDNNVLIVAVSLAVGIIPITAPEFYHAFPQTAKIVLDSGISTGCVAAVVLNLLFNHLGRRQGDDEVTAPMEPGEEIAGQRGGAGSPAAGPSAVTAH

SEQ ID NO: 9555 - protein, 459 aa, Streptomyces avermitilis
MAAARRIVIENCAIATVDADDTEYASGHIVVAGGRIESLGAGKAPEDLENVVRRIDATGHLVTPGLVNTHHHFYQWITRGLATDHNLFNWLVALYPTWARIDERMVHSAAQGSLAMMARGGVTTAMDHHYVYPKGSGDLSGAIIRAARETGVRFTLARGSMDRSEKDGGLPPDFAVETLEGALAATEATIDEHHDASFDAMTQIAVAPCSPFSVSTELLTQGAELARRKGVRLHTHGSETVEEEQFCKELFGMGPTDYFESTGWLGEDVWMAHCVHMNDSDIAAFARTKTGVAHCPSSNARLAAGIARVPDMLAAGVPVGLGVDGTASNESGELHTELRNALLINRLGAHREAALNARQALRLGTYGGAQVLGRAAEIGSLETGKLADLVLWKLDTLAHASIADPVTALVFGAAAPVTLSLVGGEPVVENSRLLHVDEDAVARSTREEAQRLARIAAQA

SEQ ID NO: 9556 - protein, 315 aa, Streptomyces avermitilis
MTDDSRPGRPVMLGQNQYGKAENRVVKITRDGATHHIKDLNVSVALSGDMDEVHYSGSNANVLPTDTTKNTVYAFAKEHGIESAEQFGIHLARHFVTSQEPIKTARIRIEEYTWERIEASDANSRFIGADEVKHSFVRKGQETRVTQITYDGSSWEVISGLKDLVVMNSTNSEFWGYVKDKYTTLPEAYDRILATQVAARWRFNWSDDERKMPHWEKSYEQTRKHMLQAFAETYSLSLQQTLYQMGSRIINHRSEIDEVRFSLPNKHHFLVDLEPFGLKNDNEVYFAADRPYGLIEATVLRDGCEAKIPVDLTNL

SEQ ID NO: 9557 - protein, 135 aa, Streptomyces avermitilis
MSTSTTASVSTHILDTSIGRPAAGVAVQLAARSGRSASYGQGGDWQALGGSATDADGRCKDLPALPAGTTHVRLDFAVEPYFEKKQADAQQDAPANRDSGAFFPEVAITFAVKPGEHYHVPLLLNPFGYSVYRGS

SEQ ID NO: 9558 - protein, 172 aa, Streptomyces avermitilis
VTSTSTPPGLARFNDLGEHAALAALHEACASTTWARRLIAARPYATADDLYTASDAAMAELTAADLAQAMAGHPPIGRPKPGDPTSAREQRGMAGASEELKADMLELNLAYQEKFGHVFLICATGRTGEQMRDAVRERIGNAPEREREIVRTELGKINRIRLARLVEEDAHA

SEQ ID NO: 9559 - protein, 122 aa, Streptomyces avermitilis
VTGNGDEPFIAAVKPLVDAMGGEMLPPDEAGVDDVVLSWEGVDVVAVRLPQLADSLDHILAAMERKKGKPLADLDRKSKQEVVRILEARGAFSVRHGVETVASALGVSRFTVYNYLNREKEA

SEQ ID NO: 9560 - protein, 83 aa, Streptomyces avermitilis
VRLRVEFTTEPFDLDEAPAHALVAREVVEAAELDAVDVGPFGNTAEGGADAVLTAVDALLRKALEAGATRVSLQVNVIGEGDR

SEQ ID NO: 9561 - protein, 503 aa, Streptomyces avermitilis
MKRRQMVKALAGTAALPAVVGAAGGARAAGSGAASTSTGAVSAATRTKGSDPLAFDPANYTTLTTTVATSDGDKAVTYRFFKAVTYVADPVDVTYQSLNVSVPVEIDGKAVDASHAPIVFSNAVGGYMPSSTAGNTGIGQGVNAKLSLASGFVVVDPGARGRTLVDTAGVYYGVAPAAIVDLKAAIRYLRHNKGRVPGDTDRIVATGVSAGGALTSLLGASGDSDRYAPYLQELGAADASDAVFAAAPYCPITDLEHADMAYEWNWGTNPLPTGAQVDQTLSKELRSGFAEYQASLNLRGKNGFGRITARNYDAYMVKTHLEPSATRYLGALPDADRAAYLTANPWITWSGGRASFGWGDFLTHVGARKKNVPSFDTFTLAAPENNLFGVATTKARHFTQWSLRKATGDDGARLDADLPEKIDLMNPMYFIEHQNPGRSRHWFIRVGTKDSDTSLTVVGNLTAGLENLGDDVDTYMYWDGGHGANQDAPDFITWIRSVSGYAK

SEQ ID NO: 9562 - protein, 285 aa, Streptomyces avermitilis
MPGLERGTAAEQRFNVNLSILFTELPLLERPAAAAAAGFTAVELWWPWVDSPTPDQSELDALKKAIEEAGVQLTGLNFYAGRLPGPDRGALSIPGEESERFRANIDVAADFARSLGCTALNALYGNRVEGVDPAEQDALALENLVLAARAADRIGAILLIETLNQPESPRYPLVSAPAGIGIVDQVNEATGLGNARFLMDLYHLSMNGEDLPRVIAAYAAKTGHVQIADNPGRGAPGTGTLPLKELLGQLRKAGYEGWVGLEYKPGDRPSAEAFDWLPAEARAAR

SEQ ID NO: 9563 - protein, 305 aa, Streptomyces avermitilis
MSSNPAPSPRPARPLVAWIGLGIMGSPMSENLIKAGYDVTGFTLEQDKLDRLTAAGGTAAGSIAEAVRDADVVITMVPASPQVEAISYGPDGILENARSGALLIDMSSITPRTSVDLAEAAAAKGIRVLDAPVSGGEAGAVEAVLSIMVGGEQADFDEAKPVFEALGRTIVLCGPHGAGQTVKAANQLIVAVNIQACAEAVVFLEKSGVDLKAALDVLGGGLAGSTVLTRKKDNFLHRDFKPGFRIDLHHKDMGIVTDAARAVGAALPVGAVVAQLVAALRAQGDGGLDHSALLRSVERLSGARL

SEQ ID NO: 9564 - protein, 485 aa, Streptomyces avermitilis
MSKRVLTTESGAPVADNQNSATAGVGGPLLLQDQHLLEKLARFNRERIPERVVHARGSGAYGHFEVTDDVTGFTYADFLNTVGKRTEVFLRFSTVADSLGGADAVRDPRGFAVKFYTEEGNYDLVGNNTPVFFIKDPLKFPDFIHSQKRDPFTGKQEPDNVWDFWAHSPEATHQVTWLMGDRGIPASYRHMNGYGSHTYQWTNAEGEAFFVKYHFKTNQGIRSLSAEQAQEIAGTDPNSHQTDLLQAIERGVRPSWTLYVQIMPAAEAAEYRFNPFDLTKVWPHTDYPLQRVGRLVLDRNPDNVFAEVEQAAFSPNNFVPGIGPSPDKMLQGRLFAYADAHRYRLGVNHTQLAVNAPRATVVSNYGRDGLMASPAQGRAAKNYEPNSYDGPAETGRPLSAPLAVTGHTGTHEAPPHTKDDHFFQAGELYRLMSAEERSRLVANIAGGLSQVSRDDVIEKNLTHFHAADPEYGTRVEEAVRALRED

SEQ ID NO: 9565 - protein, 78 aa, Streptomyces avermitilis
MEHATKYPHIVVHPPALDGSRRVTAGDAPLGIASHLDDVIEILRMADLDRIEVEESDLIEWQGGGPDDWPGLSEHEDD

SEQ ID NO: 9566 - protein, 594 aa, Streptomyces avermitilis
MARMTAARAAVEILKREGVRSAFGVPGAAINPFYAALRASGGIDHTLARHVEGASHMAEGYTRAHPGNIGVCIGTSGPAGTDMITGLYSAIGDSIPILCITGQAPTAVIHKEDFQAVDIASIARPVTKMAVTVLEAAQVPGVFQQAFHLMRSGRPGPVLIDLPIDVQLTEIEFDPETYEPLAVYRPAATRAQIEKAITLLNESERPLIVAGGGVINADACELLVEFAELTGVPVVPTLMGWGVLPDDHELNAGLVGLQTSHRYGNATFLESDFVLGIGNRWANRHTGRLDVYTAGRTFVHVDVEPTQIGRIFAPDYGIASDAKAALELFVEVARELKSAGGLPDRSGWAASTQERRATLQRRTHFDDIPIKPQRVYEEMNKAFGPQTRYVSTIGLSQIAGAQLLHVHRPRHWINCGQAGPLGWTVPAALGVAKADPEARVVALSGDYDFQFMIEELAVGAQHRIPYVHVLVNNAYLGLIRQAQLGLDINFQVNLEFENINSPELGVYGVDHVKVVEGLGCKAIRVTDPGELGAAFEQAKKLAAEYRVPVVVEAILERVTNIAMSRTNDISDVVEFEEVATEPGHAPTSIRTLKV

SEQ ID NO: 9567 - protein, 372 aa, Streptomyces avermitilis
VPPRADAGRGAGNPALGVTAFRCRECRDWRTMEALSRRHPVEWAMAESVPVRCPVCRREHLYATPSYPCACGAPVAPPLDRAAAPSAVTHRTWDEDWVTVRCGACGREDQWPHPELGCHCGVVLRIPVSGGPGTPGQAPRPAAEADDARGAPPVGEPADPQEPTPGHHTPTPDDHPPTPEAPGPAPGAPSSAPGPRGSTPGPRPSAAKPGAAAAPGGAAGSIPRIPGTTRRSRPRPAALPRATPSARPAFQPVTIRTARDAVTAAALYLRWLGYQDVRRADQRPPNGIGLAARGMLAQVDPTVRPASLRDVECLWLTAMTESAGCVYFSLAGYADDARAVADRLGVPLFVLDLTGTPQPVNSLADDLVATGA

SEQ ID NO: 9568 - protein, 540 aa, Streptomyces avermitilis
VTELSYAHGTSTTPLLGDTIGANLDRAIAAYPDRDALVDVPSGRRWTYAEFGAAVDEVALGLLAKGVLKGDRVGIWAVNCPEWVLVQYATARIGAIMVNINPAYRAHELAYVLRQAGISVLVASLAHKSSDYRALVDQVREKCPELRETVYIGDPSWEALTAGAASVPYERLIAGAADLSCDDPVNIQYTSGTTGFPKGATLSHHNILNNGYWVGRTVGYTEEDRVCLPVPLYHCFGMVMGALGATSHGACIVLPAPSFDPAATLAAVQRERCTSLYGVPTMFIAELNLPDFASYDLSSLRTGIMAGSPCPVEVMKRVVAEMHMAEVSICYGMTETSPVSLQTRRDDDLEHRTGTVGRVLPHIEVKVVDPAGGVTVPRGTAGELCTRGYSVMLGYWDEPEKTAEAVDAGRWMHTGDLAVMRENGYVEIVGRIKDMIIRGGENIYPREIEEFLYGHPKIADVQVVGVPHERYGEEVLACVIPRDPADPPTLEELWAFCDGQLAHYKIPSRLRILDSFPMTVSGKVRKIELREQAAREGRDD

SEQ ID NO: 9569 - protein, 559 aa, Streptomyces avermitilis
MTANTSATDAFRAARDFLLTHREDYATAYEGFRWPRPEHFNWALDWFDVLARGNDRTALHLVEEDGATTRLSFAELSERSDRVANWLRARGVRAEDRVLVMLGNQAELWETALAAMKLRAVVIPATPLLGPADLRDRVERGRVRHVVVRAEDTGKFDEVPGRYTRITVGGERPGWQSYEEAYAADAAFEPDGITHADDPLMLYFTSGTTAHPKLVEHTHVSYPIGHLATMYWIGLEPGDVHLNISSPGWAKHAWSNLFAPWNAEATVFLHNYTRFDAGRLLTEMDRAGVTTFCAPPTVWRMLIQADLTQLRTPPREAVAAGEPLNPEVIEQVRRAWGVTIRDGFGQTETAVQVSNSPGQKLKTGSMGRPSPGFHVELLDPVSGAPGVDEGEIALDLSARPVGLMTGYHGDADRTAEAMAGGYYRTGDIGSRDADGYITFVGRRDEIFKASDYKISPFELESALLEHEAVAEAAVVPAPDELRLAVPKAYIVLAAGFEPGPDTAKVLFEHARSVLAPYQRIRRLEFGELPKTVSGKIRRIELREATAAGSAEEYREEDFR

SEQ ID NO: 9570 - protein, 279 aa, Streptomyces avermitilis
VAADAAEAVEVRGALLRLRRATGLPVAFGGLVEPGRPQIRISELCGHTTLALSSLAVVSGSGLGGKVVALSRPCAVTDYSTSRQISHEYDVAVAAEGLRSVVAVPVVVRRRVRGVLYGALRAAQPLGDRTLTAAVEAARDVEQALVVRDEAHSLMTAAREPETASGAAWEQVREAHGALRALAPRLMDPALRAELLEVCGQLAGAASAEPAAAHALGLAPREVDVLVCVAAGATNAVAAERLGLRPETVKGYLRSAMRKLGAHTRLEAVVAARRAGVLP

SEQ ID NO: 9571 - protein, 936 aa, Streptomyces avermitilis
VTVRRDFKEPARPRPDLVIGREELFAGAREQLTRGGSVLVHGPAGIGKSTILRALVTEYGETAHTVLRCSSTESESHLPFLALADLLGLVEDEVLDRLPAPQRTALESALTGRGESTLQRDGLALRLAVLSTLRVLAARGPVLIVADDLQWLDPASAELLGFAARRLGGMPVQMLCAVRTDTEPQGQQHDRYLRASPPETLAVRVNPLSRAQTAELLGRRGHTDLPRSTVRDIHRTSGGNPLFALELGRALAESPTPPSPGEPLPVPTSLRALVLNRLDMLSPQARRTLLVASAGARPTLALLHAAGRENAEAETAQAAALGLLVTERDAPGVRFAHPLVSAALYAEATAQERRAAHAALSTAASDPIERARHLALATTGTDPRVATRLGEAAAVARDRGAPSVAAGLGLLAARHTPADTVPGPDERRLQAAEDALTAGETDLARDIAREVLGRAGGPADRVRAWMVVIDAAGQAMAEVDAVFPQALADAGDDPRLLALVHYQLAWRALLVEGEFDKAREEAARSAELAARAADRRAELLALAFQAQMETLMGHPDAPGTIKRALKEPQDPRVACDHNGAGAARFRWLIMGDQLAEARTTISALLREVRRRGMVESEVHFLRALAEVELRAGHCGRALDLARESLRLARDTGIGEGATAMFTSLAEAAGGEVNRALTLAREAVGRAEEDGDLVYLSRALGALGHAQLVAGDAAGAVRSLRRVRELEEGLGVTDPARGRWHGDLAEALVRIGEPAEAQGFIDTTRTQALRLGRESVLAVLDRAEALARAARGEIDAATRQLTSAQDRLAKLGYGLEEARAAFALAGLRTHRPGPTSYDEAARLFRRCRALPWLRQVETATVTGPAQPALSTAALDALAATERQVAALVMEGATNREIAARLFISVKTVEATLTRVYRKLGIRSRVDIVRLAAGGRQG

SEQ ID NO: 9572 - protein, 263 aa, Streptomyces avermitilis
MFGLNRAKKTAAVVAATAAAAATALLAAPGAVAAPQPIVGGSTTTTTAYPFMMQITDASQNQFCGGTLVSATKVVTAAHCMVGETTSSVRVVGGRTYLNGTNGTVSKVSKIWINPDYTDATNGDDVAVLTLSTSMSYTPASYVSSSQTSIYATGATARIIGWGTTSENGSSSNQLRTATVPIVSNTSCASSYGSDFVASDMVCAGYTSGGVDTCQGDSGGPLLIGGVLAGITSWGEGCAEAGYPGVYTRLTTFSSLVTAQVNS

SEQ ID NO: 9573 - protein, 422 aa, Streptomyces avermitilis
VSASPASVRGMTKSTSQKATASQVTASHVTAATAATAATAATASKARASKAPKASRAAAAAPVLTPRALNRATLDRQLLLRRAPLSAKDAVEHLLGLQAQNVKPPYYALAARLDGFTPEALSRLMADREVVRIVTMRSTIHTHTADDCLTLRPLVQAARDRELNYFRKGLAGVDLDRLTAVSRELVETEPRTMKQLREALLVEWPDADPQSLAVAARCRLPLVQVTPRGLWGRSGQVALTTAEHWLGRPAGPAPAPDSTVLRYLAAFGPASVKDMQTWAGLTRLRDAFERLRPQLVTFRDETGVELFDLPDAPRPAADTPAPPRFLPEFDNLLLSHADRTRVVPADLKGRTWAGNQAYCTLLVDGFLAGVWRLDEDALTIEPFGTLTRAQRQEVVQEGERTLAVMAGGTNSYDIRFGTVVRA

SEQ ID NO: 9574 - protein, 386 aa, Streptomyces avermitilis
MSERRARPASKNGRKSAWRRALNPPATPPAEPPAGGPDAPAPETADAASVVQATLYRDGVRVSSPASLADTFRELRDEPSGMAWIGLARPTESELLSLAEEFDLHPLAVEDAMEAHQRPKLERYGETLFVVLRAARYLDAPEEVDFGELHVFVGPDFVITVRHGAAPDLSAVRRRMEETPELLKLGPEAVLYAILDAVVDGYVPVVAGVQNDIDEIETEVFRGDPAVSRRIYELSREMVEFQRATRPLVGMLHSLMAGFAKYGTDEELQRYLRDVADHVTHTSERVDGFRQALADILTVNATLVTQQQNAEMRALAEAGFEQNEEIKKISSWAAILFAPTLVGTIYGMNFEHMPELGWSFGYPFAIGLMGLVCVSLYVIFKRRGWL

SEQ ID NO: 9575 - protein, 96 aa, Streptomyces avermitilis
MRLAALPTAFAPVDDLGKEAVAGRETVIFTENKAGTLFYINHKQFDHGRVDFRARLNTVEEWTIKNDSDESHSFHIHTNDFQVMRINGKPQVNYGL

SEQ ID NO: 9576 - protein, 91 aa, Streptomyces avermitilis
LSAARTAGGMAGLIVVDGLDEYLPAPLRGITEHVVALKDFQLVGDQIKTTKLKIGAPTTRTVNGQLNPRIRIRPGETQLWRLGNIGANILY

SEQ ID NO: 9577 - protein, 603 aa, Streptomyces avermitilis
MTVLPDDGLSLAAEFPDATLEQWQRLVAGVLRKSGKEVSDTAAEEALSTALEDGLASRPLYTARDSAPDPGLPGFAPFVRGGRAEGNTTGGWDVRQRHSAADGDAVLADLENGVTSLWLVAGAGGIPVPSLGRVLDGVYLDLAPVALDAGGDTEPAARELLRLYAERGVAKEAARGNLGADPLGHEARTGDEPFDFAPVAGLARLCAEEYPGLRALTVDALPYHEAGGSAAQELGCSLATGVAYLRELTAAGLSVEHACGQLEFRYAATADQFLTIAKLRAARRLWARVAEVCGAPGAGAQVQHAVTSPVMMARRDPWVNMLRTTVATLAAGVGGADAVTVLPFDHALGLPDAFARRIARNTSTILVEESHLSRVIDPAGGSWYVERLTDELAHSGWEFFQWIEREGGQAGALRSGRLGQDLANTWAARSAKLAERREPVTGVSEFPSLAERPVERAPAPASPSGGLPRVRRDEAYETLRARSDAHLAATGSRPRIFLAALGPAAAHTARLAFASNLFQAGGIEPVTEGTFEDSGATEVCLCSSDALYEERAAEVAGAVKAAGARHVFLAGRPGRYPGVDSHVFAGCDTVAVLSATLDRMGVS

SEQ ID NO: 9578 - protein, 724 aa, Streptomyces avermitilis
MGIPDFAGIELGTPTASGGPDEWRTALKKATGGDDLLWETPEGITVKPLYTGQDVEGLDFLGTYPGIAPYLRGPYPTMYVNQPWTIRQYAGFSTAEESNAFYRRNLAAGQKGLSVAFDLPTHRGYDSDHPRVTGDVGMAGVAIDSIYDMRQLFDGIPLDKMTVSMTMNGAVLPVLALYIVAAEEQGVPPEKLAGTIQNDILKEFMVRNTYIYPPKPSMRIISDIFAFTSQRMPRYNSISISGYHIQEAGATADLELAYTLADGVEYLRAGQEAGLDVDAFAPRLSFFWAIGMNFFMEIAKMRAARLLWAKLVKQFDPKNAKSLSLRTHSQTSGWSLTAQDVFNNVTRTCVEAMAATQGHTQSLHTNALDEALALPTDFSARIARNTQLLIQQESGTTRVIDPWGGSAYVEKLTYDLARRAWQHIEEVEAAGGMAQAIDAGIPKLRVEEAAARTQARIDSGRQPVIGVNKYRVETDEKIDVLKVDNSSVRAQQIEKLRRLRAERDEQACQDALHALTRAAEGTGNLLELAVNAARAKATVGEISDALEKVYGRHAGQIRTISGVYRTEAGESPSVERTRTLVGSFEEAEGRRPRILVAKMGQDGHDRGQKVIATAFADLGFDVDVGPLFQTPAEVARQAVEADVHIVGVSSLAAGHLTLVPALREQLAEEGREDIMIVVGGVIPPQDVPTLLEMGAAAVFPPGTVIPDAAYDLVTRLAADLGHDL

SEQ ID NO: 9579 - protein, 328 aa, Streptomyces avermitilis
MAIDLDSYVKGVLEGKRAQIARAITLVESTRPDHRSLAQELLTELLPHSGQAKRIGISGVPGVGKSTFIDALGTMLTGLGHRVAVLAVDPSSSRTGGSILGDKTRMERLAVDPAAFVRPSPTAGTLGGVAKATRESIVVMEAAGYDVVLVETVGVGQSETAVANMVDSFLLLTLARTGDQLQGIKKGVLELADVIAVNKADGPHERDARAAARELAGALRLMHGANAAWTPPVLSCSARDAVGLDTVWERLEQHRTLLDSTGRLAAKRRDQQVDWTWTMVRDELLGRLHADPAVRTLAPSLEQQVRDGALTATLAAERILRVFGDGVR

SEQ ID NO: 9580 - protein, 468 aa, Streptomyces avermitilis
VGKTYAGARLRRLREERRMSQAELARVLGISPSYLNQMEHDSRPLTVPVLLRLTEAFGVDAGFFSERDTTRLMADLREALAREIAETRVSASDLTELASRIPAVAKVLLDLGRRNQLLSERLAEAAEGRDGEPDVPRSPHEEIRDFFYRRQNYLHDTDLAAERLAEEIGIRPGEVVRALTARLADRHGVRLTAETGDHLHHYDDASRTLHLSSRLRPGQRAFRMATQLALLEYGDELDHQAAQDFPTATPTHALARIGIANYFAAALILPYRTFHAAAEEARYDIERLTDRYGLGYETVCHRLSTLQRPRLRGVPFSFVRVDRAGNLSKRQSATGFHFSRAGGTCPLWNVYEAFAAPGRIHVQIAEMPDGQRYLWTARAITRHRGGWGEPGKTFAIGLGCEIRHASRLVYSDGLDLGNASAAIPIGMGCRVCERLDCPQRAAPPLGRPLRIDQNSTTFVPYPVAHRPE

SEQ ID NO: 9581 - protein, 427 aa, Streptomyces avermitilis
MAEARTTAAEELTRRWAFDPRWQGIERTYGAADVVRLSASVREEHTLARRGAERLWRQLHELDYVHALGALTGGQAVQQVKAGLQAIYLSGWQVAADANQAGHTYPDQSLYPANSVPQVVRRINNALLRADQIATAEGGEDTTDWLAPIVADAEAGFGGPLNAFELTKAMIAAGAAGIHYEDQLASEKKCGHLGGKVLVPTSQHIRTLNAARLAADIADVPTVIIARTDALAANLLTSDVDERDAEFVTGERTAEGFYRVRGGMAPVIARGLAYAPYADLIWVETGTPDLAQAREFAEAIHAEYPDRMLAYNCSPSFNWKAALDDDQIAKFQRELGAMGYRFQFITLAGFHSLNHGMFDLARGYAEHGMTAYVDLQEREFAAQEHGFTAVRHQREVGTGYFDLVSTAVNPASSTTALAGSTEEEQFH

SEQ ID NO: 9582 - protein, 530 aa, Streptomyces avermitilis
MSTSALTHRVRVLAAPGDRHDEILTPAALDFVGRLVAAFGERRPELLKERRRQAIRLAAGSALDFPLATAGVRADASWRVAAPAPGLTDRRVEITGPPDRRTAVNALNSKARVWMADFEDATSPTWDNIIGGQLTLLDAIERRIDFTTPEGKEYRLGDRLATIMVRPRGWHLTEEHLEFDGRPVPASLVDFGLYFFHCAQRQIDAGHGPYFYLPKLENRYEARLWNDVFVLAQELLGIPPGTIRATVLIETITAAVEMEEILYELREHSAGLNAGRWDYLFSLIKTFGHRTDFLLPDRATVTMTAPFLRAYTELLVRTCHRRGAHAIGGMSAQVPGRDPAAGEAALAKVRLDKEREAEDGFDGSWVAHPGLVPMCREVFDGVLGERPHQIERTRDDVEVTAADLLSVRRISGPPSPEGVRTNIAVSLRYFDAWLRGRGAVALYGLMEDAATAEIARVQIWQWLRHRVVDRDTVVRLLDDELAALGAEYPWAALDEVRALFERTALAAELPLFFTPDAYTRHLVRHAEARS

SEQ ID NO: 9583 - protein, 289 aa, Streptomyces avermitilis
MSRGIRRVGVVGGGQMGAGIAEVCARAGLDTIVCEVDAEAARAARERVEASLDRAVRHGKLDRAAAQDALARTTFTRSLEDLADRQLVVEAVVENADAKTEVFAALDKIVEDPEAVLATNTSSLPVTRLGMTTRRADRVIGLHFFNPVPVLPLVEVVASLHTSARTVDAVTDFATRSLGKTVIRSQDRAGFVVNALLIPYLLSAIRMTESGFASVADVDAGMERGCAHPMGPLKLADLIGLDTVASIAESLYDEFKEPLYASPPLLQRMVEAGLLGRKTGRGFHVYDQG

SEQ ID NO: 9584 - protein, 772 aa, Streptomyces avermitilis
VTAKSAAAAARATVYGYPRQGRGRELKKAIEGYWKGRLDADALRTTATGLRRDTWQQLAEAGIHEVPTGDFSYYDHVLDTSVMVGAIPARHRAAVEADALDGYFAMARGTQDVAPLEMTKWFDTNYHYLVPELGPDTVFSTDSAKQVAELGEALALGLTARPVLVGPVTYLLLAKPAPGVAADFDPLTLLDRLLPVYAEVLADLRAAGAEWVQLDEPALVQDRTPAELNAAERAYRVLGGLTDRPKLLVASYFDRLGDALPVLAEAPVEGLALDFAEGAAANLDALAAVGGLPGKRLVAGVVDGRNIWVNDLEKSLALLGTLLGLADRVDVAASCSLLHVPLDAAAERDIAPQVLRWLAFARQKTAEIVTLAKGLGHGTDAIAAQLAANRADLVSRADSALTRDPAVRSRTAATTDADARRSGPYPERAAAQRARLGLPLLPTTTIGSFPQTAELRTARADLRAGRIDSAGYEERIRAEIGEVISFQEKAGLDVLVHGEAERNDMVQYFAERLTGYLTTQHGWVQSYGTRYVRPPVLAGDISRPEPMTVPWTTYAQSLTDRPVKGMLTGPVTMLAWSFVRDDQPLGETARQVALALRDEVGDLEAAGTSVIQVDEPALRETLPLRAADRPAYLAWATEAFRLTTGGVRPDTQIHTHMCYAEFGDIVQAIDDLDADVISLEAARSHMQVARELAEHAYPREAGPGVYDIHSPRVPGVDETAALLRKGLEAIPAERLWVNPDCGLKTRGWPETRASLENLVAAARTVRAEHAGS

SEQ ID NO: 9585 - protein, 210 aa, Streptomyces avermitilis
VTSRVTLISPAMNRSLREARFDDGCRLDASGAAHAESAAGTLPAADRVWVSPTARCRETASALGLTAMEAPELGGLDVGRWRGRTLDDVSGGEPQAVALWLTDPAAAPHGGESVRALCARVAGWLLTCEEIAGRTLAVVEPEIVRAVVITVLESPEAAFWRLDVPPLTATDISGRSGRWNLRMGRPLDVQGNGVGTATATATGAETGAGH

SEQ ID NO: 9586 - protein, 144 aa, Streptomyces avermitilis
VARQLQPRHITLGGREAVALTLEEYERLIVSRRQIGGQSARVRALSQRVKQSEELLTDLEALIGRHTDGCPGPQGVPGDAAPCQREPQGADATDRVGARGPGAAGTASDCLCCALTALLRRHRSGTGGRDPGDKRSPSPSPPRR

SEQ ID NO: 9587 - protein, 252 aa, Streptomyces avermitilis
MNSTTVRNLLVRGMLAGLGAGVLALLVAYFLGEPGVDDAIGFEEAHAPAHEHEVELVSRGLQSTGGLATGVLVYGVAFGGIAALAYCFALGRVGRFTPRATALLLSATALLAVYVVPFLKYPANPPSVGDPDTIGKRTTLYFLMMVLSVLLAVAAVILGKRLAPRWGTWYATVAAVAFFGLAIGLAYAFLPVINEVPKDFPATLLWRFRTSALAIQLTLWTGFGLIFGELAQRLLAPRTEPVAPAQATPVPQ

SEQ ID NO: 9588 - protein, 73 aa, Streptomyces avermitilis
MAQTVAQPTATTPALPAKLPIGAIVPWAVFFGILMLVLLYFVGAEQGATSVVNGADVHEWVHDARHLLGFPCH

SEQ ID NO: 9589 - protein, 206 aa, Streptomyces avermitilis
MLINHSSGLAEYLPYAYPSLRAFPALADTGPQSLDDNRLTRFHPTELIEMGVTAPAVGAPGGTPGVYSNTNYLLLGELLEQVTGTTAERYITRNVIERAGLRDTELPADPYVDGPHSQIYEAWFGMIDPPRDYSVYDIGGRRSAGAGAGAEAGALRPPLSPPARPAPLTPASLRPAVLCRTKITAGGPVLARDPARGTVGAITTTA

SEQ ID NO: 9590 - protein, 294 aa, Streptomyces avermitilis
MKSLLSSKPETAYETRHMERTAGGVHDTAARRTPAAPGPLASFARFVLCGGGVGVVSSTAVALLAALMPWAVANALITMASTVLCTELHARFTFGAGQRAGWRQHWQSAGSATAAYAVTCAAMLVLRMVQPSPGMLCEQAVYLSAAALAGIGRFLVLRLFVFATDRNRNRTTTTTTATATATVRATSPARPWDLSEAGRARGTETIAARVRSYASADVSRCGARAATVPALRGSSRCRAIRRPAQGSSTVRPPISSGRNRPHRFAGRKRAVRCDPAGSAPAGGTEAGASACGVC

SEQ ID NO: 9591 - protein, 168 aa, Streptomyces avermitilis
MTVYATIDSPLGALLLVGEESATAKGGTALASLSVPGQKGGATVQDDWLEKAEAFDEIVTQLTSYFDGRLTRFDIEYVTGGSEFQRRVWQALEAIPYGTTLSYGDIAARIGAPRAAVRAVGTAIGANPLLVVRPCHRVIGASGALTGYAGGLERKRRLLDLENAHRDA

SEQ ID NO: 9592 - protein, 243 aa, Streptomyces avermitilis
MNGTAHLPPRIGDRVAECDWSAITDELDEYGNAPTGQLLTPAECRGIANLYEEPDRFRSTVDMARHRFGSGQYRYFTHELPDTVAELRAAFYPRLLPIARDWAERLGTSAPWPDSLAEWVALCHEAGQARSAQILLRYGPGDWNALHRDVFGEMLFPLQVVIGLDAPEVGFTGGEFIMTEQRPRAQSRGSSRTLPQGHGLVFTTRDRPVASRRGWSTAPMRHGVSTVRSGRRHTLGLVFHDAA

SEQ ID NO: 9593 - protein, 334 aa, Streptomyces avermitilis
MKTFMIERYGDKAGVRAGEMPDPQVGADDILVQIHAASVNPLDLRLRDGDFKAFLPYRLPLILGNDLAGVVVQVGSAVTRFAVGDEVYARPDKDRIGTFAELIAVHQDDVAAKPATLTMEEAASLPLVALTSWQALVERARVMPGQKVLIHAGSGGVGTIAVQLAKQLGAHVATTASTAKADLMKELGADVVVDYKKQAFETVLHGYDVVLDTLGGETLEKSLQVLKPGGKVISIAGPPDPAFARELGAKPILRLAMSALSFRTRRRAKRRNVTYSFLFMKASGDQLRELTPLIDTGKIRPVVDRVFPFAETRQAMEYVEKGRAKAGKVVVAMT

SEQ ID NO: 9594 - protein, 129 aa, Streptomyces avermitilis
VETASRLFREQGTRVSVADLMKASGPTHGGFYKQFTSKEALIGEATAHAFDELARLRNDGLEQHAGQRDAAQQALIDTTEGVSDFAEWLTVEDRDGITRLCTMLGALIPARATKDPHSPRKSSPPRAQH

SEQ ID NO: 9595 - protein, 109 aa, Streptomyces avermitilis
MGDVPETHTGWTFLTNHARVLSAIAEDPTVRIRDIAAHCRLTERAVQKIISDLEQGGYLTHTRQGRSNTYRIQPGTFLRHPADNGSTVADLLSLLAQHDSRRDGQPQQA

SEQ ID NO: 9596 - protein, 261 aa, Streptomyces avermitilis
MSEQELSQLSGGMDDAAPCPWLKVEVHPAGDRQVVVAYGDIDVDTEAILQRALREALDHSVSGVNLDLGAVGFCDCAGLNVLLRMRRHALAHGKTLAVQATGPATGKLLTITGTLSLFDVTAGPGTRAKGRNPLPPEPHDPSRVDHIDGTGRGRDGTDLETDGTIDGTVVDLRIEVGQLRRAMQTRPVIDLARGVLMASFGLSAEDAWTVLVTVSQHTNTKLHQIAEDLVNTVQGAPLPEPLQRQLAEAVMPFSRVRNAGA

SEQ ID NO: 9597 - protein, 432 aa, Streptomyces avermitilis
VDRATAWRDTWSTTRHRGVELPHARGVFSVLLGLLAVVESLAEFVVGHGSIPRMFAESATTGVRDGGVAGVQLAMVVGLLCLFTALPLALLRPLPAGVTVTAASFGSLVIFQTLTLAGFAAQCVAQYRLGRSGHPVAAVLLGAPFLALALPASQDTDFRTRVVLLAALAPVAALVGLVRRTGEHQREHTAVQQVMAGTQWENAARGERARTVRELHDVVGHHISMIAVRAETARVATPGMPAVGADRLLGIGDTARAALTEMRRLLGVLREDTEPVTGGERRPQPDLRRLGELLDEAREASGSTSVRLILSGSPRTLEPGLELAAYRIVQESLTNARKHAPGAAVDVELIYTEDALRMRIRDNGPGPPHTERADGHGLLGMRERAAAVGGQIRTGSTAVGGFVVDARFPAVRERVAGGGRGRRWCAAVCGVR

SEQ ID NO: 9598 - protein, 254 aa, Streptomyces avermitilis
MKRPGTRFRAAAVCAAVVSLALPLAGCSSLETTAPSAARAHAAGAAARLGTVDCRQTKCIALTFDAGPSENSARLLDILKEKKVPATFFLLGKRHIEKYPELVKRMADEDHEVASHTWDHKILTRLKPAEIRAELERPNKDIERLTGRQPTLMRPPQGRTNATVHKICRELGISEVLWSVTAKDYTTDDPKLIQKRVLAQSSRDGIILLHDIYPGTVPAVPGIIDALKERGYVFVTVPQLLAPGKAEPGTVYRP

SEQ ID NO: 9599 - protein, 408 aa, Streptomyces avermitilis
VDLELHGRLDELQRDPYPHYARARRFTALEHVPELDAWLVARDADVREVLRRPDDFSSANALRPDVMPAPAALAVLGGGFGGRPVVVTADGARHQELRAPIVRGLSPARVAAVLPYAAERATALVDRFLSGAESGRVELMAAYARRLPGDVIGRIVGLDPADVPAVVYGGHRAEELLFRPLTEDEQVVAAQDVVAMQHLLDAFVRDRRADPREDLASEIIASVAPGDGELTLDQRHDIVAHLQNLLLAGHLTTTALIGTTVLNLLRHPRQWELLCAEPERIPAAIEEAARYDSALQGFRRVTTRPVTLAGTELPAGASVFVAFGGANRDGGRHPRPDEFDITRTPRRHLAFGFGVHGCPGAQLAREQLRLTLEQLTRRLPGLRPADDRPVTMRPTLIHRSPRSLHLVW

SEQ ID NO: 9600 - protein, 335 aa, Streptomyces avermitilis
MPLKTYGVLIARAVDVRREGSTDTPHYQVHLTDDQGTHYRASVNVKSQERPSELLYLVDEDFRHPITARLEGLVSGWSKLPSGPGGPNLDFVRGNLFDPSKMRTLPPEVEGPDNDLADILDHYVRRAVEDPAARMYVFGERWGPEAELRDKVFDFLPGNGVHDIHMNQGNSRRFEGDDGVWQDGGLLIHFPAQSRWVGVFLAFQSQKWHTDDATGHALDVAGPRPEPGLQPVRLVAALVNPPGPAPETESVTLINASPAPVDLTGWRLVDRLGHGGPVPPGPLAAGATLSAPLSDGAQLGNHGGEITLLDADGLKVHGVSYTAEQAAHEGWTVVF

SEQ ID NO: 9601 - protein, 149 aa, Streptomyces avermitilis
VVLFLLERVAPVSVDQAWHRLTDWERHAAVVPLTRVTVATPPPTRVGTLFVARSGIGPLAFDDPMEVVAWQPPGAGAPALCRLAKRGGFVTGWAEIEVHPYGDGASRVVWREDLSVRGLPHAFDRPLGAVARRMFGRAVDGLLRPGPAS

SEQ ID NO: 9602 - protein, 236 aa, Streptomyces avermitilis
MTETSHLHTTRTSYDAVAVDYDRLLRNHLAHLPFDRAMLGAFAERVVAEGGGPVGDLGCGPGRVTVHLKSLGLDAFGIDLSPEMVAVARQTYPELRFDVGSMTGLDLDDGSLAGALAWYSLVHTPQPELPPVFAEFHRVLAPGGHLLIAFKAGDECVHLEHAYGHDLSLDVYRFPPERISELLREAGFVEVARLVREADASWEKTPQAYLLARKPAQPRAPRPDTPEASTRDAAAS

SEQ ID NO: 9603 - protein, 383 aa, Streptomyces avermitilis
MLDIAEELHRWVERGRDFAVATVVAVGGSAPRQPGAALAVDADGTAIGSVSGGCVEGAVYELCRQALEDGETVLERFGYSDTDAFAVGLTCGGVIDILVTPVRAADPARPVYAAALAAAAHGEAAAVARIVTGPAELLGRALLVRPEGSYEGGFGAHPELDRTVAGEAGAFLDAGRTGTLETGEQGARCGAPLTVLVESSVPPPRMIVFGAIDFASALVRIGRFLNYHVTVCDARPVFATRTRFPEADDIVVEWPHTYLERTQVDGRTVLCVLTHDAKFDVPLLKLALRLPVAYVGAMGSRRTHLDRNDRLRAVGVTELELARLRSPIGLDLGARTPEETALSIAAEIVAGRRGGSGVSLTGAHTPIHHDAASSMAGRIGSVA

SEQ ID NO: 9604 - protein, 485 aa, Streptomyces avermitilis
MTQQSVEPRSVADDAGAGTRVPAGRSWLDRYFHISRRGSTVAREVRGGVTTFMAMAYILLLNPLILSGKDAAGNTLGQQALITATAFAAACTTLLMGFAGRVPLALAAGLSVSGVLSSQVVPQMTWPQAMGMCVIYGVVIMLLVFTGLREMIMNAIPLALKHAITMGIGLFVALIGFYKAGFVHQGKATPVTLGPTGELAGWPVLLFAATLLLIFMLQARGVPGAILIGIVSGTVLAVVLNALGVIDPRQWASGAPELHGGAVSMPDFSIFGKVEFGGWDQVGAMTVGMIVFTLVLAGFFDAMATIIGVGTEAGLADDQGRMPGLSKALFIDGAGGAIGGVAGASGQTVFVESATGVGEGARTGLSSVVTGLFFAACLFFTPLTAIVPGEVAAAALVVIGAMMMMNARHVDWSDRGTAIPVFLTVVIMPFTYSITAGVAAGVLSYVAIKAAQRKAREIGAFMWGLTVIFLVYFALNPIESWLGVH

SEQ ID NO: 9605 - protein, 793 aa, Streptomyces avermitilis
MGTTGTPTKITQGTKSKGGIGESTLRPDGTLKVTGEFAYSSDMWHEDMLWGQILRSTVAHAEIVSIDTSEALAQPGVYAVMTYDDLPTDVKNYGLEIQDTPVLAHGKVRHHGEPVAIVAADHPETARRAAAKIKVEYRELPVITDEASATAPDAILVHEGRTDHHIGHVSHPNIVHRQPIVRGNAEEAAKKADFIVRGEYTFGMQDQAFLGPESGLAVPAEDGGVDLYVATQWLHSDLRQIAPVLGLPEDKVRMTLSGVGGAFGGREDLSMQIHACLLALRTGKPVKIVYNRFESFFGHVHRHPAKLSYEHGATRDGKLTHLKARIVLDGGAYASASPAVVGNASSLGAGPYVIDDVDIEAIALYTNNPPCGAMRGFGAVQACFAYEAQMDKLADKVGMDRVEFRQLNAMEQGTLLPTGQPVDSPAPVAELLRRVKAMPLPPERQWESSEGADVRQLPGGLSNTTHGEGVVRGVGYAVGIKNVGFSEGFDDYSTAKVRMEVVGGEPVATVHTAMAEVGQGGVTVHAQIARTELGVTQVTIQPADTQVGSAGSTSASRQTYVTGGAVKNSCELVREKVLELGRRKFGTYHPAWATAELLLEGGKVVTDAGEVLAGLVDVLGDESVEVEAEWRHRPTEAFDLRTGQGFGHVQYSFAAHRAVVEVDTELGLVKVIELACAQDVGKALNPLSVIGQIQGGTTQGLGMAVMEEIIVDPKTAKVRNPSFTDYLIPTILDTPTIPVDVLELADDHAPYGLRGIGEAPTLSSTPAVLAAIRNATGLELNRTPVRPEHLTGK

SEQ ID NO: 9606 - protein, 196 aa, Streptomyces avermitilis
MRVNFTVNGRPQEADDVWEGESLLYVLRERLGLPGSKNACEQGECGSCTVRLDGVPVCSCLVAAGQVEGREVITVEGLADYAEQRSCGTGSCGTSLQDAQRWESRPGDSRTGEGTGVSPRAALSPIQQAFIDAGAVQCGFCTPGLLVAADEMLERNPTPTDADIREALSGNLCRCTGYEKIMDAVRLAAARQSEAV

SEQ ID NO: 9607 - protein, 299 aa, Streptomyces avermitilis
MDFLRPASWEEALAAKAEHPTAVPIAGGTDVMVEINFDHRRPEYLLDLNRVGELSEWEVGEESVRLGASVPYTQIMESLRGELPGLALASHTVASPQIRNRGGVGGNLGTASPAGDAHPALLAAGAEVEVASVRGTRLIPIDDFYTGVKRNALAADELIRAVHIKKADGPQQYSKVGTRNAMVIAVCAFGLALHPETRTVRTGIGSAAPTPVRAKTAEEFLNAALEEGGFWDNGKIITPSVAKQFADLCSAACNPIDDVRGTASYRRHAVGIMARRTLTWTWETYRGADGRTHQKGSVA

SEQ ID NO: 9608 - protein, 557 aa, Streptomyces avermitilis
MRLRALLDTDALGLRLLGGEGELDRTVRGVMTTDLKDPSRYLSGGELVLTGLAWRHDAADTEPFVRILAGAGVAALAAGEAELGDIPDDLVLACARHRLPLFAVNESVAFATITEHVVRQVSGERAGDLAAVVDRHRRMMTSGPAGGGPDVVLDLLGSDLDLRAWVLSPTGRPIAGSNLSGPLPATDVCARLAAEHLAAARTGRRGPHRVLVGTTTYSLFPVHSSGRSTGASRDVRETVLSDWLLAVEADAGDWPAERLDLLQGVTQLIAVERDRRDAARTVRRRLAQEVLELVQTGAAPAEIAARLRVAAPVLLPGLGSAPHWQVVVARVEWDGGEIEGGPVAQSLLEEILVDPLSTGAEHSDRIAVAHTGEEAVALVPLPAVSSEHDGSEAGLLADTLLEAVRDPLSAGLNDDGRLTLGVSAAVHSAEGLRGALEEARHARRVAAARPGRVCAAGHQELASHVLLLPFVPDDVRRAFTARLLDPLREYDRRHRAELIPTLEAFLDCDGSWTRCAARLHLHVNTLRYRVGRIEQLTSRDLSRLEDKLDFFLALRMS

SEQ ID NO: 9609 - protein, 257 aa, Streptomyces avermitilis
VAHTAMSGHGTTAGDDPLQTAVWRLRSRACWADAAALLEPRTAGASLQRAALLVERCLYTEQGWQEAEDALRTAEAQARSDDERGAAACERGQLAYAATLLGVRDRADEARAALGRAAALIAPGAPGRALLDFRRGLLAENLARSPQAARAAYRRAHAGATAHNDPLLLSFTWRHLAGLALRDGELAEARHGFGESLRIREELGYLVGTAPALASLADAETEPEASRLRAEAGRLFRLLGGVPTWLARQLTPPAATA

SEQ ID NO: 9610 - protein, 93 aa, Streptomyces avermitilis
VTMVPNPGQQIAWQNQLRTNQQVFSNNAAQYDRRRRRNRGRPASGLAGVLKLLLLVAVVVLLAENPGLRAELWTFAQNLGAYVQGLWADTRNG

SEQ ID NO: 9611 - protein, 296 aa, Streptomyces avermitilis
VEQAGPRPRDMHGSPGTGIPDMGKAAVRVPPQPRAAEVGRERDRERERDRERDRARDRERDRGAAAAGGSARGEHTHGEPPLPVAQAARPVVQRASVRGQVLDALRTALVAGELAPGEVYSAPVLGERFGVSATPVREAMQQLALEGAVEVVPNRGFRVVVRGARELAELAEIRGLIEVPVMLRLARTVSAGQWAELRPLAEASVRAASTGCRATYAETDRAFHRAVLALAGNEQLVRIADDLHRRAQWPLVGGPVSRGRADLLADAAEHTALLDALIAQDLVVVQSLVREHFAGG

SEQ ID NO: 9612 - protein, 275 aa, Streptomyces avermitilis
MPSPVADAYARLTEAFPGLAVTELDPGEAAPEGDGWASAALLAAGGTGLDAFLAWDEAQVLRDYGQRGRPDVVAGFGLHRYAWPACLLITVPWFLGRRVPRLPVEHVTFQRTLGRMAIRVTEFACLPDDPAAGLPGARVVPDEQALRAEVRAAVTEHLEPVLGGFGPRMRRRGRALWGMATDEVAEGLWYVAHLLGEEERAVRELELLLPGATRPYVGSAAFRELTGPNGEALPTRDRASCCLFYTLRPEDTCLTCPRTCDTDRIARLTAVASPS

SEQ ID NO: 9613 - protein, 350 aa, Streptomyces avermitilis
MRLTDISLNWLLPGAVLLLGMLAAVAVLARGKRSGESSTNADDSWERSEERRRRKEAIYGTASYVLLFCCAAVAAALSFHGLVGFGEQNLGLTDGWQYLVPFGLDGAAMFCSVLAVREASHGDAALGSRILVWTFAAAAAWFNWVHAPRGIDHAGAPQFFSGMSLSAAVLFDRALKQTRRAALREQGLVPRPLPQIRIVRWLRAPRETYSAWSLMLLENVRTLDEAVEEVREDRRQKEQNRLRRREQERVERAHLKALSRGHRGLPGRGGGGGGRQLEAPSVERAPAQVTSEPAISTEQLPPVPSRPSLQPVRNSADPITVDLTAEDDTMALPRLDSLERKLKDLERQFG

SEQ ID NO: 9614 - protein, 140 aa, Streptomyces avermitilis
VEESADSTTDQPGGTQLRRRLARADLRAVPEARRALRELLRHWGRPEKSEIAELLTSELVTNALIHTDHDAVLTATVSPRGLRVEVRDFVGRRPIPRVPNADDGTHGRGLLLVQSLADAWGVRAHGVGKAVWFELDGGAA

SEQ ID NO: 9615 - protein, 163 aa, Streptomyces avermitilis
MNSTTARRPARRAALAVGLAAALALPLGLTASAQASAGTDQPRSISGKPSDSVTRIADFYGAYIDAQSDPDNGGKLVDALRKYYVSASYLKELKAWEDKNHADGVLRAQNVPVRWKVTDNGTADHTEAAVTLTWGDKRTTKLIVDMTRSHKIFHIGTKGIGGK

SEQ ID NO: 9616 - protein, 290 aa, Streptomyces avermitilis
VEVCADGPAPSRDGIPGTPYMCTSEGLGRFHPGGSSVSCCGCRTGRPMLLVSYRPPPDRPPDGSPRTGRRDGIRHPCTQIRGTPMTKRVRVAALTALTAAGLVLGTAVAGPAGAAIRGGGSPAFLSAAELPPHPTSSWTAGKVTDGVPDELRLCLDAALPGDDSRYRAYRTDLDTSARQLTMVLGDEATAKGRTARLNQDIRSCATRIERSDPETDAVLKDYGRLPVEEGAHVYGLHTATSWGAGDIHLFSVGRDGRAVTVVEWAQLGDFTDAPVTAFKKTTTTAVNKLY

SEQ ID NO: 9617 - protein, 580 aa, Streptomyces avermitilis
MAKQNVAEQFVDILVRAGVNRLYGVVGDSLNPVVDAIRRNSAIDWIHVRHEGTAAFAAGAEAQITGKLAACAGSCGPGNLHLINGLYDAHRSMAPVLALASHIPSSEIGLGFFQETHPDQLFRECSHYSEMISNPKQMPRLLQSAIQHAVGQSGVSVVTLPGDVASEPAPDKAVETALVTSRPTVRPGDTEIDKLVALIDAADKVTLFCGSGTAGAHAEVMEFAEKIKSPVGHALRGKEWIQYDNPYDVGMSGLLGYGAAYEATNECDLLILLGTDFPYNAFLPTDVKIAQVDVRPERLGRRSKLDLAVWGDVRETLRCLIPRVKPKENRRFLDKMLKKHADALEGVIKAYTRKVEKHVPIHPEYVASVLDELAAEDAVFTVDTGMCNVWAARYISPNGRRRVIGSFSHGSMANALPMAIGAQFTDRNRQVVSMSGDGGFAMLMGDFLTLVQYDLPVKVVLFNNSSLSMVELEMLVAGLPSYGTTNKNPDFAAVARACGAYGVRVEKPKQLAGALKDAFRHKGPALVDIVTDPNALSIPPKISAEMVTGFALSASKMVLDGGVGRMVQMARSNLRNVPRP

SEQ ID NO: 9618 - protein, 674 aa, Streptomyces avermitilis
VAGFSGCPVFIRPERWTIGGMSQQGERSTGHEDDWWGQLYDDSTADTGPAAAADSLDDRFASAAGTVGQPAPRDTAGAPLPPTAPPSVPEQRAGGGPAAPARGSESPAAPARGSGSPGRHAGAATRGTGAADASGGAGGADASGEAGGAGGAVGSGGRHADPPRRDVPARDPAPWEPPSARPPGPATFPPGRRPPGLRPDAPPPSPAGEGGVEPVNPGRSAPARPGEPVKPRPPVPPSPIGPPQPAPAEALSPSDAPPPPVEAELGRLRPPAPPVGPPSLAPTEAPAPTDAPPPPPELPDLPPPSLARAAAPPPPVEAPGLPPLPDLPPRDPTLTVVHEPPPVDHIGSGPPTYDAEPTALPAADPDDLDDLVADTVLDGARYGSCTLRAVSARGDSARYRGEPRRDSLLTARFGVGDQALLLVAMATGARATPGAHRAAAEACHWIGRAVGRSHARLAEDIRAARRGDLKSGLHRLTDRSLGKLRASAAEQGVEPEEYSATLRCLLLPADPECRTRVFFGVGAGGLFRLRDGAWQDIEPHVADATGEAVVGFGSLPSETPEGDRLTMDLGITTPPSPYEPSPRLSASLEQGGTPVEPPRDPFRFRASVAHPGDTLLLCSGGLAEPLRGEPRLAEHLTARWSNGGPPGLAAFLADTQVRVKGYADDRTAAAVWEA

SEQ ID NO: 9619 - protein, 327 aa, Streptomyces avermitilis
MLGAIGLDGAHESAYRALVSMGAADVPDLARRLTLGEYDTERALRRLERHGLAAQSSARPGRWVAAPPGVALGALLTQQRHELEKAELAAALLAEEYRAQATEPAVHDLVEVVIGAAAVSQRFLQLQLGAGDEVCALVTGTPVAVSGMENDAEKQAADRGVAYRVVLEREVLDQPTGIVELSAALGRDEQVRVVDKVPTKLVIADRTLAMVPLTSHAAEPAALVVHASGLLELLSGLFESVWRGALPLRLSAGGAVDEQEADGPDSTDLEVLSLLLAGLTDASVAKQLDLGLRTVQRRVKRLMELTGVTTRLQLGWHAYEKGWVARD

SEQ ID NO: 9620 - protein, 160 aa, Streptomyces avermitilis
MGAWKLLPVGVVLLLGLAGVLVPGVPGSWLVWAAVLWWTLKDPQPLAWGVLVGATLVLLLSRAIRWSLPPRRLRESGATPRMGAFAGIGALLGFVLLPVIGAIPGFMGGIYLSERLRLGRHQEAVAATRTAMRSGGSSVLTELFACLLVAGAWLGAVLWG

SEQ ID NO: 9621 - protein, 421 aa, Streptomyces avermitilis
VGHHARMTRAIKVRHLLAALVTALVLAPTAVGADEGTASGVAPPASAPRWTGTWETAPSGTTPALPGTSIRNVVHTSVGGTALRVRISNRLGTAPLQLDSVTVALQRPGAPRSPDAVPGSMRTATFAGATSVSIPAGRERATDAVRLNVPANANLVVSVHTSADSGPATYHRSAFQTNFLARNGDRTADTDGSAYTTTVSHWYYVTGVDVLGTTAIGSVVALGDSLTDGTGSSASANRRWPDRLAARLRALPPNRRLGVLNAGISGNRVLLDGVGPSALARLDADALLRSGVRAVIVLEGINDIKGTPAQTDPGAFERAYRTIVSRAHARGIRVIGATITPYGGHSSFTGAGEKARQAVNALLRTGRVFDGVADFDAAVRDPANPNRIRPAYDPGDHLHFNDRGMQALADTIDLATLTEWR

SEQ ID NO: 9622 - protein, 133 aa, Streptomyces avermitilis
VGARECLAAVMTEFSEAERAYLKSQRLGRLATVDAHGQPQANPVGFFPQDDGTILIGGYAMGGTKKWRNLQKNPKVALVVDDVISVEPWRVRGVDIRGEAELLTGPHDLGPHFSEEVIRIHPRRIHGWGLEEA

SEQ ID NO: 9623 - protein, 472 aa, Streptomyces avermitilis
VIDEETRYEAVRSRDARFDGEFFFAVETTGIYCRPSCPAVTPKRQNVRYYATAAAAQSSGFRACRRCRPDAVPGSAAWNVRADVVGRAMRMIGDGVVDREGVGGLAVRLGYSARQVQRQLTAEVGAGPVALARAQRAHTARVLLQTTGLSITEIAFAAGFASVRQFNDTIRAVYAATPSELRAAAPRGGPPARRGAAPSAGIPLRLAHRGPYQAIAVFDLLARETVPGIEEMNGPRGRRTYRRTLRLPYGTGIVAVDERPGAPAPRTPAHHGGWLDARLRLTDPRDLTTAVQRLRRLFDLDADPYAVDERLGQDPRLGPLVAARPGLRSPGTADPDELAVRALVGTAEAERLVRRYGKTLDAPSGSLTHVFPEPAVLAQAEPAGTLGALTAALADGTLRLDAGADRDDARQTLLALPGMDDDTAAVIRTRALGDPDVAPPGAEVPDTWRPWRSYALQHLRVAAESAAYEPAT

SEQ ID NO: 9624 - protein, 375 aa, Streptomyces avermitilis
VKGHPLSLSSLPGSFSSSSHPLVPYGWDADWEAEFAPYDSEGLLAGRVIRVDRGQCDVVTPGGMLRADTAFVTPHDPMRVVCTGDWVAVEPAGDPRYVRTYLPRRSAFVRSTSSKRSEGQILAANVDYAVVAVSLAVELDLGRVERFLALAWESGAQPVVVLTKADLVPDATTLSYLVQDVETAAPGVPVLSVSSNLGEGLDVLAAVLSGGTSVLLGQSGAGKSTLANALLGEDVMKVHATRDVDGKGRHTTTTRNLLALPGGGVLIDTPGLRGVGLWDAETGVNQVFSEIEALAAECRFHDCAHTAEPGCAVLAALDTGELPERRLDSYRKLLRENQRIVAKTDARLRAEIRRDWKRKGAEGKAAMEAKRGQWG

SEQ ID NO: 9625 - protein, 511 aa, Streptomyces avermitilis
LWMHSMQELPMPDLPTPQDAAEAALFSECWDAVLSYADLCTSGSAAAAQLATEAFTHGIHQARAADATAKDTGRRTLRLPRIPLLLTAVRTAAAAWEAHGQGHRLDPDLRLWLNSDKAARYTGPPLHRPLALRGLRDMQEPDAALLWLAEVESLPLPDVARRLGLDPTAAAEELVQVRALFRDRCHRNHLDTPMKAECRSYARLLDAVTRSPNAGAPDDLSRHLATCVECAEAAACLRLHGGGLPSALAGGVIGWGGLAYLERRRRAADAGLSGGRVYTGADTGLAQGGTARPRIGRTGILAAAVIVSALALGASLMQFGDSGGGASASDDATDGRPVAGEAASLPAADLPSGSAAAPSSSSSSSTSRPTGAKSEVKSSDPDTEPQGKSSSTVEETHKAGGSTKAPSYCQVKYEILNEWPDGFQATVTVTSEKALDNWRIGWTFRDGQQISQMWDASVTQSGARVTAAAADYNKQVAADGTFAFGFLSTWHDENTTPYGFTLNGGKCTTNG

SEQ ID NO: 9626 - protein, 439 aa, Streptomyces avermitilis
MGSRTALVEDLMERFPHVPREAVFKEDLLRGGVAFDDSALSDNEDGDVKPKSYFIFSFDHGTLPELGEAALRRPPEEIILTGGPYDLRRTVVSVRVNPASPYRVAADEDGMLGLYLDGKRISDVGVPPMPEYYRHQLSNGKSVMEVAPTIQWGYLIYLTVFRVCQYFGAKEECQYCDINHNWRQHKAAGRPYTGVKDVEEVLEALEIIDRYDTAKASTAYTLTGGAITSKVAGRDEADFYGHYAKAIEERFPGRWIGKVVAQALPRDDVQRFKDHGVQIYHPNYEVWDRRLFELYCPGKERYVGRDEWHKRILDSAEIFGARNVIPNFVAGVEMAEPFGFTTVDEAIASTTEGLRFFMSHGITPRFTTWCPEPTTPLGKANPQGAPLEYHIRLLEAYRATMEDFGLSSPPGYGEPGPGRAVFSVSSFMDSLPAQEPTPA

SEQ ID NO: 9627 - protein, 335 aa, Streptomyces avermitilis
LPERPLAMFAMTAENVPWIFPPEVLARLRACVDIDPGLVAEDFTAPRVREALAGVEILITGWGCPRLDAAVLDAAPELRAVLHAAGSVKGFATPALWERGIAVSSAAGANALPVAEYALAMILLAGKDLFAHRDRFRTDRAFPMGDILPGVGNFGRRVGIVGASRIGRRLIELLRPFDLRPSLADPYVDAAEAARLGVPLLPLDDLLRSSDIVTLHAPLTPETRRLIGRRELALMPDGSFLVNTARGALVDHEALVDELRAGRLSAVLDVTEPEPLPAGSPLFDLPNAFVTPHLAGSQGNEVARLGLTVTEEAERLRGGEAPAYAIDPGALERTA

SEQ ID NO: 9628 - protein, 422 aa, Streptomyces avermitilis
MTDAGTALTNWAGNITYSAKELHRPQSLDALRALVADSAKVRVLGSGHSFNEIAEPGADGVLLSLTALPPSVEVDTAARTVRVAGGVRYAELARVVHGHGLALPNMASLPHISVAGSVATGTHGSGVTNGSLASAVREVELVTADGSAVRIGRGDDRFDGAVTALGALGVVTALTLDLEPDYRVAQQVFTELPLAGLDFDAVAASAYSVSLFTGWRTSGFAQVWLKRRTDRPSADFPWAAPATEAMHPVPGMPAVNCTQQFGVPGPWHERLPHFRAEFTPSSGAELQSEYLLPRPYALDALHALDAVRETVAPVLQICEVRTVAADAQWLSPAYGRDTVALHFTWVEDLAAVLPVVRRVEEALDPFDPRPHWGKVFAVPARVLRGRYPRLGDFRALVDSLDPGGKFTNAFVREVLGSGDRPS

SEQ ID NO: 9629 - protein, 424 aa, Streptomyces avermitilis
MAWRDRGIVSVKRTSRDIRTANRYEVLRQIIAKSPTSRQELAAATGLSLATVATLVGELLDLGMLTEVGFEDSAGGRPRGLVAVNSGGGALIGVDIAETYVRVELFDLGLGQLARADEDMRPGESRPEQVVGHVAAAVGSVVAQAGVDGARVLGVGVSVPGQVDRDRGIAEYAPNWDWHDVPLLSLLAEHITHPLYLDNPLRACAVAELWFGAARGRGDAVVVNLGTGVGAGLALGGALHRGVSNSAGEWGHTTLVLDGRLCHCGNHGCVETYVGAPGIMQNLRELSPADPLLHPGDQTATIDALARGVAARDPVALKVVRDTARYLGAGIADLVNLLNPEVVVLSSWVAATLGEPLLDEVREAVARHALRRPFASTEIVLSPIPTDPVCLGAATFALEGALQSVGQRPAQRATSARSRTAPPS

SEQ ID NO: 9630 - protein, 433 aa, Streptomyces avermitilis
LSRSRTQDKDVTMSATSNSNWDRRSVLRAAAGLAALGPLAACGSNTGRSGGGSSGESLVQYFHAYGEAGTEQAIRRYAKAYDKAAVTTQWITGTNFESKLFSALLTDNAPDVFEFHPQLQMIKSGQVAALDDIIDPVKDDFNPADITSHTVDGKVYGVRMIDDPQFFFYRKSLLEKAGTGVPQTLDELAEAAAKLTTDKVKGLFLGNNMVAPNYALVWAAGADQLNAKNEIAYHTDEVAAALKVYRKMFTSGHLLLDAPADYWDPSALVQGLTAIQWCGMWAMPVMQQALGDDLGIFPFPSAASGAKPAVYNGGWSMFVNAKGKNVDLAKEYVKWLWIDQKKYQEDWALSYGFHIPPRTSTAESATKLKSGLPAEGVKLFTDYGRFDNVSWTQAMISALEGVIADAVRKGKDPEAALDTADKKVNRELKNLFG

SEQ ID NO: 9631 - protein, 320 aa, Streptomyces avermitilis
MSTTTTRDVARPAPAKASKAGPRRGLRGTTLNFWLFTGPFLLGLVIFVYVPIGWSVWLSFFEARYTVTPSKFIGLDNYRQMLTNGAFVDALVTFTVFAAIIVPVTWALSLGLALMVHRLRFMKAFFRSVFFLPTACSFVAASLIWKMSIFSGVRFGLANTVLGWFGVENIAWLADPDPPWYWLVIVTVRLWLQAGFYMILFLAALQNIPPELYEAAAIDGAEPGWQTFRHITLPQLRATSTAVILLLLVAAYQAFDEFFNLLSKTTWGRPPLVELYYTALGENQDYGAGSAGAVVLTLLICVVTLLQGRLMGFGRGDESK

SEQ ID NO: 9632 - protein, 296 aa, Streptomyces avermitilis
VTTVIESDKAGAVPPKKRGREGRGVLGSTGLYLATGLCALLFLVPFYLIIRNALSTDAEITGEEWQFFPTHIRWGNITELFDDPTVPFARSLWNSAVVGVLHTAGTLLVCSLAGYGLARIPYKHADKIFYAVLVTLMVPAAVTFVPSFVLVSSLGWVDSYRGLIIPGLFSGFTCFLFRQYFLGFPKELEEAARMDGLGYWGAYWRIVVPNSLNFFAAMATITFISGWNAFLWPLVIGQGEDSWTVQVALSSYMTNQTVNFHLIFMATAISILPLVLVFLFLQRWLVQGVAQTGIKG

SEQ ID NO: 9633 - protein, 1015 aa, Streptomyces avermitilis
MSFRTTASPTSTEYVEDVSPGSGALPPRAWYASSDAVSLSLNGSWAFRLSPTADAQDDSFAAEGYAIEEEGEGYDAGDWTEIEVPGHWGLQGHGAPIYTNHLYPFPVDPPRVPTENPTGDHLRVFDLPADWPALSDGGCVLRFDGVESCARVWLNGTDIGEFKGSRLPHEFAVGHLLKPRGNVLAVRVHQWSAGSYLEDQDQWWLPGIFRDVTLLHRPAGSALDFFVHASYEHVEGLGTLRVDSDVDGRVTVPELDVDVETGESVTVAVEPWTAETPRLYDGVLATEGEQVPLRIGFRTVVRQDGLIKVNGTPVLFKGVNRHEWHPERGRALDLETMRQDVLLMKRHNINAVRTSHYPPHPAFLDLCDEYGLWVIDECDLETHGFTEQAWRDNPVDDDRWTPALLDRAARMVERDKNHPSVVIWSLGNEAGTGRGLTAMAEWIRGRDTSRLIHYEGDIDCRDTDVYSRMYAAHAEVERIGRGLDGGTHRRRDLPFVLCEYGHAMGNGPGGLADYQRLFETYGRLQGGFIWEWIDHGIKDERYGFAYGGDFGEELHDGNFVCDGLLFPDRTPSPGLVEYKKVIEPVRIEGWGSPLAGRSRAPGGGADGTDGTDGTDGTDGTDGTIRVTNAYDFADLSALAFEWSYQVDGETVEAGALSVPALAPGESADVKLPTPPVDGRGAETQWTVRAVLTAETAWGPKGHQVAWAQFPLGKGSSERVARPGGRVAPSCGPVPGERRITLGPAAFDARTGAPRTIGGVDVTGLRLDVWRAPTDNDNGAHWQPDERYGPLWRRLGLHRMQHRLEAVELDDDALTVRSRVAPAGWEVGLRTAYRWTSDGTRLRLTVSVAPEGDWTLPLPRLGVRFGLSSAADRVRWFGGGPGEAYPDTRSASMLGRWESAVDDLQTPYVRPQENGARADVRWAEIGGLRIEGEPEFWFTARRWTTEQLDAAEHLTDLTPGDTVWVNLDHGQQGIGSQSCGPGALPQYHLRPGPAEFSFVFSEASSRRSMSEPRSRR

SEQ ID NO: 9634 - protein, 358 aa, Streptomyces avermitilis
VPHTTAAHRRRASRPLPLVAVGALVAAAVALPQLTPDAFAATTLRGYADGRGVRIGAAVGDSPLRSDSAYTTALDREFNSVTAENAMKWDAVEPSRGGFDWAAADRLVAHASAHGQGVRGHTLAWYAQLPSWLKNGNFSASELNTILKSHIDTEVGRYKGKVYAWDVVNETFNEDGSMRGSLWQDKLGTGYIANALRWAHAADPAAKLYINDYNIEADNAKSDALYALAKQLLADGVPLHGIGFQSHFVVGQVPSTMKANLKRFSDLGLEVSVTELDIRIPLPASSDELAQQSADYKTASENCLGVARCAGITVWGVSDKYSWIPGTFSGYGAALPYNESYAAKPAYTGLSNGLDPTA

SEQ ID NO: 9635 - protein, 795 aa, Streptomyces avermitilis
MSMATRTDTQAPVLHVADSHDLIRVHGARVNNLKDVSIEIPKRRLTVFTGVSGSGKSSLVFGTIAAESQRLINETYSAFVQGFMPTLARPEVDVLEGLTTAILVDQQRMGADPRSTVGTATDTNAMLRILFSRLGQPHVGPPSAYAFNVPSVRASGAITVERGAKKAVKATFNRTGGMCPRCEGRGTVSDIDLTQLYDDSKSLNEGALTIPGYSMDGWYGRIFGGCGFFDPDKPIRKFTKKELHDLLHKEPTKIKVDGINLTYEGLIPKIQKSMLSKDIDALQPHVRAFVERAMTFTVCPECDGTRLSEGARSSKIEGLSIADACATQISDLADWARGLDEPSVAPLLGALLGTLDSFVEIGLGYLSLDRPAGTLSGGEAQRVKMIRHLGSSLTDTTYVFDEPTAGLHPHDIQRMNDLLLRLRDKGNTVLVVEHKPETIAIADHVVDLGPGAGTAGGTVCFEGTVEGLRAGGTVTGRHFDDRAAVKETVRKPTGALEIRGATANNLKGVDVDIPLGVLAVVTGVAGSGKSSLVHGSIPAGEGVVSVDQSAIRGSRRSNPATYTGLLDPIRKAFAKANGVKPALFSANSEGACPTCNGAGVIYTDLAMMAGVASTCEECEGKRFQAAVLDHHLGGRDISEVLAMSVTEAEEFFGAGEAHTPAAHRILGRLADVGLGYLTIGQPLTTLSGGERQRLKLATHMAEKGGVYVLDEPTTGLHLADVEQLLGLLDRLVDSGKSVIVIEHHQAVMAHADWIIDLGPGAGHDGGRIVFEGTPADLVAARSTLTGEHLAAYVGT

SEQ ID NO: 9636 - protein, 194 aa, Streptomyces avermitilis
MARVGLTVDRVVEAAADLADEVGFENVTVSALARQFGVKDASLYSHVKNVQDLRTRVALLAGEEMIDRIAAAVAGRSGKDALAAFADAYREYALERPGRYAATQIRIDQTLVASSRAFHRTAEITYGMLRAYGLEEPDLTDAVRLLRSTFHGYCALEAAGGFGAPRDVLASWQRTIDALHALLEHWPEQERDRD

SEQ ID NO: 9637 - protein, 273 aa, Streptomyces avermitilis
VTDLYYEVCGGGPVLLVVPGGAGHPMGLDGMTERLATRFTVVTYDPLGLAHGRLGEPVEDQRAQAWSEGARRVLDAVLPDGESAYVFGSSSGAIAALDLLARHPRRLRHVVAHEPPVVAVLDDAAAQRAMFAEVYEVYRAAGLEAAAARLGAGLTGTTPGEPPGGAAQPPSPADELSHPMPLFLTRVLRQFTAYEPDVTALTALSPRLTLGAGADSRGQLLHRTASLAAELSGSGFVEFPGGHVGAVEHPVEFADQLAETLLPAGAPGVPLTT

SEQ ID NO: 9638 - protein, 465 aa, Streptomyces avermitilis
VPPWGRERALSQQQLRRGPSRSDPAPVTPGGSRPSRFVGWLGGLGCAAAGYGVFQFLFGVLPDSVTGTPAKYVIAGVSGLGTAAAAWLAAALVRARATASAPGPAPIPSTTAPGPLPQIFTGAYDTLADQVTVVDDPVRGQLTGWSHSLGEATPVRPTPVGTAYGLHIMLDLGVPDGRLSTGDLVDTLWRLRLPDGGWSARSQGTAARPEVTALVLGALARAGAPRDRLAAEVALCEAGFTPELDRTGRELTHVVTTVLRGLLRAAPRSAALPLLREALVGGAITDPQRDHRRCWSHRLVPVHGRPSSLHTAQAVVALDRAARVLGESANARAAREDGVRWLLACADEPHDTCLDLENLREEVRRPRADDPSRHEVLNVRHFTASWIVRALLTPGARELAREDGIEEAWRERLDGAVTAVWAGQTDGIWAWVRDDSSELRRPMWMTYQGLSALRAHAVWMYQPGS

SEQ ID NO: 9639 - protein, 256 aa, Streptomyces avermitilis
MGGRQVLAARRRLAQALDGERPEHELVAAARTVVAELGSTERLLELISELACGEGDPEGCARLSYRHVLGFDKLLLIDGGPRHMLRAHLWHPGAGAIGKEDIHNHRSPLASYVVRGRLTMELYEQDERNGQDERNGKGEPRGGGGMAAARYRESLADRSADWLLEPAGPARLRMTHVGQYTAGSAYALPAHTLHRAWCDTDVPTVTLFLETGSERRRHTDVFTAAGPHPGTVPKVPLDVAGYLAELGGLAELLRSS

SEQ ID NO: 9640 - protein, 139 aa, Streptomyces avermitilis
MDIPGDKRLAAAVVMDDEGRVLLVRRSERERFLPRVWGVPCGKLEPDESPRDGALRELKEETGLRGEVVRKVGESSFVSDYRGHETKNWQDNFLVRPLSTDITLPAPDQAYAWLTPSELSSVDIDEYNLDIVRQALTNS

SEQ ID NO: 9641 - protein, 261 aa, Streptomyces avermitilis
VTRQADVTSFSALHHADAPLLLPNAWDHASAAALAAQGFEAVGTTSLGVAAAAGLPDGTAATREETVRLARQLGGGTFLLSVDAEDGFGHDPDGVAELARELAAAGAVGINLEDGLASAKLHAAKIAAVKAAVPDLFVNARTDTYWLGDGGHAETCRRLDAYRQAGADGVFVPGLSDPTRITALVKTLDVPLNILYSPLGPTVAQLGDLGVRRVSLGSLLYRRALGAALDAAADIRAGRPPRGVAPTYTEIQALSAEGPDA

SEQ ID NO: 9642 - protein, 173 aa, Streptomyces avermitilis
MNDSAQERLRETGTENPAAAVVAMVDHVLDLAATWTAWDGKPAHVDDRVYTPHKAIRRVTDLPQALNSVRAGDTPILDHLAELEARLVGEEPQPDHWHASASTTEADLAPFTPEDLDEARSRLTRLARIWANRLGTLTEGQLDDSPAQGWSFRRLAEHLEESTYYADAVGRSA

SEQ ID NO: 9643 - protein, 328 aa, Streptomyces avermitilis
MPQTPRTTALTHRLVSSPAGRIHLVEQGTGPLVLLVHGFPESWYSWRHQLPALAAAGYRAVAVDVRGYGRSSRPNAVHAYRMLDLVEDNVAVVHALGERTAVIVGHDWGSNIAATSALVRPDVFRAVGLLSVPYTPRGGPRPSEIFAGMGGDEEFYVSYFQEPGRAEAEIEPDVRGWLAGFYAALSADTMPAPDAPDPHFVRRGGTLRERFPAGRLPAWLSEADLDVYAGEFERTGLSGALNRYRAMDRDWEDLAPFDGAPVRQPSLFIGGGLDASTQWLADAIEAYPVTLPGLVSSHILDGCGHWLQQERPQDTNRLLTDWLASLPG

SEQ ID NO: 9644 - protein, 569 aa, Streptomyces avermitilis
MQPFRSPATPPEDRTLSPYTGHTRAHWEATADALLAAVAPYATEDQALYHLPGDRPSWSGRLSDGLEGYARTLLLAAFRRDEKALERYADGLAAGVSGVWPRIEHRGQPLVEAASVALALRLTRPLLWDRLSDGVRQRAAAWLGDALTAEPWPCNWELFPVTVGGFLQEIGYEPDDAREAVDRGLERIEQWYVGDGWYTDGDGRAFDYYNGWAMHLYPVLHAWLADDARLLDLYGGRLSAHLTDYARLFGADGAPLHQGRSLTYRFATTAPLWLGALTGRTPLPPGETRRLASGALRYFLDRGAVDDRGLLTLGWHGPDSAVLQGYSGPASPYWASKAFLGLLLPADHEVWTAPEEPGPAERADAVTPIAAPNWLLQCTRSDGVVRLHNHGSEDVRYDPHYSRLAYSTVTVPSPAYDNTVTVGGDPSRTSIEPLGVGEGWAASRHTAGEGVRVTSLVVARGAVEVRAHLVAGAAPGTPVRVTGWTPAQGLGAELLPGHNLSGDLTGVTADGPTLFTALARLTAEQDPVPLAEAVSVRVADPGEIRVSWTDGPEVRIRLGDGEVAVSAGQ

SEQ ID NO: 9645 - protein, 340 aa, Streptomyces avermitilis
VPAVLAAVTALSAVPAQAQAHEGRRAPGLENCTASACHFDVAPGTYDVRVLLGGDAAAGTSISGEARRSLLPETATEAGERVARGFTVNVRTPEGEPTGADGTPGLDLVLGGAAPALAGISVTPARHPRQIFLVGDSTVCDQPGDPYSGWGQQLPQYLRKGLSVANYADSGESTVTYLADPALFPTVQPLIRRHDLVLIQLAHNDKTTDEATYRANLETLVAGVRAKGGDPVLVTPIVRRWFNADGTLNNNTALLVNGLGVDHPAVIRSVAAAEDVPLIDLTAKTKALVESLGVERSKSIYLYNEKRDNTHTSVQGATLYAGLVRDELVAQHLIPEKQAR

SEQ ID NO: 9646 - protein, 558 aa, Streptomyces avermitilis
MSGSPNRPVRRRTFVLGGAAAAGTAALAGPLAPPASAAGFGYTDDGSNYVVDTGANLVFKVSKTNGDLTSLVYRGTEYQGYGGKNSHVESGLGTSAVTIAQSGSTILVSVTYGTLKHYYAARSGENNVYVWTNKADTSVSATRYIVRVKAGLFLNDEPDSYTYAPTTVEAADVFAKADGQTRSKHYSKLRVVDYDYIGWSTGAVGLWMVRSNHEKASGGPFYRSLLRHQSADGGGLYEILYYGENQTEAQRFGLQGPYVIAFTDGGAPSSSLYPGNLTTSWADSLGIFGYVAAGGRGKVAGVGISGRNTAYAYTVGLANSAAQYWGSARSSDGYFSIAGVLPGTYTLTVFKGELSVHSASVTVTAGATTTLNTITIPSSNDPGNASAIWRIGTWDGTPSGFKNAALMTYAHPSDPRAAAWTGNVVIGSGGETSSFPAYIWKDVNSGLLVYFKLTAAQAAAAHTLRIGVTTAYANGRPRVTVNDWVSAIPSPPTQPSTRSLTVGSYRGNNYTFTYSVPAAAWLTDTSQYNVLKIDVVSGSGTTAYLSAGTSIDALDLLA

SEQ ID NO: 9647 - protein, 464 aa, Streptomyces avermitilis
VILFALCLAFAGALTTAGPARAAAQTLTNGTQFTDTSGNGVHAHGGGVIKVGGYYYWFGEDRNADNTFKYVDAYRSTDLKNWEFRSHVLTQAGASELASANIERPKVMYNASTGKFVMWMHKENGTDYSEARAAVAVSDTVDGTYTWQGSFQPLGQYMSRDITVFVDTDGTGYMVSAARENYDLQIYRLTADYTGIDSLVADPWHGGHREAPALFKRGGVYFMLTSGATGWNPNQQQYATATSLAGPWTAMTNVGDSTAYGSQTAYVLPVQGTSGTSYLYLGDRWGNSFGGSVNDSRYVWLPLTFPTSTSLSMSWYPEVTVDTVAGTISGTSATYETLTARHSAKCADVPSQSLLTGVALTQYTCNGGNNQKFWFKSVAGGYYELMGRGSSLCLTENVTAVTQENCTAATSQQWSLTTSGGYVSLKSRASGECLDVSGASTANSAALITYTCNGGTNQQWTRGT

SEQ ID NO: 9648 - protein, 109 aa, Streptomyces avermitilis
VRSHFQKTGRDVTLTGDAVVTVPAGTRIGYRGGDGNDVVLKTMTKKRRGAAPSASAAPSVKSTAAVGENEGARAWWPLLLAPPAATLAVPVVRRNRSRRRGGRRHAASR

SEQ ID NO: 9649 - protein, 313 aa, Streptomyces avermitilis
MTRSTTLAEALAAAPVVLDGGLSNQLESAGHDLSDELWSARLLAERPEAITEAHLAYFEAGADVAITSSYQATFEGFAKRGIPEERAAELLGLSVGLAREAAVRARADGVTRPLWVAASVGPYGAMLADGSEYRGRYGLTVAELEAFHRPRLEVLAAAGPDVLALETVPDADEAEALLRAVRGLGVPAWLSYSVSGDRTRAGQSLEEAFAPAAEADEVIAVGVNCCAPEDVDGAVETAARVTGKPVVVYPNSGETWDAGARAWSGRSTFTAEQVTGWRRAGARLIGGCCRVGPAAITSIAGTLGEQGRARPTE

SEQ ID NO: 9650 - protein, 416 aa, Streptomyces avermitilis
MPSAPSSSCPTTFRRCASGGCPRRRALADDTEMACSIARVPRTAGFDQDALARSFAEHHDFDRGYGPSMNRLLRLVRQGEPWRDLAAGLFEGQGSWGNGAAMRVAPLGVRFAADLPVAAEQAARSAEVTHTHPEAAAGAIAVAVAAGFAARGRAEAVTGAGLLDVVLDLTPASKVRAGVEQARLLLDQPHVELAAHTLGNGRLVSAVDTVPFTLWCAARHLDDYPAALWACAAAGGDVDTTCAIVGGIVAAHVGTAGIPAAWRQRVEPLPPWFFGHAAASWSALARTLPGERHPCVCCGRLVHDRPPGSHDICPLCFWEDDAVQLRLPAAAYGPNRISLVDAQVNARDIGACTQRDLSFVRPPQPDEPVDPDWRPIDPLRDRFEDPDGETDARLPWPTDHTTLYWWRPTFWNPCGR

SEQ ID NO: 9651 - protein, 533 aa, Streptomyces avermitilis
VRWTRRWTRRWTRRRTRWSVPRTERCAAGTRRGSPSSAASPSPHRPSATAGYDRPIRRSRGTGCATPERLAPLRPNRKYSEAFARFLSDPVVAGDDCLNLNVWTPEPGRGARLPVMVWIHGGALTRGSSAVPVYDGSSFARDGVVLVSFNYRLGVEGYGLFPDAPPNPGLRDQLAALEWVRDAVAEFGGDPDRVTVFGESAGAISIGALLASPRARGLFRRAVLQSGPPESTERDKVRRLVRRMAVKLRIPATAAAFAEVDRTLLAEAQAEVGRLAGPVLGGPAFGIVVDGDLVPSDPREALLGGLARDIPLLLGWTSEEHRLWLAPTGLLERIDRLGPVALAGAMARCRCGPEVPRGYRLAHPGAPTSDLVGHLVTDHLLRVPLHRLADSRTGHAPSYVYEFAWRSNHPRLGACHALELGFVFDTVDVPDSAKLAGPDAPQELADAMHAAWVRFAVDGDPGWPAWDDSHPVRVFGADEELVHGPRDAEVGLWKAEFTRPAATPAPVSPPPPGPPARGRAPLSAVRYFRRSDV

SEQ ID NO: 9652 - protein, 349 aa, Streptomyces avermitilis
MVRTGSMAGPTLAVVAREAGVSVPTASKVVNGREDVAPETRRRVTEALDRLGYVKRPRFDTTKSQGLVDLVVHSLESSRSGAVLHGVEEAAHEAGLEVVVSAGLTRTRGGRPERGWLDKLSARGSSGVLFNLAELTPPQYAWLDQHRIPYVLIDPELEPPAGVVSVGAANWQGGMSATEHLLALGHERIAAIGGHRRKMCGGARIAGYRSALAAAGVRHRPEYVRHGNFDPAVARRRMREFLDLPEPPTAVFVCSDRMALGVYEALAERGLRVPDDISVVGFDDLPEARWASPGLTTVRQPLAEMAATAVRLLVRMMAGERPEGTRTELSTRLVERASTAPPRDRATEG

SEQ ID NO: 9653 - protein, 816 aa, Streptomyces avermitilis
VNERRRPAVRTVAVLSPRPGPPHPHQATHGRTFGLSHTSSRQLPDKDDTPTAEDPTPTVLPEQQPAEDGHRDDAHRDDEEAAPADTEPDAGEATAAQDTAPGASAAQDTAPGASAAQDTTKPGDASATDGTPKPGDASTTDGTPKPGDASTADGTPEPGDASATDGTPKSADASATDGTPKADDAPETAPGPEAAAEAEAGAGAEAGSEAAPDTSAVPESDPDPAVPDPSTPDAAVPDPDTPDAAVPDPDTPDAAVPDPDTPDSAPARPGWRGKHPDAARVLAWTATGIAVALVLFALLVPNDLARFTPSRFVRIPAEGILGAALLLVLPPKPRRILAVVGGVGLGLLTILKFLDMGFYWSLERPFDLVLDWVLLDDAESFLKDSIGGGGALAVMIGAIALAVAVIALMTWSVVRLTRLMASRRHFAGRTLLVLGTAWMTCSVLTLEVAGVPVASRSAATLLENRAHAVRAGIKDGQAFARQASVDAFADTPSDQLLTGLRGKDVIFAFIESYGRSAIDDPAMTEPINETLTAKTKELSDAGYSSQSGWLRSPVAGAGSWLAHSTFLSGLWIKNQQRYRNLTSGNRMTLTEAFRRTDAWRTVGIMPGVTRAWPEGKFFGLDHIYDSRELGYQGPKFSWSPVPDQYSLAAFERLEHGKKHSKPLMSEIILTSSHNPWAPIPKTIPEDQVGDGSVYDAIHDAGKDPKEVWKDPAKVRDEYRKAIQYSVTSLVDYVAKHGNKNTVLVFLGDHQPNRTVTGDKAGRDVPIAIVAHDQGVLDRISDWGWTDGLKPASDAPEWRMDTFRDRFLTAYGPEPTS

SEQ ID NO: 9654 - protein, 234 aa, Streptomyces avermitilis
MPFRVLVYTRTTGYRHDSLPDAVAAVRSLGAAHGFDVDATEDPAAFEAPLDAYGAVVFLSTSGEVLTPEGRTRLAAYTRKGGGFVGVHAAACTEDAWPYYGELLGARFARHPAYQPGKAVVEDRDHPSTHHLPTVWEFTDEWYDFRTTPRGSVRVLASADESSYDGGGMGDDHPLAWCRDQGAGAGRVFYTALGHASEAYGDPDFRAHLLGGIRWAAREVQAYGPVRRDPPDRP

SEQ ID NO: 9655 - protein, 219 aa, Streptomyces avermitilis
MTRAARVPKALAVLPALLLLPVLLSACGTEKAGAGGSGADRAEVSRARLDARAAALGVAPELVYVTEAPGFTLAQQSVGVYGGDGFSSVYVSRKTGAQIQLSVDRGTMTAANCPKQPLGEASGERITCARDGDTWYRTAGGRQEYAVPEKGHVVRVSADANAVGRAVLRRAAGAAHRPDDTELAAVLPTPDGTATAPVERGDLPPVGDGAPNNDVGTSG

SEQ ID NO: 9656 - protein, 132 aa, Streptomyces avermitilis
MTPRFDVISLAVSDMAAALAFYRRLGLVFPDGAESEPHVEAGLPGGLRLALDTEETIRSFHPEWQPPAAGGRLSLAFRCDSPAEVDTVYGDLVGAGYHGELKPWDAVWGMRYAVVHDPDGNGVDLFANLPAQ

SEQ ID NO: 9657 - protein, 237 aa, Streptomyces avermitilis
VVAERASAPPGYAERPSRLAGAVVWTNRPSAAAGRPVLPDGCMDLLWTEGRLLVAGPDTHAYRPQGPAGEWAGVRFFPGTAPVFLGVPAYELRDRRVDLAEVWPAAEVRRLTGRVDAAADPATALEEIALHRAAQADRPDPLLRKVVASLAAGRPVARAADELGVGARQLHRRSLAAFGYGPKTLARVLRLQRALALAWAQVPFAETAARAGFADQAHLARDVRELAGVPLGELLRR

SEQ ID NO: 9658 - protein, 320 aa, Streptomyces avermitilis
MDALAGLLEGPRARGAFMIRACFDPPWCIRVEDRAPLTIMLVVRGEAWVMPDGQERTLLRAGDLAIARGPDPYTCADSPATEPQAVILPGGECAYPDGRSLKGHRDLGVRSWGDRPDGSTVLLIGTYLMQGEITGRLLDALPPLLSLTSREWKCPLTPILAEEIVRDEPGQEVVLDRLLDLLVIAALRAWFSRPEAEAPAWYRALADPVVGRVLRLVQDDPAHPWTVASLAAKAGVSRAALARRFTELVGEPPMAYLTGWRLALAADRLRDSADTIGAIAHQVGYGSAFALSTAFKRVYGVSPQEHRTGGAPTVPRGTVT

SEQ ID NO: 9659 - protein, 277 aa, Streptomyces avermitilis
MTQNTRNTTVLVTGASGRTGSRVAEAARAAGLTVRAASRATGFDWADRASWAAALAGADAAYLMYPTDVGSPAAAGAVGTLAREAVEAGVRRLVLLSSRGEERARPTEEALKESGADWTVVRAAWFAQNFSEGPLVEGLRHGELVFPAGEVREPFIDVRDIADVVVTALTAGERYVGRTLDLTGPRLLTFREAVAEISAATGGTFAYTPVPARQYGENLKAFGVPPEEVDFLVDLFESLLDGRNAHLSQEVRQILGRAPHDFSEFARENAAAGVWKA

SEQ ID NO: 9660 - protein, 345 aa, Streptomyces avermitilis
MEYRILGLAAEAAFFTLLSVPPLLLSMIGLLGYVDDWTGADTIASLENNILEASRTVLSDKGVTEIAQPLLHDVMKGGRPDVISLGFLFALWSGSRAVNVFIDTITVMYGLDGTRGIVKTRMMSFLLFIVALLIGSVALPLMVAGPDAVVNVVPWSTTVVQVLYWPVVIVLSIVFLTTLYHVSVPVRSPWVEDVPGALVALAMWVLGSFLLRIYLTSTVEGPTIYGSLAAPVAVLLWIGVSAFAVLVGAAVNAAIDRVWPAAATAAARAANERLLEEQAAVFVARVAAYRAADIDPDDPDMPSEFPERWSRFLPPEDVTSRFRTHVKSPHHHPQHKNGDPPAGEQ

SEQ ID NO: 9661 - protein, 549 aa, Streptomyces avermitilis
MAASTHTVTNQAPPLVGYDVFAADRALVEAVERHLDPALLDEARTELSGLGLSAGSAQVQEWGALANENPPKLRTHDRWGNRIDEVEFHPSWHRLLGKGVSAGLTAAWSRPGGHVRRAAGFVIWTQAEAGNGCPLSMTHAAVPALRTDPALAAEWEPRLTSMVYDQGMRPAAQKAGALFGMGMTEKQGGSDVRANTTAARPLAEDGTYELTGHKWFCSAPMSDGFLVLAQAASATDGGGLTCFLVPRVLEDGTRNVFRVQRLKDKLGNRSNASSEVEFDGTWARRVGDEGRGVRTIIEMVAATRLDCVLGSASLMRQAVAQAIHHCTYREAFGGKLVDKPLMRNVLADLALESEAATTLALRLAAAYDDGGEQERAFLRLAVPVAKYWVTKRCTPVAAEALECLGGNGYVEEFGLARLLRESPLNSIWEGAGNVQALDVLRALQREPQALNAYLQEVGRARGADHRLDGAIKGLLTELADLEGIEGRARRVVERLALVLQGALLVRYAPPEVADAFCASRLGGDWGTAFGTLPHSLDLATVVERARPVA

SEQ ID NO: 9662 - protein, 441 aa, Streptomyces avermitilis
VAHSPKDVTRLVARDAAQAARMLREVRSATLAGQRTRVAPRPVIEASWGRMRRSGVDPDHDVRAGLLSLDEVERRRRESPLRVVLPVLREGLLSVADVAQHIMVVADADGRVLWREGSPAVLRQADGLGCEPGADWGESVVGTNGVGTPAVTGRPVQVFASEHFVRSFASWTCTGAPITDPRDGRLIGVVDISGPLETMHPATLAWVDSVAKLAEARLREVHLTSLERLRAVAAPLLARLDGRAVAVDRDGWTAAVAGMPYARRLALPTSLTAGRSCLPVLGPCSVEPLPGGWLIRACDRATPAHTTRIVLDLSHPRRWSVTVSGDTGSWTHELTPRHAELLYLLTLHRSGRTAAALAADMFGDPARTVTVRAEMSRVRRYLGAFLDHRPYRFSETAEVELLAPDDPLDLLPHSIAPAVLRVRTAGPGGGVSLLAPGGGPV

SEQ ID NO: 9663 - protein, 467 aa, Streptomyces avermitilis
MKQRGRHRRRRRGRALRATLAGTALALTAAATLISTSQAAGGDNPGALTPLTSAAETGKLQLHENLVGRTTLDTLTSDMGGNVGVHGVLQSANHSMRNKADCAATEAAALPVEPSASRAYCWDSGDATTQKWLPQSVTTSGDADNDGTWGDDRVILAGWTHNDHKAGEPADDQGLARVAFIDANDPDNLKYRWVLLVAPLSGDADFGAVRSHLGGMVWYQDKLIVTAKNGADHNNALFVFDMHRILRANVDSSAVGKVSGGYAAHGYQYVLPAIGSYDLTGGACTSGNDNAVPCFASVSLDRTSTPDSLVANEWFSSGGTQPARVWRYYYSTAASRTGLLGSNSSDVVNADEAYETKAVGLQGVLSHKPSGASTPNWYVDHAPGSRGKHGTLWRQNKDGARAARCTTDQTTACWGRHTESMSLWQETGELWTLTEWAANKDAQWEPDAIPERVLYAVPLSSVDDSLG

SEQ ID NO: 9664 - protein, 190 aa, Streptomyces avermitilis
MSDITVTTWSLEQTSPADLRPATAPDGEVRIVRSEVPSPEFSRFLYASVGGDIRWTDRLSWTYEQWQAYLARPGVETWVAHDRGTPAGYVELEPQDDGVVEIAYFGLIPAFRGRRIGGHLLSYGAARAWDLAARWPERAETKRVWLHTCSKDGEHAMDNYLRRGFTLFDTKVEAEADVAAPGPWPGARAA

SEQ ID NO: 9665 - protein, 564 aa, Streptomyces avermitilis
MAATPQNPAAAPRRKVSRHRGEGQWAVGHFTPLNGNEQFKKDDDGLNVRTRIETIYSKRGFDSIDPNDLRGRMRWWGLYTQRKPGIDGGKTAILEPEELDDKYFMLRVRIDGGRLTTEQLRVIGEISQEFARGTADITDRQNIQLHWIRIEDVPEIWQRLEAVGLSTTEACGDTPRVILGSPVAGIAEDEIIDGTPAIDEIHRRILGNKDFSNLPRKFKTAVSGSPLLDVAHEINDVAFVGVNHPEHGPGFDLWVGGGLSTNPKLGQRLGAWVPLDEVADVHVGVLSIFRDYGYRRLRTRARLKFLVADWGVEKFRQILEDEYLKRKLVDGPAPDQPVASWRDHVGVHRQKDGRFYVGFAPRVGRVDGTTLTKIAEVAAAHGSGRLRTTVEQKMIVLDVEEGQVESLVEGLEALDLTVKPSSFRRGTMACTGIEYCKLAIVETKARGASLIDELERRIPEFDEPITINLNGCPNACARIQVADIGLKGQLVLNDQGEQVEGFQVHLGGALGLEAGFGRKVRGLKVTSDELPDYIERVLKRFQAEREDGERFATWAARASEEALS

SEQ ID NO: 9666 - protein, 59 aa, Streptomyces avermitilis
VSERAAPFYCPYCGDEDLRPSEQGHGAWECGACNRAFQLKFLGLLARGFQPNDGGGDEI

SEQ ID NO: 9667 - protein, 245 aa, Streptomyces avermitilis
MRTVQADTDTGTERATGRDAELKTLAEQAGRDLEDASALEILQWAADTFGKKFCVTSSMEDAVVAHLASRTFPGVDVVFLDTGYHFPETIGTRDAVEAVMDVNVITLTPRRTVAEQDAEYGPKLHDRDPDLCCKLRKVQPLEQGLTAYDAWATGLRRDESPTRANTPVVSWDEKRRKVKISPIARWTQDDVDAYVAEHGVLTNPLLMDGYPSVGCAPCTRRVLEGEDARAGRWAGSTKTECGLHG

SEQ ID NO: 9668 - protein, 178 aa, Streptomyces avermitilis
VTTGATIWLTGLPSAGKTTIAYELAGRLREEGHLVEVLDGDEIREFLTADLGFTRADRHTNVQRIGYLADLLARNGVKALVPVIAPYADSREAVRKRHGASGAAYLEVHVATPVEVCSQRDVKGLYAKQAAGEISGLTGVDDPYEAPASPDLRIESHTQTVQESAAALHALLTERGLA

SEQ ID NO: 9669 - protein, 311 aa, Streptomyces avermitilis
MTTAATASQETDSPYALSHLDALESEAVHIFREVAGEFERPVILFSGGKDSIVMLHLALKAFAPAAIPFTLLHVDTGHNFPEVLAYRDRVVAAHGLRLHVASVQDYIDRGVLRERPDGTRNPLQTVPLTEAIQQHRFDAVFGGGRRDEEKARAKERVFSLRDEFSQWDPRRQRPELWNLYNGRHAPGEHVRVFPLSNWTELDVWQYIAREHIELPEIYFAHEREVFQRSHMWLTAGDWGGPKDGETVEKRRVRYRTVGDMSCTGAVDSDATTLDAVITEIAASRLTERGATRADDKMSEAAMEDRKREGYF

SEQ ID NO: 9670 - protein, 487 aa, Streptomyces avermitilis
MTSTTEPTEPLSVEQLSATTLLRFATAGSVDDGKSTLVGRLLHDSKSVLTDQLEAVEQVSRSRGQDAPDLALLTDGLRAEREQGITIDVAYRYFATARRRFILADTPGHVQYTRNMVTGASTADLAVVLVDARNGVIEQTRRHAAVAALLRVPHVVLAVNKMDLVEYKESVFAAIAEKFTAYASELGVPEITAIPISALAGDNVVDASANMDWYGGPTVLEHLETVPVSHDLAHCHARLPVQYVIRPQTAEHPDYRGYAGQIAAGTFCVGSEVTVLPSGRTSKIAGIDLLGTPVDVAWTPQSVTLLLEDDIDISRGDLLVPSKDAPATTQDVEATVCHVADAPLTVGHRVLLKHGTRTVKAIVKDIPSRLTLDDLSLAPAPGAAGRQRHRPRQDPYRRAAAARLVRRLPPHRRVHPDRPGGRHDADRGHGRRVLRRARAGQGRERRRRVGLLIMTTTDFYSTFAKEGGRVGSGALGSGQGGVARCAR

SEQ ID NO: 9671 - protein, 68 aa, Streptomyces avermitilis
LVANDIGRVKIRTAEPLPLDSYADSRRTGAFILIDPADGTTLTAGMVGESFAAPEPVKDASDDDGWDF

SEQ ID NO: 9672 - protein, 382 aa, Streptomyces avermitilis
VTAGPTRGTPPVPANRSTLIRRAVAAAAALPLLALAACGYGSESKDDTSAKEKVAAGAKKIDGLDTVKIGYFGNLTHATALVGRQEGLFQKELGATKAEYATFNAGPSEIEALNSGSIDIGWIGPSPSINGYTKSNGKSLRIIGGSASGGVKLVVNPKKIKSLKDVKGKKIATPQLGNTQDVAFLNWIAEQGWKVDAQSGKGDVTVVRSDNKVTPDAYKAGSLDGAWVPEPTASKLVAEGGKVLLDESTLWPDKKFVITNIIVSQKFLKAHPKVVEAVLKGSVGTNKWINANPDEAKAAANKQLETDSGKALPADVLDPAWKSIQITNDPLASTLNTEADHAVKAGLLSKPDLSGIYDLTLLNKVLKADGASTVDDAGLGVK

SEQ ID NO: 9673 - protein, 270 aa, Streptomyces avermitilis
MSSQEVTTMATTIAKATDSVGVVEHAARIEHVSKSFAGPAGRQLVLDDITLDVAPGEFVTLLGASGCGKSTLLNLVAGLDAPTTGSITTKGRPALMFQEHALFPWLTAGKNIELALRLRGVPKAERRDKAEELLELVRLKGAYGKRVHELSGGMRQRVALARALAQDSGLLLMDEPFAALDAITRDVLHDELTRIWRETQLSVLFVTHNVREAVRLAERVVLLSSRPGRVAHEWTVDIPQPRRIEDTAVAELSVEITEQLRGEIRRHGQH

SEQ ID NO: 9674 - protein, 303 aa, Streptomyces avermitilis
MASTETTSADAPAKDNTHHDLAGLEAGLDALETVQVGRTPFRQVFVQKILPPVIAIALVLVVWQALISFKIVTDPSKLPPLSAVWNEIENAWLEGKLLGYIWTSVSRGLLGFLFALVIGTPLGLLVARVRFVRAAIGPILQGLQSLPSVAWVPPAVVWFGLNNSMMYTVILLGAVPSIANGLVSGVDQVPPLFLRAGRTMGATGLRGTWHVVLPAALPGYVAGLKQGWAFSWRSLMAAEIIASFPDLGVGLGQLLENGRNAIDMAMVFEAILLILVVGIAIDLLIFSPLERWVLRSRGLLVKS

SEQ ID NO: 9675 - protein, 245 aa, Streptomyces avermitilis
MHRPVLLVIAHGSRDPRHAATVHALVRRVRAMRPGLRVETGFLDFNVPSVNGVLESLAAEGVREVVALPLLLTRAFHAKADIPAVLREAPSRLRIRQAEVLGPSPFLTAALERRLYEAGLTPADRPSTGVVLASAGSTDPEAIAVIGDIAREWRRTGWCAVRPAFASASLPRTEDAVRELRALGCERIAVAPYVLAPGFLPDRIARGAAEADVLSDVLGPAPEVAHVLLNRYDEARVPALAALGA

SEQ ID NO: 9676 - protein, 198 aa, Streptomyces avermitilis
MKNDDMHPYMIECAAEAARVARGVTAAQLSDPTHCPDWDVRALVNHWVLYTSHGLEHRALRKQLPEELTARDFTAEPDWAEAYAAQLDRAVAAWADPAVWEGEVDLGMAKVSATDIASMVIKELAVHGWDVATATGQEYRVSDGAARFVLAVVETHGDLYRQYDGFADPVPVPDDAPVFDRALASSGRDPRTGRLSLG

SEQ ID NO: 9677 - protein, 91 aa, Streptomyces avermitilis
MCEASLRLLRLDTIDLYQLHRLDPGVPMADQLGTLDALRTEGEIRHLGLDTVTAEQLEAALELTDIASVQNRYNLLDRASEPLLSRLDSLG

SEQ ID NO: 9678 - protein, 181 aa, Streptomyces avermitilis
MTTYAALLRGINVGGNKKVPMAELRTLLQGLGYGGVATYLQSGNAVFTSDHGDEQSLAAEVGQAIEKRFGFTVDVLVRDHAYLKAVREACPFPAAELEAKQLHVTYFSGPVDAERFASLDQPAFLPEEFRLGDRALYLYAPDGLGRSKLGETLARPRLLKGIVATSRNWNTVVKLEELTGA

SEQ ID NO: 9679 - protein, 757 aa, Streptomyces avermitilis
MANGETTRVRGIAARAGGWSARHRWAAVGIWVLFVVLAMGLGSAAGQVKVKESDQLGGETHTAAKIIEDAGIEEPASETVLIQVRNGSSKATDAGFRDAVDAVMRAVEDTGKATDVTSPYDTRTISKDGRSALVQFDMRGESDTAGERVEPVLKAVEGVQKDHTELRIEEIGGASMMKQYNDAFGDDFQKAEYSAVPVALGILLIAFGALVAALLPVALAITAIMATMGLMGIVSHLQPMDDTASSVMLLVGLAVGVDYCLFYLRREREERAAGRSADAALRIAAATSGRAIIVSGITVCVAMAGMLFTGLATFEAMGLASLMVVAVAMVGSVTVLPALLSLLGERVEKGRIPFLHPDKRRKNGNAAKGNGESRFWGAVLRVVLAKPGVALVVAAGALLAIAAPALGMKTQNLTLDQEFGDSLPIVGTYNRVNDAFPGGSEPAEVVVRAKDINAADVKSALADFRTQAVSSGASRGPVEIKVHDAQNIAFVYVPLVGGSDQDKAGQSLDLLRDKVRPDTLGKVDGVQAPITGQVAGNKDFNDQLIGSVAPVFAFVVVFAFLLMLVSFRSLTIAITSIVLNLLSVGAAYGILVGVFQHGWGASLVGAEGVGAIVTWLPLFLFVILFGLSMDYHVFVVSRIREARLRGRSTKDAIQHGVVTTAGVVTSAAVIMVAVFAIFGTLSMQSMKQMGVGLAAAVLIDATIIRGVLLPAVMALLGERNWYLPRWLNRLPDLTHDESPEPVSPPQPPAVEGERVGV

SEQ ID NO: 9680 - protein, 323 aa, Streptomyces avermitilis
MPSLRRDLPPLPEVRRITQKKRDAWWTVLLVDPVATPLVRQVALRTRITPNQLTWGAFLLGLASAVCFALGDWRWLVAGAVVYHLSFILDCMDGKVARLTGQGSVFGAWLDFVFDRIRVAVCAVALMAGQYERSGDTTYIWLAAAVIGLDTLRYINSLEIFKIRHSMRKQIKSRLREARRSENQAELAFMEDLLRNNPEADIEQDQRSAAAGQEAPEGGTAARPQAQVIDLHEEFRHRFPAYLRARSFLLRHRIRTHLVSGIEFQMGVFIIGPFLDSVIGATIVSGALLLVFELAIIYKLLLSTRDFTRTIDSFERDDVARAA

SEQ ID NO: 9681 - protein, 426 aa, Streptomyces avermitilis
MRRRWITALVALGLLLAGCSSDHDGSGGRITLRFQSLAWQEESVAANKELVEEWNATHPAVQVAYVQGSWDSVHDQLLTSFEGGEAPDVIHDASDDLADFAYGGSLADLRELLPARLMSDIPQRSWRTATFGDGIYGVPFLQEPRVLIANATWLKESGVRIPTPERPWTWDEFRRIAGQLSGKGKYGVAWPLKEPVSATLNLSLSTGGQMFHRGADGKVTVRFDAADALVPRTVHDEVNTDGSASGSTLGMGGSDTLPGFFGGKYAMVPLGFSYRQQIAQQAPKGFEWQVLPAPAGADGLAQGVSPQTLSVAADSPHKKEAAEFIDFLLRPKNMVRLALGDWMLPTGTEALKDPALHTAMDDWATGTALAAHLRSAPAQSVRGYPEWKDKVATPAFQEYYSGAIGLAELRKRLVEDGNLVLARYQR

SEQ ID NO: 9682 - protein, 277 aa, Streptomyces avermitilis
VKTPKRARAGQYVALLAYLVFLAFPFLWLISTAFKPPRELASLHPTWIPRNPTLANFRQAFDEQPLLHAALNSLLAALGAALIAVLIATPMAYVMARRRTLLARAATGWVVVSQAFPFVLVIIPLFLVLKHLRLINSVPGLIMVYVVWALPFALWMLVGYVRAVPVELEEAAAVDGAGRARTLVSVTAPLLAPGIVATALFAFITAWNEFFFALVLLKTPQKQTLPVVLTHFIGAEGVADLGPLAAAAFLATLPSLVVFAVIQRRITGGMLTGAVKS

SEQ ID NO: 9683 - protein, 312 aa, Streptomyces avermitilis
VTLATVTKRSVKSPPRPAGRGRTPTGQGAWFLVLPALLPILVLSVGPLLYGIALAFTDSQSGRTAPTQWIGTLNFQDLVQDTLFWDSFRIGLLWAVGVTVPQFLLALGLALLLNQDLKLRWAARALAIIPWAMPEVVVGIMWRLVYNPDAGILNETIRDLGLGDGRDWLSGLSTALPAVIVVGVWAGMPQTTVALLAGLQNTPRELHEAASMDGAGAWRRFLSVTWPALRPVALAITALNLIWNFNSFALVYVLTNGGPGGRTRLPMLFAYEEAFRYGQFGYAAAMGCVLVAVISVLLAVFLVGRLKGGEDA

SEQ ID NO: 9684 - protein, 287 aa, Streptomyces avermitilis
MDEAQARDVLATASVLPGPARDARLLALGENAVFAAGDLVVKVGRDAELLDRARRELEIAHWLADTGVPAVRAAEPEARLVDGHPVTVWHRLPDPVRPAEPRDLAELLRVVHALPSPSFDLPPRELLGGVERWLRLAGDAIDPADAAYLRERRDGFAAAAAALTPQLPPGPIHGDALPRNVHVGPGGPVLVDLETFSADLREHDLVVMALSRDRYGLPAEAYDAFTTTYGWDVREWTGAAVLRGARETASCAWVAQHAPSNPKALTEFERRVASLRDGDETVRWYPF

SEQ ID NO: 9685 - protein, 240 aa, Streptomyces avermitilis
MAWHEQLLIGFDLETTGTDPREARIVTGAVIEVKGQEPVGRREWLADPGVEIPADAVAVHGITNERAAAEGGPPDRVAESLAQTLVGYWRTGVPVVAYNATFDLTLLSAELRRYGLPSLRERLDGRDPAPVIDPYTIDRWVDRYRRGKRNLEAVCTEYGVPLDAAHDATADALAAARLAAAIAHRHPKIAALGPAELHRRQIEWYAAWAADFQSFLRRKGDTAAVVDGTWPLREPADETV

SEQ ID NO: 9686 - protein, 430 aa, Streptomyces avermitilis
LAGISHRGELGGAEGGAWVGSGGLELPPGDEGHEGNSTDVPPGAVSLARPMEMGSIGPELDWGTDAWREVRTRAQRAGRAYIWLNLVEQRLRAVVAAVLRPIYEPVHGDEWVVAAAGPAGQEWVQRAVAVREVSRRKGYLLDPADDNVLSFLTLPQLRELMVQHWPCFEPYIDERRDVELALDELEVTRNVVSRNRALSEAVLGQAERASAKLLEILGAGSDVPSARRLPVDAVEDMVGDRYGDVVGVHPDRVRLLRQFPGEDIFGGARRLDAIGIGLNLLVQNFSGRRLVRLAESGCRVRLLFLNPASSAVKRRERELGIKRGEMSRAVEMNILHMRRVRSKLRDPGAFEIQVYDETPRFTAYLVDGDGSDGIAVVQSYLRRTRGMEAPVLVLRGGGRVVKADDVDDSGLFPTYREEFELAWADSRPVS

SEQ ID NO: 9687 - protein, 439 aa, Streptomyces avermitilis
MRVNRISRARRRAAVSLSVAALAVGATTVAGPAVAQTKSAPAAAADCSAAYRIEQKLASGTTWQMCWHYESEAGLVLENISYQPPGETRPIKVLTSAKLGQIHVPYDDGKAEYSDLTGAGFGQGLMNMAPGECPGGTIKTVKVPGAWDPQHPNVKGLCTTTRSRGHAYRMQGDTANKVFQAQGKDLLVYTVNQVGWYEYITEWRFQDDGTINMNVGATGSLSPVDYDAGDGRGWPLGKGAKAYATSHSHNIFWRLNFGLDGSSKNTVEQYDSVVTAPARGNEGPTNKTTRTKITKELAGDAKNMRWWRVVSATGKNKDDHARSYEIVPGATTKYPGRSFTKHDIYFTEYKKCEQFASDNLRNCGTGAGKSVDKWVGGQTLTHPIAWVNVGFHHIARDEDQQPMPVHWQGFSIAPRDVTAMNPLTPAELADQNGHVENGS

SEQ ID NO: 9688 - protein, 286 aa, Streptomyces avermitilis
VGLKTLLETGGVGGNVRKIVHRHLGKVVAGAAIAVAGTAVMVGITLPGSAGADEQGGQGAGQSAQQAGQAGQQGQAAAQPGVVEQAPAEGEKGTGRDPLTDDETKRVAQIAVNQQFFGSSENVEGRRGPQRVGVDLAEQDENAPAGANAPRRADVRFYDYKDDTLVTKTVNLDSGKVEQTDTQHGVQPPISSDEAVEAARLLIADPLGAGLKADFKDATGKELTSPDQLLLNSMAYRATSGAQPAVLAQCGDHRCVRLFPKVRNGPWIDSRDLVVDLSARKVGKLG

SEQ ID NO: 9689 - protein, 702 aa, Streptomyces avermitilis
MQVWPGEAYPLGATYDGAGTNFAVFSEAAHRIELCLLHDDGSETAVELRETDAFVRHAYLPGVMPGQRYGFRVHGPFAPGRGVRCNSAKLLLDPYAKAISGEIKWGEEVYGYHFGAPDKRNDLDSAPHTMTSVVINPYFDWGNDRRPRTEYHHTVLYEAHVKGLTMRHPALPEELRGTYAALAHPAIIEHLTELGVTALELMPVHQFVNDHRLVDMGLNNYWGYNTIGFFAPHNAYASWGDRGQQVLEFKSAVKALHEAGIEVILDVVYNHTAEGNHMGPTLSFKGIDNASYYRLTDDPRYYMDTTGTGNSLLMRSPHVLQLIMDSLRYWVSDMHVDGFRFDLAATLARQFHEVDRLSSFFDLVQQDPVVSQVKLIAEPWDVGEGGYQVGNFPPLWTEWNGKYRDTVRDMWRGEPRTLAEFASRLTGSSDLYQDDGRRPLASINFVTCHDGFTLHDLVAYNDKHNQANGEDNRDGESHNRSWNCGAEGDTDDPAVLALRARQMRNFIATLMLSQGVPMLSHGDEFARTQGGNNNAYCQDGELSWVAWPEDGSELLEFTRAMVWLRRDHPVFRRRRFFHGRPVEGTHDELSDIVWFTPTGEEMIQRDWDSAQARALTVFLNGTAISEPGPRGERISDDSFLLMFNASPKSLEFVVPVDHGRQWQVVVDTARTDGIPPGTVAKVKAGDRLTLVDRSLTVLQRPA

SEQ ID NO: 9690 - protein, 795 aa, Streptomyces avermitilis
MTPERPEPTVPTATYRLQLQPEFPFGAAEAAVPYLASLGVSHLHLSPVLETVPGSLHGYDVVDHARVRDELGGERGLRSLARTAREHGLGLVVDIVPNHMAAAPRHNRPLWEVLREGPDSAYAHWFDVDWDAQGGQLLLPVLGQPLGAEIDRLKVDGDVLRYYDHVFPLREGTGKLPLPQLLDAQWYRPVWWRLARTELNYRRFFSISELIGVRVEDPEVFTATHATVLRLLDEGVVDGLRIDHPDGLADPDAYLRRLHAATGGRWTVVEKILTDGEHLPAAWPVAGTTGYDALRHVDGLFTDPAGAGELLGQYRRFAAPQADRGGHWEATVRRAAYKVVTHELATEVDRLTRAASRLCATSPDPALRDHAPWALRTALQELLVRLEVYRPYASGDAAAVVTEEAAAEARAVFTVPEEAGAVSVVRDLALGRAGDGPGHLEFRARFAQTSSALRAKSVEDTGFYRYVPLLSANEVGGNPGSPAVSPQDFHAYCARVQRDWPATGTALSTHDTKRSADVRAAVSVLTQCPERWADTLAEVTRAGDGVPDPHVAWAAWQTVLGLGPAAEERVQAALLKHVREAGLHTAWTEQDPAYEETVAAFVAQGPCGAPGRLVTDFRAELGPHVRANVLGAALVHLTMPGVPDVYQGTEGEYRALVDPDNRGVFAPQEQPSAKSALTTAALRLRGRRPEVFGDAATYEPLEAEGPGAAHCVAFVRSGEVLTAVTRLSLRLAEAGGWRDTALALPPGRWADALAPEREFEGHTRVVELFGSSPVVLLERLGGRVGGVQATVAGPR

SEQ ID NO: 9691 - protein, 329 aa, Streptomyces avermitilis
MSLRQMEYFLAVVEEASFTRAAETLHVTQPALSHQIKALERSVGGALLERMPRGVRLTPMGRAFRPHAELAVRSAAQARRAARASAGAEGGELHIAAVHSVAVGVLPDVFARWRTAHPQVVLHLHEYATSEALEEQVERGTADLAVGPAPRDWPGSVVPVGEEEIVLVVPFDDRFAGRTTVTLPELSDRSWIRCAMEPVVHGQRFLDWACGQAGFRPRTAVFTEHTSTAVRMAAAGVGVSTAPSHIVRGAVGEDCVVLSVDPPWRRPLTVFSRVPPSGAAAAFVELLRRYGGLPAAPAEACEDGIARPADCGAPETARPLPPTALLDAR

SEQ ID NO: 9692 - protein, 478 aa, Streptomyces avermitilis
VENMNTPDVIVIGGGTGGYSAALRAAALGLTVVLAERDKVGGTCLHRGCIPSKAMLHAAELVDGIAEARERWGVKATLDDIDWPALVATRDDIVTRNHRGVEAHLAHARVRVVRGSARLTGPRSVRVEGAPDDLPGGAGDFTARRGIVLATGSRPRTLPGLVPDGRRVVTSDDALFAPGLPRSVLVLGGGAIGVEYASFHRSMGAEVTLVEAADRIVPLEDVDVSRHLTRGLKKRGIDVRAGARLLDAELLEAGVRARVRTVRGEIRTLEAERLLVAVGRAPVTDGLDLAAAGLATDERGFVTPSDWDRLETAVPGIHVVGDLLPPPSLGLAHASFAEGLSVAETLAGLPSAPVDYAAVPRVTYSSPQTASVGLGEAEARARGHEVDVNTMPLTAVAKGMVHGRGGMVKVVAEEGGGQVLGVHLVGPHVSEMIAESQLIVGWDAQPSDVARHIHAHPTLSEAVGETFLTLAGRGLHQQ

SEQ ID NO: 9693 - protein, 416 aa, Streptomyces avermitilis
VSLLPEQRYPSVTEIVSSARALAAHRPGLCALRQVGVSRAGRPLHLLSVGHATRAVLVVAGAHANEPTGGSTLLSLAERVLYERELRDGTSWHFLLCADPDGAALHVTPAPRTLFDYHLGFFRPAGPEQPEWSPSVLPPDRLPPETRALTRVIDELRPYLQVTLHGTDLGGSWVQLTKDIPGLAEPFAKSAAELHIPVETGASDAAGWPASGPGVHVMPAPGSNAAYPSMPDDARHSTWYHTHRYGGLTAVVEVPMWASDLVDDPAPHPAPAAALRQLGRRLLRDALEVELVLTEALPRLPGPDGPLLRAAKWALELVPGLAGDWAQAPPADTTMAYVGSVDAFGRRLPLRAAAMLLRVLQEADDRAAPRLEQLVAAWSDAFAVRFRARWVPLEDQVEHQSRTVVAAARHARDRAA

SEQ ID NO: 9694 - protein, 146 aa, Streptomyces avermitilis
MTKTTMAVPGALLAAIALLSAAPAQAAAHRVTPGNWLYVTVTTGDARSSHISRLLTCDPPHGHAHAARACEELAAADGDITRIPPKRTFCPMIYAPVTADAHGEWNGRHVEYRHAFGNACGLEGETGAVFALSEQASDGPTPGLRS

SEQ ID NO: 9695 - protein, 469 aa, Streptomyces avermitilis
VRTPCTPGEPTAPHEWRCALPPLLRYPTVDELAARAAALVARRPGDARLRRVGTSRGGTPLWLLSVGHGTRHALVVAGPHANEPVGGATALRLAERVLAGPGPAEGADATWNLLLCLDPDGARRNEGWLSGPYTLGHYFRHFFRPGFLEQPEWLPDGAERAALPETRALLDLQDELRPFFQCSLHGVDVGGGFVELTQDLPGLAQRVAGTAARFGIPRELGPYDTLYWPPLGPAVYRIPPPRRGDLAAAITEAAVESTWFHPQRYGTVTAVVEAPMWGVAAVEDGSPPGDADAVLRAVSRTLRRDTGLLEDILARIRPRLAATPDTASLLAPVDDYLLVGPGLADSWDPDTFDGTGRPLPPLNTARLTALGISGRRVALRTAGLLRQLATAAGAAASDVLPELDRLIDEWCADYRDGYGARWVPVGHQVEYQTRVVLAAFELAGRYAPVRSHSGEPRWGSDAVVPMHTE

SEQ ID NO: 9696 - protein, 212 aa, Streptomyces avermitilis
LPRGTTLTETTSVSGVFWTPWPDCPTITCVTSSFEFHTYPARLSDAERDRALKVLRDGVALGRLSHDTFIRRMELALVARQPAELAALTADLPAEKRVSRLVFGTVEAVSGFTVRLRRAWQAERLPKLLLPHPGSTHPLRIGRDPASGLRLSHDTVSRVHAELSRQGGLWVLRDLGSTNGTTVNGRHVIGAAVVRDGDQVSFGNMAFRLATE

SEQ ID NO: 9697 - protein, 581 aa, Streptomyces avermitilis
VQFEVWAPQAARVTLHCGGATRALARDEERDGWWKGDAEAGDGTRYGFALDDGAVLPDPRSRRQPDGPDGLSAVVDHGRYAWRADRPGRGLPGAVLYELHVGTYTREGTLDAAAERLGHLVELGVTHVELMPLCPFPGRHGWGYEGVSLWAVHEPYGGPEALKRFVDRAHELGLGVVLDVVHNHLGPSGNCLPAFGPYFTDTHHTPWGAAVNLDAPGSDEVRAYLVGSALAWLRDYRVDGLRLDAVHALCDTRACHFLEELSTAVDALAADQDRPLFLVAESDLNDPRLVTPRHEGGLGLHAQWNDDFHHALHTALTGESQGYYEDFARAPFAALAKTLTGGFFHDGTYSTFRGRCHGRPLDRTRVSAHRLLGYAQTHDQVGNRAQGDRLSASLSPGLLACAATLTLTSAFTPMLFMGEEWAAGTPWQFFTDHTDPELAEAVRRGRRREFAAHGWAEEDVPDPQDPATRDRSCLDWAEPESGIHARVLAWYRGLITLRHHEADLSDPDLTDVKVAYDEEARWIAFRRGDVRVAVNLSKEPARIPLGLAHARVLAAWEPVETPGADGVLELPGESSVVLTQA

SEQ ID NO: 9698 - protein, 311 aa, Streptomyces avermitilis
MTQAPTPTADSIRRLVRSVLADGPADGAGPEVRPVAAGGEHSTWWVGTRHVLRLAPDRDASVRLRRELRLRDLVRPHIGVAVPASVAHGEWATGLAYTLDTRLPGAGGEEHAVSAVGEADLAALLTGLREVPVRQAEPLGVPRAVPRSLEALRTVAEDAAQYLSGADEFDADRLGQLTAPAAVQLAAQPGAAVLVHHALKGEHLVVSGDGRVRGVLDWTDAVIGDPAEDIAGLAIAVGAPAAVRAATLAGYGARPCLRGLWLTRCDTLVRLADRLQGRDDSPLPLLRTRLRRAWEAILLERVTELPGDETL

SEQ ID NO: 9699 - protein, 381 aa, Streptomyces avermitilis
MTGTPAPPGTGDPAPFTAADYAARMRRAAQSAADAGLDGVLVAPGPDLVWLTGYRPVETERLTLLVLRAGHDPVLVVPTLEAPDAAEAAGAPALTLRDWTDGKDPYEAAATLLDRSGRFGISDNAWAMHLLGLSGRLPGTRYVALTEALPMLRAVKDAAELERLAAAGAAADATFEEIRKVPFAGRRETDVAADLAELLRQFGHSQVDFTVVGSGPNGANPHHEAGDRVIERGDMVVLDFGGLKHGYGSDTSRTVHVGEPDEEERKVHDLVRAAQEAGFRAVRPGVACQDVDRAARAVIADAGYGDRFIHRTGHGIGVTTHEPPYMIEGEQRALVPGMCFSVEPGVYLPGRFGVRIEDIVTVTDDGGRRLNNTSRELVIVD

SEQ ID NO: 9700 - protein, 113 aa, Streptomyces avermitilis
VSGGPQSMGAKSAQGDSSANAVLAPGKATLGVEAVDAASNGALVVGVHAPGPGYTAGLVRGDILLAFGRTRLDSAADLARAVAGARPGTAVPLTVRHANGNQQQLMATPGIVT

SEQ ID NO: 9701 - protein, 725 aa, Streptomyces avermitilis
MTQPFQLPHFYMPYPARLNPHLDEARAHSTRWARGMGMLEGSGIWEQSDLDAHDYGLLCAYTHPDCDGPALSLITDWYVWVFFFDDHFLETFKRTQDREGGKAYLDRLPLFMPLDLSAPVPEPENPVEAGLADLWARTVPAMSADWRKRFAVSTEHLLNESLWELSNINEGRIANPVEYIEMRRKVGGAPWSAGLVEYATAEVPAAVAGSRPLRVLMETFSDGVHLRNDLFSYQREVEEEGELSNGVLVLETFFGCTTQEAAETVNDILTSRLHQFEHTALTEVPALALEKGLTPPEVAAVAAYARGLQDWQSGGHEWHLRSSRYMNEGALSQKRPFGLSAIGTSAADLRGLLADAGAERLRRYTHVPFQKVGPSRIPDFHMPFQVELSPHLEGARARLTPWMHSTGMLQEGVWDEDKLTAYDLPLCSAGLDPDATPDELDLSSRWLAWGTYGDDYYPMVFGPRRDLAAAKLCTRRLSACMPVDGEEVPAPVNGMERGLIDLWAITTAEMTPDERRTFRASVDVMTESWVWELSNQLQHRIPDPIDYLEMRRATFGADLTLSLCRVGHGPKVPPEIYRSGPVRSLENAAVDYGMLINDVFSYQKEIEYEGEVHNAILVVQNFFGCDYPTALGVINDLMTQRMHQFEHVAAHELPLLYKDFKLPQEVRDIMDGYVVELQNWMSGILKWHQDCHRYGAADLARRAHGFVPDRAPSAPFTAWAAPVAR

SEQ ID NO: 9702 - protein, 259 aa, Streptomyces avermitilis
MTSFVLPHELHGDGAHKVFAVHGWFADRAAYAAVLPDLDRAAFTYALVDLRGYGRAKDAVGAFTTAEAAADLVELADRLGWDRFSVIGHSMGGTVAQRLLALAPKRLRRIAGVSPVPASGLSLPADQWQLFADAAHKPENRRAIIDVTTGGRRPGAWLDRMVARSLADSDAKAFRAWLDSWAGEDFQAEVTGAGVPALAVTGALDPALSSALLRDTWMRWYPRGELRELPSAGHYAMDEAPLDLIHVVEEFLRAEDAGE

SEQ ID NO: 9703 - protein, 421 aa, Streptomyces avermitilis
VSVREQAPPVPDVFDPRRYAAGVPHAAYRTLRDHHPVARQAEPEVLGWPAGPGFWAVTRHADVVRVLKDSTTYSSRFGATQIRDPDPDDLPFIRDMMLNQDPPDHGRLRRLVSRAFTPRRVDRFESLARDRARTLLAAALAGARAGDGSCDLVATVTDDYALLNLADLLGVPESDRGLLLHWTRRVIGYQDPDEAGEPLLDAAGKPVDPRSPGALRDMFEYARQLASYKREHPADDIMTTLATDPELTGPELAMFFFLLTVAGNDTVRGAAPGGLLALAEHPEAYARLRARPQQLPSAVEELLRWHPPVLTFRRTAVRDTDLAGQRIRAGDKVVVFHASANRDGRVFTAPDRLDLSRSPNPHVSFGDGPHVCLGAHFARLQLRVLYAQTLRALPAPRVAGPPGRLVSNFINGIKSLPLQVA

SEQ ID NO: 9704 - protein, 404 aa, Streptomyces avermitilis
MSEAPVIVSDDPGSFPHSVLAERHPALIRKVRDAFPYGPEQRRALDALQKSALDGVIEPLGTPAEDHERWVAWGLPKHLGRSWFSVPFLWAESYFYRQLLAAVGYFGSGPWQGIDPFRPFKLAELDTPEAAEELAALDALTGRPLDEQARALLHGSLWGNRADLGFRISAGGDGSVDSQLLVDDSESLWALLPAHTADSDSDSDSDADGTAGPARTVCLVADNAGRELIPDLLLIDHLLHHGRAERAVLHVKPYPYFVSDATTADVLDAVRRLTGTKGAAGAAGDRLWSALTDGRLVVRAHVFSCAPLPYADMPDDLRREFAEADLTIMKGDLNYRRLVGDRLWPPTTPFTTPTAYFPGPVVALRTLKSDVIVGLDADTEAALAAAQGQGWRTSGTHAVIQARP

SEQ ID NO: 9705 - protein, 193 aa, Streptomyces avermitilis
MRMPTESAHGPVGVICPSCGESTVRAVEEICADEASVRDGLSNRLAKAPGVTSGFDGCLHFVEGMLMVGVGAALAYSGVDNDKPLYTIGGALLAVLLFVGTILVVRGEARERDVVNAGEHRADRLWRPAHYCSGCASVFCPGGGPWEGLLTPEQFQKYVWTEAGYGKQLDPAVRDLELPVGIRTGPEGAQDHV

SEQ ID NO: 9706 - protein, 311 aa, Streptomyces avermitilis
MTAHRTAAAAAVAVAAPLLLTAWAAGPAQAHGAPTDPVSRVVACSPEGGGRARTAACTAAIAANGSPFTAWDNLRVAGVNGRDRQLIPDGKLCSGGLPAYKGLDLTRSDWPSTRLTPGASLTMKYSSTIPHTGTFKLYLTKQGYDPTKPLTWSDLPAQPFAQLKDPALAGGAYRLGAKLPADRTGRHVLFTIWQNTSTTDTYYSCSDVVFAKAKAAAGAGGGSTGAARKPAGKATPSSPAATSSPSSSPSPSRSETAASTPPPSRTAVPGTPAAATAHRSDSGPSLPLLAGGAAAVVLAAGAVVSLRRRRR

SEQ ID NO: 9707 - protein, 390 aa, Streptomyces avermitilis
LLRLDVDCSSGLQIPLLSQGSVAPDPSHGASRSPGPWLSRGGGGTSGRAARRTVSTTMRGLHHDARSPPRCAVSTTMRGLHHDARSPPRCAVSTTMRGLHHLRVIHHPHRGAGTVAFPSPGPCPVARLPPPVRRVRRRRHGPAAAAAPPRPLASPRGAVTRSSSTLLRRGTPMRTRPLLALAGVVVALSVSAMSPASAAGTVLTTGSAGGDAVATGDVLSASLATGTAATLYSSATGTSGVSCSASTFTAGVVDNPAASGTATESVTAHTFDGCTSNVIGVLGVSGVTVNNLPYTTTVGSDGTVTVTPASGSTIQTTVKLSTLLGTINCVYQAPSLSGTASNTDNSITFTNQQFTKTSGSSLCFSSGYFTAKYAPVKDTSVSGSPSVFVN

SEQ ID NO: 9708 - protein, 224 aa, Streptomyces avermitilis
MASSSDATASHGSTPQTPESGSAAEGSERRGRVRLRRAAVMAVPATAIAAGLVILTAQGALGVQFAISGMPFTVTATDLNGTGFEQFGNLDNMAEGSPNAGDTGGQVLVVTSAIKDATLTKLCQSVDLGGTNLRIEAGAGKDKVVASDLTTDSTELSGDAEFNKIEIGNDASTLDKAGVQGNKGVFSQQADTVHIANLRQTNYATTAGVFKLPGLHLSFSDKAC

SEQ ID NO: 9709 - protein, 139 aa, Streptomyces avermitilis
MASRPRSAFRRWRASRPFWGGLLLTLGGAEVLLTEKVSLKVVMHIGMQGLAGYLLPVVMMLCGLLILFNPAQRLFYSVIGILVTLGTWLTSNLGGFFIGLLLGATGSCLAFGWLPDQEPRRRLLRRHRTPSPTADSPAS

SEQ ID NO: 9710 - protein, 266 aa, Streptomyces avermitilis
MKRNGTLAREIVSSHSVFGAPCWVSLTTRDLEAAENFYKAVLGWRWRTGKLGDRFRFALSEGMPVAGIAAVASQWQMAAAWTPYFAVPSADEAVSRSQERGGTTAVGPIAFPPGRAALLADRDGAVFGIWEGQLVAGWDHWRRAAPAFVRLHTRDAFDAAIFYGEVLEWASARPGACQVQYDGKEVVLLSQGDVVARIHSGAVGAAPDPQLRPHWQVHFAVDDVEACVHAAQDHGGTVLRWEPGATEAVLSDPDGARFTVTARTKR

SEQ ID NO: 9711 - protein, 162 aa, Streptomyces avermitilis
MDRQHTPDPRPRLSDAHRRLSDPRPGLSAPLLCERPQRLSLPVELPAGLGYDAVGTSPEHGERIMECLPRVGCVFADDLRWWWIVPSGSHVGVTWPSCTTYAIGAYLADPSWTRASGRPRPGGPRLIHRPDGDSPYTPPIPLYFLICRLAGISPSWSLGAVS

SEQ ID NO: 9712 - protein, 236 aa, Streptomyces avermitilis
MLSSPVGGVRAALGHDSKRVGRWCATRDGTERCGTGTFRGATADERRTAMAPPSLPQPLRRPGRPAREEQPVPQAGIFGLPAIPASVAVARGHVRELLAAWNTDAETCDNAVLVASELVTNAIMHTASGRIVCRLRTDGARVRIEVEDEHRGQTLPAQCRPEPDDQGGRGLLLVGALSGDWGVKNSAYGPGHIVWAELSPDGGDPASTGLPATTNTTRPVPHLAEGPSSHGPTAHA

SEQ ID NO: 9713 - protein, 291 aa, Streptomyces avermitilis
VTAETDWGGAPTVLRMILGRQLEELRTRAGRTYEEAAAAIGVSHSTIRRMESAKVARLRLADVEKLLQIYGVTDQQEIDTFLKSVREANKRGWWHTYRDVLPDWFAAYLSLEQAALQIRAYEAQFVHGLLQTEEYARALLSAGNPHAPAEATERRVALRMRRQELLSRSAPPRLWVVMDETVLRWPVGGPTVMRAQIDHLIALNALPHVTLQIMPFRSGPHPAMRAGAFHVFRFRARELPDIVYLSGLVGAVYLDKSDDVVVYREALDRLGAQSAPARKTEALLGAIRKEL

SEQ ID NO: 9714 - protein, 83 aa, Streptomyces avermitilis
VHHHIRDGHIRNGMPARDLGARGWSKPWSDDAGGACLEAKKLADGRVALRQSTDPDSPALVLTPAEVAGFLAGVKKGEADFLL

SEQ ID NO: 9715 - protein, 276 aa, Streptomyces avermitilis
MGGAALPDNGWPADRIDTESAHSARIYDYIIGGKDYYPADKEAGDAMSREWPALPVHMRANRDWMNRAVAHLAKEAGIRQFLDIGTGIPTSPNLHEIAQSVAPESRVVYVDNDPIVLTLSQGLLASTPEGRTAYVEADMLDPASILDAPELRDTLDLTRPVALTVIAIVHFVLDEDDAVGIVRRLLEPLPSGSYLAMSIGTAEFAPQEVGRVAREYAARNMPMRLRTHAEAEEFFEGLELVEPGIVQVHKWHPDAATADGIRDEDIAMYGAVARKP

SEQ ID NO: 9716 - protein, 334 aa, Streptomyces avermitilis
MLPTPSEPGTGIVTSTAKSSRSRTRNPGAAAVALAATAALLAACAGCSSSSGEESDPLSGDKAGGDSVVVGSNNFAESILIADIYGEALKAKGIKVTYKPNIGSRETTYGLLKNGSLTVLPEYNGALLAYLDSKATPKTVATTTAAINAKLDSKLKLLDPAPAQDKDSVTVNAATAKKYHLTSESSIADLKDIAPDLAIGASPEFQTRQQGLVGLKSVYGLNFKSFKALDAGGSLTQAALKKNTVQAADLFTTDPTITKEKFVVLQDPKNLFGFENVQPLVYKSGLSQKGADTLNAVSAKLDTVALLKMDAEVQLQNKDPLDVAKAWLTSAGLD

SEQ ID NO: 9717 - protein, 918 aa, Streptomyces avermitilis
VGWPNRGSEEAVVSPELATRHSGVRGPPSSERSVAAPVDEYGLVNLRAPWSAHEGGSVSTNKVDAPTRPAPSPNPGGTGGFAARWPFRRKLNALVGVPLAVVAALLCYLITDQVDQARSAAAAAQLVRDSAQVADLVDRVENEHQQAVLLSVRYEAAAGADARPALTSYRRAQAAVDAQVDKVRGTFGDRLPDTEAQALKEINGLGSLRGTIEEGYLPADNIDPAYTNAAKGLLDGLGLDRNAALAATFTGNLLDSLLRADAAHSSFETSVFSATTGDSNALIEFTNAVGSYELYTYQADRFARFATERQADELSGIEHSTAQREIAEAYAELQIDPSGLQANTPSRIRAAFADALRDYPAYPKQAESRLKIAASLIGQIADRADDASSEAWWRAGLLLAAALLGFVLWLAFSVAVRRSVVRPVEALTDAAQEVFDITSRELARVADDDAEDLGPLRLREVPVPVRDEIGELAEAFNHVQSTAAALLERQVLSRRNVAEMFGNVGRRVSNLTTRQLALIDAVERGETDPALLDRLYRIDHIAVRLRRNADSLMLLAGIRETVLDSGPTALTNVVRAALGQIEGYQRVRLRAETEVMVEPDIIGDLTLMVAELLENAVAFSPVGSPVEVAVRGTGGDGALIEIADHGLGMSAERLDEENARLIRRERLDLVPTKVLGLFVVGSLARRWDVGVTLSRTPGGGVTAEAVIPSTLLLAMSPLNVPAAVATAPAAATVEPGPATPSSPATSSSSAAATLPRHGETESRPGALPRRVPRRETAPAEKAEETEDREEAEETASGTAPALQDRTERTLLPHDDTGAARPLRRRVRGATLRTTAAEAAQQAAHGPARPADAHEVRSALEEFEAAVERAHRDSGTGTPAPAPQPTPDQNYQNHQSDQSDQRHQNHQSHQNHLPEGAEQ

SEQ ID NO: 9718 - protein, 158 aa, Streptomyces avermitilis
VSTSTGDTPAGGTTPAELRAAAADFTWLLNRFATETAGVVDAIAVSSDGLLIAVSELREHADSERLAAIVSGITSLAAGASGNYGLGGLNKVIIDLEGGHVLVSAIGSGAVLGVVTDKEAKLGNIAYEMTLFANRAGAALSPQLVLELKNSVGVTSTG

SEQ ID NO: 9719 - protein, 146 aa, Streptomyces avermitilis
MADGRTPAGEDRFTAPGPDPVGPAPAVRPFLVTAGRVAGTRSGPPIPVETQVVATAEGLDQLDRLSFEQHDIVAACRQPQSIAELAARLRLHLNVVRVLAEDLRSEGRLSVYLPNPGITQDASVLRRVIDGLRAIPDSRGVLRDTD

SEQ ID NO: 9720 - protein, 191 aa, Streptomyces avermitilis
VTPTEQAAVRPPLPVKMVIAGGFGVGKTTAVGSISEIVPLTTEAAITEVAAGVDDLTHTPRKTTTTVAMDFGCITIDPTLKLYLFGTPGQDRFGFMWDDLVEGAVGGLVIVDTRRLDDCYAAVDYFEHKQIPFAVALNAFDGRIEHDLDEVRWALDVAERVPVVVFDARERGSVRDALLVVLELALARTGA

SEQ ID NO: 9721 - protein, 222 aa, Streptomyces avermitilis
VNVLHFINAFFSDSAHWHGYDGIPRRLLEHIQYSLMALGIAAAIGLPVGLLTGHTGRGGNALAFLATAARALPSFGLLVLMFVLLGLGLLPVMIPLVVLAVPPILVTTYEAMRSVDPSPVDAARGLGMHEAKILFQVEVPVALPLILSGLRSAAIQIVSTATIAAYVSLGGLGRYIVDGLYQRNYEKVVGGATLVAVMALVTLGLFWTVNRVAVSPGVRRSG

SEQ ID NO: 9722 - protein, 240 aa, Streptomyces avermitilis
MNGFFDIPSDLQHSYLGLIGLHLKEALLPVLAGLLIALPLGQLCVRFRWLYPPVLGVTTVVYAIPSLAFFVVLIDYTGQSEITVMIPLALYSLVLLVPAIVDGVRSVPQETLAAATAMGFGPVRRYVQVQLPIAVPAIIAGLRVATVSSISLVSVGTLIGNQGALGNLLADAMFYHRPALAVNSVVTTAVLAILMDAALVLVRVLLTPWMPRGTRSARRAPRDDSARPEPAALALKDAVR

SEQ ID NO: 9723 - protein, 375 aa, Streptomyces avermitilis
LIRIDSVTKRYPDGTVAVDRLSLEIPDRSITVLVGPSGCGKTTTLRMINRMVEPSEGTILLDGADITKQPVNTLRRSMGYVIQNAGLFQHRTIVDNIATVPRMLGWGKERARSRARELMERVGLDASLARRYPYQLSGGQQQRVGVARALASDPPVLLMDEPFSAVDPVVRKGLQEELLRIQDELGKTIVFVTHDIDEAIRLGTMVAVMRTGGHLAQFAPPAELLSAPADAFVEDFLGTDRGIRRLSFFPSAGLELLTTPVVAIDSTAEQIAARGTPDVPYLLVTDVDGKALGWSEPKDLTAGKVVPERLLPYGRPFESGKDSLRAALDCAVLSPTGWAVAVDGTGRVVGVVSQETIGEAIRGAHAERRKADLAG

SEQ ID NO: 9724 - protein, 658 aa, Streptomyces avermitilis
MFPPPRSTGRSFGRRLRIAAVRALVLALTAAATLLFVQPAPAQAAVTTRQITVPSAPMGWASWNSFAAKIDYSVIKKQVDAFVAAGLPAAGYTYINIDEGWWQGTRDSAGNITVDTAEWPGGMSAITAYIHSKGLKAGIYTDAGKDGCGYYYPTGRPAAPGSGSEGHYDQDMLQFSTWGFDFVKVDWCGGDAEGLDAATTYKSISDAVGRAAATTGRPLTLSICNWGYQNPWNWAAGQAPLWRTSTDIIYYGNQPSMTSLLSNFDQTLHPTAQHTGYYNDPDMLMVGMDGFTAAQNRTHMNLWAISGAPLLAGNDLTTMTSETAGILKNPEVIAVDQDSRGLQGVKVAEDTTGLQAYGKVLSGTGNRAVVLLNRTSAAHDITVRWSDLGLTNASATVRDLWARQNVGTSATGYTASVPAGGSVMLTVTGGTEAAGGAYAATSTGRYTGVTAASTGLNVVDVAYTNNTSSARTATLQVNGQTATTVSFPPTGASAGTVSVEVSLSKGSANTLALSGGPATEGITVRPLPGTNGALVTGKQSGRCADIYNNTITNGTQAELWDCNGGPNQSWTYTSRKELVLYGNKCLDAYNLGTTNGTKVVIWDCNGQANQKWNINSDGTITNVNAGLCLDAYNAATANGTSLVLWSCGTGDNQKWTVT

SEQ ID NO: 9725 - protein, 341 aa, Streptomyces avermitilis
MNASLRPHAPRSSAPPARGAALAAGAVAVCLLAAGCSASDGSDAGTEAAGRAGTARIKVALVTHGERGDAFWDLVRKGAQTAAAKDGIELTYVSDATGAGQAELLRDAVRDRVDGIAVTLAKPEAMKGAVADAMAAGIPMVGLNSGIDDWRSYGLLEYFGQDESLTGRALGDKLDALHAQHALCVIHEQGNVALEARCAGVKKTFGGRTEMLYVDGADPKAVTASVTARLRQDPSIDEVVTNGAEIGLEAVKSVKSAGSKARIATFDLSKNVVKAVQRGDVQFAVDQQPYLQGYLAVDSLWLYRSNGNLSGGGEAPVLTGPAFVTKENVAEVAKYAADGTR

SEQ ID NO: 9726 - protein, 829 aa, Streptomyces avermitilis
MSRRTGARRRLGSIRLSLILLALLPSVTLAAMWGVTTKQMFSEGLELRTQTELSMSTGAMGTDATLALQRERSLSAAWLASPGGSRAALDEQRRRTDAAVTRLVGRSDEIEMAPARVGERMYPVMAAAKSLEYYRGQVDDPTDITAKQALDQYTSIIDNQVHAFQELSQVDDGDLTSQAGPLVALEHAAEIVSQEDAQLTLAWPSGKLDEKSWVRFAQLVDARRWLVQDQLVPSLRGSAKTQTDRILQSPQWQTLEDVEDQVIAARTANGSVARTIELPDARKRWSAALDQVSAQYANLIQQQTSALLDRSSDKARGLLIKAASLSAGGLAALLLCVVLSWRITRSLSRRLRGLRMATLSLAEERLPDVVARLDRGEKVDVDSATPPLDYGRDELGQVAQAFNTAQRTAVHTAVELADTRRGFQKVILGIARQSQNLVNLQLSKLDELERRHQDPHILEGLYELDSTASQLRRYEENLVIISGEQPRRSWTEPVALIDILRSAVGEVAEYQRVEVHTDEEVFLTPPAVADVIHLLAELIDNATAYSPAPSPVGVRAAMVAKGLAVEVEDRGLGMSEEDYAALNAQLAVVPQFDVVALADDLRLGMFVIARLATRHGIAVTLRSSPYGGTTAIVLIPHAIVVREASGSPSTKSTDTEPAGSADARTVEPAAAAKGTAGTPDPARQPHERTREARPAARARTAEVPANGAESDTEGVRRTAGRTPRPEPGGVRREGLAPLPRRVPQTSLAAELKEEAAPGREDDDPCEDFTAERAAASLAGFQRGTLQARDTTAEGAYDHREEAAAEDPDARVPAPGASSPTLSTPPADRS

SEQ ID NO: 9727 - protein, 143 aa, Streptomyces avermitilis
MTRPTPATHSQLDQLLTGLVDRVAEVDHAVVLSEDGLVVSKSTGFLRDDAERLAATASGLMSLSKGVSMDFRRGPVRQALIEMGKGYLILTAAGPGAHLVVLTRQGADVGVVAYQMNMLVKKIGEHLSAPPRGGAGTAADSGE

SEQ ID NO: 9728 - protein, 118 aa, Streptomyces avermitilis
VTDGDAAGRLVRPFTLTGGRTRPSRADFTLITSVTAVERPPAGSFRPQPEHTRILRLCAEPVVVAELAAGLDLPASVVVILLCDLLEAGRITAHPPRLLSRTTDLDLLQKVRDGLGRL

SEQ ID NO: 9729 - protein, 194 aa, Streptomyces avermitilis
LAGSDPAAPAAPAAAAPDTVKILIAGGFGVGKTTMVGSVSEIAPLRTEEPLTAAGLDVDDLDGIAEKDATTVALDFGRITIGSELVLYLFGTPGQQRFWFMWNDLAIGALGAVVLIDVRRPESSFAAVDFFERRGIPFVIGVNGFHGLHPYTPEEIREALALPERAQVLLCDARERESCRDVLIALIDQLIAAR

SEQ ID NO: 9730 - protein, 245 aa, Streptomyces avermitilis
VRRVEHVMGFPVSLRIDDEGDFDAAADAVFAWLREADARFSPFKADSEVSRLDRGELREDALSADLLEVLDLCEHYRAATGGAFDVRLPGRGLDPCAVVKGWSVQRAAELLSAAGARRFCLNAGGDVAAAGGPWRVGVRHPEHADKLCTVLELTDGAVATSARYERGDHIRDGRTGRPATGLLSLTVVAPTLTEADSVATAAFAMGTEGVEWAAGLDGCEVFAVDAERRVLRTAGLPVAGARAAA

SEQ ID NO: 9731 - protein, 139 aa, Streptomyces avermitilis
VKRALPVLVLSVAGLIPLWRYEPSTDTTSTTQTAPPAASPSASSSPGSSPGSSAQVVAGSTVKTEKGPVQVEVTFEGDTISAVRMLRQPNHPQTTAAVPKLVAETLKAQSADIDTVSGATVTSDGYKESLQAALDAKGA

SEQ ID NO: 9732 - protein, 472 aa, Streptomyces avermitilis
LKVRRQENDSSRQRSSVSQDPIKELPSVTTVQSPPAPPTAIRPRVVARAGLYAVLAANAAVVAFLFAQAGFASNALIVLGRLAGLYGALLMAFQLLLVARLPWLDRRIGMDRLTSWHRWTGFGILWTLLAHAVFITFGYAQSSSMDPVNQLVDLAETVEGVLRAVVALTIIVVVGAVSGRYARRRLAYETWHFIHLYTYVAVVLAFTHQVAAGTTFTSSSAATAYWYAVWGVALGSVLVGRLVLPLWRNWRHQLRVTAVVPESDNVVSIHISGRDLDRMPARAGQFFLWRFLTRDRWWQANPFSLSAAPDGTRLRLTAKTAGDGTAALRHVKVGTRVFAEGPYGAFTAMHRTRPESLLVAGGVGVTPIRALLEDLEGHAVVIYRVAEDRDAVLYDELRELAHAKGAELHLVTGPAAPDRLAPSELARLVPDIAERDVFLCGPPGMTTTLLRTLRELGVPKQQIHHERFSLAG

SEQ ID NO: 9733 - protein, 262 aa, Streptomyces avermitilis
VARSGALGHVKHYEQVEKVRLLVVDDDPPIADLVATVARYEGWDAVTAYSGEEALRLAAEFPPDIVVLDLMLPDIDGFGVLDRLRRSGTMVPVVFLTARDTVADRVAGLTRGGDDYLVKPFAVEELMARLRTVLRRSAGPGFQRSVLRVADLTMDEDTRQVRRGDRLLTLTPTEYEVLRYLMRKSPAVLTKAQILDHVWEYGFGGRSNVVELVVSRLRRKLDEADAADAGDVAAEDSAADAGREPLIHTVRGFGYVIRPAAR

SEQ ID NO: 9734 - protein, 478 aa, Streptomyces avermitilis
VTGRLRRTYRRLRLGTRLALGLGVLSLVVFAVVGTALTTYMRDYLEAQLGDQMKLVQVLQSKDAQVHGVVQRQPYYGWYTAVYDVSGDSAVLRRPADVPADTRALTALAETMAHSDTDLRRTVRIDGKGTYRLQACEVEPGVVLVSAAPMADVQATVRQLITVQVVAFVLALLALVVFGRAMLRRGLKPLSDMAHTAHGIASHNLTGSAARLPLRDDGRSGGPEVEELRTAFNTMLEHIDGSLAVRAEAEQRLRRFVADASHELRTPLMSVRGYADLFQYAAANAPGERDRHLARLRAEAARMGLLLDDLLLLARLDAAEVETPLRMEDADLVELVRQAADAFRAGHPDRPLTVTTGPDAVPLRLDPLRIRQVLDNLLTNAAVHTPAGTEVSVEVSVSSGTAWVGVADSGPGVPAADRERVFDRFYRVDKARSRDRGGSGLGLAVARSLVRAHGGTVALTGEPGATVFTLGIPLGRRD

SEQ ID NO: 9735 - protein, 647 aa, Streptomyces avermitilis
VCASTRSPCTPGRLRRACASLTPIREGTRSRRCSRSVARGSDVEALRLEWAAGAPRLRATEAMARQGLVTTVSSRAGTAVVVGWAGSVRDRVAGAHGLLDDFGRPGAAPRLPAGDYAAVLVCRDRVLLMRDEQARIPLFFRESGGQVSAVSTSARRLGDFEELERRYFCRYLTGNMAQPHSELTPFAGVHRVLGGEVVELSITGRMRGRALGRVGHADHPWDSTADGLRLSGAAKELRLALEHAVGRRMGTMTACHVSGGTDSTSVALLAARPTAAGQDSPRDLVLLAGRFGTGELAGEQPYLDEAMKEIHRHAPGARPVMVDVGDVADFDDFQDHAGDADEPHAHAFRAPFWSRLHAAAAELGCDILLTGCGADAMVDANPFHLHRLARTGQLRQLTKQARAWAAGSERGVRDVVCDYVMRPALPLTAERITALVRRGTVLGGLGSFTRPRWLRPGFARAHGYREAGIAESRFVFGRRPEQSLFEAANYLAAPDPLSWRRARQDGFFLSHPFLDHEVIATMRSLPPEATFRPGRPKAVLREAMADLLPSRIRGRAVKVPFDELYARGLRRHGDELIDLCRSARHPLVAEMFDVETLCRAVREAQLGVGDAYSWDRMNSSLALVVWLERLDRRGCAGGAGMPVIAGS

SEQ ID NO: 9736 - protein, 208 aa, Streptomyces avermitilis
VAEETDALAAMTRILSPHCRVTRMSGGALIADWRRRTRFLGMTATDMRKFADGSSEERAELVTGLIRAGCATARRKGHSDVEVGLWLRGVHLLIRTLGFGRVLRLLSLAAPVYARADPPSAEDVERLKRAVRSHSRSSWFVNDDCKTEAVTAFVLLRRCGLKAVLHVGVREHPFALHAWTSSAGLCIPDADPRGHAFAPVLSISCAGQ

SEQ ID NO: 9737 - protein, 1211 aa, Streptomyces avermitilis
VSADAVHAVRAPVPVVAECVLGGAVLAVVCVRLLLTSLWPVALTVDIDGIEWHGPLRRLRWSWPELDWLCVVPAVDRRILRTGHRFPEQLLLRTTPPATAPATAPTTPPTPSPLTAPATAPGPRRRITGPAGLLLRTVELTPRWDAGWRCVSVDLRPLAVEPRELDLALDTHAGPRWRRTGLPPATTSAVATGSEYRIPGRLRSPLTRRAAGYGGRLSVAVWLACCYGYLRFAATRPGPGLHWAYLGAGLAAPAVVLPALLALDHLLARRCALHLDAGGLRLHAGGTDRALPWSAVESLEIGSAPEGARGRQHRWALLARPLVPEPGAAPPRDCFRAAPDGTLRIVPVLAGVPGEALGLAVHPGQLAHALHTFGVRVAGPARDGDGAQRWSAPALDAAVPPADPPSAPPSGTRSAAPGELRVLRVSPTGDSGHRTIAAALRAHTGPGPLRVMVEPGRYPEPLSLKGEVELCAARGPGTVVVEPAVAGANVLDVTGSAVVTGLAVVGRGTATVAVFGRLLLRDCRLEGRDGAAALTASAGSEITVMGGELAVGKATLQGARAVLRGTRFQAAGEDALVVSQGAHAEVTDCVFADGRGSAVHVSGAGTRARLRTCEFSGFGGHGVLVEQQAEAEVRDCLLRDLSGTALGFRDQGHGTVVGTRVRGADAGAVVSGGADPTLRDCSFHGCRAVGVRVTEEAVCGIEDCSFEHLSNAALSVDQKARLRVNGCRIVDARHGVVVEKGHASLERVEARALTGSVVRLCQDGTFEAAELRADDCKYGLHASGSGSSGELTGAELCGMRDCALVLTGSARVVARNLRISEPVSDGLFARDTSYLTVRQCTVERAARYGAHILDSAVLVADQLTVTDSGAHGILAENSSQFDIRDSSCTGSDGDGLRTRSDVSGRITDSRITGSRGEAVAGDGSVRLDAVTTRDAPPPAGQPAAGLGPQAELDALIGLTEAKRQVRTQVDLLRLARLRRDAGLSEPPGGRHLVFSGPPGTGKTTVARLYGRILAELGVLSDGRLVEVHRSDLVGQYLGSTALKTRAVFDSARGGVLFIDEAYSLARRFGVNHDLGQEAIDELTKLMEDHREDVVVIAAGYPVEMEGFLEANPGLASRFSRIVTFSPYSPGELVRIVRHLADRHGFELDPDVEPRLLARFRGRASTGSPSNGRDARTLFETMIEHMAGRLSDIDRPTHQELLTLRPDDIPEP

SEQ ID NO: 9738 - protein, 94 aa, Streptomyces avermitilis
VIDRAVRAAREGGPIGEHLEALGLLPGRTADEADEGAPRGTTLPPRVTDGAPHALLGQHVCPRGVCTRREQRAVGEERPVCEIFDLALRFDPER

SEQ ID NO: 9739 - protein, 309 aa, Streptomyces avermitilis
MLSGFVTDVGRKLAERWAATLVLPGLLFTTVAAVALTLRQSAWSDVDLLRLRVTALTGAGSGAGPGAGSGSTRTAVLLLGVLAASFAAALVADALGGPYEQALLGSWPRLLSRPAAALTGRRRRIWQERDDACRRAVAQDTEGAAERAARLGALEVLRNQVALTRPECPTWIGDRLRAPAVRIRLEYRLELSDAWPRLWLVLPDSTRQPLAEARQRLDEAMRLGGWAVLYLLLGAVWWPSAVAGAGAALVAWRRGRDRAEEYAELVESAVDVHLQELFERFDEEARPVRASLGPAVTERFRKGAGPRRP

SEQ ID NO: 9740 - protein, 1256 aa, Streptomyces avermitilis
VHEMTEPQQLPGEDRPAERERLLRAVRGRLDALGGPTGNGHLHTAEARQETDRLLRHLVAPHPATGGGHALDAEVAYVLGVMYLFVADDRPDAPTAAQDGQCALLLLAPFYCHLPDQPDVLPPPLRAGLDQLLGAEGRRPDAPEEIVQEHAASLANLAMLLLELGITLAYPEAIRVAADLAREALPHLSPDGHDRALAGCNLGYALLLSGPTPVSSPGQADPEQLAEAVSVLRTAFAATPREHPNHARCANGLGLALLASAGQAEDRTQLAEAAAMLRIATQTATEVDQNLPQMYSDLGYTLTLCARTAGEGEEPGPEVREEAVDALRRAVDLTTPAEDGEMLRTRLDRLADAVVIGSPSDDRPRAAAQAEQAVDTLRRLLDLTPEGHPERGDVLLRLAGNRLVAQHPQETIDLLVQGESAYATDPRREQIARALLVEAAMLKGELDSRADLTPEQQADWQAIDDVMLPLLSGDTTGHPMRSVMNLIGLGGEGGGSRSQELMDFGSMVLGYPDRVGLNEIFAKAMELQARRIARLPEEERAGAVAAFLAGDDDEGAPGPPGGRVEESEEPPDTSSLDELLEIHERLLPRLPPDSREHRLLHGGRNMLRLVQIMYESMYAPGDTRTRLQLMRRALPLMRELFEELPAQLEELGIKPELFGAHTALAFAYESPFEQLEAVEEGVRAARRRLTELAPDTPEYAETRTTLALSLFVRHALWSEEADYEEAVGIARELTSAPAPGWRTAMLLTQWTSAAQSRIQRTGLLGQAPPGVGQSPSLITRLASDGAATALDDRDPVEALETLEDGRAHLLSGALNARRELEVLHGADAKLHGRLRAALERIRALRTAREPGRWPTPDEEDELRSASDDAAWLVAELQQHPGFQRFLTPLPLGLDDLLPAAAEGPVVSVNINPRRCDALALCPDGLRAVPLPRLYASDLVAQAESFRVAVEALTAGPRDPLFEDAREIFTGTLAWLWDVLAEPVLDALGFTGPPESGAPWPRLWWSPSGVLNSFPLHAAGRHGSGEAADAAVLDRVASSYTPTLRALLFSRARRRAAPGRRRTLAVAMPQTAGQAPLARTVTEATEAVAAGGGVPLIGPAATRDSVRAAMVDAAVVHFACHADSDPEDLSAGRLLLADGDLLIRDIAELHLETAELAYLSACGTARGGATAALADEVIHLGSAFQLAGYAQSVATLWEVGDSFAARAAAEFHRTLAPSLPGPGPLPAALALHHTVRSLRQDDRERPWTWSALVHAGA

SEQ ID NO: 9741 - protein, 279 aa, Streptomyces avermitilis
VCEATHPRTPRYCPDMDAVRAVLIDIDGVLTVSWKPLPGAIEALHRIRDASLGVVLLTNTTSRTRASIAATLGASGFPVSAEDILTAPTATAAHLTDHCPGARCSLLNSGDIREDLVGVTLLDDTDTVPDVVIVGGAGPEFDYAALNRVFGHLQRGARLVAMHRNLYWRTDRGLDLDSGAFLLGLEHAAGTRAEITGKPAPAFFEAALTRLGAGPGQAVMVGDDIESDVLAAQRTGITGVLVKTGKYLPETHHAASARPDHVLDSVADLPALLDSVVRR

SEQ ID NO: 9742 - protein, 135 aa, Streptomyces avermitilis
VSYDIEKPDEAWRAELTPAEYAVLRKAGTEPAFTGEYTDTRTKGVYSCRACGAELFTSNEKFESHCGWPSFYDPKNTDAVELIDDRSHGMVRTEVRCARCGSHLGHVFEGEGYATPTDQRYCINSISLRLAPDEG

SEQ ID NO: 9743 - protein, 464 aa, Streptomyces avermitilis
MAPGLPTAMDRPHFIGIGGAGMSGIAKILAQRGAKVAGSDAKESETAEALRALGATVHIGHAAEHLADDATCVVVSSAIRADNPELARAAELGIPVVHRSDALARLMDGLRPIAVAGTHGKTTTTSMLAVSLSTLGLAPSYAIGGDLDAPGSNALHGEGDIFVAEADESDRSFHKYAPDVAIVLNVELDHHANYASMDEIYASFETFVDRITEGGTLVIAADHEGARELTRRVTASGVRVVTYGESADADVCVLSVTAQGLKSEVEVLLDGTELTFTVSVPGRHYAHNAVAALAAGVALGIPAADLASALAAYTGVKRRLQLKGEEAGVQVIDSYAHHPTEMTADLEAMRAAAGDARILVVFQPHLFSRTQELGKEMGQALALADASVVLDIYPAREDPIPGITSELIIEAARAAGADVTPVHDKAEVPSVIAGMARPGDLVLTMGAGDVTELGPRILDRLSKQ

SEQ ID NO: 9744 - protein, 157 aa, Streptomyces avermitilis
VFTSVLMIEKALTSADVEFVTTLHGDEAVSFHVLLQPRGDQADRLLRAIDDVALGELDEAAHERETPEGKDAAALGGQALEVSLAALHASGSEAVGRLIEDHPLDALKALVDEVDADEVIVLTDPHYVEEFFHRDWASRARHKVGVPVLKLFSHSKA

SEQ ID NO: 9745 - protein, 378 aa, Streptomyces avermitilis
MTCSVARQLEWGTVSSSTAASGIDPIAEAAPLSLCARAPHVPADRLVAEMVPPPRFDSVRFATYIPDPNQPSQTEAVRVLEDFATGLGGAHASGSGRRRLFGFGKAPKTPAGPRGVYLDGGYGVGKTHLLASLWHATPAEPELKAFGTFVELTNLVGALGFQKTVQTLSGHRLLCIDEFELDDPGDTVLVSTLLGKLVDAGVALAATSNTLPGKLGEGRFAAADFLREIQGLSAHFRPLRIDGEDYRHRGLPAAPAPYSDEQVTKAAYATPGASLDDFPHLLEHLARVHPSRYGALTDGLGAVCLTDVQPVPDQSTALRLVVLADRLYDREVPVLASGLPFDQLFSEEMLNGGYRKKYFRAISRLTALARDAKGLVAA

SEQ ID NO: 9746 - protein, 272 aa, Streptomyces avermitilis
MRRLFPVTEETAAQASGGAPGADAADREWGLDELAAAYAYPRAGAAGGPGGRTPWLRANMVTTLDGAAQHEGRSQPISSAADMRIFGTLRGLADVVVVGAETVRQEGYRPARARAEFAELRAAAGQGPAPAIAVVTASLDLDFSLPLFTSALVPTLVLTGAAAPPDRVAAAEKAGARVVVAGDGRGVDPARAVRALGDLGMTRLLTEGGPRLLGQLVAAGVLDEMCLALSPMLVAGDAQRIASGPSVAVPARFELVSLLEDAGFLFGRYRRR

SEQ ID NO: 9747 - protein, 130 aa, Streptomyces avermitilis
MVRGTTVRFVLTILSTALLALQLFAPTASFAATHSDTHASAPTASGGFVAKRADEVASCGESEHPAGPTGPLRTRDRHGAAATSASAPPVLVFMGYGSPATHPTEAGAESHRTSRSSTAHSPAALQVFRC

SEQ ID NO: 9748 - protein, 193 aa, Streptomyces avermitilis
MQPLIDHARAHGQRPEEFAQLAEGQSPQALFITCSDSRVVPALITGARPGELFELRTAGNIVPPYAASQHPTSEAATIEYAVEVLKVTDVVVCGHSHCGAVGALVRGDDLTAVPAVRDWLAHAAPRPAGAVEDPAVTEAVQSHVLTQLLRLRSYPCVSAKLTSGQLRLHAWFYEVHTGSVLAHRPQTDTFTAL

SEQ ID NO: 9749 - protein, 318 aa, Streptomyces avermitilis
MLQELLVAAVAAGSAGLIYVTAAARVVKQYERGVVFRLGRLAGDVRPPGFTLVVPGVDRLRKVNMQIVTLPIPAQEGITRDNVTVRVDAVVYFKVVDAANAIIQVEDYRFAVSQMAQTSLRSIIGKSDLDDLLSNREKLNQGLELMIDSPAIGWGVQIDRVEIKDVSLPETMKRSMARQAEADRERRARIINADAELQASKKLAEAAGVMSEQPAALQLRLLQTVVAVAAEKNSTLVLPFPVELLRFLERAQAQQPPTPAESGADGATGTPAGTGHGTPAYTGPGSATATGADGATGIESGPRTDTGTVPRTDTGTGT

SEQ ID NO: 9750 - protein, 460 aa, Streptomyces avermitilis
MPENGRPASRRQVLARSGALGVSIAFAGNLSELFAGTAAAQDLGHRGYGPLVPDPNGLLDLPKGFRYRVLSREGDPLRSGEGPVPSNHDGMSAFAGRHGRVHLVRNHENRVTAKFPVPTVEGLTYDPTGKGGCTALTLDGQGQVLSERVAIAGTAVNCAGGPTPWGTWLTCEETEDRAGTNGYTKDHGFIFEVDPANPHRTGAVPLTAMGRFQHEAIAVDPRHGIVYETEDAFLKPFGLFYRFLPHRPEGGVGSLRAGGRLQAMRVPGVPDLSSVQETGAAFDGVEWVDVPDPLAAQTPVRLQDFGPKGITHAQKLEGCYWGGSCVYFVSSFARGADGSAADHYGQIWRYDPSARRLTLVIVFGPDTDVQLPGESPDNICLAPGGGLMVCEDGNGAQHVFGVTRRGEVYALARGAQNIGTPEAPEWGEFAGVTFSPDGRTMYVNCYTPGTTFAVTGPWRR

SEQ ID NO: 9751 - protein, 289 aa, Streptomyces avermitilis
VIILVRRVAVAGALGALGAALAACGTPGASGTPHAAARPAHSAPTTAASSKPPTLTPGPSGLTPVFKNGPRTQGKTVALTFDADMTADQGARAAAGEHFDNPQLIGALRELKVPATVFMTGRWADEYPQEARAIGRDPLFEVANHSYSHYAFTSDCYGLPTVSEDRMRSDVERAFAAFEKAGVPHVMPYFRFPGGCYDQRALRTLIPVGVTAVQWDVVSGDAFATDADAVAQQVLEGVRPGSVVVMHCTRSAAPTTERAVRTIVPELRKKGFRFVKVSELIQAASGGRR

SEQ ID NO: 9752 - protein, 59 aa, Streptomyces avermitilis
MSGDYCGTETAGPAPKAGGPPFAACVLCQEPTEYPESYKGITLCPVCAWQEAQRGACSG

SEQ ID NO: 9753 - protein, 257 aa, Streptomyces avermitilis
VTSDPTPATPATPATPAAPAVDGSAPQDSPFRSERTSRDEARQFVLPLVVRIEKSAPPARTDALETAARAVLVILSDERSLGDGEWAQAMTDWQDARIRKVVRRARGAEWRRAEALPGITVTGKSAEVRVFPPVPLDGWPKDLARLQVSGTDLEDFEPPLEADPSAPVLRLSPDLDMSAGKAMAQAGHGAQLAWWELSDEDRAAWRDAGFPLAVRTADPSHWRELTASGLPLVRDAGFTEIAPGSCTVVADHPALRG

SEQ ID NO: 9754 - protein, 262 aa, Streptomyces avermitilis
LRRINGTALVIAALFATVGALAYPVWSYADRSGTGQANLAAGTVSTRWGPLTASDRDLIVRVRLAGLWELPAGQQALERPVSKAFKETADHLIVGHTDLDKRVRIVAAQLGVELPNQPNPQQQGWLQELSAASGKEYEYKFANLLRSAHGKIFPAIGAVRNSTRNTLVRQLASDTNQTVLDHITMLEKTGSVDFDAIANDTAAAATASPTGPPAPVPGSTAASAPPAEATGDVQVSSSPSPGEPGTVNTGRPDPEDSDNVLQ

SEQ ID NO: 9755 - protein, 487 aa, Streptomyces avermitilis
VVEEGTMERLRTLGTLGTGIGWRPEIADAVERMPGIDWVEAVAENVCPGHLPESLLRLRARGVTVVPHGVSLGLGGADRPDEGRLAALAERAEALGSPLVTEHIAFVRAGGALTASPLLEAGHLLPVPRTRDALDVLCENVRIAQAALPVPLAVENIAALISWPGEEMTEGQFLYDLVERTGVRLLIDVANLHTNHVNRGEDPAKALDELPVEAIAYVHVAGGFERDGVWHDSHAHPVPQPVLDILADLASRTTPPGVLLERDENFPEPGELERELGAIRKTLEKAGTRAGASAGAAGAATRTAAELTVAESTAVGAIAGPRRGGADAQAAPRAAGTEALSAASTSTPADPARQRLALAQAALLSALVAGTPVPEGFDRVRLGVQARALAAKRADVVAKVAPELPEILAEEYRPAFLTYAPGHPMTGGYRRDALDFAEHLLLAGRPEDAEARRRLRDWWLERSGPTPPSRHPAARLARATRRVLLRR

SEQ ID NO: 9756 - protein, 255 aa, Streptomyces avermitilis
MRSINHTGLFSGTGLIIAGLTATLVALIFPIWSYADRSGTGLDTLSAQTVSTKFGPLSALDREFVTKVRLAGLWELPAGQQAQDKGTTQAVHTAGEHLVEGHTFLDARVRNVAARLGLELPNQPNPQQRQWLATLNSAQGETYDRDFANILRQAHGKVFSVVAQVRAGTRNSLVRDLADDANTTVLDHIKVLEATGLVDFDALARDAATSGPPPLTSSPAPPGPKASPNSPIPVTPSPTYTLPPAASSPRPSEKN

SEQ ID NO: 9757 - protein, 255 aa, Streptomyces avermitilis
MFWVLLLLLAWVAAGTSCTRLCLAAVRAAAVDANAARGHALTLYEAAFLAGGPKRVADLTLVAMARQRRLLLAHTGWATVVDPNGRDEMERSVLGAIGPEGQSRIAPVRRTTAAADPVRSLADRLVTAGLAVPDGARTTVAGAVRQVQAASAAVAALGAVAVLMPAEAAEEQIPVVVWFALPLLLTLSCLAIARVEVHPYTRWASPAGQRLLGALPRHADEAGDDRTYLTSVAVRGIRAIGEPELRAAFTHRERG

SEQ ID NO: 9758 - protein, 243 aa, Streptomyces avermitilis
MSDDAPTTESGRIPNKGKLAKDLNEVIRYTLWSVFKLKDVLPEDRAGYADEVQELFDQLAAKDVTIRGTYDVSGLRADADLMIWWHAETSDELQEAYNLFRRTKLGRALEPVWSNMALHRPAEFNRSHIPAFLADETPRNYVSVYPFVRSYDWYLLPDEDRRRMLADHGKMARGYPDVRANTVASFSLGDYEWMLAFEADELYRIVDLMRHLRASEARMHVREEVPFYTGRRKSVAELVAGLA

SEQ ID NO: 9759 - protein, 216 aa, Streptomyces avermitilis
VLHADSVVVALPAAAAAELLRAEAPAAAAELAGVEYASMALVTLAYRRSGTSLPEGSGFLVPPVDGRTIKASTFASQKWGWIADEDPDLLVLRTSVGRYGETEILGRDDAGLVDVSRHDLREATGLAATPVASRVTRWTDGLPQYPVGHHARVARIRDHVAKLPGLAVCGAAYDGVGIPACIAGAYAAVEQLGGDRAGLDELSAHPVQSLHGGAGE

SEQ ID NO: 9760 - protein, 474 aa, Streptomyces avermitilis
MSTTQTRTGMGQVVVIGGGIAGLAAAHRLLDRGARVTVLEASDRLGGKLLPGEIEGVRVDLGAESMLARRPEAVGLAREVGLADRLRPPATASASIWTRGALRPMPKGHVMGVPGTASALAGVLSDEGLRRIERDADLPRTEVGDDVAVGEYVAARLGREVVDRLVEPLLGGVYAGDAYRLSMRSAVPQLFTAIHAHASLTEVVRELQEKAAAAQQTGPVFMGIEGGVGQLPLAVAESVRARGGEIVTGAPGDRAAQSRGRAGRVGGWSPAVVCCTPTPWSSPCPPRPPPSCCAPRHPPPRPSWPASSTRPWRWSPSPTAAVGPASPKAAASSCLPSTGAPSRHRRSPPRSGAGSRTRTPTCWCCARRSGGTARRRSSAGTTPASWTSRATTCARRPAWPPRRSPAASPAGPTACRSTPSATTRAWPASATTSPSCPASPSAARRTTASASRPASPARTPPWSSWAATARGWTS

SEQ ID NO: 9761 - protein, 324 aa, Streptomyces avermitilis
MQTARTVRPVRVLAALLLTSALALAGCSAADDGGGSSSDAKAAAPGAQKGAADSGSASGAKASGAPKLTASAIIRTASLTVQVKDVPKALDDARTTVETAGGFIGNESTSRDARGHERTRVVLRVPSEKYDQVLGDLEGTGKLIDRSRKAEDVTDQVVDVESRIKSQRASVARVRELMDKATKLSDVVSLEGELSSREADLEALLAQQASLKDRTSLATITLSLSETPVKKAAAKDEDPGFLDALAGGWHVFVTLLRWIALAFGAVLPFAAVAALVVFVWVRLVRPRLPRRPAPATTAAPGAVPGFPAPSPAPAQRPAEGREEH

SEQ ID NO: 9762 - protein, 466 aa, Streptomyces avermitilis
MSMSRTSRTKERLVVIGGDAAGMSAASQARRLKGPAELEIVAFERGHFTSYSACGIPYWVGGDVAERDQLIARTPEEHRARGIGLRIRTEVTEIDAEGARVRSRDLASGAESWTSYDKLVIATGARPVRPELPGVDAPGVHGVQTLDDGQALLDTLAATRGRRAVVVGAGYIGVEMAEALINRGYEVTVVNRSKEPMATLDPDMGRLVHKAMEGLGITMVNDAEVTGLPTGDDGRVRAVATEDAEYPADVVVLGIGVRPETTLAQAAGLPLGEHHGLLTDLAMRVRGHENIWAGGDCVEVLDLVSGSERHIPLGTHANKHGQVIGANVGGGYATFPGVVGTAVSKVCDLEIARTGLREKDARRAGLQFEAVTVESTSRAGYYPGADPMTVKMLAERRTGRLLGVQIVGGEGAGKRVDIAAVALTAGMTVEQMTALDLGYAPPFSPVWDPILVAARKAVAAVRANGV

SEQ ID NO: 9763 - protein, 137 aa, Streptomyces avermitilis
VNATGRSYVCLLNRPRCRQLREEQAMNERVTPPIHALPDGEAEVALVLHLPWEDVALLGQEAGRLAAKMQRPVTIDEAVSHRLRSNRPASHAKPAGAQPPAVPSTASVSALSPRPPAEQARQAIERINGTAGQHESA

SEQ ID NO: 9764 - protein, 272 aa, Streptomyces avermitilis
VVIPVHDVNPVQRTPYVTYALIAINFAVFLFTPGIAGSVTGDSGVSQLCHLQAFLERYAAVPQELIHHQMPRLVPTGEVGIGPQGPGCVAAPPDYDKSPPLSVLTAMFLHGSWLHLLGNMLFLLIFGNNIEDRMGHVRFTLFYVACGYVAGYGFALLNDDSGDPLIGASGAIAGVLGAYLVLYPKARVWVLVPFLVFLPLRLPAWIVLGFWFALQAVYSSGGAVSTAGTVAYAAHVVGFLAGMLLAWPLRPGTPPPPAPRSLLWGRQARHTW

SEQ ID NO: 9765 - protein, 355 aa, Streptomyces avermitilis
VSANDRPATGQPTATYESAFLKACRREPVPHTPVWFMRQAGRSLPEYLKVREGIPMLESCMRPELVAEITLQPVRRHNVDAAIYFSDIVVPLKAIGIDLDIKPGVGPVVEKPIRTRADLAQLRDLTPEDVSYVTEAIKLLTAELGETPLIGFAGAPFTLASYLVEGGPSKNHEHTKALMYGDPQLWADLLDRLAEITSAFLKVQIEAGASAVQLFDSWVGALAPADYRRSVMPASTKVFQAVESYGVPRIHFGVGTGELLGLMGEAGADVVGVDWRVPLDEAARRVGTGKALQGNLDPAVLFSTTEAVETKTREVLDAAAGLEGHVFNLGHGVPPTTDPDALTRLVEYVHTQTAR

SEQ ID NO: 9766 - protein, 223 aa, Streptomyces avermitilis
MAAAQGRLSDGAGGMDDAKEGDRDGTETAPLPFRASVEALRAARLRPEIEIDPTRPPQRLAPYAYALEAAVVEDDEDLADGRLVLLHDPAGHDAWQGTFRLVTLVRAELEPEMVADPLLPEVCWSWLTGALEARGLSYGEPSGTVTRASSHYFGGLGERPAASQIEIRASWTPREGLGGVPDTAAHLASWCDLLCQIAGLPPTGPGADASVVTLPQRRGPQSR

SEQ ID NO: 9767 - protein, 220 aa, Streptomyces avermitilis
VSVLLEQPASLVAYRPNKPTAMVVVADPRVRSTVTRHLWALGVRDVIEASSVAEARPRIGNPRDICVADVHLPDGSGLTLLSETRAAGWPNGLALSAADDIGAVRNALAGGVKGYVVTGTRTNLGLPTRPGAAPIGSAAARMHRRPPGAPSHPGGYRELSGREVEVLRLVAEGQSNKAIGVSMGLSALTVKSHLARIARKLGTGDRAGMVAVALRTGIIH

SEQ ID NO: 9768 - protein, 426 aa, Streptomyces avermitilis
VTDAQETAADSSLRTTGGAPPDDVETAPTPLLEPREGIPPVIADDASLAEVIAAFAAGSGPVAVDAERASGYRYGQRAYLVQLRREGAGTALIDPVACPDLSGLGEAISGVEWVLHAATQDLPCLREIGMVPTRLFDTELAGRLAGFPRVGLGAMVESVLGFVLEKGHSAVDWSTRPLPEPWLRYAALDVELLVDLRDALEKELDRQGKLEWAQQEFDAIASAPPPEPRKDPWRRTSGMHKVRRRRQMAVVRELWETRDRIAQRRDVSPGKVLGDTAIVEAALALPANTHALAALNGFGHRMGRRQLEQWQTAVDRARALPDAELPQPGQPVTGPPPPRAWADKDPAAAARLSAARAAVSALAERLNMPQENLITPDTVRRVCWEPPKLADADSVAAALAAHGARPWQIEQVTPVLVTALAAPPKA

SEQ ID NO: 9769 - protein, 132 aa, Streptomyces avermitilis
MLPSPGGGSGEGHIRGGAVDPPGARTGVGTGGEPDPSPRDHLERRTRRVRTERATRGRDAFTVCDDFCPPFRYAPTEDLGVISTSLFRFRGPFGAHWGTISAGAVLVVLPTLIVFLFLQRFIRNGFTRAVTK

SEQ ID NO: 9770 - protein, 408 aa, Streptomyces avermitilis
VPRTVRDVVFVDGVRTPFGKAGPKGIYHETRADDLVVKAIRELLRRNPGLDPKKIDEVAIAATTQIGDQGLTLGRTAGILAGLPQSVPGYSIDRMCAGALTAVTATAGSIAFGAYDAVIAGGVEHMGRHPMGEGVDPNPRFVSEKLVDESALFMGMTAENLHDRYPHITKQRADEYAVRSQEKAAKAYANGKIQQDLVPVSVRNTNAEVGETGWGLVTADEPMRPGTTLENLAGLKTPFRVHGRVTAGNAAGLNDGATASIIASEDFAREHNLPVKMRLVSYAFAGVEPEVMGYGPIPATEKALAKAGLSIEDINLFEVNEAFAVQVLAFLDHYGIADDDARVNQYGGAIAFGHPLASSGVRLMTQLARQFEEQPEVRYGLTTMCVGFGMGATVIWENPHHKDAGGDK

SEQ ID NO: 9771 - protein, 708 aa, Streptomyces avermitilis
VSTTELLKGAAALFPDEVVTSAHVRHLDLPSGAGRFALITLDNGFDHTKPTTFGPASLANLNTAIDQVEKEAAAGEIVGVGITGKPFIFAVGADLKGVELLKNHDDALAIGKGGHEVFKRLAGIAVPTFAYYNGAAMGGGVEVGLHCQYRTVSAALPAFSLPEVFLGLVPGWGGCTILPNLIGADKAVSVIIENSLNQNKQLKGEQVYDLGIADAIFEGADFLEQSLLWTTAVLKGEIAVERPEIDRGEAWDQAVAKGRFIADSKVHGAAPAAYRALDIIAAAKNGDLQQGFDAENQALADLIMGGELRSGIYAFNLVQKRGKRPAGAPDKSLARPVTKVGVVGAGLMASQLALLFLRRLEVPVVLTDIDQERVDKGVGYVHAEIDKLLLKGRVNQDKANRLKALVSGVLDKAEGFSDADFVIEAVFEEIGVKQQVFAEVEAVAPAHAIFATNTSSLSVTEMASKLKHPERVVGFHFFNPVAILPLLEIVRGEQTDDASLATAFGVAKKLKKTAVLVKDAPAFVVNRILTRFMGEIQNVIDEGTPVEVAEKAVEPLGLPMSPLVLLELVGPAIGLHVSETLNRAFPDRFTVSPNLAAVVKAGKRGFYVYDSGKPELDPEVAALLKQGDVVLTEEQVRDRVLDAVAQEIGLMLDEGVVAEAQDIDLCLITGAGWPFHLGGITPYLDREGVSERANGKRFLEAGVASVPA

SEQ ID NO: 9772 - protein, 1504 aa, Streptomyces avermitilis
VGELEMRQVQDGDNSWVTVVIPAYNAATTIGKALQSAVNQTYELVEVIVVDDASTDGTIEVVTNFAGNNPRVRVLRRKENSGGVGAPRNWGIAQAAGRWVMFLDADDELPPRACERLVASALETGSDITAGKAVRINRTTGESEPWAPEVYAMSRTVSDLEEFPLLLSDPIAAAKLYNVEFLRTAGVWFPEGVFYEDTYFSTVAGCLARGITVITEPVYRWMWESDGASITGRTGELRSIRDRIAVHRATDAFLLERGLWSLKVRKDSKFLSHDLRLYMRALAEGDAAFEQGFAATVSAYLFSVSDEAFELCGPVDRVRAYFLMYQETEAALTTLDYAQRKSVFSSYLVEEDGRVYWSGDHLHLPDARRLLDVTELGLAAAPVSQVPLFAQLNSWQVEGTKLTFDGELVNRFGRITADDTISLSLAVRNRHTKRDVVVPIPKVSVDERFVTFEGSADLVRVLGDDLSEATVWNVSVVVEWNRSRSRSALNVRDIDLDGLHFTREDEEFEGYRTVSGNLAFRSATASRRTFEAEQSDPNAPWMWWRDRIHPPIRQLTHRFELAVVVPCYNVAKYLDDCLASIAAQRGFAATQVILVDDGATDETPRMLDHFARFYANVTVVHQRNGGLGNARNTGLDQVSAPYVTFLDSDDILGEDALAAMLEAARRDGSEVVMGDLVNFPDRPYGPWKEYFGDGDRVFHDFADAPDMIFSGSACNKLFSTRLLRRLGLRFGEGVHFEDAWLTLPAMLRANSLSLVDRPVYYYRGRPDGSSIMDSLWSKPANYVDHLRLNHFLLNYSAEERPEIRRMFHRYATRTYKGFLCNARNVMGRTQLAEMFADLHRHYAQIPDDVIVEFVTSPAQQLDHYAAKSGNFELFCDPEPALAAAPLRLELDDDGFYRTFAGGVRPSTTARVKDPNVVVESVRARDDVLVVEGCMAFPGVDLSGPMDNRLELVYQTRHSKVTVPLTQVYRRDLWNARNGRDLYAGWHAELPAEVLADSGFGVGDLRLRVHLADGSRHRNVVMKARLALHRLKGPGRVGPYRYMLTIAAQDALHLRLVASGPAARVRHALWRAGRELRILKTRNPGWRMRFAYWLTYPFLNSKEIWLIGERSDTAQDNSYHFFKWIRQNRKRRKAYYVIDGASADRAKVAPYGRVLTLGSFKHRVYLLHATKLIGSYDSESYLVPEGYKKALFLHRFGELVKYQRVFLQHGVTYNDVTTGADQRIASYDLLVTAGRQERDFMALEAGYGDRAKPVGFPRFDALQREPRDKPRILLMPTWRQWIVTASYKKSAGPAKTNFTQSEYYRFYRSLLSDPRLGRALDHFGVDLEFFPHYEIRPYLHNFKFSSPSIEVADPHTRNVQQAMKECSLMVTDYSSVFFDVAYMGIPLVYVPFDEEDFYGRHYKRGYFNLSEDGFGPVCRTVDQAVDEIIEVVRRGFTVEPAYRARVEDFFVHRGGGNCQRVYEAIDAMGDASAAQLAPPAPVGALMPGRSRSPEGAGRHGWVDAA

SEQ ID NO: 9773 - protein, 406 aa, Streptomyces avermitilis
MTKLSLRAVQKLTVKKRDAWWTVLLVDPVATRMLIVLARFRFITPNRVTWAALFVGLAAAGFFLKGDPQSLLIGALLYHLSFILDCIDGKLARLKGNGTVFGGWLDYVFDRIRVLFCALALMGGQFLPTDDERYLVAALVVVFLDMLRYVDALQIYKMRMSMRTKIEKITKAREEEERAARGVPADAEGEQVVFMEDLLRDNPGAAAETLREEAGAANVVDLHEQFRDQFPWYTRVRRAMLRTRIRPHLISGIEFQMFIFIVGPLIGQILWTTVVSAALVMLFELVIMYKFWLSTRDFTRVMEELSPAPATVGTIAPHLHRGRHRRAAQEALLADERYRAPEAEDDPGFWPYPQPNVTPHGHDLPQQHDGLPHVPRQHAGAGPLPQYGTAQSGERRGAPGAWENSR

SEQ ID NO: 9774 - protein, 525 aa, Streptomyces avermitilis
MTRRSERRAGGAVAQAPGIRPHVVAVVVTEPAAAVPLVTLEAPGAEIAVVCLRAGAKEGRAALDRALAQAAERGCRVLGAPRILGGEGGDSVAALLDELREINPERLHTLDPDPVHVSFDETGGTPVYDEPAGHADIAADALAAARALQSETGEPLYVDCHRAKADVRLGAASCLRHPAPVNWLVAGFDGRLTAFLPTAAGVVRWFQDLPDGTAWRGPEPVEGPGLLPGLTVVRDPHGFPHLFALRRTRRGDGGVDVEVVHAVQYRTGQPLTPWNSLGGPNSGDWRKGREVGFPTAAFDSAGNLFVFVRNFGHSISYRCQSVDGVWTAWQHLGGTRVADDLVAVTTPHGGVEVYARARDTEAVVRWYPAQGGAWTEDRTPPFAARPGTMSPAPEPGSIHFRDLRTNAPSAWRPGAQAPCPLGDAEGSGPVAAASGVEMDGWAYSLLIRSGSGGACAVGAYPEGRPGTGVWWQDLAERSYGIPAAAVSRTGRLAVATRAPGQGLLVAHRREQAGSLAFGDWQPARG

SEQ ID NO: 9775 - protein, 413 aa, Streptomyces avermitilis
VGGLVRAASAGAALTAGPSLYDPACGPPKGPGADALGRTTKTMRATSARANGQRQQPVGEEALDLADRPAAVRSGPWLLPGHDGRLLAYALVDQAVLRWTERRPGGPDWLGPDVLPAKGLSHLTVAQGRNRYAHLLGRRVRPAKDGSLTVDLVYAIQYQAGRPLSEWRSIGNPHAKRERTALMGGPTAAVNTAGTLYVFVPTAEGRVAVRREDTQGRWEPWLDLQVTAAVDTPAAVSTSTGHVELLAPARTGALTWHQPEPGAVLRRGHDFGVIPLPGSVTGAETSPGRVTYFLTDVRGGMVAVRAGEWPVPLGGDPGDGRHAVVSTTLDGYPCTVLAHRGAEGRIMLGVCVAEDEGNGVWWTDTGTACLGDPVLALDGRGRVVVLAVAADGSLTLARQEDGPGLTLSTWSRI

SEQ ID NO: 9776 - protein, 328 aa, Streptomyces avermitilis
MTWLITGGAGFIGAHVVRTMLEAGERVAVYDDLSTGDPGRTPEGVPFVKGSTLDGGLLRRTLADLHITGVVHLAAKKQVAESVERPLYYYRENVHGLETLLDAAAETGVRNFLFSSSAAVYGMPDVKVVTEDTPCAPINPYGETKLAGEWLVRAAGRAHGMTTASLRYFNVAGAADERLADTGVFNLIPMVFEKLTQGTAPVIFGDDYDTEDGTCVRDFIHVEDIASAHLAAARALTGREPGSDLTVNIGRGEGVSVREMIELIGEVTGYGADAAPVSAARRPGDPARVVAAADRIQAELGWSARYDARAMVASAWAGWCARHPQARR

SEQ ID NO: 9777 - protein, 369 aa, Streptomyces avermitilis
MSHVSTPQRRSTGETPRGRGGRGRKRPGGRRTGRKILLALLILVLAAAGTGYWLYSDLNNNIEGVDIDKALGDDRPEKLATSGQNILVLGSDSRAGKNASLNTGKVSGARSDTALVMHIPEGRKKAVAVSIPRDTLVTRPECAKSDGSTLASAKRVMFNSVYSQAGPACVVKTVEQMSGVRMDHFVEIDFAGFKGLVDAIGGVTVTVDQDIHDTSSGLDLTAGTHKLNGTQSLQFVRTRHGIGDGSDLGRIGLQQEFMLALLSEIKQQDLLGSPTKAYKIANNLTESLTTDSGLASLTKLAEFGRSMNGVDPSTMETIMLPVAYDKADPNRVVAAEPQATTLWKALRTDATIPESAKKSPATGGTSSAS

SEQ ID NO: 9778 - protein, 121 aa, Streptomyces avermitilis
VTTLVIIDAANVIGSVPDGWWRDRRGAAERLRDRLARDGVPGAEGPVEIVLVVEGAARGVESVPGVRVESAPGSGDDRITELAAEAAGRDRLVVTADRELRRRVRESGAEVAGPRAVLGPS

SEQ ID NO: 9779 - protein, 497 aa, Streptomyces avermitilis
VETAGPDSVLRMLVEPLDAPRSVVAPRRERGYWSRLLPPLTVLACLTRVPSFVRPLWSPDEGYLAVQARMLAGGGELYETVVDRKPPLLPWLYQGAFAVCGSGSLTSVRVLAVLAQLLTAVLLASLARRRWGDGAGRTAGVLYLLASVGLNPQDAQAATFEVFMLPCTAAAMWCADRRRWGAAGAAVACAFLVKQTGGAVLVPVVWLLCRGGVSRTGLVRLGAGAIVPVLGAAVLTDPAGFVFWTVTGSGAYAAFTGSELHVLTRGLTNTAILAVACAGLIPPVVRVLRRARTGPAELWLWPASSAVAVLLGFHFFGHYFLQLIPPVALLATAALQALPRDRMVTAVFTSACCCTLFLTWGLLAPRSDLAHAERLADAVVRRTAPGDPVLVWGIHPETYWLADRAPASRYLTAGLLTNYSGGRDGPQVGERYAVEGAWPAFRAELAAHPPALIVDDSRDKPYRPERVPSLRRILAAGYEEVGRVEGAVLYAPASGRD

SEQ ID NO: 9780 - protein, 507 aa, Streptomyces avermitilis
VSSTLFRTKKVEQSIQDTEEPEHALKKSLSALDLTVFGVGVIIGTGIFVLTGKVAKENAGPAVSLAFVAAGIACGLAALCYAEFASTVPVAGSAYTFSYASLGELPAWIIGWDLVLEFALGTAVVAVGWSGYVRSLLDNAGWHLPDYLSGREGATGFGFDILAAALVLVLTVILVIGVKLSARVTTVVVAIKVTVVMIVIIAGAFFISGDNYKPFVPKAEHVAAGSGVKSPLVQLMFGWAPTNFGVLGIFTAASVVFFAFIGFDVVATAAEETKNPQRDMPRGILGSLLICTTLYVAVSIVVTGMQKYTRLSIDAPLADAFKATGHPWYAGVISFGAAVGLTTVCMILLLGQTRVFFAMSRDGLLPRFFSRVHPRFRTPHRPTILLGVIIAIVAGFTSLSELAELVNIGTLFAFVVVAIGVIILRHTRPDLHRAFRTPLVPLVPILSVLASLWLMLNLPAETWIRFAVWMVIGFVVYFLYGRSHSRLGREQAAAAGRTPTPSGGDIE

SEQ ID NO: 9781 - protein, 642 aa, Streptomyces avermitilis
VPLLTRIRGPRDLDRLSLEQLDQLAEEIRTFLVDAVSKTGGHLGPNLGVVELTIALHRVFDSPKDRVLFDTGHQSYVHKLLTGRQDFSKLKMKGGLSGYPSQAESEHDVIENSHASTVLGWADGLAKANQVLERDDHVVAVIGDGALTGGMAWEALNNIAAAKDRPLVIVVNDNERSYAPTIGGLANHLATLRTTDGYERFLARGKDLLERTPVVGRPLYETLHGAKKGLKDFIAPQGMFEDLGLKYVGPIDGHDIEALESALARAKRFGGPVIVHCLTEKGRGYQPALQDEADRFHAVGKIHPDTGLPIASSGADWTSVFGEEMVKLGQERKDIVAITAAMLQPVGLDKFAKVFPKRVYDVGIAEQHAAVSAAGLATGGLHPVFAVYATFLNRAFDQVLMDVALHKCGVTFVLDRAGVTGTDGASHNGMWDMSILQVVPGLRLAAPRDADQVRAQLREAVDVDDAPTVVRFSKGAVGPAVPAVGRIGGMDVLREPGTDAPDVLLVSVGALAPMCLEIAGLLDKQGISATVVDPRWVKPVDEAMAPLAERHRVVVTVEDNSRVGGVGSAIAQALRDAGVDVPLRDFGIPPRFLDHASRGEVMAEIGLTAPDIARQVTGLVSKLDGRFERPTAEIDSVEPARD

SEQ ID NO: 9782 - protein, 430 aa, Streptomyces avermitilis
VSIEKTSATADQAAVENPEAAAGSDVAVDPRLLVRERGFAGYISEFKRKIRAGDLGSLPVVVGLIIIWAIFASLNSNFLTAGNLSDISVAMVGTGMIAVGIVFVLLLGEIDLSVGSVSGVAGAAFAVLNVTHGMPEWLALILAILTGTVAGAIHGFVFARIGVPAFAVTLAGLLFWNGFMLQILGSNGTINLDSSGLVAKLSGYYFSDVAAAYGLAVFAVAVFFLTTFFDNRRREAAGVPSRPLSEIIVRTVLLAVVAFAAAAVFNQYKGLPLAVVLFLAVLVITDFVLRRTAYGRKIFALGGSIEASRRAGINVAAVRISVYAISGTFAAIGGLFIASKIASANQGAGAGDLLMNAIAAAVIGGTSLFGGRGRTWNALLGVLVIVSIQYGLALQGIASPVQYMITGGVLLATVVIDAVTRKTQKSAGRA

SEQ ID NO: 9783 - protein, 262 aa, Streptomyces avermitilis
MVHVSATPVLALRGVSKRFGAVQALTDVELEIHAGEVVALVGDNGAGKSTLVKTIAGVHPIDEGVIEWDGKAVQINKPHDAQNLGIATVYQDLALCDNIDVVGNLYLGRELRKRGILDEVEMERRSRELLTTLSIRIPSVRIPIASLSGGQRQTVAIARSMLGEPKLVILDEPTAALGVEQTAQVLDLVERLRERGHAVILISHNMADVKAVADKVAVLRLGRNNGVFEVKSTSQEEIISAITGATDNAVTRRAARNGEAQK

SEQ ID NO: 9784 - protein, 369 aa, Streptomyces avermitilis
VNTRMRRAAVAVAAGAMAVSLAACGSAKESKGDSDTSSSKKGDAITVGLLLPENQTARYEKFDYPIIKKQVADLTNGKGKVVYANAKQDATTQSQQVDTMVTNKVDVLIVDAVDAKAIANSVKKAKDAGIPVVAYDRLAEGPIDAYTSFDNEEVGHAQGKALLKALGSKAKPSAKIVMMNGAITDPNAAFFKKGALAELKGKVDIAKSYDTKEWKPENANANMEGAISALGKKNIVGVYSANDGMAGGIIQALKSAGISVPVTGQDAELAGVQRIVTGDQYMSVYKSYPQEAAVVAKMAVALGKGEKLDSIATSKVDSPTTKQVPSVIVPVISLTKDNIKDTVIKEGFYTVADICTAKYKKACDSIGLE

SEQ ID NO: 9785 - protein, 399 aa, Streptomyces avermitilis
VETPGSQSSLHRANLERVVRAVRLAGSLTQAEIARTTGLSAATVSNIVRELKDGGTVEVTPTSAGGRRARSVSLSGDAGIVIGVDFGHTHLRVAVGNLAHQVLAEESEPLDVDASAAQGFDRAEELVSRLIAATGVDRSKIAGVGLGVPGPIDVESGTLGSTSILPGWTGAKPAEELRGRLGVPVYVDNDANLGALGELVWGSGRGVKDLAYIKVASGVGAGLVISGKIYRGPGGTAGEIGHITLDESGPVCRCGNRGCLETFTAARYVLPLLQSSHGTDLTMEGVVRLARDGDPGCRRVIADVGRHIGSGVANLCNLLNPSRVVLGGDLAEAGELVLGPIRESVSRYAIPSAARQLSVLPGALGGRAEVLGALALALSEMGDSTLLDGTLSAATPAFT

SEQ ID NO: 9786 - protein, 306 aa, Streptomyces avermitilis
MKTTDTPPPVDRIEDRPRVTKTAAARKKEKSSEGGVLNVFSHGVLILWAIMVVLPLLWAVMTSFKDDDSIFSSPWSLPDKLHFENWSRAWSQAHMSDYFGNTLIVVGFSLVGTLVLGSMAAYVLARFDFPGNRFIYFLFVGGMSFPVMLALVPLFYVLNNMRLLNTLPGLILVYIAYSLPFTVFFLTSFFRTLPTSIAEAAFVDGASHTRTFFQIMLPMAKPGLISVGIFNFLGQWNQYMLPTVLNTDPDKKVLSQGLVELATSQGYKGDWSGLFAGLVMAMLPVLAAYIIFQRQVVQGLTAGALK

SEQ ID NO: 9787 - protein, 307 aa, Streptomyces avermitilis
MQHGKYRFIVGFLVAPLALYAIFVIWPFIQAIYYSFTDWTGLSPDFKMVGFANYTRMFDDDIFWKSLRHSLVFALLLPLVTLSLALFFAFMLNVGGRRRKGAAITGVRGSGFYKIAYFFPQVLSIAIVALLFQFAYNPNDGVINGTLQAIGLGSVQPDWLGDPNLALWCVMAVLLWSTVGFFVVLFSAGMASIPKDFYEAALLDGASRFTTFFKITLPLLWDTVQSGWVYMGILSLGAEAFAAVQIMTVGPGGPDYSTTVLPLYVYQSAFRDANAAYATTIGVALLVVTLLFAAIVMRLGRRERLEY

SEQ ID NO: 9788 - protein, 485 aa, Streptomyces avermitilis
LSMGSTSAENRNTGGIGRRDLIKRSAALGLISVPTMSFLSACASSDSGSEDKAKTGKKTKKNPLGVNETAALSVVIFDGGFGTKYATDANAEYKKAYPKVTIDFHKTQKIQSELQPKFNGGTPPDLIDNSGAQQMDMGVLVGKKQLTDLTPLLDAPSIDDPAKKVRDTLRPGIVEMGQFDGDPVWIMYYAYTVYGVWYSQTALEKLDSTYPEDWDAMLALCAKAKKKGIAGWTYAGKYPYYLPFSLYPFIAKIGGREVLDKIDNLEPNAWKDPAVKSAFEAYYELYKKGYILKGTPGIDHIQSQTAWAKGKALFIPNGSWVENESAKVIPADFNLAVSGPSGLDSSDKMPFGTIWASGGEPFIVPAKANNPAGGMEQLRIMLSEASSKNFTSQVKSLTAFNGGTDGIELTPGLKSGVAALDKAGDNVVNPRLQDWYVKLQKEQIGVSGLGEMMAGRLTPAEAIKKIQGYADAAAKDQSIKHYKHQ

SEQ ID NO: 9789 - protein, 1281 aa, Streptomyces avermitilis
MQHGARHRWGLTSGYRPGSGRRPGPSAVVAVAAFALVVASQGAAVARPAQAAAADREFASSFESGEPAPDWLSTVDTAADGSKRASGVDGGYSTGIPGNVTDHVTDVRAGAENTGAGEVKENLVDGESSTKWLTFTPTGWAEFDLDAPVKLVTYALTSANDADERDPADWTLQGSTDGKDWKTLDTRTGESFAERFQTKSYDLASPAEYQHFRLDITKNHGADLLQLADVQFSTGGTSDPAPKDMLSLVDRGPSGSPTAKAGAGFTGKRALRYAGTHKADARAYSYNKVFDVNVGVGRDTELSYRIFPSMADKDRDYDATNVSVDLVFTDGTYLSDLKATDQHGFALTPQGQGAAKILYVNQWNNVVSRIGSVAAGRTVDRILVAYDSPKGPAKFRGWLDDIALKAAPPEKPKAHLSDYALTTRGTNSSSGFSRGNNFPATAVPHGFNFWTPVTNAGSLSWLYDYARSNNADNLPTIQAFSASHEPSPWMGDRQTFQVMPSAASGTPDTGRTARALAFRHENETARPYYYGVTFENGLKAEMAPTDHAAALRFTYPGDDASVLFDNVTDQAGLTLDKEHGIVTGYSDVKSGLSTGATRLFVYGVFDAPVKEGASSGVKGYLRFAPGADHTVTLRLATSLISVDQAKDNLGQEIPDGTSFTTVKNRAQQQWDKLLGKVEVEGATPDQLTTLYSSMYRLYLYPNSGFEKIGSKYRYASPFQPMPSPDTPTHTGAKIVDGKVYVNNGFWDTYRTTWPAYSFLTPGQAGEMVDGFVQQYKDGGWTSRWSSPGYADLMTGTSSDVAFADAYVKGVDFDAKAAYDAAVKNATVVPPSSGVGRKGMATSPFLGYTSTDTSEGLSWAMEGYNNDYGIARMGQALYKKTGKKRYKEEAAYFLNRAQDYVKLFDGKAGFFQGRDGKGDWRVDSATYDPRVWGYDYTETNGWGYAFTAPQDSRGLANLYGGRGALAKKLDTYFATPETASPDFVGSYGGVIHEMTEARDVRMGMYGHSNQVAHHVNYMYDAAGRPWKTQANVREVLSRLYTGSEIGQGYHGDEDNGEQSAWYLFSALGFYPLVMGSGEYAIGSPLFTKATVHLENGRDLVVKAPKNSAKNVYVQGLKVNGKKWTSTSLPHSLIAKGGVLAFDMGAKPSSWGSGGGAGPVSITKGDQVPSPRADAIKGGGALFDDTSATSATVTSVELPVAARTKAVQYTLTSSSDHTAAPAGWVLEASADGTHWTTVDRRTDESFTWDRQTRVFSIAHPGKYAHYRLVPTAEATLAEVELLS

SEQ ID NO: 9790 - protein, 1104 aa, Streptomyces avermitilis
MRFRPSSVLLAVTLVVAGGATPALAATTAPPDLVRDPTTYVDPLIGTTNGGDVFPGAVTPFGMLSWSPENTRGDATRTAAPGGYQYDATRIRGFSLTHMSGTGCAGGSGDIPFFPYAGDVTSSPASDTKDAVYAADFSHQDETAEPGHYKVGLSSGVTADLTATARTGSGRFTYPADKPASLLIRTANSEVGSTDSSVRIDPATRTVSGSVTSGNFCGYLDPEGRRGYYTLHFTARFDRAFKSTGTWQDDRLNPGSTEASGGTGGFSQGGRPVAGKGAGGYVEFAPGSGPVNVKVGISYVSQAGAEANLAVENPRGRSFEAVRDAARRAWRERLGAVGVGGGTAEDRTTFYTALYHALLHPNVISDADRRYRGSDDKVHVVGRGHRAQYGTFSGWDVYRSQVQLLTLLDPRTGSDIAQSLLELARQNGGIWDRWLHGASGTHVMNGDPSPAALAGIRAFGGTDFDLRGALDSLVKAATVPTSQDLSAAGKPVLSVGQRPSLDKYLNRHYMPSVSNAWGGAAETLEMSGADFALSQLARAAGEKETAATFARRSQWWQNNFNIAAAPSPSARVGSGKGYLNSGYIANRKADGSWVTGFTPATGNGFVEGTAAQYTWMVQHNPAGLFAAMGGRDAALDRLDAFFHDSDGSWAFTGSGGDKSELDNEPSINVPYLYAYAGAPYKTQETVRAAMDKLWSTRPGGIPGNDDLGAMSSWYVFSALGMYPQVPSRAELVLASPLFPRVEIRRPHGNDIEIRAAGAAKDAPYVRSLKVDGRTSDRSWLPASFVRDGGRLDYTLSATPNRAWGADAADAPPSFRAGEQPYQIGVGPTTATVAPGGSTKIDIRALALSGGTGPEVRFRVETPAGVTATPAEGTVSDGAQQITVTAADAARQGFYDVKVTVTSPDTSYEQPVALTVAAPGSLLAAYDNTGVSDDVGDHDEADYDGGGWSYSRQALAGAGLTPGTQGTVNGLTFTWPDSPAGRPDNASATGRTVELPTPAAELSFIGSAVNGNQQTKATVTYTDGSTDPVDLSFTDWTVGGGGGTVQYGNEVVARTPYRNVAGADKDPVATYVFATKPYTAPAGKKIKSIKLPDNTDLHVFTLAVN

SEQ ID NO: 9791 - protein, 391 aa, Streptomyces avermitilis
VRWERSHIPADRNPPEGTAPTSRGIPTTPTRGMFVMLPTVARLPLSTRHRALLLVLLALLTTVPALGLVVTAGGRAAAHGTPMKPGSRTFLCWQDGLTDTGEIKPVNPACKAAQQVSGTTPFYNWFSVLRSDGAGRTRGFVPDGELCSGGNPNFTGFDLPRSDWPLTHLTSGATVDFSYNAWAAHPGWFYVYLTKDGFDPTKTLTWNDMEDQPFLSVDHPPLNGSPGTVDANYSWSGRLPSGKSGRHLVYMVWQRSDSAETFYSCSDVVFDGGNGEVTGVHDPGNPTEPPPGVCSATRRTTGSWPGGYQSEVTVTNTGDVPMLGWMVDWTLPSGQTVDSLWNGNATYQGQDVMVHNADWNGSLDPGRSATFGYVVRGSGGDPSTALACQVG

SEQ ID NO: 9792 - protein, 165 aa, Streptomyces avermitilis
LDRPAEEPSGKRLGTARELARNLFCSRDIYLCEQHGQGGSEAVRGPDAGDDREADADDGLWGPALANLLIGLLAILPALCLCRLLTPYPQAGCDGGFACAGEAPGHTTGVTIGAVLGGAAVLGLVLVVDVLMPRQEGRRMRTWLGMTVLVPIPFVVGQAFGWIQG

SEQ ID NO: 9793 - protein, 512 aa, Streptomyces avermitilis
MTARPRARSLRTRLLLFIGVTLVVVCAAMTLTTVFAQRAYLLGNLDERVTDAAERSQGGAGLHPENDTDLGFLHENGQPAGTLAARLDVDGYITAAEVVSQDAPPRALTAAQRAALDGIATDGSKHTRTVPGLGTYRVTALDSKGIRVLTGLPMGDVQDMIGGLVLVEAVVAAAGLTAAGCACAVVIRRQLRPLGRVAATAVEVSRSPLGHGRVTGLTRVPDRDADLGSEAGQVGAALNRMIDHVESSLAERQRGEEEMRRSEERMRRFLADASHELRTPLASIAGYAELMNRGTERIEPNLAWRRVSAESARMTGLVEDLLLLARLDEGRPLHSAEVDLAGLVAEAVWDARAAGDTHDWQLALPLDVPALVIGDEARLHQVVANLLANARVHTPPGTTVVASVEATGGSCTIRVRDDGPGIPPALLPTVFERFTRADASRSRASGKVGGSGLGLAIAAAITAAHGGRIHVDSAPGHTEFTIELPLAPEPEPTELAASPALSGALEAARAHP

SEQ ID NO: 9794 - protein, 241 aa, Streptomyces avermitilis
MSGTPGPRNGRVRVLIVDDEPALTELLSVAVTEAGWRPYPAADGHSALRLARGCAPHAVVLDGMLPDLDGLQVLRRLRYESPKLPVLMLTARDALERRIEGLAMGADDYVTKPFSLEEVVLRLRGLLRRAGTAGARADDSVRVLGDLVLTEETREVHRDGTPIGLTAKEFDLLALLLNHPRQVLSKAQILEHVWSSTFDGGGNLVEVYISNLRRKIDKGRAPMIRTVRGLGYAIRSAEDGR

SEQ ID NO: 9795 - protein, 905 aa, Streptomyces avermitilis
VSANSFDARSTLQVGDESYEIFRLDKVEGSARLPYSLKVLLENLLRTEDGANITADHIRSIGNWDSQAQPSQEIQFTPARVIMQDFTGVPCVVDLATMREAVKELGGDPAKINPLAPAELVIDHSVIADKFGTNDAFAQNVELEYGRNKERYQFLRWGQTAFDEFKVVPPGTGIVHQVNIEHLARTVMVRGGQAYPDTLVGTDSHTTMVNGLGVLGWGVGGIEAEAAMLGQPVSMLIPRVVGFKLTGELKPGTTATDLVLTITEMLRKHGVVGKFVEFYGEGVAATSLANRATIGNMSPEFGSTAAIFPIDDETLKYLRLTGRDEQQVALVEAYAKEQGLWLDPAAEPDFSEKLELDLSTVVPSIAGPKRPQDRIVLANAAQQFAQDVRNYVDEVDEAGKESFPASDAPALRPNGAPSRPTLVTAPDGSTYEIDHGAVTVAAITSCTNTSNPYVMVAAALVAKKAVEKGLTRKPWVKTTLAPGSKVVTDYFDKAGLTPYLDKVGFNLVGYGCTTCIGNSGPLPEEVSKAVNEHDLAVTSVLSGNRNFEGRINPDVKMNYLASPPLVVAYALAGSMKVDITKDALGIDQDGKPVYLADIWPSEAEVNDVVANAIGEDMFNKSYQDVFAGDAQWQALPIPTGNTFEWDPQSTYVRKPPYFEGMAHEPSPVTDITGARVLAKLGDSVTTDHISPAGAIKADTPAGKYLTEHGVERRDFNSYGSRRGNHEVMIRGTFANIRLRNQIAPGTEGGYTRDFTQPGAPVSFIYDASRNYIEQGTPLAILAGKEYGSGSSRDWAAKGTALLGVKAVIAESYERIHRSNLIGMGVLPLQFPEGANAESLGLTGEETFSFTGVEELNNGTTPRTVKVTTDTGVEFDAVVRIDTPGEADYYRNGGIMQYVLRSLIRK

SEQ ID NO: 9796 - protein, 65 aa, Streptomyces avermitilis
MPLTFRKSFRILPGVRLNINKHSWSLTTGGKHGPRHTHSSTGRRTTSMDLPGPFGWRRTRTDKRH

SEQ ID NO: 9797 - protein, 437 aa, Streptomyces avermitilis
MHLRVVGGRRLSGSIDVKTSKNACVALLCATLLNRGRTVLRRVARIEEVYRLLEVLGSIGVRTRWINDGVDLEIVPPAELEMEAIDEEAARRTRSIIMFLGPLLHRVDSFKLPYAGGCDLGTRTIEPHMIALRRFGLEIAATEGLYHAQVDRAVTPGRPIVLTERGDTVTENALLAAARHDGVTVIRNASSNYMVQDLCFFLEALGVRVEGVGTTTLTVHGVPNIDVDVDYSPSEDPVEAMSLLAAAVVTESELTVCRVPIEFLEIELAVLEEMGLDQDRSAEYFADNGRTRLVDLTVRPSKLEAPIDKIHPMPFPGLNIDNVPFFAAIAASAQGKTLIHDWVYDNRAIYLTDLNRLGGRLQLLDPHRVLVEGPTRWRAAEMMCPPALRPAVVVLLAMMAAEGTSVLRNVYVINRGYEDLAERLNTIGAQIEIFRDI

SEQ ID NO: 9798 - protein, 224 aa, Streptomyces avermitilis
MTDRGERPVVPWELPDPGLEPTLQDPDVQPTIRDVDDATYVPTVLDAHWTSAEPAPESDVLHFGPGVPPLGLTDTAVDVWRGTAKRKSQQEPWGRLHRLRRYRLAAVVLAIVLAWLLWQRQTADLRITQVTAQTSSVLGCDGTAEVVAVVNTNGAAGTFTYEWNRSDGTSSGPREERLGRGQDETHLRLLWTFHGKGTSKATARLVIESPSRHTTSASFTYTCR

SEQ ID NO: 9799 - protein, 663 aa, Streptomyces avermitilis
MAGATDRDGWKVERGDDSWTVPGYIDLKKLGKGGAGRVMIARHAGTGRNVAIKYLNEELCSKVEFRTALRAEARLLGGLTSPHVTRLYEYVEAEQGAAIVMELVYGAALRTLLKKEGSTDIEAALVVLKGSLLGLAAAHGVGVVHRDYKPENVLVNWDGQTKLVDFGISARTGDRHNLRGTCAYMPPEQWKLEAATPAGDVYAATATLYECVTGVRPFEGPEPWDFQRQHVDEPVPMDRVPEEVRALVRHGMAKDPALRPPSALDFLRELEWAAENAYGPDWEERGQSRLAAVAAALVPLAISRLDARLVGSSAELARTVLTARRRSRLRRRGDVLTGAAAVAVVGLLSLMPSGWAAGGAEGHAGAHAQAVTRLDARKDTGSATEARGTEHGDTAESDPDSDRAGTSGAQGGGGHGDGGAGLAPADGGTRSDSGSGGGAGDSGTDSPDDGNNTVERNGGTENGGTENGGTENGGTENGGTENGGTENGGTENGGTENGGTENGGTENGGTENGGTENGGTENGGTENGGTENGGTENGGTENGGTENGGTENGGTENGGTENGGTENGGTENGGTENGGTENGGTENGGTDNGGTDNGGTDNGGTDARHGHSNAGTSDGDPASTGGTDSGNSAGGTGTGTGSGSTSAVTPRQGDPAAVEGEPG

SEQ ID NO: 9800 - protein, 196 aa, Streptomyces avermitilis
MNEMTMGRRERKKAATRKALADAALDLFLERGYDQVSVKDIADAADVSTTTLFKHFPSKEALVFDEDAEQEAALVSAVRDRAPGRSIPAALCEGILHIRSGANLEDPRIAAFRALVEGTPVLRSYAHRMWMRHQAAVAHAIAEEIGAPDDDAACAALARFALEAPRVGEGYPDPRERIRRAFDLLERGWSAEHGRG

SEQ ID NO: 9801 - protein, 522 aa, Streptomyces avermitilis
MSATRPSRPGGPAAEPAATPPNVRWTLLGVMLGMLLAMLDNTIVSTSMPTIVGDLGGMEHISWVVTAYALATAVSTPVWGKLGDLYSRKHAFLAAITVFLIGSVASGAAQSMTQLISFRVVQGLGAGGLAALAFALIGSLVSPRERGRYQGMTATVMAIGTVGGPLLGGLITGHLGWRWSFYINLPLGLVTLVWCQVMLRLPVQRTKARIDWLGILLMTVTISAVVLAATWAGTTYAWGSWQIVSLAVVTVLGLTAFIASQKRAVEPVLPLRVFDTGNFRLAGVMVFAAGAAMFGATLYLPLFQQSVQGADATSSGLLLLPMVVPIALVSNIAGKVMSRTGKYKIFPILGAGFLAVGLFLLSTMDTGTSRTVTSFYMVLVGVGLGFLMQMTTTIAQNSVEMRDMGVASAGVTLFRTIGGSLGVAVFGSLFTRATEHHLPSAASGNADASLSGSAVDRLPQGAKDAYLTAVADGTQQIFLVAAAVCLAALLAALAVKEVPLRGKPVAAEPAEQPSAEKARIWR

SEQ ID NO: 9802 - protein, 67 aa, Streptomyces avermitilis
VTERTEAAGRRAPVIHAYAADPNATGDAVAKTVAGSAGSTSWSTTRACSSVARCRTSLWIRSTGSSR

SEQ ID NO: 9803 - protein, 229 aa, Streptomyces avermitilis
VSPDLIPHQKSLSPSYLVFCDVDETLIRCKSGPEFLRHYFEFRHGAEGARRTEELLADLYARLARGLPRDEANREYHRAWRRCPVDEVEDRARHWYRERSRAADFYITATVDALRRHRAEGGAVALVSGSFPPLLPLVAEEVGAQYVLGARLERCGRVLTGELLGLPAIGDGKRVLARELLARHPHIDPADCYAYGDHPSDLPMLHMVGHATLVTPDGTHAPVKPAALT

SEQ ID NO: 9804 - protein, 407 aa, Streptomyces avermitilis
MMLRHNPVDESVNDTSPALPVAVLAAAESAAAHATAADDARRLGDETVALLTHAGFARHFVPRAWGGTEGTFDSLLTAVTAVGEGCASAAWCAVLWAAHSRFAAYLPYEGQRDLWSAGPDVRISASVRPSGEARRLPSGWLLSGEWECVSGVDFADWLLLCAPEPGVEGAAGSRMFAVPKGDIRVRDSWHSTGLRGTGSHTAVLEPALVPEHRTFPMADLLAGTPGPGRSRCHTVPGHLAGGLLFCAPALGAARRALAEWSSWAARAQTRGRPQDDGSRLHHALARSADDMEAAQLLLQDAARCADTGTRAEADVLRNRRITAAAADLLVDGVERLFRTAGVHACGGPGVLERSWRDVHTVAAHQMLRREAAAMVYATSVFSSLTEPRPPATAPQPAALLEVSARES

SEQ ID NO: 9805 - protein, 206 aa, Streptomyces avermitilis
VEPAKEGSVMPKQARALRTYDRVLDAAAYEFARYGYTNANLQNIADRIRLTKGALYGHFANKEELAAALDHHLSATLGVLLTEARTSPHPALGRLQSLVLGLGRLFRTDLRALAALRLAAETARSTAKPIPLLTETHDLVLQLVRETQQEGHWDASISTRPLADLIVAALFGTFWTETDTGHPGSDGTVDTMWEALAQALGGAPAR

SEQ ID NO: 9806 - protein, 345 aa, Streptomyces avermitilis
MSVVLDDSRTMKAPSMGATVEVLSFLQPVTRELVHRSSIAEVFVTDGVRTGENAFSVGAQWPRDHALYHPDENGLNDPLLFAETLRQAHFYGAHTYFGVPVGSRFIGQDVSFEITDPTALRVGAAPLAVVLNGTWTEERDRRGRPAGARLDVTLTVDGRPCGRGHTRGLMLDDRRYRLLRGRPAASGEVSPPRPAPDARIARPNRVGRLRWKDCVLERDRPDQDWRLRVDRDHAVLFDHPTDHVPLMVMLEGFRQLGHLTVHEASRRTLGDRAFALAGLSLDCAAFGELGETILLSLEKGPSEGVPTEECALRVAAHQGERLLARADMTWKCVGSRAPWSRFASW

SEQ ID NO: 9807 - protein, 218 aa, Streptomyces avermitilis
MDVMSSERNGQSTRLPAGTPFDDTAHLKQQRAIRTRGTILNAAAAAFATDGFPQVTIKDIADGAEMTKGAVYFHFPNKEALAVAVLEEFYRRMQEAVNGALEHGDPTSPTTVVDVMRRLARAFHEDVFIHAGARLQIERPYIKAELPVPYVGTLKVLTELLDQCRTAGNLPKSTKPEALARALGSAVFGAQHISWVLNDREDIVERVEEIIDAFVPLH

SEQ ID NO: 9808 - protein, 289 aa, Streptomyces avermitilis
VTRPPPGCAARPTSSSTRTASWPGSRRCRCPRRWRRGSAAAGTPTPSPLRCTPAGPGINAAVDCAADIHRELGPLRPDDVREIVVEASLYTLFAGERAARYVDGPASPLGALVLDVPYPVATTLLTGDFSVDDFSSPHLDDPARWALARRVRLEHDTAMTRELFLSDAPFGEAVREAGPLATPWLRGFGGDALVDLVGTLEADGRDFSRSTKATGARVTVRLTDGRTVTRSRLIPVGAAGPDTRVRHSEMVQEKFLSVGGPRRVADTVGRLHRMRPRGVRRWIEAAFLD

SEQ ID NO: 9809 - protein, 556 aa, Streptomyces avermitilis
MTAAVLSERVARALCEQWEQQTRPARSRPSSDTPLRELSHWAANLRPEHIPCRVLKLAASQVLSQIASIRAGLEHPLGRRLVAAFGHPMQRDPRAAAGVFAALGSWLNLDDTAYAGHLSNSTVAVPLAFAYARQLDGLSLLTAVVAANECAARITASATLGPLRGQSAVHTHLAGAVAGRLHCDRAPADQWENALGLAFAMPNWPLMRAFLASDARLFNTFTPVRTAMDACDAAAAGLRGAPDIIEHQDGFLARFATVPLPQAVAKGLGSRWHTNTLSFKMHPGGPRHQRGRGLRRRHPPRTRPAAPGRRAGDRRRGVLVHAVRGGARGPLRRRPRLSAGRARPRRPLPGRHHPADRRLLGGRLLLTASGRPRTLGAGPPGAAGARHGDDPRTLPVRRAVRRGGARGGPAGHAVAARLRRRRARRPRRHAGGRRPGLLPLHQGHRRPGHGTADRRPYGHPLPPDPGGRGGPGHPRPPLRDGPGEVSVGGRPPSGGRHGGAAAPYAPARCTPLDRGGLPRLTTRGASGAPQGEFQAPFLPGYGPRRVTHDRCAGPPR

SEQ ID NO: 9810 - protein, 122 aa, Streptomyces avermitilis
MSDITTTVTQYLALWNETDADKRAAGIAELFAPDAPYIDPLAAVEGHEGFGAVVAGAQEQFKGLSFELHGTVDTHHNLARFQWGLVTAPGTEPVAIGFDVLVTGDDGRIKGVYGFLDKVPGA

SEQ ID NO: 9811 - protein, 319 aa, Streptomyces avermitilis
MADSAAALGPTRALVLANPASGSHSPQLVREVTELCGSCLEHVELHPTTAPGDATVAVRRALQRPAHAPDLVVVIGGDGTVREAVQGLASAPGRAALTVVPGGTGNSGYKMLWGERPWTESLKAVLTDSGVGGSARLRRHDLARLAETRQYVYLGACSGVIADALITARDIPLTGRDLYTKAFADTAAAYVPYPGRVTVDGRVVHEGPTVLANVGGGRYRGGRYLVLPDSLLDDGLLDVCVIGDGVTAADVPRLTLNADHMGHPATVYARGRTITVERTDGRRLPLEHDGEYQHGIGPSATFEVQPGALPVWAPAIERN

SEQ ID NO: 9812 - protein, 489 aa, Streptomyces avermitilis
MALESPREAAPKKAATEERQPPSAPHWATLPIILIGTFVITLDVFIVNVAIPATQQDLHASQSAVEFIVAGYALAYAAGLVTGGRLGDLYGRRRLFLIGVALFTLSSAWAGFAPSASQLVAARIAQGLASALMGPQVLAIIGVAYDGPARVRAFNAFGLTMGLAGVFGQLIGGVLIHADIAGLGWRTCFLVNVPVGIAALVLAPRVVPESRAQGRARLDPLGMVLISAGLVAVVLPLAEGQQEGWPLWTWLSLAAAPVLLVVFAVQQRRLAAAGRSPLVDPALFRQRSFTFGVSTAVVYYSGMASFFLVLALYLQQGLGLTALESGLVFLPLGVGFLTVSLSARRIAAALGRQTLAVGALVLTAGLAALFAAAQHIGTDGAVGWLVPGLTVGGAGMAMVMAPLASIALAGTDPRYAGAASGVLSTASQVGGAVGVALVGVVFYHVLGQGTGTSAYADAFTASLYLLAPLALAVAAFVQFIPGPKAASSA

SEQ ID NO: 9813 - protein, 339 aa, Streptomyces avermitilis
MRFENDLYIASTASWLPDLVPMEEAIAAGLVDDEHRNLGYESIAVADGVAGPEMAVRAGRLALERAVGIERDEVGLVLHSSCGFQGHEMWPAAAYVANETVGRAAPGFDLQQRCNAGLGSLCLAAGYIDAGFTSAVLLTTGDNFAPPWVDRWNVQLNLVFADGGTALVLSGRKGFARVVSATLGADNSLERWNRGTTPFATAPGLEMPLRLRERGLQHAATPEAEGSWERIEAALMDTTRRALAEAQVSVEDISRVVTPLIHRGVWPENYDVLGFTEKQSTWDLGRLVGHIGAGDQFLGLEHLVKERAVGPGDLVLLVAAGAGFSLSAAVVEILDVPPW

SEQ ID NO: 9814 - protein, 255 aa, Streptomyces avermitilis
MSREGQWFHPAEPSLDASVRLFLLPHAGSGAIIYRDWENLLPSDIAPQAVTLPGRHNRRGEATFEDWDPLLDALHEAVLDDLDDRPFAFFGHCLGAQLAFRLAIRMEEDGGPAPVMLGMSGWSPQGFFLPTEEQSRMPAAEMVEWIKKLGSFPAEIYDNPEMLALVVPALRADLRVAAQYVDDKAGVSCPLASYGGRSDPLQEHPDAMTHWAGRSPDYLGHSEYPGGHFYIDAHAQSVTAHFAQRLQRVVSALVS

SEQ ID NO: 9815 - protein, 367 aa, Streptomyces avermitilis
MDAERPGRAPQGARGTARSAPDDTRSTNQPQSPDRALRIGILLPTREQAINGAYAAAPLLDFARQAERLGFDSLWAGDSLTARPRLDPLVVLAAAAAATERITVGTAALTPALRHPLIGANMVASLGHVARDRLVLGLGSGFPMPETEEEFASVGASFAGRVGRLDEITALWRTAWNSGEPGNPTDFDGRFWQADRLDRLPAPATPGGPPLWLAGSDTPKVLARVATRYDGWLPFLPDADAYGRARRRIAELAEEAGRGADAVTPALYATVTVNSDSAAAKSELEHYITHYYGRSLEQMSAIQAYGWGSAESCAEWLGGYVRAGARHLVLRIGSLDPEPQLKEIAEVLLPAVRALGGQTVTVGGAKS

SEQ ID NO: 9816 - protein, 534 aa, Streptomyces avermitilis
MTTTANGSWTLTHTSRAHAGSRPHHAAIVCEGRITTYGKLHRESNRAAHALRVSGVQRGDRVAYLGRESENYYLVILACAKAGAVLVPVNWRLTPDEVDHILRDSGATLVFVDDEFWATATKVRPHLPEFHTMIRIDGTDAEGEPARGAGLPAWYADQPDADLEPGTGPDDAVVQIYTSGTTGLPKGAVLAHRSFFTLPQAMRDHDVAWIDWLPDDVALISLPGFGIAGIGWFMHTFNAGGTSVIMPQFDPQEAVRLIRTHRVTTTFAAPAMLQMMAGERTAGPDAFVSLRKICYGAAPMSETLLKQCLETFDCEFAQIYASTETGSVAVCLPPEAHHPGSTVLESVGKPCPGNEVKVVGPDGAELPPGAIGQICVRAPSRMLGYWNLPEATGRTLVGEWLHMGDAGYLDEDGYIYLCDRMNDTIIVAGQNIYPAEVEKALAAHPAVADSAVVGLPDPRWGEAVHAAVVLRPGAQASPRELLLSLRGHLADYKIPGAYHFVDTLPRNPSGKILRRAVRERLSAPARDPLTSAVQ

SEQ ID NO: 9817 - protein, 633 aa, Streptomyces avermitilis
VTALDAARQPVPPRLWLVTEGAQWLPGDPAGDGGHLAAATLWGFGRVLLTEYPRHRATLVDLAPGSDLAPLLDEWEAEAAGEYQIAHRPGRRYVRRLLAGDATLTWSGGYELRAPDSGDLSDLALVAAADRAPDADEVQVRVGSVVLTDDDARTALDTGRAEREEEEPPPVLGALATGTVLAAGDGSGFATGDEVLVRHAGTLRSTLTVPSASVVLAPHPEPHYGARHFGLDETGEALRTALLDPDTQVWVDLPGEAADEPSAGAQAGTDAPADIRPDRTYLVTGGLGGLGLVTARKLVALGARHLTLVSRSGKATEAATPLLAKLAEDAELAVVRADVSRPADVRRLVAEVAAGPYPVGGVVHAAGSYDKKLISELTWESIDAQLAAKAYGGWLLHEAAQASFPELEFFVTYSSIASVLGGAAQGHYAAASAGLDSLAEWRTRQGLPGLSVNWGAWARVGMSARLEEHLSREIERGGVHFFSPTRALDTLARLWGGTPRTQRVVGEFDWDRHAADSETGDQFYDRLVRPDRADDGLDRALLAALPKPERTALITQVVREKVAAVLRLTAGDELETTAEFGSLGLDPLSARHVTSGLEQAFRLPLPASLALDHPTVRQLAAFLDGQLCPVPAA

SEQ ID NO: 9818 - protein, 1253 aa, Streptomyces avermitilis
MPRTESQTEETNRAPGQAPEPIAIVGIGLRLPGGGNSPDEFDAYLREGRGATGPLDRLDTFDASFFNISPKEAPYLDPQQRMLLETAWQALEHANIDPTPLRRGNGGVYLGAGSRGYAPEPAPLPYEEPDGPLAAGVTTCALSGRLSYFLGWRGPSLSVDTASSSSLVALHLAVRGLRAGETDIALCGGVDAPHRPRVAGKLAEGCGVVVLKRLGDATRHGDTVLALVRGSALAQDGDGAGPAAPDGAVQEKVVRGALAAARLAPEDIQYVEAHGTGTSPAGSVESGAVGRVFAESHTEDAPLLVGSVQTDLGHLEPASGIVGVIKAVLQIRSGTVYPHPGRTTSSGRDAGEPRFVRVPTACEPWQADVRRAVVSSLGFAGTVGAVVLEQPPAVKHSEETAPDAAAPLFTLSAKSAAALREQARNYRRLLAQRPDVPLAGLCYTANVGRSHHPYRVAGPVADHAALVRLLDQAAGRDHEGPSGIRRTAFMFSGQGSQYAGMGAAPYERFPVFREHVDACDRLFAPHLGRSVAALVRGTAADPEAIDRTEYAQPALFTLEYALARLWMSWGVRPHVLIGHGIGEVVAAAVAGLFSLPDAVTLVAARARLTRAVRAKGGTAEVAAPAEDVEPLLAAHPDLALAAVDAPDRCVIAGGANALAEVTGLLRARGVRVDRTAVPHALHSPLMTEVYDDFRAALDGITFHEPAISLISNVTGRPARPAEIGTPDYWVRHLGEPVRFLAGLRSVAQRGRHALIEIGPGSDLTALAQRGLTAADHVWPVSLRRGDRSADTTLAALAGYYTAGLPVSWAGYHAGRPAPAKTSLPTYAFQREDHRPPSIAPRRTGAAYGAARHLLLGTEERFASGVREFTAEFTAGDLGALADLGDGERTTLPTGAYVDLLLALQDAVGGHTRCAVRELKLLTPLHIPAGTTVALTTRWRPRSEGGADVEVFTLVGGEEDTHATARIAAGREPVVPVCELAELDAELTPAGQRIDDEDIYTDLASVGRPHGPRMRLLLHASRHRDGLVTGELTGRDATAAEHVPAELLEAAVQAAVVLDPEGPVFVPREISRVRHFRKPRGEQLRVLARVHGEQDRRIADILLLENGEPVTELLGVHLARPEGRVGRRQFLHRPEWVRRALPGAAAGTSAAAPSSADAAAPARTAPGGRHLLLLDPAAGRAAALAGQPGLRVTRLSDPTGLKAALEDPTVTDVCRVWRRPSPTSAASGGSGRAPCPPTGCAPSARTTTARCWPW

SEQ ID NO: 9819 - protein, 112 aa, Streptomyces avermitilis
VSAGAACMTAMPPADTTVIQRLRELPRTEIADEIETLVLRKFKTVLLMDESEDLPLDISYFDLGLTSLRLTEIRQSLEQLLDLSINVNVLFNEPTVAQLVDYLADALSTPSA

SEQ ID NO: 9820 - protein, 543 aa, Streptomyces avermitilis
MLREAAQEESAPAPSGLKSYDLYIAGKDVAGDGWVYTVSGRSLLEDVFTSVSLKRSLEQDPESEAAQHPYVVGRCAVADDSAIDMATQAAAAAASDWAAVPLERRMRLGTRFREELLKHQDEFLDMLVAESHPVKLARWELSCLLQIYAPGSLRWYMKQMRVEKEYAGRKLILHRQPDGVVAFNPPQNAPLPSAALCVLALMAGNAVVVRAPRSIALSTMWLLRDIVAPILEEFDAPPGVLNAVCSNPKQTMDRWIADPLINDIFYIGGSQEGLRFEQQCVAHGKKPILELAGNDGIVVWKDADVKWAAEAITESFFGSGQICMVPNYVLVHPDVAEALIAEVREQVKGIRPGLPEEEDVLLSPVRRSERFFRLLRQALDNGGSLVTGGHRTELDGTPSETGVFLQPTVIRVDGLDRARTFDVVREETFFPLIPIVVPERDNDDALLEAFLRFVNTNSYGLRNSLWSRSDHVIETFVRRVVNGGLLKVNDSHIGFLPYLPSHGGTGRTGGAFGEANYPMLKTSHVQGVSIARDISPYDAVFGA

SEQ ID NO: 9821 - protein, 379 aa, Streptomyces avermitilis
VRSLDAARAVCEQFHPGLLKELEQIPFTDREKPGSPVIDLFRIHGGVGLLIPEEYGGHGAAPLDALRIQLALGAVSPSLVAAVSMHHFTAAMLYSLAVKAGRLTGAQTELLRRIVPDQQVMASGWAEGRTEQNILTPAVTARPVDGGYLLSGSKKPCSLSRSMSLLTASIAIHHDDGTAELALALVPADAPGLSVHPFWGNDLLAGAESDEVRLTDVFVPAGMVVRAGADDPHRLDDLQTAGFVWFEMLISAGYAGGAAALVEQVLERERGSVQERAELAVEMEAALALLEGVARAIGTEPGDEESVARVLVARYTVQKALPRIAARSLELLGGLDFIRGSAHAQAAAAVHALAFHPPGRGAAAEPLLRYFDGGALVLA

SEQ ID NO: 9822 - protein, 427 aa, Streptomyces avermitilis
VTVIQESPVDTEAEILGLYRAHLSKGRATLAELFGSHMETASEGAWLTTSDGERFLNAGGYGVFIMGARHPIVMEEVERQLRTHPTATRILLEPTVARAAEALVSVLPDGLDRVHFALSGAEAVETGLKLARAGGRKRTISMRGGYHGKTLGALSATAKDVYQAPFRPLVPDFQHLPFGETDALEAELAAHPGEVCVILEPVQGEGGVIIPPAGYLKRVEELVRAHDGFLILDEVQSGFGRLGEWWGADTEGVVPDVLLTGKALGGGVMPVSAAVATRKAFRPFDKDPYVHTATFSGQPVLMAAVQGAIRAMKEERLVTRAMDLGAQLLPRIAEIAYRNIPELVVDVRGQGLLIGVELVEAGLAGELLIELFNHGVVANHSMNGSSVVRFTPPAVLSDTDVEFLLNSFDLATRDLVRGAAKMPEGGN

SEQ ID NO: 9823 - protein, 160 aa, Streptomyces avermitilis
VRHVELEALIPAEQATTVFDSVRRWERYPDLAPHVKQTTVHATYPAEDASSSWELHFRSGLLRWTEDDVFVPERGEIRFEQSDGDFDSFTGTWTLTQQGDDVAVRFDADFDFGIPSLEGILDPIAERVIKETVAWALTGLFPAVRLSGGVELTEPAAVGV

SEQ ID NO: 9824 - protein, 178 aa, Streptomyces avermitilis
MDQANPFETPRTYSLHRAEYLVGLAVTTGLIVAHFGEIRWWPAIALFLYIDLIGYIPGAIAFKRSGGQPISKTYYVLYNVMHSLITQGAVAALWCWLVKPEWALLVLPFHLFGDRGLFGNFMKSFALPFEPVRQSGYLRLLDDLGLAHPKPVGHAVEPTPVGHVPAPRVRQEQREAVR

SEQ ID NO: 9825 - protein, 184 aa, Streptomyces avermitilis
MSTATEVRAPRRPVRQDPVERRRALYHLASPVSVLTVGPEERLHGTTASTVTLVSREPLLVGVVLRAGSSFARLAAAEGRFAINVLSDEQAVVARHFADSGRPDGSEQFAGLAWTADSYAHAPLIAGALAHYTCRFHSAHAAGDSELLLGHVVRARTGDGLPLFSYAGGLFAGSLRPAKEAAAS

SEQ ID NO: 9826 - protein, 327 aa, Streptomyces avermitilis
MTGSVAPEADWDKAPGLLDGAKDLTLGPEECNLAYWFTSVAQGTLRDRGETGHHVNATVPAFLKEPGPLRDALVLEFGFRGLSEEIATRLLGHYVAIAPGVPELEFYATQLIDEARHARVFRNHLVELGMPAGTLLKDIDEMAADYRKRVLDPVVDFTLDIVRDQADFPGGVAVFAIVIEGALAPAAELSERKWTPLSPATGEISRGTAIDEIRHLTVASTILRDHAVEHPEYRPRLLEILRAGVRLWDEIPDREFVIHREELFQEGMAQHADKIGDYEIWPGVRMLDTTPEQRYDMAERWTDEMAESRMAYMGLPLDVLSSPEAGT

SEQ ID NO: 9827 - protein, 335 aa, Streptomyces avermitilis
MSGGRAAVITGIGGYVPPDLVTNDDLAQRLDTSDAWIRSRTGIAERHVIAPGTATSDLAVEAGLRALKSAGDEHVDAVVLATTTPDQPCPATAPQVAARLGLGQVPAFDVAAVCSGFLFGLATASGLIAAGVADKVLLVAADAFTTIINPEDRTTAVIFADGAGAVVLRAGAADEPGAVGPLVLGSDGELSHLIEVPAGGSRQRSSGPTTDPDDQYFRMLGRDTYRHAVERMTDASQRAAELADWRIDDVDRFAAHQANARILDSVAERLGVPAERQLTNIARVGNTGAASIPLLLSQAAAAGRLGAGHRVLLTAFGGGLSWGAGTLVWPEVQPV

SEQ ID NO: 9828 - protein, 76 aa, Streptomyces avermitilis
MLEQLKEILSNKLKVSPEAITPEATREDIELDSLAVVELSLLLKSELDLDVSDDDLLEAETVADMVRLMEERSAKV

SEQ ID NO: 9829 - protein, 406 aa, Streptomyces avermitilis
MAGMDIAVTGLGLVTPGGIGVGPSWAAVCDGRPAAALDPVLADNPVRISCRVPDFDPEQLLSARRAHRLDRFVQFALVAAHEAVADAGLDPTTWDGARVGVVLGCADGGPGTVEEQHRVLLEQGADRVSPLLLPMQLPNMLAGQTAIEFGATGPNLVVATACASGATAIGTARDLLALGRCDVVLAGGSEAMITPLVMAGFAQMGALSRREDDPASASRPFDADRDGFVAGEGAGILVMERVEDARARGAHIHGRIIGYGATADAHHMTSPHPDGAGIEAAVRAALADAGADPDDVQHVNAHGTSTPLNDLAEARMIQRTLQGDPLVTSTKGVTGHLLGAAGAVEAAFALLSIEHEMVPPIAGLCIPDPRIDIKLAQSATSMPIDLALSNSCGFGGQNTALAIAPA

SEQ ID NO: 9830 - protein, 506 aa, Streptomyces avermitilis
MSKIGSPPTDRRTVAVTAPPGRLDTRHILFLIVAAAAPLSAMVGTVPLAFAFGNGAGVPAAFLFAGVTLLCFSVGYAVSVRRTGGSGGFYASVADGLGRPPAVAAGFVALLAYNCATIGLAGALGYFTQLVLAAHGFTVSWQWCAAVGLLAVAVLGYREIALSARVLALLMLGEIGVLAALDVAILVRHGLSALPTASFSPHTATGPGLGVALMFAFVSFIGFESAALYGKEARDPQRSVPRATYAAVVLIAGFYALTSWLAVGAVGTGKVREVATRQMGDLFFVLGDDFLGKAGSTGLQILLCTSLFAATLALHSAANRYAQVLAEDGLLPASLGAEHPRHRSPHRASVAQSVLTALVVGGFAVAGLDPYADLTTSMLGLGTLGIVVLQALAALSVLGLRLRRPGGRAHWWRELVAPLLGFAGLAVSVWLVVGNFDMLTGSPDPLIARLPWLLVAVAALGLGYAAWLRAARPGRYRLLGTRHLTTSDEPPATAVPTSGVRHARSQ

SEQ ID NO: 9831 - protein, 427 aa, Streptomyces avermitilis
MHDPSELLEDGPAAVRRLARRRYDLDLAALEKAVRRRSEAQAEVTRLRTELNRTSRARGRSGPPSEEEKEAARALRADVQQAEATARTAGHDLTELLLGIPNVPLDSVPDGDTDQEAVEVRRWGRPPHDAGTDARHHSDIGESLGILDGPAAAKLSGSRFSVGRGAGARLERALADFFLDLHTGEHGYTEYSVPFLVNRDTMTGTGQLPKFEDDLFRTQVGDRELFLIPTAEVPLTNLVAQQLLDARALPYAFTARTPCFRAEAGAYGRDTRGILRLHQFEKVELVRVCAPEDAPAQLELMVGHAEECLRRLELSYRVVQLPAGDLGFSARMTYDIEVWLPGSDAYREISSVSDCGTFQARRADIRHKRADGRKAPAATLNGSALPIGRTVAALLEQGVREDGSVLLPEALVPYTGFRRILPGGATA

SEQ ID NO: 9832 - protein, 260 aa, Streptomyces avermitilis
MSGVLAGKRILVTGVVTEASIAFHVARLAQEEGAEVVLTGFGRLSLIERIAARLPKPVPVIELDVTDQAHLDTLADRIRESVDGADEHYGLDGVVHSIAYGPQGAFSFLDGDWADVSTAVQVSAYSLKSLTTACLPLLERRGGSVVGLTFDATVAWPHYDWMGVAKAALESTSRYLARDLGGRGIRCNLVAAGPLRSMAAKSIPGFGELAEVWQHRAPIGWDLVDPDPAARGVVALLSDFFPRTTGEIVHVDGGVHMMGA

SEQ ID NO: 9833 - protein, 108 aa, Streptomyces avermitilis
MTYVIALPCVDVKDRSCVGECPVDCIYEGRRALYIQPDECVDCGACEPVCPVEAIYFEDDVPAEWGDHRGSNADFFDALGSPGGGTPLGALDTDSPLVRSLPQKVVQS

SEQ ID NO: 9834 - protein, 469 aa, Streptomyces avermitilis
MSQTTTAVSGVSAPVSIGVRLDRMPITPMHRRLTAVIGIGLLFDTFENSLSGTIAKVLQGDFAFGATSLKLVLASVFVGQFIGSLVLGRVADRFGRRRAFLINLAIYSGFSLLGAFSPNAGWLIATRFLAGIGIGAEQALSDCYLADVLPAAKRGRFIAWAYTLAFCGVPAVGFAALWLVPLTPLGVDGWRWLFVIGALGSAVVWVLRRQLIESPRWLAATGRTAEADRLVSRMEAQAPAGRTAEDLPAPYEAPGAARVRLRDVFAPGLRRRTVMLWIFCALSVVGYYGFGTLAPQILAAKGFDIVAGLGFTALCFLGYPVGSALSLPVIDRVERKTLVAASAAAMVAAGMGFAFTDSPALIVAFGFGYTLCSNVFSSVSHVYLSEQYPTAIRATASGAAYSLSKLSAAALPFVLLPVLDSYGPGALFAVIAAAMAALAVTVLTLGERTTGASVDRAPVPVNIPTLKRS

SEQ ID NO: 9835 - protein, 365 aa, Streptomyces avermitilis
MQRPHVQEAEATAAPQQRTGASATFAELLKRVKAEGLLDLDPRYYIGRLALNTTLLLVGFAAFFALGDSWWQLVVALWMGLCGGQSAFMWHDAGHKAMFRSKKAASAVGYFHANLVNGVSFGWWVNHHNRHHSNPNHLDMDPDIGRRTAIFDIKQYPTRRGTQKFIVRYQSVLFFALLVTESFKMLKTAVLSIAQGKTKRPVLESFLLLARAAVYLTLVFTVLSPVLAVAFVLVQQAALGVYFGMIFAPNHKGMEVRDGDEETLDWLERQVLTSRNIRPSLFIDFLYGGLNYQVEHHLFPAMPQKNLARARELTRAYCAERGVPYHEVGFWASYREVASFLHEVSAPVRRGDVEEQIRRQAGQAA

SEQ ID NO: 9836 - protein, 66 aa, Streptomyces avermitilis
VSDSEETPATGTPTDGTTTTESLQHALVGQLMAIIGAPDDEDVARAADDIVQALDIRLREAQTAAA

SEQ ID NO: 9837 - protein, 331 aa, Streptomyces avermitilis
MPATTTDNPILGAIRTHTQSENPSSFLALNSGNSTFTVPGADGVVVYRRTGRYAVQFGGPFAAPDAYDTLLDAFRQYVKDEGLHLVAVQLQRPDAERYAGRGFTVNQVGASWAVQLPEFSLRGTRFMQLRNKISRAHRNGLQIKEVTAEDWQDAIATIDEAWLGSKGGAQQLEFLVGQIGGEPQAQRRLFAGTIEGAPVAYISYSPVYGERAGWMHDLSRRIPEGSPGLMEAINAHAIEVFRAEGVEWLHFGFTPFTGLDASHELDGHSPAFQWLMHALWAEGAALYPAQTQLSYKQKWAPDALIPEYVAFDGPSASLAGFAHVFRACKAF

SEQ ID NO: 9838 - protein, 265 aa, Streptomyces avermitilis
MLSFSILGALQIRTALGPAEISGDLQRTLIQTLLVNEGQSISGESLVEEMWGEAVPDNQANALQAHISRLRRKLRSLEPDRTTSRVTIHPSGYRLTINESELDAAEFTKTVRLAEVATADDPAATARLLGGALAMWRGPVFGDFPGGTLCQLACARYEEYRMRAMELRFDAELRLGHHAAMLAELHDAHTNHPLRERFCEQLMIALYRSGRQADALNVYRRMWQHLSDELGIEPSPALRRVENAILSHDPALAGDTPAPIILQPA

SEQ ID NO: 9839 - protein, 143 aa, Streptomyces avermitilis
MTTSQTSARPATTAGRAAAARPLRTFLALDAAVTAVNGLIYLLAAGPVGDLLDLDTGLLRGIGAFLTVYGVLVAVLASRQVPSAVATKAVIEANLLWAVASVATAVFGWFDPNTVGTVWIPLQAAVVAGFAVLQINGLRRLAG

SEQ ID NO: 9840 - protein, 514 aa, Streptomyces avermitilis
MRFQVAELAEIREQVHAGPGEKATAAQHAKGKLTARERIGLLLDEGSFHEVEPLRRHRATGFGLEAKRPYTDGVVTGWGTVQGRTVFVYAHDFRIFGGALGEAHAAKIHKIMDMAISAGAPLVSLNDGAGARIQEGVSALAGYGGIFQRNTKASGVIPQISVMLGPCAGGAAYSPALTDFVFMVRETSQMFITGPDVVKAVTGEEITQNGLGGADVHAETSGVCHFAYDDEETCLDEVRYLLSLLPGNNRETPPSVPSEDPPDRRCEALVDLVPVDGNRPYDMRQVIEEIVDDGEFLEVHERWATNIICALTRLGGQVVGIVANQPRSLAGVLDIEASEKAARFVQLCDAFSIPLVTLLDVPGFLPGVGQEHGGIIRHGAKLLYAYCDATVPRISLILRKAYGGAYIVMDSQSIGADLTYAWPTNEIAVMGAEGAANVIFRRQIAEADDPEAKRAELVKAYKAELMHPYYAAERGLVDDVIDPAETREVLISSLTMLRTKHADRPARKHGNPPQ

SEQ ID NO: 9841 - protein, 61 aa, Streptomyces avermitilis
MTTPCIRIEKGAATDEELAALTVLFLTRAPRPEPDTAPPSPGSTTAWRPDPFHAPHSWQAP

SEQ ID NO: 9842 - protein, 132 aa, Streptomyces avermitilis
VRTERINPPELSPPTGFSHAVAVTGTRVVFLAGQTALDTDGKVVGETLPDQFGRALTNLLTALRAAGGVPADLARVTVYATDIADYRAHARELGGIWRELAGRDYPAMAVIGVARLWDEQALVELDGFAVLA

SEQ ID NO: 9843 - protein, 375 aa, Streptomyces avermitilis
MTAFSLDPAQTARRAELRTLAADRLRPLAEKGEPGHVNRPLVAELGRLGLLERLFTAGALDLCLLRESLAYTCTEAETALALQGLGAYPVHGYGTRAQRECWLPRVSDGSAVAAFALSEPGAGSDAAALSLKAEPDGPDGWRLTGEKCWISNAPEADFYTVFARTTPGAGARGVTAFLVPADRPGLTGTPLDMLSPHPIGALAFDAVPVTADDVLGEPDHGFRVAMHTLNLFRPSVGAFAVGMAQAALDATLAHTSGRDAFGGKLRDLQTVAHQVAEMALRTEAARLMVYAAAAAYDEAAPDVPRRAAMAKLLATETAQYVVDAAVQLHGARALRRGHLLEHLYREVRAPRIYEGASEVQRAVIAKELYATVEAP

SEQ ID NO: 9844 - protein, 594 aa, Streptomyces avermitilis
MDPRNGTDPRNGTDPRNGTDSGNGTAPRDAVDDRRPTASAHVDTFARDHLPPPEQWPELHFDLPELRYPERLNCAAELLGRTDAGRPAFRTADGDVWTYGQLRARVDRIAHVLTSRLGVVPGNRVLLRGPTTPWLAACWLAVLKAGAVAVTVLAQQRPHELATMCGIARVTHALCDVRAVDDLAKAEVPGLRLTTYGGDAPDDLLRLPAPDEAYPAVDTAADDVALIAFTSGTTGRPKGCMHFHRDVLATADTFSKHVLRPQEDDVFAGSPPLGFTFGLGGLVVFPLRAGASALLLEQAGPRQLLPAIAEHRVSVLFTAPTAYHAMLDELPAHDTGSLRRCVSAGENLPAATWRAWHERTGLRIINGIGATELLHIFISAADERIRPGMTGVPVPGWHARVQDENGTPVPDGEPGLLAVRGPVGCRYLADPRQREYVRGGWNVTGDTYVRDPDGYFRYVTRADDMIISAGYNIAGPEVEDALLRHPDVTETAVVGRPDEARGQVVVAYAVLRAGARRDAEALGAFLRSELAPYKCPREFVFLDALPRTATGKLQRFRLRDNRRTDVDSVPPEASVPAETSVPAEAPVPAEGDHE

SEQ ID NO: 9845 - protein, 280 aa, Streptomyces avermitilis
VINVSDQHAPRSLIVTFYGAYGRFFPGPVPVAELIRLLAAVGVDAPSVRSSVSRLKRRGLLVPARTAAGAAGYALSPDARQLLDDGDLRVYATTPPRDEGWVLAVFSVPESERQKRHVLRSRLAGLGFGTAAPGVWIAPARLYEETRHTLGRLRLDPYVDFFRGEHLGFAATFEAVARWWDLAAIAKQHEEFLDRHARVLHDWEAREDTEPEEAYRDYLLALDSWRHLPYADPGLPAALLPEDWPGARSAAVFRALHERLRDAGAAFAAGTETLDPAGET

SEQ ID NO: 9846 - protein, 299 aa, Streptomyces avermitilis
MSLMRNLNRALTATTGLQVRRAAADAPPQPKKTATAAKPAGRPTPVYRCPADKDLSTDRLLRRPVFIMSPVRSGSTLLRMLLNAHSRLHSPHELHIRRLEVDYGSKLSQRAMSALDLERGDLEHLLWDRVLHRELVRSGKDFIVEKTPSNAFVYRRIRDCWPDARFVFLLRHPVSIAQSWHEGDPDKRTYDEAAADALRYMKAVDNARKGITGGHTVRYEDITAGPERELRRLCVFLGIDFEPTMLEYGRKDDSQVVKGLGDWRDKIRSGSVQAGRSLPAEDEIPELLRPMCKAWGYSS

SEQ ID NO: 9847 - protein, 136 aa, Streptomyces avermitilis
VKPHAEIAEVWPRDGYIRLVGRIHGRPADGSWRLLVTRRARAEQRLDYRARVEGDRFESELPIADLAVPDGAGVEEWDIHLTDGAAELRAGRRLDDICGKKKIMVFPRQLTQDLSVRPYYTVKDNLSLECRTGAAS

SEQ ID NO: 9848 - protein, 388 aa, Streptomyces avermitilis
MNQANSLVAAGWDVELVSAVRRRDDIQFPLDARVKVSTVVDLREDAHVPPAGPVARWRDRRRGRLLDRPARHIPAGEFGYRYFNRYVEERLIAYLRTLTDGVLVTTRPALNFLAAEHASRGVIRVAQEHMNHGTHKRDVQQRIRETYPRFDTVAVLTERDREEYEALLPGTRVVRIPNAVHSLDQVPARPRSKIAVAAGRLFPQKGFDLLIPAWAKLVEAYPDWQLRIYGSGEKKAELRALIEEHHLYNHVFLMGHTDRLDDELAKASFYVLSSRFEGLPMVMIEAMSHSLPVVGFDCPTGPSDVLTHGVDGLLVPPEDPDALADAMAKLMKDEGLRAEMGVAAVLTAASYGPDAVHPRWEALFTELATRPGRHGQRRPGGAAKGPHA

SEQ ID NO: 9849 - protein, 183 aa, Streptomyces avermitilis
MTTTSRAQGATVWLAGLPSAGKTTIGRILAGRLRSQGHRVEVLDGDEIRRFLSAGLGFSRADRHTNAQRIGLVAEVLARNGVLAVVPVIAPYADSREAVRKRHEASGTPYLEVHVATPVEVCSERDVKGLYARQAAGRLKGLTGVDDPYEPPVDPALTLETQGQTPEESAGAVYAVLAARGLV

SEQ ID NO: 9850 - protein, 311 aa, Streptomyces avermitilis; identical to SEQ ID NO: 9669

SEQ ID NO: 9851 - protein, 406 aa, Streptomyces avermitilis
MTSTTTATTDTLRFATAGSVDDGKSTLVGRLLHDSKSVLADQLEAVEQVSRSRGQDAPDLALLTDGLRAEREQGITIDVAYRYFATARRRFILADTPGHVQYTRNMVTGASTADLAVILVDARNGVIEQTRRHAAVAALLRVPHIVLAVNKMDLVGYEEKEFDRIVEDFAGHAAELDLPGFTPVPVSALCGDNVVERSAHMDWYAGPALLDLLETVPVGAESAGAPARFPVQYVIRHDGVRHYAGQLVSGSLRVGDRVTVHPSGETSEITGIDVLGTTARAAYAPQSLTLRLAGQRDIARGDMITAGPDAPELTRDVRAAVCHLADRPLRIGDRVLVKHTTRTVKALVKDLAGATELTANDLGRIALRTAEPLALDDYARVRRTGAFLLVDPADGATLTAGMADLS

SEQ ID NO: 9852 - protein, 755 aa, Streptomyces avermitilis
MRVAVVGGGPGGLYAAALLKRLDPSREVTVWERNAPDDTFGFGVVLSDETLGGIEHADPVVYAALRDEFVRWDDIDIVHRGVRHTSGGHGFAALGRQRLLGILHERCRSLGVELRFGTEAPYPAWLTETYDLVIAADGVHSSTREAYAEAFRPSVETHRCRYIWLAADFAFDAFRFEIAETEHGVLQLHGYPYAADASTVIVEMREEVWQAAGFAELDERESVERCAKIFADALGGRSLRSNKSAWTHFRTVVNERWSHGNLVLLGDAAHTAHFSIGSGTKLAVEDALALAACLEEQPGLPEALAAYEQERRPVVASTQRAARASLEWFENIGLYLGRPSRQFAFNLLTRSRRVTHDNLRLRDAHFTEAVEREFGCPSGTPPMFTPFRLRGLTLRNRVVVSPMDMYAAVDGVPGDFHLVHLGARALGGAGLVMTEMVCVSREGRITPGCAGIYTGRQAEAWRRITDFVHTRAPGVGIGVQLGHSGRKGSTKLMWEGIDEPLEEGNWPLVAASPLPYKPGSQTPRALSRAQLTDIREQFTDAAWRAARSGFDLLELHCAHGYLLSGFLSPLTNHRTDAYGGSLARRLRFPLEVFDAVRSVWPEERPMTVRISATDWAEGGTTAEDAVEIARAFAAHGADAIDVSTGQVVADEQPAYGRSYQTPYADRIRGEAGVPVIAVGAISSWDDVNSLILAGRTDLCALARPHLYDPHWTLHAAAEQGYTGPGVVWPAPYRAGSRRPQSGRTDAPKPRLTLGT

SEQ ID NO: 9853 - protein, 275 aa, Streptomyces avermitilis
MSPFTGSAARTPDWKHLGVEIADGVATVTLARPEKLNALTFGAYADLRDLLAELSREKSVRALVLAGEGRGFCSGGDVDEIIGATLAMDTAQLLDFNRMTGQVVRAVRECPFPVIAAVHGVAAGAGAVLALAADFRVADPSARFAFLFTRVGLSGGDMGAAYLLPRVVGLGHATRLLMLGEPVRAPEAERIGLISELTDEGHADDAARTLARRLAEGPALAYAQTKALLTAELDMPLAASVELDAATQALLMNGADYAEFHAAFTEKRPPKWQGR

SEQ ID NO: 9854 - protein, 166 aa, Streptomyces avermitilis
VRRTIPDVESRTACSMNGPTLHEPPTPPASWRVALPHTAAAVPVARALVRSALAELKHSADSDTAELLTAELVANAVEHTAGEGPIELVVELLPTGCQVEVHDPDPAPPGNLTVPGPREEPDPWQEHGRGLLLIRALSSACGHRPTGSGKAVWFRLPVIPPQRRFA

SEQ ID NO: 9855 - protein, 480 aa, Streptomyces avermitilis
MPALRIKSPELLVAESGADLEGHGLKRTMGLFQLICFGVGAIVGTGIFVGLSDSVAQAGPAVVVSFVLAAITCVFTAFAFAELGGAIPVSGSSYSFAYAGLGERTAFLVGWCLLLEYGVSVSAVAVGWSQYVNELLDSLTGLELPAALSAGPGDGGVINLPAVVVIALASVLLVRGVRESARATAAMAVLKLAILVVFCAIGFSAFKDGNLTPFSPAGLGGIGAGTTAAFFSYIGFDAITTAGEEARNPRRDIPIAILVCLGLATLLYCAVALAAIGAIGGDQVGGRPAALSYVVNEVTGSTAGGAVIAFGAVVAIASVVLAVMYGQTRILMSMARDGLVPRVFERVSPKTSTPVTGTLLVALVFAVPAAFASLDAVVNLCTIGTLAIMAVVNVTVIALRRREPGLTRSFRVPLYPVIPVLGVGFCLYLMYETGWTTWIQFAAFLAAGCLVYALYGRRNSRLAKSAAATRTDAEAVSQAV

SEQ ID NO: 9856 - protein, 335 aa, Streptomyces avermitilis
MATVPTALAGRHFLKELDFTAEEFRGLLELAAELKAAKKARTETLYLRGRNIALVFEKTSTRTRCAFEVAAADQGASTTYLDPAGSQIGHKESVKDTARVLGRMFDGIEYRGHGQGVVEELAAHAGVPVYNGLTDEWHPTQMLADALTMTEHSDKPLTEIAYAYLGDARYNMGNSYLVTGALLGMDVRIVAPRLLWPDETIVEVAQQLAVASGARITLTEDVKEGVRGADFVATDVWVSMGEPKEVWDERIGLLGPYAVTMDVLRATGNDDVKFLHCLPAFHDLGTDIGREIHARHGLTSLEVTDEVFESAHSVVFDEAENRMHTIKAVLVATLA

SEQ ID NO: 9857 - protein, 409 aa, Streptomyces avermitilis
MGLHVDSEAGRLRRVILHRPDLELKRLTPSNKDALLFDDVLWVRRARAEHDGFADVLRDRGVAVHLFGDLLTEALDIPAARTLVLDRVFDEKEYGPLATDHLRAAFETLPAPDLAAALVGGMTKREFLEAHPEPVSVRFHVMDLDDFLLGPLPNHLFTRDTSAWIYDGVSINAMRWPARQRETVHFEAIYRHHPLFRDEAFHVWSEGQADYPCTIEGGDVLVIGNGAVLIGMSERTTPQAVEMLAHKLFAAGSARTIVALDMPKRRAFMHLDTVMTMVDGDTFTQYAGLGMLRSYTIEPGVGEKELKVTDHPPEHMHRAIAAALGLGEIRVLTATQDVHAAEREQWDDGCNVLAVEPGVVVAYERNSTTNTHLRKQGIEVIEIPGSELGRGRGGPRCMSCPVERDAVPG

SEQ ID NO: 9858 - protein, 340 aa, Streptomyces avermitilis
MADITRRFGWRHLRGAPTAHVRHQRAGRLVHDGPGLSFWYRSLTAALSEIPVDDRELAMTFHARTSDFQDVAVQATVTYRISDPGVAAARLDFSVDPDTGVWRGAPLEQLATLLTETAQQHALDVLARTPLSAALVDGVAAVRDRVAAGLAAEPRLPATGIEVVAVRVVALRPEPEVERALRTPAREQIQQEADRATYERRAVAVERERAIAENELASQIELARREEQLVDQRGTNARREAEEHAAADAVRAEAEAARTVRLAKAEAQAAREVGEARARAQAAWLHVHAEVDVATLHALTGTRLAENLPRIDSVTVSPDVVTGLLSRLGAAAGGPSGEPA

SEQ ID NO: 9859 - protein, 297 aa, Streptomyces avermitilis
VSLAPRVVLVHRTTEYEELVARHGTPGQAAFFLASRGRSVDEVAERHRRARRAWAEVVAAVPLTWRQARVERRDLDRFLFAPEDVVVVVGQDGLVANVAKYLAGQPVVGIDADPGRNPGVLVRHRPGDAAALLASARSGHADELTMVEAVADDTQRLLALNEIYLGAAGHQTARYRLGLDEYGGAVEPQASSGVLIGTGTGATGWIRSVWQERGEGLPLPAPVEDRLVWFVREAWPSPATGTSLVAGELTASARLSVTVESDRLIAFGDGMEGDALELTWGQTVRLGVAAVRLRLVG

SEQ ID NO: 9860 - protein, 848 aa, Streptomyces avermitilis
MTNGTQMKARTLAVTDLSLVVLIGASGSGKSTFARKHFTPTEIISSDFCRGLVADDENDQSASRDAFDVLHYIAGKRLAAGRRTVVDATSVQQESRSQLIELARKHDVLPIAIVLDVPEEVCAERNAARTDRADMPRRVIQRHTRELRRSLRHLEREGFRKVHVLRGVEEIENASVVTEKRFNDLTHLTGPFDIIGDIHGCAAELESLLGKLGYADGVHPEGRTAVFVGDLVDRGPDSPGVLRRVMSMVGSGNALCVPGNHENKYGRHLKGRKVQHTHGLAETVEQMEGESEEFRTQVREFIDGLVSHYVLDGGRLVVCHAGLPEKYHGRTSGRVRSHALYGDTTGETDEFGLPVRYPWAEDYRGRAAVVYGHTPVPQATWLNNTICLDTGAVFGGKLTALRWPERELVDVPAERVWYEPAKPLATEAPGGHEGRPLDLADVRGRRVVETRHAGRVSVREENAAAALEVMSRFAVDPRLLPYLPPTMAPTATSHRDGYLEHPAEAFAQYRQDGVARVVCEEKHMGSRAVALVCRNAEAARERFGTDGPTGSLYTRTGRPFFDDADRTEEILGRVREAVGAAGLWEELETDWVLLDAELMPWSLKASGLLRTQYAAVGAASGAVFPGALAALEGAAARGVDVGELLARQRERAADAAAFTDAYRRYCWATDGLEGVRLAPFQILAVQGRSLAAVPHEEQLALLDRLVEHDASGLLGTTRRLFVDTGDPESVQAGVDWWLEMTGRGGEGMVVKPAGAVVRGEQGRLVQPGIKCRGREYLRIIYGPEYTRPENLARLRGRFLNHKRSLAIREYALGLEALDRLAEGEPLWRVHEAVFGVLALESEPVDPRL

SEQ ID NO: 9861 - protein, 495 aa, Streptomyces avermitilis
VFLTISATGTPERPATDLGFLLHKHPDKSQAFSTSYGTAHVLYPEASVERCTAALLLEVDAVALVRRGKGKGRGGAPDAALAQYVNDRPYAASSLLAVALSSVFSSAMKGTCAARPDLPARPLPLRIEVPALPARGGPDIVRALFEPLGWTVTARPVALDAAFPEWGDSRYVGLVLESAELTLAEALRHLYVLLPVLDDAKHYWVASDEVDKLLRAGEGWLPDHPEHKLITSRYLARRWSLTRQAMDRLELVRLAEADDSEVEEIDNAVDESTDTEEKPVPLAVRRRDAIIAALQASGAARVLDLGCGQGQLVQALLKDVRFTEIVGVDVSVRALTIAARRLKLDRLGERQASRVTLFQGSLAYTDSRLKGYDAAVLSEVIEHLDLPRLPALEYAVFGSARPRTVLVTTPNVEYNVRWETLPAGHSRHGDHRFEWTREEFRAWARRVAERHGYDVEFTPVGPDDPEVGPPTQMAVFSMTSAHSNTPTTAKEEKAA

SEQ ID NO: 9862 - protein, 308 aa, Streptomyces avermitilis
MDLRVFTEPQQGATYETLLRVAQAAEDLNYDAFFRSDHYLHMGSVDGLPGPTDAWITLAGLARETRRIRLGTLMTAGTFRLPGVLAIQVAQVDLMSGGRVELGLGSGWYEAEHEAYGIPFPKEKFGRLEEQLAIVTGLWSTPVGERFSFDGTYYQLKDSPALPKPAQGKVPVLIGGHGAKRTPALAARYADEFNIPFASLADTEQQFNRVRAAAEEAGRRGDDLVYSNALVACVGRNDVEVKRRADVIGRDVDELKANGLAGSPAEVVEKISQYQAVGSQRMYLQMLDLDDLDQLELIAAEVMPQLDR

SEQ ID NO: 9863 - protein, 153 aa, Streptomyces avermitilis
MDVVRLIVASRRALAGSDAAPQIMTEAWQAYALAQAIGSRLAVSGPPELRGEALGLTELAGRGCGVLDTPSLDVADLRAAQLTELGDAREALLDLGDLLAEVGMALVALASAADGEGTYWQCMEAIDAADESRDRVREMLRRLAARDGALPQP

SEQ ID NO: 9864 - protein, 110 aa, Streptomyces avermitilis
VKELDVAHLQRRLADFAAARDWQPYHTPKNLATALSVEASELVEIFQWLTPQESERVMDDPDTAHRVTDEVADVLAYLLQLCEVLDIDALAALDAKIDRNEKRFPVPGTD

SEQ ID NO: 9865 - protein, 405 aa, Streptomyces avermitilis
MTVSSLSTGSLPAPLSFEPSLSSPASGAVVDAGPRPDRPHVSELRLSAFAGHRRAGFPLGPLTLFTGPSGCGKSRALQAYEALARLAGGAELGAAFPDPAACVPQRARPDAQRRRGFRIGCTTDGPEGPVRLDVAVQAEPVPRIVGERLTSGGLVLLETALRDPGRRVVQAAWHTAGSAPVTRGPLPDDRLGTALLPLRVAGKTDGQRRVLAAAEQMVVALRSVFACDPRPHRMRAPAPLGTGRLLPGCANLADVLWRTRSECGRRHALLVEAVRAGCAGPVEDMLAEPAGDGTVRALLDRGDGSRTPLALLGDGELRYAALALVLLTGPGVLEVDPAGEVPQALQTLTVLADGLDRCMDPRQARELVRLAARMCERGHIRLVGAVSDTSWAAGAEGVTVVDLSA

SEQ ID NO: 9866 - protein, 134 aa, Streptomyces avermitilis
VRGGPVNSHDVTDEQWEGLAQVVPLRGRDAWPSAVGHRSIPEAQTEARRRFVVLRVNIFADARDVAETLMRGIPVLLDLTSAETEVAKRVLDFSTGVVFGLASGMHRVDRNVFLLTPPGTEVQGLMEGVGVPGI

SEQ ID NO: 9867 - protein, 1352 aa, Streptomyces avermitilis
MTTTPEAERTRTAEQVRTVCSYCGVGCGIVLDVGTGPDGRRTVLKASGDKEHPANRGRLCTKGATTADMLAAPGRLTSALVRDDRGAEPVPAPVDEAVRETARRLRAIVDEHGPDAVAFYVSGQMSLEAQYLANKLAKGFVRTNQIESNSRLCMASAGTGYKLSLGADGPPGSYDDLDKADVFLVIGSNMADCHPILFLRLLERVKAGAKLIVVDPRRTATAAKADLFLQVRPGTDLALLNGLLHLLYENGHTDAEFIARHTEGWEAMPDFLADYPPATVSEITGIPEDDIRAAARLIGEAGEWTSCWTMGLNQSTHGTWNTNALVNLHLATGAICRPGSGPLSLTGQPNAMGGREMGYMGPGLPGQRSVLVDEERAFVEELWELAPGTIRADGVGRGTVEMFRKMADGDIKACWIICTNPVASVANRKTVIEGLEAAEFVVTQDVFADTETNAYADVVLPGALWTESPGVLVNSERVLTLARPVVEPPGEATADWRLIAAVAREMGYTEGFAYESAEQVFEEIKRAWNPKTGWDLRGVTYERLRSTPVQWPAARADGPARNPVRYVADGLVFPTASGRAVFHARPHLPAAELPDDDFPFVLNTGRVQHQWHTLTKTGKVAKLNKLNPGPFVEVHPRDAAALGVVDGDSVEVASRRGRAVLPAVVTDRVQPGCCFAPFHWNDLFGEYLSINAVTSDAVDPLSFQPEFKVCAVALARVASPPSALPVRSLDAAPPAPDGGLTASSAPAGQAEIFGLTPGPPPVLTARERQYLTGFLAGLGSGAPGVPVLPAEAPFSAEHALWVNGVLAGMYSRAATAEAPAKPPGREVVVLWASQTGNAEEFAAATAERLTATGHRATLVGMDDTDVAQLPRTADLLLITSTFGDGDAPDNGSGFWDALSAEAAPRLDGVRYAVLAFGDSSYDDFCGHGRRLDTRLDELGAVRLAPRTDCEPDYEPYAGAWLDQVLGALGTKTDAPKPARPRKPEPAIARLTGNRLLSLPGAGKEVRRFTFDTSGTGLTYEAGDALGVRPVNSPDLVDEWLSVTGLDHSTPVAVEGVGEVPFAQALHRHLDITHITPDLLRFVSEHAHDNRELKKLLRPDNKDGLAQWSWGRQAVDVVAEHPVRATAEEWAEVFKRLQPRLYSISSSPLVDPHLVSLTVSVVRYEDRLGRPRGGVCSPFLADAEHHTPVPVFVQRSPHFRPPADSSTPMVMVGPGTGVAPFMGFLQERRALGHRAPNWLFFGEQHRATDFYYEEELTALLADGTLTRLDTAFSRDQRAKVYVQDRIREHGPELWHWLQNGARFYVCGDASRMAKDVDRALRDIAVTHGGLTEAEATAYVKQLAAEKRYVRDVY

SEQ ID NO: 9868 - protein, 570 aa, Streptomyces avermitilis
VHLAEAGPSTSGRRAGTPAAPDEAPAQWHRVLTLLACISLFIGTRQVWVQAASLRPVVAAVISLCYAGILTTGLLTLVVRRGRALARLDLGVLVIAVTLTLCAWVMNHGGTDEAVLTMQAAREFIAGRPVYEQPWPWLFGHGIALTPTMSGGYDFTYGYPPLCLLLTAALLWIGGTGAAAATLVSTVALLAGTVVLWWLLPVRWRSAATLVCLGFGLVPSYARYGYPAVVALALLIPVVVRWPRMGGGGWTDWGRAACLGAACAAQQLPWFLTPFLLAGVYALRRGERGPRAAVVAVGRIGAVAAGTWLLINAFFVVSEPRSWLSGIMLPLTQGAVIHGQGLVGASLYYTDGSGRLAWYSHASTLLAAVLLALLVLFMRRLGPAATVLPWCTFFLATRSQDGYYLLMTPLWLAAAVTAPPSAFASAWQPRLPFGAHRRRAARVGVVALLLALPLSAAAYAVTGAPPLRMEVLAVRRGTGTVTGLTLRVTNTGGTTMRPHFTVTTNQGMNRYWSVKAGPASVPAHGSARYELLPPDGRFKLPEPGVRIRLRAFSASPETLSSTDVRLQPKR

SEQ ID NO: 9869 - protein, 115 aa, Streptomyces avermitilis
MHLVPADRVDRSTIDGHRVCDAIAAIGEPHGVRAWADRFSLLADPGRLALLLALHRAGPLAVSDLAVATGMNDPAVSQALRLLRTAEVVVGEKAGRVVRYRVIDPVVLKLLEQVT

SEQ ID NO: 9870 - protein, 377 aa, Streptomyces avermitilis
VIHEVLERDRMTLPAQSSEAAASFRWRREDTVRTAGLLAVIAALHVVAFGVLFLLVVPGHYEVGSKAFGIGLGVTAYTLGMRHAFDADHIAAIDNTTRKLMADGKRPVSVGFWFALGHSSVVVVLAALIAGGTQLAGRVMNEDSTTHQVLGVLGTTISGSFLYLIAALNLVALVGILRVFRAMRAGTYDERELEQHLDSRGFMNRILGRFTKSITRPGQMFPLGFLFGLGFDTATEVTLMVMAGSGAAAGLPWYAILCLPLLFAAGMSLFDTLDGTFMNFAYQWAFSNPVRKVFYNLAITGLSIAVAFLIGTIELVGVLHDKLDLRDSVTGWIAGLDLDNVGYIIVGLFGVVWAAAITYWRVARVEQRWAVRPADGN

SEQ ID NO: 9871 - protein, 254 aa, Streptomyces avermitilis
MSPIRTTPIRTTLRRAGTVTALAAAGVLTAAGASFAHVTVHSESSAKGATDGVVTFRVPNEEDTASTTKVQVFLPTDHPVLGVLVTPQDGWSAKVTTTKLKTPVKTDDGTITDAVSEITWTGGRIRHGQYQDFDVAFGQLPDDADQLTFKTLQTYSDGNVARWIEETPKGGEEPENPAPVLRLTAKGAAEDTGSAADSDKSAAGSGSSETKAADSDSTARGLGIAGLIVGVLGLAAAGFAIARGRTATARSVDE

SEQ ID NO: 9872 - protein, 203 aa, Streptomyces avermitilis
VCMAGSTAMNASPTVRTVRAAVFAVGCVLLAVGGHALATGAVPPVWLDVAGFLPVFAAAFALGGRERSLAGIGGAMLTVQGGMHLAFDAVRPRAERMPMPGTAHGMHMAHQPHAMTSHAVAAHLAAALLASWCLRRGEAALWSLLRKAVAFVPGLAAWWRTAPLPAYAAAARPYAPGPRRPHRTLLRHALSRRGPPAGSPYPA

SEQ ID NO: 9873 - protein, 1667 aa, Streptomyces avermitilis
VTPGSAATGTSDMSGDFENSGEDSGGSGDALPRLLSALHGAVPGLDGTALAEALWLAARMARDQDPAVDAPARTATGTPETEGRAQRPSAPGPRQPFPVPDDDGTRAPDATDPAPAASPALPLHERLPGSGTTLRGHPVAAPRAAVLPHALELTRALRPWKRPWSEGRRAQLDMDATVDGYARSGELLPVFTAAPERWFDLALVVDRSPGMQVWRETIAEFAAVLDRLGAFRTLQVADLTFDTAQRPHTPGQLRSTDGRRLVVVVSDCTAKAWRRPEVWHLLRDWAGATPTAVLNPLPAKLWRRGGLNLPTVRFTPAAPGATRSRVPHEPPPLLDVSPDPDEDPWLPIPVLSLTPHSLGRWSRALMRGDPDGCTAVLVPPTGRLPGPARPRGVPLPPDTLAKGFLRTAAPRAARLAVLCSPFDRLSLRLLHVIRQELVPEATTADVAEVVTSGVFALEGDGTGPVELVLPAEAQTVLQEQLGAHEVWGIHRAISRHVASRGDGRALLSAAAYDPEGARELRGEREAFAEASRRTLELLGLAETGEKWVSGADGLPPAPPVFVEYNAVAEEMRAQIASGRSRVVLVTARNEAPGAGRTALALQVARLVREHFPDGQFHVDLRGSRRVPLPPDAALHLLLRLLGTPAEGIPREPDDIAAALHSALRGKRVLLVVDDASTPELLRCFAGEPPEGCAVIVTARGLPPGLPAHCSEVWLDSLSADGALTLLEATLRRTIRDDDLLRPLLSGTTWWPLTVRLLGSWLNSANPPELAYLLYGAGEQPLSLEGFLRLRLDHLPWASATALHQLAVAETGEFSFPEALALMGPVPDARRLLDTLVDEGLLERRGPDAYGFHGAVHDHLHGRTAYAVERGEAAARLLDFYRSAAATMYENRRPGTALARRLDAPPLPVRLPEGWIPNALALLDRTGRSALGAWVLFLLQDAGATTPYRTLYEQAAHTFLERTSDFVPGAWGVAALAHAQYEGGRPDDAWHTVEALSWPEVARWQGPLSGTNALLLGRLTLARGLLDRAVGELRLACLLFHEDADRHGEATASLVLARAFLRRDEPVQAVAPAVRAARFFEDLGLTAETGNALLCLESAFSATGADEELLTAQRRVRAHFRTRHLRDEEAQALARTAHTLLRLGRPAEAEEAARAALALLEGSDHEAAREAARNALNSSLHPGPAARTVIAVDTSPYTSAVGILDTVTRTLRSGTAVTADEQLAACTWHDSCLIFVDQAVPLGPLLTELADRLPAELEAVGELAPPRLAVHVGPLETDPVDLTSDVGVEYTRAMLRSAEFRRLSDHYPDHPTLCISPEAYKALTADGRPLLRFAPHLVTSAAGTEVCVVLTPLGHAYADDSELLRLARTFNELDPDGRRLAGALRDCFDAALDMENTGRFDLRQLRGRERALTALELERSLCRAFPFDAGESTDLVWRPSGRRAPVPFELRLSLTGPNWRFSPHTQDVLCLVVQADDRASRWSAGLIRVRPDALTRTSEPENDGTAVLTTSARRSAVLWLRRDAPLPENVLLHLDDATRAAILAPKDAVGRTAEFFRRVQGRPVPVTALRPLLRGQDHKRRVREAVVVLRPEGVLVVRGNSWGRAVAEALRLRRPAEDELLSVRLAAHRPGHGDRPTVSIGAGTWVVAASDDPVVPFVEGFPAPSWLS

SEQ ID NO: 9874 - protein, 314 aa, Streptomyces avermitilis
MTWQPFYVGTGQAPAGAEEQVVLPPAPPWREFPRRSQHRQFVPPPRLAEAVNAALALRRPLLVTGPAGSGKSTVIEQVAAELALGDVLRWHITSRSSLAEALYRYDALGRIHAQRLEGPGGSDDIAPFLRMGPLGTALLPSARPRALLIDEIDKSDLDLPSDLLDVLERGEFEIPELARYGTDVVPVREHGGERTHLIARGRVQCAEFPFIVMTSNGDRDFPAAFLRRCIRFTMPLPTPETLLRVVEAHMGPEKAAADETGRLITVFLERLTAGESLAVDQLLNAVHLLTGDGAPGDDRRQAIAELILRELSHA

SEQ ID NO: 9875 - protein, 701 aa, Streptomyces avermitilis
VIGAQCPALGLLPELEQAARSLHDTLTAPWAGACEKDHPERTTLRCGADVTQAEVERAVREAGRHAAAEGAVLVVALLGHGTPGGTSLYFAAGDSEPENPTKMVDVGSLLSQLLDTPGLDGVIALVDTCYAGNAAPDLKSLAGGIREGDTRLALLMGAGAKEEAYELRFSRTLVKVCGEGIEGAGETLSPAAVADAVRTDGGAEGQAILRTEFDGAQLAQERLWLARNARHSTPTGPLLGPVGAEELARALERLGGDPDSSGVSHPAKVTGLRDLDSLKPALSALPSSAERAWALGVLDALRDAVRTTALLTAWPGADLTTPLLRRTLAEVSPASTATLPESRGTGLLRDAVEHLLLRSPRAGQRRTVPLADFVAALARDTGVDPGTPELRRWAADLDAEIDLNDAFVRQADRTRDTRLRLVVSLHSAVGDDWPESLAAWLLDGDAVRHHEEFPCDPDRTGVEGRLGTVLRWASRHARVLGAPLYRVEIAAPAPLLVQWRPEETDFGMRLGADHDVVLRWSDRIQPPDHLWWINDRARKALEAMRACPDGTRADWLGESDTRQFQETYGRLMSGPRTRAVALTHRPSRLKDMMERLLAASPIVLWPDDEASVPDDVRAYLDTHWHLLPAEFCRAYRDKWSTCGDPAGATSAAASDRRRLAGLRTVWDGPEWLEFCTWFEQEQFTHEAAQEESATTDGEYPT

SEQ ID NO: 9876 - protein, 356 aa, Streptomyces avermitilis
VQERVPQRLPVLHRSRKDLCPAYVPNPCAPNRGSGKAMGRPRLVFVHGIGGPRDARADLDEWLRATAHGARAAGHSARISGLLGGWAADARFAYYGDLFRRSGAQGGPAAGAQDEDALVALLQEAVDERLTDPELTPAEAAALRRARAQLAPTGRAQGAGAPARHAVNALTSLLALPGLRATGGWLTARTTAGMLGQVARYLNRAEPDERGAALDDRIRSRVAECLDREGPTVVVAHSLGTVVALETLHAHRASVPLLITLGSPLGIRTAVQPRVRPQPLGTPECVGRWLNFWDRDDLVAARPALEKFVRPNAAGALPVSGRVDSDGAWVHPAAKYLAQPAVAGPLVEALTTAGGR

SEQ ID NO: 9877 - protein, 130 aa, Streptomyces avermitilis
MQSYTIGQAARLLGVSPDTARRWADAGRMATHRDEGGRRLIDGRDLAAFSVEIAKSGGEEDASYTSVRNAFPGIVTAVKLGDVAAQVEIQAGPHRLVSLLTREAVEELGLEVGVEATARVKSTNVHIDRA

SEQ ID NO: 9878 - protein, 139 aa, Streptomyces avermitilis
MSLSIRNQLPGTVTAVTRGEAMATVKVRLDGGQDITAAITADAVTDLGLTTGAAVRALVKSTEVSLATDAVEGVSIRNQLPGTVEGVAAGGAMASVRVTVEGGELTAAITKEAVTDLGLAPGSAVVALIKSTEIALEAV

SEQ ID NO: 9879 - protein, 222 aa, Streptomyces avermitilis
MTPPVHLAAQLAVNVLDAQSLLAAFGVLGVGVVLFAETGLLVGFFLPGDSLLFTAGLLCTGTADHGVKLSLGPLLVAAAVGALAGSQVGYLLGRKAGGALLARSRSARLHEGAKRAEELLERYGHAKAIVLARFVPVVRTVLNPMAGALDVPVRTFTLWQVVGGLVWSVGLTLAGYALGSSIPNVDRYLLPMVAVIVAVSLIPLAAEVLRSRRAARAKGARG

SEQ ID NO: 9880 - protein, 447 aa, Streptomyces avermitilis
MTRMPRRSGRPGGPGGPGGPGGSSTPGTPDPSSASSACSASTASTPSGTSSPSGTSSPSGASSPSGTSSTSTTSSTSAPDAPDAPDAPDAPDAPDAPDAPDAPDAPDAPDAPGAPGAPGAPDAPDAPDAPDAPDALEPPERARTRSRWHAAAALLVLVGAVFLAHDHWPVIEAGADRLAAADRGWLLVGATAAVSTWVSSALAQQGAVAQPLPGGRLVAVQFAASAANHVLPAGIGAGAVNLRFLTRCGLPVARSATALAVKTVAGAVVRGVLIAVLALACPGVLRVPHVPAVVHVPAVAVAIVLAVGAAIAALLSGPLRRAIRAVLADVRAVHRQPARAAALWGGSLAFALLHASVVVAVTQSLELPLSPALVALAYLAASGAAALLPTPGGIGSLDAALALALTLAGSPAATAASAVLGYRLLTVWLPLLPGLFVLGLLVRRKTL

SEQ ID NO: 9881 - protein, 519 aa, Streptomyces avermitilis
MANSSNVTLVGGRRPGPPAVVGTSWRGRGELALAALAALFTLAQLALVRPGMGLGWDETVYVSQISAQAPPAFFSAPRARGVSLLVAPITSWSSSTPLLRVYLALLSGLGLYLALRVWRGLFPARVLALAGALFASLWVTVFYGPQAMPNYWVAIGALICVGCFLRVRADRYGRADRYGRADRYAPADRYDRAALGGVGAGAALMAWMRPTDAIWTALPLLALLACVRGRRRPALLTALAVGLVAGAGEWVVEAYASYGGLGQRLSDASHIQGGLGWNIAVGDQLRSLGGRALCRPCTGAMPGVAVMAWWFVLPLLAALGLAVAVRARRTAATLVPLACATTAAVPYLFLIGYAAPRFLLPAYALLAIPVADALVHLVSVPRRAWRPVAVALVTLVLAGHLAVQYAVLEKAVDRTTAAHRGWARTAGELHRLGVRPPCLLTGSEAIPIAFYTGCSSAQTSGHNANATRAGILRTATRIPVAALAPANGSPPAYARDWPSHRYGAVRIHVAPAAGEGGRG

SEQ ID NO: 9882 - protein, 222 aa, Streptomyces avermitilis
MTTIAIVGAGPGLGAAVARRFGREGFDVALVSRDRGRVDALAAELAEEGVTARGFAADVRDPKALTAALDAATATLGPIEVLQYSPVPQREFMRPVLETTPADLVGPIEFSLYGPVAAVQQAVPGMRALGRGTVLFVNGGTAVVPHPDRAGTSVAFAAESAYGHLLHDTLAGDGIHVAQLIIPGAIIPGHRRKDPAVLADILWGLHQDRHGYRHFADDLDAA

SEQ ID NO: 9883 - protein, 217 aa, Streptomyces avermitilis
MSVGLPRRKRPVRCRSATVTLAGLVVAAAMGTASLVSCGTDGGGSGSNNASFSPTPTAPDTASFSGTPPSALSSLGASVKESARAAASAAASSASAAASAFEASVSADVARANAAAEQRLKNAKGQGNAMSDVALTGKPRSETGGVLALVVNITNRTDKTASYAVQVDFRDPDGKVVETRFVGAEKLKPGERAQPLAISRKPPEPRLTAEIARAQRY

SEQ ID NO: 9884 - protein, 92 aa, Streptomyces avermitilis
VTGSRLDLDSDQMGRDLVALVLTVVELLRQLMERQAIRRIDQGDLSDEQVDEIGTTLMLLDQRMTELCEQHGVRPEDLNLDLGPLGTLLPKR

SEQ ID NO: 9885 - protein, 75 aa, Streptomyces avermitilis
VTRDVVPWDSPEPLSGPIGVPLVDLLDRVLATGVVISGDLVIAIADVPLVRLSLHALLSSVSERVPAPWADGGPL

SEQ ID NO: 9886 - protein, 271 aa, Streptomyces avermitilis
MTERGPEPSDAKATYVFAVCRNPDPAVVAGLPGVTDEAAVGTLPLGTLTAIVQPVRAGDFTDEAWQARLSDQRELERYARAHHEVVAAAAACCPTVPLPMATLYHGEERAREALAREADRFHAALGRIAHHAEWGVKVYAPACPPNDTDRTPNRRTTPADRSRPAPGAGLAYLDRKRGLQERRERRQDEALRTAEAVDAEVRGLATASRRLRPHGPQAAGDRRVQILNATYLVAEHRADEFALLARTLRKRTGADIELSGPWVPYSFVGEV

SEQ ID NO: 9887 - protein, 119 aa, Streptomyces avermitilis
VADVDFRQGAYPVSGPGTTNLADILERVLDKGIVIAGDIKIDLLDIELLTIRLRLFVASVDTAKKAGIDWWETDPALSSRAARSALQDENRELRERLKALESRTDDESAPAAAKEDRGT

SEQ ID NO: 9888 - protein, 376 aa, Streptomyces avermitilis
MTKTERDQPAEEASGADRLREELSNFLGAQVEKLAEKAGDKLSDVTGQLTDVAEGGGGLPAIGSRILQGDSPLKAFVSEKAKGLKDNVLGKAKEALGGGKGKRKASGGKVMNIIEVLDVGVPLRAAYDHWTQYDKFSSFAKGVRDVSKTDEVGSNWKVKVGPSSRSYKATVQEQIPDDRIVWTSEGAKGTTRGAVSFHELAPTLTRIVLVVEYYPSGFFEKTGNLWRAQGRRLRLDFKHFQRYVSLTQEEPEGWRGEIRDGEVVVSHEDAVEEEEAAEQEESEGEEPEEEGEGEAEGEAEDDADYEYEDEDEDEGEGAAEEADEYEDEDEEGAEDEEGAYEDEDEDAVEDEEGEEDEEDEDVAPSRKQRRQRRGRG

SEQ ID NO: 9889 - protein, 376 aa, Streptomyces avermitilis
MDDTAKVTLAAAVVGGYVLGRTKKGRMALSIATYLAGRRFGLEPRQLATEGMRRLGEMPQFAQLQEQLRGEVLDAGRKAVTAAADRGMSSLADALSDRTARLGKKGEEEEGEEEEGEEEYAPDEEGAEGEEEEEEEEEEPEEEEPEEEEEEPEAAYEEEEEEEEEEEQPEGEYEEEEEEEEEEEEPEGEEEEEEEEEEEEEEEEPEPEETRPRRPRSARQSARSRKARGPEAREKAAPAGEEKPRTAKKAAARKAAPAKKTPAKKAAAKKTAPAKKSAPGKTAAKKAAAKKSAPAKKSAPGKTAAKKAAAKKSAPAKKSAPGKTAAKKAAAKKTAPAKKSAAKKSAAKKTAPAKKSAARKTTSSKRAASKRADRRR

SEQ ID NO: 9890 - protein, 84 aa, Streptomyces avermitilis
MGLLTGLLTFPVAPVRGVIWVAEKLNEAAERELHDPGVLRAQLAVLNQELEDGDISLEEFEREEERLLDRLHAAQVGSARNDRR

SEQ ID NO: 9891 - protein, 249 aa, Streptomyces avermitilis
VTAEGVYVYAIVRAGRPLPTGAGGVGSPAAPLRTIRQGRLAAVVSEAPPKLRARRRDLLAHQELLLRLSAEGPVLPMRFGMVAPDEETVRGRLAADEADHVAALERLSDGVEINVKALPAQNALADLVAEDKKVRRLRDEARRRPGYEASLRLGEAVTTALQSRAAEAGRRILRELTPLARAVAPGPDVQGCVLNVSFLVSRGDSDDFHRVAERFADRHRTHVELRLAGPLPCYSFVSAEAPHARTAGV

SEQ ID NO: 9892 - protein, 156 aa, Streptomyces avermitilis
MPPTTYSDEVVACPPRAGTLYDVLELILDRGMVIDVFVRVSLVGIEILKIDARIVVASVDTYLRFAEACNRLDLERDSGSTTVPELIGGGAVKSMGKRKVRKAAESVGDTVRKAVGGGRDEDEEPDEDEEEQQEERPRKRRAPARSGASRRRPVEA

SEQ ID NO: 9893 - protein, 106 aa, Streptomyces avermitilis
MAEERRPRAGKSSTNAARRTPSVRGAEGAARAASRSLEGLIGHPTEGVSAVRRADDGWCVVVDVLELARIPDTTSLLASYEVQLDQDGELMEYRRVRRYRRGSADE

SEQ ID NO: 9894 - protein, 74 aa, Streptomyces avermitilis
MLCVALRMRRAHTEKKPTRSEGAMIVLGVILLVIGLLTGISILWTIGVVLVVIGLILWILGAVGHAVGGRRHYW

SEQ ID NO: 9895 - protein, 273 aa, Streptomyces avermitilis
VAEKRVVIVTGGGTGIGEATARLLREGGHHVVISGRRAEPLRRLERETGALACPSDVGDPDAADGLVRTALAAYGRLDGLVLNAGIGRGGAVGDVSLEDWHDVMRTNVTGPLLLLRAAIPHLLDTKGAVVAVASVSALRNGASNVPYATSKAALLQLCRSVAVDYGRQGVRANIVCPSWVRSEMADRRMARFAEEADLKDGSVESAYEEATRFLPLGRPGEPREIAEAISWLLSPAASYVNGSVLTLDGGATALDPGTLAFDFHVAPRGDAEL

SEQ ID NO: 9896 - protein, 178 aa, Streptomyces avermitilis
MSSADGGQRMSTDDRVAVTPGIARPHASPGLAGPDRLGLVTDRTGALPDLRPAAPRLVGDSDSDVYDVCVGVSHSGTTPETVRALGPAHRPRRAITAALTDAAPCPVADADAADAALGTVVRETGLRQGAISVRIAQLAIVDRVLIAVTRRTPHQAEAAPRATFDTVHDLRLEGQPRR

SEQ ID NO: 9897 - protein, 326 aa, Streptomyces avermitilis
MTDRTTTSRAGIRGFRAGDGPQLVEVWRRSAPADSITPDRFRSLVLLDANFDPEGLRVAVDGDRVVGAAYAVRRLTPMTGTDLEPEQGWIPFFFVDPAARGHGLGRRLLTDALDWLHRHGRTRVDFSSYTPNYVLPGLDAEAYPEAAGLLESLGFRTLYEAAAMHRGLVGYRVPEDVARRSDELTARGYRFATPCDDDLVDLIALAGNHFGPDWACTIRQCLAAGTPLDRIVVARDPTGRLVGWAMHGTFDAVDERFGPFGVLEEMRGTGLGKVLLHLVLERMRARRAHSAWFLWTGEQSPAGHLYRRSGFTTTRVFRVLRREAAG

SEQ ID NO: 9898 - protein, 449 aa, Streptomyces avermitilis
MTPSHRTGGLSRRHFALALPSALLASGAFGCAAPHQGTGRPGDPIVLTLLSHYASGELKKALRGPVDEWNATHDRVKVRTKAVEFTDLLTTFMVRQAAGQGADIIHPYCLWNGQLVRAGVLRPAPSEHAEEITRGYGTAAVGASSVGGEVYGYPTEVQTYALYYNKRLLREAGISGPPRTWRELEETAYRTAARDRYGNTLVQGFGLSTYDDSTTVGQTLALLNAAGGRFVSADGRSTAIDSPAGRAVLDLEHRLVVKGASAPGVNVYKAFQSGQVAMVVSAGWWTASLKAQMGKDYRDVGVAPVPVPEADDKRATLSTGFMLGVNTASDHPREAWEFLRWLNTEKVSAKSAEKGATATRMSSLQVSVGSLTGRADDMRTLLSEGGDPNLRPFLDALAYAVPEPNVPGAQQAKSLLRKNIEALWTGQQSVDEALRTIRRQVDQEVSRSW

SEQ ID NO: 9899 - protein, 320 aa, Streptomyces avermitilis
VNTLTPETTERAHGPRSAGPAVNGRAQTRRRRHQAVVAYLFLAPALLFFAVFLILPLGFALLLSTSRWAGFDLGDIDPVGLDNFTGLFADGSTFLTPILTNTLLFALGTVALALAGSVLVATCIDNLRFQGLWRTLYFLPIVTTVVAVGNVWKYMYEPGGLVNGVLNALGLGSVAFLQDPDTALPSVVVVQAWASVGSAILILTAGLKSIPESYYEAAALDGAGPGTVFWKITLPLLRPSLLFVCITQFLTGLQSFALIIVMTKGGPGDATNVAALEMYRQAFSYGDWGTASAAAFVLFVVVLVVTLVQLWIFRRKGEDA

SEQ ID NO: 9900 - protein, 275 aa, Streptomyces avermitilis
VTGAVLTVVPFLDMVMTSFKGPGESGTLPYRFLPEAFDLSNYRAAVAQLDLPVLFRNSVIATALITGSVLLTSSLAGYALAKLRFPGRNFIFRLVLSTMMFPPFLFFIPHFLILVHWPLAGGNDLFGRGGAGLTVSIAALVVPFLVNGFGIFLTRQFMVSIPDEVLEAARIDGAGEFAVWWRIVVPQTKPVLVTLGLLTFVDAWNEYIWALLVSTANPDVMTLPVGIQLLQDYVDPTRTMPIVMAGLALSILPVLILFLLLQKHYIRGVMLSGLK

SEQ ID NO: 9901 - protein, 638 aa, Streptomyces avermitilis
MTSPTGGGAAFNGGGRATAPGLPFAGVPPEMQASVDTLLKTEPEHPEPEVVFEHGRPDPDGAELSLRRLIRPYWPIALLGGVFVALEALTLQAGPKLTQIGIDDGITAKDSGTLVLVAIAYLVSLVVTGAAQAARVKVTGRIAAWVMNDLRVRVFTQLQRLSLNFYTGEKSGVIMTRMTSDIENLQALLQDGLAQLAVQGLTMVVVTVVLFTFDVRLALITVVLVVPVLTALSVWFHRASGKGYVRVRDTIAAVIADLSESLQGVRIVTAHNRQQHNIEQHRQVTGTYYDANVRTGRINSIYTPSTQVIGVVGQLALLAIGAGMVADGELTIGELVTFLLSLGAFFQPIQQLVQLYNTYQQGQSSIVKLRELLSTRAEVEEAPGAVDLPKVEGEIVFEDVTFGYVPDRPVISEVSLDIRAGETVAFVGPTGAGKSTLAKLVTRFYDPTSGRILIDGRDLRDVRIESLRRQIGVVPQEPFLFAGPLRDNIRFAVPDASDGRVREALRVVGLVDVVERLPDGLDTVVQERGQSLSSGERQLVALARAFLAQPRVLVLDEATSNLDLQSETKIEQALDVLLEGRTAILIAHRLSTAMKADRIVVVDEGRIVEVGAHDQLLAADGKYTQMYAVWTNQAAEAH

SEQ ID NO: 9902 - protein, 597 aa, Streptomyces avermitilis
VNKTYPPPSAAIDPDPSRSWLWRAWPLVRAHRWMFSAALVMSGASMLVVVQVPRLIQDAVDNSIVSDRVPLSHYMWWLVGMSVIMLVVGYLSKQLLFRAAARIEYDLRNIVYEHLTAMSFPFYDRMQSGQLISRANSDIRAVQMYLAFAPYLLVQSGISLVSFAYMLAIDVPLAILAMLPMPLMFVASRRMQRSLFPVSWLIQARLADVATVVDENVNGVRVVKSFAAERSQLASLQKAATSVAWANVKDADLRARWTPLVQNLPRVGMAIVLLYGGYLVIHGELGVGAILAFNAYLLMLQVPFQVIGNLIMLGQRSSAAAKRLYEVLDEKPEIADAPDAREITGPRGDVRFDDVTFGYGDGLDVLKGFSLQLRPGETVALVGRTGTGKSTAARLLPRFYDVRAGSVSVDGHDVRDLTLRSLRDTVGVVLDEPFLFSASVRDNIAYGRPDADFTDIERVARLAGAHEFITELSEGYDTVIGERGYTLSGGQRQRIAIARTLLLNPPVLVLDDATSAIDVQVEQEIHAGLRSLFAGRTTLIVAHRLSTISLADRVVLLDGGRIVADGTHKELLASTPLYAEVLAQADETIEELGSVGR

SEQ ID NO: 9903 - protein, 221 aa, Streptomyces avermitilis
VLAGADKVFLYAKPEQIEAFVAAAQSAGVRQVVLLSSVSVVMATSEQNPIARMHRTVELAIERSGLDWTFIRPGMFATNARWWWGESIRGEGVVRLPYPEAQNAPVHEKDMAALAVTALTEPGHSHQAYTVHGSESLTLRRQVEHIGEALGRPIRVETVSVEQAREEFAEKAPSNVAEALLRMWAAADGVPAPVSVIVDRITGRPAHTFAQWAADHADDFR

SEQ ID NO: 9904 - protein, 439 aa, Streptomyces avermitilis
VCVWTPRRCSTGRHRTTWSSTSSRHCSTTDPAEEPMMPPSMTQSERVVKPTGRGYLLLDAHPVGCFRSVELMRAEVPVPEKPPARRPTALVIGSSSGYGLASTIAGLVRYGIDGVGIGLERPAGHRSATAGWYRTVATDAIARELGADFSFRNADAFADTTKTETLDLLAERFGGVDYLIYSVAAPRRTDPRSGTTYQSVLKPLGAPHTTRNLEFADDGAAQVREVTVAPATEAEAAATVGVMGGEDWSRWITALAERGLLRSGFRTVALTYIGSPLTSAIYRGGTIGAAKAHLESTARALTERLAAVDGRAFTSVNGALVTQALTAIPGIPLYVSLLRGVLGDRFPSPVAQSLDLWHQLTARRPDVDDSGRIRLDRWELSEPVQAAVAERWRSITPETVTALADTAWFRAQCRALYGFDVPGVDYTVPVATDLPWPES

SEQ ID NO: 9905 - protein, 4498 aa, Streptomyces avermitilis
VKTSGQDVVAVVGLSCRLPGASSPEAYWELLAAGREAVGGVPADRAVHVGTRVARAGLLDGVADFDAGFFGVSPREAAAMDPRQRLMLELAWEALEHAGVDPSAARGSRAGVFLGAMGDDYAGLVRDQGAGAIDSFTLSSLQRGVLANRISFFLGLSGPSVVVDSAQSSALVAVHQAYESVRRGESAWALAGGVNLILSPESTATASEFGALSPDGRCYTFDGRANGYVRGEGAGLVVLMPLADAHAYGHDVVCVIRGGAVNNDGGGEQLTTPSRAGQEDVLRAALTDAGTRSAEVGYVELHGTGTPVGDRVESAALAAVFADRDRPLVVGSAKTNVGHAEGAAGVVGLIKAALAVQHGQVPASLNFAAPADDIPLAELGIEVAAELRAWPGDEPRVAGVSSFGMGGTNCHLVLAQALDPSPAEENHGVRAGTVPWLVSGGTERALRVQAERLAGHLAAQDGPDALDIGFSLATTRAALPHRAVVIGEDPAELSEGLAALAANQPAPNVVSGAVAEGGTAFMFTGQGAQRTGMGRDLYARFPVFAKSFDAVCAELDPSLGGELREIVWSDADLLGRTRYTQAALFALETALFRLMESFGARPTHLIGHSIGEVTAAHVAGVLSLSDACTLVEARGRLMQAARSGGAMVAVNADEGDVRALLPVSGVSIAAVNGPRSVVISGDADPVLATAESFRAAGVKTKRLNVSHAFHSHHLDGVLDEFADAIRGLTFHAPRIPVVSNLTGRPATTDELTDPDYWARQIRGTVRFADGIRALHDAGVSRYLELGPDPVLAGMARETLAEQAPAAVATLRTGQAEVRTLLRALGTLHATGAPVDWTPLLDGGRRVVLPTYAFQRRRHWIGEAREAAPAAEPARVHDRGSLLDLVRTHLAAVLGYDAADMTPLTSFKDLGLTSLTAVELCAGLSSELGLALPGSLVFDHPTPDRFAAFLHAKLTGHGDAEGAPSVPAFRDGDADDPIAIVGMGCRFPGGVSSPDALWELVRSGRDAVSGLPRDRGWDLDNLFDPDPETSGRTYVRQGGFLDDIAGFDAGFFGVSPREALAMDPQQRLLLETAWETLEDAGIEPGSLRGSDTGVFIGAMAGDYGPRLDTPHGGVDGYVLTGTSGSVTSGRLAYFLDLEGPAVTVDTACSSSLVALHQAARAVRSGECSLAVAGGVSVMSSPGVLVEFSRQRGLSADGRCKAFAESADGTGWGEGAGLVVLERLSVARARGHRVLAVLRGSAVNQDGASNGLTAPNGPSQQRVIRLALADAGLGAGDVDVVEAHGTGTRLGDPIEAQALLATYGKGRSEDRPLWLGSLKSNVGHTMAAAGVGGVIKMVEALRRGVLPATLHVDEPTSHVDWSAGGVRLLTESREWRSEGRPRRAGVSSFGISGTNAHVILEQAPPAEQSLPPESVPPSESVLPQESVPPAGSVLPAGPVSFTEQAGPVGWVLSARSEEALRAHAGRIAEAAADTGVPLEDVAATLAARTAFEWRGVVLGATREELLVGLGSLAEGAPCDGVVTGVAGAGGTVLVFPGQGSQWGAMARELYAGAPVFRARLEECAKALSAFVEWDLLDVLLSDDGGVLLSRVDVVQPALFAVMVSLAALWEAHGVRPDAVVGHSQGEIAAAYVAGVLSLEDAARVVTLRSQAIRALAGRGGMVSVGLSVDEVRPRLGRWGGDVEIAAINGPTSTVVSGSAGALDELQAVFEAENVRTWRIPVDYASHSCHVDRLRENVMDLLAPITPRAGDLRFYSTVTGRRIDTTELDADYWFRNLRETVEFEAVTRLLLADGFDTFIECSPHPVLVAGVQETIDSTHTPARAIGTLRRHHGGLDSFLRSTGEAFTAGATTQHTPARPHDGRHADLPTYPFQRTRYWLEPDTSRRDIAASGLTAAGHPLLGAVTEGATSLVLTGRISLATHPWLADHQVAGTLVVPGAAFAELAVYAADRVGAGSIRELTVRSPLVLPEHGAVRLRVEVSEPAAGESGRTVRIDARPDMGTATSWTCHATGVLDAETPSPDWDLTAWPPAGARPVDVSYETLAAQGYHYGAVFQGLHRMWRHNDHVYAEISLPTEPDAFTIHPALLDATLHAALMSQVLPSDGRIRLPYAWEGATLYASGASALRVSVTTAGDNAIRLRAADGAGMPVAEVASLAMLPADLADLGSAAVSRDSLLHLEWTPAPSADAAPPTRLSLLGHDPFGLRAATADGVDWRRFTELSAIPGDSSDVVVCIEGDETADVPGAARTALYRALDLVQAWVSDERFGEARLVVVTRRAVMTGSGEPVPDLSTAPLWGLLRSAQSEHPGRLILADVDEDARSSAALPSALAGGATQFALRDGRVVVPRLARASSQDGPRGPAGMPGRPEPEGRRGPEAPSRWDTDGTVLLTGGTGTLGRLFAQHLVTQHGVRHLLLVSRRGPDASGAADLVAELSGLGAEVTIAACDVADRGALSALLAAVPANHPLTGVVHAAGTLDDGLIAGMTPEKIDAVLTPKLDAAWNLHDLTKDLGLSAFVLFSSIMGTIGNAGQANYAAANVFLDALAQYRHATGLPATSLAWGFWSERSELTRGLNDADIARMARTGLKPLPSDEGVALFDAAFARGEATAAPVALDLDRLRAQAAGATLPEVLRGLVRARRAATAVTATASTLADRLAGHTAEDVDRELLDLVRSHTATVLGHAGADSVQPAVAFRELGLDSLSAVELRKRLNEVTGLRLSATVAFDRPTPSALAAFLREELLGGSTQAVAPAAAAATAEDDDPVAVVGMGCRFPGGVSSPDALWELVRSGRDAVSGLPRDRGWDLENLFDPDPGRTGKSYVDKGYFLDDAGEFDAGFFGVSPREALAMHPQQRLLLETMWQTLEDAGIEPGSLRGSDTGVFIGAMSQDYGPPMHEGSAEADGLLLTGTSGSVTSGRLAYFLDLEGPAVTVDTACSSSLVALHQAARAVRSGECSLAVAGGVSVMSSPGVLVEFSRQRGLSADGRCKAFAESADGTGWGEGAGLVVLERLSVARARGHRVLAVLRGSAVNQDGASNGLTAPNGPSQQRVIRLALADAGLGAGDVDVVEAHGTGTRLGDPIEAQALLATYGKGRSEDRPLWLGSLKSNVGHTMAAAGVGGVIKMVEALRRGVLPATLHVDEPTSHVDWSAGGVRLLTESREWRSEGRPRRAGVSSFGISGTNAHVILEQAPPAEQSLPPESVPPSESVLPQESVPPAGSVLPAGPVSFTEQAGPVGWVLSARSEEALRAHAGRIAEAAADTGVPLEDVAATLAARTAFEWRGVVLGATREELLVGLGSLAEGAPCDGVVTGVAGAGGTVLVFPGQGSQWGAMARELYAGAPVFRARLEECAKALSAFVEWDLLDVLLSDDGGVLLSRVDVVQPALFAVMVSLAALWEAHGVRPDAVVGHSQGEIAAAYVAGVLSLEDAARVVTLRSQAIRALAGRGGMVSVGLSVDEVRPRLGRWGGDVEIAAINGPTSTVVSGSAGALDELQAVFEAENVRTWRIPVDYASHSCHVDRLRENVMDLLAPITPRAGDLRFYSTVTGRRIDTTELDADYWFRNLRETVEFEAVTRLLLADGFDTFIECSPHPVLVAGVQETIDSTHTPARAIGTLRRHHGGLDSFLWSAGDAFTAGAVDRWNPADQSRGGHVTLPSYPFERTRYWLTPDTGRRDVGAVGLTAAGHPLLGAVVEGAAGTVFTGRVSLATHPWLADHQVAGTLVVPGAAFVELAVYAADRVGAGSIRELTVRSPLVLPEHGAVRLRVEVSEPAAGESGRTVRIDARPDMGTATSWTCHATGVLDAETPSPDWDLTAWPPAGARPVDVSYETLAAQGYHYGAVFQGLHRMWRHNDHVYAEISLPTEPDAFTIHPALLDATLHAACTEGPRLATSWRGVAVHAVGASALRVRIGPDRAGSVSVTLADTVGDPVAEFTVGTTPVEPGELRAAGVVQLGVLHREAWVDHLAKSSPRKANWAVVGEDPLRAAAGLTAAGVYARAYPGLDALAEADGDAPDYLLLTVPTGAEVAATVRETLSRLNAVQSAERLATATVVFLTTAAVPAFDPAGADLAGAAVWGLVRSAQAENPGRFVLADVDADEASWRALPRPVMSGEPQMALREGRVRVPRLAPGAPVGTRERFAGHEGTVLITGGTTPMGERLARHLVSVHGVRHLLFTGAEAPEPTAELTALGAAVTTAACDPADRTALRELIGRLPAERPLTMVVHIPQAPPHDRTLSAPPSQAPDALAEVVGAMVGAAGVLDQEIGEATLVLCSSFAGTVGGAGTAATAASAVALDALARRRRARGAPAVSLAWGPWTADDAPSRGGNAGVGVLGAREAVALFDTACRADEPVWIPARLDLAELTRQAEAGEALPPLFRSLVKTTGKRTASGGAVSVTSLRQRLASMAEAEQDRTLSGLISTQISAVLGLESADVVRPNQILLDFGFDSLSILTLRNRLDSATGVRLDTASMFHRSTPDDLVQHLKQALLDNRSGRGADDAPIDDTV

SEQ ID NO: 9906 - protein, 270 aa, Streptomyces avermitilis
VLRFQALGRLTVTNDLGDCTPTAPMARRVLAQLLLCSNNIVMLDAIIDELWGDKPPKSAVPTAQTYIYQLRRQFEPWVPEGTVEQVLATCGTGYMLRVDPDQLDLAAFLRLSKQGRTALAAGDPAAAARLLRQALDLWSGPALADVTAGPSIQAHVVHLTEQRAHTVELRIQADAMLGRHRELVGELKAMLLTHPLNEWYHAQLIKALASSGRRNESLVAYQHLRRTLSAELGLEPSGVLRELHQEVLAGRDSWSDWGVSGRPLAEQLTR

SEQ ID NO: 9907 - protein, 275 aa, Streptomyces avermitilis
VKRREKCRRLTRRNNRRRRSREGTQTVASLEGKTALVTGGRTGLGFGIATALVERGANVVITSRTEDELRKAAAALGEERALGVAGDARDPEHQRIAVETAVDRFGSLDLLVNNVGGTERTARRLVDVDLASYRRTVEINLMSALTWVQTAWHGWLGEHGGAIVNISSIAGELAVPDGTAYGTAKAALNHFTRQMANELAPAVRVNGVASGTVLTDFTRANVEGREDKVIGSIPLRRLGEPADVGAAVAFLLSDEASWITGHTLVVDGGRLLHNR

SEQ ID NO: 9908 - protein, 218 aa, Streptomyces avermitilis
MQPDRAGQLRIVLIDDHALLREVVCETLNVEPDMVVVGVAASGAAGIAHCEIEQPGVVLLDGNIPDESVTETAHAIRSTSPNARILIVSMPDDPALVRQLLDCGVRGYLNKSASRNDLVSSIRAVCADNIRIVLHISVEALTHIATTANCQDKLTRREIEILTLVSKAMSNRQISRRLTIAEGTVKRHLGTIFTKLGARSRLEAVNKAVSIGLIARAG

SEQ ID NO: 9909 - protein, 269 aa, Streptomyces avermitilis
MYRTEHEQRFDNGAPEAPEQLGLLSEILNRETFRTLGEEVRVGHGWRCWEVGAGDGSVARWLAARVGTSGHVVASDLKPQHVPSHPRIEAIRHDLVEDPWPEHAFDLIHARLVLMHVADKEAVAARLAAHLRPGGALVLTDWYCGCADEGIIKSPVDAYTARIFQEYHDGVHKLAGETGMDFEWAARTPDVLSAAGYRDITVRDFRAPGEGGAPTARLARLHSTMLEPFLLSQTSLTEADLSVIREKLLDPEFEMVTNHTYTTVVRVPK

SEQ ID NO: 9910 - protein, 86 aa, Streptomyces avermitilis
MATFTQADLVGYIRQAAGEDEGFDLDGDIADITFADMGYDSVAMVEVTLLVERELGIGLPDDDKASKNSTPKQFVELVNELLPASI

SEQ ID NO: 9911 - protein, 334 aa, Streptomyces avermitilis
MSDGLYIAAASSWLPERLTLDEAEQAGLADRARVWNTGIESVCVSPDKSAPEMAVLAARDALGRAAVGAEDLQLLLHACAYHQGHDMWPAASYVQRFCGGGSYPAVEVRQMSNGGMIALELAAGHLRAYGGSTALVTTADRFSLPGFDRWRSDPSTICGDGGTAVVVSTRTGFALLRGLATVSDPGLEHGSRGERFSDAPLAARAPIDLNSDSLVRELGVEALLNRIEAGQREAFDRACAQADVKLGDIDWYVLPNLGRTRMRAQYFDPFGIDPQRSTWSWGRRVGHLGAGDQFAGLAHLVSEGALEPGQTCLLAGVGAGFTWTAGILEIIARP

SEQ ID NO: 9912 - protein, 416 aa, Streptomyces avermitilis
MSRAVPENDNGTTPERPRAVITGLGVVAPNGFDTDEYWDAVLHGRGGIDRVTRFDPEQYPATLAGEVADYDVRAYIPGRLVPQTDQTTRLVLMAADAAVRDSSLDPAALPEDQVGIVTGLSAGGLEYSQRELEKLWSLGSDHVSAYLSFSWFYAVNTGQISIRHGWHGPGGVLTGNTSGLDAIAQARRHVVDGLPVVMCGAVESAMCPLGWTIELTTGRMSTVADRTQAYLPFDTAASGYVPGEGGAMVVVEEAGHARGRGARPYSEIAGYATTFDPRPGSAREPGLRRAIESALADAGVTPDEVDVVFADAAGVGELDRAEAAAVTAVFGPRGVPVTAPKTMTGRLYSGGPALDVATASLSMRHGVIPPMINVTDPVRSDQLDLVLDRPRETTVSTALVLARSDGINSAVVLTAA

SEQ ID NO: 9913 - protein, 410 aa, Streptomyces avermitilis
VRAPGGGNAKEFWELISSGTSAIRTISLFDASGFRSRIAGECDFDPVAEGFSAQEIRRMDRSAQLAVAATREAVADAGLDLAETDPHRCGVSVGSAIGGTMSLDREYNVLSDGGRKWLLDHEYAVPHMYNYLVPTSIAADVAWTVGAEGPVSLVSTGCTAGIESVSHAARLIREGSADVMLAGGSDASLSPICVACFDAIKATTPRNDEPATASRPFDRTRNGFVLAEGSAMLVLEELNHARERGARVYAEIGGWDVRANAYHMTGLRTEGPELAKAIEVALRMAGRVPEQVDYVNAHGSGTKQNDAHETDAFKRTLGDHAYRTPVSSIKSMIGHSLGAIGSIEIAACALAIDAGLIPPTANLHEPDPELGLDYVPLSARQADLRTVLKVGSGFGGFQSAMVLTQGGSDE

SEQ ID NO: 9914 - protein, 399 aa, Streptomyces avermitilis
MDFGADPYPEYAWLRAEEPVRQVLEGRGLYGLLVTRYEDVRKLLSDPRMSKDPRNAPLDWQEAGKGRPLEDRTGLGTHLLTTDAPEHTRLRRLVSTAFTARRVEGLRAQVQHITDGLLDTIVPRGQAELIGDFAFPLAITVICELLGVPKADQDVFRQWTKDFRRWTNTDSAQADRGDARPVGLRDLLEYLTRLVDKRRQDPADGLVDALIAARDDDDRLNEAELLSMMSLLLVGGFETTVNLIGNGTLALLRHPDQLALLRERPELVDSALEEMLRYDGSFETATWRFPLEPIEVAGTRIEKGHPVLLSLASANRDGAKFPAPDDFDVTRADPAHVAFGRGAHFCLGAPLARLEGRIAFHGLLRRLPGLALSVPPEQLRWQRSLTVRGLEALPVTFDA

SEQ ID NO: 9915 - protein, 501 aa, Streptomyces avermitilis
VRRTREENTVLILGGTSMRVVIVGGGTVGLCTAVFLARQGVSVHVLERRAQVNDHPRAFGITDRSAEILREAGIDIETDHLVRGLMTGTSLADLTTVTAKFEPPEIGPAKLGSCPQDRVDRAALARLRELGGQVDFDSEVVAVTDGGVTTADGRTVTADYVIAADGVRSRMRDLLGIGVTGPGPLSSSHMLNVLFRAELPTPPTSMTFLRNERASGILLKVDETGRWVFHIPNGDPETPVERIQQQIRDATGVSDIEPEIISLLPWSSTARVADRFRQGNVFLVGDAAHVVPPVGGLGLNVGIADGHNLAWKLAAGGDALLDTYEAERRPVALFTMRQTVLRAEHRDLHWDNDASRAADRAAVGMAGIMIPVIGYRYDSGAVVDPEPLSDMENLVLDGAPGSRLPHRWLPDGRSTVDLVDGFTLITGTAADHWLDATRDLGITGHAVEGWAEAVGIKEDGAVLVRPDGFVGWRTATTRNAVETSTQHLRDVLDRILCRQKA

SEQ ID NO: 9916 - protein, 261 aa, Streptomyces avermitilis
VNLLADGWTLTQRRLFRLRHEPGTLLTMLMMPSGFVVLFGFVFGGAIGVPGTSNYREFMMPGLFVMTTGTALSTAMVEVATDQARGVMERLRSLPTHRVSVPLGQSGAEGILGAYGLAVLMVCGLVVGWRPHDGVPRALAGIGLLLLFRYTLAWVGTYLGLVVRSARTAARLAPLTLSLTMVSNALVPTDRMPVGLRALCEWNPLSSAAAAARELFGNPGAPGPDAAWPLTHPVTASLLWAGLLLLIFVPLSVRRFARAGL

SEQ ID NO: 9917 - protein, 313 aa, Streptomyces avermitilis
VRKQYGDVVALDGLDLVVPSRTVYGLLGPKGAGKSTAVRILATLTRPSSGRAVVAGFDVARNPADVRKVIGLAGQDASFDDGLTGRENLRILGRLSRLGSRGARRRADELLERFGLAHAGDRLVGTYSGGMRRRIHLIASLLRAPAVLFLDEPTTGLDAPSRAEIWESVRRLVADGTTVLLTTPCLEEVERLATAVGVIDRGQLIAEGSPAQLKAQIGRHIDVVVESADHVPSAMARLERLTGRCPEADGSRIVVAAVDQAPALPLIVSELDASGAVIRNIGIREPGLDDVFLTMTGQTVGPAQPVETPEAVS

SEQ ID NO: 9918 - protein, 261 aa, Streptomyces avermitilis
MRPEKPARGPAPSHSRRQIAAVAIDIADSEGIEAASVRAIAKRLGTGAMTLYRYLPTKEDLYTVMIDEATGFEPQEPTGDLRADLTTLARRRRQILLRHLWLAPLLATRPIMGPNFMRGMERDLAVLAGCGLGMDDTIHVLNLIHSWVSGAVQAELTERATANQSGLDRHAWRLRMEPYLKSLLETGEFPHLSRMVQTSEIGEADERFANGLAIILDGIEARFPTATGKDGSRRPVGDTGGGAPSARRAKGQPTARSSTTE

SEQ ID NO: 9919 - protein, 359 aa, Streptomyces avermitilis
VSCRTGTDTVPAGSHEQRTVESGEVMAKETTPRGGGVWAAADLLTPMAVRVAATLRLADHIAAGARTTEALAEAVGADRDALGRLLDHLVTAGVLSGTGPGAYDLTAMGRHLCEGAPEDMRAILDIEGALGHAELSLVHLLHTVRTGEAAFPQQYGVTFWDDLSSDDGRAESFDTLMGARLTAHSPAVAGAYPWGTLRHVVDVGGGDGTMLIAILQSHPDLRGTVVDLPGPVRRAEKAIAAAGLDHRADIAAGSFFDALPAGADGYLLSSILHNWDDASAARILRRCADAAQTTGRVLVVDYFGDRTVQTEGDLRMLGYFGGRQHTLEQLAELAGTVGLHTTSVTPAGRYSVVELRAVG

SEQ ID NO: 9920 - protein, 322 aa, Streptomyces avermitilis
VTTLVRCLVVSSTQRRVDHAITIEGDVETVFDLIADIARWPQFHRSAVHAETVHANEKGELVRHWALAGDAAVRAWQTVRRTDRPGRRITFAHMEPEQPATDLRGEWVFTELTPNRTRVELSHQVVAPTGADLGPLLDRIAQESEDCLATLRDTAERRADLDELVVSFTDPLFIAGSVEDAYDYLYRADLWPERIPHVVGLAMTEDVPNVQFFDMDTKGPDGSTHTVRSVRICLPNHLIVYKQISLPTMLDAHTGHWRFTETPEGVIAEARHTSTIKRSALSQLGGATTVAEARRYLRRLLSGNSMSNLRLAKAYAEERAGF

SEQ ID NO: 9921 - protein, 225 aa, Streptomyces avermitilis
MPSIITVGAFDSGNVADVTKILQEFDGEVASELPQLRRRQVFSYSDLYVHMQDWDVADPDEAYRIISTDPRCTRLNERLSTYFGDHAATEDWDGPVDRPTAERFYLWPAERLDDLEQTYSAVIVNTQRQEHIPEAARLFAESDATDIPQKMGTLRRQIYLWRGIYLHIQDFAVANSMEAISEVWTEGDPRFLQLVDDLTEIIPPYDPQGNSLATRFYHWAAEVPA

SEQ ID NO: 9922 - protein, 386 aa, Streptomyces avermitilis
VLPAEYETLRERGIGQVELPTGKLVWMVVRPEYARIVLSDPRFSSDKTDDRFPKLTPNSLMKLRYCAPFMINLDGPEHLKKKKSIMDEFSPEGLARLLPRLRVAVEEKIDDMLRQPTKPVDLVKELAFPIAWQLQEMFLGIPAAELETMRDNVWKLLLGTTTEAEEREAADRLNGHAEEVLKEKAKHLGDDMMSRLIVQEREKHGEVNWYELAPLMLSNAQGIHNSVSTMISLGVLTLLNHPEQRPTLLAHPDRMTTAVDEMLRYFSVNDGTPMRLATEDMLIGDTLVKAGDGVAVPTLPVNRDPSVCPYPHQLDIMREEPARHLAFGHGPHKCPADRLVPSLLEIVYTTLFERVPTLALAVPEAELTYKYHSIQAFGPAEMPVTW

SEQ ID NO: 9923 - protein, 234 aa, Streptomyces avermitilis
MTQITPPVKLDELITAITENHTTALDQLSGAILLADHIGEVADHLIGHFVDQARHSGASWTDIGRCMGVTRQAAQKRFVGKPDAKPSNAFEKFSQPARSAIIAGMNEAKTAGNAEIVPAHVLLGLLGTEGSAVGALRAQGIDLDQARDTAVATLPPRSDADPVLIPYDAHAKKALELASRVAFRLGQDSVSTGHMLLGLLEEGDGAGVLASLGLDTAAAERFVAEAADESSVAS

SEQ ID NO: 9924 - protein, 246 aa, Streptomyces avermitilis
MATPGTDGRVALVTGASGALGAAVARVLDHRGYRLALHYTNGEDQARKVAAKLSGPSTLVRADVADWAATRDMVDRVRAELGGISVLVNTGAIRRDGLMATQSVDDWTRTVAVNLIGTFHTCRAALPDMLRGRWGRIINVVSPAGLLGSRGQTAYSASKAGVLGMTRSLALECGRFNVTVNALSPGLMATALTEEVPAEVRATLVARTAFGRMGTPDEVARGIELLLDADYMTGQVLSIDGGMSIS

SEQ ID NO: 9925 - protein, 79 aa, Streptomyces avermitilis
MGPRLLFSAKVSVHKAWYPVTRRRLDFQEAFLDLAPDGTFTARALVPAPPELACVHGRWVADSSHVLSWTAATVNASTH

SEQ ID NO: 9926 - protein, 433 aa, Streptomyces avermitilis
VGEEYEVEIGPVAHGGHCIARTSEGQVLFVRHALPGERVLARVTEGEEGARYLRADAVEILDASKDRVEAPCPYAGPGRCGGCDWQHAKPGAQRRLKGEVIAEQLQRLAGLTPEEAGWDGTVMPAEGDKLPAGEVPAWRTRVQYAVDADGNAGLRRHRSHEVEPIEHCMIAAPGVSELGIEERDWSGMESVDAIAATGSQDRMVILEPRPGARLPLVELDKPVSVMRVEEKDGGIHRVHGRAFVRERADGRTYRVGSGGFWQVHPMAADTLVKAVMQGLLPRKGDMALDLYCGVGLFAGALADRLGDKGAVLGIESGKRAVEDARHNLAAFERVRIEQGKVEAVLPRTGITEVDLIVLDPPRAGAGKKTVEQLVSLGARKIAYVACDPAALARDLGYFRDGGYKVRTLRAFDLFPMTHHVECVAILEPAAKGL

SEQ ID NO: 9927 - protein, 683 aa, Streptomyces avermitilis
VSKLTDVPKRILIGRALRSDRLGETLLPKRIALPVFASDPLSSVAYAPGEVLLVLSIAGVSAYHFSPWIAVAVVVLMFTVVASYRQNVHAYPSGGGDYEVANTNLGPRAGLTVASALLVDYVLTVAVSIASGIENLGSAIPFVVEHKVSCAVAVIVLLTLMNLRGVKESGKLFAIPTYVFVAGVFIMIAWGAFRGFVLDDTMHAPTADYHIKAEHQGLAGFALVFLLLRAFSSGCAALTGVEAISNGVPAFRKPKSKNAASTLAAMGLLAVTMFCGIIALAMATNVRMAENPANDLIHNGVAVGPDYVQNPVISQVAEAVFGKGSFLFIVLAAATALVLFLAANTAYNGFPLLGSILAQDRYLPRQLHTRGDRLAFSNGIVLLAGAATLLVVIYGADSTRLIQLYIVGVFVSFTLSQTGMVRHWNRHLATEKDQAKRRHMVRSRAINAFGAFFTGLVLVVVLVTKFTHGAWVALLGMCIFYATMSAIRKHYDRVAEEIAAPEGPSDDSVRPSRVHSVVLISKIHRPTLRALAYAKLMRSDTLEALSVNVDPAETKALKEEWDRRGIDVPLKVLDSPYREITRPVIEYVKGLRKESPRDAVSVIIPEYVVGHWYEHLLHNQSALRLKGRLLFTPGVMVTSVPYQLESSEAAKKRARRRQEWSAPGAVRRGPAEERAKESSNTKG

SEQ ID NO: 9928 - protein, 223 aa, Streptomyces avermitilis
VHIVIMGCGRVGSALAQTLEQQGHTVAVIDQDPTAFRRLGSGFGGRRVTGVGFDQDTLREAGIEEAGAFAAVSSGDNSNIIAARVAREMFGIENVAARIYDPRRAEVYQRLGIPTVATVRWTADQMLRRLLPSGAEPLWRDPTGGVQLAEVHASSAWVGHKISKLQEETSVRVAFLTRLGEAILPSSQTVLQEGDLVHVMMRTDDVEKVEAAFAEGPEEESGH

SEQ ID NO: 9929 - protein, 225 aa, Streptomyces avermitilis
MRVAIAGAGAVGRSIAGELLENGHEILLIDKAPTAISVERVPQAEWLLADACEITSLDEAALQRCNVVIAATGDDKVNLVVSLLAKTEYGVPRVVARVNNPKNEWLFNEAWGVDVAVSTPRLMSALVEEAVSVGDLVRLLRFSHGDANLVELTLPPESALAGTQVGDVEWPQDTSLVTIIRGTRVLTPSQEDSLEAGDELLFVAAQAREEQLEDLLSVRREDASS

SEQ ID NO: 9930 - protein, 255 aa, Streptomyces avermitilis
VTSLDKPTEDAQQDSRAVTEAALFEAFGGVRGMVETVVPGLLFVTIFTINKDLHWSAIAAITVSLLLVVVRLVMRDTVKHAFSGVFGVAFGVVFAMMTGNAKDFYLPGMLYTLGLALAYIITTLAGVPLIGLILGPVFKENLSWRTRNPGRKKAYAKASWAWGLILLAKCAILFPLYWWANTAQLGWVLVALKIPPFLLAVWLTWVFLAKAPAPIDVFAEMEAAEKAEEERKAALAEERGEERGEATAGRHRRDV

SEQ ID NO: 9931 - protein, 172 aa, Streptomyces avermitilis
MRAVAAECAGAAECPGPVSARSERWRRECVAVGVPRYAFGMSAVPHSEKPVGRFRRMLDRLSSSQEDLESEELREDAETAGCTRIGDCHDRQIVTVTGTLRTVTLRPRAGVPALEAELFDGSAALDVVWLGRRSIVGIEPGRKLIASGRISMSRGRRVLFNPKYELRPLGRE

SEQ ID NO: 9932 - protein, 238 aa, Streptomyces avermitilis
MLSPTGGGPQTPTRVLVVDDEPQIVRALVINLKARKYEVDSAHDGATALHVAAARHPDVVVLDLGLPDMDGVEVIRGLRGWTRVPILVLSARHSSDEKVEALDAGADDYVTKPFGMDELLARLRAAVRRAEPTGGGEDDVIVETEDFTVDLAAKKVNRDGRDVRLTPTEWHLLEVLVRNTGRLVGQKQLLQEVWGPSYGTETNYLRVYMAQLRRKLESDPSHPKHFITEPGMGYRFER

SEQ ID NO: 9933 - protein, 851 aa, Streptomyces avermitilis
MARGKLRIYLGAAPGVGKTYAMLSEAHRRVERGTDCVVAFVEHHGRPRTEVMLHGLEQVARRELAYRDTVFAEMDVDAVLRRAPAVALVDELAHTNVPGSRNAKRWQDVEELLAAGIDVVSTVNIQHLESLGDVVESITGVRQRETVPDEMVRRADQIELVDMSPQALRRRMAHGNIYKPDKVDAALSNYFRPGNLTALRELALLWVADRVDAYLTEYRSEHRVSAIWGSRERIVVGLTGGPEGRTLIRRAARLAEKGAGGEVMAVYIARSDGLTSASPKELAVQRTLVEDLGGTFHHVVGDDIPSALLDFSRGVNATQIVLGSSRRKAWQYMFGPGVGATVARESGPDLDVHIVTHEEVAKGRGLPVARGARLGRSRIIWGWLVGVAGPVVLALLLNTVDLGLANDMLLFLALTVAAALLGGLLPALASAAFGSLLLNYYYTPPLHRLTIADPKNIIAIAIFVGVAVSVASVVDLAARRTHQAARLRAESEILSFLAGSVLRGETSLDALLERVRETFGMESVALLERESDVAPWTCAGSVGVRPLVDRPEDADVDMPVGDHMALALSGRVLPASDRRVLAAFAAQAAVVLDRQRLQREADQARTLAEGNSIRTALLAAVSHDLRTPLAGIKAAVSSLRSDDVAWSEEDRAELLEGIEDGADRLDHLVGNLLDMSRLQTGTVTPLIREIDLDEVVPMALGGVPEDSVVLDIPESLPMVAVDPGLLERSVANLVENAVKYSPSDESVLVAASALANRVELRVVDRGPGVPDEAKDRIFAPFQRYGDAPRGVGVGLGLAVARGFAEAMGGTLNAEDTPGGGLTMVLTVGAAVDSPAGRPGLAHATAERQTRC

SEQ ID NO: 9934 - protein, 404 aa, Streptomyces avermitilis
MPKLPSRVHRRRPRTAVIAALATALVGGLLAWPAAHRADAAPATFAHPGVTVSRSQLDFSRTKVNAGAQPWKGAYDQMMASTYASLTRTAKPRATVECGSYSNPNYGCTDEREDAIAAYTDALAWYITRDERYAKKAIELMDAWSAVIKDHTNSNAPLQTGWAGSSWPKAAEIIKYTYTGTWANSGRFATMLRDVYLPEIINGSNSNGNWELSMMEAAVGISVFLEDKTSYDKAMAKFRTRTAAYIYLSSDGAVPKTVPSQNLDTTAKIVSYWQGQSTFVTGLTQETCRDFTHTGYGISAVSHIAETSRIQGADLYGTDVGERLRQALGFQAKYQLGEAAPSWLCGGSLNRGLGPITEVGYNALHNRLGIAMTNTQNLTEQNRPAGSNNLFVAWETLTHGDNPS

SEQ ID NO: 9935 - protein, 254 aa, Streptomyces avermitilis
VFGRRKKGSAAEDAAGEAEQVVDGVDAEADDEGERERPRLEPEPRPDGPWDSSEVRDPAEGRVDLGGLFVPGVEGMELRVEVAGDAIVAATVVLRDSAVQLQAFAAPKREGIWGEVREEIASGITQQGGVIDEVEGPLGWELRAQVPVQLPDGTGGFQVVRFVGVDGPRWFLRGVISGQGAVQPQAAGLLEQIFRDTVVVRGEGPMAPRDPIVLKLPNDAQMVPEGVQQEEQSGSRFSGGMGQLQRGPEITEVR

SEQ ID NO: 9936 - protein, 175 aa, Streptomyces avermitilis
MTRAPLNVLLRRVDPDVPLPAYEHPGDAGADLRTTESCELKPGERAVLPTGVSVALPEGYAAFVHPRSGLAARCGVALVNAPGTVDAGYRGEIKVIVVNLDPRESVRFERFDRIAQLVVQQVERVRFQEVAELPDSARAEGGFGSTGGHAAVGADTNGQQGGNRYASVVSDRKGQ

SEQ ID NO: 9937 - protein, 194 aa, Streptomyces avermitilis
VSGTSAALKPPADATTPVRHPDAPAPGELLGAHYGHCFGCGEEQSHGLHLAARAGQGVSITAEFTVQPAHQGAPGLAHGGVLATALDETLGSLNWLLRTIAVTGRLETDFVRPVPVGTVLYLEAEVTAVAGRKIYSTATGRIGGPEGPVAVRADALFVEVKVDHFTDNGRQEEIRAAMNDPDQLRRARAFEVNP

SEQ ID NO: 9938 - protein, 153 aa, Streptomyces avermitilis
MQLSAPPYEERLTAPRTWWLMCFLVGVSMALILLPFGTLPLLGGLVGGTAVAAVVASSYGSIRIRVVGDSLIAGEAKIPVAALGEAEIMDQEEARAWRTYKANPRAFMLLRSYIPTALRVEVTDPQDPTPYLYLSTREPERLAAALKAARTEA

SEQ ID NO: 9939 - protein, 311 aa, Streptomyces avermitilis
VTGSTPPWKRRFPRRGADEEPHDGSHGARDDERGSSEPGSASLEPSAATVDAAAPSGLPAPVDPDPPPPVARRRAAVVRDGVREGVRKGGSRARAGLAYVVDRIIENAPRIPVRDLATLRRQFPGLGPEELADKLVTGAANATSTVGAGIGAAAMLPVPPAMPTELAAEITGVAAIELKLIAELHEVYGLRPPGTLTQRSTAYLHSWSGERGIDVTKPSTINVALGGQMRRELRQQVMKRTVRDLPNLMPFMVGAAVGAVMNRRDTKRLAGRIRKDLRKMQVPWDALPELPPLEKPADPLRLGEIPKELGP

SEQ ID NO: 9940 - protein, 98 aa, Streptomyces avermitilis
MATDYDTPRKTDDDVDSDSLEELKARRNDKSTSAVDVDEFEAAEGLELPGADLSNEELAVRVLPKQQDEFTCMSCFLVHHRSQLAREKNGQPICRDCD

SEQ ID NO: 9941 - protein, 415 aa, Streptomyces avermitilis
VATTPAPPAAPPKPTWDPRRQEAPFPWLRPTIRIRLTLLYGGMFLIAGILLLSIIYLLAAQALRTGSEPLFKILDGNGIKVASDDCPGVSTNNIPLTAFNDAISACTDHQRQVALDNLLSRSLLALLGLAVIAFAFGYAMAGRVLSPLGRITRTARAVAGSDLSRRIELDGPDDELKELADTFDDMLERLQRAFTAQQRFVGNASHELRTPLAINRTLLEVHLSDPGAPMELQQLGKTLLATNERSEQLVEGLLLLARSDNQIVERKPVDLAEVASQAIDQARSEADAKGVEFRGERASAVVQGNGVLLERIALNLVQNAVRYNVPEDGWVEVTTEVQHGHAVLVVSNTGPVVPAYEIDNLFEPFRRLRTERTGSDKGVGLGLSIARSVARAHGGHIAAQPREGGGLVMRVTLPI

SEQ ID NO: 9942 - protein, 217 aa, Streptomyces avermitilis
VRVLVVEDEQLLADAVATGLRREAMAVDVVYDGAAALERIGVNDYDVVVLDRDLPLVHGDDVCRKIVELGMPTRVLMLTASGDVSDRVEGLEIGADDYLPKPFAFSELTARVRALGRRTSVPLPPVLERAGIKLDPNRREVFRDGKEVQLAPKEFAVLEVLLRSEGAVVSAEQLLEKAWDENTDPFTNVVRVTVMTLRRKLGEPPVIVTVPGSGYRI

SEQ ID NO: 9943 - protein, 272 aa, Streptomyces avermitilis
VTDQSEHLDHLKAELLEIALDAAARAGAFLRDGRPDDLGVAATKSSAVDVVTEMDIASEKLITGLLADRRPDDGVLGEEGADVEGTSGVQWVIDPIDGTVNYLYGLPSWAVSIAARKDGETLVGVVHAPMRGETYSAVLGQGAFVNDLPARVRPAPAFGLALVGTGFGYLAERRARQAEVVRQLVPEVRDIRRGGSAAIDLCDVAAGRLDAYYERGLNPWDYAAGDLIAREAGALTGGRPGEPLSTDLTIAAPPGLFEALQTRLEDLGAWHD

SEQ ID NO: 9944 - protein, 375 aa, Streptomyces avermitilis
MPEALDASPYDALLLLSFGGPEGPDDVVPFLENVTRGRGIPRERLKEVGQHYFLFGGISPINDQNRALLDALRKDFAEHGLNLPVYWGNRNWAPYLTDTLREMAADGRRRILVLATSAYASYSGCRQYRENLAGALATLEAEGLEVPRVDKLRHYFNHPGFVEPMTEGVLRSLAELPEDVRPGAHIAFTTHSIPTAAADTSGPVEEHGDGGAYVKQHLDVARLIADAVREETGIDHPWQLVYQSRSGAPHIPWLEPDICDHLQELHGAGVPAVVMAPIGFVSDHMEVLYDLDTEAKAKAEELGLPVRRSATVGADARFAAAVRELVVERAAVESGQKVTPCALGALGPSHQLCPVGCCPARAPKPAAAGADSPYA

SEQ ID NO: 9945 - protein, 412 aa, Streptomyces avermitilis
VPSPYRALFAAPGSKGFSAAGFLGRMPLSMMGIGVVTMISQLTGRYGLAGALSATIALSAAALGPQISRLVDRHGQRRVLRPATLFALTAAAALLLAAHYDWPDWVLFVCSAGIGCVPSLGAMTRARWANLYRDTPQLHTAYAFESVVDEVCFIFGPIISIGVSTVWFPEAGPLLAAVFLALGVFWLTAQRATEPEPHPHEQHSGGSALRAAGLQVLVATFVATGAIFGAVDVVTVAFAEEQGHKAAASVVLALYAAGSCVAGVVFGLLRFTGAAERRWLLGICAMAVSMIPLLLVGNLPFLAVALFVAGLSIAPTMITTMSLIEQHVPRAKLTEGMTWVSTGLAVGIALGSSVSGWVIDAAGARAGYGVPAVSGAVAVAVGFLGYRRLSRPAPQRGGSHEHHSEREERHVA

SEQ ID NO: 9946 - protein, 439 aa, Streptomyces avermitilis
MSTTVSGKSGTWRNWAGNVTARPVREVTPASVEELSAAVRKAADEGLRVKAVGTGHSFTAAAATDGVLIRPQLLTGIRGIDREAGTVTVEAGTPLKRLNVALAREGLSLTNMGDIMEQTVSGATSTGTHGTGRDSASIAAQIKGLELVTADGSVLTCSEKENPEVFAAARIGIGALGVVTAITFSVEPVFLLTAREEPMSFDKVTADFDELFAENEHFEFYWFPHTGNCNTKRNNRSAGPERPVGQLSGWIEDEFLSNGVFQVANLLGRAVPATIPTLARVSSRALSARTYTDIPYKVFTSPRRVRFVEMEYAVPREALVETLRELKSMVDRSPLRVSFPVEVRTAPADDITLSTASGRDSAYIAVHMFRGTPYQAYFTAAERIFTAHEGRPHWGKVHTRDAEYFSGVYPRFGEFTALRDRLDPERRFGNDYLRRVLGS

SEQ ID NO: 9947 - protein, 263 aa, Streptomyces avermitilis
MREKPEVGARPDSEEEPGRKRLDLSVPQVAGSAVAAVVAAKLASCFGVYGTILGAGLISVVATCGGTVFQHFFSRTGEQLREVTVQPKPRVSAGRRPGEPVRPVAAAASGEFTDGTVYRARVKSWKRPVVAATLVFGVTMAGITTYELVSGDSFSGGVSTTVGGALAGRTKTPPTTDNSPSPSRTPSSVRPAPSDDASSESGEGGTTQDPTPTPSATKSPDAGSDGSLPSATPTPSVSATTPAPDASSRSRSAVPGQAGPAAP

SEQ ID NO: 9948 - protein, 348 aa, Streptomyces avermitilis
MPELRVVAVSNDGTRLVLKAADSTEYTLPIDERLRAAVRGDRPRLGQIEIEVESHLRPRDIQARIRAGASAEEVAQLAGIPVDRVRRFEGPVLAERAFMAERARKTPVRRPGENAGPQLGEAVQERLLLRGADKDTVQWDSWRRDDGTWEVLLVYLVAGEPHSASWTYDPPRRLVQAVDDEARSLIGESDDLAAPEPSFPFVPRIARLPRDRPLDRALDRQTERPALPSQAPEPAEESTAERDSLTSLLEAVPSFRGDMVVPERPAEIPAGQDEPAPEPEAEEPPAASASAGSAYADVLMPRSVGSHRDRLVGATDRQAEADGVRPGRRAAVPSWDEIVFGTRRKKQE

SEQ ID NO: 9949 - protein, 283 aa, Streptomyces avermitilis
MNVIISASELASELAGPNPPTLLDVRWQLSTAKAGGAAPFDGRAAYASGHVPGAVFVDLDADLAGPAGPAGRHPLPDLAHFGEAMRAAGVSARRPVVVYDGGQGWAAARAWWMLRWTGHPAVRVLDGGLAAWSGPVTTETEELVAGDFEPAPGALPLLDADGAAALARTGLLLDARAAERYRGDVEPIDPVGGHIPGAVSAPTTENVAENGRFRPAAELADRFKSLGVNDAAEVGVYCGSGVSAAHEVLALAVAGIPAALYVGSWSEWSAAGSRPVAAGPDPQ

SEQ ID NO: 9950 - protein, 267 aa, Streptomyces avermitilis
MTEARGPAGRNGTTDAGYTPGTPCWVSLMVHGMAATQEFYGALFGWEFQPGPQQLGPYVRALLDGHEVAGIGQLPPDRHLPVAWTPYLASEDVDATAETVRHRGGTVGVGPLDAAEAGRMAIASDPMGAVFGIWQESAHLGPRLTGVPGTPTWNELLTYDSTSVAKFYEAVFGYEEEPVVSADFDYITLKVEGRPVAGIHGVGNAVPRDRGPHWITYFQVADVDETAAQVTDLGGHVLRPPAESAHGRAATVVDPEGAMFSVVTTSG

SEQ ID NO: 9951 - protein, 216 aa, Streptomyces avermitilis
MPELVFFSGTMDCGKSTLALQIGHNRSARGLQGVIFTRDDRAGEGKLSSRLGLVTEAVEAAPGMDLHAYLVDQMSKGGKVDYLIVDEAQFLAPEQIDQLARVVDDLDLDVFAFGITTDFRTKLFPGSQRLIELADRIETLQVEAMCWCGARATHNARTVGGEMVVEGEQVVVGDVNRPAAEVGYEVLCRRHHRRRMTSASAYAAAISPDVLPVTSA

SEQ ID NO: 9952 - protein, 395 aa, Streptomyces avermitilis
MALPTWDDPEPLAVDSAPLPEYGAGSLADLLPTLAAGMEVPGQRAAIQELTAADRNCVFLIDGLGWEQLRAHPEEAPFMASLLESSRGGTGRPITAGYPATTATSLASVGTGLPPGAHGLPGYSARNPETGELMNQLRWQPWTDPRAWQPYPTVFQLADAAGVHTAQVSSPTFQNTPLTKVALSGGTFHGRLSGEDRMDLAAEQLAAGDRSLVYTYYAEVDGKGHRFGVDSDPWRGQLMYVDRLVQRLAEQLPPRSALYVTADHGMIDIPFDEQHRIDFDEDWELRAGVALLGGEGRARHVYAVPGAQVDVLTCWREVLGEQFWIASRDEAIAAGWFGPDVDERVYARIGDVVAAARDDVLIIASEREPKESAMVGNHGSMTPVEQLVPLLEVRT

SEQ ID NO: 9953 - protein, 195 aa, Streptomyces avermitilis
MAKTSTTTQGLRAAIERSGYYPALVAEAVEAAIGGEAIRSYLVHQETTFDANEVRRHVTVLVLTGNRFIVSHTDEQAADTTSPTPYATTSTESVKLGRISSVVVSRVVANPESYKPGTLPREVVLTIGWGAVSRIDLEPAACGDPNCEADHGYTGNSTADDLSLRVSEAGDGPETVRQALVFAQSLSEATADVAR

SEQ ID NO: 9954 - protein, 949 aa, Streptomyces avermitilis
MQTASDRHEYPAHWEADVVLRDGGTARIRPITVDDAERLVSFYEQVSDESKYYRFFAPYPRLSAKDVHRFTHHDFVDRVGLAATIGGEFIATVRYDRINAAGLSASAPADEAEVAFLVQDAHQGRGVASALLEHIAAVARERDIRRFAAEVLPANSKMIKVFTDAGYTQKRSFEDGVVRLEFDLEPTDRSLAVQRAREQRAEARSVQRLLAPGAVAVIGAGRTPGGVGRSILGNLRDAGFTGRLYAVNRAFPEDLKNFDEVPAHRSVLDIAEPVDLAVVAVPAAHVPEAVAECGEHGVQGLVVVSSGYAESGPEGRERQRELVRQIRTYGMRLIGPNAFGVINTSPEVRLNASLAPETPRPGRIGLYAQSGAIGIALLSRLHRRGGGVTGDTGVSTFVSSGNRADVSGNDVLQYWYDDPDTDVALMYLESIGNPRKFTRLARRTAAAKPLVVVQGARHGGAAPQGHAVRATRLPHATVSALLRQAGVIRVDTITELVDAGLLLARQPLPSGPRVAILGNSESLGLLTYDACLAEGLRPLPPLDLTTAASAEDFHAALARALADDGCDAVVVTAIPAVGETSAADQALAEALRSAAAAAPAKPVLVVHVELGGLAEALSAAASTAPQPTDVAGHPPSLPASAERGDPHRPAERLSAAAQAPDGARLIPAFPAAERAVRALAEAVKYAQWRRDAADPGKVPEYDDIDQKGAAELIDRLLASGQGLTLGTDETCALLSRYGIGVRRALPAPTPDDAAEAARAIGYPVALKATAPHLRHRADLGGVRLDLADEEQLRRAYAELTEMFGKPEELRPVVQGMAPRGVDTVVRAVIDPAAGAVLSFGLAGAASQLLGDIAHRLIPVTDREATSLVRSIRTAPLLFGWRGSAPVDTPALEELMLRVSRLVDDHPEVVAVTLEPVVVAQHGLSVLGATVRLAPPPVRDDLGPRTLPVY

SEQ ID NO: 9955 - protein, 93 aa, Streptomyces avermitilis
MAERRVNIGWAEGLHARPASIFVRAATASGVPVTIAKADGNPVNAGSMLAVLGLGAQGGEEVVLASDAEGADAALDRLAKLVSEGLDELPETV

SEQ ID NO: 9956 - protein, 231 aa, Streptomyces avermitilis
MRIPAHSVCTAIRDDIVAGVYERGSRLTEELLARRYGVSRVPVREALRTLEAEGFVVTRRHAGACVAEPTEQEASDLLEMRMLLEPLGAARAAQRRTEAHLKVLRGLVRLGQERSRRGSSEDLRSLGGWFHETLAQASGSPALTSTLAQLRHKIAWMYAVEAPANPAESWAEHGGIVDAVARGDSERARAITALHTERASAVHRLRFPGGGDRPERVRTSQHPVNMTSLRH

SEQ ID NO: 9957 - protein, 258 aa, Streptomyces avermitilis
MAFTRATGKHRRPGRTKRTTTHAVGVAALTTTGVIGTLAAPALAAEPSAEPSVEQTGLTQAVSIGDSVAAQVDAQAVAQEQAAAEAAAKKKAEEAARKKAAELAEKEHAAKARAAREAERKRLNTFVAPIAGSYVSTGYKSGGSLWSSGSHTGVDFHAASGTSVHAVGSGTVVEAGWGGAYGNNIVIKMNDGTYTQYGHLSSIGVSVGQTVTPGQQIGISGATGNTTGPHLHFEARTTAEYGSDIDPVAYLRSHGVNV

SEQ ID NO: 9958 - protein, 462 aa, Streptomyces avermitilis
VNELATMDFHPQPQAGEARPWAFPAPERGTLDNGLTVLRCQRPGQQVVAVEVLLDAPLDAEPASLDGVATIMARAFSEGTDKHTAEEFAAELERCGATLDAHADHPGVRLSLEVPVSRLPKALGLLADALRAPAFEDSEIERLVRNRLDEIPHETANPARRAAKELSKELFPATSRMSRPRQGTEETVQKIDSAAVRAFYERYVRPATATVVVVGDLAGVDLDGLLAETLGAWTGSSAEPRPVPPVTADDSGRVIIVDRPGAVQTQLLIGRVGADRHDRVWPAQVLGTYCLGGTLTSRLDRVLREEKGYTYGVRAFGQVLRSAPDGTGVAMLAISGSVDTPNTGPALDDLWKVLRTLAAEGLTDAERDIAVQNLVGVAPLKFETAGAVAGTLADQVEQHLPDDYQATLYQQLAATGTVEATAAAVNAFPMDRLVTVLVGDAAQIAEPVKALGIGEVSVVAAE

SEQ ID NO: 9959 - protein, 454 aa, Streptomyces avermitilis
MPMGHTATAEAGSGGLTATEHRLANGLRVVLSEDHQTPVAAVCLWYDVGSRHEVKGRTGLAHLFEHLMFQGSGQVKGNGHFELVQGAGGSLNGTTSFERTNYFETMPAHQLELALWLEADRMGSLLTALDDESMENQRDVVKNERRQRYDNVPYGTAFEKLTALAYPEGHPYHHTPIGSMADLDAATLQDAREFFRTYYAPNNAVLSVVGDIDPKQTLAWVEKYFGSIPAHDGKPQPRDGSLPDTIGEQLREVVEEEVPARALMAAYRLPEDGTRVCDAADLALTVLGGGESSRLYNRLVRRDRTAVAAGFGLLRLAGAPSLGWLDVKTSGDVEVPVIEAAVDEELARFAEEGPTAEEMERAQAQLEREWLDRLSTVAGRADELCRYAVLFGDPQLALTAVQRVLDVSAEEVQEVAKARLRPDNRAVLVYEPVAAEAEDVEAAETTDENEESAK

SEQ ID NO: 9960 - protein, 818 aa, Streptomyces avermitilis
MARRSTKTPPPDDFEERILDIDVVDEMQGSFLEYAYSVIYSRALPDARDGLKPVHRRIVYQMNEMGLRPDRGYVKCARVVGEVMGKLHPHGDASIYDALVRLAQPFSMRLPLVDGHGNFGSLGNDDPPAAMRYTECRMADATSLMTESIDEDTVDFSPNYDGQEQEPVALPAAFPNLLVNGSSGIAVGMATNMPPHNLGEVISAARHLIRYPGADLETLMKHVPGPDLPTGGRIVGLTGIRDAYESGRGTFKIRATVSVEDVTARRKGLVVTELPFTVGPEKVIAKIKDLVGSKKLQGIADVKDLTDRAHGLRLVIEIKNGFVPEAVLEQLYKLTPMEESFGINNVALVDGQPLTLGLKELLEVYLDHRFEVVRRRSEFRRGKKRDRLHLVEGLLVALLDIDEVIRLIRSSDNSAQAKERLIERFSLSEVQTQYILDTPLRRLTRFDRIELESERDRLNGEIDELTGILESDAELRKLVSGELAAVAKKFGTDRRTVLLESAGSTAATVPLQVADDPCRVLLSSTGLLARTANGAPFGEDADGRRTKHDVIVSAVPATARGEVGAVTSSGRLLRLNVIDLPRLPETTSAPNLSGGAPISEFLSSLEGDETVVCLTTLDESSPGLALGTEQGVVKRVVPDYPSNKGELEVITLKDGDRIVGAIELSTGEEDLVFITDDAQLLRYQASQVRPQGRAAGGMAGIKLTDGAKVISFTAVDPAADAVVFTVAGSRGTLDDSVQTTAKLTPFDQYPRKGRATGGVRCQRFLKGEDCLSIAWAGPVPARAAQKNGTPAELPEMDPRRDGSGVSLAKTVAVVAGPV

SEQ ID NO: 9961 - protein, 361 aa, Streptomyces avermitilis
LSQSSSPQQIPVVVLAGFLGSGKTTLLNHLLHRSGGSRIGAIVNDFGAIEIDAMAVAGALGDSTVSLGNGCLCCAVDAGELDLYLERLAHPSARVDVIVIEASGLAEPQELVRMVLASENARVVYGGLVEVVDAAEFDATRAKHPEVDRHLAMADLVVVNKIDRADDGERVLRAVRSLTDRAAVVPATYGRVDPELLFDCRPTGERIGQLSFDDLHEHRGEEDHHGHLHAAYDSVSFTSEAPMNPRRMMDFLDSRPEGLYRIKGYVDFGTADPRNRYAVHAVGRFLRFYPEPWAPAGPRLTQLVLIGSGIDTAALHKELDACTNDAPHADEHSMWGVLRYVQEQEQEQEQRQETAEAEQAG

SEQ ID NO: 9962 - protein, 173 aa, Streptomyces avermitilis
MATQNSGMRRLGSATRARLAVAVSAVVERSTRQRRRAVLTEQHRLHFDLLCKAMDDPALAAVLDTYEREIPPETQRQYLFANALYVNALYFHRIGALNLVELHGHLRVICRNRIFREYWTATQHHRESLPDSSEEAALGRMTEGLVQELNNLADDTDDGDLEEWWVVGQPPGE

SEQ ID NO: 9963 - protein, 109 aa, Streptomyces avermitilis
MSFTGRERKVISPRSVRRALSARPSTDLGTDLKIVRRVGASPRERGSASGQTCPDIFELSDGNFAVIGTEATADLDGELPPDAARAEYERIVVISRETLVRAKADIPDA

SEQ ID NO: 9964 - protein, 388 aa, Streptomyces avermitilis
MPINRAASTSVDVPRGLAGVVVTDTSLGDVRGLEGFYHYRQYSAVELAQTRGFEDVWHLMVHGELPDAEQRAVFTARTAALRWLPDGVRATLPAVAAAAGRSGPLAGLRTALSLLGAAKGFRPVYDIDREQRRADTVMASAAVPTLLTALYRLGQGLDPVEPREDLSYAANYLYMLTGSEPDAARTRAIEQYLISTIDHGFNASTFTARVITSTGADVAAALVGAVGALSGPLHGGAPSRALDTLDAIGTPERIDSWIRERVLAGDRIMGFGHPVYRTEDPRSRMLRGVAEQFGGPLVDFAVEVERHVEAILAELKPGRELHTNVEFYAGVVMELCGLPREMFTPTFAAARVVGWSANILEQAEDPKIIRPAARYVGPVPPVAVPLMV

SEQ ID NO: 9965 - protein, 418 aa, Streptomyces avermitilis
MTDHEAAPTHPDRRLSTKEAAELLGVKPETVYAYVSRGQLSSRREPGGRGSTFDAKEVAALARRNRREPSGSSAIGGELSVRTRITLIDKDRYFFRGVDATELAARHSYEEIAEWLWTGRLRPGVTFAAPDASVAVARRAVDALPEHSGPTDRLRVATIAAATADPLRFDLSEDAVLGTARTLIPTLVAALPPLRRDHRDEGPLARHLWGRLTGRAPDAASVRVLDTALGLLIDHDLAASTLAVRVAASARAHPYAAVSAGLGVLEGPLHGAASGLAHRLLLDVLDQGSAAPVVADELRAGRRIPGLGHRLYPGEDPRARALFALLEEVPDAAPALAAAHDVVATTARHAPLHANVDLALAVLTVSSGMPASAGETVFAVARTAGWIAHALEEYEERPLRMRPSGRYVGARPPQPLPR

SEQ ID NO: 9966 - protein, 315 aa, Streptomyces avermitilis
VSTCATVSRDLDEPLAGTAATARTWLLLEQPGPWGTKALTSSHLDQALGRALEAAAEGTGVRIALIRRPGRHADCGTPAVRQVYAAHTVPGNVWLHGAMTSDPEQLLDLDFTALGMGDPHTFDRLLGGRPHTGDPLALVCTNGKRDRCCALLGRPLAAELAASGVTGAWEVTHLGGHRFAPTLLILPFGYAYGRAEAPHIKEVLQGVREGRVVVEGCRGRSAWERPGQAAELAVRTAAHEYAADALTVVATDGTAPRWEVTVAHADGRLWRVIVAQGASLPPRPESCGSALGSPARMDVVAVRELIPTEIDATSR

SEQ ID NO: 9967 - protein, 575 aa, Streptomyces avermitilis
MSPTPPVRRLRLGLPRRVFSQVLLMQVSIAAGVAVLATGLFLAPLSAQLDDQAMRRALAIAQTTAAQPQIAEDFQATRPSVGGPVQTEAERIRKASGAEYVVVMNMDGVRWSHTDPTQIGKVVSTDPREALAGKDVMQIDNGTLGRSARGKVPLRNADDKIVGAVSVGIEYDSVRARLILAIPGLFAYAGAALAIGAVAAYLISRRVQRQTRDLAFSDISALLAEREAMLHSIREGVVALDRGGRVRLLNDEAQRLLGLDAEAIGQSLDDTLGPGRTTDVLAGRVTGTDLLTVRGQRVLVANRMPTDDGGAVATLRDRTELEQLGRELDSTRGLIDALRAQDHEHANRMHTLLGLLELDMYDDAVEFVGEVVGDHRTTAEQVTEKIHDPLLAALLVGKATVAAERGVALWISDRTLLPDRLIDPRGLVTVVGNLVDNALDAVAGTPHARVEVELRAEGRTTVLRVRDTGPGIPVERRELIFTDGWTTKKPPAHGKRGIGLSLVRRLAERQGGSARVDEADGGGAEFTVVLPEALTEPAPAPETAPTEDSLPGNTPTEELIPAPDTSAPTTKEESR

SEQ ID NO: 9968 - protein, 229 aa, Streptomyces avermitilis
MTRPIEVLVVDDDTRVARVNAAYVQKVAGFHVAGEAHNAAEALRQMETLPHLDLVLMDHYLPDETGLAVVQEMRRRGHQTDVIMVTAARDISTVQAAMRHGALQYLVKPFAFAGLRAKLEAYAELRRTLDGGGEAEQAEVDRIFGALSAGSEPGLPKGHSPTTAELVRRALVAAEGPLSAQEIAERTGLSRQTAQRYLKLLERTGRATLTLKYGDAGRPEHRYVWATRV

SEQ ID NO: 9969 - protein, 353 aa, Streptomyces avermitilis
MRMTARYTALAAAGLLALSSLTACANDAASTASSGSGSKGDGKGVKVKIMVGGLDKVIYLPAMLTQRLGYFDAEGLDVELLSEPAGVQAETALVSGQVQGAVGFYDHTLDLQTKGKDVESVVQFSHAPGEVEIVSNRHADDITSPKDFKGKKLGITGLGSSTDFLTKYLAVKNGVSVSEFSPVAVGAGPTFISALQKGSIDGGMTTDPTVANILAKNLGKVLIDMRTPRGSKEALGGPYPSSSLYMQTEWVNSHKDTVQKLANAFVKTLKWMSTHTASQIAEKMPADYSQGNKTLYAGAIKTTLPMFTDDGVMPKDGPETVERVLKAFNPNIKNAKIDLSKTYTTEFVEKVTG

SEQ ID NO: 9970 - protein, 297 aa, Streptomyces avermitilis
VRGVPPMSPDLMPGAVVAVTATETTKTGRAHSRARAARRRKVVITLARALLLVAVLGLWEACARAKVIDPFNFSMPSKIWDQIYTWVTHGTALGSLGEQIWFTLHEALLGWVIGVVAGVVFGIALGRINLLADVLGPYIKVLNSIPRIVLAPIFVIWFGLGPASKVASAVVLVFFPVFFNAFQGAREVDRNLVANARILGASDRRVTLQVVIPSATSWIFTSLHVSFGFALIGAIVGEYIGATKGIGLLVAQSQGTFNAAGVYAAMVILAVVALVAEGLLTFAERRIFRWKPSDSER

SEQ ID NO: 9971 - protein, 283 aa, Streptomyces avermitilis
MLWPAPHLRSRPMSADTSPAIELRGASKIFKTPSGGLHTAVRELDLTVGRGEFVAVVGPTGCGKSTTLTLVSGLEEPTEGEVLVTGEPVAGVGDKVGFVFQQDATFPWRTVLSNVMAGPRFRGVPKAEAKQKAREWLARVGLTAFEDRYPHQLSGGQRKRVALAATFVNDPQILLMDEPFSALDVQTRALMSDELLELWEGTGASVVFVTHDLEESIALADKVVVMTAGPATVKQVFDIDLPRPRKVESVRLEPRFIEIYREIWSSLGEEVRITRERGAAHVA

SEQ ID NO: 9972 - protein, 230 aa, Streptomyces avermitilis
MIDVLVVDDDFRVAEINAKYVGKVPGFRVAARAHSAAQALAAVERAPIDLVLLDHYLPDQTGLELVHRMRERGHGTDVIMITAASDVTTVQAAMRLGALHYLVKPFTFAALRTRLDSYAALRRTVDRVGGRGVAGQEQVDRIFGALRTTPAPSSPGLPSGHSEPTTDLICDVLHQADHPLSAHEVAAETGLSRSTAQRYLRHLEQVGRLRLSLKYGDTGRPEHRYAWVAP

SEQ ID NO: 9973 - protein, 530 aa, Streptomyces avermitilis
VTGHHQTLALLLFSGFVAVTLAITTWVSRHRHGSAEEFYAGGRLFSPMENGFAIAGDYMSAASFLGVTGLIALYGYDGLLYVVGFLVAWLVVLFLVAELVRNCGRFTLADVVAARMSERPVRIAAGTSSVTVSVLYLVAQMVGAGSLVALLLGGSSGAARAWTVIGVGALMVIYVSMGGMRATTWIQIVKAVLLLSGTIALTVLVLVRFQGDFDQLLRTAMERSGHGEAFLAPGLKYGGDWTARLDFISLGLALVLGTAGLPHILSRFYTVPTARAARRSVVWSVGLIGGFYLMTIVLGFGAAAIVGPEAVRRSNAAGNTAVPLLALDLGGGTNSTGGTVLFAIVAAVAFATILAVVAGITLASSASVAHDLYASLRRRHAKPRSEVAVARTAAVGVGVVAIALGLLARDLNVAFLVGLAFAVAASANLPVLMYSLFWRSFTTRGAVWSVYGGLVPALGLVLLSPVVTGSPESLFPGVDFQYFPLQNPGIVSIPLGFLAGWLGTVTSVEPADEAKHAEAEVRSLTGAGAV

SEQ ID NO: 9974 - protein, 176 aa, Streptomyces avermitilis
LGTWPKRAADKESSVEKQDGRDAGEVGFDDPWYDALASGWGELDSTGAPAPVVPPARREHEGRVGGAADVYLEVQRSAAFQEVRSRYRRFVVPGVIVFFTWYVGYVVTATTAPGLMARPVAGSVNVGLLAGLGQFLTTFLFTWAYARHARLRRDRAALDLRWDTQELTRSAGGGQL

SEQ ID NO: 9975 - protein, 227 aa, Streptomyces avermitilis
MTEEESRKPARVVVADDQTVVREGIVMLLGLLPGIEVVGAAGDGHEAVKLVAELNPDVVLMDLRMPRCDGVEATRRIRAEHPGTQVVVLTTYADDESLFPALRAGARGYLTKDAGGDEIVRAVESVLSGDAGLSPSIQRRLLERLSEPERGQAASSEVPDGLTAREAEVLVLIAEGLSNHEIARRLHVSTATVKTHINNLFAKTGLKDRAQAVRYAYGKGLVRPPAE

SEQ ID NO: 9976 - protein, 384 aa, Streptomyces avermitilis
VTTESAWTRWPSREALGREGLSRPRRMLAWTVRALVLAMLLWGAFSSSHVHGWGAVAAAAGVLLAAGASWAFFRTTLQHRLWPSLALIAVLLGIAIVAQTAGFQVPALVIWCGCAVSALERLPLAAALPVTTAALAAYAAVDNDVWLTTAATIAGLFLAGYVLRLDAEARGSAQRLLAQERAARAAETQSAALAERARIAREIHDVLAHSLSAQLVHLEAARLLIERGADREQILGRVVAARGMAREGLAETRQALSALRGEISPLEDFLSELVAFEDGADVTVSGERRLLTAEASQAVRRVAQEALTNVRKHAPGAKVQVKLEYGERQVTLHVRDSGGKPGDLTGSGAGYGLLGMRERAELLGGSLEAGREEKGFVVTLKVPA

SEQ ID NO: 9977 - protein, 182 aa, Streptomyces avermitilis
VMSGLTHALLILAVVVLVVARQFRMQKINADRRWWIVPAVLAFLAVREPGLLDAHHRTGSGILLGAELLIGVATGVGWAWTTRIWTDADGTVWSKSTKASVGVWIVGIVLRVGLFGLGVLLGVRQESPALLLALAATLLLRSGVLIWRVHSLGPADGGSRAYGDGVAQPSWSVPQPSRKERV

SEQ ID NO: 9978 - protein, 63 aa, Streptomyces avermitilis
MVSRRSRWVAPPSLTAPAQVSRAICAGRRRCPSGFSTRGWRTVSLRDPPTIHPGSDLLTCRFP

SEQ ID NO: 9979 - protein, 707 aa, Streptomyces avermitilis
VTADTSVPSTALLTGADRDGSNYTARHLLVLEGLEAVRKRPGMYIGSTDSRGLMHCLWEIIDNSVDEALGGYCDHIDVILHDDGSVEVRDNGRGIPVDVEPKTGLSGVEVVMTKLHAGGKFGGGSYAASGGLHGVGASVVNALSARLDVEVDRSGHTHAISFRRGVPGAFATVGPDAKFDATAGLRKAKKIPRTRTGTRVRYWADRQIFLKDAKLSLENLHQRARQTAFLVPGLTIVVRDEYGLGEGGSKGEESFRFDGGISEFCEYLATDKPVCDVLRFSGQGTFKETVPVLDDHGQMTPTEVTRELGVDVAMRWGTGYDTTLKSFVNIIATPKGGTHVAGFEQAVTKTVNEVLRAKKLLRVAEDDVVKDDALEGLTVVVTVRLAEPQFEGQTKEVLGTSAARRIVTNVVSKELKAFLTSTKRDAAAQARVVLEKAVAAARTRIAARQHKDAQRRKTALESSSLPAKLADCRSDDVERSELFIVEGDSALGTAKLARNSEFQALLPIRGKILNVQKASVTDMLKNAECGAIIQVIGAGSGRTFDIDAARYGKIILLVDADVDGAHIRILLLTLFQRYMRPMVEAGRVFAAVPPLHRIELSQPKKGQDKYVYTYSDRELRETLLELQRKNVRYKDSIQRYKGLGEMDADQLAETTMDPRHRTLRRINISDLEASEQVFDLLMGNDVAPRKEFISSSAATLDRSRIDA

SEQ ID NO: 9980 - protein, 272 aa, Streptomyces avermitilis
MRRPFARALALGAAAAVIPLASPAPATADSIVIGGYPVETAQSPWTVALSSRDRFGGTRAGQFCGGVVIARSTVLTAAHCLSAAVLGAPPSRIRDLRIIADRTDLLSTQGKEIPVRATWVNPDYDSSTNAGDFAVLTLASPLPESSVIPMASSADPAYAPGTAAVVYGWGDATGSGDYAHSLRAARVQVLPDEACEEAYPGDGDGKYLAGSMLCAGELAGGRDACQGDSGGPLVAQGRLIGLVSWGSGCGRPGSPGVYTRVSDVARAFGRSR

SEQ ID NO: 9981 - protein, 512 aa, Streptomyces avermitilis
VSASTSRTLPPEIAESVSVMALIERGKAEGQIAGDDVRRAFEADQIPATQWKNVLRSLNQILEEEGVTLMVSAAEPKRTRKSVAAKSPAKRTATKTVAAKTVTAKKATATAAPAVPVGDDPAEDASAKKAAAKKTTAKKAVAKKTVAKKTAAKKTTGKKDDVELLDDEAVEETAAPGKAGEEPEGTENAGFVLSDEDEDDAPAQQVAAAGATADPVKDYLKQIGKVPLLNAEQEVELAKRIEAGLFAEDKLANADKLAPKLKRELEIIAEDGRRAKNHLLEANLRLVVSLAKRYTGRGMLFLDLIQEGNLGLIRAVEKFDYTKGYKFSTYATWWIRQAITRAMADQARTIRIPVHMVEVINKLARVQRQMLQDLGREPTPEELAKELDMTPEKVIEVQKYGREPISLHTPLGEDGDSEFGDLIEDSEAVVPADAVSFTLLQEQLHSVLDTLSEREAGVVSMRFGLTDGQPKTLDEIGKVYGVTRERIRQIESKTMSKLRHPSRSQVLRDYLD

SEQ ID NO: 9982 - protein, 287 aa, Streptomyces avermitilis
MTAARSADSGLTGPGELDRYPYAEASAADRVGIPAWESADPELGRVGRRAAGSRGRGLHGQLVQQLGQMIVSGDLGADRPLVPEEIGQRFEVSRTVVRESLRVLEAKGLVSARPNVGTRVRPVSDWNLLDPDIIEWRAFGPQRDDQRRELSELRWTMEPLAARLAAGHGREEVQQRLADMVEIMGHAMAQGDALTFSRADAEFHSLLIQVAGNRMLEHLSGIVSAALQVSGGPVTGCDRPNEAALAHHARIVDALGAGDGAAAEAAMRQLLTVHPEVERVVPAPREH

SEQ ID NO: 9983 - protein, 581 aa, Streptomyces avermitilis
VIQAIGLTSNPRKDLPPVVDDVSFEAHAGRVTALLGTPGAGKTTALRLMLELQQGRGITYFRGRPLHRIAHPSREVGVLLGDVPGHPARTVRGQLRMLCAAAGVPVRRADEVLEVVGLVSLRDERLSTLSRGMDRRLGLACALLADPHTLVLDAPADGLSAREGRWLHGLLRAHATQGGTVLFTTDDPREAAQTADQVVTLEAGRLVADQEAADFARTRLRPRVAVRSPHAARLGALLAKEARTGQRSVEIVREDGNRLSVYGSTCADVGETAFRHGILVHQLADETGDMGAAPDTQPTAPPPRPAGSLESEDLSPLPPPISVRQAPSPLRPLRYELRRAAGVGTGYVTAAAVLIASALIAVILARIGHTPQHRLLAAWPQDFPLPPAALGAGLLGAVAFGDEFRHPALATDRGTVPRRLGLLTAKLLVSGATALLLAFLAVGCDLEVLYLVYGRELTQVPTDWLSLGAGWLGLLVGCAWAGVLAAGIFRSTTAGLAAVLAVPVVVVPLVQRALEGPSVRTAAGFATRLRELMLVQWPFGGERYLAAAARVVAQPVGSALMLSLTALLCAYLLTTLRSRVR

SEQ ID NO: 9984 - protein, 250 aa, Streptomyces avermitilis
MPYDPSAFPPFAVTVDLVVLTVRRHALCALAVRRGEQPFQGRWALPGGFVRPDEDLGQAAARELAEETGLRAHDPSAQDNGAHLEQLATYGDPKRDPRMRVVSVAHLALAPDLPAPRAGGDANSARWAPVEELLQQGGYGRDGEKAAPLAFDHAQILADGVERARSKIEYSSLATAFCPTEFTVGELRRVYEAVWGVALDPRNFHRKVTGTPGFLVPTGGTTTRQGGRPAQLFRAGGATLLNPPMLRPEV

SEQ ID NO: 9985 - protein, 799 aa, Streptomyces avermitilis
VTRGRPTPFTWVAVPVAGSRRRIAHDLSEPPTRRRSRPRRARRRRSRLMSLPTPSAAHDGDRPPRRASTKPLMPGGDPSAPPTGGGGKTAPRMAQERTPTSFAGAGRRSVIPEATSRPSGTPARGNRPSGPGPLAGRPFAPRPPLPPLRHAADLPPAHTALICAALPGLAISTEQGQLTGQGLDGFYRSGRRLLSRCQVRVAGREPLAVQARMVAADRVRFVGALRASPDAGPDPDVLVERTRHADGTERITLHSAASRPLRLSVEVALGTDLADLGTVASGSPGPELPASVHDSGLRWTGPTGTSAVTADPPPADALASAGLLRWGLELPPGGTWSVELRVRPDGAGAGRAVVRGATSPLAQATATGDDPRAQSLLHACVEDLQALLLRDPSHPSDPHLAAGAPWRCGLAPAEALVAARMALPLGTRLAAGTLRTLARSQLSGPGPHSGMIPGPRRDAGAHLPPGCTGTEATLLFPVLLAEARRWGLPEQETQELLPAAERCLQWLRTAVGDGTYLPDPQPGGPLRCETQAYAHRAALLGADLLDAHGRPGGPGLRQWAGELRTAFRDDFWIEDLKGGRPAAARAPDGRLVPHLGAGAAHLLDTGLLGSGVMAQGLLDRVRTEQLARLLGGPAMDCGWGLRSLGAREAAYNPFGHRGGAVRVQETAVAVTGLAAAGYEKEASSLLRGVLAAAEAFGHRLPEMYAGEQRTEAGSPLPHPAACRPAATAAASGVLLLTALAGIRPDAPAGTVTLRPLRSAPLGEIGLTGLRVAGAPFSVRVSRLGLAMVEEAADGLQLRA

SEQ ID NO: 9986 - protein, 575 aa, Streptomyces avermitilis
MARTAAHPSGDVERSSAGAGDDLAGPAGPVDAEMGGTPYDDESTAYISHTEHTDPSGERQVTLRTPAELADALPYLLGYRPEDSIVLVALHDQDGRGRFGGRARLGIPAHSDDWASVAGQLAHGLVTGSERRGVRPESMVAYLCQEPASGETGCDVVARLQPLAQLLRTACGSLDVPVVEALCISDGRFWSYCCPSPDCCPPEGRPMGLPGTSVLAAAATYAGLQVRGSLREFRARLAPWETAAALAQEIALDAASTALVPRILDGETREDVAEETLGLARQVMGRFTATSPVSGTLPADLRDDELLGHEEAATLILGLQDRTTRDRAAEWMEDDEAAPALRLWRALARRCVGSYGEHAAAPLTLAGWVAWSSGDELEAREALAMALGADPGYLFARLLHQACNEGLDPESVRRCLRAEREGRAVTDGSVPPAPLAATAPSLRSAQPPRSLEPQDPGASQGARWSGPSTPGDSADPAAPAGQGDGTGESPGVLGRRRRRVRSVSGGSRPSRRSPRTVARRGRRPAEGTGPAADGTRSAMDGLRRSAEGPRSAAEGATTRSHAPGGTARSDAQGDV

SEQ ID NO: 9987 - protein, 734 aa, Streptomyces avermitilis
MSDEDQRPAPSADPRPAPDGDLRTAADAVLARLVGAPTGEARLREDQWRAIEALVAHKRRALVVQRTGWGKSAVYFVATALLREQGAGPTVIVSPLLALMRNQVDSAARAGIRARTINSSNTEEWDTIQAEVAASEVDVLLVSPERLNNPDFRDQVLPKLAAATGLLVVDEAHCISDWGHDFRPDYRRLRTMLADLPSGVPVLATTATANARVTADVAEQLGTGGGTDALVLRGPLDRESLSLGVLRLPDAAHRMGWLAEHLNDLPGSGIIYTLTVAAAEEVTAFLRQCGHTVASYTGKTENADRLQAEEDLLGNRVKALVATSALGMGFDKPDLGFVVHLGSPSSPIAYYQQVGRAGRGVEHAEVLLLPGKEDQAIWEYFASVAFPPEEQVRRTLDVLARADRPLSLPALEPLVELRRSRLETMLKVLDVDGAVRRVQGGWVSTGVPWTYDTERYAWVAKQRSAEQQAMRDYVTTTACRMEFLRRQLDDEGAAPCGRCDNCAGGRFHDSVSSGSLDAARGELGRAGVEVEPRKMWPTGLPAVGVDLKGRIPAGELAAPGRALGRLSDIGWGNRLRPMLTPQAPDGPVPDDVAKAVVGVLADWAKGPGGWASAGPDAQPRPVGVVTMASRTRPQLIQSLGARIAEIGRLPLLGSIEYTGEFAQVHRSNSAQRLKALDGALTVPPALATALKEAGGPVLLVDDATETGWTLAVAARMLRRAGASGVLPLVLAVQA

SEQ ID NO: 9988 - protein, 211 aa, Streptomyces avermitilis
VTFGFAPSSAASMSTSADLSAASANPLTRMLEPAEWAAAGIPLLRNPREVVSGLHSRHRPGPATAIVAVLDPEERLQASASFTRRAAPADGWMFRNALLAQLRRVIPHDLRRRTPVRTAVLLYCREGDARWTEEDGAWMWGLRDACTLHGLRCGAYITLTRDGWQVLGEGRGGRRPNTDSPPEAFELTSAPPPLPRTGGSASEVLRRAAAR

SEQ ID NO: 9989 - protein, 208 aa, Streptomyces avermitilis
MPLIPEEPQIHESAQGPRATPASGRTAPTPRPVPGPRPAAPSRPGRPGPVRPMPAQRTPRDPAVATPGPAAPAAAVTPATPQIQLIPASVEGALDAAEEAVDLLLESGRAPGEVLVVTTGEPHPWAAHELSFGEAAYWAQHDAGDDVFYADASAVGRAASRPVVVVAVNGGPAGVAATALPLALGRAGALLIVCGDPQQINSVLGAGV

SEQ ID NO: 9990 - protein, 233 aa, Streptomyces avermitilis
MPYEPPTHTVERSLRATTGAKVIAGVDEVGRGAWAGPVTVCAAITGLRRPPEGLTDSKLLTVKRRTVLAEELRKWVTSYALGHASPEEIDALGMTAALRLAAVRALEALPVRPDAVILDGKHDYLGSPWKVRTVIKGDQSCVAVAAASVIAKVQRDKMMAELGIEHADFGFAANAGYPSPVHKAALAERGPTPYHRLSWAYLDALPQWRHLKKVRSWADGSVPEIEGQLGFDF

SEQ ID NO: 9991 - protein, 207 aa, Streptomyces avermitilis
MVTSRWTAAPAQTASLRRRGAVLERAILDAALEQLSTVGWNGLTMEGVAAGAQTGKAAVYRRWPSKEDLVVDALQAGLPRFDEVPDLGCVREDLLQLCRQAREAMFSRPGLALRSVIHECDSSQADRFGGVILEGVVEPTVKLLRAIINRGIERGEVRSDAANGYVFDAIPAMMMYRTKMCASEWSERDIEELVDQLMVPLLRPQGA
